United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 161

SEQ ID NO: 6799942 - DNA, 78 bp, Homo sapiens
tattgtatacaagcttaattgttaatattccctaaacacaattttatgaagggagaagacattggtttgttgacaata

SEQ ID NO: 6799943 - DNA, 66 bp, Homo sapiens
gtctaccacagtatgaaatctgaaatccttacatggaataacagattttcaagctgtgggtatgac

SEQ ID NO: 6799944 - DNA, 64 bp, Homo sapiens
acatggcaggggctggtagatttcagatgaattcctcccatgtatgtgccatccccagtcaagt

SEQ ID NO: 6799945 - DNA, 76 bp, Homo sapiens
gtcagaattgcagggagggcaggacaccctggcaaaagtagaaaaatgccagcttgctgtccgctacatttctgat

SEQ ID NO: 6799946 - DNA, 61 bp, Homo sapiens
ttcgcttggtgtttacatggcttaaactgtctaatttatagactctgaaagcaccggtgaa

SEQ ID NO: 6799947 - DNA, 57 bp, Homo sapiens
cggagcaggaacagatcccttggagacaccttatcttcaaaattgttctaagctctg

SEQ ID NO: 6799948 - DNA, 87 bp, Homo sapiens
gtcatgatataaaccttggcctgtttttcctactagatgataaaatgcgaacagtaggagccaagcagaactaaggaaggatgtgac

SEQ ID NO: 6799949 - DNA, 81 bp, Homo sapiens
tcccctgtctgcctcggtgtcccttgctcagggctcttgatggggcctgggagcacatcggggtccttgcaagacccggga

SEQ ID NO: 6799950 - DNA, 62 bp, Homo sapiens
tgggctgctggggtcacatggtaaggaattgttttcttttcccagcctccttgagcaaacca

SEQ ID NO: 6799951 - DNA, 85 bp, Homo sapiens
agggagtgggtgctgatgctgtctgtgacctctgcatgtctggaagtcaggccagcagacctcagggactctcagcctgcttcct

SEQ ID NO: 6799952 - DNA, 71 bp, Homo sapiens
tttcataggaagaagcagccttgcttaaattgagaaagtcagactgaacaaaacatggttcttcctagaga

SEQ ID NO: 6799953 - DNA, 72 bp, Homo sapiens
ggagagcaaactggagccagtaggagtgtacttaacactaacaagatccacctgagtttcagttatttctct

SEQ ID NO: 6799954 - DNA, 107 bp, Homo sapiens
ggagacttcttatgggtattcttattcacaattaactttatacttaaatgtcttaaggatagatgggtgaggggtggttgtgactgctggataccatagaaagttcc

SEQ ID NO: 6799955 - DNA, 56 bp, Homo sapiens
ctagcacttagggattgttatgggaatttggtttcagtcagttggccatgtgctag

SEQ ID NO: 6799956 - DNA, 95 bp, Homo sapiens
tcttctacaaaattggaaatatagaatggaaagtgttgagaggtccattcaaacatcaacattcttaagatttgtgtctcacagttttgagaaga

SEQ ID NO: 6799957 - DNA, 100 bp, Homo sapiens
tggcaatgtgcattatgtgtttgttaaggggtatcaagatgtggaagacatcatctgtgattcttcttgagtcttggactctgtaaaatccacattgtca

SEQ ID NO: 6799958 - DNA, 81 bp, Homo sapiens
atcttgagcctcagtttctccatctgtaaagtggacaaggtatgaaatttgatagttagggggacaagctggggtggggat

SEQ ID NO: 6799959 - DNA, 64 bp, Homo sapiens
cccatgtctttcactctctttctctttatcactactttggaagctttgtgaaagcagacatggg

SEQ ID NO: 6799960 - DNA, 69 bp, Homo sapiens
tctgggctgaaatgaaggccttgggagtttgacttcttcaattaggctgtttgtttttctgagtccaga

SEQ ID NO: 6799961 - DNA, 83 bp, Homo sapiens
ggacggggcaggagaggggcagccagcatttcctgagcgccagctaatggcggggacctggcacctttgctctgtgactctcc

SEQ ID NO: 6799962 - DNA, 60 bp, Homo sapiens
aggctatggtggggccagcggcatgggaggcatcaccgccatcacgttcaaccaaagcct

SEQ ID NO: 6799963 - DNA, 94 bp, Homo sapiens
actcttgtgcctgaaaatgttagtgatacgaattgacactttaatgttgtatgcttggtggggatctttttatcacaaggcattttccaagagt

SEQ ID NO: 6799964 - DNA, 104 bp, Homo sapiens
gtatacattcatttaataaactcttcagaataatgtgttagagaagttaagtcttctccattaacaaattagtttttataagaggaggatggtgtaaagtatac

SEQ ID NO: 6799965 - DNA, 100 bp, Homo sapiens
taattgccattgcgttttgatgatctgggctggacacacttaacctcttgttttgtaatctgagttgcatggtaccggtccattattttcatggcaattg

SEQ ID NO: 6799966 - DNA, 61 bp, Homo sapiens
ggaagggaactgggtctccttgttcaccatgatgggcggggacagaaggcggttctcttcc

SEQ ID NO: 6799967 - DNA, 87 bp, Homo sapiens
ggctcccctgtgaacctgcctctgttgggcatggtctggagggggaccctgttcacaggatcatctacagcagggcaggagggagcc

SEQ ID NO: 6799968 - DNA, 91 bp, Homo sapiens
cttgcttcctgatatggtggcaataattatgattggggaagattagtgtaaagcttctgcaccaagcatagtgctgacctaaggcagtaag

SEQ ID NO: 6799969 - DNA, 58 bp, Homo sapiens
gccaagacgtggcaggactggacgcacacagatctgttgatcctttcccccatgttgc

SEQ ID NO: 6799970 - DNA, 95 bp, Homo sapiens
caggggtgagcgctcagagcaggaaggggatgatgggcatgcgcaggggcgggtagtcccggaactccttcaggtagctgcggtgcttgcccttg

SEQ ID NO: 6799971 - DNA, 83 bp, Homo sapiens
ttcctctgtgtaaaacacttcaaggacttctgtctcacttaaggtagtagccaaggttcttgaagtggtttgcccgtagtgaa

SEQ ID NO: 6799972 - DNA, 58 bp, Homo sapiens
ttcctcaggctgctttcacataacctgtctttaggctgtgtgagtaaggctgagagag

SEQ ID NO: 6799973 - DNA, 70 bp, Homo sapiens
ggggcccgagcctgcagtgcccacgtgaccacgggaaactcactctgggccagcgcaggtaaggagctcc

SEQ ID NO: 6799974 - DNA, 60 bp, Homo sapiens
tgctgagtttcttcatggtgcagaggcccttcttgtctccacaccagaaggagctgagca

SEQ ID NO: 6799975 - DNA, 62 bp, Homo sapiens
agcatccaggagcattaagagaacatagggctcagccttgtggtgctggtggtttttgtgct

SEQ ID NO: 6799976 - DNA, 88 bp, Homo sapiens
tgtgctaattactggtaataagatctgttacatgggcctttacataggttatgcaaagaaatagactaatgaaatgagtaatagcaca

SEQ ID NO: 6799977 - DNA, 56 bp, Homo sapiens
ccacccgctgcgctaccacgtccttgtgaccccggggctgtgcctccagctggtgg

SEQ ID NO: 6799978 - DNA, 63 bp, Homo sapiens
gtggggttggcagaggtctcgttgtggctgaatcacagcccaacttcttctgcccaatcctgc

SEQ ID NO: 6799979 - DNA, 76 bp, Homo sapiens
accttgtgggagtggtgagaggccacggttttccttgggggcatttccccaaagatgtggctgccacctaccaggt

SEQ ID NO: 6799980 - DNA, 66 bp, Homo sapiens
atgccttggctagatctttcagaagaaactaacaaaggatgtttcgggagagaaagaccaaagcat

SEQ ID NO: 6799981 - DNA, 73 bp, Homo sapiens
tcacctgagcccaggcacaaattgcagtgagccgagattgctccgctgcacttcagcctgggtgtcagagtga

SEQ ID NO: 6799982 - DNA, 60 bp, Homo sapiens
cagccacaatgcaattgtaaggtgtgtttcagacacaagggcctatagtgtatttagctg

SEQ ID NO: 6799983 - DNA, 91 bp, Homo sapiens
ctaaaaagtatgtacatgtagtcctaatgctggtgaagatacagttagaggtatcatcaaacatggacattaggggtatacttttttttag

SEQ ID NO: 6799984 - DNA, 87 bp, Homo sapiens
agtctatcccaatatgtctctgcagttgggtgacccaatatgtctctgcagttgggtgacccaatatgtctctgcagttgggtgact

SEQ ID NO: 6799985 - DNA, 55 bp, Homo sapiens
tcaagaaagggcttcaccaggatgatcaatgcaaatggatatggagctttcttgg

SEQ ID NO: 6799986 - DNA, 57 bp, Homo sapiens
tatttattgtctgtctatattttcagaatggaagtttgatgaggcagatattgagtg

SEQ ID NO: 6799987 - DNA, 59 bp, Homo sapiens
ggggcagccagccaggctcagggcaggaagctgctgattctgggtcacttggctgctct

SEQ ID NO: 6799988 - DNA, 58 bp, Homo sapiens
acatagtgagagaaagatcagcttgctctaattaaacaagttgaattcttctacatgt

SEQ ID NO: 6799989 - DNA, 108 bp, Homo sapiens
gacttccccttgccgtttcctgcaacctggcctgtggcttaaggtctgtgaggacacagacttggtgtttggcaggcatgcagaagatgtaaagggctcacagaggtc

SEQ ID NO: 6799990 - DNA, 81 bp, Homo sapiens
gaaaggtggtataaaaatagctgtttttaggccaaataagcatgttggttacttctgccttagagaacactacagcttttc

SEQ ID NO: 6799991 - DNA, 58 bp, Homo sapiens
cacccactgagctcatgtcccagggctaggctctgcctgaggacaggagacatgggtg

SEQ ID NO: 6799992 - DNA, 66 bp, Homo sapiens
ttcatctcttatgtttatggatacatccccagatccagaacggtatccatcacatggtctgatgaa

SEQ ID NO: 6799993 - DNA, 83 bp, Homo sapiens
ggcaatattctaggtctgtaaatgagagagacaggacctgtgagttgctttcttataccgatagaatacctggaagggtagcc

SEQ ID NO: 6799994 - DNA, 60 bp, Homo sapiens
acagatggtgagccgctgatgtctgcacacggctgagccaggcagctcactactttctgt

SEQ ID NO: 6799995 - DNA, 79 bp, Homo sapiens
gcatgttgcagctttcccacgcagtggatgagaacgaaggttacgaccattgtgtgggaggcgtctgtgtagcaattgc

SEQ ID NO: 6799996 - DNA, 69 bp, Homo sapiens
gagattacaacatgggacgcatatttaagaagagataaaatatgacactgcttgtccttatgtaatctc

SEQ ID NO: 6799997 - DNA, 55 bp, Homo sapiens
tggctcagccagccctaggaacagcttgctttgtttgtgctgcttctttgagcca

SEQ ID NO: 6799998 - DNA, 124 bp, Homo sapiens
gaaaggtagatacctacaaacatggcatctaaaaggtggtttgattatcccactgtcaagtatcagtgttatgtcacctattactgtgattttcatgtgatgtttgtagcagcaattacttttc

SEQ ID NO: 6799999 - DNA, 72 bp, Homo sapiens
cttcctggagctggtgtctttccctctgggcaatataagtgccttttgggaggaggcatcagcttcaggggg

SEQ ID NO: 6800000 - DNA, 81 bp, Homo sapiens
gcctgtttcacttacccttccttcagagtgtgaattctaccactaattaggctgaggagtgggtgggcagtgagaggaggt

SEQ ID NO: 6800001 - DNA, 56 bp, Homo sapiens
gatgaggtcatgttttacatatttaccattatgtaatataactttggcctaacatc

SEQ ID NO: 6800002 - DNA, 63 bp, Homo sapiens
gttgaatgagtgagcacgacagtactgacattcagtttctgaggagtcagcttactcactaac

SEQ ID NO: 6800003 - DNA, 67 bp, Homo sapiens
tttgctaagagaactcgtggaccaacagaggcttgaagttggaacaaaggggcttttctcttgcaaa

SEQ ID NO: 6800004 - DNA, 66 bp, Homo sapiens
agttctctattcacttatgtttcaggctccaaatgacatggtattgaaatactgagtgaaagaatt

SEQ ID NO: 6800005 - DNA, 130 bp, Homo sapiens
ttctcgtttccctgctgcttcctaaaactgtgtctttcctgtaactgctgttcaaaaaatgttttttgaatgaataatgcagtgggaaacataaagccatttaataaagcaaggaagggatattgatgaa

SEQ ID NO: 6800006 - DNA, 59 bp, Homo sapiens
tggaaatagctccagttaagcacatcgaaaagatgttgttttaaatgagattatctcca

SEQ ID NO: 6800007 - DNA, 75 bp, Homo sapiens
tgccccaggtgtctgtggccagccctaatggaagacccacagagggctggatgtacaggtctaacacgtggagca

SEQ ID NO: 6800008 - DNA, 95 bp, Homo sapiens
ggctcagctgggcagtttttctgctggtctcactagtcacttgtgctgctgtattcagctggtgggtcggctgggagagctgcaatgactgggct

SEQ ID NO: 6800009 - DNA, 60 bp, Homo sapiens
gctccaggggagactagacccacacctactcatgagctggggtgtagctcttctggatgc

SEQ ID NO: 6800010 - DNA, 56 bp, Homo sapiens
ttcctcaaagaattcagctccatacgataagtgttaatgctttatttcttggggaa

SEQ ID NO: 6800011 - DNA, 124 bp, Homo sapiens
ttggagagggctgtgtatgagctgaagatacatgtgttagaagtcagtatataggtggtatataaaatataatcatctctgatccttttaaacctgggtctcattccttcctccacccctccaa

SEQ ID NO: 6800012 - DNA, 64 bp, Homo sapiens
gtgcagagaaatgagaagtcgagaattcatcctgctccaccggcttcctcaccttctcttgcat

SEQ ID NO: 6800013 - DNA, 56 bp, Homo sapiens
ccacagattagcgtacacccacctccaacctgcagctgcatggcgcacatctgtgg

SEQ ID NO: 6800014 - DNA, 89 bp, Homo sapiens
ctcacagtcacagcctggcctctgctcctgtgggccagtggccagacaccccctgggatggctcaaaggagtcaggacttggaagtggg

SEQ ID NO: 6800015 - DNA, 80 bp, Homo sapiens
tgcttcagcccatcccagtacatcgcatggtgaccaaaagatgtagtcgtcctggcacagtgggtgtggggcaggaagca

SEQ ID NO: 6800016 - DNA, 71 bp, Homo sapiens
tgtatccttgttccttgccttcctatgttgttaacatcccttaagaagcagtaccaaggagataagataca

SEQ ID NO: 6800017 - DNA, 92 bp, Homo sapiens
cctgtgaagaagctggcccaccatgggaagagagactaattggtatctccatagcttggactattttttccactggatctgcagtttctggg

SEQ ID NO: 6800018 - DNA, 71 bp, Homo sapiens
tgcacaacgttctgcccctgggattggggcttcaggcccttagatttcagggtgcagatgatgacactgta

SEQ ID NO: 6800019 - DNA, 71 bp, Homo sapiens
ctccgggacatgtggcccctgaaaatggcagctgccattaggtagcagccttgcaggggtcgcaccggcag

SEQ ID NO: 6800020 - DNA, 82 bp, Homo sapiens
ttctattcttcccaccaaatgcacaaggaaatggggaacttgggctagtctctcagaagtgcatgtggtaaagaggagagaa

SEQ ID NO: 6800021 - DNA, 90 bp, Homo sapiens
gaaggtgataatgttctgaatcaagcaactctccagtggtagaaaacaccacagcccagagatcttgattgagaacattttattcccttt

SEQ ID NO: 6800022 - DNA, 59 bp, Homo sapiens
ggatttgctgctttggaactccacagggtgaactgcctgggaagcccatagcagcttcc

SEQ ID NO: 6800023 - DNA, 66 bp, Homo sapiens
ggattatcatgcctgattatgttactcagcactcttaagtgtgaatttattctcagacaatgatcc

SEQ ID NO: 6800024 - DNA, 56 bp, Homo sapiens
ctgaggagctgaaggccctccaggcccagtttgaggatgccatcacagcccatcag

SEQ ID NO: 6800025 - DNA, 97 bp, Homo sapiens
gggccatgttggcaatagttgatctgtgtgattggatgcattttcaaagagtttgttaatggtgcctttctgcatagacagtgttccacaatcgcct

SEQ ID NO: 6800026 - DNA, 59 bp, Homo sapiens
gggaaaacagggctgctgctcaccctgcttgtccctggcacagaaagctgccttgtccc

SEQ ID NO: 6800027 - DNA, 66 bp, Homo sapiens
cagagttccgtccaggaacgtcccgttgtagtggtacctcacaaaatcagacacctggatggtctg

SEQ ID NO: 6800028 - DNA, 112 bp, Homo sapiens
actttgaggctttctctttatattttatttgattgtgaaacattctgcttgctaaaatggtggcttagaacttgatagacagtacaaatcagtgaagaggaattctctgagt

SEQ ID NO: 6800029 - DNA, 103 bp, Homo sapiens
ctcatgctctttgtggtgtgacttcaggaaggcacttggtgtgttcactcccaccatgggaaacttggcaaaatacacgagggccttctacacacaagctgag

SEQ ID NO: 6800030 - DNA, 61 bp, Homo sapiens
gctcagcggagaagaatctgtggcctgctgacagggaccatgtgttgattctctgcagagc

SEQ ID NO: 6800031 - DNA, 76 bp, Homo sapiens
ctttgatggctttattttcctggtggcttcttacttcaaaagcttccagctctctttgaagcataaaccatcagag

SEQ ID NO: 6800032 - DNA, 121 bp, Homo sapiens
agcctatggaaaaattggaaggatatttattaggaggtgaggctctgtgagttactcctatcctaactgaacacacacatcttaataatctatcttcattcatccaaattcctcataggct

SEQ ID NO: 6800033 - DNA, 87 bp, Homo sapiens
cacagctatttttaagtgtcgtctttgcgagccatttgtgtgtgcccacaggcattctatacaatgggtgcaaagatgtgagctgtg

SEQ ID NO: 6800034 - DNA, 63 bp, Homo sapiens
gacagactgtgtctgaggtattctcttgcaaatccctgagggtactgaataacaaagtctgtc

SEQ ID NO: 6800035 - DNA, 73 bp, Homo sapiens
agacatgattttttgagaagagtttgaggtattagttcaacaaatatctatcaagtctttttgtcttatgttt

SEQ ID NO: 6800036 - DNA, 56 bp, Homo sapiens
gccctgcacgatcaattctgtcattaaccccatagtacagatgaggatgcggaggc

SEQ ID NO: 6800037 - DNA, 58 bp, Homo sapiens
gtggctttggaattgtagactcgtccagaagctggacagataacgtgaccgaggccac

SEQ ID NO: 6800038 - DNA, 66 bp, Homo sapiens
atttctttgtgcttctcaagaaaagtgaagggtgaatgaaaatctcttcacttgaagttcagaaat

SEQ ID NO: 6800039 - DNA, 62 bp, Homo sapiens
ttggctgaaggttaagtgctggaaataatgactgaacgtgcagacttagatctttagaccaa

SEQ ID NO: 6800040 - DNA, 64 bp, Homo sapiens
tatttatcgagtgtctactatgtgcaaaatatttttctaggcactgaggatacattgatgaata

SEQ ID NO: 6800041 - DNA, 56 bp, Homo sapiens
tacacacctgcctgcagactctggaacatgccatcattttgccttgcagctgtgtg

SEQ ID NO: 6800042 - DNA, 116 bp, Homo sapiens
aaccagttattggacttgtccacacttttcaagtacatgttgttcaaaagccacatgttctcgtctatgaggtcaagagcagcatgagctatgaactggtgcagacagtgacggtt

SEQ ID NO: 6800043 - DNA, 76 bp, Homo sapiens
gggtctttggctgtgggtttgctcaggcctcttctgaatccagggtgatcccctctggcaacttcacagcccaccc

SEQ ID NO: 6800044 - DNA, 56 bp, Homo sapiens
cgcagctgccttgtcagccgtttgatctccaaccggcgaggacaagaggagttgtg

SEQ ID NO: 6800045 - DNA, 73 bp, Homo sapiens
gcattgaaaggaagactatgcttgctggcccagaaggctcttcctataagcctgtagtctcactgtgcagtgt

SEQ ID NO: 6800046 - DNA, 87 bp, Homo sapiens
gcctgttgtacactcatgcctttggcattatttcttggcctggaggaacaggatggcaaggttaattgcaaaggtggagtgttgggt

SEQ ID NO: 6800047 - DNA, 96 bp, Homo sapiens
tgtgaaatcattttacactacttggtttatatccaaaggcaaggaggaaggaaccttcctccttgcctttggatattaaagtagaatggtagcata

SEQ ID NO: 6800048 - DNA, 90 bp, Homo sapiens
gttgataaaaggcatattcccagacctcatctccagaaattatcatcagtgcatctggaggtgtgcccaggaatctgcattttaatcagc

SEQ ID NO: 6800049 - DNA, 55 bp, Homo sapiens
agcagggaagctcagaagaggccagtgggcttcccgagttctgtgcttcctggct

SEQ ID NO: 6800050 - DNA, 55 bp, Homo sapiens
gggaggctgaggtggatggatgacctgaggtcagaagttcaagaccagcctgccc

SEQ ID NO: 6800051 - DNA, 93 bp, Homo sapiens
cttcgcattattttaaggaaaggcattatgatttgagtaccacaattctgtgaagacattaagtctatgtcaccatttcaatcatgcaagagg

SEQ ID NO: 6800052 - DNA, 85 bp, Homo sapiens
tctcaggcagtgaccctctagatggaagcactgtctgttgtctaagaaaagatcgtgcatccttttagagtgttactgtttgaga

SEQ ID NO: 6800053 - DNA, 79 bp, Homo sapiens
ttgatgatattcagactgcttagctcccagtagtcctcagaagttaccttggaggccaagcagtttagggaatgatcag

SEQ ID NO: 6800054 - DNA, 56 bp, Homo sapiens
gagtgtctaatcacgtttcacaaggcaaattggtaagacaatgttgttggacactc

SEQ ID NO: 6800055 - DNA, 65 bp, Homo sapiens
ctggcagatagccacgcctgtcaaggaaagtatactccaagcggtcaggctggggctgctgccag

SEQ ID NO: 6800056 - DNA, 93 bp, Homo sapiens
tggtgtaccttcaataaatgttatgcccatcatccaagcatctccaaacatgattgtgtttagaaatgggttacatttagagatggtatgtta

SEQ ID NO: 6800057 - DNA, 86 bp, Homo sapiens
gtgcaaggtagtttagtgattacagatatataaatagtaaaatatatttgtttaccaagctttaattacataagcaacttttgtat

SEQ ID NO: 6800058 - DNA, 69 bp, Homo sapiens
ggggtttcacttgtaggatgtacttatcatttctggaaatcgataatatcttacatgtgctttgttccc

SEQ ID NO: 6800059 - DNA, 78 bp, Homo sapiens
ctcctgcatattgtccttgatattatttactgtaactaggatttatctcaataataatgcgaggagaaaatgaaggag

SEQ ID NO: 6800060 - DNA, 92 bp, Homo sapiens
agagttccttgcctcagagacctgacagtacagagggaccagcacaagccgatcatctgaacatgttgcagctctgggcaatgatggcgtct

SEQ ID NO: 6800061 - DNA, 82 bp, Homo sapiens
agacaaagggtgagaaaatggccttattcaaggaagactcggcggcacacggcgaggttctgtagggtttcaacctgagtct

SEQ ID NO: 6800062 - DNA, 56 bp, Homo sapiens
gtgatgaggcttcttggtgaacatagttcagtctgtcttgattattggcctcacac

SEQ ID NO: 6800063 - DNA, 58 bp, Homo sapiens
gccgtaaagctacgcttttgcgcctcgccccttcacgacttgtagagctctttacggc

SEQ ID NO: 6800064 - DNA, 63 bp, Homo sapiens
cccagggtaatcatgtgaagccaatgaaataataaaaaggaccacatcggatgacccctgagg

SEQ ID NO: 6800065 - DNA, 81 bp, Homo sapiens
gaggcctgtttcatgttcctgaacacaaagggtcccgtcagatgtttctttgtgtttaaagaggaagtgagattcgctctc

SEQ ID NO: 6800066 - DNA, 67 bp, Homo sapiens
gaggggctcaaagtgtgcagggaaggtaggccctttccctggttccaggctatggtcaaagcccatc

SEQ ID NO: 6800067 - DNA, 127 bp, Homo sapiens
aactcaaaccttggatatgatattactaactgaaggcagggatgattatttttccatatttaatcaaaataacagcactgttgatggtccaaatggtttcctggttagaatttgaagcaattgagtt

SEQ ID NO: 6800068 - DNA, 56 bp, Homo sapiens
tgtttgctagggttggtatttaagcctgtctgaatatgccactttctagccaaaca

SEQ ID NO: 6800069 - DNA, 63 bp, Homo sapiens
tgctcagataacagtacaaggtgacacgcagcacctgtttgttcttgcaacagttattaggca

SEQ ID NO: 6800070 - DNA, 78 bp, Homo sapiens
gagttttagagagaaataaatgagatttaaattgcttagaacagtgcatgtctcgtaagtttcacttcaataaatctt

SEQ ID NO: 6800071 - DNA, 64 bp, Homo sapiens
gctggtgggacaaagctttgccaacccttcatggaggtctggagccagtgttgcccaacacagc

SEQ ID NO: 6800072 - DNA, 64 bp, Homo sapiens
ctcagtttctggataagctgggcctctttacctcctttttctgcttttcttgtccaggctgtag

SEQ ID NO: 6800073 - DNA, 65 bp, Homo sapiens
gttgcttcaatgactgcccaatggcacccttccattccaagtagggtgcctttgagtcatgtaac

SEQ ID NO: 6800074 - DNA, 106 bp, Homo sapiens
ttctttcatgatattgaaaagaactggaagaagtgaaagctttgccacattgcttgcattcatagtgtttccttccagtgtgagtcttttcatgtctatgaaagga

SEQ ID NO: 6800075 - DNA, 96 bp, Homo sapiens
tgtgtcatcttggctaggctatagcttccagttgtttggtcacacactagtccagatgttgctgtgaaggtatgttttagatgtgagatgcacaca

SEQ ID NO: 6800076 - DNA, 100 bp, Homo sapiens
ctttgatatagcattgacctgtcatctccttaattctgtgcaatatgtttataacatttagcacttgtaacagagaaaggaataggaacatattttaaag

SEQ ID NO: 6800077 - DNA, 64 bp, Homo sapiens
tgaataaatgaaccctcctgtggtttcatttattcagtgaaccacaggagggttcatgtattca

SEQ ID NO: 6800078 - DNA, 84 bp, Homo sapiens
ctgtggttgccacttataggaaagaaaattatgtaggaagttcagagattcacctacgccatttcttccctgaagatgccacag

SEQ ID NO: 6800079 - DNA, 61 bp, Homo sapiens
tagattcccaggaaggtatagtgttatttcactaatacagaatactaattcctgagaaata

SEQ ID NO: 6800080 - DNA, 55 bp, Homo sapiens
atgccagggtcccttcagagattctgattaatcagtctaggatgtggcctggcat

SEQ ID NO: 6800081 - DNA, 55 bp, Homo sapiens
tatttcagttgcgtttcccgagtagccccagcaacaggagaagcatctagaaata

SEQ ID NO: 6800082 - DNA, 71 bp, Homo sapiens
acctggctggctgtgcccctgccgtcctgcattgtaaattggctttaggttgcatgtttctccagcttggt

SEQ ID NO: 6800083 - DNA, 121 bp, Homo sapiens
ggcctagggcagcgtggctggctccctcacaggtactgcttctgttctttcacctacgggcctcttggttgccacagggagttacagaagcacttctcagggactctttgcttgccaggcc

SEQ ID NO: 6800084 - DNA, 65 bp, Homo sapiens
gcctgccctgggccaggaagcggccatggtacaagtctctgggctgccacagggctcaggcaggt

SEQ ID NO: 6800085 - DNA, 88 bp, Homo sapiens
gtcctggaggaagatctgctgtgatgggcactgtttgagcacacaagagatatactaaacctgaggcctccccagcagacctcctgat

SEQ ID NO: 6800086 - DNA, 65 bp, Homo sapiens
gccaagtcttgtgcatctcttcatgaccagagcctggcacacaggagtgctcaagaaacattggt

SEQ ID NO: 6800087 - DNA, 64 bp, Homo sapiens
attccaaaggctggcctggaggaacttctgcacagaatttataattagcccagctttgtggaat

SEQ ID NO: 6800088 - DNA, 117 bp, Homo sapiens
ggatcacattttcctgccttcttcatgttagtaattgagtgctagacatcatgaatattacattgttcagagtctagattttgctatgtttctgcaaagaaggttgaagtttgttct

SEQ ID NO: 6800089 - DNA, 55 bp, Homo sapiens
tggagcagggcaggtaaggatcagactgcatttggctcatggctgtgctgcacta

SEQ ID NO: 6800090 - DNA, 66 bp, Homo sapiens
aaatgggtctaaataaaatttgcatgtggctagacattagtttggttacacttaatttttccattt

SEQ ID NO: 6800091 - DNA, 65 bp, Homo sapiens
aggattcctagatctcccctttagagattctgattccacaggtctggagtgaggtctgggagcct

SEQ ID NO: 6800092 - DNA, 68 bp, Homo sapiens
cccaatatgactgtatttgaagacagggcctttaaaaggttaattaactttaaatgggatcataaggg

SEQ ID NO: 6800093 - DNA, 69 bp, Homo sapiens
ttcccactttccttctcacacttggggctacaccagtagagaggttgtatgtgcttgagaaggtgggag

SEQ ID NO: 6800094 - DNA, 104 bp, Homo sapiens
ggacattttctccttggctttcagaatccctatctgcctttttatgccagaacagggactggaggcttcaatgtagaggggcaaaaaaaaaaaaaaaaaattcc

SEQ ID NO: 6800095 - DNA, 62 bp, Homo sapiens
aaaaaaggagattttagcttggtttttgaatattaagaagtcagtggtctgtctccattttt

SEQ ID NO: 6800096 - DNA, 62 bp, Homo sapiens
ctttcacaagatttgagatgctgtcaaaaataaatgccagctcctcagattctgtgtgaaag

SEQ ID NO: 6800097 - DNA, 57 bp, Homo sapiens
cagggtgggcacccagcctccaggggccaatatctggctggcgcctgcctcaccctg

SEQ ID NO: 6800098 - DNA, 58 bp, Homo sapiens
atgctttattggagacagtcattgtatcaacagtacacttgatctccagtacagacat

SEQ ID NO: 6800099 - DNA, 70 bp, Homo sapiens
gacaaggtctgaagtgtctttgtacttggggccctcctggggccactcagaccaacgacccttccttgtt

SEQ ID NO: 6800100 - DNA, 72 bp, Homo sapiens
ttccctgacttgtggtcattgggccctgcctggtccaagcagccaggcagtgctcaagacagcagcacggag

SEQ ID NO: 6800101 - DNA, 55 bp, Homo sapiens
ggaacccaggtctctctgactccaaacccatgttcttttcaggatccagggttct

SEQ ID NO: 6800102 - DNA, 90 bp, Homo sapiens
gctgaattttgaacagccctgagaaggaggatctctattcacctacgaactgaaggaccttgtccagggttacttagttgtttaaacagc

SEQ ID NO: 6800103 - DNA, 68 bp, Homo sapiens
gaggggggtggatcacctgaggtcaggagttcgcaaccagcctgaccaacatggtgacaccctgtctc

SEQ ID NO: 6800104 - DNA, 57 bp, Homo sapiens
ctgctgtggccagccaggtcaaaggtgagggtggcctggactaggtactcatggcag

SEQ ID NO: 6800105 - DNA, 70 bp, Homo sapiens
tttcaacattgattgagcacccattatgtaaactagacatgtatatgattggctgctatcagtgaaggaa

SEQ ID NO: 6800106 - DNA, 62 bp, Homo sapiens
attattttggtccaggatacagaagagggctccaggagcgtagacagatgggccaaggtaat

SEQ ID NO: 6800107 - DNA, 113 bp, Homo sapiens
gcccaaagcccaccagggcacctgccgtctgcagcctccaggagttcacacagagatctgggattgctggggcaggctgtagcccacggatgtcgcctcctgagtttctgggc

SEQ ID NO: 6800108 - DNA, 83 bp, Homo sapiens
tttaacttttgcaagcgaagcataatgatgattgagattgaaagatcaaatcattgcattaatgtttgaactgtgatattaaa

SEQ ID NO: 6800109 - DNA, 59 bp, Homo sapiens
tgccagattgtggcatggcactcaactcctcaaagaagccattgagttccagtcaggca

SEQ ID NO: 6800110 - DNA, 71 bp, Homo sapiens
cactttcacagctgtgcttatgatgctaatgccaaggtgcttcagagatcatgagacacattatggaaatg

SEQ ID NO: 6800111 - DNA, 58 bp, Homo sapiens
gtcagagaactggattttccaaattgaactagaattgggaaacaatcagttcttggac

SEQ ID NO: 6800112 - DNA, 71 bp, Homo sapiens
tattgctgatggtattatgctagtagtttttctttaaccttaagaaaactaaataatgccatctggtggtg

SEQ ID NO: 6800113 - DNA, 74 bp, Homo sapiens
gaatgtcactgttgttattgttattattccgctctaatggaatgccaggatatatatcaatacagcaggacttc

SEQ ID NO: 6800114 - DNA, 67 bp, Homo sapiens
tgataatgtgtgtccatttggtgtgttgatttgtatagaatcatttttcaaatggctacctttgtca

SEQ ID NO: 6800115 - DNA, 88 bp, Homo sapiens
ggatgcttgctgcaggcacatctctgctgctccccacaactgcacctccatgaagccttgtctagcagaagtgccttagcaatcactc

SEQ ID NO: 6800116 - DNA, 66 bp, Homo sapiens
gaggctgggggcagcctgaccccacgtggaagagcttggggtcatgaggctgctgtcaccaggctc

SEQ ID NO: 6800117 - DNA, 76 bp, Homo sapiens
gccacatatactaggatagggaactcatggctggagcaagatttttgtatttctttatcctatttgtaggtgaagc

SEQ ID NO: 6800118 - DNA, 77 bp, Homo sapiens
ctcctggcgtctgtacatcccgagagccagtatcttccaagctgaggtttgtcttgggatgtgacagcagtcaggag

SEQ ID NO: 6800119 - DNA, 67 bp, Homo sapiens
gctgtagcagcccctcccaacctccccttcctgtggctgccccagagcctgtgagggatgctgcagt

SEQ ID NO: 6800120 - DNA, 55 bp, Homo sapiens
gaaggcaagcagcataaatgtctttaaagatgtgcaccctggtgcttttgtcttc

SEQ ID NO: 6800121 - DNA, 82 bp, Homo sapiens
gtttatctagaacttaaagtcagtcaacagctatttactgagcatctacaatgttgtttggctaagtaggtgctggaagaat

SEQ ID NO: 6800122 - DNA, 72 bp, Homo sapiens
ggctcctctagggcacagaatatgtacaatctaattctatattgacagtggctagtgcccagagcaggggct

SEQ ID NO: 6800123 - DNA, 100 bp, Homo sapiens
gggttttgagcagttgtctgatcatgaggcagggctggggtgtggagtaaatcttgttttcaataacctgttgagtgacattttatattgccattggccc

SEQ ID NO: 6800124 - DNA, 56 bp, Homo sapiens
caggttgatgaattaacaactcttgtgagctcatagccacagaggtttacagcctg

SEQ ID NO: 6800125 - DNA, 56 bp, Homo sapiens
gtgtttaataggtagctgaatctgcttcctgaatggtttagttaaatatggtgcac

SEQ ID NO: 6800126 - DNA, 61 bp, Homo sapiens
gtggcagctacatttaatgcaattcttgttttaaaaatttttattgatatgtagctgttgt

SEQ ID NO: 6800127 - DNA, 95 bp, Homo sapiens
ttatgggttggttccctcactttgtaataactcctgagtttgcatgagaaagcacagccaatagcattatacagtgaaggaattactactcatag

SEQ ID NO: 6800128 - DNA, 63 bp, Homo sapiens
atatttttgtgtgtttaggtttgtgtatatattttacatgtgtgtataaatacacaagggtat

SEQ ID NO: 6800129 - DNA, 69 bp, Homo sapiens
ctgcagcctcgacctccccaggctcaggtgatcctcccacctcagcctcccgagtagttgagactacag

SEQ ID NO: 6800130 - DNA, 82 bp, Homo sapiens
cctctggtgttgccgttatcattttggttggttttcttcctggactttcaaagttgggaattgtaattgtctattccagggg

SEQ ID NO: 6800131 - DNA, 87 bp, Homo sapiens
catttcaatgtataacaggaagtattcaaacagatttcacctaaactggagaactgttgttaatgtaactgctgttatatcaaaatg

SEQ ID NO: 6800132 - DNA, 104 bp, Homo sapiens
gtttcaccaattagacggctactaatttcttcacttattttactgagaataaatgtctgagatcagtgtcataaggagaaattacagcaagtttttggtttgac

SEQ ID NO: 6800133 - DNA, 79 bp, Homo sapiens
gcttcctcatttgtctttctcatttgctgccaatggccacccacacctggcactgggtgggagatctgaatgagtgggc

SEQ ID NO: 6800134 - DNA, 126 bp, Homo sapiens
ttacctgcgccacacttaacttttcgagggggctatccatggtgggggcttggcccaggtcctcccagggagagagccttcggccagagggtggccggctctgaaagttatgcacaacgcaggtga

SEQ ID NO: 6800135 - DNA, 73 bp, Homo sapiens
catgataggccctgattcagtggtgcccagaggccactgaggtctctggcaattgctgctgactcactgcatg

SEQ ID NO: 6800136 - DNA, 84 bp, Homo sapiens
tttatgggacattatgatctctgtggcatccactcaactttgacattgcggtacagaagtggccatagacaatatgtaaatgaa

SEQ ID NO: 6800137 - DNA, 62 bp, Homo sapiens
ctgacagccatgttttagagaatttgatgactcttttaaactctttagaaagaggctgccag

SEQ ID NO: 6800138 - DNA, 111 bp, Homo sapiens
gctgcagcctggcctggtcctgtctgcctggctgtcaaacccagaagaccgtggtttctggtggcctctgtgtgacagcggaggaggtggggcgaggcctggaagtgaagc

SEQ ID NO: 6800139 - DNA, 79 bp, Homo sapiens
aagatgattaggatgaaagcaaacttccaatgcaactcttattgtgcttgaagaattcgtgctttcggactggtttctt

SEQ ID NO: 6800140 - DNA, 64 bp, Homo sapiens
ggaaattgagggagaaagttggagtagggagcctctaaacctgcctataaactgcctcaaatcc

SEQ ID NO: 6800141 - DNA, 84 bp, Homo sapiens
tccactgccaaactgacatttaatagtattgtgggaacctaccacaggtcttgcagaaaatagtatagatttgtttggtaggga

SEQ ID NO: 6800142 - DNA, 55 bp, Homo sapiens
gcttcctttctttgtttgacatcttcaaagtgaaaagtgtcattgccagggaagc

SEQ ID NO: 6800143 - DNA, 64 bp, Homo sapiens
tccagtcaggctgaattcaaggcccaggcccccgtgtcggaggccttcctcagcactgtctggg

SEQ ID NO: 6800144 - DNA, 105 bp, Homo sapiens
acaaaggcccggatgagccttggcagccaggacccgcctggaaagcggccacccttgccagtagcagccggccaggcgccctgggctccatcccctgctttatgt

SEQ ID NO: 6800145 - DNA, 74 bp, Homo sapiens
cagtaagaactgggagggagagcaatagtctttactttgagatttgacattattctctcagtctttgggatctg

SEQ ID NO: 6800146 - DNA, 59 bp, Homo sapiens
aaagtaagatttgcatttcagatagatgcttttacatggaatacagatctttagacttt

SEQ ID NO: 6800147 - DNA, 64 bp, Homo sapiens
tgttcccatcagggatgagggtgctgaagtatttacaactgcaccatcagtcatgatggggata

SEQ ID NO: 6800148 - DNA, 60 bp, Homo sapiens
cctctgtcctggggagtggagcaagagtccccccttgtaacccatccatggggccagagg

SEQ ID NO: 6800149 - DNA, 69 bp, Homo sapiens
aagagaggagggagcagggactataaccagcctagggcttttctctggatcctgctgccacctcttctt

SEQ ID NO: 6800150 - DNA, 75 bp, Homo sapiens
gccccattttggaggcacctggttgcaggggaccacagctaggtgagtcacaactgggtgtcttcatcagggggt

SEQ ID NO: 6800151 - DNA, 61 bp, Homo sapiens
agggaacctgcttcaggaagtgataggtctgatatttcccaaagatttcctgcaagcccct

SEQ ID NO: 6800152 - DNA, 74 bp, Homo sapiens
gcctctccctgcttccttcaagtttatctgctggaaagaggggtagacgagggaggaggtagagccagagaggc

SEQ ID NO: 6800153 - DNA, 68 bp, Homo sapiens
agtgctcttgggagagaataatcaataggttggtattgatttgctaatcattattctgtcctggcatt

SEQ ID NO: 6800154 - DNA, 72 bp, Homo sapiens
gtaaacccagggttttgtcttccccatttccatcccacaaggccttgggggaaggtttgtcctgaggtttgc

SEQ ID NO: 6800155 - DNA, 77 bp, Homo sapiens
gatcatgtcattttctcctaactcaaatttaagagtttctaatttgtcttgggctgaaatgtgcttgtgacagaatc

SEQ ID NO: 6800156 - DNA, 81 bp, Homo sapiens
gggcagtggctggcgtgccctccagacttggctggagcctctgctccctgcggtcctagggggttatgctggtcattgcct

SEQ ID NO: 6800157 - DNA, 106 bp, Homo sapiens
cttggtgaacagttttaaaaagcagagggctgtgctaaatttcagggtattgatagcttgagtttacattgtattagccctgctcgttatcatttttttccccagg

SEQ ID NO: 6800158 - DNA, 71 bp, Homo sapiens
aagagatggtaatagtaacatttccattgttagttattacaaacatgtacaatgtgtgctatttatctttt

SEQ ID NO: 6800159 - DNA, 105 bp, Homo sapiens
gggaccaagatctagaaagagggggcatgaaatgagcctggagatgcatgtggtgacatgtttcctctaaacgcatttgcttatcttcattagatctagaggccc

SEQ ID NO: 6800160 - DNA, 80 bp, Homo sapiens
taatgaatatgacctctatctatgattgtggaaattctgagttgaattccaaatatcttggtggttaggtcagtgtatta

SEQ ID NO: 6800161 - DNA, 61 bp, Homo sapiens
caaatgagattctatctccaggcataagttatgtgttaagtctgggtgtaaatcttatttg

SEQ ID NO: 6800162 - DNA, 68 bp, Homo sapiens
cccctggcttggagggtagggtgtggtgtgtagatactgaacagcaccttcctatccaggagatgggg

SEQ ID NO: 6800163 - DNA, 69 bp, Homo sapiens
cttctcacattagcccatctggtatttggagtaaaatatacacccccgtgatgtgctaattgtctgaag

SEQ ID NO: 6800164 - DNA, 98 bp, Homo sapiens
tatttacctcatcagggagagctttgtttgattgtcagaaaatagaacatgtacatttgtctgtcataaacacacacaagctctccagagcataaata

SEQ ID NO: 6800165 - DNA, 68 bp, Homo sapiens
gaccactgtgagactggttctgaacccagtgacctccatctctgggagcagttgcatctccagtggtc

SEQ ID NO: 6800166 - DNA, 104 bp, Homo sapiens
gggaggatctagcaatgtattcacatggtggtagattgttgtaacatttgcagaggtaagctaatttaaccccaatgtgttaataccattgattatttcctctc

SEQ ID NO: 6800167 - DNA, 74 bp, Homo sapiens
ggaaaggcttaaattgtaagggcacactctttaaaaaacacagtgctcattgacagtgggagctttaaaaatcc

SEQ ID NO: 6800168 - DNA, 55 bp, Homo sapiens
gccagggttggggaggagggcgattggctgtctctctttttctccagctctgagc

SEQ ID NO: 6800169 - DNA, 55 bp, Homo sapiens
ttgagctgttttcatgttagagtgttttaaaaagcctagtgttaaaacagtttaa

SEQ ID NO: 6800170 - DNA, 67 bp, Homo sapiens
acatacactgtgcatgcatatacacacatgtatgaacacgtgtgtgcatgtatgtatagatgtgtgt

SEQ ID NO: 6800171 - DNA, 84 bp, Homo sapiens
ggcagctcagcagagatggcagctggcttgggcacctcggaggagggagacccgaggaagttgcctgactgctggcctcctgct

SEQ ID NO: 6800172 - DNA, 112 bp, Homo sapiens
gatggaggtcttctctagacatggttgacttctttgatgacaacctagtagtcacataaactgcccaggaatctcaaagaaaggtcatgatgtacccctgaagaacgccatc

SEQ ID NO: 6800173 - DNA, 88 bp, Homo sapiens
gggtctcgctctgtcgcccaggctggagtgcagtggcctgatgtcagctcactgcaccctcaaactcctgggctcaagtgatcctccc

SEQ ID NO: 6800174 - DNA, 100 bp, Homo sapiens
tgctggatgaatctgagtgtctggaattttaagtgttcgcctcttgcttctcagtaggtggctgcctcttgaggtctggcattcacccaagtcttgagca

SEQ ID NO: 6800175 - DNA, 123 bp, Homo sapiens
gagaaagtggggagtgttgggatgacatattttgaaagctatgagttaatatatgcattaaatatattaagtcagttgtattagcatatatgattcagttttcagcgacagctctgtttcctc

SEQ ID NO: 6800176 - DNA, 79 bp, Homo sapiens
taagaagcatttttggaatgtatttgaccaaagaatgcttatgttcttaagaaattgcattctaatccgatgtccctta

SEQ ID NO: 6800177 - DNA, 67 bp, Homo sapiens
atatatgtgtctgtttctagactctgttctgttccctgggtcaacaagcattaacaggcatttatat

SEQ ID NO: 6800178 - DNA, 68 bp, Homo sapiens
gtagaaatggaatctcactatgttacccaggttggttttgaactcctgggctcaagtgatcctcctac

SEQ ID NO: 6800179 - DNA, 56 bp, Homo sapiens
ctctgggctgaatggctgaaccctggatcccctggaacaatcactctggcccagag

SEQ ID NO: 6800180 - DNA, 94 bp, Homo sapiens
aggcccagagggagttactgcctcaggcagcaaggggaagaattgggattcagacttaggttggctgatgcaagagcttcctgccctggtgctt

SEQ ID NO: 6800181 - DNA, 84 bp, Homo sapiens
tttgcttcagagagtggcaggtttttaattaattttaataatgtaaaattccattaggaaacttccatcagttcattgtgcaaa

SEQ ID NO: 6800182 - DNA, 55 bp, Homo sapiens
gggagtttgaggtccaggtgtgggcagggttggttctgttggaggcctctcttcc

SEQ ID NO: 6800183 - DNA, 76 bp, Homo sapiens
gagtgagtgggtgacagttaacaggtttccacagtgattagtgagtgggtgacagtgaacaggttcccactgcctt

SEQ ID NO: 6800184 - DNA, 81 bp, Homo sapiens
ctgggggcatagcccatgcaaatactcggtgaccaggagagtggccgtgtggagaagcagggcaggaatgtgaccacccag

SEQ ID NO: 6800185 - DNA, 60 bp, Homo sapiens
cctgtctgaaagaatctcagcctgaactgctggggatttgaggctgtcatttctggcagg

SEQ ID NO: 6800186 - DNA, 69 bp, Homo sapiens
gtgcagctttggaggtggaactctattttcacacttttctatggagccttccgagtcccaggttttcac

SEQ ID NO: 6800187 - DNA, 69 bp, Homo sapiens
ggcgcgcctgagcccgtgcacggcagcctctccggaaggtgaagcacgctgccgcactgggggcctgcc

SEQ ID NO: 6800188 - DNA, 79 bp, Homo sapiens
ttttccattcctacaagttagaaaggggaatcacagttacccaaatggaaaacttctagcttgagtgaataaaggaaga

SEQ ID NO: 6800189 - DNA, 59 bp, Homo sapiens
aagggagctctaagtagagggaccagcaggcgcaaaggccctgtggtaggagcttcctt

SEQ ID NO: 6800190 - DNA, 74 bp, Homo sapiens
gagtagaatctgggaaaaggtgactcatttgacctgaactgtctccactgatacctttccctgggagactgctc

SEQ ID NO: 6800191 - DNA, 58 bp, Homo sapiens
gtacagggataggatagttgtggcgcatcaacagtgcatttggcatcccttctcttac

SEQ ID NO: 6800192 - DNA, 62 bp, Homo sapiens
gatcaggaagtctgccacaaggctgttctcattattcaacagtctttgtggctatttcgatt

SEQ ID NO: 6800193 - DNA, 81 bp, Homo sapiens
gggaagagctatcatgcatgttctctttttctaccttaacaaagaaatctggagatggaaaactgctggtagtctgctccc

SEQ ID NO: 6800194 - DNA, 128 bp, Homo sapiens
attgtgttttgtaaaagcttctcaagagattctcatgtacagccagggttgagaagtatgtccctagaaaaaaggttccaactttgtcatatattataatcacttgaggaattttgaaaaataccaat

SEQ ID NO: 6800195 - DNA, 55 bp, Homo sapiens
gaaactgagtaggctagagcactgtgaaccttagtgcttggctcatgcagtcttc

SEQ ID NO: 6800196 - DNA, 66 bp, Homo sapiens
gtgcatacagaagtgtgtgtgtaggaatgcacatggcgtgtatgtgtgtagacacttctgtagcac

SEQ ID NO: 6800197 - DNA, 73 bp, Homo sapiens
ggcccaggcctggctttggtttgctgagtatccaggctagcagggagggccagtgtcaagaaagaggagggcc

SEQ ID NO: 6800198 - DNA, 113 bp, Homo sapiens
acctctcccttctacttgaatccacaatgacctgggaggctacagttttgccgtacatcaggcacacaattccaagagcttcctaagtgattcagtggggggagttatcaggt

SEQ ID NO: 6800199 - DNA, 107 bp, Homo sapiens
gccatctgaacaataggttttcataagaaggtaacatccttaatcttatttttagtttcaggatggagtaccttttataactgagaaaacttcttgtgactttgtgc

SEQ ID NO: 6800200 - DNA, 55 bp, Homo sapiens
ggggctgcaaagggcagctgtgactccagggcagagctggcctggtttgagctcc

SEQ ID NO: 6800201 - DNA, 79 bp, Homo sapiens
tagagatttggctctgggatatctttgtcagctttttgagttttccaggtaaaaggttttctagggttgagggtctttg

SEQ ID NO: 6800202 - DNA, 72 bp, Homo sapiens
gtccctagccaacaccttattttctggctgtataagacagcgacccaaaaagcaaagggttgggaggaggac

SEQ ID NO: 6800203 - DNA, 92 bp, Homo sapiens
cccagcccatctggctcagctgctgtgtgagggcccagcgctggtgggcagccagatcgccttacactgcctggggccacggtagagctggg

SEQ ID NO: 6800204 - DNA, 60 bp, Homo sapiens
cgtccaagattagaaaatttgaggatttatttattgactttttgggtttgatctaggatg

SEQ ID NO: 6800205 - DNA, 84 bp, Homo sapiens
gtttcagagaagaaagaaaaagctacctttgtgttcatagctaaacattagtttcttatattggagtctctctttttctgatac

SEQ ID NO: 6800206 - DNA, 70 bp, Homo sapiens
ggcccatacaatagtaaggtatattgtcattcatagctgatgacagccatgatccttactgttttatgcc

SEQ ID NO: 6800207 - DNA, 84 bp, Homo sapiens
ggcctttgaggtcccttcaattctcatagtctagtttttggtgagaagtaggactaggggttgaggcatcttattttgctggcc

SEQ ID NO: 6800208 - DNA, 68 bp, Homo sapiens
tgctgaaacagtggttatgagcatggacttgggaatccaatgcctgagtttgaatcctggatcaagta

SEQ ID NO: 6800209 - DNA, 71 bp, Homo sapiens
gatattctttgatgcttctgaaggtgtgagattgttatttcacataccaccataaagtcaaataaaatgtc

SEQ ID NO: 6800210 - DNA, 61 bp, Homo sapiens
gctgagcatgttcccaggaatgtattaaggattttaatttacatgtctggtcatttttagc

SEQ ID NO: 6800211 - DNA, 55 bp, Homo sapiens
ggcatgcaaagccccttacagacacattcagcctcagaggtggcccttgtatgcc

SEQ ID NO: 6800212 - DNA, 62 bp, Homo sapiens
tacaagctgaatggtgctggggggggtcaatccgcccttctgagcttcaatttcagtctgta

SEQ ID NO: 6800213 - DNA, 65 bp, Homo sapiens
gcgtaactcagagctctgcttgggttcttaggggcttagctgtccctggcagaagcctgatatgc

SEQ ID NO: 6800214 - DNA, 98 bp, Homo sapiens
ggaatagtaaagtcatgttaatatagacagtgagctatgagtggtttgattctcatcccaagctgtcttggttcgctgtttgaatgactgtgatgtcc

SEQ ID NO: 6800215 - DNA, 71 bp, Homo sapiens
gtgcagcaagacaatggagcataaacgtggacaaagaagataagtttgtgtttgtctgcatgtctcgccac

SEQ ID NO: 6800216 - DNA, 74 bp, Homo sapiens
gacctgcctcgattttcctgtcattcctgtgtgccagcatcacacacagtgattggggtatctgcagctttgtc

SEQ ID NO: 6800217 - DNA, 66 bp, Homo sapiens
gatgatggctgttaggaggattggtttgtcaaagcttatttaatggttttccaaccggctatcatc

SEQ ID NO: 6800218 - DNA, 83 bp, Homo sapiens
ccagtctaggtttacagtactcacttgcattgtatcttatttcagaaaatgccagtgcagatattgtggccgttagatgttgg

SEQ ID NO: 6800219 - DNA, 104 bp, Homo sapiens
tgaaggtagtgctattatggtagtcatttgtagagtaggaaagagtggctttgagcagttatgtatcttgcccatgctcttaatcactatgttatactgcctca

SEQ ID NO: 6800220 - DNA, 86 bp, Homo sapiens
aaatttatctgtaatcaaaaggcaataattgttccatatgtcagtggccacatttgtgcctttatgaataagaaacagggatattt

SEQ ID NO: 6800221 - DNA, 76 bp, Homo sapiens
tcactctgttgcctaggctggagtgcagtgacccgatcttggctcactgcaacctctgcctcacgggttcaagtgg

SEQ ID NO: 6800222 - DNA, 78 bp, Homo sapiens
agtcctggtccaagtaattggcggggagtttagacaattgtgcaacctggatgtctttgccatgcatgtgtcagggtt

SEQ ID NO: 6800223 - DNA, 75 bp, Homo sapiens
aatcatgaatgggacattaatgaggtcattagcatttttgggaaaaatgcattatcaattgatgtaggaatgatt

SEQ ID NO: 6800224 - DNA, 86 bp, Homo sapiens
cccggccccggcctctcctcaccctgcctcagctgcacccgatgccttgcagctggtttggggtagaggacaggctggccccgcgg

SEQ ID NO: 6800225 - DNA, 97 bp, Homo sapiens
ctctacacagcttccgagctagcagcagcacacattcagggaacattggagggattttcttcttcttttgtgggtggtaatgttggtggttgtggag

SEQ ID NO: 6800226 - DNA, 87 bp, Homo sapiens
aataagccgcggcatttgtaaaagctagtcaatgatgtattagcctctggattatcataaaactagtttggtaattctgtgattgtt

SEQ ID NO: 6800227 - DNA, 81 bp, Homo sapiens
gtcaggcagttctgggttcaaaccccggccccctgagtagacaaggctgtggacactgagctcagagagagtgtgcttgac

SEQ ID NO: 6800228 - DNA, 64 bp, Homo sapiens
ccttggcgaatcagaccacagcaggactttattaattaaattgctgtaggctgattgctgaagg

SEQ ID NO: 6800229 - DNA, 109 bp, Homo sapiens
atgtgctgaagtgaattctgtttttagcttcgtggttagattgggcatcagttaatgtttaaattgatagtcatttttccactaagttaaaggaaccagtcctgcatat

SEQ ID NO: 6800230 - DNA, 76 bp, Homo sapiens
ggccgaggtgggcggatcacctgaggtcaggagttggagaccagcctggccaacgtggtgaaaccccatctctacc

SEQ ID NO: 6800231 - DNA, 61 bp, Homo sapiens
ccgttgacagctgccacaaaggccatgatgagagtcaatggagatgatgacagtgttgcgg

SEQ ID NO: 6800232 - DNA, 55 bp, Homo sapiens
agagtgatggtgtaactgctgacctacaagcatcacacagaggcatcatcacttt

SEQ ID NO: 6800233 - DNA, 87 bp, Homo sapiens
agtggggtagctttgcaaactttcctctggacctgaaattccagcatccagtaaagtaggaactttgcatctcctgctacctgaact

SEQ ID NO: 6800234 - DNA, 96 bp, Homo sapiens
tgaaaatgttatattaaagttaacattaaggaaatcttggtgtcacacttgaaaacaaggctgtgatgcctattttctgtataaactttattttca

SEQ ID NO: 6800235 - DNA, 89 bp, Homo sapiens
acagagatgcaggcagcgcagcagtgaaacagctgcatatgtttggaaagacttggagctcccgcactgattagctcctgcatttttgt

SEQ ID NO: 6800236 - DNA, 61 bp, Homo sapiens
ccaaccacagttaccccacacactgagaaagggagagctctctttgtgaggtggtggtcgg

SEQ ID NO: 6800237 - DNA, 85 bp, Homo sapiens
gcttatcctcccaggattttgcagacattgtcttttgaagcgagggtctgaagcatgcgtttgtaaactccttcagacaataagt

SEQ ID NO: 6800238 - DNA, 70 bp, Homo sapiens
gaatttagacttcttgcaggtaattcttagagaaacataaaaagaaattggttgtttgaagtgtaggttt

SEQ ID NO: 6800239 - DNA, 62 bp, Homo sapiens
cctgtagggataacaaagaatgagcagtaaatggtacttggttagatggtagtccttgcagg

SEQ ID NO: 6800240 - DNA, 56 bp, Homo sapiens
aaagaatttgtacaccctactacagagcttggcagtggggaatcaacagattcttt

SEQ ID NO: 6800241 - DNA, 66 bp, Homo sapiens
ctctccatcaggccgggcagcagcaaaggccttgtctatggggccagactcctggctgatggtgag

SEQ ID NO: 6800242 - DNA, 67 bp, Homo sapiens
ccacctagtgtttttaagaggagaataacattactaagttgaaatgatcactctgatgctagggtgg

SEQ ID NO: 6800243 - DNA, 80 bp, Homo sapiens
tctgtggccctaatgtgttggacagcttctactgtgaccttcctcggcttctcagactagcctgtaccgacacctacaga

SEQ ID NO: 6800244 - DNA, 86 bp, Homo sapiens
tgtggttccagtgttactaccgtgggtcttcactaggtattactaaaatggagcctggaggggccagggtggtaatggatgccaca

SEQ ID NO: 6800245 - DNA, 72 bp, Homo sapiens
ggtggttcgagtgtagtaggccatatgaacttcatatgattggttttttgtgatggcattacatttatcatc

SEQ ID NO: 6800246 - DNA, 63 bp, Homo sapiens
gtttggctggctgtcagtaggctgtggggctttttccagagcaaatagagaagccagctgggc

SEQ ID NO: 6800247 - DNA, 83 bp, Homo sapiens
agcactcagagcacagcagatctctgatgggggccccccaaatctcttcctccctgagtcagatcaggctgtgacatggtgtt

SEQ ID NO: 6800248 - DNA, 55 bp, Homo sapiens
gcctttcccaatggggtgggtccacagggactagtggcctctgctggggacaggc

SEQ ID NO: 6800249 - DNA, 64 bp, Homo sapiens
ggatctcacagggctgaaatcaaggtgtagactgggttgtgttctcatctggagcctgaggtcc

SEQ ID NO: 6800250 - DNA, 106 bp, Homo sapiens
ggggttccaggaggtcagcggacacagccagggtctcaggaggcgcgctctgcgcgctgtttcctttcttccctgggtgatctcctgcgtggccaaggtttgcccc

SEQ ID NO: 6800251 - DNA, 71 bp, Homo sapiens
tggtgagacacttctgaaggttccaagagttcagaagtctgggcacttgaaatattaggggtgatttacca

SEQ ID NO: 6800252 - DNA, 56 bp, Homo sapiens
ctgcctgcttttctgggagccgggcacacagtaggcgctcaccacgcagcaggcgg

SEQ ID NO: 6800253 - DNA, 84 bp, Homo sapiens
gagagagggagagatggtacagagaaggttacatatgaacacggagattctgtagcacttttgtattctccttggagtactctc

SEQ ID NO: 6800254 - DNA, 59 bp, Homo sapiens
ggcgaattgaaaaagtattgaaggtatttcaatactttttcaatactatttcaatagtc

SEQ ID NO: 6800255 - DNA, 59 bp, Homo sapiens
agtcctgctggattgtgtctggtgctgcttttgaggctctagggtacagcagcagttct

SEQ ID NO: 6800256 - DNA, 64 bp, Homo sapiens
attggcctatgatcttgagagccacctatcaattatactttcaacaggatgataataggctaat

SEQ ID NO: 6800257 - DNA, 62 bp, Homo sapiens
ggaatgtgctgacacgcgagagtggtactggatagccagtggaaatgcgtggcatacgttcc

SEQ ID NO: 6800258 - DNA, 89 bp, Homo sapiens
ggagtttcgctcttgttgcctaggctggagtgtagtggcacaatcatggctcaccacaacctccgcctcccggattcaagcgattctcc

SEQ ID NO: 6800259 - DNA, 92 bp, Homo sapiens
cgcagttagtaagcagattgaaacataggcagtcgagctggggagtccattcctctgaccatcatgttatgccacctctgctctatgctgtg

SEQ ID NO: 6800260 - DNA, 65 bp, Homo sapiens
ttaccagatgggggactatgagaatgtctacaaacttttctgagatttgggttcctcatctgtaa

SEQ ID NO: 6800261 - DNA, 62 bp, Homo sapiens
gcaggaactgtggggtggtagcaggagtggactctctcacatcatgcccacggtctccctgc

SEQ ID NO: 6800262 - DNA, 60 bp, Homo sapiens
attcttattcttgaaatgtgggactctaaaattaagggtcctagtttttaaggtgggaat

SEQ ID NO: 6800263 - DNA, 92 bp, Homo sapiens
gctgactgggaggaagcaaagtggatattcaaataggacatccaggtagaatgaccatcttgtcctgggaaatcccttaggcctgagtcagc

SEQ ID NO: 6800264 - DNA, 68 bp, Homo sapiens
cccagttatgcagttaaagtgcttatcacagaaatgttcttctgggtaattataattgtaattatggg

SEQ ID NO: 6800265 - DNA, 69 bp, Homo sapiens
tatactgtttctcctgtagtgtaaggaccttacaatgtaagtcatcacattgcagagattatcaatatg

SEQ ID NO: 6800266 - DNA, 85 bp, Homo sapiens
aatctggattagccacctttctggtgctcagtcaccaagtgttcaaggcaattggcagtttcatcagacagggcagatctagatt

SEQ ID NO: 6800267 - DNA, 66 bp, Homo sapiens
ggctcttgacacaatgtatattttcaagacccaaaagtttcctgaaaaattacatgttcaggggtc

SEQ ID NO: 6800268 - DNA, 73 bp, Homo sapiens
atcctatttgcttttaagccacataattaaatgcctgttgtttacagtggcctcaaagaaagagaagtagggt

SEQ ID NO: 6800269 - DNA, 80 bp, Homo sapiens
attaggttggtgcaaaagtaattacagtttttgccatagaaagtaatggcaaaaactgatttcttttgcaccaacctaat

SEQ ID NO: 6800270 - DNA, 78 bp, Homo sapiens
aaccctctgaagttattcagtgggctgacatacaatttgcaaagtattgcctcacatgaataatttctctccagggtt

SEQ ID NO: 6800271 - DNA, 58 bp, Homo sapiens
tatcagcaccgcggacagcatccaggcagggaccggggagctgtcctgggtgctagtg

SEQ ID NO: 6800272 - DNA, 86 bp, Homo sapiens
cacatcattcacatcattcagggcctcgttggcatgtccaggcatgttcagtgggaggccattgaatggtttgaaacaggaaagtg

SEQ ID NO: 6800273 - DNA, 65 bp, Homo sapiens
gcttcgttgattttattataaaattgtacctgaattctaaggtatgcattagtagaacggcaagc

SEQ ID NO: 6800274 - DNA, 66 bp, Homo sapiens
gcttgactaattatgttactaatcacttgaagcatcttccatgtgacaatgtaattatgtcagagt

SEQ ID NO: 6800275 - DNA, 76 bp, Homo sapiens
ggccagggagtaggcagtagcttgagatataaggaatttctctttgaggtctcggaactgctgattgctctctgcc

SEQ ID NO: 6800276 - DNA, 69 bp, Homo sapiens
tgggaatctaggttcaaggttggcgggctctagcatggattcttccagagcctagaatcttgattctta

SEQ ID NO: 6800277 - DNA, 97 bp, Homo sapiens
tcttctatcttccccaaagtcctggcatggaattgtccctgaggtaacagtttctgggaccaagatcagcacagaggaaatggggcagggtggggga

SEQ ID NO: 6800278 - DNA, 72 bp, Homo sapiens
gcccgaggcgccccgcgcgttgtcccgcaggttgcttgctgcgaccggaggtggcgtccggggacttcgggc

SEQ ID NO: 6800279 - DNA, 82 bp, Homo sapiens
gtctgcaaggcttggaggtggcgccaggggcagctgctgtcttcagtgctgacttctccctggggttcctccagccacagac

SEQ ID NO: 6800280 - DNA, 96 bp, Homo sapiens
caagctcatgaaaagtatgctaaagaagagagaatgtagaatagcaaaaccagctgggagcctgtctacactttctctgcatatttcatagatttg

SEQ ID NO: 6800281 - DNA, 127 bp, Homo sapiens
cctcctcagaattcaggaccaacaaaatcctctttagcaaggagaaataatcctgctgatccacgaaatgccacaattagcaatttatccttttgctaaagcacttgcgagtccccataggaggagg

SEQ ID NO: 6800282 - DNA, 77 bp, Homo sapiens
ggcaggaagcccccatggggaagggtggggtgtgtgaccccagcagccttgtcccttctcttgggggcggtggtgcc

SEQ ID NO: 6800283 - DNA, 83 bp, Homo sapiens
agtatttgagccatttggaaacacggtcatcttccccactggctcagggtgaggctggccggttccagacatggaatgatgct

SEQ ID NO: 6800284 - DNA, 56 bp, Homo sapiens
cgttctggttgggacgggcaggaagttacggatccaagctggtatcagctagagcg

SEQ ID NO: 6800285 - DNA, 63 bp, Homo sapiens
tatgcaaatcattagatttcctgcatttagctggcaggaaatattgtctaaatggagtgtgta

SEQ ID NO: 6800286 - DNA, 67 bp, Homo sapiens
taggatggctgtggcacctttgcttctccagtgcctggagtcaccatctgtggcagcctgagtccta

SEQ ID NO: 6800287 - DNA, 116 bp, Homo sapiens
actgcttcttgcttcagggtttgctgtgggcagtacataagctacttgacccaatactcatgtgaaagtttattctgcttggccctcccagttgccttgcagacatccaggagagt

SEQ ID NO: 6800288 - DNA, 63 bp, Homo sapiens
gcaattattaagctttctccagtgttagcttgtgctaggccactggtggggtttaaaagaagc

SEQ ID NO: 6800289 - DNA, 66 bp, Homo sapiens
cactatctctttctcaaaatgtaagcaagtttggtttatttgttttagtaagagagggagagagtg

SEQ ID NO: 6800290 - DNA, 89 bp, Homo sapiens
ctgaaactactatgggaatgtacttgttaatagaaagattgttttactaagtcctctctttctgaaagacaatttgatactagttgcag

SEQ ID NO: 6800291 - DNA, 85 bp, Homo sapiens
gcactaagcacttccccactagtggccccatgtggttgtgtgtcatcgctgactacctgttacaggtgaggaagctgggtggtgc

SEQ ID NO: 6800292 - DNA, 65 bp, Homo sapiens
tgcctggatactcattaatttcctatatttttatctgccttgaattattttctgtgtccagtgca

SEQ ID NO: 6800293 - DNA, 56 bp, Homo sapiens
gctgtgaaacctcagtgatagtgatagaaataacattgtatctgggttcattgagc

SEQ ID NO: 6800294 - DNA, 73 bp, Homo sapiens
gcacgtggccaggcgggtggtcctgacgcttcaattcatttacaagtattggattccacgcctgctcctgtgc

SEQ ID NO: 6800295 - DNA, 78 bp, Homo sapiens
taggagacacattgcagttgtttagaatatgtgtaacttcctatttatatttccattaacagcaaatggcagttccta

SEQ ID NO: 6800296 - DNA, 73 bp, Homo sapiens
agaaggaaagaaaggtgaggtctggtcttcaattgaaaattgaagagttgattattatcttcgaacacattct

SEQ ID NO: 6800297 - DNA, 93 bp, Homo sapiens
ctatgaaacatggaatttcagtggtttgatgatgtatatcactttttttgaaggcttatgtatttcaaacttactgcattttttagggtatag

SEQ ID NO: 6800298 - DNA, 63 bp, Homo sapiens
aaacaagagtcttgctccacctttgtctccgagcacctttaaactggagcagggcccttgttt

SEQ ID NO: 6800299 - DNA, 73 bp, Homo sapiens
tgtggctcagcggagctctgctgtgcttttaggattactgtggctcagcggagctctgcacaaagggtccgcg

SEQ ID NO: 6800300 - DNA, 75 bp, Homo sapiens
ttaccgttatactctgaaaacaatagtagcctattattatatttggctttgtactgtcagtggtggaagcggtga

SEQ ID NO: 6800301 - DNA, 81 bp, Homo sapiens
atctgtccaacagtgtctgaaataacaccggatggccggcaaaagggtatccattgtcacaggcgtattggtaccgcaggt

SEQ ID NO: 6800302 - DNA, 79 bp, Homo sapiens
gaccagctagatgattttgatgcagtaaagacaagttaagaaaatttgtctttactgtcaacaagacagtaaacttgtc

SEQ ID NO: 6800303 - DNA, 92 bp, Homo sapiens
ccaggaggaagggatggagagggaaggaggccatgtgtcccaaaggggaaccctgggggagtggtcctttcctatctgccactggtgcctgg

SEQ ID NO: 6800304 - DNA, 57 bp, Homo sapiens
tcaggaggctgaggttgcagtgagccgagattgtgccactgcattccagcctggtga

SEQ ID NO: 6800305 - DNA, 81 bp, Homo sapiens
ttggctcccaatcccctgccgtctccaatcattgcaatgcaaattcgatagaaaagagctgcaggggtccctggcagctga

SEQ ID NO: 6800306 - DNA, 84 bp, Homo sapiens
ggaaggggtcatttgcaaagactggcttaacagtagtatgcaaaatataactgtgagagaggttcttggtattaaccaactttc

SEQ ID NO: 6800307 - DNA, 68 bp, Homo sapiens
gctttgttgcccaggctggtcctgaactcctgggctccagtgatcttcccgcctgggcctccaaaagt

SEQ ID NO: 6800308 - DNA, 77 bp, Homo sapiens
gtttctcccctgctgaagaacgttcatacgagttatgtgaacccagtaaaaatgtatctgtcagcaagaagagtaat

SEQ ID NO: 6800309 - DNA, 125 bp, Homo sapiens
ggcaaaaataggcaggtttttgatagctctcggggaaggaggtacattcaaaactgctgccctttctgaaatgttcaagtgtctttctctctccaagtggcttcagaacactgaaaactgtgacc

SEQ ID NO: 6800310 - DNA, 97 bp, Homo sapiens
tgttagagatctgactggcagcttcaggacactcggaagcaagggggacactctattaaggatcgctgaagtatgcccacatgtcaggtttctctca

SEQ ID NO: 6800311 - DNA, 61 bp, Homo sapiens
gacactgtgtgacttctgagactaggctagaaaaggccaagctcaagctacacacagagtc

SEQ ID NO: 6800312 - DNA, 129 bp, Homo sapiens
gactttgattaatcttattctcttgaccatcagtactatagcttattaatccacaaagtattataaagtacctgctttggaaataagaggctaaatggtaataatgggggagagtttagttctgaagtc

SEQ ID NO: 6800313 - DNA, 61 bp, Homo sapiens
ggggtacagaataaaaatcctacaggataaaattccagcctgtttatttcctctgtacctt

SEQ ID NO: 6800314 - DNA, 92 bp, Homo sapiens
gatgggatcactctttctgggctccttgggagcaagtgagaggaagcccttacctgcaccagcagcctccataaggaagggagcatccgatc

SEQ ID NO: 6800315 - DNA, 57 bp, Homo sapiens
gcggcggagacagcaggaagccccaaaacccgagctgggtttcctgcttggagtcgc

SEQ ID NO: 6800316 - DNA, 60 bp, Homo sapiens
tgtgtttgcagcagaaaagcagacactaaactgaaatgtgtaatgcctgtgataagcaca

SEQ ID NO: 6800317 - DNA, 76 bp, Homo sapiens
ctcttacatgcacacaaatgtgaacgtgcctctgatgttactccaagataggtagtgcatattttggatgtaagag

SEQ ID NO: 6800318 - DNA, 61 bp, Homo sapiens
ttctgtcttctcggttgtttacctaattccccaacagaacagtaagtcttaggagacagag

SEQ ID NO: 6800319 - DNA, 70 bp, Homo sapiens
aaaatgggccaggctgctgactgctaaagaaaaacacaaattgggtacatagcaggatttggtttatttt

SEQ ID NO: 6800320 - DNA, 71 bp, Homo sapiens
tgcttgagcccaggttgaggctgcagtgagctgtaagcatgccactgcactctagcctaggtgacagagca

SEQ ID NO: 6800321 - DNA, 61 bp, Homo sapiens
gccttcataggagaatttaagcacagaagatctgcctgtttccttctgtctctttggaggc

SEQ ID NO: 6800322 - DNA, 55 bp, Homo sapiens
tcccagggccgcaaacgagtttgggcggaagccagggctttggggcttcctggga

SEQ ID NO: 6800323 - DNA, 72 bp, Homo sapiens
gaaccccactgcattttggctagttaaagttaattgcataattattgctttgctggcttgaaatgctggttc

SEQ ID NO: 6800324 - DNA, 107 bp, Homo sapiens
aacattgggttcttttgtgttctaccttcaaaacaatctgtttgcatttgaaatataagtgtttaagctttttaggagttagtgtaataagagaatgtgaatatgtt

SEQ ID NO: 6800325 - DNA, 65 bp, Homo sapiens
tattgttgttgtgagggggatgaattatttatacaaatttctccctttaaaccagaacaatgata

SEQ ID NO: 6800326 - DNA, 59 bp, Homo sapiens
gctggcatttggtctggccaaaaagccaaaatggctttgatagttgattaaattccagt

SEQ ID NO: 6800327 - DNA, 100 bp, Homo sapiens
ctgttaaggggccccctctactttaacatggaggcacttgctgtgacatgacaaaaataagtgcttccatgtttgagtgtggtggttcctacctaatcag

SEQ ID NO: 6800328 - DNA, 87 bp, Homo sapiens
cgcttatcagcagatctcaggagagtgttcagtggaggccctgccggtctgcacagctcacctccctgggaactgctcgcctgagcg

SEQ ID NO: 6800329 - DNA, 101 bp, Homo sapiens
cagccagtcaaactccagggtgactctgtctgaccagattccagcatcctctcttagtatctgttctaaccactaggcgtgccttggcctttgcctggttg

SEQ ID NO: 6800330 - DNA, 55 bp, Homo sapiens
gcattacaggctgtaagatgcagtaacctatattgtaaggtattctctgttgtgc

SEQ ID NO: 6800331 - DNA, 86 bp, Homo sapiens
cactcatggttggtattgaggggtgatgaggcactggctttgggggagccaggcagactctctttcttcttctccttcgtgggttg

SEQ ID NO: 6800332 - DNA, 77 bp, Homo sapiens
gactttacagaccctgagttacagatatatatcagggaaaaaatgtgctatttctgtaactcagggtctgtaaagtc

SEQ ID NO: 6800333 - DNA, 56 bp, Homo sapiens
tgctatcagattaagcattttccttgtgaaaaatggaaagtgttaagtaagtagca

SEQ ID NO: 6800334 - DNA, 64 bp, Homo sapiens
ggagagagtttggaaaagtccttaatagaacagagtttgtaaaagacatttctaagcaatttcc

SEQ ID NO: 6800335 - DNA, 64 bp, Homo sapiens
ctccagtgcgtcttagtaaaccatctctgtgaaatggttaagtttacttagaaggtaactggag

SEQ ID NO: 6800336 - DNA, 83 bp, Homo sapiens
acagcagcaaatatgtgggtggctatttggctgcagctctatgtagctatagaggctgtacctttgcattgtgcccgtgctgt

SEQ ID NO: 6800337 - DNA, 64 bp, Homo sapiens
aaagctgctttataatctcggcagagctgttttcactgcttttttgggaacgtaatccaggttt

SEQ ID NO: 6800338 - DNA, 65 bp, Homo sapiens
tccttttctgcaccttgcgatgtgaactttgatattctgtaatgtctggggcgccagaagagaga

SEQ ID NO: 6800339 - DNA, 69 bp, Homo sapiens
actcctgtgtggctgggaggttaccagatagccccgtcccgtccctccacccagccttcacacaggagt

SEQ ID NO: 6800340 - DNA, 77 bp, Homo sapiens
gtgaagagcaagatgcttagaagcagattatctggtttgaaaacccagatctgagtatgatttgcctgaatcttcat

SEQ ID NO: 6800341 - DNA, 74 bp, Homo sapiens
gggctgagagtgatttgggagagccagctgcagggctcctgggctcagatcagctccctcccccacacctgccc

SEQ ID NO: 6800342 - DNA, 115 bp, Homo sapiens
ccagaccatagaattgtgaaggccatgcactgtgcaactcaggaaatgtcatttgcatagcctgtgagaaaatggcaacccctggagttgtggaacaccatggtcttggtcatgg

SEQ ID NO: 6800343 - DNA, 91 bp, Homo sapiens
ggactgtggcagctatggtctaagggccaacaccgttcagcattagccgattgttgccgtataggactttgggaccatggctaccagagcc

SEQ ID NO: 6800344 - DNA, 68 bp, Homo sapiens
cttaataggtggtgggattaaaaatgttttgcagttacttgacaacatgatcccacctgcctataaag

SEQ ID NO: 6800345 - DNA, 64 bp, Homo sapiens
tcctggaagtgcgtcaagcagctggacagaaatcacagtgtggacactggttggcacttaggga

SEQ ID NO: 6800346 - DNA, 68 bp, Homo sapiens
tcagctccttagtgcctctgcacgagacagagaaattacttcactcctccagtaggttctaagactga

SEQ ID NO: 6800347 - DNA, 129 bp, Homo sapiens
aatcttcagtatgttggcttttcaaacctgtctcatgaagcaatggcagagaatttgtcaccgactcttggtggtcaaagccagtgttcttgttgccatttgaagctgccagtgttttaaactaaattt

SEQ ID NO: 6800348 - DNA, 57 bp, Homo sapiens
gaggaggcaggtgcagcctcagttagcaggaagcccctgagaagctcctgtctcctc

SEQ ID NO: 6800349 - DNA, 79 bp, Homo sapiens
tgttccatgccaaatttctttctgttctgatgattcaaaccttagcagtcagacagagctgaacttggtcctggtaata

SEQ ID NO: 6800350 - DNA, 116 bp, Homo sapiens
gctatagtaacacatctatggttaggtggcgactgatgtatgtccgactttaaaaccagtgttttgtttacagtcagcttacattagttgatgatatataccatagagcatatagc

SEQ ID NO: 6800351 - DNA, 94 bp, Homo sapiens
ccagtgaacaaggctccctggctctgcaccctcatcagtcaaatgggggaaacctcatggcagtggggtgaggattcagtgagaggcacactgg

SEQ ID NO: 6800352 - DNA, 85 bp, Homo sapiens
ctggaagggataagaaataggactctaggggctttggaggagcctggctcttccaatacctagattttggacttctagcctccag

SEQ ID NO: 6800353 - DNA, 77 bp, Homo sapiens
tactgcaaaatgttggaggaaatattatacactatctaaatgtgaaattaatgtttttctcaacattgctgtaagta

SEQ ID NO: 6800354 - DNA, 84 bp, Homo sapiens
tttgcagtgccagactttgtttgggaatccctttgtgatccaaacagagaattcttcaacaaagtatttggatgttgctgcaag

SEQ ID NO: 6800355 - DNA, 62 bp, Homo sapiens
atgtttcctcttatgcaaattgggagctagaagagttgtacagtgtaaataagtggatgcat

SEQ ID NO: 6800356 - DNA, 98 bp, Homo sapiens
tctgagaaggggtcattttgctggtgctaaggccgggagcttattctgatgctgcgggctctctgactggcctttcacctgcagcccccaagctcagg

SEQ ID NO: 6800357 - DNA, 78 bp, Homo sapiens
tgtttcttctctgtggcttgggcctgcctgtcatcaatataatagaatgatggaagtgcaagctatagacaccagaca

SEQ ID NO: 6800358 - DNA, 74 bp, Homo sapiens
tctgggtcatagttattttgcaagagaaataagctttccatcctctcttgcatttagagactattaatccatga

SEQ ID NO: 6800359 - DNA, 129 bp, Homo sapiens
tgagtatgataaaaaatgaaacttgatttagtgctttgaatgtaaataaaaggtgacatattaactgattttatcatctttatgtttgaaagtacaatctcaggagatttgaatttaatatcactacca

SEQ ID NO: 6800360 - DNA, 69 bp, Homo sapiens
gtggcatgactctttgggctgcccaatttaaagagaattacattgaacagaaaaactcagagagcccac

SEQ ID NO: 6800361 - DNA, 69 bp, Homo sapiens
gcggtcggcagaggggctctgctcatcacaggctatcaaggatgacagcagacccctcccttctgccgc

SEQ ID NO: 6800362 - DNA, 72 bp, Homo sapiens
gggctgtgtccccgctgcctcccctttgacctcccctttgacctctgcgggagggagctggccacacagcct

SEQ ID NO: 6800363 - DNA, 123 bp, Homo sapiens
cgcgcctgaagggtttctttctaataatggccctggtgcttgcgcaagtctagactgtcagctcccagagggaaggcggctggcagctggctctgcgcaggctgggggcgcctcccgggcgtg

SEQ ID NO: 6800364 - DNA, 62 bp, Homo sapiens
gcagtgacactcagtggctctgtcccatgcatgttaaatgggaagagcctggggtgtcaggc

SEQ ID NO: 6800365 - DNA, 73 bp, Homo sapiens
cctggctccacaggcatgttacattgttccaggagcatccgtagggaacagtaactgtctgctgtgttccagg

SEQ ID NO: 6800366 - DNA, 85 bp, Homo sapiens
gccttaagcagaaaagctaagtgaaggaaaaccgtctttcttttcaacttcctgacttcttttatagtgaattttcttggagggc

SEQ ID NO: 6800367 - DNA, 58 bp, Homo sapiens
ttgctgagggcagatgaattagaggtctctgactgagctcttatttttcccttaacaa

SEQ ID NO: 6800368 - DNA, 55 bp, Homo sapiens
gtatttttagtagagtcggggtctcaccatgttgcccaggctgaattaaaaatat

SEQ ID NO: 6800369 - DNA, 111 bp, Homo sapiens
ctggtgagagcagacctatttgtgaggctcttttctgctgtgtctgacttcaggccaagccaggaagcagcaagaaagaactcactcatggagccctttgttctgggccag

SEQ ID NO: 6800370 - DNA, 82 bp, Homo sapiens
atctggggttacgattattcacagatgtattggaactcctacacaatgggagctactttgtgaaaagtgaaatactccagat

SEQ ID NO: 6800371 - DNA, 63 bp, Homo sapiens
ctgtagttccctgtggttgctgccctctgttatttggggtagttagcattcagggagctggag

SEQ ID NO: 6800372 - DNA, 77 bp, Homo sapiens
cacaaagacagaattagcttttctgaaacaccttgctgacgcctccagcattctgaagggctaagtgtctataagtg

SEQ ID NO: 6800373 - DNA, 63 bp, Homo sapiens
tgccttttactctaagtgaaatgggaagactttgataaacattgagcaaaggagtaaaatgca

SEQ ID NO: 6800374 - DNA, 62 bp, Homo sapiens
tttaatcttcaaaatagtcttatgttgtagcttcttttgctgttcctattttggagattaaa

SEQ ID NO: 6800375 - DNA, 58 bp, Homo sapiens
tcttgcttttctgtgctttcctcagactgtaacaacagcagccacagaacttgcagga

SEQ ID NO: 6800376 - DNA, 56 bp, Homo sapiens
aagatgcctgccagtgcagttctgtctttctcatgggactctacacaggccatctt

SEQ ID NO: 6800377 - DNA, 80 bp, Homo sapiens
gggaaagtgacagaggcaagaccagaagcccaagctcttgcacttggcagcctggcatcttgacctgcctggactccccc

SEQ ID NO: 6800378 - DNA, 82 bp, Homo sapiens
ttcaatccttacaacaatcctgtgagtagatagtattgttatttccattgtaaagacaaactaaagctcacagaggtttgga

SEQ ID NO: 6800379 - DNA, 61 bp, Homo sapiens
ggggcgccggtaggagccggggatggctgcgtccctcaggctgtcttccttctggtgtctc

SEQ ID NO: 6800380 - DNA, 70 bp, Homo sapiens
tggccaggatggtcttcatttggctctcccaccttcctgtcatggagggctatgaaaccatacttgggca

SEQ ID NO: 6800381 - DNA, 75 bp, Homo sapiens
agagggtagcaggagcagcctgcctagaaagcgtggccccacccttctggggtagtgctgcccgcaaacacccct

SEQ ID NO: 6800382 - DNA, 124 bp, Homo sapiens
ccacactgggtaaggagagcagcaaatgggtgagagaacaacttggggttgctgtgggaaggatgcaagggaaatccttcagccatgggctctccacttcctctcgcccccaaacctcagtggg

SEQ ID NO: 6800383 - DNA, 82 bp, Homo sapiens
ccagacactggggccttgggaggagaacaaagctccccttggagctctgggtgagccattctactcctaacccttgtgctgg

SEQ ID NO: 6800384 - DNA, 102 bp, Homo sapiens
tgcgggtcagcaataggcgcgattcaaaggggacagtactttgcactctgacaaaaaggggataaggctatcttttgagtgtgttcatgtgcatggtttgca

SEQ ID NO: 6800385 - DNA, 59 bp, Homo sapiens
gagtttgtcctttgggaatgtgtctcaggaaagtcacagtgagatccaagggcaggctt

SEQ ID NO: 6800386 - DNA, 57 bp, Homo sapiens
agggctactttcctgagtccctgttcacaaaatcgcccggacccaggaaagagtcct

SEQ ID NO: 6800387 - DNA, 65 bp, Homo sapiens
ctcctgcctgtgggactgaggagcagcccaagaactggggtcccacgggtctccgcagcagagag

SEQ ID NO: 6800388 - DNA, 95 bp, Homo sapiens
gctaaggatctaaggttgacttgaatcaaaatttgacttacatttcccctagtgcttaaagcttgattcgaagcttaaatacttgggttcaaagt

SEQ ID NO: 6800389 - DNA, 64 bp, Homo sapiens
caggacaggagtggggtcaaagtccaagattaaaaaggaccctttgcataccctccctgtgctg

SEQ ID NO: 6800390 - DNA, 58 bp, Homo sapiens
ggtgccacgagtcaccttccaggcaaggagtcccagctgatggagacttgtggcctcc

SEQ ID NO: 6800391 - DNA, 68 bp, Homo sapiens
gaactgctttatctgagaagtcctttaaattgcttcgtctgaggaaaagaagagggtaaaggcagttc

SEQ ID NO: 6800392 - DNA, 55 bp, Homo sapiens
tgtccagggaaggtgtgaggctgggcaagtttatttcccccttcctccctgggga

SEQ ID NO: 6800393 - DNA, 86 bp, Homo sapiens
gcagctcgtttgtaacttgggcaagttatttcattggaacaatgtaggcagtcatattggagtaagttgaggagcaaccgagtggc

SEQ ID NO: 6800394 - DNA, 130 bp, Homo sapiens
ccaaagtcacttccacattttggggtatgtttttagcagtgccccactctactggtacaaatttactgtattagtccattttcacactgctgatacagatatacctgagaccaggtaatttatacagggg

SEQ ID NO: 6800395 - DNA, 57 bp, Homo sapiens
ataatttcaacactgcatcctccctacttaacagttaaggggaatgtgttgatttat

SEQ ID NO: 6800396 - DNA, 94 bp, Homo sapiens
catgatctcagccctcaaaaaccttgagcctctgcctggcagtcccagacaaaggcatcggcaattagggagcattgatgagggcaagagcatg

SEQ ID NO: 6800397 - DNA, 55 bp, Homo sapiens
gcacaaagccaaatgaaagatggttcttgccttccaggaacttttggctttgtgt

SEQ ID NO: 6800398 - DNA, 56 bp, Homo sapiens
ttttgattttgaaagaaattacctcattttacagatgaggtagctcagactcaaag

SEQ ID NO: 6800399 - DNA, 58 bp, Homo sapiens
cttcttcatgtattgatagtcttctagcacaggaagattgtctgaatgagtgaagggg

SEQ ID NO: 6800400 - DNA, 70 bp, Homo sapiens
ttgaatggtctaggctcagtagggttcaaggcaggaaacaattttatcctctgctgatatagcttttcaa

SEQ ID NO: 6800401 - DNA, 65 bp, Homo sapiens
ttcctattgggatcctgacaaatctgcagttctgacagtctttgtaatgatcctactatgctgaa

SEQ ID NO: 6800402 - DNA, 82 bp, Homo sapiens
gtaagatttcaatttctggcatctttatcagcagtcagttaattttgtatctttgaagtatacggaaattgtggaaatctgc

SEQ ID NO: 6800403 - DNA, 86 bp, Homo sapiens
gggattttctcttccctctggacctgtcccccaccaaccagcaaatagctcctgggcctaggttgagggagagagagaagtgaccc

SEQ ID NO: 6800404 - DNA, 80 bp, Homo sapiens
cagggcaattgaggcttagtcaatcagactcaatgagccgcacttcattgatttttggatctgagctgcaatggcgcctg

SEQ ID NO: 6800405 - DNA, 80 bp, Homo sapiens
ggctgagaagtccagaggtccaggatcaaggcatcaccacatttgatgtctggtgagggcctgccttctggttcatagtc

SEQ ID NO: 6800406 - DNA, 95 bp, Homo sapiens
agtggtaaagggattatagtgaggtcatatagcgaactccagaaggaacacaggcatctggactcctgtctggctttctttgagactgaactgct

SEQ ID NO: 6800407 - DNA, 57 bp, Homo sapiens
ttgtggcttattctaatttaaagctgtctggcttagtgaatttcggtatggctataa

SEQ ID NO: 6800408 - DNA, 64 bp, Homo sapiens
ctcttcagttgttgcatattctactgttggctttaattttcctttgtatatgagcactggagag

SEQ ID NO: 6800409 - DNA, 78 bp, Homo sapiens
gtcaggctgttgacacaatcatggcagacatttcccaagatgccgagatgactgctggcatttgtcaacaatcctgtc

SEQ ID NO: 6800410 - DNA, 61 bp, Homo sapiens
tgtcagtcactgaatctctgtactcaaagaagaagtcttggacatagatcagtgattgaca

SEQ ID NO: 6800411 - DNA, 77 bp, Homo sapiens
ttcacaacacattgccagagatcagcagggggaaaatatgcacaacacaattctgcattcaggtaaagtgtactgaa

SEQ ID NO: 6800412 - DNA, 57 bp, Homo sapiens
ggagtagattctgggaagatggctacaggggcagcaacatcattttaaaatctctcc

SEQ ID NO: 6800413 - DNA, 67 bp, Homo sapiens
aggcagctgagtgttggcatgttcagggaactttaaaattaactgcatttctgacacacagttgctt

SEQ ID NO: 6800414 - DNA, 66 bp, Homo sapiens
ggtcaccatgtcattttctttctttcattcacggaagttactgtagaagagaatgattccatgatt

SEQ ID NO: 6800415 - DNA, 66 bp, Homo sapiens
gcttgggagtctgggcctgatggctaaagccccttctaatctagggtagcctagagcccttccagc

SEQ ID NO: 6800416 - DNA, 88 bp, Homo sapiens
gtgtggcagtggcgggtgctgtggcagctcctcctctcctctcctgacagagtagtgagtcagtcaccctggacctgctgacctacac

SEQ ID NO: 6800417 - DNA, 69 bp, Homo sapiens
ggagggtgggcaaggtccctgccagctctgtctctgggaccagtgggcaggggcctctgcctcaccccc

SEQ ID NO: 6800418 - DNA, 79 bp, Homo sapiens
tgctttcaaactgcaacatgttgctttaataatatttaacagaatatttacgggacagcagttctagttgtggaatgca

SEQ ID NO: 6800419 - DNA, 64 bp, Homo sapiens
actgcggctttgagtcagtaattcctgctcccctttctgcagggtctaggctgggggctgtagt

SEQ ID NO: 6800420 - DNA, 76 bp, Homo sapiens
gggagcccggggtaggccctgaggcagctctgctcccccctcagggaggcctcagcctgccctgaacactggcccc

SEQ ID NO: 6800421 - DNA, 91 bp, Homo sapiens
gggagccactggctggagaccagctgcctcccagggccctgccagggctggcacagagggctggtgtttctattcccagggcctggctccc

SEQ ID NO: 6800422 - DNA, 58 bp, Homo sapiens
tggtaccagcttctttgggtttcttcggtagcagggtggagtcaggtggctggtgcca

SEQ ID NO: 6800423 - DNA, 127 bp, Homo sapiens
ccccagcctgcttcctgcctgatggctcaggtgtccccatgctggtcatgctggctcaggctgcaggagcaagcctgggagacttccctgcctctgccactttgtgtgggtaattgtgctttagggg

SEQ ID NO: 6800424 - DNA, 67 bp, Homo sapiens
gacctctgcaagagcttcaaggtagaaagcacaattctgacatctttctgggttctgcagacttgtc

SEQ ID NO: 6800425 - DNA, 73 bp, Homo sapiens
gcaataatgccacataaggagaaaaaaatctcattgggaccatcattccctgtgtctccttggtgggatatgc

SEQ ID NO: 6800426 - DNA, 67 bp, Homo sapiens
gagatttcaaggcaaaagtgacaattagtggtagcaacacctttgggaatttactgcctaaaatctc

SEQ ID NO: 6800427 - DNA, 74 bp, Homo sapiens
ggaatttgggtcacaaggtactgtaagaaaaattaaacattagttttcatgaatttccttgagaaacaggtttt

SEQ ID NO: 6800428 - DNA, 58 bp, Homo sapiens
ccattcagtatgtctattctctgtctcattccaggacagagtacagtgtgcttagtgg

SEQ ID NO: 6800429 - DNA, 62 bp, Homo sapiens
aacacttgaactgatctatactcaatgagaggaggtcattgattacaggaagttcaagtgtt

SEQ ID NO: 6800430 - DNA, 64 bp, Homo sapiens
tattcttggaattgacagtgttgtaccctgctagcacttacatgatgtgttaattccaatgata

SEQ ID NO: 6800431 - DNA, 80 bp, Homo sapiens
caatggtgaaattacgggattttttaagttaatggcatctatggcattgtttgtaaaattccagtagcccttcataactg

SEQ ID NO: 6800432 - DNA, 88 bp, Homo sapiens
ttcccactcctgagtagtagcattgtcaacatataatatgaaagccatcaattcattctgacagtgtttgcacttcaggtggtaagaa

SEQ ID NO: 6800433 - DNA, 89 bp, Homo sapiens
gcagccggatcataaggaacaaagacaggtggtgtctggggagtccctgtccaggctttttcatgctgtctccctcctgtgaggcttgc

SEQ ID NO: 6800434 - DNA, 58 bp, Homo sapiens
tggatgggactaatgagctcctcgggggtctctattttaagggtgctaatcccattca

SEQ ID NO: 6800435 - DNA, 113 bp, Homo sapiens
aggttcctcaaaaaaacctctgtctgtttattcatcagttaatgtaagtatgtagcatcattgcttctttaaatgatagtcaacaaggagagagaataatgaggacaggacct

SEQ ID NO: 6800436 - DNA, 64 bp, Homo sapiens
tcaaagtgtctttatatttgagaaaagtctgcatttgtatttctcttaaatagagccacttaga

SEQ ID NO: 6800437 - DNA, 78 bp, Homo sapiens
agggaaaattacaagtttcagtgttttgcaaggtgtaacggcatattttatggcaatactgagattattgtactccct

SEQ ID NO: 6800438 - DNA, 65 bp, Homo sapiens
ggatacattccactagtgactggcgggggaaagacacatgtcctgccaggcacgtgagagtggcc

SEQ ID NO: 6800439 - DNA, 122 bp, Homo sapiens
tgaggtctgtaatttctttaatagttttgttctggtgttgggtcttgcttttagtcattgtgctatggttaggtaagatgttaacagctgagataactgggtgaagaatattcagaaactta

SEQ ID NO: 6800440 - DNA, 117 bp, Homo sapiens
cagtgccaggtgactctggctaagatgctctagggctgaattttttaatgccagctttcccaggggatcagtaaaggttttgccctgggtattccaaccaggagagcctgtgtcctg

SEQ ID NO: 6800441 - DNA, 78 bp, Homo sapiens
gaacttgatgagtaggtatgaggcccacaggagcccttctggagctctttggtcgcatcatccatttcttccgagttc

SEQ ID NO: 6800442 - DNA, 82 bp, Homo sapiens
ttaaaattagttgcattcaggatatgacgatcgaatataatagtttatagattatgcgtccatattcatgagctgagtttaa

SEQ ID NO: 6800443 - DNA, 56 bp, Homo sapiens
gtgtgtgtgcctgcacacacacacatgcacatgcgtgtgtgcgcacacacacacac

SEQ ID NO: 6800444 - DNA, 85 bp, Homo sapiens
aggtgaggctgggaagtccaagaccaagatgccacagattcagttcttggtgagggccttcttcccagtttgcagatggacacct

SEQ ID NO: 6800445 - DNA, 69 bp, Homo sapiens
gccagggtttctatgaggcctgaagcctggagcctgtcataggcaactgcagtctgaggcctccctggc

SEQ ID NO: 6800446 - DNA, 84 bp, Homo sapiens
tgccaggaacataccaagttttgtatacagctagacactcaagagcaagtatagctgtttatcaagttcttgagtcttctggca

SEQ ID NO: 6800447 - DNA, 57 bp, Homo sapiens
tgcaggtgctccgggggtgccccatccaagcttggcacattcttggtgcaccttgta

SEQ ID NO: 6800448 - DNA, 93 bp, Homo sapiens
tccacctctgaagcccatgttcttcccattaccccacgatcctggccaagaatcagggcagatgtgcatgatgggaagggcggcgtggatgga

SEQ ID NO: 6800449 - DNA, 101 bp, Homo sapiens
ggagccacagaaggtgcaggtaccctggaggcaccaggagggcaggcatggcttggcatagacctgcagacctgggcccccaggggcactgggtggcgtcc

SEQ ID NO: 6800450 - DNA, 81 bp, Homo sapiens
gaatagaaattacttattttgattcctcgggggtttgttttgtcaaaactcatgtagtatttaggaaagtaatcattgttc

SEQ ID NO: 6800451 - DNA, 75 bp, Homo sapiens
ggaggccggggaggaagtccagatcaagtcaccagcagtttctgcatctggtgaaggctggccctttctgcttcc

SEQ ID NO: 6800452 - DNA, 82 bp, Homo sapiens
cccagtgggatttgtaaatgatgcttaatagactttaaaagcctatttaaagttagacagcatcatttctcagaatgctggg

SEQ ID NO: 6800453 - DNA, 55 bp, Homo sapiens
ggcctgcttactgattgttgtttaatgccagtaagcagcaaaaggaaagcagatc

SEQ ID NO: 6800454 - DNA, 82 bp, Homo sapiens
gagccttgatttcctcatctgtaaaacggggctgggaaggcctagctcccaggcagtcatgaggacagaagagaacaggctc

SEQ ID NO: 6800455 - DNA, 83 bp, Homo sapiens
tcgaaagcctggagccaggaccttgcccagcacatcaagtgacatcaccctgaggctcaaggtctggtggaggtgcatttcgg

SEQ ID NO: 6800456 - DNA, 68 bp, Homo sapiens
gcagagacttttatctctggagtttaaagacttctatctctttaagtccaagaggaaaggtttcctgt

SEQ ID NO: 6800457 - DNA, 65 bp, Homo sapiens
cccacttcttactcctgggatttggtaaacggaagagacctctcctgttccgggagtaggccggg

SEQ ID NO: 6800458 - DNA, 76 bp, Homo sapiens
gggaaagcagaaggttggggctggaggtctgctggcaggcaggcagacatttggagccaactttcctgctcagccc

SEQ ID NO: 6800459 - DNA, 84 bp, Homo sapiens
atgagcggaggaggtgacgaaaagaaattgtcctgagaggaagccaagggcaaaactttactcttgtagcctttactccgtagt

SEQ ID NO: 6800460 - DNA, 67 bp, Homo sapiens
ggcccagtgtgggtggatgttgaactcctgcagttaccattacagctcctgccaacactgatgggct

SEQ ID NO: 6800461 - DNA, 64 bp, Homo sapiens
aggctcacccagggtcaagagactccagcagcctggctgctgcaaggcttgaacctgttgactt

SEQ ID NO: 6800462 - DNA, 71 bp, Homo sapiens
ttctaaggcttgaagtcagatctgaccctcgaagttgacactccagcctctttgactctcaggtctttgaa

SEQ ID NO: 6800463 - DNA, 55 bp, Homo sapiens
tgcccctgacctcaggcgaaggagggggttctcatcctttcctgagctcagggca

SEQ ID NO: 6800464 - DNA, 69 bp, Homo sapiens
ttgtcataatataaaaactgacttactaacttagattatttggagagttaagtgcttgtgttattgcaa

SEQ ID NO: 6800465 - DNA, 84 bp, Homo sapiens
gctagtgtcatgtcatataagagctttagagtcagttgagtttagatcttggctttcccacttattatatgtatgacattcagc

SEQ ID NO: 6800466 - DNA, 80 bp, Homo sapiens
ggactcaaggccagttcttctgactctgcagccagaagaatgaatgtaataaaagtcaggcagctgagctttatgggttc

SEQ ID NO: 6800467 - DNA, 71 bp, Homo sapiens
ttttagggttgccatggctttaatttgattgttatttattgagcattcaaactgtgttaggcagcataaag

SEQ ID NO: 6800468 - DNA, 65 bp, Homo sapiens
cgctttctgcagctgccagtgatttcagcttcccaaggtatggacttgcagctgccagatgagcg

SEQ ID NO: 6800469 - DNA, 77 bp, Homo sapiens
gatgtgcaaatttactcttgagacattgtaattttgaaagcaaatgtcttctctgtaggtaaatttactgcattttc

SEQ ID NO: 6800470 - DNA, 60 bp, Homo sapiens
gactgtggactctcatgatagagataaacttttattttctgtcttgtttaggccactgtt

SEQ ID NO: 6800471 - DNA, 61 bp, Homo sapiens
attctacacaaagcaagaagactggtgttgccagtgggtttctaacatgccttgtgagaat

SEQ ID NO: 6800472 - DNA, 118 bp, Homo sapiens
tggtggagaatgggttaggaatcatgtagacatgggagacctacattatgaaacatagaaaaatatcatattagacacttatgtccactggacttctttcttagcctcacttctacca

SEQ ID NO: 6800473 - DNA, 82 bp, Homo sapiens
ccaagtatttgtgctacaaatgagttgtatgaaccagtgcaacagcttgctttctattccttcatttccaggacaaatatgg

SEQ ID NO: 6800474 - DNA, 66 bp, Homo sapiens
tgctgggcatcgtaggaggtactgaaaacttgtgaggaaaagttcctattttcaatgattttggca

SEQ ID NO: 6800475 - DNA, 56 bp, Homo sapiens
ggggttggtgcctttataaagaacacaacacgtatctgctgaatggagccaacctc

SEQ ID NO: 6800476 - DNA, 85 bp, Homo sapiens
gaatttaattttgaaaagtctacttgcaattgagtatcctatcctttgtagctattgttgccaagtactttgaaaagttgaattt

SEQ ID NO: 6800477 - DNA, 57 bp, Homo sapiens
aggccacaagaaaatgcttcatgccaacagtgagtatgagatgtggatgtgatgcct

SEQ ID NO: 6800478 - DNA, 61 bp, Homo sapiens
tctttgatttcttgaggcattggagaaatgaaagtcatcaccatgcaacagaaagagaaga

SEQ ID NO: 6800479 - DNA, 71 bp, Homo sapiens
ggaggaaattggagtagatattgtacaattgacaacatcacagctgtaaaataattctccatgttttcttc

SEQ ID NO: 6800480 - DNA, 90 bp, Homo sapiens
gtaggtgctctcctgggtgtccatccggccacctccagccccacacatgaatgagtgggctgcagagctgggtgggcctccgagccctgc

SEQ ID NO: 6800481 - DNA, 60 bp, Homo sapiens
cttggttaggttatgaatgcccacacagttttgtgtgggtattcattcatttatgctaag

SEQ ID NO: 6800482 - DNA, 70 bp, Homo sapiens
gtggataatggccaaatctctatttttctgagtagccaaacttagcggtcagcatttagcctttatccac

SEQ ID NO: 6800483 - DNA, 60 bp, Homo sapiens
ccttgaaggccaccttattggaacgtgaggtcctgccctcggccaatgttggccccaagg

SEQ ID NO: 6800484 - DNA, 103 bp, Homo sapiens
ggcgcccagaatatttaatacccggccctttatgaaaagctctgtgtacctatgtttagaggggacagaaaaatgagggagctggattaattttctaaggccc

SEQ ID NO: 6800485 - DNA, 92 bp, Homo sapiens
ggtcaggcagtggtgtcccttttggggtgagggtggtggagggggctattctatgcccaatgtaggccccaggaggttgtaccagccatgtc

SEQ ID NO: 6800486 - DNA, 79 bp, Homo sapiens
ggggcttttctatgctcctgagtgtgcaggagatgctaatgacagcacctcttgcccttgttaggactagacaggcctc

SEQ ID NO: 6800487 - DNA, 68 bp, Homo sapiens
gcatctaaattccaccatggggttcaaattttttaaatgaaatcttagacccttggtagaaaaagagc

SEQ ID NO: 6800488 - DNA, 87 bp, Homo sapiens
ggatagaatgaggtttgagcctcttgacccagtctactgagatctgggactgctttggtcatgaagctacacaaacctttctcttcc

SEQ ID NO: 6800489 - DNA, 56 bp, Homo sapiens
gctccagtcttggcttggtcaatgtctggcacaacacagcaattaagactgtgggc

SEQ ID NO: 6800490 - DNA, 72 bp, Homo sapiens
atgagttgggacagggaatctgatcccctgttgatttctctcaagggaggaaggggccctgcctttactcat

SEQ ID NO: 6800491 - DNA, 81 bp, Homo sapiens
ggccttggaaaagacacttcacctttcccagcctcagatccctaaagttcaaggcagggcaggtggcgtgtgcccatggcc

SEQ ID NO: 6800492 - DNA, 63 bp, Homo sapiens
caaaaatccataagaatctaaagacttgtttcaaaataagtgctttggatgatgtgggatgtg

SEQ ID NO: 6800493 - DNA, 60 bp, Homo sapiens
gggtgaatgttgcttagcgtatcgcaatgcatcattgcttcatgcttctgacaatagctc

SEQ ID NO: 6800494 - DNA, 64 bp, Homo sapiens
ggcttggaattggtaggatgtatgttagctccagctggcaataagaatcttaataattctggcc

SEQ ID NO: 6800495 - DNA, 75 bp, Homo sapiens
gcactattagaatccatggttgcagtggcccctgaagccctgctgaatcccatggagtctggttgttaacagtgc

SEQ ID NO: 6800496 - DNA, 58 bp, Homo sapiens
acccaggctggagtgcagtgatacaaactccacttgctgcaaactccgcctcctgggt

SEQ ID NO: 6800497 - DNA, 91 bp, Homo sapiens
tttaaagaagtttgacaaagtaaaatgacaatatccagataagacatgggcattctaaagtgtcttttagtttgtgagatctgactttaaa

SEQ ID NO: 6800498 - DNA, 78 bp, Homo sapiens
gatgatgcctccccaaaccatggagtaagttcacatgctggagcatgttaacagctgcttctggtgtcaggcattgtt

SEQ ID NO: 6800499 - DNA, 62 bp, Homo sapiens
gtttgtcatgctttccttatggacttctggttatgcctccttaaggatgtgggctgagggat

SEQ ID NO: 6800500 - DNA, 61 bp, Homo sapiens
gttacctgaatgtcttattgctcgttgtatctagcatacaaacaatagatattcagtaagc

SEQ ID NO: 6800501 - DNA, 123 bp, Homo sapiens
tgtaatttcttcagaagcggtagttttgaggtatctgtctttaattgtgggatcctgtaggtgcagacagtatggttctggtaatttaaggcacctcagagcatcaccttttgctgatctgca

SEQ ID NO: 6800502 - DNA, 103 bp, Homo sapiens
gatattcattgctaaatttacaagatttggctgaaactccaaacgtctgtcctatcacggtggagtattagtcagtctttaaaacctttagcttactgtactc

SEQ ID NO: 6800503 - DNA, 73 bp, Homo sapiens
gtggggtgctatttcagattgaagggtcagcgaggtcctgcagaagagcttcaatttaaatggaagccaccac

SEQ ID NO: 6800504 - DNA, 73 bp, Homo sapiens
gcttgaacccgggaggcggaggttgcagtgagccaagcttgtgccactgtactccagccttggcgacaagagc

SEQ ID NO: 6800505 - DNA, 103 bp, Homo sapiens
cctgctctgctctgctctgccctggctgagggacctcgggtaagtcatgttacctctctctacctcagtttccccagccattaaatagagtcagcaaagtagg

SEQ ID NO: 6800506 - DNA, 76 bp, Homo sapiens
ctggacagaaaatagtatatatttatctttgggattgaaacaggttaaaaaaatagtgttactcagttttgtccag

SEQ ID NO: 6800507 - DNA, 69 bp, Homo sapiens
gttagcagtaaagcacgtctatttaatgatcagcctaagctgatccatggtgatgtctttaaagttggc

SEQ ID NO: 6800508 - DNA, 86 bp, Homo sapiens
tttgacagcttgagggctagatgtatatacctggtgtggaatgcaaagaccattctccaatataacatttggtacctccgatcaag

SEQ ID NO: 6800509 - DNA, 98 bp, Homo sapiens
gagggctgtgatttgctttaaatttcatggtacatcgtgacttgctcaggttgcatagttgataagctgtaaagtttgaattataatcgcttttcctc

SEQ ID NO: 6800510 - DNA, 71 bp, Homo sapiens
ggatctgtggaccgtcttactggctacctggtgttgtaagattatttgagctcaaggcagtccacatttcc

SEQ ID NO: 6800511 - DNA, 83 bp, Homo sapiens
ggggctccttgtggcctgccctgacagcagtgatgggctgtgcctgcccagctatgtgtgcagggacaggatggggagccgcc

SEQ ID NO: 6800512 - DNA, 74 bp, Homo sapiens
aaaaagagattatacttgtttttaccatttgtgtcctagatgtagtacactggtaggaagagatggctctattt

SEQ ID NO: 6800513 - DNA, 130 bp, Homo sapiens
ctcagaagaataggcttgttgttttacagtgttagtgatccattccctttgacgatccctaggtggagatggggcatgaggatcctccaggggaaaagctcactaccactgggcaacaaccctaggtcag

SEQ ID NO: 6800514 - DNA, 57 bp, Homo sapiens
caggagaggagagacagcctacctattcggtcttgctgtccccatgctccatccctg

SEQ ID NO: 6800515 - DNA, 60 bp, Homo sapiens
tctctgaggtttcctcacaagctgttgagttagaagcagccttcaggcaatgtcagtaga

SEQ ID NO: 6800516 - DNA, 63 bp, Homo sapiens
gggagctgtaagggacaggtagctaaaaataatgacagagatgcacggtttcattacagtccc

SEQ ID NO: 6800517 - DNA, 64 bp, Homo sapiens
gcgtgtggtgaggccccttaggctgggttctggtctagtgccaggggcaccactactccaccgc

SEQ ID NO: 6800518 - DNA, 89 bp, Homo sapiens
ttccaattgcttcatttcctcaggctttactatgttgctgctacagaaagaaatacttggggacagtggggtaaaaaaacactttggga

SEQ ID NO: 6800519 - DNA, 60 bp, Homo sapiens
gtgaggagggctggtcccaggccctgccacctggggaccctggtgtcccaaccctcccat

SEQ ID NO: 6800520 - DNA, 55 bp, Homo sapiens
gccacatgcaattgcagcacgtaacatcagtattatttctgtatgcatctgtggt

SEQ ID NO: 6800521 - DNA, 56 bp, Homo sapiens
ccagagctctttgatccactgccaggcctcgggcaatggagccaaggtgtgtctgg

SEQ ID NO: 6800522 - DNA, 58 bp, Homo sapiens
catgtcagcatcaaaaattatgagtcgtgttgatagtatgaacttttgatgtgacatg

SEQ ID NO: 6800523 - DNA, 66 bp, Homo sapiens
tatctaagagagtcaatatttataccggccaaggattaagtatattaggtggcttttgtttagata

SEQ ID NO: 6800524 - DNA, 76 bp, Homo sapiens
cttcatgcctgaaaggaggccacatggctaggacagagctgtgtctaaagccgaaggcctccatgatcagatgagg

SEQ ID NO: 6800525 - DNA, 67 bp, Homo sapiens
agatgctgtcttgctggctttgagggtacagaaaagactcacaggccgagaaatgcaggcagcttct

SEQ ID NO: 6800526 - DNA, 72 bp, Homo sapiens
tcagcaagcacatgaaaatgtgaagctggatgcactgagaggcatcaacagtttcattcatttgcatgctga

SEQ ID NO: 6800527 - DNA, 81 bp, Homo sapiens
tctaactcaaaatccataaaatcaggttggcgccccaaatctgccactagttacctctttctatggattttttgggccagg

SEQ ID NO: 6800528 - DNA, 77 bp, Homo sapiens
ctcaggagaaacacgttttgggggttgtttaatgtctaggcacgacttgcctgcaccctctgctatgtgctcctggg

SEQ ID NO: 6800529 - DNA, 91 bp, Homo sapiens
gagtacttcttggacagcttcaggagtcaaaccacctgcaaagaatcatcaggcctgcctccattgaaagctgtctattgggaagggactc

SEQ ID NO: 6800530 - DNA, 77 bp, Homo sapiens
gtcaagagggcactgcttttacctaggtgagagacagtggtggcttggaccagggtgggagcagtagaattcttgac

SEQ ID NO: 6800531 - DNA, 65 bp, Homo sapiens
aatttttagtcagacattgagcatctaatatgtgcacagcattgttcaaagtttgcctaaagatt

SEQ ID NO: 6800532 - DNA, 59 bp, Homo sapiens
tccacttactgtgtaattaaaatgattgtcactgtgattatcttatactcgtaggtgga

SEQ ID NO: 6800533 - DNA, 105 bp, Homo sapiens
gcattattagggtagtaacaatgatagctaccgtttatgctgtgctaactagggcacagttataagactaagctattcgcatacatctaatctttataataatgc

SEQ ID NO: 6800534 - DNA, 77 bp, Homo sapiens
ggaaatgtggtaaacattactgtgctgtatagcttctttggttttatagagctcagttgtgttttgtaaatataacc

SEQ ID NO: 6800535 - DNA, 66 bp, Homo sapiens
agagcaggcataaagctttgaagacctacagacctggctctaattcctagctctgctatttgctct

SEQ ID NO: 6800536 - DNA, 72 bp, Homo sapiens
tttacctactgttttctttatagtacagcagatttttaaattagtttgtaatggagcaaacaggttggtgaa

SEQ ID NO: 6800537 - DNA, 130 bp, Homo sapiens
tttgccgcttagtggggctccggcggtgggatgggtctctgccgtgagctttcgcgagccgctcttggcagcctggaatgcgaggctagctcacgcttctcttacacctctcttgcccttctggtggtaa

SEQ ID NO: 6800538 - DNA, 68 bp, Homo sapiens
agtactggtctcagcagattgaggagggtaccacagtagtcaccacgcagtccgctgagattagagct

SEQ ID NO: 6800539 - DNA, 88 bp, Homo sapiens
aggcccagggtggcaagggccagaggccatcctcctgctgccctgctctggggcagacatgggctcctcggcctgcgtacctgggctt

SEQ ID NO: 6800540 - DNA, 78 bp, Homo sapiens
gttaatccttcttgcaacttagtggcagctctggcccccacagtctacttgagcttgtataattcatgaagttttgac

SEQ ID NO: 6800541 - DNA, 55 bp, Homo sapiens
ccttccctgatcacgtgtcaggagttttgtaaccccaaggacatttcagggttgg

SEQ ID NO: 6800542 - DNA, 57 bp, Homo sapiens
tgtctgtgcccaaggctcccgggattagcacaatcagcaggtggctggggacggaca

SEQ ID NO: 6800543 - DNA, 102 bp, Homo sapiens
tcctgcattaacttgtcttgtgtgcactgtgaaaagttcaaccttaaaggaaaaaaggaaatttctgacttttatatgcatatgagacagttgtttaaagga

SEQ ID NO: 6800544 - DNA, 62 bp, Homo sapiens
gtcttctggccaacttgcttgttggcataacctgtcgacttgtctgtgtggcccatgagggc

SEQ ID NO: 6800545 - DNA, 67 bp, Homo sapiens
ggacagctgagaggcctgggcccgtgagctcttgcagaggagttgacacgcagaggggctgctgtcc

SEQ ID NO: 6800546 - DNA, 67 bp, Homo sapiens
cacaggagagcctttgaagggaagtgaaatgattggatttgaattcctaaataacggctgccctgtg

SEQ ID NO: 6800547 - DNA, 78 bp, Homo sapiens
caggcctaatcacatgcagggcctccacccaggatgctgggagcctggcctggctctgtgtgttctggttaggttctg

SEQ ID NO: 6800548 - DNA, 72 bp, Homo sapiens
gttggaaaagggatggagggaccaatgctgaatagtaaaggaaccagctgtcccagcctttctttctccagc

SEQ ID NO: 6800549 - DNA, 77 bp, Homo sapiens
agacatgtggactagatctggaacagcctgaagtttagagccaaactcagctaaactcagtctatgtccacctatct

SEQ ID NO: 6800550 - DNA, 91 bp, Homo sapiens
atttaaacaaaaagagtttggtgaagcaatttgaaaaacatgtaaatatttttattagtgttaaatttgcctagattctagttgattaaat

SEQ ID NO: 6800551 - DNA, 83 bp, Homo sapiens
gaggaacgtgcccccacagccagctccctcccctgcagggcctgagggctcagtgcgggatggggctgcagggctatctcctc

SEQ ID NO: 6800552 - DNA, 60 bp, Homo sapiens
acactttaagcatttcacactgtttatgaaggccctaccttccaggtggaattaatgtgt

SEQ ID NO: 6800553 - DNA, 87 bp, Homo sapiens
ggctgttttcatctcctttattggcatttttcctcagctggagtagccctttactccacataaagtcagcagaggggaagaacagct

SEQ ID NO: 6800554 - DNA, 111 bp, Homo sapiens
tcagctactgtagattggtacattactcactgactgcaagtcaagttaaacttgaaagcctggatttaacttaacttggtcatgatatattgtcttttatacaattgttgg

SEQ ID NO: 6800555 - DNA, 76 bp, Homo sapiens
gaggcctaagactcctaaatagccgttggaagggtagtgtttttccaagggaatgtttatgagtaactagaggatc

SEQ ID NO: 6800556 - DNA, 126 bp, Homo sapiens
tcagagtcacatatggagttttgtagaaatgtacacgtccagattcagcccctagagattgcgattcactaggggtgttatggggaccagttgtatatttttaaaaacacaccacagggattctga

SEQ ID NO: 6800557 - DNA, 89 bp, Homo sapiens
agtagggtaagtactagaacttctaactaaggtcagagaagtaaagtaactctcctaaggccacatagcaagttttaggcttcctagct

SEQ ID NO: 6800558 - DNA, 63 bp, Homo sapiens
agcatggcacagaggtctccgatacttcatcttaaaggatggcattgcagcctctcccatgtt

SEQ ID NO: 6800559 - DNA, 130 bp, Homo sapiens
agttgcgaacagctgtatcagagatcaggcggggtcactgcacgctcaggcaggccgcgtggatttgtctgctggtccctgcagtgtgctgggcgggacactccttgatctctccatgctgtcaccgggt

SEQ ID NO: 6800560 - DNA, 58 bp, Homo sapiens
cttccctttcttaaagagttaggcagtgatatacatgtcatttagaagtaaagggagg

SEQ ID NO: 6800561 - DNA, 98 bp, Homo sapiens
gcagtggaagtggctgcaagagcaacagtggcagtggtgggacccctttgcccagcgtcccctgtgccctgtgttcctgaggcagccgactctgctgc

SEQ ID NO: 6800562 - DNA, 74 bp, Homo sapiens
ttgatttttctcagggaggtgtgaactgaggaatataccgtattttcctgcacagcccttcctgagatgttcag

SEQ ID NO: 6800563 - DNA, 129 bp, Homo sapiens
cctggggacacccaatatttactgcctgaggcctaagtccttcccaagcatgtacctacagatctgtacctgagaggtgatgatgaggaggcttttcaggctcaggcagatgaagagctcagctccagg

SEQ ID NO: 6800564 - DNA, 104 bp, Homo sapiens
catggaaaggtattgttttggtcatgaaaaatctccatttaatgtttaaatcattatttggcttacacgatattttctggagaactatgcctcataaatccatg

SEQ ID NO: 6800565 - DNA, 82 bp, Homo sapiens
gcaactctgtaaagctcatcattaggaggctaccaagaagaataggatagtcctcccacccatgaggagctaacagttctgc

SEQ ID NO: 6800566 - DNA, 59 bp, Homo sapiens
gtgtgtgtgtgtgtggggagggtttgtctccagggtcagaagtcacatacatatgatac

SEQ ID NO: 6800567 - DNA, 77 bp, Homo sapiens
gtaagttcgtcagtggtcataaagatattttgtctgatggcagaaggcctgaatctttgttcccataaaagacttac

SEQ ID NO: 6800568 - DNA, 77 bp, Homo sapiens
tacaggaaaagaggtccaggctcaaaaggttgttatttgtccaaggtcacacagctgacagagcctttttcactgta

SEQ ID NO: 6800569 - DNA, 82 bp, Homo sapiens
ttgtgccttagtttccgtggctatagaatggggataataatagcaccagtctctgtgtgttgtcaggaggattaaggcacag

SEQ ID NO: 6800570 - DNA, 91 bp, Homo sapiens
gtggccctgcatgacacagcttgcctccccctcttaggaactgtgagtaataaactgttctttcaaaggcagctgtttctgtgtctgtcac

SEQ ID NO: 6800571 - DNA, 58 bp, Homo sapiens
cctcactgtcatcagtagttatggctgtctcttccagattactgctggagatgttagg

SEQ ID NO: 6800572 - DNA, 96 bp, Homo sapiens
ttcaggtgttggaagttctcttttctttctggataaaataaatgttaactgtgtgttttggcttcttggagggcaggaaggcttcagttatctgaa

SEQ ID NO: 6800573 - DNA, 90 bp, Homo sapiens
tctttgccctaaaagtgtagactatttttatggttctgaatacagccctcctttcagatccgtggattataatttagatatcagcacaga

SEQ ID NO: 6800574 - DNA, 56 bp, Homo sapiens
ggctgttcctctaacattgcagaggccactgggaaaatccctgcagatgagcagcc

SEQ ID NO: 6800575 - DNA, 59 bp, Homo sapiens
ggtagtttgaggttttggagcaggtcatgaccatgcagcaatctagaaacccagactct

SEQ ID NO: 6800576 - DNA, 64 bp, Homo sapiens
ggatgaggtgggctcaagtcacttgctcctaagttattcatctggaagcagagcccatgcattc

SEQ ID NO: 6800577 - DNA, 64 bp, Homo sapiens
gagaaaggcccagtggaaacagcttgcaataacacatccagaatgacctattgggccatttctt

SEQ ID NO: 6800578 - DNA, 80 bp, Homo sapiens
tgcagggcatatgaaggcagtgtgacatattgaaaggaaattgaacccatttttaggtctgcctctattgcctacctgca

SEQ ID NO: 6800579 - DNA, 85 bp, Homo sapiens
tcccagggtctgagattaggctggaaccactggccagaaacttagtttcatggcaggcttcttcagcctttctggcatctgcgga

SEQ ID NO: 6800580 - DNA, 92 bp, Homo sapiens
ggctatggacagctttcaacactgccttcttggccttcaaaaccttcgctttggttttggctttaggaggggcaggagctttcttctttgcc

SEQ ID NO: 6800581 - DNA, 77 bp, Homo sapiens
gatttacagcaacctaaatccactaactagctcgcatttcagttgcctattggtgcatgtaggtgatgctttatttc

SEQ ID NO: 6800582 - DNA, 80 bp, Homo sapiens
acattttctggatatatgtcttcgtcacctatctcacaggtttgttgtgaggcgtaaatgaagatagtatgtgaatatgt

SEQ ID NO: 6800583 - DNA, 56 bp, Homo sapiens
agcaccaagcaggctcaagcacggctgaaccaagcactgtgaccctgttgggtgtt

SEQ ID NO: 6800584 - DNA, 65 bp, Homo sapiens
ggcctggaatgctttcctaccactttccccaccctgtgggctttagggtcagagagatccaggct

SEQ ID NO: 6800585 - DNA, 76 bp, Homo sapiens
tattagattggtgcagaagtaattgcggttactttttaattgcaaaaatcacaattacttttgcaccaacataata

SEQ ID NO: 6800586 - DNA, 119 bp, Homo sapiens
atatattatatataatatatatatatatatgcattaacattgtaggaggagtaacttgaacctttctaacatagatgcaagtttgtgcatatgtgtttatgtgtgtaaataaaatatat

SEQ ID NO: 6800587 - DNA, 77 bp, Homo sapiens
atgaaatatcaatagctggtatattgggagatttacataattgatgctcttctaatggttcagatatattaattcat

SEQ ID NO: 6800588 - DNA, 57 bp, Homo sapiens
ttgactgggatcagctagatgattcttgtgcagagtctctcatgtggttgcagtcag

SEQ ID NO: 6800589 - DNA, 101 bp, Homo sapiens
ggagtctggctctgtcactgaggctggagtgcagtggcgccatctaggctcactgcaacctccacctcccgagttcaagtgattctcctgcctcagactcc

SEQ ID NO: 6800590 - DNA, 61 bp, Homo sapiens
agtgccatggaggaacagatgccaaagaaagcttattcaagtcctttcctccatggcgact

SEQ ID NO: 6800591 - DNA, 68 bp, Homo sapiens
tatcagtcctattcccagtgagcaaatgttaatgtcatttaaatagaatctgaggaaaggatttgatg

SEQ ID NO: 6800592 - DNA, 95 bp, Homo sapiens
tagacaatgacagttttccagattggttgaactgatttgcatttccaacaacaatgcaaaccagttcaaccaatctggaaaactctcagtgtcta

SEQ ID NO: 6800593 - DNA, 89 bp, Homo sapiens
cgagtatacgttagcatgtcagtcgccacacgtctcagtgacgtgcgcttcagggcacgtgggcgaaatggcatcctgactccaacttg

SEQ ID NO: 6800594 - DNA, 66 bp, Homo sapiens
ccatgacaagtacaatggttagatgcatttgtattgcagagacaatcagaagttgtgcatgcatgg

SEQ ID NO: 6800595 - DNA, 55 bp, Homo sapiens
tgcaagggtagaagtgatggcattaagaaaagagtgccagctttgaatacttgta

SEQ ID NO: 6800596 - DNA, 74 bp, Homo sapiens
ctgataaatacttgtcagatgaataagagtttaatgttttctaaaattttaattttgagcaagtatttgattag

SEQ ID NO: 6800597 - DNA, 86 bp, Homo sapiens
taaacaaagactcttaacatggggggtaagtctgcatggcaaattcatgtagaccttttctgtcttaggagaggttattttgttta

SEQ ID NO: 6800598 - DNA, 58 bp, Homo sapiens
gctgctgggatcctgggtctcagccgtggctggggctgcatcagcaggacccggcagc

SEQ ID NO: 6800599 - DNA, 92 bp, Homo sapiens
ttgggtcactgctttggatgactggtgcaggttcaacctagcaaaacaattaggaaaccagtttagtcatgctgtaagcggtatcacaccaa

SEQ ID NO: 6800600 - DNA, 68 bp, Homo sapiens
gagatggggtctcactatgttacccaggctggtcttgaactcctgggcttaagtgatctgcccccctc

SEQ ID NO: 6800601 - DNA, 70 bp, Homo sapiens
ggccaagatgtaagtgacaaaaagaaatgtaaggtatactactttactgttcatgttgtacacttgggct

SEQ ID NO: 6800602 - DNA, 126 bp, Homo sapiens
gctgtgattctgctttgtggactttacacaagctgtcacaatatcccaatctgccacagatgttctgggtagcattggttttattgggtgataagggccacgtggcagactcgtacccactatagc

SEQ ID NO: 6800603 - DNA, 55 bp, Homo sapiens
gggcctgctccccatcgctgctcttcctccagggcagggtccatggaggcagccc

SEQ ID NO: 6800604 - DNA, 72 bp, Homo sapiens
ggagatgtggccattatccagttaatttgatcattgtaacaaccagaactgataatggacacataaaaagcc

SEQ ID NO: 6800605 - DNA, 55 bp, Homo sapiens
ctgggtagctgctgctccttcagcctggggaccatatgaagcagagctaccccag

SEQ ID NO: 6800606 - DNA, 71 bp, Homo sapiens
acacgaggatctgatggacagggctggaggtgcagctcctgtgcctctctgtaagggtccctccctcgtgt

SEQ ID NO: 6800607 - DNA, 119 bp, Homo sapiens
ggttgcttccaagaataaaatggttgttttaagaatgttttcccttttttctcttttatttactggtgggcagaggagagaacattatataaacagaacatcagttaattaattgcacc

SEQ ID NO: 6800608 - DNA, 96 bp, Homo sapiens
tgtggtgtggggagcggtcctgtgcattgcagggtgttcagcagcatccctggtgtctatccagtcagtgccggtagcacccctccagtcatcaca

SEQ ID NO: 6800609 - DNA, 80 bp, Homo sapiens
ttgccggtgcttagagctggaaaactgcaggtagggctgagatggatcctgtttgtcagcgtctgttctgtactttgcaa

SEQ ID NO: 6800610 - DNA, 69 bp, Homo sapiens
gatggatgccttaaggcgagatacttaagtcacaccaacttcagtttcttcatctgtaaggatgctgtt

SEQ ID NO: 6800611 - DNA, 68 bp, Homo sapiens
gggcaaggaagagcaggtggtgctagagtctggtctctatggggatggcccagctgtgcttccagccc

SEQ ID NO: 6800612 - DNA, 67 bp, Homo sapiens
ggtgctgaaaggacttggggcttataggtatgcaatctacttatgagcaaccttctcctccagcacc

SEQ ID NO: 6800613 - DNA, 57 bp, Homo sapiens
gagagaggggaagagaagctctgggttgcatgctgctgggagctcttcccttttctc

SEQ ID NO: 6800614 - DNA, 72 bp, Homo sapiens
aaataaatgtataggcactaaacctcaaggtggttactaagacctccagatttagtgcctatacatttattt

SEQ ID NO: 6800615 - DNA, 114 bp, Homo sapiens
cagcaggatagagttacagaatttattaggagttgagtgtcaaacttccgtgtaataacttacagcaagacagaccgctcaatttgcctgggagttagcaaaatctacaagctg

SEQ ID NO: 6800616 - DNA, 91 bp, Homo sapiens
tgcccacatgcactttgatggagagcgtcccaggctggggacacacaccaaggcttgccatcacgttcttttcatcagtgtaacagcggta

SEQ ID NO: 6800617 - DNA, 71 bp, Homo sapiens
cgatggatttgggctgcagcaattattagtgtggcattggcctattggtagttttgtatttctctcctttg

SEQ ID NO: 6800618 - DNA, 67 bp, Homo sapiens
tccagctggttgaagaggagctggactgtgctcaggagcgcctggccactgccctgcaaaagctgga

SEQ ID NO: 6800619 - DNA, 64 bp, Homo sapiens
ccatgcgcacccaggggaagctgtcccttcatcatcactggccacccctgagagtgtgtgcagg

SEQ ID NO: 6800620 - DNA, 56 bp, Homo sapiens
ccctgctgccttcacccaggacagcagacagactagccaggatgatgcaagcaggg

SEQ ID NO: 6800621 - DNA, 58 bp, Homo sapiens
gctgatccttttatgtctagcttgatgtttacagtaactctggaggtagagggttagt

SEQ ID NO: 6800622 - DNA, 62 bp, Homo sapiens
gggcggatcatttgtggtcaggagttcgagaccagcctgaccaacgtggtgaaaccctgtct

SEQ ID NO: 6800623 - DNA, 76 bp, Homo sapiens
ggaatatggctgaatggaaaagacattgatcctaagagctagcttaggaaatattgatttcagtcacctatcttcc

SEQ ID NO: 6800624 - DNA, 124 bp, Homo sapiens
actccttggtgcactgtttctactttgggtgctgatctggagtggttgctatgttttgtgctcgcctgtcctccaggtgcagaaggactcagggtggaatttgaccggcagtgctcctcagagt

SEQ ID NO: 6800625 - DNA, 61 bp, Homo sapiens
gatgctcctggcatcctgcttttaactacttcagggttaatgacaggcctgccagagcctc

SEQ ID NO: 6800626 - DNA, 64 bp, Homo sapiens
actggaatgtgatccatgtgaagaacagaatttattctgtttaattcaccatcatgttcccagt

SEQ ID NO: 6800627 - DNA, 59 bp, Homo sapiens
atggacaggtactgcagtgggtggcagatggccacataatgatcatagtccttgaccat

SEQ ID NO: 6800628 - DNA, 79 bp, Homo sapiens
catgaattttgttatctcagactgagttacttgtagctccacagtgttaaagtaataacaggctagtaataaaataatg

SEQ ID NO: 6800629 - DNA, 76 bp, Homo sapiens
gtgcctcccagccccacatgagctgtctcgtagggccaagacagcacttttgtatgggggtctgtttcagaggcac

SEQ ID NO: 6800630 - DNA, 72 bp, Homo sapiens
ggcagcccctttctcctgtgaggtcagaagttgttaggtttagctgaagctgcagcaggaggaagggtggtc

SEQ ID NO: 6800631 - DNA, 60 bp, Homo sapiens
ccctgggagcctggcagttgctgagcccatacgcctcagggactggtgagcttccagtgg

SEQ ID NO: 6800632 - DNA, 65 bp, Homo sapiens
gtgatgggtatttggggtgatgggtatttgccttcagggtctgcctcagagaaacagctgcacac

SEQ ID NO: 6800633 - DNA, 99 bp, Homo sapiens
acctgctatggctctgttggcatccctgggcgggtctccaagcttgtggtcgcatgcctgccctggagattggcctggcttgccaacaggaaggcaggt

SEQ ID NO: 6800634 - DNA, 55 bp, Homo sapiens
tgtctgtcatctgttcagtgctcaataaatcttggcctaaaaatgatgacatgca

SEQ ID NO: 6800635 - DNA, 59 bp, Homo sapiens
gagcttttcccgtctttctcgtgctgcgttcaagcacgatgcagggacggcaggggttt

SEQ ID NO: 6800636 - DNA, 59 bp, Homo sapiens
agcaggtttgttttcttctgaggcctctctccttggcttgcagatggctgctgcttgct

SEQ ID NO: 6800637 - DNA, 99 bp, Homo sapiens
accaaaaacatggggaaaatgtaaggtgctcatgtatttctatgtttgttttattctataaaggaatttctaacttttattttcctcatggtatgtggt

SEQ ID NO: 6800638 - DNA, 63 bp, Homo sapiens
gtggcacagagatggggcatgaacaccctgcagaggggactcccagcctcttctcttgcatac

SEQ ID NO: 6800639 - DNA, 68 bp, Homo sapiens
catgtacatagatcttgaaaattagctggacttaagtaggcatttagttttcaagctttagtttagtg

SEQ ID NO: 6800640 - DNA, 57 bp, Homo sapiens
ggccccaggtagaagatatagaagcaaaggggatacttctgtgatttctgtggggtc

SEQ ID NO: 6800641 - DNA, 62 bp, Homo sapiens
tccaggcttatacttgacatttgtctcttttaaattgaaaacaaatgttacataagtttgga

SEQ ID NO: 6800642 - DNA, 73 bp, Homo sapiens
gctgaacagtggtgccttgctccagtgcctctgaagggcttggaaattgcaggacacagctttactgctcagc

SEQ ID NO: 6800643 - DNA, 91 bp, Homo sapiens
gtaaagattgatttgaataacagtgggttttccttgcggtaaagtagaaatacaattagaggaggaagctcataatttatctcagctttat

SEQ ID NO: 6800644 - DNA, 57 bp, Homo sapiens
tttctttccagagtgattggcacaggttgaggggctgggagttacttaggaaggaga

SEQ ID NO: 6800645 - DNA, 94 bp, Homo sapiens
tgtgaggttgggaggtagagcagacatggcttggatgtggcagggtcagatgctgtggcctgggcagatgtggtggcttccacgaacctctgca

SEQ ID NO: 6800646 - DNA, 129 bp, Homo sapiens
ctatatagacgttgtacatgccggatttattttgaggcgaacgcaatcattttgaaatgcctagttttcaaagtaaaaatgtgttcacgttacaaaaccactgtagcaagacatttctattaaaaatag

SEQ ID NO: 6800647 - DNA, 95 bp, Homo sapiens
gtgggcatttataggagtctgagtcctcatagacaaggacaagcggaccagtgttttaatgagggccatttattaaacggctaatgaaatcctac

SEQ ID NO: 6800648 - DNA, 57 bp, Homo sapiens
aacacaggaaattggtaaatggagagaaactgttgtccctttgctttcatctgtgtt

SEQ ID NO: 6800649 - DNA, 56 bp, Homo sapiens
taatttaattgtgtggtgctggggtgtttttccccctagcaaatacatcaaaattg

SEQ ID NO: 6800650 - DNA, 73 bp, Homo sapiens
aggggatcgaaggacaagcttagtccactggtccagagggaatcagtacagcttagtcttctcaaaaccccct

SEQ ID NO: 6800651 - DNA, 72 bp, Homo sapiens
tcttcccaatattctgcttttatgtttcatcctgcaggcacctcctcatatagagcaaggatgtcaggaagg

SEQ ID NO: 6800652 - DNA, 78 bp, Homo sapiens
gcttatttcaaactggttgcctcccctgtaaaatgccatttatggcaactggctgagagggagctatttatagtaagc

SEQ ID NO: 6800653 - DNA, 79 bp, Homo sapiens
gttttgggtacatgtggagttttctagtcaaagcaaagagagatttggaattggctgagttctccaggagtagtcatgc

SEQ ID NO: 6800654 - DNA, 75 bp, Homo sapiens
tgtggagctccagcatctgggttaaaattccggctgtatcctttactggctgtgtaacctcaggcaagttcctca

SEQ ID NO: 6800655 - DNA, 64 bp, Homo sapiens
aaatgtgtgcacaaagacagcttctcattatccttagtggttttcagtcttggtgctcacattt

SEQ ID NO: 6800656 - DNA, 63 bp, Homo sapiens
ggattataggaaggtcactgtgaggctagatgaatttggctgcacttacctctcctgctgtct

SEQ ID NO: 6800657 - DNA, 62 bp, Homo sapiens
aagcctcctaattgccactctggaaagtatcaagttgtggtccatcagcatttcaggggctt

SEQ ID NO: 6800658 - DNA, 71 bp, Homo sapiens
caacatcaatcctcagaaactagtactccatggaatacattttgagaaatgctagcttaggaatcatgttg

SEQ ID NO: 6800659 - DNA, 67 bp, Homo sapiens
tcctgatccccttcccagtaagcctttggggcagcaggtattgaggctgcttgggaagaggatagga

SEQ ID NO: 6800660 - DNA, 103 bp, Homo sapiens
gcaggggcagaggcacggataaccacatttggttcattgcaggcgccggggacatcactcaggcccggcaaggagccagtcatccagactgcatgtgccctgc

SEQ ID NO: 6800661 - DNA, 62 bp, Homo sapiens
tgttgcatgtggctgtttgccaaggcacacaaagtgcttgtaggcagcaaccatatgctaca

SEQ ID NO: 6800662 - DNA, 70 bp, Homo sapiens
ctgcaaagacttcctacacagttatgccagagagagaatatattagtcattctggcctgtgtggctgcag

SEQ ID NO: 6800663 - DNA, 88 bp, Homo sapiens
gtatgaggggctgatcaaaatctttcctgttttccagaattggagacaaaaaccaattctgagaacaaaaggtactcagtacctctgc

SEQ ID NO: 6800664 - DNA, 63 bp, Homo sapiens
aaggggtcagtgttggtctaaatttctgactggtcacacattcagtagcagcactggccgctt

SEQ ID NO: 6800665 - DNA, 56 bp, Homo sapiens
ctgggcagggagactcagccttgaccagagcaagggaaggcttctaccctgtccag

SEQ ID NO: 6800666 - DNA, 60 bp, Homo sapiens
cagttgcactagccacatttcaagtactcagtaacattaacatgtggctagtagctactg

SEQ ID NO: 6800667 - DNA, 110 bp, Homo sapiens
gtctgtaattatttattcatttatttttgcacttgtcaaatattatagtacacctactatgtgctaggtaacatgcaagtttctggagataagtgatgaaccaggcagac

SEQ ID NO: 6800668 - DNA, 72 bp, Homo sapiens
tagctatattgtttgggccattgtttttgcctatagatagtaatcctcttgcaaggcttaaacattaatcta

SEQ ID NO: 6800669 - DNA, 62 bp, Homo sapiens
gtctttggcttagctaatatctcatcccctgggaaaagtgattggtctaaagttaagaagat

SEQ ID NO: 6800670 - DNA, 56 bp, Homo sapiens
tatccaaagagattcatgttcttggtccatatatttggaatgatctctttgaggtg

SEQ ID NO: 6800671 - DNA, 70 bp, Homo sapiens
gctgtccagggttatacagctgaacaaaattacattaaattaagttatggtcttataatccagggatagt

SEQ ID NO: 6800672 - DNA, 79 bp, Homo sapiens
tggcttctgatgcttgaagcctacattcgtcactgaggaagttacccaggtgactgtgtaccaggtttgcacgaagcta

SEQ ID NO: 6800673 - DNA, 91 bp, Homo sapiens
gctcagggtgagagtgggcctgcaggttctgagaggctgggctggggacagttgtctcccaacccctgtgcccagtcttcttgccaggagt

SEQ ID NO: 6800674 - DNA, 56 bp, Homo sapiens
tggtgagaatgcaaaatgttagtcattttgaaagacagtttggcagtttcttacta

SEQ ID NO: 6800675 - DNA, 92 bp, Homo sapiens
cagctgcatgagcttgtacaaattacttaactctctgggcctcaattttttgaaccagagaaatggagtgataacagtacactctgcaactg

SEQ ID NO: 6800676 - DNA, 64 bp, Homo sapiens
tcggcgcagtcgggaggcggggtcggtctccgacttcccaacgtgggcctcccagctgcgctgg

SEQ ID NO: 6800677 - DNA, 64 bp, Homo sapiens
ggtctgctgttgagcacaagtgaaggaaggaagaacaacctccatgtgtggaagacggtgaatc

SEQ ID NO: 6800678 - DNA, 70 bp, Homo sapiens
ccaacctgctctggcaggaccatgaagcgtagggtgtaatttttggtttcacccctgctgcagcagttgg

SEQ ID NO: 6800679 - DNA, 60 bp, Homo sapiens
agcctggagcttgagttatgagttcagccgtgccatgaactccttgggccattcctggct

SEQ ID NO: 6800680 - DNA, 57 bp, Homo sapiens
agccagagactgtgtctgtaatgttcagaaaatgtctgagggacacagctcatggct

SEQ ID NO: 6800681 - DNA, 79 bp, Homo sapiens
tcagtacttctgcatcttccagattactcagctgtttcccagatttattacagtctctggagtatggagaaggatctga

SEQ ID NO: 6800682 - DNA, 68 bp, Homo sapiens
cctccagtttggttctgttctccagccttcttctggcttggagctgtcactcagaaccaaggtgaagg

SEQ ID NO: 6800683 - DNA, 61 bp, Homo sapiens
aaaggctattcagggacttgccctgcagagacagtagcaaaacaagtctctgaaagctttt

SEQ ID NO: 6800684 - DNA, 61 bp, Homo sapiens
cagtctacctttcagacattgacaatgatttcttggctaatgatactgagaagggagactg

SEQ ID NO: 6800685 - DNA, 56 bp, Homo sapiens
tattactttcaatatcgcaggggatgtacactccccctgtgatattgttagtaata

SEQ ID NO: 6800686 - DNA, 74 bp, Homo sapiens
tctgtctttttactatgttcaatctatatagtatatatttatgtaaagaagagatgagagtaaaaaaaggcagg

SEQ ID NO: 6800687 - DNA, 56 bp, Homo sapiens
cttcggagggctgggcagccccaggagacagggcagcagctgcaggccctccgagg

SEQ ID NO: 6800688 - DNA, 114 bp, Homo sapiens
gctcttcctcagatgcttgcgggtgcctgggtggatgctgactgttctgctcgggattccccgtagctgtctgtgaacacagcatttgtcacaatagcctgcgaagaggagggc

SEQ ID NO: 6800689 - DNA, 81 bp, Homo sapiens
agtttgttagcaacaagtctcaatgactctttcacataagaaagaaatgcaatgtctttgaaacattgtatgcttctgact

SEQ ID NO: 6800690 - DNA, 74 bp, Homo sapiens
aagcacgatgactaaatgatcctcttggtccttttgggcaccagccctcccagagtggacatcatcaggtgctt

SEQ ID NO: 6800691 - DNA, 56 bp, Homo sapiens
gtttttccgtttattttcccaagttggtggatttgaggcaaaatcaacgggaagac

SEQ ID NO: 6800692 - DNA, 64 bp, Homo sapiens
ggaaatcagttggaacacaagcagtttggggacagcccaccgttgctgtttcctactcatttct

SEQ ID NO: 6800693 - DNA, 64 bp, Homo sapiens
ggtaacttgagtgtgttgttcaatgaggtccaaatgagatgaacaaggcattccggaagtaacc

SEQ ID NO: 6800694 - DNA, 62 bp, Homo sapiens
gtcttggagggttgttgttttgaagctgctgacaccctcatgcaacgatcctccaaatggac

SEQ ID NO: 6800695 - DNA, 76 bp, Homo sapiens
ggagctcagaaaagttttgttgattgtggaattgtggaaaaaaacagcaatatagagttggaaagacctgagcttc

SEQ ID NO: 6800696 - DNA, 60 bp, Homo sapiens
ggacaacctgtacctggctgtgctcagggcctctgagggcaagaaaggtagcagggctcc

SEQ ID NO: 6800697 - DNA, 59 bp, Homo sapiens
gagctgttttttaaagttaggacccagagaaatctgacatctactacagaaagcagctt

SEQ ID NO: 6800698 - DNA, 73 bp, Homo sapiens
ggggagtggatcagatattctctaagaacaattcttgctctgagaactctttgattgtatctgggcattcctt

SEQ ID NO: 6800699 - DNA, 64 bp, Homo sapiens
gacctcgtccctgtcggaagggtcaggcctgggtgcctgggcttctggagtggggcagatggtt

SEQ ID NO: 6800700 - DNA, 55 bp, Homo sapiens
cagccatgcatatgcacgtaaattaaaaggttaaaggtgtgcatatgtgtgactg

SEQ ID NO: 6800701 - DNA, 72 bp, Homo sapiens
gtattattttgtatttgtgtacctacatgcctttagaaatgaatgttcctaggacagaatgcagaaaaatac

SEQ ID NO: 6800702 - DNA, 64 bp, Homo sapiens
ccaagcttttgtgtagatttttccctgtctggagtaggcaggtgtttttatattaaagatctgg

SEQ ID NO: 6800703 - DNA, 99 bp, Homo sapiens
aagatgggcaggtggttcactaaagttggagaagagctgctctaaacaagaaagtgttcagtttctcttgctttgttttgctctgtttttgcttttctt

SEQ ID NO: 6800704 - DNA, 70 bp, Homo sapiens
cacttaatgcctctggcagccgtgatatcagaagcaaatctcttctagctcctgagtgccagagggagtg

SEQ ID NO: 6800705 - DNA, 57 bp, Homo sapiens
gggtggggtgtctttgtggtctgtgagccttccttcatctccagaggcacctggctc

SEQ ID NO: 6800706 - DNA, 65 bp, Homo sapiens
tcccctggagatatgcttcacatttatctaaatttttgcaaaagtgtgataaactccaagtggga

SEQ ID NO: 6800707 - DNA, 130 bp, Homo sapiens
ctagtggaataacatgaagaaacatcaatgctatggcatttgaatctgtcttttgaacacgatcagtgcagtagaagtatcaggaagattctcagtgtgctcagatgtgcctccatctctatttgcctag

SEQ ID NO: 6800708 - DNA, 69 bp, Homo sapiens
gtaccagctcacagaaatcctgcaggaggctgtagcttcagcttctctagctctgtctgttgggcttac

SEQ ID NO: 6800709 - DNA, 92 bp, Homo sapiens
tgctcaagatgaagtcatgtgccacatgcttttcccacaattataggaaagtctttctctaaaaaagtctgttcacttggtattttggtgca

SEQ ID NO: 6800710 - DNA, 80 bp, Homo sapiens
gacaccagtgggccctgtgtatcccctgtgcttgttatagagttggcacacagtattacaataggtgctcattaaatgtt

SEQ ID NO: 6800711 - DNA, 90 bp, Homo sapiens
catccccctgcccttttcttttctaccaataggattcacgtaacaagaatgccttagaggatagtgaagccacaaaagggaaggggtctg

SEQ ID NO: 6800712 - DNA, 75 bp, Homo sapiens
tgtcattttttgaagaagtaattttaagtctcctatcatgggagattgtgtcaatttctctttaaaattctgtca

SEQ ID NO: 6800713 - DNA, 59 bp, Homo sapiens
agttcagagttgggttttatacctagactaatttggatgtataacctggctatgttact

SEQ ID NO: 6800714 - DNA, 126 bp, Homo sapiens
atggctctggagaagacaagaggatagacagttgtaggggagaggagtcactgatgtgtggtgggaacattcctctctctggctttctcccccagcttctctcatcttgtccagctcttggaacat

SEQ ID NO: 6800715 - DNA, 70 bp, Homo sapiens
ggactattatgtaatcattacagtacatggacataaaaactgtgcataactagagtaattacagtagtct

SEQ ID NO: 6800716 - DNA, 98 bp, Homo sapiens
atgataaatgttagcttttggaaatgggttttgatgaaattatcataatctgattatgcagcttcaaagaacctttcctaagctcgatttttcctcat

SEQ ID NO: 6800717 - DNA, 69 bp, Homo sapiens
gcaattatacttcttgtctatgttgttgccagccagcggtaccaaggagacaaaggtgtattcatttgc

SEQ ID NO: 6800718 - DNA, 71 bp, Homo sapiens
gtatactgacatggcagagactgagagagagaaagagattatctctttgatgtctcttcctgtaagagtat

SEQ ID NO: 6800719 - DNA, 111 bp, Homo sapiens
actgatgtgttccactggttaggaaatgtgaaccaagaagtcaaagcgatctctttgatcctattgattttgtgatttttagaaagtgacttagcatacctgggcatcagt

SEQ ID NO: 6800720 - DNA, 86 bp, Homo sapiens
gagggtgggtaggtggggcgtggcagggcaggaggtagctgctgaccacctgccttgacgtaacgcatgacccatctgttcccctc

SEQ ID NO: 6800721 - DNA, 102 bp, Homo sapiens
agacagacagtagacttgtagcctcagctgtcttttccgaggtgactgaattaatcatttggatatttcagttgatagctacatggtatatttttcaagtct

SEQ ID NO: 6800722 - DNA, 57 bp, Homo sapiens
tgctggcaatgctcttgacgtctcaccaccaaacagacctccctcgagcaaccagca

SEQ ID NO: 6800723 - DNA, 58 bp, Homo sapiens
gtactgggaatggagcctgggcctcggcaccatgcccagggccgccactttccagtgc

SEQ ID NO: 6800724 - DNA, 75 bp, Homo sapiens
agttatttactcctttgtctctgagttgatcggatctatttccaagagcagattttataggggaaacagatggct

SEQ ID NO: 6800725 - DNA, 68 bp, Homo sapiens
tcagatctttcatctatgtatttagtcaatgaaaacatgttgactacatactgtgtgtaaagaattgg

SEQ ID NO: 6800726 - DNA, 57 bp, Homo sapiens
gaaaatgtgtcagcttgtcgatcttctctgcagcaggatccaatagctacacatgtc

SEQ ID NO: 6800727 - DNA, 82 bp, Homo sapiens
cactggaggtctaatgaaagatgtaggaactttatgcctgatatgtgtgtggtttttgtttctttggttgcttctttttgtg

SEQ ID NO: 6800728 - DNA, 69 bp, Homo sapiens
cagttcctgagagtcaagaatgcagggagagcttagctagacttctacttttagactctcacaagactg

SEQ ID NO: 6800729 - DNA, 63 bp, Homo sapiens
gtgctggtgttggagcaaatgcaggaggccttttttcactgcttggttgcaacattgcagggc

SEQ ID NO: 6800730 - DNA, 82 bp, Homo sapiens
atgggattcaaaggactaatgaatagatgaatcttggaatttcaaaattagtcttctcatttggatccttgaatgaactcat

SEQ ID NO: 6800731 - DNA, 70 bp, Homo sapiens
gaggcagctccagggacccaagagaaaagacttgcctatggtttcctctctcagtcctggcagcagcttc

SEQ ID NO: 6800732 - DNA, 89 bp, Homo sapiens
ctctaaacagtccagcttatacgtgcttctttaagatactcacacatgtctttgaaggagctcaatgatgatgctctactttttcaggg

SEQ ID NO: 6800733 - DNA, 75 bp, Homo sapiens
tgcagcggacagaggccacccctgcaggtggtgtgtgcaggacagtgccctgaggggtggtgtctgtactctgca

SEQ ID NO: 6800734 - DNA, 69 bp, Homo sapiens
ctcagagactttatttccttatttgtgagatgcaggctgtaatcaaagtagccggatggaatttttgag

SEQ ID NO: 6800735 - DNA, 66 bp, Homo sapiens
agttgaacactaagtttccaggctgagtttcacccatggggcttttggtgtagttgtcattcaact

SEQ ID NO: 6800736 - DNA, 94 bp, Homo sapiens
tccagaggagcttgtgttccatgctgtgcatcttgatgacccaagcctgaaggtcacaagggtggcacagtgggggagggcttaagcacctgga

SEQ ID NO: 6800737 - DNA, 116 bp, Homo sapiens
acttgataatcatattggagcatttatgactaatgtaaaatgcagaaaatacacaaaggagtaaagcatgatatttgacatgaagtagcttataaatgcataataattagtcaagt

SEQ ID NO: 6800738 - DNA, 68 bp, Homo sapiens
ctgaggtgacatgaaggaataattgtttagacatcaatgaaaaatgtctgtctgctcatttacctcag

SEQ ID NO: 6800739 - DNA, 91 bp, Homo sapiens
gtttatgaaaagaggcctggttctgggtgtagatggaagtttggcctgattaattggtccttaccggcagcccagaggtttcttcatcaac

SEQ ID NO: 6800740 - DNA, 72 bp, Homo sapiens
tcttaaaacaacccggcttgtaatcctcgcactttgggaggctgaggattacttgaagtcaggagtttgaga

SEQ ID NO: 6800741 - DNA, 93 bp, Homo sapiens
ggccaggctgatctcaaactcctgaccttgtgatccactcaccttggcctcccaaagtgctggtattacaggtgtgagccatcatgcccggcc

SEQ ID NO: 6800742 - DNA, 79 bp, Homo sapiens
catgtccttggagtccactttccctccccagcctgtccaggcacacatggcaggagagatgacactccaagcagaggtg

SEQ ID NO: 6800743 - DNA, 76 bp, Homo sapiens
ctgcagaatgatgtgagttttcatctcagaggatttggattcctctcaagactggttttcacagcactaactgcag

SEQ ID NO: 6800744 - DNA, 67 bp, Homo sapiens
agagaatcaaactgagctgaacaaattgcgagtggggcgtccagctgtgctgttggcttgtctctct

SEQ ID NO: 6800745 - DNA, 56 bp, Homo sapiens
tctaccttgttttagcattttggaagataaataacaatatgctgagtgaaggcaga

SEQ ID NO: 6800746 - DNA, 60 bp, Homo sapiens
catttggtgttaggcatgttaatctgataaccacggatacaggctgcttccaccaatatg

SEQ ID NO: 6800747 - DNA, 60 bp, Homo sapiens
tctctgcccggggaatggctctggcactgatccagaggccatctgctctgtggggaggga

SEQ ID NO: 6800748 - DNA, 56 bp, Homo sapiens
gtcccccacacttccatgtcacacgactgtgatttacatatgcaggtgtgaggggc

SEQ ID NO: 6800749 - DNA, 71 bp, Homo sapiens
ggaaatgcttcagaatagatatctcattgttagaaaaacctatttctgaggtattttttaaagcacaatcc

SEQ ID NO: 6800750 - DNA, 64 bp, Homo sapiens
gagacttcagagagaaccctaaatgagatatgatagttatgttttattttggtctttatgtttt

SEQ ID NO: 6800751 - DNA, 84 bp, Homo sapiens
cctggtctggttgaagaatttcaagcagtgcaatgttgctagaatgcaaagttgcaggtggtgagaggtagaagcaagaccggg

SEQ ID NO: 6800752 - DNA, 89 bp, Homo sapiens
ctgcctcgcaggggcccatcacatctgattagtgactgattccagatccatcatttgtttatcaggatgtgccagctgctgcttggtag

SEQ ID NO: 6800753 - DNA, 74 bp, Homo sapiens
tgacaatctgccgagctgttgttttatgcagtgagactttgcagaccgtgacaagacagcttgcagacaactca

SEQ ID NO: 6800754 - DNA, 81 bp, Homo sapiens
ggaagtgcagatggcggctgggctcgttcccacacgcgtgcatgcatgtgtgcaggagggcgcggctgtcagttcacttcc

SEQ ID NO: 6800755 - DNA, 94 bp, Homo sapiens
ccataagaatttctatacaggtcagcagttgttctaatggtttggcaaatctactccggatcaagggcaaatgctacctatagcaaaggtatgg

SEQ ID NO: 6800756 - DNA, 81 bp, Homo sapiens
cctgcctgatgagatatactctgaactccaggaggctcatccaggtgagccccaggaggacaggggcatctcaatggaagg

SEQ ID NO: 6800757 - DNA, 66 bp, Homo sapiens
agcttccttgtaaaggctctcttgataagaaagtccagtggaccttctgtcagaaaagctgaggct

SEQ ID NO: 6800758 - DNA, 57 bp, Homo sapiens
catgaggcaaggctggccgtgttccctgggaacactccaggtctgacttgccccatg

SEQ ID NO: 6800759 - DNA, 55 bp, Homo sapiens
gacctggccatccagctggcatctactgttatcagagtgctagccctggctggtt

SEQ ID NO: 6800760 - DNA, 99 bp, Homo sapiens
gggttttctaggtggtgctcctggcttcaggttgggcttaggtccggtccacatgtcattctagggtctaggctgaaggggaagtgctactgaaggctt

SEQ ID NO: 6800761 - DNA, 94 bp, Homo sapiens
gaggcgtgaggatcgcttaagcccagcttgttatgattatgcatgtgaatagccaccgtagtccatcttgagcagcgtagcgaaacacagtctc

SEQ ID NO: 6800762 - DNA, 63 bp, Homo sapiens
gctgtgggcttcaggctgaattcctcctagataggaaagctgtctatggccttctgtcacagt

SEQ ID NO: 6800763 - DNA, 88 bp, Homo sapiens
tggaattctgacctcctgcaggcaggctcaaggctgacttccatgggaacatggggagtgccttgggccccctaagattcagatacca

SEQ ID NO: 6800764 - DNA, 91 bp, Homo sapiens
actcggccttctagattggctttgtgatggtagaactgggatcctgaacaccacaaatttgcccacgcggggccttgaaaggaggttgtgt

SEQ ID NO: 6800765 - DNA, 119 bp, Homo sapiens
gccatctcctccatgtgtctggggaacaaggctagcctagccttcaccagcgtagtggctttcgctctgccatggaagtggccagacctagccatgggtccctaaacacagggtgtggc

SEQ ID NO: 6800766 - DNA, 73 bp, Homo sapiens
gggctagcgctagtgttatgcatgcacttggctgcaggaactggctacaggtatgtgcatgacatcacagccc

SEQ ID NO: 6800767 - DNA, 72 bp, Homo sapiens
ggctcctgtggggaggcattcttctccctgctgaggcagatggtggtaattgcctcctttgtcccgggagcc

SEQ ID NO: 6800768 - DNA, 60 bp, Homo sapiens
gggagatactgcgttgtattaggtacaaagaaaattgctgccacttctcagtgatcttcc

SEQ ID NO: 6800769 - DNA, 62 bp, Homo sapiens
ttgcagctgttactgatagatacacttatctctcactggtgtatttaatcagcaacagtcaa

SEQ ID NO: 6800770 - DNA, 60 bp, Homo sapiens
ttgtatagactagctttcacgatgttagggaattattattgtgtgataatggtcttgcag

SEQ ID NO: 6800771 - DNA, 81 bp, Homo sapiens
ggctctggccatctggagaggtgctgggccatatgtaaagcacacaaggtggctgagccacttgttcagatgagcctggcc

SEQ ID NO: 6800772 - DNA, 70 bp, Homo sapiens
tacttctctgcgatcacgtgataagttagtcacatgattggcattttagacatgatggtgcagagaggta

SEQ ID NO: 6800773 - DNA, 61 bp, Homo sapiens
ctgccaggctgtcccaggtccgggatgccatcggcaagtgggcggggacaggcctgggtag

SEQ ID NO: 6800774 - DNA, 79 bp, Homo sapiens
agctcttgtacattctcaatagtagatgagtaaattgggctgtttacacactatgatttgaagcctgtattataaagct

SEQ ID NO: 6800775 - DNA, 59 bp, Homo sapiens
agcacctgcctgcattggctatgggtccacaccaagcatcagctgataaggctggggct

SEQ ID NO: 6800776 - DNA, 72 bp, Homo sapiens
cttggctgtgaaagcttctcaaactttccttgcttttgataactctgaaatgtttgaggtttactagtcaag

SEQ ID NO: 6800777 - DNA, 58 bp, Homo sapiens
gccctctgtgtaacaatccagacaaggccacagttgtcctcggtgagcatcagagggc

SEQ ID NO: 6800778 - DNA, 66 bp, Homo sapiens
gtttctgccctgctggagatcacagtggaccccagctcagtccagcttcccaccagggcagcaggc

SEQ ID NO: 6800779 - DNA, 69 bp, Homo sapiens
gcctcaaaattcttgtatgtatgcaaaatcaaaatctcatcttgattcttcatatcagtacaaggaggc

SEQ ID NO: 6800780 - DNA, 79 bp, Homo sapiens
aatgatgatgtttatcttggtattcccttacatatctatacatgaagaaaggccttaatacaaaggaaggcatcacatt

SEQ ID NO: 6800781 - DNA, 82 bp, Homo sapiens
acctcggcctcccaaagtgctgagattacaggtgtgagccaccgcacctggccaatttttgtatttttagtagggacggggt

SEQ ID NO: 6800782 - DNA, 60 bp, Homo sapiens
ctgcaagccagggagagatgcctcaggagaaaccaaacctgctgctctttgggcttccag

SEQ ID NO: 6800783 - DNA, 62 bp, Homo sapiens
tggcagcttcctgctcataggaaacctcgtcctttagctttctctggagtcaagagcttcca

SEQ ID NO: 6800784 - DNA, 65 bp, Homo sapiens
aggacttcttaactgtatatactatgagatggtgaaacacatttctgggcaagttatagaatcct

SEQ ID NO: 6800785 - DNA, 78 bp, Homo sapiens
tctggctcttcgtatagtgtaacaggattccagcagagcttgggttttccacatatgccatgcgaggttcgggccaga

SEQ ID NO: 6800786 - DNA, 79 bp, Homo sapiens
cacttcccaactgttggaggattattttgctccacacgaagacaggagagcaaagtattaaccaacaggatgtggagtg

SEQ ID NO: 6800787 - DNA, 76 bp, Homo sapiens
gcattaaaagcttggttaccagttggaacgtggagagaactctgtatagttagtttcataatcatgtccttaatgc

SEQ ID NO: 6800788 - DNA, 67 bp, Homo sapiens
tttgtcacctgggaccatttagcccactcagctgtggggagcgggtgcaggggaccctagggacgga

SEQ ID NO: 6800789 - DNA, 87 bp, Homo sapiens
gcctctgtagaataaatgtacacatctgtttaacatttggagttattgaaatcagacctgttgtgcatttgccatctattaagaggc

SEQ ID NO: 6800790 - DNA, 60 bp, Homo sapiens
caggtaactttagtgaaagagctctgatccctcagtttatctattcattacagttatttg

SEQ ID NO: 6800791 - DNA, 97 bp, Homo sapiens
cacttgaaagatattaaagtgaagttctcagatgcttgccagcccatgagttttgtcttagaatttcactttgaagacaatgaatattttacaaatg

SEQ ID NO: 6800792 - DNA, 55 bp, Homo sapiens
ccctgggccttttggggacaagcagctctctgaggaccccacaggaggccctggg

SEQ ID NO: 6800793 - DNA, 100 bp, Homo sapiens
catactgattctatctctatgaaatctagagtaggcagaacagatctgtggtgattgaaatcagatcagtgcttgcctctggaggagattgacaagaatg

SEQ ID NO: 6800794 - DNA, 62 bp, Homo sapiens
ttgttgggcatgcagtggctgtaattctatacaaaaatcacaacgcactaagtgctggacaa

SEQ ID NO: 6800795 - DNA, 77 bp, Homo sapiens
gttcaggttttataatatattcttgatatcaatatattttaaaagatatctgggtgaagtttaaaaatcccctgaac

SEQ ID NO: 6800796 - DNA, 77 bp, Homo sapiens
ggttgaggaccaggttggtgtccttctggccacgctcagtggccaggttgctgacgacgatctggtagttctccatc

SEQ ID NO: 6800797 - DNA, 58 bp, Homo sapiens
ctaatgtacagtttctagactcaaattaagaaatatgggtctggaaaatggcttgtag

SEQ ID NO: 6800798 - DNA, 69 bp, Homo sapiens
catgtgatttcaggtttttcatactgaaaacattgagatttcagttggaagacaccctgaaatcttatg

SEQ ID NO: 6800799 - DNA, 62 bp, Homo sapiens
ctccagtgagcaagtaatgaaggcctatgctatggctccctcaaaccaccttgttactgggg

SEQ ID NO: 6800800 - DNA, 77 bp, Homo sapiens
actctatgatgtagcttttgttattagcctcatttcaggtaaggaaactgaggcttacaaaggtaaagtctgtaagt

SEQ ID NO: 6800801 - DNA, 58 bp, Homo sapiens
tgcattgtgtactttacatgccatcattataggtatgtaacaatttcatatacatgca

SEQ ID NO: 6800802 - DNA, 59 bp, Homo sapiens
aatctggtttgacaacttttgtcttttaatgggagaggacaataacagttggattgatt

SEQ ID NO: 6800803 - DNA, 68 bp, Homo sapiens
acaaatactgttcacaaagacaatttcaaacatttctttgaattatgattgaaatgaggagtatttgt

SEQ ID NO: 6800804 - DNA, 64 bp, Homo sapiens
ttgcaagcctgttctggtactccaggtgagccttcaagaccatggagaagagaagaggctgcag

SEQ ID NO: 6800805 - DNA, 130 bp, Homo sapiens
atctcatttaatccccaaatgtttcaagggtctacatgtagtaatcacacccagcaagtcaaaccatcctattatttgaggggatgtgtggtcactaatccattgagacatacattacttaaactttgat

SEQ ID NO: 6800806 - DNA, 68 bp, Homo sapiens
gcatccagcaggccagtgatgtcaggaaatgtggccctccctggccactggccactggccactggagc

SEQ ID NO: 6800807 - DNA, 71 bp, Homo sapiens
gtgacatttcgtgacgtgagaactaggacagcaagtattcatagaacacttctcactgggacaaatgtcgc

SEQ ID NO: 6800808 - DNA, 57 bp, Homo sapiens
ggaggacctgctggccctgcaaggcgtttcagtttgtgtaacctgccaggttcctcc

SEQ ID NO: 6800809 - DNA, 126 bp, Homo sapiens
tctcagtaaaaatgtcaatggctgtgatttgtaaatagcaaagcctggcacaatgataataaacaactatgaagctcatcagtgctgttttacttttgcagattactccatcgattattactgtga

SEQ ID NO: 6800810 - DNA, 80 bp, Homo sapiens
gggtacagaggaggtggaattccaggaattgagggagcaaaaccatggcacagttcaaggaatgttggcttctctggctc

SEQ ID NO: 6800811 - DNA, 55 bp, Homo sapiens
tctgctcctagtttagcttacatttttcttacttggagcttttactaacagcaga

SEQ ID NO: 6800812 - DNA, 116 bp, Homo sapiens
atcctgagtgaaatgggagctggggcagggaaaggctgatgctgtgggtcggtcacttgtcactaataagcccattttcctgccttgccttgccccatcttttagtttttcagggt

SEQ ID NO: 6800813 - DNA, 57 bp, Homo sapiens
gttaatctgctttcaaaatgcaccaccatcaaaatgcattgcaaaaagcagcttgat

SEQ ID NO: 6800814 - DNA, 84 bp, Homo sapiens
tcttacctttacctacctaggtccaatctaaagtttccgactttgaggaggtatgactaggtactgtatgggaaaaggatagga

SEQ ID NO: 6800815 - DNA, 71 bp, Homo sapiens
agaatctttccgagaaactgctttgtgattagtgcatttatctcacagagttaaaagtttctttggattct

SEQ ID NO: 6800816 - DNA, 61 bp, Homo sapiens
accccacttcccccatgcaaacacacctctgcttgttcaggcctgggacagttttaggggt

SEQ ID NO: 6800817 - DNA, 104 bp, Homo sapiens
tgcctaaagtgacaacatctcctgtttcttttatctggcctggtgcccttttggaatgccacaggtactatgggagagagggagaaggtctgttttcttaggca

SEQ ID NO: 6800818 - DNA, 55 bp, Homo sapiens
gcattaatgtaagacccactccagtcccttccctggagcttggtccacctagtgc

SEQ ID NO: 6800819 - DNA, 91 bp, Homo sapiens
ctccatgtcaccagttctggttaagacagacgggcttgtcttctgcctccgagactcctggatcttagccagattctggagtgagttgggg

SEQ ID NO: 6800820 - DNA, 103 bp, Homo sapiens
tgtgatttttcttacgctgcgttgaatgcaaggaatttgtttgtttattttcattcatttcctatggatacaggcagatgtgtaagttgagctttaactcaca

SEQ ID NO: 6800821 - DNA, 72 bp, Homo sapiens
tctgcctgtctctgactgccattagcaaaagacattattcctgtcctcaatggaccagttagagaggcaaga

SEQ ID NO: 6800822 - DNA, 58 bp, Homo sapiens
ggtctcagtccgtgctgttcaggtgagctgaccacaagacacctggggtggacagacc

SEQ ID NO: 6800823 - DNA, 57 bp, Homo sapiens
ctctgtgtggtcctctgtattgaaaatacttgatgtattctaagagaccacccagag

SEQ ID NO: 6800824 - DNA, 83 bp, Homo sapiens
gcttgctttcccagcagaccctgtctggagctggcacagagcatcctctgttccagattcggcgtgggacgttggaagcaagc

SEQ ID NO: 6800825 - DNA, 130 bp, Homo sapiens
tggggccatgtctagatgctcactctgaatggggcaggcccagagctctgggggagctagagtccttgcttgtcggcctgctaggctctggggtactgcctcccagtgttccggagtgtcacaggcctca

SEQ ID NO: 6800826 - DNA, 71 bp, Homo sapiens
ctttaggaatccttggttttaagcaatagaaatagagtttttctagcttaggcaaagaggaatttattagg

SEQ ID NO: 6800827 - DNA, 57 bp, Homo sapiens
ggcaaaccatgacatgaagcgtgaacgcaatcagtgtttcttcaatgcaggtttgcc

SEQ ID NO: 6800828 - DNA, 77 bp, Homo sapiens
gacccgaaagagcaggaaatcagttttaatttaacgtaatattaatcagagcaacttttcctgctttgtgcaggctc

SEQ ID NO: 6800829 - DNA, 86 bp, Homo sapiens
tggagcaatggttctcaaagtgtgctccctggagcagcagcagcaccagcatctcctgggaacgctttagacatgcacatcctcca

SEQ ID NO: 6800830 - DNA, 85 bp, Homo sapiens
aggctggagaaggatcagaggatcagggacagtttcagtagcatgcactaaactgaattcctctttcttatcctctcagcagctt

SEQ ID NO: 6800831 - DNA, 82 bp, Homo sapiens
agttatagggtacatgtacacaatgtgcaggtttgttacatatgtatacatgtgccatgttggtgtactgcacccattaact

SEQ ID NO: 6800832 - DNA, 90 bp, Homo sapiens
cgcttcccgagtctagttaggagtataggaatgcctgtttctggcacattaaccagtctgggcatacatgagctctaaagcagggaagtg

SEQ ID NO: 6800833 - DNA, 81 bp, Homo sapiens
ctctgcaaaggcacagttgatcactataggcttcagttaaaccaactgtggcttcaaggtgtgtcactggccagtgttaag

SEQ ID NO: 6800834 - DNA, 98 bp, Homo sapiens
tgcccttggctttatgcctctgttccacatttgtaaaatgaggatgataatagtatatacctcataatgttggagtaaggataaaaataaatgaggca

SEQ ID NO: 6800835 - DNA, 58 bp, Homo sapiens
ttacagcttcgacagaggcagttgcttgagaaggcaggtgctgggtgggcagctgtaa

SEQ ID NO: 6800836 - DNA, 127 bp, Homo sapiens
tggcaagtggataagtaatgttgacttagagttcatttttccctaatgagtacctaggggactcagtgacagctctggggagaaatgggaaggatcttaaattgatggaaaaaactcacatatgtca

SEQ ID NO: 6800837 - DNA, 82 bp, Homo sapiens
gcatctttgctccttgctgttagcctacattattgagaacttactgaacccttgtaaatgatagtatttggaggcaagttgc

SEQ ID NO: 6800838 - DNA, 58 bp, Homo sapiens
ccaaggctgaggtttccagttggaaggtacatttgatgggggagctgtctgcccgtgg

SEQ ID NO: 6800839 - DNA, 61 bp, Homo sapiens
tctggtggggttggaccaggcaggaaagaggcaagggtctggacattccacccatatcaga

SEQ ID NO: 6800840 - DNA, 55 bp, Homo sapiens
gggggcaggacctggcttcggattccacactgggctcagaaaaagtcctggcctc

SEQ ID NO: 6800841 - DNA, 62 bp, Homo sapiens
gccccagtcctctgctctgttatccctggatgctacaggccctgcaagagcttaggaggggt

SEQ ID NO: 6800842 - DNA, 79 bp, Homo sapiens
agccccttcaaaattccaggatgcaggaggtgccctggtcaccaggaggagtggctcctgtgtttggaagggtggggct

SEQ ID NO: 6800843 - DNA, 56 bp, Homo sapiens
ctctgtgggccagagaggccccctgacaagtctgccctagactggcctcatcagag

SEQ ID NO: 6800844 - DNA, 83 bp, Homo sapiens
tgctccctctgaaatgagcaaagggatgaatcactgaaacaggccattattctttttgcttaaccaatttcacaggccccgca

SEQ ID NO: 6800845 - DNA, 122 bp, Homo sapiens
gcatggtcctgggatcatcagcatcagtgtttgcatgggagcttgttagaaatgctgagtctcaggccctagctagacctggtgaatctgaatgttatatgatccccaggtcattgctatgc

SEQ ID NO: 6800846 - DNA, 120 bp, Homo sapiens
taccctcgatgccactggatactcacaagcagggttatgctccttcatcttgggcttgtttgcctaaatgaaagggtttaatttattttgtacctcctatgcgtgggatagtccagggtg

SEQ ID NO: 6800847 - DNA, 90 bp, Homo sapiens
tgggtgcttatagagatagcagtattgattcgctagcaacagctcttcgctcatagctatgatccaatgagcttctctggtggtttccca

SEQ ID NO: 6800848 - DNA, 85 bp, Homo sapiens
ctgaagaaagataactttcattattttggcatgagacactcttagaatgccctatgtcgagaataattagaatttcactcttcag

SEQ ID NO: 6800849 - DNA, 106 bp, Homo sapiens
cttggcttgtaatattattgcttctgagcagaggtcaagatacttgggcttttcttcatgtaagaggcactctgcttttagaggaaatagggtttatattgttagg

SEQ ID NO: 6800850 - DNA, 85 bp, Homo sapiens
ggcacgaagctgaagctgttagggagtggtaggtttggagtacagtacatgctctgaaatatctagcctttagcagcttcatgcc

SEQ ID NO: 6800851 - DNA, 75 bp, Homo sapiens
atagaattgtttggcgatgagaagagtgctctgttcagaaatcctacgttgcatttattatctgccaggcactgt

SEQ ID NO: 6800852 - DNA, 88 bp, Homo sapiens
gcaggcagggcaaataattactatcctcacttcacattaggttaataacttgccgaaagtcaaaggattagtaattagttctgctggc

SEQ ID NO: 6800853 - DNA, 87 bp, Homo sapiens
cggctgcacctgtcttctgtgcctctctcctctcttcccctccatctggggaaagagggacaggcgcagacacagagcaagcggctg

SEQ ID NO: 6800854 - DNA, 66 bp, Homo sapiens
tcgcgggctctgaccagtctccgggctgcagctgtctcccagcagcctccaggagcagagccctga

SEQ ID NO: 6800855 - DNA, 81 bp, Homo sapiens
ctctcaagcgtggctgctctgatggacgctgaacactgatttctgaacgaagcctttcccacagatgccacacttgtaggg

SEQ ID NO: 6800856 - DNA, 87 bp, Homo sapiens
caggactctggggaccctgggcagtctgcacttcaggtgctgatcctgcggtgggctgggctgtcccgagtcagcccctccgtcctg

SEQ ID NO: 6800857 - DNA, 57 bp, Homo sapiens
gggagctgtagtccagataccgcggggcacgtcggaagctgataaactacaactccc

SEQ ID NO: 6800858 - DNA, 84 bp, Homo sapiens
ctgacagtatgatattaagtttttgtgatctggagccatttttagcaaaatctctggagtaagagctatgaaattaaatgtcag

SEQ ID NO: 6800859 - DNA, 107 bp, Homo sapiens
gcctcctgggcaaaggctagttagagtggcgtcctaggaaaggagggggctaacagtgtttctggttcatcttctatcctcagcccctgcctagcttgtccagaggc

SEQ ID NO: 6800860 - DNA, 80 bp, Homo sapiens
caagttggagtcgattcaaggtattggttcttggtcagtctgctgaattcaaaacactattacctttaatcagcaacttg

SEQ ID NO: 6800861 - DNA, 57 bp, Homo sapiens
gtggtatctgtctcccccactggagtgtgagctcctgtgggcaaggccgatgtccat

SEQ ID NO: 6800862 - DNA, 82 bp, Homo sapiens
ggatcacaacggcagcccttgcgacaccctggctggggagttttattcctgagggggttgcgcaggggctcccttggactcc

SEQ ID NO: 6800863 - DNA, 71 bp, Homo sapiens
ctcgcccctgcctgtgggcatcaacatgtctgtcgaggtcctggattgaacataggcagaggaagagcgag

SEQ ID NO: 6800864 - DNA, 62 bp, Homo sapiens
gtggattgaaacagtagctcatagaccaatgctggtctgagaactgattttcactcatctgc

SEQ ID NO: 6800865 - DNA, 85 bp, Homo sapiens
tgttaaacatgcagactcctgggtcccatcccagagtgactgagtcagaatccagcgtggggcccagaaaagtaacagtttaaca

SEQ ID NO: 6800866 - DNA, 103 bp, Homo sapiens
tcctgccagctctttggtttcctttgtgagccgtggcaggcggacgctgtccccagaggccagggggctcacaaatgttattccagggctgggctcggcagga

SEQ ID NO: 6800867 - DNA, 81 bp, Homo sapiens
tcatgctgagcccttatttgtagaataatatctttctggagtaggcattgtagagagccatgttttacaacccagcaatga

SEQ ID NO: 6800868 - DNA, 56 bp, Homo sapiens
ggtagtggagcatgagaggtgtgatccccccactctgccactgtgcttacactgct

SEQ ID NO: 6800869 - DNA, 65 bp, Homo sapiens
ttcaacactgtttggctgagtaacagtgcaaagacactttttatagcaaataaaacagtattgaa

SEQ ID NO: 6800870 - DNA, 58 bp, Homo sapiens
gggatgggcagaggttcaacttcaacaatatggtttgttttctgggctgttgccccct

SEQ ID NO: 6800871 - DNA, 83 bp, Homo sapiens
tcacagggcctgttcgtagtggcagaacttgggtccctggaattccagggtccatgtttccagttaattccaggcatcagtga

SEQ ID NO: 6800872 - DNA, 128 bp, Homo sapiens
ccatcctgagagagctgagttcaggcggagacagaccgcaagctcaaagctgaagcaggaaaggatgcgaatggctctgggaatgggaagatgctctgtgtggtggcattcggaggttctcaggaggg

SEQ ID NO: 6800873 - DNA, 61 bp, Homo sapiens
cagcagtgatgtgtgagggttcgttaattattgctcttactgatgtttgcacaggctgttg

SEQ ID NO: 6800874 - DNA, 64 bp, Homo sapiens
tttctgagaaattaaacactttatatgacattttacagcatgtagagaggttgaaactcagaga

SEQ ID NO: 6800875 - DNA, 100 bp, Homo sapiens
aaatagctgtatcatttgtaccagcaatgtatgagtgtttgagtttttccatatcttcaccaacactcagtattgttagtctttttgattatagacattt

SEQ ID NO: 6800876 - DNA, 92 bp, Homo sapiens
gacttttaatccatagtcacatgtcagaataagtgcatggtatatggtttattacatcagttgacatgtgagtatgtaacattgaatttgtc

SEQ ID NO: 6800877 - DNA, 64 bp, Homo sapiens
gggccacgtgacctctggctccttgtggctccagggtctggtgaggatcagaggtgcgtggccc

SEQ ID NO: 6800878 - DNA, 76 bp, Homo sapiens
ctggggggtgagggtggggttatggagggtcttatgcattgggagaggggctgggactttaccctgtggcccaagg

SEQ ID NO: 6800879 - DNA, 72 bp, Homo sapiens
gatcgggagagagggaaagggccgagctgcttcatgacctccagcaggctccttccttctctgggcctcttc

SEQ ID NO: 6800880 - DNA, 66 bp, Homo sapiens
agggagcatgccaggaacaaacagtggtgcccactcactgggcccatttcttgagttcagctcttt

SEQ ID NO: 6800881 - DNA, 56 bp, Homo sapiens
gagagctgtggtttgaccaggcagccccctatgcctcttccagactcaggcttctc

SEQ ID NO: 6800882 - DNA, 65 bp, Homo sapiens
gtcatttgctcttactgccactagtggataactgttatcaggctgagggctgtaacagcagaggc

SEQ ID NO: 6800883 - DNA, 75 bp, Homo sapiens
gtcttgaactcctgaccttgtgatccacccgccttggcctcccaaagtgctgggattacaagcgtgaggcacggc

SEQ ID NO: 6800884 - DNA, 99 bp, Homo sapiens
tagcaatctgctttttccctgtccctcaaggtccagtcatgggggagtacttagccagactgccctgaccttgtggccccagctgggaagcagagacta

SEQ ID NO: 6800885 - DNA, 81 bp, Homo sapiens
gagactaccttttgttccaaacaagtcataaagtacactgacttgatgctttaaccatcttgtttggaagggaggtgtttc

SEQ ID NO: 6800886 - DNA, 102 bp, Homo sapiens
gtggtagagctgggtaaactgacagggtgaccagagctccaagtcactcctttctggctgtgagtggctgcttctggttgctccagtgttctgatctaccat

SEQ ID NO: 6800887 - DNA, 65 bp, Homo sapiens
cccaggaagaggggtcaggtgttggggcctcacactgcccccttctggatctccctcatcctggg

SEQ ID NO: 6800888 - DNA, 61 bp, Homo sapiens
gaggggagggagaagagaagtaagagataagagctatctctaaatgctctcccatcccctt

SEQ ID NO: 6800889 - DNA, 68 bp, Homo sapiens
gagttttaccagtttcattcggcagctcataaggtgattttatgtgcaactgaaaaaatgtaaaactc

SEQ ID NO: 6800890 - DNA, 64 bp, Homo sapiens
ttcacaggatgagtgatgttgaagaaggttatgaacctttatatatcaacttctccacagtgaa

SEQ ID NO: 6800891 - DNA, 127 bp, Homo sapiens
tttaggtgttttttttttttttaatgttccaaagtaatgtgctttgttcagccattttcagtaatagaagttgcaactaagtggctacagtgcttattactaaattatgtagaaacaaccatttaaa

SEQ ID NO: 6800892 - DNA, 73 bp, Homo sapiens
tgacactgcgcatattatctgttccgatctgcaaaacaatctgcaggtgacaagacaggtaatattattgtca

SEQ ID NO: 6800893 - DNA, 59 bp, Homo sapiens
atctacaggctgaggtgggaggatcaactgggtctctccagttacctaggtctgaaggt

SEQ ID NO: 6800894 - DNA, 92 bp, Homo sapiens
ggagtatcctggggatcagttcaaatgcagattcaggagttctggggccaggcctgagactctgcatttatagcaagcccccaggtgacgcc

SEQ ID NO: 6800895 - DNA, 55 bp, Homo sapiens
ccagatgtgtgtcactctctggcttcattcttcagccattctgggtgcagtctgg

SEQ ID NO: 6800896 - DNA, 80 bp, Homo sapiens
ggtctcccgctcttgctatcagaatagcatgccaagcggttcctgttattctgttattctgatgtgcaggataggagact

SEQ ID NO: 6800897 - DNA, 106 bp, Homo sapiens
cccggggccggcgttgccatggcaaccgggccccaggagaagccgtcagcggccgcgtcttttgttcgggcctaaatcggcgttggcatgtgaaaccggcccgggg

SEQ ID NO: 6800898 - DNA, 129 bp, Homo sapiens
ctaagactgcacatgtgttttgcagactttcttcctgaccatttgccacatgggtctctgataagattctgttggtttaatagtcaaaataatctttgcagtttgtgagcactgagtagcaggttctgg

SEQ ID NO: 6800899 - DNA, 99 bp, Homo sapiens
tggcttgacaaatgtggcaccttaattggtgagagagctgagtctgaaccccaggctcactaaccttccatccatagaggtttccacagcctccagcca

SEQ ID NO: 6800900 - DNA, 80 bp, Homo sapiens
tctctcacatctttttctcaatacacctatcacccagcacatactgggtttctgataaacatgggagaaaggaatggagg

SEQ ID NO: 6800901 - DNA, 64 bp, Homo sapiens
actgagggtagaggtcagtgttgaaaattttgattttaaacatctgaatcctgcttcccacagt

SEQ ID NO: 6800902 - DNA, 57 bp, Homo sapiens
ttctatgtgctggagaatatttttatgccatttaaaaataaactgaagcacagagag

SEQ ID NO: 6800903 - DNA, 79 bp, Homo sapiens
agtgattaataaaacagcgtggtagtagtctgatcacctttatggtgaatctggctattgacatgttatagcaattgct

SEQ ID NO: 6800904 - DNA, 87 bp, Homo sapiens
tagttagcctgactcactggtagactatagtggagggaggcttccctggctttactgagggtgtatcttagtgcattcaggttgcta

SEQ ID NO: 6800905 - DNA, 79 bp, Homo sapiens
cctgaccccggccattggagcgtggggggcagcctttgcagaggggtgtcctttgggggctccgaggagctggggaggg

SEQ ID NO: 6800906 - DNA, 71 bp, Homo sapiens
tctcatgtagtttacagaagaggagcaacaattactggcatgttgttacttgcatgtagactaactgtgga

SEQ ID NO: 6800907 - DNA, 78 bp, Homo sapiens
catcttacctctacttcagtgtcagcttgttaaagttgcaaaacttaaaagttacttgactattgaaggggattgatg

SEQ ID NO: 6800908 - DNA, 62 bp, Homo sapiens
atataactctccattaagggccccattagcaacacaagggcctcattgtcaaggagttatgt

SEQ ID NO: 6800909 - DNA, 123 bp, Homo sapiens
ggaatggcatcaaactttccaatatttggaagtatgtgatgaatacaaaagagttgaggaatacaaattgaattattaaaaagttatattcaacatatttaatttccagaatttgccatctcc

SEQ ID NO: 6800910 - DNA, 72 bp, Homo sapiens
cctcccagtaatcactgtgtattgcattatgcaagtcagcaaattctgctcactttaatatacatgaggagg

SEQ ID NO: 6800911 - DNA, 58 bp, Homo sapiens
ttccagggtagctgagctaagcctcttatcattggaggagcggggagcagtcctggga

SEQ ID NO: 6800912 - DNA, 68 bp, Homo sapiens
ctgtagtcccagcttctcaggaggttgaggcgggaggattgcttaaacccaggaagttgtggctgcag

SEQ ID NO: 6800913 - DNA, 55 bp, Homo sapiens
tgacagcagcatagtgagcaatgagcagtagctcaccattctgcacatgctgtca

SEQ ID NO: 6800914 - DNA, 75 bp, Homo sapiens
ttgttttgtttcattatattcaatgtttggctgagcccagtgaaacaattagaatgtaatgaagcatctagataa

SEQ ID NO: 6800915 - DNA, 76 bp, Homo sapiens
agaatttctttgtatgattcctttggttgttttcagtcttgaagatggctctgaggaatatataattggacattct

SEQ ID NO: 6800916 - DNA, 112 bp, Homo sapiens
ctagtgctgccacccccttgggtcggtgagcatggctgctctggatggagtcctgtgttccagaggcccaggtcaagcagccaccgtccctaggcacggtccccaagcatgg

SEQ ID NO: 6800917 - DNA, 61 bp, Homo sapiens
agagacacacccaaggttatgagagcagcagagcaggattctggctgtgggtggcgtctct

SEQ ID NO: 6800918 - DNA, 64 bp, Homo sapiens
gagtaattttcttgatttcttagttacttcatcatagcttttcataagaaacaggagaattctc

SEQ ID NO: 6800919 - DNA, 77 bp, Homo sapiens
gggtctcttctgtgtttatggcatgctccctctcaaccttcccatccaagtgtggttgtgtctaaataaggagacct

SEQ ID NO: 6800920 - DNA, 58 bp, Homo sapiens
ctgagtagcgcagtgggttacagatggccatatagcgatcatagcccatggctgccag

SEQ ID NO: 6800921 - DNA, 80 bp, Homo sapiens
atttattttataaagtgttatgagaactaagtgggttagtaaatgtaaagcacttagaatatagcactgacaaagtgaat

SEQ ID NO: 6800922 - DNA, 75 bp, Homo sapiens
cctgcaaacagctggaggtctgtgagcactgcgtggagggagacagagcgcgcaatctctccagctgcatgtggg

SEQ ID NO: 6800923 - DNA, 88 bp, Homo sapiens
atctcaaggaagtcctgggcggctttgaaaggctgtcaggaggaagctggattcagcatattcagtgtagctcaggaaatcaagagat

SEQ ID NO: 6800924 - DNA, 127 bp, Homo sapiens
ggctgccagagtggggaataggtaatgactgttttatgggtatagggttttattttggagtgactaaaatttttttggaaagacatagaatttgtacttgtagaacattgcaaatatactaaatgcc

SEQ ID NO: 6800925 - DNA, 56 bp, Homo sapiens
ctgactacaaaaaagctagtcttttccatgcgatgtagaggctttcttgtagtcag

SEQ ID NO: 6800926 - DNA, 66 bp, Homo sapiens
tgtgagcactatggctaggctctgagaacacattgaatgtttattgagcacttgctgtgtgccata

SEQ ID NO: 6800927 - DNA, 89 bp, Homo sapiens
gatgatactgtacctgtcctgggaatgggatgcagtgccttgggtggtttcaggagattgacacacttccaggaccaggcattttcatt

SEQ ID NO: 6800928 - DNA, 69 bp, Homo sapiens
cagaacctgaggtgggcatcagcattctcagactggcaccggctggctgcatgccccctccttcttctg

SEQ ID NO: 6800929 - DNA, 60 bp, Homo sapiens
tcatgtacatgtttcccaattcctctggaattttccatctgagggaaaacatgtagttga

SEQ ID NO: 6800930 - DNA, 74 bp, Homo sapiens
gctgctttctgcaccccaggtcgacgacgccgggcaaaaccttggcaagatggcactggggggtggagggttgt

SEQ ID NO: 6800931 - DNA, 86 bp, Homo sapiens
ctgagggctaggaatgataagacatgagtagagggttttaaaaatgagctctttgttttccactcttcatcatgcctagatctcag

SEQ ID NO: 6800932 - DNA, 68 bp, Homo sapiens
agacagcctgtcattacagccgagtcagaaggaactgtgacctggttgactgtgagcaggaggtgtct

SEQ ID NO: 6800933 - DNA, 99 bp, Homo sapiens
ataatgcattatacgagaaagctgtctatagaatcatgcagtttgtgttcaacccctaaatagaatgcagctgtgggcagggcttctaataaacgttgt

SEQ ID NO: 6800934 - DNA, 84 bp, Homo sapiens
agggggggattttcctgtgcattgtgggatttttagcagcctccctggctccaatccacttgatgccaataaaactctccctct

SEQ ID NO: 6800935 - DNA, 77 bp, Homo sapiens
gggatcagtctgtgtttataggtttggaaactataacaaggaagcatactagtctaacttgtgagtatagatgacct

SEQ ID NO: 6800936 - DNA, 59 bp, Homo sapiens
cctaggaagattcagtagctggcggcaccatgacagctggcagctggaatcatctgagg

SEQ ID NO: 6800937 - DNA, 63 bp, Homo sapiens
actgagtgaattcaagtaaagggcctgtaagagtgcctggcacttgctaagaattcactaagt

SEQ ID NO: 6800938 - DNA, 67 bp, Homo sapiens
ttggatttggaagttgctcagcaaaatagttaattgctaaatgtcagagtagcttgcatgtatctga

SEQ ID NO: 6800939 - DNA, 66 bp, Homo sapiens
ggtcacaggctgggaagcctaggcctcgcggttctgcagagtccgggcgcggcccagcctgtggcc

SEQ ID NO: 6800940 - DNA, 79 bp, Homo sapiens
cttggaaactttggcttttctgctgattctggtgggaagccccactctgctatcttagcaaaaggccaagagagccagg

SEQ ID NO: 6800941 - DNA, 64 bp, Homo sapiens
ggtctgaaaccagcacacggcgggtgtgggcacttgcatccattgtcttgttggcttctatgcc

SEQ ID NO: 6800942 - DNA, 76 bp, Homo sapiens
aactgagtagcaatctacaaaaactgtctcaggaatcaagaatcggtttgtgctatatttatgggttgccttggtt

SEQ ID NO: 6800943 - DNA, 64 bp, Homo sapiens
gtcccttcttcatgtacttttcctttttcagcttttctgaatgtgtacattttcaggaggggat

SEQ ID NO: 6800944 - DNA, 75 bp, Homo sapiens
gcttggctaacctagttcaacaactgtctgtaacccaaagcagaatggaatcaggaactagttagcactacaagt

SEQ ID NO: 6800945 - DNA, 77 bp, Homo sapiens
aggtgagtaagttctgatgtctgttgccagcccttctccctcgggcttgtctctcattcatgagaacacactcattt

SEQ ID NO: 6800946 - DNA, 91 bp, Homo sapiens
tgataactatgatttcttgaaaggtgtgcatccatctctttactgtaaagaatagaagagaaatagtgccactgtttaaagaatggtttca

SEQ ID NO: 6800947 - DNA, 74 bp, Homo sapiens
gcatgaggtggtgctaatctctgctcttgccccaccagtgagagcggctctctgtagatagcagcgccttctgt

SEQ ID NO: 6800948 - DNA, 72 bp, Homo sapiens
agaaatttttgagggcagtattaggttgattgggctgattcccacagctttgctttccttaatattctttct

SEQ ID NO: 6800949 - DNA, 59 bp, Homo sapiens
cagatatttttagtatttctgccttagtttgttaaatgattcaggtctgagagtatctg

SEQ ID NO: 6800950 - DNA, 69 bp, Homo sapiens
ggaaggaaagcaatttaatggaccatgacagagtaagtcactgtcattccctggctttgtttcccttcc

SEQ ID NO: 6800951 - DNA, 59 bp, Homo sapiens
ctgagagtagtactgagaactgcggtagccatcatgccgcaacttatcgcattctgcag

SEQ ID NO: 6800952 - DNA, 88 bp, Homo sapiens
gtgtgaggaaaaacctagtgttttaaagacatttgttgatctaatgtctaatgaattaattaattactaggttgtatttttcctacac

SEQ ID NO: 6800953 - DNA, 83 bp, Homo sapiens
caaagccatgagaacagctgagtttccaagtctgccaaagaatgactgggcaaggcctgcagctcagtgtgtctctgtttttg

SEQ ID NO: 6800954 - DNA, 116 bp, Homo sapiens
gcgttgaccgtggagggcagttcaggcggtttgttggggtccaggcccaggcccggtgtctcgggcccggctcccgacgcccggccaggacagtagggcccatagggatcataagc

SEQ ID NO: 6800955 - DNA, 77 bp, Homo sapiens
gatttaccaatgagaggcttacaaagattgatgagagtatttctttctttcgttgatcaaagcctgtctgatatttc

SEQ ID NO: 6800956 - DNA, 112 bp, Homo sapiens
gcgaggtcaggctgccagccagggaaggggcagggaggtaagaaaggagagaaaagttctcagctgcctgccctgctccctccccactccctggctgagggctgccctctgc

SEQ ID NO: 6800957 - DNA, 69 bp, Homo sapiens
gcagtaatctcatatcaatttccagttcttgaataacaatattcaaagttgaggttgagattccgctgc

SEQ ID NO: 6800958 - DNA, 60 bp, Homo sapiens
acattctagatatgttatatttcttgtaactcgaaaggaaatgatgaatggtcagagtgt

SEQ ID NO: 6800959 - DNA, 69 bp, Homo sapiens
ggttgctgtcaaggttacatgctttctcttccatatgcagaaagcttcacctgctggcaggtctcagcc

SEQ ID NO: 6800960 - DNA, 75 bp, Homo sapiens
taaatatctattcagcatcaatgatgaggattgtctttttttctcttgtaatttagtgatgcagtggattatttg

SEQ ID NO: 6800961 - DNA, 55 bp, Homo sapiens
atcaacatagccactccttagagcagagtgattggttcagggatgaatatgtgat

SEQ ID NO: 6800962 - DNA, 71 bp, Homo sapiens
gagcaaacatcctgactgtaactaagagacttttgctacaaattctctcttgggagtcagtgataaggttc

SEQ ID NO: 6800963 - DNA, 88 bp, Homo sapiens
ttgatgtgtgacttcagaatagagactactcagagatatgtaatcttattagtgtctgtctgagttttttcactgtcataacgtacaa

SEQ ID NO: 6800964 - DNA, 73 bp, Homo sapiens
ctgctgctgtaactcagttggggacctcgcctcaggggaggggaaggctctggggattgagataaaagggcag

SEQ ID NO: 6800965 - DNA, 100 bp, Homo sapiens
agttgatatgtaaatccagttagcaaagagaaaaattatgctaatattaacattgtcattttttttgccacagtaagtctggatttgtcagacatcaatt

SEQ ID NO: 6800966 - DNA, 55 bp, Homo sapiens
cggccgcgacccgcagctcaatcgcagggcaaaccgagctgcctgtgcgcgcccg

SEQ ID NO: 6800967 - DNA, 56 bp, Homo sapiens
ggggagttgctgcctgaatgccccacaacataggggccatgaggcagctgcacccc

SEQ ID NO: 6800968 - DNA, 80 bp, Homo sapiens
gatgccacccccgtgagcagctggggcctgtgacgatgaccgggaacacgcactccctgcctcagcttttggtggccatc

SEQ ID NO: 6800969 - DNA, 59 bp, Homo sapiens
cagtgcaggcttgtggccgcaggaagctctcttgtctggcatactccctgctctcactg

SEQ ID NO: 6800970 - DNA, 80 bp, Homo sapiens
gctgctttctgattactcacattctgtttcttgcttttaaaaaaacagtaaagacaagagtgttggaccagtattgcagt

SEQ ID NO: 6800971 - DNA, 68 bp, Homo sapiens
gcctggggccgtctggaaagggcattctgaacaatcttggaaggatgtccacccagaccttgccaggc

SEQ ID NO: 6800972 - DNA, 71 bp, Homo sapiens
gcccagtcaagttttcagaaattgcgacccaggccaacaacctgactgcaacttcatgagagaccctgagc

SEQ ID NO: 6800973 - DNA, 58 bp, Homo sapiens
gccaggctttttctgggtcggagaactggagttctgcctggattttggaaagcttggt

SEQ ID NO: 6800974 - DNA, 130 bp, Homo sapiens
gactttacaagtaaagcaaagtttgattcgtggatttaggaggaaaggtatgtgcatacatgcatgtgtgtatgcattcattcattctttctaatgtgtaaatcataagttttcaaatatttgaagtgtt

SEQ ID NO: 6800975 - DNA, 57 bp, Homo sapiens
taattgctggttattatcatgtcattattaactagtaataatagtagccggcattta

SEQ ID NO: 6800976 - DNA, 67 bp, Homo sapiens
actggtcacctatagaggagatgtaacaaagtttagttggacacatcatttgtctgtagctgaaagt

SEQ ID NO: 6800977 - DNA, 73 bp, Homo sapiens
agataggaaagggcagagctgggagccaagtgttaagtattttagtccccagagtctctgctcttgcctcact

SEQ ID NO: 6800978 - DNA, 57 bp, Homo sapiens
tgtgtacattgccttttaaaggtgggtcaaaggcaccatccttggcacgtttataca

SEQ ID NO: 6800979 - DNA, 58 bp, Homo sapiens
caggccagaacagctctgcaccatcacatatcgtgttgcggcttagctgtttggtctg

SEQ ID NO: 6800980 - DNA, 129 bp, Homo sapiens
ggagttacttggttagtttttgtgtttagccatttagtagcaacgtgttaaatgagacagaatggaatctggaatttaaagatcatttcatgttttcttaaatggcatatgaaagcctatcataacttt

SEQ ID NO: 6800981 - DNA, 113 bp, Homo sapiens
ttttttctctttccatttcagtggcttcatttctgccagaatttaacattgacagggtgatgttgcctcttttctggggggaaaaagaagctctctgttgtcaagaaaaaaaa

SEQ ID NO: 6800982 - DNA, 129 bp, Homo sapiens
cccaatcaggaggctcctcgatgtgacgtggatccgtgtttcctcttcttcttcctggtggtttacgtaagagggagagcaatggggacgggcagggacagagctgcgggctgaggttcctccgttcgg

SEQ ID NO: 6800983 - DNA, 76 bp, Homo sapiens
gcgcacccacggctgccagtcctgagcctcttctgctttcagggaggtgtcatcaggcagctctgggccactgggt

SEQ ID NO: 6800984 - DNA, 75 bp, Homo sapiens
cttttcccattcgtgtctatgaagatgttttctgttcaaatgttaaccttcaactgggcttcgatgtggggaggg

SEQ ID NO: 6800985 - DNA, 61 bp, Homo sapiens
gtcattcctcccttggagtaagacacgtacataaataattataatatgaggcaggagtgat

SEQ ID NO: 6800986 - DNA, 70 bp, Homo sapiens
gtctggtacagctaagaatttcatctttgtcatgcgtaagctgaaagattaaattcatactgtactggat

SEQ ID NO: 6800987 - DNA, 90 bp, Homo sapiens
gtaagtgtgtggtataatttctggtacatagtaagaacacaattaatgctagttgtttttagtagtgctattactactactactacttat

SEQ ID NO: 6800988 - DNA, 83 bp, Homo sapiens
gctcccttcctgaatgctgttgtgctgtggagctgctgtcatattcaaccccacaggtgcttgcatatcagtggtgggtgagc

SEQ ID NO: 6800989 - DNA, 69 bp, Homo sapiens
aataggctgacctcctttctcgactaattgcattacatcgccagctggctccagaaggagtcgtctgtt

SEQ ID NO: 6800990 - DNA, 63 bp, Homo sapiens
catgggtaggatttactcagatgttagactgatttagagacaaatgtagtgtgtccacccctg

SEQ ID NO: 6800991 - DNA, 59 bp, Homo sapiens
tccttttccaaatgaacatttgaacttatggcagagacaaaagtttgacaggaaaggga

SEQ ID NO: 6800992 - DNA, 84 bp, Homo sapiens
gtggggggaacctggtggcaaccctgtccccactgggcaaccatctgaagacaaagtagggtgcctgctgcaggttcagcccgc

SEQ ID NO: 6800993 - DNA, 60 bp, Homo sapiens
tctacctgcatcttcatatacttctatccaattcttaacagtgtgtgataggcaggaaga

SEQ ID NO: 6800994 - DNA, 62 bp, Homo sapiens
gcaaagaaattgggtctgtgtttaattttgatgtttcaaattttgagcttccaagtctttgt

SEQ ID NO: 6800995 - DNA, 56 bp, Homo sapiens
tgtgtaatggggaagggttttcttcatcttggcttaactctacccctgttatcgca

SEQ ID NO: 6800996 - DNA, 59 bp, Homo sapiens
gagaattcatttgatcctgatgctggaaatatatcctgcttggagtagaatgcattctt

SEQ ID NO: 6800997 - DNA, 86 bp, Homo sapiens
gagtctcactctgttgcctaggctggaatgcagtggcacgatgtcggctcactgcaatctccgtctcccaggttcgagtgattctc

SEQ ID NO: 6800998 - DNA, 85 bp, Homo sapiens
ctgggatgtgttaaattagcaatctgaaaattgcggggaggaacgaaatcagcaagagttggggttgttgggagcggcttcccag

SEQ ID NO: 6800999 - DNA, 56 bp, Homo sapiens
tgtcaatagttttgagttctctacaaaactacagagaccaaggtacactattgaca

SEQ ID NO: 6801000 - DNA, 60 bp, Homo sapiens
ggtgagcagttgtataaagactttgatagtctacaatgtctgaaatatttactgtttgtc

SEQ ID NO: 6801001 - DNA, 66 bp, Homo sapiens
tgcttctgactgggtcagttgaactagcaattctctagctgacacaatacttccttgttagaggca

SEQ ID NO: 6801002 - DNA, 64 bp, Homo sapiens
gatgacagttctagcatctgaaccctgcccaagacggggctcctcagcatcctgagctgtcctc

SEQ ID NO: 6801003 - DNA, 55 bp, Homo sapiens
gggctgtgtccacaaggcctgccctgccagcggcactgaaccaggacacaagccc

SEQ ID NO: 6801004 - DNA, 81 bp, Homo sapiens
ggcacaaattcgctctgcactgtccggctttcttcgctatgtattgaatgaaagaacagctgacagaagacagtttgtgtc

SEQ ID NO: 6801005 - DNA, 129 bp, Homo sapiens
ctgttcaagattcgttaaatggcagaaggaactttacagatatgattcagttgagaatcttataatagagagattagcctggattatgcaggtgggccctaaatgtaaccataaatttacttataatag

SEQ ID NO: 6801006 - DNA, 67 bp, Homo sapiens
tattatagactgagggtcaggctgattgacttttatattctgattctgccactttctgtctgtgata

SEQ ID NO: 6801007 - DNA, 102 bp, Homo sapiens
ggaaagaaaggagagaggatgagaagaagggaggaaggaaataaaaacattatcaggatatttctttgcaactcccatttccatccttcttttgttctagct

SEQ ID NO: 6801008 - DNA, 102 bp, Homo sapiens
tgagatggagttttgctcttgttgcccaggctggagtgcaatggtgcgatctcggctcaccgcaacgtccgcctcccgggttcaagcgattctcctgcctca

SEQ ID NO: 6801009 - DNA, 66 bp, Homo sapiens
agaaaaatgctgggaaagttggaattccagattaggaacaagttcacatgctctcatgctttttct

SEQ ID NO: 6801010 - DNA, 71 bp, Homo sapiens
cagcttcatcagaaaatacccagtgtttaaaagtctcctcttctttaagtcagtgttttttctggaagttg

SEQ ID NO: 6801011 - DNA, 73 bp, Homo sapiens
ggcagtcctgctccaccgtgggctggacgaagacatcatctactccagggcatccacgcgtggggtgggagcc

SEQ ID NO: 6801012 - DNA, 55 bp, Homo sapiens
tcaggtgtgttgtattttaccaggttttccatgaggatcaagtacgatcacctgg

SEQ ID NO: 6801013 - DNA, 91 bp, Homo sapiens
caaaataaaagacatcacaggcaaaattccttctctctctccctctttttaactagggaaggaaatcttgcttgtgagcagctgaattttg

SEQ ID NO: 6801014 - DNA, 90 bp, Homo sapiens
gtaggtattgacttggtgtcttttttatacatgttgtcatttcatagacactggctgaaagtaaagaacaccaataaagtccttatttac

SEQ ID NO: 6801015 - DNA, 55 bp, Homo sapiens
gaattggggctctgggcagggagctctgtttggttcactgctctagccctaattt

SEQ ID NO: 6801016 - DNA, 72 bp, Homo sapiens
gtagaccatctgtctcctcctcgaattgtctgatataattcagctcaggtgtggaggaattgatggcactat

SEQ ID NO: 6801017 - DNA, 107 bp, Homo sapiens
ctgacccttcccctctggcctctctgcgtggtaggactcagttctcttacctgttaattgggggtgagaatccttctcccaccagctgggaagagggtagggagcag

SEQ ID NO: 6801018 - DNA, 73 bp, Homo sapiens
cagtttggatcctgctaaaccagaataaaaagtctagaacatggatgtcctcttgatttagcagatctagctg

SEQ ID NO: 6801019 - DNA, 103 bp, Homo sapiens
taagtacctactgagtgaatgagcggccttgaaattgttttctgaggctggggaactcttgccaggaatttcaagagccactgcttttacacttggccactta

SEQ ID NO: 6801020 - DNA, 59 bp, Homo sapiens
ggtgtgcacgaaggaccagcagcagagtggcactgcctgaaggtgtctttgtgaacatc

SEQ ID NO: 6801021 - DNA, 76 bp, Homo sapiens
tcttattatcatgttaattagtgggagggctgttgaggttttccacttcattacctactaatttcaagataaatga

SEQ ID NO: 6801022 - DNA, 55 bp, Homo sapiens
gcatttactatatgtcaagcttacttgtaggtgatgaaagttcagtagtgaatgt

SEQ ID NO: 6801023 - DNA, 83 bp, Homo sapiens
ttggataaaaggacaaaatggtacagaatgtggcagtcactgttagttgtctattcaatatccatttcttctttacaaaccaa

SEQ ID NO: 6801024 - DNA, 78 bp, Homo sapiens
ctttctatacaggcgggacgtgggaggatcagacaggtaaggactctctgagcccagcgtcccgttctgtaaaatgag

SEQ ID NO: 6801025 - DNA, 70 bp, Homo sapiens
gacaactctggcttagtatgctccaaatcagcacaaaacagatatgggtgttaatggtgagagatatgtc

SEQ ID NO: 6801026 - DNA, 105 bp, Homo sapiens
cccatccctagaagcccttgctaacccagtctcctcgtgtaaacctttccccaggtttacactccaggctggggtgggcaaacaggggctcagctataggatggg

SEQ ID NO: 6801027 - DNA, 82 bp, Homo sapiens
cctctagacagtggcattagtttttagaaacatcagaagttccaagggcactgactctgagaatagtgccactgtggagtgg

SEQ ID NO: 6801028 - DNA, 81 bp, Homo sapiens
aggtcccgaggggcgggaggccagggtgggtggcctgcttggccaccccaaatgaagacctctcctctccccctttttcct

SEQ ID NO: 6801029 - DNA, 62 bp, Homo sapiens
atcatcatgagtcattagcactattaatagtggctatgctattagctttggattcagaagat

SEQ ID NO: 6801030 - DNA, 71 bp, Homo sapiens
ttgagatgggcattgagaaagaactttggtaaactataagcaagagtaatttttggacaatgccattttga

SEQ ID NO: 6801031 - DNA, 60 bp, Homo sapiens
gcagaggccaggccaccagcaagggccaaactgacaccctcctggaaacctcttctctgc

SEQ ID NO: 6801032 - DNA, 55 bp, Homo sapiens
ttcctgatggaaactcttaaggctgaaagaggattcagatttaatctctcaggaa

SEQ ID NO: 6801033 - DNA, 82 bp, Homo sapiens
ttgtggtttgtttagctattcacttgttgatggatgtttgaatttttaacatttttgactattgtgaatacaacagctacaa

SEQ ID NO: 6801034 - DNA, 76 bp, Homo sapiens
gctcttatctctttctatttcttaaggcaatgctgctataaatgcctggattaggagtgtgaagacctgatatagc

SEQ ID NO: 6801035 - DNA, 66 bp, Homo sapiens
gccatggggagggcagcgcctggttgctgggagggcagtgacaacagtgggcttgttttccttggc

SEQ ID NO: 6801036 - DNA, 61 bp, Homo sapiens
ggaccacatcttttttcctgaacagccctgaaaaggagcatcaagaaatggatgtggggtc

SEQ ID NO: 6801037 - DNA, 69 bp, Homo sapiens
gataaggcagtgacttcatctatttttccatatgtgctgactctgcaatagatgaattctgcctctgtc

SEQ ID NO: 6801038 - DNA, 58 bp, Homo sapiens
aaatgtctacttcccatctgtatttcaggttagatacacaagtgggaagtagatattt

SEQ ID NO: 6801039 - DNA, 64 bp, Homo sapiens
atgcctgtgtcatctttcttgttcacatttatatcaatgctgagcacagcaaagagacaagtat

SEQ ID NO: 6801040 - DNA, 101 bp, Homo sapiens
tggacacttttatttattcattcatccaacacgtatttgctggccgcctgctatgtgccagtctctgagttaggacattgcagtgaaaaatcaaagttcca

SEQ ID NO: 6801041 - DNA, 83 bp, Homo sapiens
aaataatttgaaagacaatatggccaaagaattttatctggacctttcttacaggactttgtcattttgtctctcagttattt

SEQ ID NO: 6801042 - DNA, 62 bp, Homo sapiens
acccagtggtgggtgtgtcagtagggtcttggcaaggatcagatggaacactcaaactgggt

SEQ ID NO: 6801043 - DNA, 88 bp, Homo sapiens
gggtcctcgtccctgaagagtgtgaggttgtgcttttggatgtgtcccagcagcacctgtcctcgctgctccagggtctggaggacct

SEQ ID NO: 6801044 - DNA, 82 bp, Homo sapiens
ctattttaatgttgatttgcataatgtttggcctagcaagaacaatactgaatgctaatagctacagaatgcaataaaatgg

SEQ ID NO: 6801045 - DNA, 66 bp, Homo sapiens
ttcaagttccttcctgagctattgctcattttctcatgaatcagcaaaagaaggaagcagcttgag

SEQ ID NO: 6801046 - DNA, 57 bp, Homo sapiens
tggtctgtcatttatttgcctgaagattttcttgctttaaaatggatgacagtacca

SEQ ID NO: 6801047 - DNA, 69 bp, Homo sapiens
gtcttcacaacttctcacagataaatttcttattaatgtactaggttttagagtgagagttctgaagac

SEQ ID NO: 6801048 - DNA, 64 bp, Homo sapiens
ctggccctatgagcctcctgatgccctggagagtgggggctccaaaagaagctcttggggctag

SEQ ID NO: 6801049 - DNA, 75 bp, Homo sapiens
cagattgaaagaaggtacttgaggacaatgagagaaaatctggattattgtatgatgtgcttcactttcagtctg

SEQ ID NO: 6801050 - DNA, 64 bp, Homo sapiens
acctttgaagcagccacgtcagaaagcagaagaaaacaacatttctgaaggcattttccaaggt

SEQ ID NO: 6801051 - DNA, 76 bp, Homo sapiens
tttttcttctcaaaggaggtgactgtagggagggttggataccaagggctcacccaactcacttctgagagaaaga

SEQ ID NO: 6801052 - DNA, 84 bp, Homo sapiens
tctcagcacctcactctgtgctcattcagtcattcaacaaacattgagtatccttgctggatgggtcctagaccagtgctgaga

SEQ ID NO: 6801053 - DNA, 93 bp, Homo sapiens
ctagtgtctctggctgagttctcacccattcttcttcctccttggcgtcaaaataaaaggatgggaagagtgataacttagtcacatcactgg

SEQ ID NO: 6801054 - DNA, 58 bp, Homo sapiens
acccagggtagagtgcagtggcgaaatcttggctcactgcaacctctgcctcccgggt

SEQ ID NO: 6801055 - DNA, 68 bp, Homo sapiens
gccccggggtctgtctcaaggggaggcagctgctgcggcctcccacattgaggacatgcttggggagc

SEQ ID NO: 6801056 - DNA, 71 bp, Homo sapiens
tgcctcaaagcgtgatgttctgagctgaaaattacatatagtgtaaagatccttagcaacatcaaagggca

SEQ ID NO: 6801057 - DNA, 108 bp, Homo sapiens
tcatagaaattctgactcttttttgttctttcacagttaatgcaatataaattttgttcattgtactttaagagatgccaaggggtttggtttgcaatatatctatga

SEQ ID NO: 6801058 - DNA, 81 bp, Homo sapiens
gaggacctgtttagtgaggtgaggagtaactggctatggttttatgatgccacggcttctccacttcctcaagctggcctc

SEQ ID NO: 6801059 - DNA, 70 bp, Homo sapiens
agcacctccaagaagctttccctgcttgcacctgccccaggctgcattaggaattgctccatgaggtgct

SEQ ID NO: 6801060 - DNA, 64 bp, Homo sapiens
gccctgtggttccaggaagcaaaacccaacccaccgccaagtgcgctcccaaaccaccaggggc

SEQ ID NO: 6801061 - DNA, 65 bp, Homo sapiens
tttctccagctcagcatccttgctttgcaaacccaatcaagccttaggagctctgtgctgggaag

SEQ ID NO: 6801062 - DNA, 76 bp, Homo sapiens
ggggagggccaggcggagacaggcgaggccaacagagcccctgccaccttgcctgctctctcacctgccccgcccc

SEQ ID NO: 6801063 - DNA, 90 bp, Homo sapiens
gttcagagccacccttggagagaggctgctcaggctcagctccctgtgctgggctttctagatctagctctgttcgggggagttcttagc

SEQ ID NO: 6801064 - DNA, 64 bp, Homo sapiens
gtagctactgcagttgttgcatttaaattgatttacatgtcaagactggcagtttagcagctgc

SEQ ID NO: 6801065 - DNA, 64 bp, Homo sapiens
tgggcatgaggttacctatctcacaggattgttgtgaagattaaatgaagtgacctgtgcatca

SEQ ID NO: 6801066 - DNA, 79 bp, Homo sapiens
gccccaggtttgtttctctaaggctacattgtgcaatgccagagtgcatgcatctggtcttggaaatagaatatggagc

SEQ ID NO: 6801067 - DNA, 56 bp, Homo sapiens
taagaatcagaataattagatttcagatcactagatctgagcttttctgagttttg

SEQ ID NO: 6801068 - DNA, 60 bp, Homo sapiens
tagtgacatttttacttcctatttgtttagcttttatgaaatgtggaagtgaggacactg

SEQ ID NO: 6801069 - DNA, 104 bp, Homo sapiens
tggagctgggagctgctcggcctggtgggaaagggcggacagggcacatttccaggccctggaaggcccccagcgcccccacctgttgacaactccccacccca

SEQ ID NO: 6801070 - DNA, 79 bp, Homo sapiens
tttcaagagttaacgcatggtttctctgctgatggtggcatatcccagggcaaatgagatcatagcattaatgaggaga

SEQ ID NO: 6801071 - DNA, 56 bp, Homo sapiens
cttcaggaggttgaccacggggcaaaggatttgctctccttctcagctttctgagg

SEQ ID NO: 6801072 - DNA, 66 bp, Homo sapiens
actgttacagagcaggaaattgtaatattttagggaaaggtgagagattttctgactcctgatggt

SEQ ID NO: 6801073 - DNA, 67 bp, Homo sapiens
gaaactctcagatgtttctggagggttgcatcatttttcgccctcatcagcagtggatgagagtttt

SEQ ID NO: 6801074 - DNA, 60 bp, Homo sapiens
ggcttcctccctctctcaaagtgtccctgcaagtgctggctgggccagggagaggaagcc

SEQ ID NO: 6801075 - DNA, 61 bp, Homo sapiens
caggctgcgtttgtgaaaggtaattaaattgtgataatgtttccattcagaccccagcttg

SEQ ID NO: 6801076 - DNA, 57 bp, Homo sapiens
gctcctgtcagtcatcaggtgctggtaaccagaaatgcctgccatctgaacaggggc

SEQ ID NO: 6801077 - DNA, 78 bp, Homo sapiens
atttgtagagatagtagagactgtttttaagtgctgttttgtaatttgagaactactttattattctttttactgaat

SEQ ID NO: 6801078 - DNA, 58 bp, Homo sapiens
gagtaaatgacaaaatagactaagaaaacatcatctagttatgttatgttgtttactc

SEQ ID NO: 6801079 - DNA, 65 bp, Homo sapiens
gtaattaggtagaaatctattttaaccaagctgcagtatgcagttgagtatatttcttcctttgc

SEQ ID NO: 6801080 - DNA, 89 bp, Homo sapiens
aggtcttgacagtgagagtgtttggaaatagaaaggggttcttttggtggcattttctcttttgttccttgacattttcctgtggatct

SEQ ID NO: 6801081 - DNA, 92 bp, Homo sapiens
agtttaaattgattttagttttacttgcgatgataatttctgcctgagcaaggaatatcttctaaggatagaactggatgctaatttaaatt

SEQ ID NO: 6801082 - DNA, 82 bp, Homo sapiens
cctcggcgctttatggccaagcatatacagattgagttttcagaacataatttgtgcttgggtctttctgcgatgaccgagg

SEQ ID NO: 6801083 - DNA, 93 bp, Homo sapiens
atactggtgatcatgcatgttactgcccccgtctccctgcgaggtaagacatagagatggaagacagtgatattgatgatcctgaccctgtgt

SEQ ID NO: 6801084 - DNA, 77 bp, Homo sapiens
atcttgacatgaggctcttctgtaaatgatcttatctgtgatcatgcaaaccgaggagtccagagtgcatgtgagat

SEQ ID NO: 6801085 - DNA, 61 bp, Homo sapiens
tgaggggttttcttcaaaagtctagaagcaaacaacttccattttagaagaaaatccacca

SEQ ID NO: 6801086 - DNA, 66 bp, Homo sapiens
gcattattcagagtgtagcaaatagataatatagctttatctacacagcatcgctcagagtgcagc

SEQ ID NO: 6801087 - DNA, 60 bp, Homo sapiens
cctggtcaatgtttctctccactgtcgtgacgttgggcagaagcttgttgtgcagccggg

SEQ ID NO: 6801088 - DNA, 68 bp, Homo sapiens
gagaacagaggccatgagctgccacctggaaaacattagctacagtttggttgtgagaggcctttctc

SEQ ID NO: 6801089 - DNA, 130 bp, Homo sapiens
tttgcatgaattgcaatgcttcctcttccttacaggcctcttactaccttaaaaatgctagcaaggtgccagggtaggcagataggagtgcagcctataaagatgggaatgtttgctgttcttatgcaag

SEQ ID NO: 6801090 - DNA, 68 bp, Homo sapiens
caggggctgctgcagtccagcatttgtgccagcgaccgaggctgcagagaccccgcagtgaggccctg

SEQ ID NO: 6801091 - DNA, 64 bp, Homo sapiens
attgtaaatagtgccacaataaacatacttgtgcatgtgtctttatagtggtatgatttataat

SEQ ID NO: 6801092 - DNA, 59 bp, Homo sapiens
tcttaggattccagttcagggcatcgtaagctacacagatcccagtctaggtcctagga

SEQ ID NO: 6801093 - DNA, 126 bp, Homo sapiens
tagctgtggattacatgtgtttcaaatgtatagctaggaattgaaaagtggtctgagcttcaaaaagtcttgctatattttaatacttccatatgaatttgacttaattatgtaaggaaatagtta

SEQ ID NO: 6801094 - DNA, 64 bp, Homo sapiens
ggcatgcagcagcagggaggaggctctgggcataatttcagtgctgattccaggttggctggtc

SEQ ID NO: 6801095 - DNA, 65 bp, Homo sapiens
ggggaagcagacctccaaggtgagagaggatggcaaagtagccgatcttcagaccttggggcccc

SEQ ID NO: 6801096 - DNA, 58 bp, Homo sapiens
accccagcatatcatggtttcgtggactgaaaatccatccggggtcatctgctggggt

SEQ ID NO: 6801097 - DNA, 55 bp, Homo sapiens
gcctccacagtgcagtcattccttgatcacaaagtttctgccatactgtggtggt

SEQ ID NO: 6801098 - DNA, 87 bp, Homo sapiens
gtgttcattaagaaaatagttatgctctagacaagaatgcttccagatttcttactgtttaagtatgactagctcatgattttctac

SEQ ID NO: 6801099 - DNA, 64 bp, Homo sapiens
tcttagaaatccagggacctactctacttatccaggaccggattttagaacctggatttcagga

SEQ ID NO: 6801100 - DNA, 118 bp, Homo sapiens
gaagaaaaggcatttgacaaaatcctgctaagattctgttcttaaagattcatcaagcacaacctgtgttgagaaggatcatttgagagggaggaacattgataattgtctattcttc

SEQ ID NO: 6801101 - DNA, 66 bp, Homo sapiens
aggcagagcttttagatgttgaacaagaacaggaaattgtgtgcgtttttagagagccagctgtct

SEQ ID NO: 6801102 - DNA, 102 bp, Homo sapiens
gaataattttgcaaatgtgtctgatctatctatcttttgaactctcttggatatggtgtcctaaggtctagatttatagacagcatgttagtaagtctgttt

SEQ ID NO: 6801103 - DNA, 78 bp, Homo sapiens
aagggatacaccagagagtgagataatttcacatacaagtgatgtgtttgagagagatttcctttctggtgagccttt

SEQ ID NO: 6801104 - DNA, 58 bp, Homo sapiens
gggcacagcctaactatggagacccagggctccttcctgctgcactaggcctgtgctc

SEQ ID NO: 6801105 - DNA, 58 bp, Homo sapiens
aaagagcaagctgttcctgagaattcatttatttgcttccaggatgctgctgcttttt

SEQ ID NO: 6801106 - DNA, 91 bp, Homo sapiens
ggcaagcaccagttgagaatgtatttttgtgtgagcagggtgttatcagtaaggttcaacatgttctacataagggactggaagctctgcc

SEQ ID NO: 6801107 - DNA, 57 bp, Homo sapiens
tgtcatgtgagggaacttgttccattgttaatttatgctgcgaattcctccatggca

SEQ ID NO: 6801108 - DNA, 66 bp, Homo sapiens
actgggtttaggccgggcaggcccaggcctggtttcgggcctggcgccgggctgcctgtctttggt

SEQ ID NO: 6801109 - DNA, 62 bp, Homo sapiens
aggctgaggtgcttggggacagatcgggccaccttgcccagcagtacccaagcccttggcct

SEQ ID NO: 6801110 - DNA, 58 bp, Homo sapiens
gacttccaagttagaacttgaacactaggatttaaatgatcaggactgacttgaagtc

SEQ ID NO: 6801111 - DNA, 71 bp, Homo sapiens
gggtaaaggatgtgtgtacaaggaaaggagaagaccatttccttctctgtacctcacatgcaccatcccct

SEQ ID NO: 6801112 - DNA, 58 bp, Homo sapiens
gaggggcctggcgaggacatgtagaaagactgcgttttccttttcaatcgggcccttt

SEQ ID NO: 6801113 - DNA, 74 bp, Homo sapiens
tgctgtgctgcacgtaattcttactgtataaagctcaaaatttacatcagcaagagtgtatgtgtggatcagca

SEQ ID NO: 6801114 - DNA, 56 bp, Homo sapiens
gccctagctgccccagcggctctggtttcaccttcttctgggaaatgagctggggc

SEQ ID NO: 6801115 - DNA, 77 bp, Homo sapiens
ctccccagctcagggacagtagctatgtggccacattttcctcatggcaggcattagagattcccagaggggtggag

SEQ ID NO: 6801116 - DNA, 69 bp, Homo sapiens
gtgtcatttctgtctcaaaagtcctgtattttgtcttgcagttcagagactggagatgggcagtgtcac

SEQ ID NO: 6801117 - DNA, 58 bp, Homo sapiens
tagagatacagatgggcgaggccagcagcttttgggcttttctccagctgtgatttta

SEQ ID NO: 6801118 - DNA, 59 bp, Homo sapiens
ggagtgtttgtgagtttaacttggcttgaataccaagttcttgctataaaaacaaatcc

SEQ ID NO: 6801119 - DNA, 98 bp, Homo sapiens
aatatgtgctctttttgtgtctagcttctttaattcagcatgatgtttttgagccttatccgcatcatgctgaattaaagaagaacatcgtacatgtt

SEQ ID NO: 6801120 - DNA, 91 bp, Homo sapiens
gccatgacacctctgaaactctcccctggtcttacctcacagtgacctgcaaggaaagtcactagaaccagaggaggcaggtttggatggc

SEQ ID NO: 6801121 - DNA, 66 bp, Homo sapiens
gtgccacagtttgctgacccttgccttagatggatgaagcatgggctgaaagagtaagctgtgaac

SEQ ID NO: 6801122 - DNA, 88 bp, Homo sapiens
tggcaagtgatgatttggatgtgcacactcactagaaccagcttccacgggttttgctctgaaccacaccatcacactcctcctgcca

SEQ ID NO: 6801123 - DNA, 59 bp, Homo sapiens
cacctgggtcattgctggtgttaaggcagaaggaaaagacaacacggcagacccaggtg

SEQ ID NO: 6801124 - DNA, 88 bp, Homo sapiens
tactatcctactgtcatttttttagaacacctgtatttttacataagatttattttaggggatgtttgccaatgatttttaggtagtg

SEQ ID NO: 6801125 - DNA, 69 bp, Homo sapiens
gttctattgtaataagcgggtgaagagtggggcttatttgttttagcagctggtgttaccatagcagac

SEQ ID NO: 6801126 - DNA, 72 bp, Homo sapiens
agagccatccttgccctaaatgtctgtgtgatgagctgtaagaccctacacggcactttaggaaggggcact

SEQ ID NO: 6801127 - DNA, 57 bp, Homo sapiens
ggttgctcctgagagccattctaatttcaggaccagaatggaaactgggagatggcc

SEQ ID NO: 6801128 - DNA, 78 bp, Homo sapiens
gagtcacgttaattctcttggttttgctgcaatgtattatgactctgtcaggagggtccagagaaaacaatgtgattt

SEQ ID NO: 6801129 - DNA, 77 bp, Homo sapiens
gggagacatatgcccacctagaatttcagaacttatagttgttatattgagagtttgggggcaatatgatagttccc

SEQ ID NO: 6801130 - DNA, 63 bp, Homo sapiens
ctgaggtacctggagcaggtccccctgagcaccgtcaacagggtctccttctcaggcatccag

SEQ ID NO: 6801131 - DNA, 95 bp, Homo sapiens
aatttactcattcacattgtgcagattatggtcgctcttctctcacaattattttgcaaccttgtttagcatatgtgactgatagtgggtaaatt

SEQ ID NO: 6801132 - DNA, 89 bp, Homo sapiens
gggattcgctcttttgtgcccaggctggagtgcagaggcgagatctcggcccactgcaacctccgcctccccgggttcaggcgagtctc

SEQ ID NO: 6801133 - DNA, 66 bp, Homo sapiens
ggcacaaggagagggcaggcctaggaatggtttagctgcatcctgatgatattgctctttcttgct

SEQ ID NO: 6801134 - DNA, 76 bp, Homo sapiens
gagaccttaggcaagaccttccctctttatggacattcctgcctctgtaaaatgaaagtatggcttgtttggtctc

SEQ ID NO: 6801135 - DNA, 69 bp, Homo sapiens
tatggccacaatggggagaaacttggcccagtttagagccaggactcaattttgccatagtcggctata

SEQ ID NO: 6801136 - DNA, 59 bp, Homo sapiens
gcagtagggttctggggcgatgttgcggggagcagcatgatttatcacaacccttctgt

SEQ ID NO: 6801137 - DNA, 69 bp, Homo sapiens
gaggatggacagctcttatgtgggcatgttacaaaggccgtactgacgtagtagagttgcttctttctc

SEQ ID NO: 6801138 - DNA, 67 bp, Homo sapiens
cttcaactgatttagtctgtgccatcgtatttcctgatgcccctgggataggcaaatatagtagaag

SEQ ID NO: 6801139 - DNA, 62 bp, Homo sapiens
ctgagctcaggctgaatcatcctagcttttctataaacatgagaagccagctgccagctcgg

SEQ ID NO: 6801140 - DNA, 94 bp, Homo sapiens
agaaccaacatagaactagtaaaagcaacagtatagcctggacagttcaagggatatgctgacgcttatattgctaagaaatttaccatggtct

SEQ ID NO: 6801141 - DNA, 58 bp, Homo sapiens
ggcagcacatgcttcttgtcgcttggaagccagcttccatgcaagaagtatggctccc

SEQ ID NO: 6801142 - DNA, 70 bp, Homo sapiens
gctactgatatggtaactgtgtttctaaggtagagtccattaagaaacaaggatgccacagtcaggtggt

SEQ ID NO: 6801143 - DNA, 57 bp, Homo sapiens
ccttttttctatgccaactctgcttcccagtcaagcggaaggagccaagagaaaagg

SEQ ID NO: 6801144 - DNA, 60 bp, Homo sapiens
gtgtatatgcatataaagcttttagtcatgttgggtgacagagagtgacatgcattgcac

SEQ ID NO: 6801145 - DNA, 61 bp, Homo sapiens
acacagagctggaactgcttcaatgctataaaccacgctctagcattaactagctctgtgt

SEQ ID NO: 6801146 - DNA, 59 bp, Homo sapiens
gactagccctgtaggcacttgagtttcaacccatatttaaggcctgcttactgctagtt

SEQ ID NO: 6801147 - DNA, 62 bp, Homo sapiens
tagtggtgaggatgggtttggtaaaagggtcttctccctttcttcattcaccttcaccccta

SEQ ID NO: 6801148 - DNA, 83 bp, Homo sapiens
cctggagctctgcctgcctctctccccgcctctgcctccccccggagaggcggcttctgaggaggctgctgttggcggccagg

SEQ ID NO: 6801149 - DNA, 63 bp, Homo sapiens
ccatgcctgctctgacatccatcccagaccaaagagtctaggggctggcagaggcagctgtgg

SEQ ID NO: 6801150 - DNA, 66 bp, Homo sapiens
ttctgtttttatcatcctgttcactttttccagataaataaagagacaggaaacaagaaggcagga

SEQ ID NO: 6801151 - DNA, 72 bp, Homo sapiens
gttgtgctagtcacttaacaggtattattttgtttattccttataacaacctttcaaagtggctatcactgc

SEQ ID NO: 6801152 - DNA, 58 bp, Homo sapiens
ttcctttcatggttgaccttaggctggctatgatggttggtcattgcggtggaaggag

SEQ ID NO: 6801153 - DNA, 59 bp, Homo sapiens
ctggggtttaacaacgatgtaatagttacctgtctattacatggtagtcaaagctaaag

SEQ ID NO: 6801154 - DNA, 57 bp, Homo sapiens
ctgaccttgtgatccgcctgccttggcctcccaaagtgctgggattacaagcgtgag

SEQ ID NO: 6801155 - DNA, 103 bp, Homo sapiens
caactataacagctggtggcatttagattctaaatactgcttgttctcctatgtatgcatcattagaatcaggtgttataatcatccatggctgcaatagatg

SEQ ID NO: 6801156 - DNA, 69 bp, Homo sapiens
tgtttcactgtgtgtgtatctgcctatcacatatgtgtgtgcacataggtatacacatatacagagaca

SEQ ID NO: 6801157 - DNA, 110 bp, Homo sapiens
tctccttcccattccctggcccccggctctgccctgggccgttgtaaatcggagagattctgcggagcggagggcagaggtggcggccgcggggactcgggaggcggaga

SEQ ID NO: 6801158 - DNA, 73 bp, Homo sapiens
caccaggtatctaaaggatttaatttagtggtaatagacaccactaagagagcatccctttgctgcattggtg

SEQ ID NO: 6801159 - DNA, 99 bp, Homo sapiens
gccacaggatgataatggtggttaagagcagggactttaagtgggatggatttaagttcaagtcccagctcttcacttactcttagtttgacctttggc

SEQ ID NO: 6801160 - DNA, 92 bp, Homo sapiens
ttgggtctctccaccgccccctgtgagcggctggatgcctggaggaagctggagaggctggccagtgctgcagtgggccgggacaggaacaa

SEQ ID NO: 6801161 - DNA, 73 bp, Homo sapiens
gcagaagtgtgtctggcggcccagtggggtcctggcagccccacagtggaatgtgttgtcgggcaaaggctgc

SEQ ID NO: 6801162 - DNA, 82 bp, Homo sapiens
ccgggccgggctggagcgcctcggatgcggcgccggagggagacccaggtcctggccgccgcgtggggccgggccgggccgg

SEQ ID NO: 6801163 - DNA, 55 bp, Homo sapiens
tagaatgtggaggtaacagactcctaccggatctgtagatgcccaccaggtttta

SEQ ID NO: 6801164 - DNA, 58 bp, Homo sapiens
ggatttttcttatgctcttctctgcacgtctgcacaaagaaggcaaaagcagacatct

SEQ ID NO: 6801165 - DNA, 80 bp, Homo sapiens
gtggggaagccaagggcatcttgcatgctggcaccttcgagaggccgtacagctggagggtgcactttgcattgccccat

SEQ ID NO: 6801166 - DNA, 74 bp, Homo sapiens
gtgttcttctttgagctcagtgactcgactttatcaacagtaaaatgtagtctaattgagctatgtgataatat

SEQ ID NO: 6801167 - DNA, 64 bp, Homo sapiens
gtgggcagtgtgtaatgcatagagtagagcatttcacaatactttattgctgccatacttccac

SEQ ID NO: 6801168 - DNA, 98 bp, Homo sapiens
tctgaggatagctcctcccttctgaagccagggatacatccccattaaccacagggagggcgttctctgctataggcagggaggggactgtttataga

SEQ ID NO: 6801169 - DNA, 66 bp, Homo sapiens
tctggggagtgcctaagtggaagtgcttattctcctgctgccgctgctcacaggcatctccccaga

SEQ ID NO: 6801170 - DNA, 65 bp, Homo sapiens
gtgctgccaggtcttgctgtccatccttaattaaatggtgggtgggcgaggcaggagtggagcac

SEQ ID NO: 6801171 - DNA, 106 bp, Homo sapiens
gcccagggctgtgtgctgcgggaagaacgaccaggctcgggggagttctcccaccagtcccaccaggatcgctcttatcccgggcctcacttcacccaccctgggc

SEQ ID NO: 6801172 - DNA, 70 bp, Homo sapiens
atggtaatactcatggcctgtcagtcacccattagcatgattgaattagcattcatgtggtaattaccat

SEQ ID NO: 6801173 - DNA, 73 bp, Homo sapiens
tgagtgccatttctgggtagtatggttagttttataagaaactttcaaaatattttcagcaatggctatatca

SEQ ID NO: 6801174 - DNA, 55 bp, Homo sapiens
accctctgagtttttcccctagctcctgggactatgggtgggagagtctgagggt

SEQ ID NO: 6801175 - DNA, 62 bp, Homo sapiens
ctttgattcagactttgtcggcagagtacaattatcatgttttcacagggctgatatcagag

SEQ ID NO: 6801176 - DNA, 58 bp, Homo sapiens
aggcgcaggtggatatcatgtgcctatggatagaggcgcagctggatatcatgtgcct

SEQ ID NO: 6801177 - DNA, 74 bp, Homo sapiens
acttgtttcatgagggctgatgcttacttatttttccaatgagggaaaaataattttagcccttataatctggt

SEQ ID NO: 6801178 - DNA, 59 bp, Homo sapiens
cttttttgtctgtgctctgactgagtgtaatctaagtcatcatgtacagagagcaaaag

SEQ ID NO: 6801179 - DNA, 55 bp, Homo sapiens
tcctcctttccccgctggagccctggatagagggctctctggcctgggaggagga

SEQ ID NO: 6801180 - DNA, 55 bp, Homo sapiens
ggttacttggtgctttcccctctggatccaaggctagataagtttccaggtaact

SEQ ID NO: 6801181 - DNA, 73 bp, Homo sapiens
tcaaggaagtcctcaaaggaatgtaaattcaaaggaaaagtgagtgatgccatcccttgggaaactttcttga

SEQ ID NO: 6801182 - DNA, 67 bp, Homo sapiens
gccgtgtctgtggagcgaggctggtttttctctcagcgacaacagaatgccaggctccatagccggc

SEQ ID NO: 6801183 - DNA, 74 bp, Homo sapiens
gggcactctgctcccagtgtttctgattccgtggatttacatttcaaacaggttcactggcgatgctgatgctt

SEQ ID NO: 6801184 - DNA, 66 bp, Homo sapiens
caaccggagtgattcccacctctaccacagggcatactgggcagtgtctggaggcattcttggttg

SEQ ID NO: 6801185 - DNA, 61 bp, Homo sapiens
taagtatgtgtacaaatcagtaagtggatttattctatcatactcatttgtaacagcctta

SEQ ID NO: 6801186 - DNA, 58 bp, Homo sapiens
cttggggcttctttctcgcccaggctctggaatgtctggctgggaagggggcccgaag

SEQ ID NO: 6801187 - DNA, 83 bp, Homo sapiens
cattgcctggagttccctgagtctccctgagtctccaggcaggtggggagcagccacgtctcagggcagctccaggtgggatg

SEQ ID NO: 6801188 - DNA, 63 bp, Homo sapiens
gttcaggtcctgaggccaagcagctctgcctcaaatcccagctgtgtgaccttggacttgagc

SEQ ID NO: 6801189 - DNA, 56 bp, Homo sapiens
cgggtgggcccgtcgtggagcgcacttctgcgcctctaatctcgggcgtccatctg

SEQ ID NO: 6801190 - DNA, 113 bp, Homo sapiens
gtcccatcccatccctgtccctgagctgtctatggtcctgtctgtgccctcttccctggagaatgaggagatgcctgctaggatggcaagcagccacgtggtgttctttggac

SEQ ID NO: 6801191 - DNA, 65 bp, Homo sapiens
atggaggggtggggacaatgcactgatgtttaaaaagacatctgttgtttttcaccacccaccat

SEQ ID NO: 6801192 - DNA, 77 bp, Homo sapiens
cagtgttgatcttcatcgaaatattgtgtcatgtcattgtgggacgcgtgatacattttgatttggaaatcaatctg

SEQ ID NO: 6801193 - DNA, 74 bp, Homo sapiens
tagagtttgaggtgcctatggatgtcaacttggagagattatatagatagttggatttataagccttaagccta

SEQ ID NO: 6801194 - DNA, 69 bp, Homo sapiens
ttcactgtttggtagctggatgatcattaggcagagttgcttcattgttggctagctacctcacatgag

SEQ ID NO: 6801195 - DNA, 55 bp, Homo sapiens
aatgcaacctgctgatctgacaatgggttgttggtaagcgtctttgggttgtgtt

SEQ ID NO: 6801196 - DNA, 103 bp, Homo sapiens
tagactttagacactgtgccttgcatggatcaggagatgagaccattaaatattgatttcctaatttatgcaggagtttttcatactctaaaaaatcagtttg

SEQ ID NO: 6801197 - DNA, 73 bp, Homo sapiens
tcttttatattcttctctatccttccctcatagtaaaaagaaaggggaaaaagagtagcagtaatatggaaga

SEQ ID NO: 6801198 - DNA, 65 bp, Homo sapiens
gaagattttagaatctgtgttcaaacctactgtctttagtgtctcagaaacagattcttatcatc

SEQ ID NO: 6801199 - DNA, 85 bp, Homo sapiens
gacatgagagtgtggaactgaattgatctaacccagtaactgaattacaaatgggttaagcctcattcatagcagtctacgtgtc

SEQ ID NO: 6801200 - DNA, 64 bp, Homo sapiens
gatcagaccaggcagccgactgatgaaaggccctcctgatgactcagtggctcctggtgacgtc

SEQ ID NO: 6801201 - DNA, 79 bp, Homo sapiens
tcctgttataactgtttttgaaatatatctaggtagcggttaccgaaagaaaggtttcataaagcaggcttaaacgtga

SEQ ID NO: 6801202 - DNA, 126 bp, Homo sapiens
ctgtgctgccgggaaactgggcgcattgtcgttcaggtccttgatctccacctttatcacgcagatttccattgagctggacatgacctcgagcgagatgatgcacttggggctctggcggcacag

SEQ ID NO: 6801203 - DNA, 89 bp, Homo sapiens
tcagaaagtacttgagagctaaggtgtcctggaggcccattctccggagtgggttcaggttggcctgagcactggctggtgtgttctga

SEQ ID NO: 6801204 - DNA, 89 bp, Homo sapiens
cctctaagaatgtacttattggtgctttttctcatactcttgcttgctttctcatgggagtataattgtacctgtaagtataccagagg

SEQ ID NO: 6801205 - DNA, 128 bp, Homo sapiens
ctgatgggtgcgattgccttcatgtaagcaaagggacactagcaaaaggctaatttggaaggaagatcatgaatttgattggggttaggtacagtttctggtgtctttgaggcaatcaaatgagttag

SEQ ID NO: 6801206 - DNA, 71 bp, Homo sapiens
aggtcataggtagatttaaagattttctgattagcaattggttgaaagagttaagctttgcctaaagactt

SEQ ID NO: 6801207 - DNA, 99 bp, Homo sapiens
tcaaattgcaattttctgtagatgaaattcagtttcaatcattgtagtcttgtctgtcagctatcgtggttgaaatgaaactcaatgcgtgtgatttga

SEQ ID NO: 6801208 - DNA, 64 bp, Homo sapiens
atttgaagtgcctcttgtggattgtgctttgggtaaagttcatttaaatcaggtacttataaat

SEQ ID NO: 6801209 - DNA, 69 bp, Homo sapiens
ctgtccttgctgatctgaaacgttactgtgcacaacaactatagagcagccttcagagcagttggagag

SEQ ID NO: 6801210 - DNA, 67 bp, Homo sapiens
gccccagggacaaagtctgtgattctgattatattttgaacattaacttcagtctatatctgagggt

SEQ ID NO: 6801211 - DNA, 70 bp, Homo sapiens
tcctagtgcctgccccaaaatgaaagggatttttctcagctcctttcagaaggatgtgcaggtggcaggg

SEQ ID NO: 6801212 - DNA, 93 bp, Homo sapiens
agaatgccatttgtattctacttaaattggcatcactgggagtttaaaaagagggtgagagaatgcttatttaggtagatattaatggcttct

SEQ ID NO: 6801213 - DNA, 68 bp, Homo sapiens
gaggcgggcagatcacctgagatcaggagttcaagaccagcctggccaacatggtgaaaccccgtctc

SEQ ID NO: 6801214 - DNA, 57 bp, Homo sapiens
gttctgagggaggttctctgggaacatattaggttctgagggaagttctttgggaac

SEQ ID NO: 6801215 - DNA, 69 bp, Homo sapiens
gtccaaggtcacagggcttatactaattgtctgactctacttgacaatacaggcttctggacttaagac

SEQ ID NO: 6801216 - DNA, 99 bp, Homo sapiens
gtctctctgttgttctgtttctagtttaggatccaatctaagatcccacgtttagtttttatatctctagtctcctttaacctgaaacagtttctcagc

SEQ ID NO: 6801217 - DNA, 86 bp, Homo sapiens
ggctttccctcccacctgagtgtcagtattctcagaggagccaatctggaaacgagatctcaggaggtctgaggggagctgtggcc

SEQ ID NO: 6801218 - DNA, 57 bp, Homo sapiens
ggtccatgagacagcaactgaaagtataaagaatgcttcacagtgtggtcatgagcc

SEQ ID NO: 6801219 - DNA, 63 bp, Homo sapiens
tctctcagcacctccacaccacccatgccacacccctgtggcactgcaggaggactgagcaga

SEQ ID NO: 6801220 - DNA, 69 bp, Homo sapiens
attactgtagaccttaatatatagagctgtgacactgttaggaaacgcttttgttaaggatccagtagt

SEQ ID NO: 6801221 - DNA, 58 bp, Homo sapiens
ctgactctgtttgcaggtagctcaggtggccagagaaggtcctcaggcagagacacag

SEQ ID NO: 6801222 - DNA, 81 bp, Homo sapiens
atgaatgttttggaaccttgcctcagaaaaatgtatgtacacacatatatacaactttacatgcaattccagggtatccat

SEQ ID NO: 6801223 - DNA, 55 bp, Homo sapiens
atcagagcactgagcaggacacctggaggcagtttgaccttttcgaggctttggt

SEQ ID NO: 6801224 - DNA, 65 bp, Homo sapiens
gggttggctggaggctattccttgggagtcagcccctcccattccagagctgcctctgctattcc

SEQ ID NO: 6801225 - DNA, 56 bp, Homo sapiens
tacttcatgagttaatatgcagctactaaaatagtgtatattgacagattgaagta

SEQ ID NO: 6801226 - DNA, 61 bp, Homo sapiens
gaagaaaaatacagaggaaaattaggctatagtgctggctttcttactctggtttttcttc

SEQ ID NO: 6801227 - DNA, 97 bp, Homo sapiens
tccctcttcccacactgtggcaacctgtgcccaagtcctttttctcacctgattgggtgtcctggtttccatagctctgtgtatgtggggagaggga

SEQ ID NO: 6801228 - DNA, 68 bp, Homo sapiens
tggtaagtcaggcatgtgtactctttgatgatgttggtacgaaatccagaagcatgtgtaatttgcca

SEQ ID NO: 6801229 - DNA, 65 bp, Homo sapiens
tggctgagggcactatgaagccaggaaagcaagaaccagaagatcctcgtgcttcccctgagcca

SEQ ID NO: 6801230 - DNA, 68 bp, Homo sapiens
gggtgtgggcagagtcgtggggaatagaggcaagcaagcagttaattcttccggactgtgaaataccc

SEQ ID NO: 6801231 - DNA, 75 bp, Homo sapiens
gaaaatctcaacccaaaagctcaaaactgtagagtaaaaacatttcacatttggcttttggagtaagagtttttc

SEQ ID NO: 6801232 - DNA, 85 bp, Homo sapiens
agctggattttcatatctgcttctgtattcagtatattgccatactctgtttgcattaaagtatatgaagaaaatcctaggagct

SEQ ID NO: 6801233 - DNA, 67 bp, Homo sapiens
gtactcagtatacaccagtatagggactgggactgtcagtctttcctttgctttgtgacttgattat

SEQ ID NO: 6801234 - DNA, 73 bp, Homo sapiens
tcaccatctttattagctttaatggggagcattttattgagttaggtccagaaaagttgatttagattggtga

SEQ ID NO: 6801235 - DNA, 63 bp, Homo sapiens
ggcactggaaggatcatgtgagggcagtttgagtgacaggtattcaatggtccttctaagtcc

SEQ ID NO: 6801236 - DNA, 70 bp, Homo sapiens
ttgtttctgtgaggctttatgtaagggtgcagtattctgccttgatataaaactgtctcccatgatataa

SEQ ID NO: 6801237 - DNA, 61 bp, Homo sapiens
gcaaaatgaatgtgaaaaatagaaagatgtttctacttttgtgtccttcacatcatgttgc

SEQ ID NO: 6801238 - DNA, 67 bp, Homo sapiens
agaaaatatttgaatggtgtaagatggtggaaggaaagccatcccacacccctacaacatatgttct

SEQ ID NO: 6801239 - DNA, 73 bp, Homo sapiens
aagataaacatgtatgctttccttctttctggctaggcctagcttgcaagctgagaaacagagcatatgtctt

SEQ ID NO: 6801240 - DNA, 60 bp, Homo sapiens
agcagaggcacagttttctacatatgctcccatggagtcaagtaggacctgttctaggct

SEQ ID NO: 6801241 - DNA, 71 bp, Homo sapiens
gcccctggccgacttgaagtctgcatctaaggcagggccttagacatggcagctccaagtgtttcatgggc

SEQ ID NO: 6801242 - DNA, 59 bp, Homo sapiens
acattacatttagcacatctgggatgtgttcacatgaagacattggctaaaagtagtgt

SEQ ID NO: 6801243 - DNA, 57 bp, Homo sapiens
ctgggtctggctactgcttccttagcccagctggaggaggtaaggatccagactcag

SEQ ID NO: 6801244 - DNA, 106 bp, Homo sapiens
cctggcagccacccagcatctgtactttagttatttggtttttctcaggaggagatcctgagatgaagactcaggagcaggttgttgattttgaggtggtcctggg

SEQ ID NO: 6801245 - DNA, 62 bp, Homo sapiens
agtcatgactccattggtcaagctaaaagaagtattagcaaaggccaagtggattcatgatt

SEQ ID NO: 6801246 - DNA, 85 bp, Homo sapiens
tctgcaccttgctattgaagctcagacctgcttatgtatttattacccatgacagtcttgcacttctatcagcattcagtgggga

SEQ ID NO: 6801247 - DNA, 65 bp, Homo sapiens
gtggcaagttgaatttgatgttgtttgacctgaatgtcaaacataggcacacattcaggggatac

SEQ ID NO: 6801248 - DNA, 62 bp, Homo sapiens
aggagggaggaatgcaacttatttagctatcggattagttattatgccattacctccctgct

SEQ ID NO: 6801249 - DNA, 85 bp, Homo sapiens
tctgaatggcagcccctgtggggctgaaagaggcttttccttaaagtccatctctgccccacacaactggcgtcatcctctcaga

SEQ ID NO: 6801250 - DNA, 55 bp, Homo sapiens
cttgtagacccctggactcacgacctgataggcgcaggggcccggggtctgcgag

SEQ ID NO: 6801251 - DNA, 59 bp, Homo sapiens
tggcatcgggccaccccatcccatgcacggtgggaggccttggggtgggctccatgcta

SEQ ID NO: 6801252 - DNA, 89 bp, Homo sapiens
gtctgtgaaatagaatcacaccgcacttatttggatgagctgaaaggtacagccagactgtgatgtgattaatgccttaatctacagac

SEQ ID NO: 6801253 - DNA, 83 bp, Homo sapiens
ggtaacagtatgtagagtaagaaaaccttctgttttgctatatatttataagaagtcagctttactgtgcactattgtgagcc

SEQ ID NO: 6801254 - DNA, 86 bp, Homo sapiens
gcccttcctttctcgggtctgtggagttgcttgctggaaatgcctcacttcaggtgctgatttggcacacgtggaagggggagggt

SEQ ID NO: 6801255 - DNA, 58 bp, Homo sapiens
cctaatctcttgagtgcttagttacattacatgtcttaagcactgttagtagaaaagg

SEQ ID NO: 6801256 - DNA, 82 bp, Homo sapiens
gaccccgcccgcttgcttgcttgcttgcctgccactcaagagaaggtgccaggggacgcggagcgacgagaggcgtgcagtc

SEQ ID NO: 6801257 - DNA, 59 bp, Homo sapiens
cagcagcaagcagtggtggcagccacatcctggcaaccacgtctgcactgtagctgttg

SEQ ID NO: 6801258 - DNA, 56 bp, Homo sapiens
gagtgccagggggcactgaacagatgtgtgatgtttgttaggtcctttcggcaatc

SEQ ID NO: 6801259 - DNA, 58 bp, Homo sapiens
cctgccccatggtccctggtgggtcacacttcccatcattaacaccctggaggccagg

SEQ ID NO: 6801260 - DNA, 73 bp, Homo sapiens
atgctacgtgatatttgtggtggatgaattactgaaaaacagaattcctcagcgaatcaagtgtctgatgcat

SEQ ID NO: 6801261 - DNA, 70 bp, Homo sapiens
gggctgaggggcctctgggaacccctgtgccaaggggctgctggcactgggcagcaggaccccaaagccc

SEQ ID NO: 6801262 - DNA, 68 bp, Homo sapiens
acacgttagcttgagcatttgccatgttgctgcaatagtctttatgataattatgcttatagctgtgt

SEQ ID NO: 6801263 - DNA, 63 bp, Homo sapiens
gattctcaattttgccaaagggttaggaaacctactgccctgttggcatgattgcaaagaatc

SEQ ID NO: 6801264 - DNA, 55 bp, Homo sapiens
cctgcaggtaaggctaactgccacaaggttggtggtgggggttaggacctatagg

SEQ ID NO: 6801265 - DNA, 99 bp, Homo sapiens
gcctcagtttcctcatctgtaacataaaaaaggcttaactggaaattctctaacatcctttccagctttgagattttatggaacaatgtagactcatgc

SEQ ID NO: 6801266 - DNA, 63 bp, Homo sapiens
gcttgaggctgcacagtacaggctgcctaagggaccggtaagctatttactgtgcagctcagc

SEQ ID NO: 6801267 - DNA, 63 bp, Homo sapiens
gtttccgccctgggcctgtgggattgcgtgactcctggagcactgggcccagggtgtggaggc

SEQ ID NO: 6801268 - DNA, 72 bp, Homo sapiens
gccaaagaccacagtgttttagaaaagcttgagcagatcctctgctaaagagaaaaaagtactgtgtcttgc

SEQ ID NO: 6801269 - DNA, 78 bp, Homo sapiens
cccaccgggagcttggtgttatttctgtggacgctggggaattgggcaccggggaactgggcaccgagcgcgcgtggg

SEQ ID NO: 6801270 - DNA, 76 bp, Homo sapiens
ggctatgatggaattgagcatcagttgtttgaaatattcaataacaattccttggatggtagttctaattttagct

SEQ ID NO: 6801271 - DNA, 130 bp, Homo sapiens
gtgatgaaggccagggacaggactgtggctgtgagagggaaatgcagtgggaaactggagagacttcaaagggaaggtgtccacttctcacctcctctactgctgccaccctggtccaggcgactgtcac

SEQ ID NO: 6801272 - DNA, 79 bp, Homo sapiens
ggaatggggacaaatggccactgacctgtgttgaaataatttcacaccaggagcagtgccagatgtttcacccatcttc

SEQ ID NO: 6801273 - DNA, 59 bp, Homo sapiens
agtgaacttgggagttctggaagcctgataaaagcaggtgttaatcacttttaagcact

SEQ ID NO: 6801274 - DNA, 62 bp, Homo sapiens
gtgtgcatgtatatacttttatgcgtacatatatgtatacatgtaggtatatacatgtacat

SEQ ID NO: 6801275 - DNA, 64 bp, Homo sapiens
ccaggtgttctctgacatggcaaatcagaagaaaaatcattgcattgggagtgaggagacctgg

SEQ ID NO: 6801276 - DNA, 101 bp, Homo sapiens
gagaaaagctttgctctttataaaaagggccgtgtgagattctttgaaactgaacgccggcggagtctgactctgaccctggatgaagagatgctgctctt

SEQ ID NO: 6801277 - DNA, 91 bp, Homo sapiens
agaggagggtctcctcgaggggtctctgcctctacccaggactctttcatgaccaggaggctgaggcccctcacaggcggcttcttactct

SEQ ID NO: 6801278 - DNA, 92 bp, Homo sapiens
tctagcactggcaataaggtgaggctcaagggatatactgtgatttatcatcaaggactttattctcttggccactttgcagtcatgctaga

SEQ ID NO: 6801279 - DNA, 57 bp, Homo sapiens
tcgcagagtttgaagtcaagatgttagcaggactgattctttctggaggctctgggg

SEQ ID NO: 6801280 - DNA, 61 bp, Homo sapiens
tagattgagcttgacagtgttgtcctaaagattctaagggaaaattctgtagtttaatttg

SEQ ID NO: 6801281 - DNA, 69 bp, Homo sapiens
aaggggtctattcatcaaggcatcacggcagtgtgcttcctgcctttggccttgccgtgaaagcccttt

SEQ ID NO: 6801282 - DNA, 68 bp, Homo sapiens
tgtcttccatcactagtcctgcagggcctgaactaagccagctgcatcattggtgattcaggaaaata

SEQ ID NO: 6801283 - DNA, 82 bp, Homo sapiens
cgtgtgtattcaaaggtccagtttgaattactgtgaggccagtggctagaaagcagtgtagttgggactggagattcacatg

SEQ ID NO: 6801284 - DNA, 63 bp, Homo sapiens
gaggaaccaatctgtgatattcagaatgtgggatgatctataggataaatggtctggtttctc

SEQ ID NO: 6801285 - DNA, 72 bp, Homo sapiens
gcctggataatttaatgcaagtgattcacacctcacttttgagaagttactctcgttaaatatgttccaggt

SEQ ID NO: 6801286 - DNA, 61 bp, Homo sapiens
cggtgtgggtccaacctgtgtgtgtgcgagacctcccacacgagccctggagccagcagtg

SEQ ID NO: 6801287 - DNA, 96 bp, Homo sapiens
ggaggggcgcgcgcccgggggccgggagctcggagatccccgccagccggggcgcaagaaccaggtcttggcccccggacctgcttgtgtccctcc

SEQ ID NO: 6801288 - DNA, 62 bp, Homo sapiens
gctggagcgggttcgggccgctgctcctgcagcagaccctgtgcctcagcaccgcctgcagc

SEQ ID NO: 6801289 - DNA, 61 bp, Homo sapiens
tttttcagtgaccatggatctatttttattctgaatcccaggtccttggttgtctgaagaa

SEQ ID NO: 6801290 - DNA, 68 bp, Homo sapiens
ctggtgccatgtggtttcatgttgtcatgtgaaaatttgatgatctgcaagaactacatgcccatcag

SEQ ID NO: 6801291 - DNA, 73 bp, Homo sapiens
gcattgaactctgaagattgctgctaactccagttttcttggtgtcagacacatttctttcagtgattaatgc

SEQ ID NO: 6801292 - DNA, 63 bp, Homo sapiens
gcctctattttttctctgaagtgggaggcaagaccatctgctgagaatgagggggtagaaggt

SEQ ID NO: 6801293 - DNA, 71 bp, Homo sapiens
tgatggaaataaaagcatagctagtttcaaaggttcccttgaataatcattctatgcttaagtttctctca

SEQ ID NO: 6801294 - DNA, 71 bp, Homo sapiens
ctaaaaattaaataatttcttagagctgtttgtaaaaatttggggacaaagcctaagaagtatttatttag

SEQ ID NO: 6801295 - DNA, 65 bp, Homo sapiens
tctcacttaacatttagtgtacccctgtttggaccaggcaaagggaatatgtgttaattagggga

SEQ ID NO: 6801296 - DNA, 93 bp, Homo sapiens
tggttggaaatgagtatagaaagtcaccctttgattttgggacatttcagattggacttcagggaggtgaccttatgctctgtttaccagcca

SEQ ID NO: 6801297 - DNA, 100 bp, Homo sapiens
agcagaaaagttgacttagaggctatggcattgagtaaagtcagtaaatatatggcataattgctgtcttttcccaatcctggatctaaagcagactgct

SEQ ID NO: 6801298 - DNA, 92 bp, Homo sapiens
cctgtgtgcctccctgggagggtcagaagggcctggttctgggcacagggccactgggtcctgctggcccttccccattggtggttttaagg

SEQ ID NO: 6801299 - DNA, 63 bp, Homo sapiens
tgttccttaaggtcttgagtgaatgagactgtacatgttcagcttagtgtaggacctggaata

SEQ ID NO: 6801300 - DNA, 74 bp, Homo sapiens
tttcaaatatttaaaggaattattataagtgggtatcttttatcaataatctttcttttccagatagtttgaaa

SEQ ID NO: 6801301 - DNA, 76 bp, Homo sapiens
ctccttcactttgcagctggaggagccggctgagtgcacgctgagtgcattggcaatgtcccggctgctgagggag

SEQ ID NO: 6801302 - DNA, 63 bp, Homo sapiens
gctccaggcgccgcttttgcagtcccccattggccggtttattgccagacggcccctgctcgc

SEQ ID NO: 6801303 - DNA, 66 bp, Homo sapiens
gatatacaatccacagttgattttctaaagtggtaaaattcacttttctttgtgttttggtgtgtc

SEQ ID NO: 6801304 - DNA, 98 bp, Homo sapiens
ttagtacatcaagacattttaaaatgcatttttagcacagagattatttacaagaaaatcatttattttcaactctctatgcgaggatgctgtactga

SEQ ID NO: 6801305 - DNA, 59 bp, Homo sapiens
atctaaaatgtggttagttggtaagattgcagttaaagcctaactaaccactttctgat

SEQ ID NO: 6801306 - DNA, 55 bp, Homo sapiens
ggaccacagacctctctggcgtcagaagaagttattctgaattagtttgtggttt

SEQ ID NO: 6801307 - DNA, 74 bp, Homo sapiens
ttcacagaagtgtgtataactcttcaaaaatacagaagtatatacccttaggagtgtatactcacctctgtgag

SEQ ID NO: 6801308 - DNA, 70 bp, Homo sapiens
ggctgccacccaggacacggcagagataagcgcaggtgagtgtggccatgcctgtcttggagtcctggcc

SEQ ID NO: 6801309 - DNA, 67 bp, Homo sapiens
ctcgggtgcctgccctgaaagaggtgaaggaactctgaccttgcctaaacccagcccaggccccggg

SEQ ID NO: 6801310 - DNA, 87 bp, Homo sapiens
gtttgttctgtgaccttctcctcttgcattctatccctccaggcactgacctgctgggtctatgcaagtggagcacttagaataagc

SEQ ID NO: 6801311 - DNA, 58 bp, Homo sapiens
agggacaccattatggcagtggctgtgccctctacccacagccacagctgggtgcctt

SEQ ID NO: 6801312 - DNA, 76 bp, Homo sapiens
ggtatagcagctgggactgccattcacagccagtggagaccagtgggatgggaggggcagctgagccagcaggacc

SEQ ID NO: 6801313 - DNA, 58 bp, Homo sapiens
gctccctatttggccttctctgataccacctcaatgggaggcaggtcaggtagggggc

SEQ ID NO: 6801314 - DNA, 71 bp, Homo sapiens
gcactgcacagtcccagaggatgccattcacagactcccatgcaaatagcttccctgggtttgtgcagtgc

SEQ ID NO: 6801315 - DNA, 64 bp, Homo sapiens
aaattcttgggcaccagcccagacctactgaatcagaagttctgggagtggcgccctacaattt

SEQ ID NO: 6801316 - DNA, 65 bp, Homo sapiens
gacctcctgctcaattccggcacgctggccctcactcagacggcactgcgcctgattggtaggtc

SEQ ID NO: 6801317 - DNA, 83 bp, Homo sapiens
gtccatcaagggtaaatctatatgacaagagaacaattcagctggttctgaaagtctgcatggagatatactatttgaaggac

SEQ ID NO: 6801318 - DNA, 106 bp, Homo sapiens
ggtgagtagggggatgaaggaggaacaccaacacagtttggaggcagggttgatgatggtcagtggagtcacaactcacagccaccggtgttggccctgcaccacc

SEQ ID NO: 6801319 - DNA, 64 bp, Homo sapiens
gtgacgcgttaactcggctggaacgctggttaatttaacagcaggagttgaattaacttgtcac

SEQ ID NO: 6801320 - DNA, 67 bp, Homo sapiens
caaatttctagtgctctgagtgtcggtcactttgacagaagatggatggtcaaatatttgaaatttg

SEQ ID NO: 6801321 - DNA, 77 bp, Homo sapiens
cactaattacaaagagatgggaagcatgtagggaaatgatgaaggataaatgcagtaccccagacttagtaatagtg

SEQ ID NO: 6801322 - DNA, 59 bp, Homo sapiens
taggttgttctcatgattagaccaatataatgtatctaatgctctgagaacagtgcctg

SEQ ID NO: 6801323 - DNA, 60 bp, Homo sapiens
cttgtgcagcctcctcttgcagggggctgtgaccccttgaaggaaaggtcgctgcccagg

SEQ ID NO: 6801324 - DNA, 77 bp, Homo sapiens
gtgctaaactgaaatctttatggaaataacaaaatgagaatttatattgattattcagcaaaggttttattgagcat

SEQ ID NO: 6801325 - DNA, 58 bp, Homo sapiens
acttgtatggagacttggaacctgattcttttttggaatgaccaaatctcttataagt

SEQ ID NO: 6801326 - DNA, 84 bp, Homo sapiens
tttctgtgccattccttgtgttaagtgctggggaaagagtcatgagtcttcctcttatatagccttggccaattggtagggaaa

SEQ ID NO: 6801327 - DNA, 56 bp, Homo sapiens
gagagctggatcctgattcgtctttgagctcctcaaaggaacaaggcttcagcctc

SEQ ID NO: 6801328 - DNA, 78 bp, Homo sapiens
ggagatgagtgagtcagtgggggtgagtgcttagggatagaaataatctttggatcgctcccccttccactcttcttc

SEQ ID NO: 6801329 - DNA, 75 bp, Homo sapiens
tgaggtgttaattttaattatccaactcatccgttttaaaacgcatgaggtccagggaagttaaatcacagctca

SEQ ID NO: 6801330 - DNA, 58 bp, Homo sapiens
tgcagttaataaccttgcacataaatcctttaacaagtgtgtgggcatatctgctgca

SEQ ID NO: 6801331 - DNA, 60 bp, Homo sapiens
ccaacctcttctctcatgggtaacttacttaagaccagtgtattacaaagaagaggctgg

SEQ ID NO: 6801332 - DNA, 69 bp, Homo sapiens
tacgaaatacagaactctcagttgtatatatcaaataatatttgtctgtagctgaattctgtgaacgta

SEQ ID NO: 6801333 - DNA, 59 bp, Homo sapiens
acagcccttcttttctgtagtgattgcagatttgagcgcatttcagtaaggaagcctgt

SEQ ID NO: 6801334 - DNA, 129 bp, Homo sapiens
tagagacaggtaggaggccattggatacatggtgcaggagtgtaggcctatgtaggtcatccatgcatgcctggctctgggatcttcgctttagtcatttaaatcatgggcctgctgtcttttcttatg

SEQ ID NO: 6801335 - DNA, 72 bp, Homo sapiens
agtagcaagttggcatgaggtagtcactgtgagtgtgcgcgaatcgtgttgccctcctgccagttcgttgct

SEQ ID NO: 6801336 - DNA, 58 bp, Homo sapiens
tctgcaggctctagatgaggttggaggcagacagacccatcccacccagccttgtaga

SEQ ID NO: 6801337 - DNA, 70 bp, Homo sapiens
gcccactttgagtgtttttaattgaagttttggttgaaaattcacttgaattcattctgcgaaagagggc

SEQ ID NO: 6801338 - DNA, 83 bp, Homo sapiens
aggctggataggcagaggtcagagtgagtgagcgacaaccctgagtctcattctcagactcttggcctcagcttctccatctt

SEQ ID NO: 6801339 - DNA, 64 bp, Homo sapiens
aaacataaggctgttccagggtttatgcttcccccaaggtagctgtttcacaacagccgtgttt

SEQ ID NO: 6801340 - DNA, 84 bp, Homo sapiens
cggcacaccctcaaagcctttctcattttaagcattagatcactttgtatcagagccacttggagatgagaaagtgggagtccg

SEQ ID NO: 6801341 - DNA, 79 bp, Homo sapiens
ggcagcaccccagctctagctgccccgaggcagggtcggggctgatgctatctccctggtagttaatggggccgctgcc

SEQ ID NO: 6801342 - DNA, 56 bp, Homo sapiens
gggtggccagctggttccttactgcccacagctggcgctgaggattcctggcccct

SEQ ID NO: 6801343 - DNA, 56 bp, Homo sapiens
ggcctcctatcgtttcaaaacacagcttcttgttgatgaagaggaagaggacggcc

SEQ ID NO: 6801344 - DNA, 68 bp, Homo sapiens
tttcttacaaaacagctgtttttttagtctttaaatttagatttgcagcaataatgttttggaggaaa

SEQ ID NO: 6801345 - DNA, 97 bp, Homo sapiens
aaatggtttttcattctgggcagtggcgcaatctctgggtgtgaaatcacgtctgaggtttacaagctattgctgacatcaatgaaatgcaacattt

SEQ ID NO: 6801346 - DNA, 70 bp, Homo sapiens
tcagttatttattttattgtgtgtttgtgcatgtcggtagagcacagtatttagtagaatgagttattgg

SEQ ID NO: 6801347 - DNA, 76 bp, Homo sapiens
cctggcggggacggctctctggcactgtgggaggggagatgcttgccgcggtgcccacagcctctttctcaccagg

SEQ ID NO: 6801348 - DNA, 76 bp, Homo sapiens
gtgttttctttcaaagcaaaatgaggctatatcttggtagcaggatcagcttggtcttttttgaaacctagagcat

SEQ ID NO: 6801349 - DNA, 61 bp, Homo sapiens
gcctacatcactgatgccaccactccattcctagggggtggtgccacagctgaagtcaggt

SEQ ID NO: 6801350 - DNA, 73 bp, Homo sapiens
tcttggaggagagtaagtacctgattcttagaagattatgtgtagatgaaatgacttagtttttctcacagga

SEQ ID NO: 6801351 - DNA, 67 bp, Homo sapiens
tcaatttggtgatgaaaatttgatttgtggtttcctctcacagggctcttcatcacacagtaattga

SEQ ID NO: 6801352 - DNA, 84 bp, Homo sapiens
gggcgtgaaaagttgtaagaggcacaaggaagaggggtaggaacttccttcaaatgtgattttaataactagtcaagtgtgtcc

SEQ ID NO: 6801353 - DNA, 73 bp, Homo sapiens
tattcagagggttgatgtgaggcttagctgctcctgataacaatggctaatgtgtcctgaaagcttctgtgta

SEQ ID NO: 6801354 - DNA, 72 bp, Homo sapiens
gtgccaatggcctcagaacggaaatggttttggccacgggaaagccagttgcttccgtctctgagacatcac

SEQ ID NO: 6801355 - DNA, 72 bp, Homo sapiens
cctgggcaagctctgggtggacacatccctttagtcttgaagattccgtgaccccctagagctgagcccagg

SEQ ID NO: 6801356 - DNA, 70 bp, Homo sapiens
agaccaagtttctctattaggggctagctttagagaagcaagtaggctgaagagaaagaaaaactggtct

SEQ ID NO: 6801357 - DNA, 75 bp, Homo sapiens
tgataccttccaagtgcttgccgctttgtacattccaaaacactttcatgcaaagcaacccttggaatggtttta

SEQ ID NO: 6801358 - DNA, 59 bp, Homo sapiens
cacaggtatatgtgtatatactgtaaacatacaggttacgtactatacatatatctgtg

SEQ ID NO: 6801359 - DNA, 74 bp, Homo sapiens
ggagggcatccacaggaaagcacctcccatgccaagccaggaaagtggggctttccagtgggaattggtcctcc

SEQ ID NO: 6801360 - DNA, 75 bp, Homo sapiens
cattgtatttttcaatttttaaactatgaagttgccttttctgggtctttgtagtcagaaaaaaatcatacggtg

SEQ ID NO: 6801361 - DNA, 93 bp, Homo sapiens
tttctgggataaacaggggcatgaaaaagtggaagatggttgtgggcactgccatgttctttggcttcacagctcttgttctgatccgggaga

SEQ ID NO: 6801362 - DNA, 89 bp, Homo sapiens
attttgcagagatgaactgtgccagtttaaaccttgtgaatacagttaatgctatatttatattagtaaatgcacagtatttacaaagt

SEQ ID NO: 6801363 - DNA, 65 bp, Homo sapiens
tgtggcccaggttggagtgcagtgatgagatcataactcactgcaacctccagctcctgggctca

SEQ ID NO: 6801364 - DNA, 100 bp, Homo sapiens
gcacagcctgtatgaacccatgttgaaccctggactttcaggactactgtatggctaaccacagccctgcaaggccaggctcagcatgtcacagttttgc

SEQ ID NO: 6801365 - DNA, 121 bp, Homo sapiens
gggcagtgggattgagtaggggagcaggaaataggcgtttgtcctctctcttttaagatgagtcctgggaggcgtgcttgtcactttccttcacattctgttggtcagtactcagttgccc

SEQ ID NO: 6801366 - DNA, 96 bp, Homo sapiens
cctgttgaaaggaacagatcagagtggattgtgctgcaaacggagatgttacctgggggcagatgattaattttgatattgtgtgccttaaacagg

SEQ ID NO: 6801367 - DNA, 71 bp, Homo sapiens
ttgcactgtaagcatctgtgtcacactaaaattgtttaaagaagtgtttatgcaggctgtttaagaggcaa

SEQ ID NO: 6801368 - DNA, 56 bp, Homo sapiens
tcaagacagtgtgatactggcctaggatagacatagggtcaatggcactgacttga

SEQ ID NO: 6801369 - DNA, 58 bp, Homo sapiens
agaactctgaacactgtctggagctcacacaagttcctggaataatgctttaagttct

SEQ ID NO: 6801370 - DNA, 59 bp, Homo sapiens
tttgtctgccctgcacttaggaaccaaggttgagttcaaacaggggtcagggagataaa

SEQ ID NO: 6801371 - DNA, 55 bp, Homo sapiens
actgtagccatcacgtctctattgagtagcagagtagaaatgtgaaaggctgagt

SEQ ID NO: 6801372 - DNA, 129 bp, Homo sapiens
ggggcgctgggggcctccgaggacagtggggtgagtggctgtcttcagggtgggagcttggggttgctcataagccctgggtaggcgatcccccactccatcgcacccctgtcctccctccagggcctc

SEQ ID NO: 6801373 - DNA, 87 bp, Homo sapiens
ttaaaataattgtgggcagtgtgatattgacccttgcaagccacattcttgccctgcagatacactgctgccacacagctgggttag

SEQ ID NO: 6801374 - DNA, 90 bp, Homo sapiens
gtacctggttggctaaaatcaaagagcttgacaatcctagctgcaaggaaggctgggatatatagttctttattccaggcagcaatgtgc

SEQ ID NO: 6801375 - DNA, 73 bp, Homo sapiens
cgagaagtcgatcacctcgtcctccgtgccgtggatgatgagcacgggagacgtgatcttggacaccttctcg

SEQ ID NO: 6801376 - DNA, 87 bp, Homo sapiens
acagagtgtccagacaggccatctctgctgtccctgtgtccccacgcttcgcaggggcacggatgacctgttagtgcccaactccgt

SEQ ID NO: 6801377 - DNA, 95 bp, Homo sapiens
acttcgtgattccagggcctagagctttctgctggtgttgatctttaatgacaaatgcagcctggacagaagcttttggttatggagcactgagt

SEQ ID NO: 6801378 - DNA, 88 bp, Homo sapiens
gaatgtgttgcctgtggagtgcttggctcagtgcctgctacatatatagcactcgttaagtgataagtattattataggcatatattc

SEQ ID NO: 6801379 - DNA, 77 bp, Homo sapiens
ttccagcaagtgcccactgaggcccagtcctgcaagcacgtaccacgtgagcagctctgtgtctctggaacctggaa

SEQ ID NO: 6801380 - DNA, 111 bp, Homo sapiens
attttgccttcgctttctcacactaagttatgcttatgcttcatggtcatatcaagctcagtttgggagatggggagataatatttcttctgtgagaaagtgttttgaaat

SEQ ID NO: 6801381 - DNA, 111 bp, Homo sapiens
cctttttgggttaacaagtattgtgcttcatgatggcgagtttctaggttgtcctgatttattagccatagatgaactcctatcacttttacagtctgtttaccaaagtgg

SEQ ID NO: 6801382 - DNA, 64 bp, Homo sapiens
gagggtgctgtcaggaagctgggcatccagggctgcacctggaaaccaagctggcagcggcttt

SEQ ID NO: 6801383 - DNA, 59 bp, Homo sapiens
cacctctcatttctacagattccctccagtgtggactctctgatggtagatgagatgtg

SEQ ID NO: 6801384 - DNA, 79 bp, Homo sapiens
atgtcactgggcttttgggaagtcgggttgagcacttaccagagtgaggctttctgggcttctttcagccatagtacgt

SEQ ID NO: 6801385 - DNA, 64 bp, Homo sapiens
cagaggcttggcattatcatgcagagcaaaaagaagctcctcacatgaagaatcaagacccttg

SEQ ID NO: 6801386 - DNA, 72 bp, Homo sapiens
agccagagtagctgccctgcaccttggccaggaccagggtccatgtgagaggagacagggaagtgcctggct

SEQ ID NO: 6801387 - DNA, 97 bp, Homo sapiens
acagatgatttgtcttctcctgtggagagattttgttttagcagtgataatttattcactttacagatggtttcctgacattggaaagacattctgt

SEQ ID NO: 6801388 - DNA, 59 bp, Homo sapiens
ctggctctgaccgcgctggcctgggccggagagcccaggaggcgtgtctcagagaaaag

SEQ ID NO: 6801389 - DNA, 75 bp, Homo sapiens
tgcagttgtgttaagatcagttcaaacatgtgtatgttgctgaatatatacacaaattggcattgataacctgca

SEQ ID NO: 6801390 - DNA, 83 bp, Homo sapiens
gtgtgtgtgtgtgtgagtgtgtgcatgcattcgtgcatgcgtgggtgtgcatgtaccatgcatatacacccatctatacacac

SEQ ID NO: 6801391 - DNA, 63 bp, Homo sapiens
gccaaacaccttcatctagccctgaaggtatttttattaggcctatgcagaaggtggtttggc

SEQ ID NO: 6801392 - DNA, 60 bp, Homo sapiens
tggaagatctatcacttagtgaatatttcattaaattgttctttgagaataggtttttca

SEQ ID NO: 6801393 - DNA, 65 bp, Homo sapiens
agcagcaagggataaacaaggacgttgcttcatgaatggcagagttgtcctgagttctagctgtt

SEQ ID NO: 6801394 - DNA, 68 bp, Homo sapiens
ggtctttaaagggggctggcattgggcattggtgttttaagtccagacctgaggccctcactaaggcc

SEQ ID NO: 6801395 - DNA, 75 bp, Homo sapiens
tatattttgacattaaggaacatatattgagggcttctcaaaaactcaaatgtgtgaacactaatgcaacatgta

SEQ ID NO: 6801396 - DNA, 76 bp, Homo sapiens
cctgagacatcagtgctcttggttcttgggcctttggactccgaaacttacactactgatgacccttgttctcagg

SEQ ID NO: 6801397 - DNA, 58 bp, Homo sapiens
gggtggaaattattccatgcagcattccatgatgcttcccctggaataaatttccccc

SEQ ID NO: 6801398 - DNA, 104 bp, Homo sapiens
gttgcaactcagcttctgcctctttggtcaattgctgcggggaaatctaatgaagaatctccttgcagggtttgataaagatgtttgagtcgataagttgcaat

SEQ ID NO: 6801399 - DNA, 57 bp, Homo sapiens
tgcagaaccccttcccaggcccaggcaatgtgtacactgggtcagatggtttttgta

SEQ ID NO: 6801400 - DNA, 78 bp, Homo sapiens
gctcacatgtctggtggtcgatgctacaggtcagctgagactttagcgagactgtcaaccaccataccgacatgtggc

SEQ ID NO: 6801401 - DNA, 85 bp, Homo sapiens
aggctaggattacaaaggtagttttgtctataaattatcaagtggttgttcatatgacataaaatcatttttgttctcctgtcct

SEQ ID NO: 6801402 - DNA, 68 bp, Homo sapiens
ctcagggtttctcacaaggctgcaatccagctgtcaggcaggggtgcagtcattggaggatgactgag

SEQ ID NO: 6801403 - DNA, 93 bp, Homo sapiens
gattctgcagaacagcagcacgtcaagctgtcactcagttaggctcgtctcagctggacctgctgatgtatctgccttagcatgaaaggaatt

SEQ ID NO: 6801404 - DNA, 83 bp, Homo sapiens
tgggtcttctatgtcatgctacagagtttgaatatgttagagacttgacataatcacgtttgtgtattacaaagatcattcca

SEQ ID NO: 6801405 - DNA, 59 bp, Homo sapiens
gctggcttgatagtttctgcttcctacctcttggaagtcagtcaccatttaagaacagt

SEQ ID NO: 6801406 - DNA, 55 bp, Homo sapiens
caggagaggctgtacgtttctcttggcacagtgctctagaactgcacctctcctg

SEQ ID NO: 6801407 - DNA, 62 bp, Homo sapiens
ggttgtctctgaagctggttctgttgagtgatgagcagtaaggccttgtaacagagttgacc

SEQ ID NO: 6801408 - DNA, 99 bp, Homo sapiens
gaggcaggaggattgcttgagcccaagtgttggaagctgcagtgatctgtgatcacaccactgcattccagcctgggcaacagagcaaaaccctgtctc

SEQ ID NO: 6801409 - DNA, 90 bp, Homo sapiens
ccaggagccgggatagtgaggagtaagttctggctacctgctcatcaggcatcctgtcttgcttctgctgcactatcctgatttttttgg

SEQ ID NO: 6801410 - DNA, 92 bp, Homo sapiens
aatgcattctggaggtggtgtttaaaagctattagagtttcctggcctctttttggctggccctgtattttttaagaatatctctatgtatt

SEQ ID NO: 6801411 - DNA, 60 bp, Homo sapiens
tgggcactgaagctttgagcagagatccttttttccactttctcctggtgacagtaccca

SEQ ID NO: 6801412 - DNA, 110 bp, Homo sapiens
aaagagaggataccgtgcaatagaggaaggctgagagcaacgtgtcagagagccaaagaaaaattttgccatcttactttaggctggtcttttgcatatattcatttttt

SEQ ID NO: 6801413 - DNA, 70 bp, Homo sapiens
tcactatcacctgagagctataaggttttactagaattttgttttaagtaggaagctatgggagatgtga

SEQ ID NO: 6801414 - DNA, 114 bp, Homo sapiens
tagataattgattggttcatcctcttccctctggctggtgttgcattttggttgtaaatatgcacgaagtgtgtgcatgtgaatgtgggactggagggaaaccatgagtatcta

SEQ ID NO: 6801415 - DNA, 64 bp, Homo sapiens
ccagtctggcaggagggggaaccatgctggagtgtgcatgggaggttttcacagccaggcctgg

SEQ ID NO: 6801416 - DNA, 67 bp, Homo sapiens
ggggtgtgtcttttgctcctggagcccagacaactcaagataaggctttgagagccaagaacatccc

SEQ ID NO: 6801417 - DNA, 74 bp, Homo sapiens
tggggactgggcagaggccgatgctcaggaaatacacaaaggactgagacgtaggcattggtcctgtccaccca

SEQ ID NO: 6801418 - DNA, 70 bp, Homo sapiens
tttcagcaatagtattttgggacaactttataaaattgctgaagtgcaacctgaaatactagagtagaaa

SEQ ID NO: 6801419 - DNA, 71 bp, Homo sapiens
cttacattattcaggtacctattatgtgctattcatattggcacataataggtgcctgaatatttggcaag

SEQ ID NO: 6801420 - DNA, 65 bp, Homo sapiens
ggtcacatgtgatttgagccaattctgtgaatgacagatgctggtcaccacgcaaaaatgtgatt

SEQ ID NO: 6801421 - DNA, 78 bp, Homo sapiens
gcagagctacgggagaaggatcgagactgtctgcacattattagaagccagcctgtttccttcttcagccgctgctgt

SEQ ID NO: 6801422 - DNA, 64 bp, Homo sapiens
ttttctagaaagtactagagctggtcactaaggctgactacgctttctttattttcctagaaga

SEQ ID NO: 6801423 - DNA, 58 bp, Homo sapiens
tgcttcagtagtaaattgttattgaagcttcagtcaatagcaaattgctattaaggca

SEQ ID NO: 6801424 - DNA, 129 bp, Homo sapiens
ctgggagggggacaggtgaccacgcaggaaggcttcctggaggaggtgtcctcactcatgaaagaaggtgatagtgacagtgctcctcttggggaagagccctccatcctgacctgctgcccccacccg

SEQ ID NO: 6801425 - DNA, 88 bp, Homo sapiens
gtgacagctggagaatatgtgtccacaaacaacacaaagcattatttgtgtgttttacaaattctcttaaacgatatcacgcttttac

SEQ ID NO: 6801426 - DNA, 59 bp, Homo sapiens
gaagttacacctttgccccaagtcatagataattttctggacgggcataaggtggcttc

SEQ ID NO: 6801427 - DNA, 83 bp, Homo sapiens
gaaaaagccagcatttgcatggtgttaaacttaaaaatctctgtaatcaatgctaatttgacatgatgaaatgcagcactttc

SEQ ID NO: 6801428 - DNA, 55 bp, Homo sapiens
tctcctctactgggtctgcagatcattcaggctttgtgttcccagaggaaggaga

SEQ ID NO: 6801429 - DNA, 74 bp, Homo sapiens
attacaatcattcaggtcacttggaaggtttgcaaaaatcacatgtttcaagtgtcctgattaatggaagtaat

SEQ ID NO: 6801430 - DNA, 77 bp, Homo sapiens
ggctactggctccaccttcattattcctgaactgttggtggatatttacaccatcatttacaatgaaagcctgagcc

SEQ ID NO: 6801431 - DNA, 70 bp, Homo sapiens
ctgtgaagcagatctgatagggccctgctgcgacaccaacagcagctcagggccaaggatgctgttgcag

SEQ ID NO: 6801432 - DNA, 88 bp, Homo sapiens
ctagtgtgtgctgctcttcttccctcataaaaggtaacttcttttgctgctttttattcatagggatggagagaaacctattcactag

SEQ ID NO: 6801433 - DNA, 81 bp, Homo sapiens
gacagagaattttgtttgatttgaaattcttgggtaaaaaaaattcttcctttaatcctctgcagacgctgttctattgtc

SEQ ID NO: 6801434 - DNA, 67 bp, Homo sapiens
aggtcaggatccaagtctgtgcttgcagctgtttctctgtccagctacttgaccttgggcttggctt

SEQ ID NO: 6801435 - DNA, 61 bp, Homo sapiens
atagccactctaattctcttgtgttaccctgctgtattcccaggaggtaggggagtgctat

SEQ ID NO: 6801436 - DNA, 61 bp, Homo sapiens
agtgtctttgtctctcaagcactcgcataagttccagagtgcttcgttgaagaatggcgct

SEQ ID NO: 6801437 - DNA, 94 bp, Homo sapiens
ccatccttatcctcctatcccacagatccaatacacatgtcaagggtttcaaatcctgtgcaatgttgaggtttcaggagaggggcagggatgg

SEQ ID NO: 6801438 - DNA, 62 bp, Homo sapiens
gcagtgttaccttgggctggttcctccacctctaacagcatctggcccatggtaaatgctgt

SEQ ID NO: 6801439 - DNA, 56 bp, Homo sapiens
tatttagtttaggaaaagtaggtaactgcttgcttatgagactcttaggctaaata

SEQ ID NO: 6801440 - DNA, 96 bp, Homo sapiens
ttttaaaggggagaatattggcttagttggcaattgttatttggggtttattgatctaaacggacagttttgtaataaggccaacctctgtcaaaa

SEQ ID NO: 6801441 - DNA, 57 bp, Homo sapiens
ttctgttagcattctgatctccttctttgggggatttcacacagagtgtaaacagga

SEQ ID NO: 6801442 - DNA, 55 bp, Homo sapiens
tagagtcttggtgccatattgaaagaaacttttcacagtgctgcacctggcttta

SEQ ID NO: 6801443 - DNA, 124 bp, Homo sapiens
ggggggcaagatgaggacattcacagcagccactgttcttctttgttccagtgatagcgacactgcagccatctccagggaaccagtggcctgtttgctgtgtgtgcttccacactggcctccc

SEQ ID NO: 6801444 - DNA, 119 bp, Homo sapiens
ataaataaaatgataggttgaaccacataaaattccatttttgtaggtcaaaatggttgagtactggcaatttcatgtggttcaacattaaaaaaagacatagaaattgttttatttat

SEQ ID NO: 6801445 - DNA, 98 bp, Homo sapiens
caagccgttttaaaaatgtgtttgataggaatattatagcttagaattcgtaatgtaggtaaatttctgttataatttatttttggaaaaatggtttg

SEQ ID NO: 6801446 - DNA, 129 bp, Homo sapiens
gctagcaaatagtcgttgatgctcactgagacagagtcctggcccaggagtacacattaatacatgtggacaagactcctgggcccctgaaggggactctatgtcctgggcactgccatgtgtgcctgc

SEQ ID NO: 6801447 - DNA, 66 bp, Homo sapiens
actcgctgtaatgtttagaagcagacagcttatctaagccttctgagtctcagcatgcttgtgggt

SEQ ID NO: 6801448 - DNA, 68 bp, Homo sapiens
atgctctgcctgctcaccagggctctgctgctcttttaccaccagattgcccttggcaaggcttgtat

SEQ ID NO: 6801449 - DNA, 57 bp, Homo sapiens
gggccagaggatacatcttgattacactaatcagcatgtacttctcctccatgaccc

SEQ ID NO: 6801450 - DNA, 90 bp, Homo sapiens
cagatttttaaattctgtattttctatgaggatgggcaatcataatatagggagtgtaaactgtagaaaatactttcttttgaagaattg

SEQ ID NO: 6801451 - DNA, 86 bp, Homo sapiens
aagagatcagttagttgcttaaaccctgatcatgtgtcaggcactattctagatgctgggggttagagcagaaaggtagatttctt

SEQ ID NO: 6801452 - DNA, 82 bp, Homo sapiens
ttctaaggactatcaagtaggttggtttttatcaactgctgttgacacactgcagaaaatcacaagcttgggtcacttaggg

SEQ ID NO: 6801453 - DNA, 107 bp, Homo sapiens
gtaaaagaggtgaggaaaagagacaggttattgaatcaaagtggtggagtccccaagcaatcttttccgctccctagtagcctgcctatttctcaaactctgtcgac

SEQ ID NO: 6801454 - DNA, 63 bp, Homo sapiens
ttgtcacttttgggctacctgaaaacactgtgtctggacattctgtaggttaaaagtagacaa

SEQ ID NO: 6801455 - DNA, 128 bp, Homo sapiens
cagatcccgtggtggaggtggtcagtgccatgcaggacttggccgtggaggagggtggctcggctgagctcctctgccagtattcacggcccgtgcaggccacgtggaagatggacgagcgggaggtg

SEQ ID NO: 6801456 - DNA, 77 bp, Homo sapiens
ggatctctcatgaggtttcagtcaagcttttgactgggctgcatttatctgaaggcttgactgaggcaggaggatct

SEQ ID NO: 6801457 - DNA, 91 bp, Homo sapiens
gctaattgtgacaactgagtgggaggtttgtgtgatgattatctgtccaagcagaattacactaaaaccccccaactcatttcacagcagc

SEQ ID NO: 6801458 - DNA, 72 bp, Homo sapiens
gctcagcgccagggctgggtttgtcggtgttcccaaaactgggtcatatttgcccccatgccctggccttgc

SEQ ID NO: 6801459 - DNA, 69 bp, Homo sapiens
tctccgaggcagctctgatgatgctctggacagacagtgggccgaggcagggtggagccgcctctgagg

SEQ ID NO: 6801460 - DNA, 118 bp, Homo sapiens
caaaataaatgccacctgcaacattatgtattacattcattgaagtgattcatttgtggacaaatcagttgctgtgtaatgttttccataatgtctggcacagctggtttttaatttg

SEQ ID NO: 6801461 - DNA, 76 bp, Homo sapiens
ggccacttgaccccccatcctcacttgcggccacacagcacgtgtcacaggaccctgagggtggcggggccaggcc

SEQ ID NO: 6801462 - DNA, 62 bp, Homo sapiens
ggctgccccatgggctgggctggatggaaggagcggttgagggtcaagtccctggggcagct

SEQ ID NO: 6801463 - DNA, 79 bp, Homo sapiens
gctgctgtacggagggcccagccggcgagtctcgcgggggctttgcaggacccgggctgtggtcacccgtactgcatgc

SEQ ID NO: 6801464 - DNA, 70 bp, Homo sapiens
atcagtggtgctgaattatggtgagtacattggcactcactccaattttacccattcagactcacttgat

SEQ ID NO: 6801465 - DNA, 130 bp, Homo sapiens
gttccataccctgggggacatgcaggtgagatgctcagggacttggatcctggccctacacacacctccttgtggccttgggcgagtccctcagtcaccctgagccttcatttcctcctcggtcatgcac

SEQ ID NO: 6801466 - DNA, 88 bp, Homo sapiens
ccttctcctcagattcctctatagcccctggcctgtccattttgtggctccttaactaccaggtcagaggtagatgagatgaagaagg

SEQ ID NO: 6801467 - DNA, 64 bp, Homo sapiens
gaaaaaacgggctgtgtttttcagatggtcagaccatcagaccaagatttaacatgcctttttc

SEQ ID NO: 6801468 - DNA, 70 bp, Homo sapiens
atcctcatatgctagcgtttttatttctgtaagatagattcccaggaaagagactgctgggttgaaggat

SEQ ID NO: 6801469 - DNA, 93 bp, Homo sapiens
atggaaagtactggttaagtagtagatgcagattgtttgggtttgaatcctggctccctcatttactactcatgtgacctatttacttcccat

SEQ ID NO: 6801470 - DNA, 63 bp, Homo sapiens
acccagaatagcacatgctgtatattttttcagaaatgacagaaatattcgtggtgcttgggt

SEQ ID NO: 6801471 - DNA, 76 bp, Homo sapiens
accaagcaacatgatgaccacgtgtatccataagcacagcacctggctggctgagggctggtcacatttgtttagt

SEQ ID NO: 6801472 - DNA, 77 bp, Homo sapiens
aaatccacattctcttcctaaatatactcctggcataagacaacaaaagtgatatttgtggggagatgttccgattt

SEQ ID NO: 6801473 - DNA, 62 bp, Homo sapiens
ccaaggccagcgccagcgtcccggggcagggccctcctgctagagacctggtgtgtactcgg

SEQ ID NO: 6801474 - DNA, 86 bp, Homo sapiens
catttttgtgaatcttctggtctctattttaatgtctgtaacagtagatacattatgttcagaggtccataagctttatcatgatg

SEQ ID NO: 6801475 - DNA, 71 bp, Homo sapiens
tgggaaattctgggatatatttagattctctgctcttaactggacaagaacatctaaatatctgagaccca

SEQ ID NO: 6801476 - DNA, 65 bp, Homo sapiens
tgcaggtgtagagttgggctccctctgcgttgtattcctttgacgttgccccaacttgcatctca

SEQ ID NO: 6801477 - DNA, 55 bp, Homo sapiens
tctctgagttttaaggatgatgtctctggtgactccattcttgcttacttataga

SEQ ID NO: 6801478 - DNA, 94 bp, Homo sapiens
caaggtatgtggctgtggggctgagtggagccagaagggctggatcttgtacctctcttccatgtttcagccccatccttcaatcatcttcttg

SEQ ID NO: 6801479 - DNA, 121 bp, Homo sapiens
acaggggcatgatgactggacttggtcactcctggcttgaagagctgggtctgcagtcatctctgcaagaaagcctcaatcttcaggcctaggatgcaatctagtttcattctgcccctgt

SEQ ID NO: 6801480 - DNA, 74 bp, Homo sapiens
acaccatgcaataaataacatggaagacataaaatggcaccaggaatggctatgttttctatttgttgctgtgt

SEQ ID NO: 6801481 - DNA, 58 bp, Homo sapiens
tcactctcatggaaatacgttttcattcatttgctgactggaatcctctagagggtga

SEQ ID NO: 6801482 - DNA, 82 bp, Homo sapiens
ttgtacaaaccgtctttacacaagacaagaataacataggaaagaactatttgtctctgatctgtgcaaagaaggagagcaa

SEQ ID NO: 6801483 - DNA, 83 bp, Homo sapiens
ggctctgcagctcatcctcttctcctggctcctgaggatgcctgaaggcagcctggagttcccaggagaagactgaaaaggcc

SEQ ID NO: 6801484 - DNA, 76 bp, Homo sapiens
ggaggggcgtagacttaacatcctgtttaaatttggcattagccgaattttttaacaggggttatgacccccctcc

SEQ ID NO: 6801485 - DNA, 68 bp, Homo sapiens
acaaagatgaaatagcttttcataattctcagaggctttgagtaggaaaggaaatgttttgtctctgt

SEQ ID NO: 6801486 - DNA, 65 bp, Homo sapiens
atggacgagccacagaaattctactttgaatcaggggaattaattgtgtggtttgaataatccat

SEQ ID NO: 6801487 - DNA, 90 bp, Homo sapiens
gggtccataggagaggagaggcaccgtctgcagcgtgcagaggcatctgtgcgacaggtaggcacggcaagacggggcctcctgccaccc

SEQ ID NO: 6801488 - DNA, 62 bp, Homo sapiens
tggccctgaaaatgtttgtccggagctgatacacatcaattctgcatacatttcactggcca

SEQ ID NO: 6801489 - DNA, 76 bp, Homo sapiens
tcgcttgagcccctgaggctgaggttgcagtgagccaagatggcgccaccgcacttcagcttgggctaccgagtga

SEQ ID NO: 6801490 - DNA, 88 bp, Homo sapiens
ggtaaaactcagttaccacagaggtcattacactttgtttgttttaaattggcacataaactgtgaagcctccttgtaactatttgcc

SEQ ID NO: 6801491 - DNA, 62 bp, Homo sapiens
gagatataagatctagaaaggagcagggccagagtgaatgctgctttttaagcttgagtttt

SEQ ID NO: 6801492 - DNA, 56 bp, Homo sapiens
ggggggatcaactgagatggcttaggatttacctggatgcctgctctgctctcccc

SEQ ID NO: 6801493 - DNA, 65 bp, Homo sapiens
tggtgatggctgttgggtttggagccagaaacgagggggctagaacccagctctgccacttgcca

SEQ ID NO: 6801494 - DNA, 77 bp, Homo sapiens
cagccctctaatttcacagctggtctatgggaaagacacatgcatccttggcccatatgattctggaagtgctgctg

SEQ ID NO: 6801495 - DNA, 77 bp, Homo sapiens
tgttgagtgagatgaagaggcccttggagtcattccaggagtctataggtgactccagtctcttctcacttctgaca

SEQ ID NO: 6801496 - DNA, 74 bp, Homo sapiens
tgggcctgcagtcactgaatacaggccaggattccatctcttgcattggctgtagaatcagagacttgggtcca

SEQ ID NO: 6801497 - DNA, 91 bp, Homo sapiens
cctcccagagattttgtatgttgaaatcctaacctccaatgtgatagtatttggaatggggactttgggacataattaggtttaggggagg

SEQ ID NO: 6801498 - DNA, 59 bp, Homo sapiens
aggaggtagggaggggtctgtcctttggtcccaaaaaacaagatctcggcttgcttcct

SEQ ID NO: 6801499 - DNA, 55 bp, Homo sapiens
tggaaggggagttgttccacgtggccaaaacactgggagtaacattcatctttca

SEQ ID NO: 6801500 - DNA, 60 bp, Homo sapiens
gcaaggagcacctttctggaaccccctatagcatccaagtttctttctgggctctcttgc

SEQ ID NO: 6801501 - DNA, 74 bp, Homo sapiens
gtgaggcctggactgacatgttcttacatccagagattcaggaatgatctggagaataaatgtccaagtcttat

SEQ ID NO: 6801502 - DNA, 91 bp, Homo sapiens
agttatctttgagttacaatgtccttacatgaaaactgtgaataataattgacctttcctgctaggaacattgtattagtgaaggtagact

SEQ ID NO: 6801503 - DNA, 65 bp, Homo sapiens
ttctttttatcttcccataagaccacctctcttgtttgttgctgaggatggggggataagaggag

SEQ ID NO: 6801504 - DNA, 83 bp, Homo sapiens
aattatggaagaatcaggagagctgcgaacgttgcaaaattccatgctatcaatgaaatgtagtttctgatcttcgcacaatt

SEQ ID NO: 6801505 - DNA, 75 bp, Homo sapiens
tgtagcaccatctcctccttccccgccctggctgtcacctctagggctcctcgaagaggagagttgggtgctgca

SEQ ID NO: 6801506 - DNA, 61 bp, Homo sapiens
atagttttgctgtcaggtcctaaagatcaaaggtcaacatagtatattgcagtaaggctat

SEQ ID NO: 6801507 - DNA, 98 bp, Homo sapiens
cagagtagaagtctgactgacctggaatgaatatacattcattccatatttattccactggaatacattcattccaggtcagtcagagttctatcctg

SEQ ID NO: 6801508 - DNA, 67 bp, Homo sapiens
gagggacacaggattcctggctctgcctgtagccacagaagtacgcctgagggattcagtttctctc

SEQ ID NO: 6801509 - DNA, 81 bp, Homo sapiens
agaccataaattgtatattccatttgtatgaaatatccagaataggtacatctatagagacagaatgtaaattagtggttt

SEQ ID NO: 6801510 - DNA, 78 bp, Homo sapiens
gtattacagatttctaggggagaggaagaagtgatgatgaattttatcctgttctactgcctttagaagtaaaagtac

SEQ ID NO: 6801511 - DNA, 62 bp, Homo sapiens
ggcagagatgaggcactcatccccttcccttgccaaagatgggactgggtctcgtctcagct

SEQ ID NO: 6801512 - DNA, 59 bp, Homo sapiens
tctggtggattaaaggtctgttcccttccctttcctatggaggaggccatgccactaga

SEQ ID NO: 6801513 - DNA, 57 bp, Homo sapiens
gctctcctgagcctcacaagggcactgaaccacttcctttatgtcactctggagagc

SEQ ID NO: 6801514 - DNA, 61 bp, Homo sapiens
tgcagctagcagcatcacaggaagacttcgcaggcctgaggactttgaacactgctctgca

SEQ ID NO: 6801515 - DNA, 125 bp, Homo sapiens
cagtgcattttattctgtcatgaagtaggtaagttctctgacttggcgctcttgtcttcaagcattggtttgttccttgcaagcaggaagctcaggtccttgaatcttgtcttcagcagtcactg

SEQ ID NO: 6801516 - DNA, 85 bp, Homo sapiens
gatcttttgtttggtcagtctgtaaaaacttttaatgcttacaaaaggaattagaaaatacatgggctgtccttgataaacaatc

SEQ ID NO: 6801517 - DNA, 61 bp, Homo sapiens
ttaagagacaggagaatgatgttccaaggactgggaagaagttcagaattctgtctcttga

SEQ ID NO: 6801518 - DNA, 72 bp, Homo sapiens
gtctagggtatgtgacctatggatcagcagcagtcttttagaaatgcaagagtcccaggctccaccctagac

SEQ ID NO: 6801519 - DNA, 104 bp, Homo sapiens
tattaaattatttagtttgcatgcctgtttgaaattggacctctcagcagcactttgaaatagttttaattaggttaacattttgtacattaaataagtagata

SEQ ID NO: 6801520 - DNA, 59 bp, Homo sapiens
gaatgcacagcgttccatgcttgaactcgaactgatcttcaagaatgagctatgcattc

SEQ ID NO: 6801521 - DNA, 72 bp, Homo sapiens
ccctggtccttaccaactgccaacaatctgacagatgcaaagtttgggttgttgtgacagttaccagtgtgg

SEQ ID NO: 6801522 - DNA, 94 bp, Homo sapiens
acgtttgctctgcagctagagaaaggatgtctttgccagaagaattacattttgagcacattccctttcatgggcagagggattcaccaaacgt

SEQ ID NO: 6801523 - DNA, 75 bp, Homo sapiens
tgtgggctcttaaactctgggaccagatggatctggctttgagatctggctggattcttagcgttcagggcctca

SEQ ID NO: 6801524 - DNA, 93 bp, Homo sapiens
cccctagaatattaaatgataaacctgtggccactaaatttgctataaggctgatttttatctaaggtcttctctatttctgtgccctggggg

SEQ ID NO: 6801525 - DNA, 93 bp, Homo sapiens
ggctgggaagtcatatagtacagccattgagagccagggttctagaatctgcccctgctctgctgcttactagatggtgactttaaacctgcc

SEQ ID NO: 6801526 - DNA, 91 bp, Homo sapiens
tagccatttttaaaacgtactgaaaagttttctaatctatcagctaaaatgagagactggtgttttcagtattagtgaaattcagtggtta

SEQ ID NO: 6801527 - DNA, 81 bp, Homo sapiens
ctaggattctctgctatctatcacctgactaaaaatgcctgaacatcagcacaggtgcagttatgtacagtgaaaacctag

SEQ ID NO: 6801528 - DNA, 66 bp, Homo sapiens
gtgcctggatggtccagctggccatcagacatttgtgtcctggcctgtggcatgacctctaggtat

SEQ ID NO: 6801529 - DNA, 119 bp, Homo sapiens
gtggttgacaatggcaccattgttcctggagtcccctcagtgggggccacagggctcacacaccctggtccagtggatgctgagggggtgccaggattctggatgcaagatacagccac

SEQ ID NO: 6801530 - DNA, 129 bp, Homo sapiens
tgctgaactccatcacaattctactttgactatgaatctaggcttatacataggctggtttctagaactgcaggtacagtaacaggcctatggtttattcatgacaaaggaatttttctgagaaagaca

SEQ ID NO: 6801531 - DNA, 80 bp, Homo sapiens
ggggtaccctgaaagcatcctcctgtctgtcccacagcccacatggacactgggcagagaggaggggagcagggtggccc

SEQ ID NO: 6801532 - DNA, 74 bp, Homo sapiens
ttactgatgtgcctttgagtctggtcctcactgctgttttcagccgtcaggcctgccctgaaagcacatagtaa

SEQ ID NO: 6801533 - DNA, 82 bp, Homo sapiens
gcgcctctgctgagaccatgacctcccattcatcacagcttgccggccagggttatgaggaggtcaggccttacaagagtgc

SEQ ID NO: 6801534 - DNA, 58 bp, Homo sapiens
gaccactgatgacatgaggagaggcaaagagggaccagaattcatgtcagaaagggtc

SEQ ID NO: 6801535 - DNA, 64 bp, Homo sapiens
tttattcacttcagtgccaaagagcaaattcctgtgctactttaggaagacttgaatgagtaga

SEQ ID NO: 6801536 - DNA, 63 bp, Homo sapiens
gccatctcggagctatcaaaggaactgatttctggaggtcaccttcgaaggtgctgggatggt

SEQ ID NO: 6801537 - DNA, 75 bp, Homo sapiens
tctcacagtttccccctagggcagcacatctcttcagaaatgccaacccagtggagggaaagcagccctgtgagg

SEQ ID NO: 6801538 - DNA, 56 bp, Homo sapiens
gagaacagcttgcctttaatagatctccttacctgatctcaatggggccctgtctt

SEQ ID NO: 6801539 - DNA, 83 bp, Homo sapiens
ttaaagtttgactgtactcattgaactgtgcttgatcattagtaatggcagctatctttaatgagatgcatgtcaccctctag

SEQ ID NO: 6801540 - DNA, 57 bp, Homo sapiens
tgggtactgtggcatagccttggctcccctagtctaggctctgacccatgggaccca

SEQ ID NO: 6801541 - DNA, 59 bp, Homo sapiens
cctgcccatcccgtccttggcctgagaaaggacaggcactgaggacggatgtgggccgg

SEQ ID NO: 6801542 - DNA, 78 bp, Homo sapiens
cctcccgtctctatttctttctctgttttattatctcattcttggctgtgaggtaaacaggagaaaatgagaaggtgg

SEQ ID NO: 6801543 - DNA, 61 bp, Homo sapiens
aaagtgctgggattacaagcgtgagccgctgcgcacggccatgacgtttcttaagtacttt

SEQ ID NO: 6801544 - DNA, 76 bp, Homo sapiens
aagctgaataacttcagtgtggtataaaacgtggtttttaggctatgtttgtgattgctgaaaagaattctagttt

SEQ ID NO: 6801545 - DNA, 69 bp, Homo sapiens
gccaggttttattttacataaagtcttttccagaagaagaccataatgtaagatgaatttgtactaggt

SEQ ID NO: 6801546 - DNA, 87 bp, Homo sapiens
atagattttatcttcttttgcttgtgtttactcttcattctccagtttgaattgtgataactcaggcagagaataattgaaatttgt

SEQ ID NO: 6801547 - DNA, 87 bp, Homo sapiens
gctgggctcagttcaagacttcttcataagactctcattttttgatgatcagtgagagataaggattgtttttctcatgggcttggc

SEQ ID NO: 6801548 - DNA, 61 bp, Homo sapiens
cttttctgtgtcacccccaaccctatgacattagtttgtgttcgtacctgacacagaacag

SEQ ID NO: 6801549 - DNA, 56 bp, Homo sapiens
gcccatggcagaactgtgagcagaactggacaagtagcacacatttctgacagggc

SEQ ID NO: 6801550 - DNA, 113 bp, Homo sapiens
gtgtgtttccttaagtctctagcttcaaaattaagagtaggcgctaccgctgtgattgtgggcagttgtgtggttggcggctgcgtttggagctctgagttgaaaagatgtac

SEQ ID NO: 6801551 - DNA, 65 bp, Homo sapiens
acagggagctgacaaccaaggagtggctgataaatactccagctttctcccctcggtttccctgt

SEQ ID NO: 6801552 - DNA, 60 bp, Homo sapiens
cagtaaatggtaaagggtttattagcaattagtgctacatgaatgctgaattatgaactg

SEQ ID NO: 6801553 - DNA, 56 bp, Homo sapiens
acacacaaatctattagtgaataataaaaactgtttgtcactgaggttatgtgtgt

SEQ ID NO: 6801554 - DNA, 92 bp, Homo sapiens
gagagaaaagggagttctcgctgattaggttttgtttgtccaataaaggacatttgacatttagtatcagctaggtgctctaacattctttt

SEQ ID NO: 6801555 - DNA, 76 bp, Homo sapiens
cccagccctggacagtgacggtgacccatggagaatgcatcatgcctgtcagggtcctgttggttcagcggctggg

SEQ ID NO: 6801556 - DNA, 75 bp, Homo sapiens
aaggcattactcccagctctaaggcgacatcgctgtcattaaagaaaacctgtgcctgagttggctgagtacctt

SEQ ID NO: 6801557 - DNA, 98 bp, Homo sapiens
aggcattccatgcccctcacaattgggctccaatttgtcctttcatgctcaccccttgctgaaagtcccttggacccaggctgagtggtatgtggcct

SEQ ID NO: 6801558 - DNA, 60 bp, Homo sapiens
ggaggcaggccgggcaggcagcgagcccagggcttacggctcccaactcaggcctcctcc

SEQ ID NO: 6801559 - DNA, 58 bp, Homo sapiens
gaagatcacaccaaggaattccacaggttctgctgcaggaaggctatggtgtattttt

SEQ ID NO: 6801560 - DNA, 57 bp, Homo sapiens
gtggtgtctccatacattgtgacctagtcactgctagcacacaggagccacactcac

SEQ ID NO: 6801561 - DNA, 64 bp, Homo sapiens
gtcacaatgtaggctgaaaaagctttgtgaacgttccacaaagcatcaacactatattgatgac

SEQ ID NO: 6801562 - DNA, 106 bp, Homo sapiens
ttaaggtaggttaatatgatgtgttagaaaatctggtgacatatgttaagataattggcaatgttctgttttgtaattcataaattagtattaactgtactcttga

SEQ ID NO: 6801563 - DNA, 59 bp, Homo sapiens
ggtctccaaagctgcattgatgtggagaaaacacctttcccttctagttttgagagact

SEQ ID NO: 6801564 - DNA, 77 bp, Homo sapiens
gcccctgggaggcaagagcaggccctgcagaggctgttctcaagtcaaagctgggcctgttcatgccaccgggaagc

SEQ ID NO: 6801565 - DNA, 57 bp, Homo sapiens
ggatatatggtcaccttaaacataatctccctaccttgtgtttgagactatgtttcc

SEQ ID NO: 6801566 - DNA, 79 bp, Homo sapiens
gagcattaaaccgagcacagggccctgtgcgtaggtcacagaccccagaggccagccctgttttccagctttattgctc

SEQ ID NO: 6801567 - DNA, 56 bp, Homo sapiens
tccagtttctcttcttgtaaaatgcaaataaattgaggtcaagagagatgactgga

SEQ ID NO: 6801568 - DNA, 86 bp, Homo sapiens
cattactgtattattggcttccaggatctcagcagggcacgagggaggtttagcctgtctgaattttggaatcaagtttggtgatg

SEQ ID NO: 6801569 - DNA, 64 bp, Homo sapiens
ccttagagaatgaaatttactacagatgaaatttactacatttcctgtggtatattttataggg

SEQ ID NO: 6801570 - DNA, 80 bp, Homo sapiens
gaggaagtttgagaaactgctgtagtaactaggttaagttaaacaaatacacccaagttttgcatagttctgtattcctc

SEQ ID NO: 6801571 - DNA, 90 bp, Homo sapiens
ttataattatttatagtaactgtggtaagatatttcacaaaagagttaccctttagtggaatgtgttctattttacagaagtaaatataa

SEQ ID NO: 6801572 - DNA, 109 bp, Homo sapiens
gatgcttgggacttttaaccatgacttcattgctcttgaatatgggtttcatgcatctggttgcttggctgttttcagaaagtaggggtaacagtcccatcaatgtatc

SEQ ID NO: 6801573 - DNA, 121 bp, Homo sapiens
caaaaagaaccaccaccccaaagatagtgtcattatttcttctctttcacggtcagcctgtttaatctgaagtttgtagatagaaaaatgattatatcttgcaagggtcataaattttttg

SEQ ID NO: 6801574 - DNA, 74 bp, Homo sapiens
aggagggcaggctggctgcctaaaaataggaggagactgggtttttggggagggcagcttaagcttgtttttct

SEQ ID NO: 6801575 - DNA, 66 bp, Homo sapiens
agctgggtagatataaaaacaagactaaagtatgatcttctagtatctttctatatttcccaggct

SEQ ID NO: 6801576 - DNA, 55 bp, Homo sapiens
gtcaacaattccagtttttactgtgataatcacaaagggagactaaactgttgac

SEQ ID NO: 6801577 - DNA, 80 bp, Homo sapiens
gccagtcactcttctaagcactttgtgaggattattacaagacatcatcataacaggctgagaggatttaggtgacttgc

SEQ ID NO: 6801578 - DNA, 66 bp, Homo sapiens
tttcctaagttaaaacttattaagctagttgggcaaaattaggaaaaatgagatgacttagaggaa

SEQ ID NO: 6801579 - DNA, 64 bp, Homo sapiens
gggcaagaaggcctctgccctggcttctgtgtattagaggttctgttctagcccttctctgccc

SEQ ID NO: 6801580 - DNA, 63 bp, Homo sapiens
gctttgtgctttaattgctgccccggttttaatggggcactttgcctttatgcactgctaagc

SEQ ID NO: 6801581 - DNA, 85 bp, Homo sapiens
gtgccgcacttggggtatttgacaaactgacactctaccacatggagtgtccaactcagcttgtcaaatacacggagcgtggcac

SEQ ID NO: 6801582 - DNA, 66 bp, Homo sapiens
ggcatttgactgtttctactcaaataaaatgaactggcaaaatatttgagcagaaatgtgtatgcc

SEQ ID NO: 6801583 - DNA, 84 bp, Homo sapiens
ggctggggtttgagttttggctttgttgcttgtgtacttcagttaggatttcttagttgcaagcagcccagaacagctctggcc

SEQ ID NO: 6801584 - DNA, 93 bp, Homo sapiens
cattcatgtgacagactgtgttctagaaggggatgtatagcagtaaaccaagtttataaaactctctgtctaaatgcagtttgcattctaatg

SEQ ID NO: 6801585 - DNA, 67 bp, Homo sapiens
ctgcaaggcaagaaaagaggtctcaccagaaacagtctctgctagcaccttgctcttggccttccag

SEQ ID NO: 6801586 - DNA, 70 bp, Homo sapiens
gaatgcagatgaaattcagaattgaggggtcagtgagatcttttggagatgaaaatttgatctgttattc

SEQ ID NO: 6801587 - DNA, 129 bp, Homo sapiens
catcagaatctccaggaaggcttgttgaaacatacatcattgggtcctaaccccagagtctctgattcagtaggtctagggtggggcccaagacttgcatttctgacaagttcccagatgatgctgatg

SEQ ID NO: 6801588 - DNA, 60 bp, Homo sapiens
acaaccttctctgtcttggcaataatttctaaacacaagaggtagcacagagcaggatgt

SEQ ID NO: 6801589 - DNA, 79 bp, Homo sapiens
gactcctgcctcatgcccaccctcagcccaggctggcagctgctcggtgggtatgctgaggctgggcccctggcaagtc

SEQ ID NO: 6801590 - DNA, 58 bp, Homo sapiens
ctctatttgtcagtttggctttaaggttttcattttgttggctagaagacagataaag

SEQ ID NO: 6801591 - DNA, 80 bp, Homo sapiens
acagctgcctgacactgccgccaccccgccagcctcctccttggcctgtgcggggggcagcagtcgctcagtcccactgt

SEQ ID NO: 6801592 - DNA, 57 bp, Homo sapiens
ggtcaggtatcccaatcctgagcccttgctagaggctgagcggactggggtccctcc

SEQ ID NO: 6801593 - DNA, 63 bp, Homo sapiens
ggccattggcagcgccagacaattaacagtcgaaagtaattgctcttggccgtgccagcagcc

SEQ ID NO: 6801594 - DNA, 81 bp, Homo sapiens
gcaaattgtaagagccctccaaggccagaatgaagggtcagacttctttctggaagcagtggggagtgattgaagatttgt

SEQ ID NO: 6801595 - DNA, 75 bp, Homo sapiens
tttatatcttgattagcctccttgtctcatgcgctggtactttcagtcacatgggtttttaggagagtgtataaa

SEQ ID NO: 6801596 - DNA, 58 bp, Homo sapiens
gccacttctgcattgaatgacctgggaagaaaaccaatttgtttaaaggtgaagaggc

SEQ ID NO: 6801597 - DNA, 85 bp, Homo sapiens
ggctgactggggcacaggctcccgaaatcacccatgtggttgacctcacttggagaagaggggtctggcctaatgtcacacagct

SEQ ID NO: 6801598 - DNA, 57 bp, Homo sapiens
gccttctgatcgctggactgactctctcgccctctcttggtgcagccctcgggaggc

SEQ ID NO: 6801599 - DNA, 57 bp, Homo sapiens
acctagctaatcattctgatctcataggtgaggaaattcagacccagattagcaggt

SEQ ID NO: 6801600 - DNA, 77 bp, Homo sapiens
tcagattgtcaattgtttattgtttctgtttgataccattgaggtatttgttccagagataaaaatatgtatgctga

SEQ ID NO: 6801601 - DNA, 75 bp, Homo sapiens
ctcaagatcttcctttattcctgcccactttgtcacaggcagaacaacgtaggagtggagatgtgatctccagag

SEQ ID NO: 6801602 - DNA, 98 bp, Homo sapiens
cacagcttctttatatctggctggggtccatcctctaatatacaccctctaatggtgagttgcagtgagcggagcctcagtgctgtgaactggctgtg

SEQ ID NO: 6801603 - DNA, 70 bp, Homo sapiens
tcatgtgtctagtgctaaagcaactccctgggtaggcttttctaacagatgtggaacactagactgctga

SEQ ID NO: 6801604 - DNA, 60 bp, Homo sapiens
ggtggggccccgtcaccgtcgaggctgcctggcttggtctcagggtggctgggcccatcc

SEQ ID NO: 6801605 - DNA, 77 bp, Homo sapiens
acagaacacgtatacaatgacccgggtccaaggccatccacggtgactctggtgtctgttgtgtttcgagtctctgt

SEQ ID NO: 6801606 - DNA, 56 bp, Homo sapiens
tcgtttggctgaagctacatcagcaggtgcatctgctggctgaaacagccaaagga

SEQ ID NO: 6801607 - DNA, 67 bp, Homo sapiens
tacctttgggtcaatgttctgattcttttgcagcttctgctcacaagactgagcttgcttgatggta

SEQ ID NO: 6801608 - DNA, 129 bp, Homo sapiens
catgaaacaagccccagggcaggaaggctggcatctttccacctgaatgactgtttaagtaaaagcagcacacgggagaaagacaggctagtctgttttccttgtaattggtgttggcttgaatatatg

SEQ ID NO: 6801609 - DNA, 68 bp, Homo sapiens
accccaggcccctgcaggccactcttgtagaccacagagctcagtgtcccctccaagggcctggcggt

SEQ ID NO: 6801610 - DNA, 84 bp, Homo sapiens
tatttgtttctggaaaggtatatttctctggttgttagctcatttgcagaaccattttgacagatatactgaggccaatgaata

SEQ ID NO: 6801611 - DNA, 60 bp, Homo sapiens
tacatcaaggaacacctggtatcagtgcacgccatcattgatgctggtaaccttggtgtg

SEQ ID NO: 6801612 - DNA, 67 bp, Homo sapiens
cagtggcatagctagtatttcttccatggctagctgattaatggcagacaaagcagcatgcctattg

SEQ ID NO: 6801613 - DNA, 60 bp, Homo sapiens
gggctcatcagctaggaaaatggcagaggactgtgcttcacccgttttcttgctgggctc

SEQ ID NO: 6801614 - DNA, 79 bp, Homo sapiens
gctgtgcttccttgtcttcctgtgatgacccatgtgccatcttacacaaatggacaatcaatggaggtaagtggccagc

SEQ ID NO: 6801615 - DNA, 71 bp, Homo sapiens
gaggcaggagtagagatgaaggctcagagctcttccccatggcctatttctccctataccctccaagcctc

SEQ ID NO: 6801616 - DNA, 67 bp, Homo sapiens
tgaaaatgtcacaaggccatgaaaagaaattgatagaaaatttcagagttccttgttgatattttga

SEQ ID NO: 6801617 - DNA, 77 bp, Homo sapiens
ccaagagaccctggagcacatggcaggaggccttcccagccaaggctcctgcagagatgttccatggttagacttgg

SEQ ID NO: 6801618 - DNA, 55 bp, Homo sapiens
gaagccctgtaggtgcaaaggtaaacagtctaggccccagcctacgggaagtttc

SEQ ID NO: 6801619 - DNA, 83 bp, Homo sapiens
cctgccctcctcacaggctgaaaggagctgctgacgtcattaaatcaataactttgtttagcattgtgttttctgggggcagg

SEQ ID NO: 6801620 - DNA, 73 bp, Homo sapiens
ggctgccagcagctgcaaatggaaacagcgggccacatgcagcctctgccgttgacagctgtgggtggcagtc

SEQ ID NO: 6801621 - DNA, 62 bp, Homo sapiens
ggctagatctttcactactgtgtaggtagtctctacttactggtaggatagattacattgct

SEQ ID NO: 6801622 - DNA, 99 bp, Homo sapiens
gttggttggttggatttccccctgcattgtccctaagagccggactccaacagtcagtccgaggaaatgcgggagggagggaggaatcttaaaaacagc

SEQ ID NO: 6801623 - DNA, 63 bp, Homo sapiens
tgtgcttcttgcagctcctgtaccccttaccctggggcagccagtatgaatgcatgaggcaca

SEQ ID NO: 6801624 - DNA, 57 bp, Homo sapiens
agtacttttcttttgagaaactgcaacagttatttaaatctcagaggaaaaattgct

SEQ ID NO: 6801625 - DNA, 65 bp, Homo sapiens
aggaacagactccattacctggctttataaaaaggtcaagagtaaatttgggtacacctgtctct

SEQ ID NO: 6801626 - DNA, 65 bp, Homo sapiens
agggtctggggtcaaccataagcactcagatgttacagctcgcttgcttcggtgaccctggccct

SEQ ID NO: 6801627 - DNA, 100 bp, Homo sapiens
aagccaatctgaattgcactaggaaaaggcagccattcttttgggtagggggagaagtgagcttggctggtcattctggttgttagcaattatctggctt

SEQ ID NO: 6801628 - DNA, 83 bp, Homo sapiens
aaaacattatataactttaaagagtcattatgtatgcccttatgatctatggctttgcatacaatttttagaaatggtgtttt

SEQ ID NO: 6801629 - DNA, 87 bp, Homo sapiens
gactagagtttcttgagagatatactactgaaagaagctatctgtattaaaattcagtatgtgtaaactactttaatgaacctggtt

SEQ ID NO: 6801630 - DNA, 110 bp, Homo sapiens
ggtggagctacatgaaatgcacagaaaatggtttctggagtcaggcagcccctgactccaggcagcctctgactccagaaactccagtcgtgtgggaatcacagcccacc

SEQ ID NO: 6801631 - DNA, 68 bp, Homo sapiens
gacacagccagccctagcccagctccctaggatgagagttctgtatggggcacagggctggcgctgtt

SEQ ID NO: 6801632 - DNA, 79 bp, Homo sapiens
gagttgtgtgtttgtggctgtgtctgtgtgcaataataaacatcttttgtgggtacttacagcaataatgacaccgctc

SEQ ID NO: 6801633 - DNA, 88 bp, Homo sapiens
gctgatgttgctggtgtcaggaccacactttgagtaggaagagtctagaagtggtcctcataattcagtgagcataaaattttccagt

SEQ ID NO: 6801634 - DNA, 78 bp, Homo sapiens
ctgtcagatactgaggcatgcaatgactgctgacagtgtcctttctgggacaatgtgcaattgcagctagtctgatgg

SEQ ID NO: 6801635 - DNA, 67 bp, Homo sapiens
gtttggaacagaaagcaatttaacacagcaactaatagcatgggctctagattctgtctgtccaaac

SEQ ID NO: 6801636 - DNA, 88 bp, Homo sapiens
ggggaggcaggcacaaaaggaccccagcatgcaggttcccccattcaggcagcaggttctgtttggctccttactgtcctgtatcccc

SEQ ID NO: 6801637 - DNA, 128 bp, Homo sapiens
tcgctgcttgccaaaaataagccgtgaaacgtatttcagagtagatcgttatttacatgctggcgaggagccacagaataccatttacatttgaaaatagagtgctgcgaagtttttataagtagtga

SEQ ID NO: 6801638 - DNA, 76 bp, Homo sapiens
tttgtgagagccaaacatgtaagtttgctgatactgaaaattaccaactggcagctcttacgtgtctcttgacaaa

SEQ ID NO: 6801639 - DNA, 124 bp, Homo sapiens
ggatgtctcctccctccccatgattttcatttgttgtgacattctcttcagttggtttatttgagaggtggtatcaggaagctaaccagggagtgagaagtgagacaaggaagggaaggaagcc

SEQ ID NO: 6801640 - DNA, 69 bp, Homo sapiens
catcccaaggcttaggtggctccctgtcttggacactccagcaggagcaatgctttggtcctggagatg

SEQ ID NO: 6801641 - DNA, 82 bp, Homo sapiens
agttctggggtggaggggagggttggaggggcctcacccagccctgccaatcccgtctctctgacagactccaatgggaact

SEQ ID NO: 6801642 - DNA, 67 bp, Homo sapiens
gaggcctctgagctccagagttagacacccggggccagtctggctctgtctggggctgaggggcctt

SEQ ID NO: 6801643 - DNA, 63 bp, Homo sapiens
gagcagggctgtggcctcacaagtactaaggcagctagaggctactagaggcacctgaagctc

SEQ ID NO: 6801644 - DNA, 121 bp, Homo sapiens
gtctgatagtcaaggggctggttactattaggttggtgcaaaagtaaatgtggtttttagaaataatggcaaaacccctaattacttttgcaccaacctaataattcacccacagtcagac

SEQ ID NO: 6801645 - DNA, 57 bp, Homo sapiens
ctggctgcaggaaggagtgggctttgtgccacagaccccgagtttgcagagttccag

SEQ ID NO: 6801646 - DNA, 74 bp, Homo sapiens
ggtgtttcttgcgtctgtagtgtatggtgtgggtgttagcaaactccatacaatggcaggctgtgaggaagtcc

SEQ ID NO: 6801647 - DNA, 117 bp, Homo sapiens
gagtggctcagggctgaggtatttctgcctagggttcatgcctggatactggaatcacagcaagatagtcatccaagagcctgggcagtgccttcctaacagatagccccttcactc

SEQ ID NO: 6801648 - DNA, 66 bp, Homo sapiens
gccagcagagtatcaatgtattttcaagaaaagtgcaatttgaaattctgcatttttaacagtggc

SEQ ID NO: 6801649 - DNA, 72 bp, Homo sapiens
ggtctcaaggttgccgcgattttcctaaaaccttaaacttaggacttttggcagaattgatggtccttaacc

SEQ ID NO: 6801650 - DNA, 60 bp, Homo sapiens
gctggctgtggcttaagcaaacgcaatcacagaattgcctagctgtgagtcagagtcggc

SEQ ID NO: 6801651 - DNA, 83 bp, Homo sapiens
tcctccttttcagccaatggtttgtacctgtccttggccacaagatgtcacccaaggaacagcaaagccggggcctgggagga

SEQ ID NO: 6801652 - DNA, 66 bp, Homo sapiens
agcccgaagtcctgggggcagctgtgtccagcagacgctgcacccagcagtcttgggggttgggct

SEQ ID NO: 6801653 - DNA, 59 bp, Homo sapiens
tcacagaatgtctagcataattgtttgcatacaataggtgctcaatgaccatttggtga

SEQ ID NO: 6801654 - DNA, 79 bp, Homo sapiens
gcccaagcctcttctacctgtagccctgaaagcgcttgagaagttcaagtgcaaagctgctgctgtggtaggaatgggc

SEQ ID NO: 6801655 - DNA, 59 bp, Homo sapiens
ccatgtatggaatcctttagtttttcttaagaaagctgaaaatgagactctacacatgg

SEQ ID NO: 6801656 - DNA, 65 bp, Homo sapiens
cacatgctggctgccttggatggcagctaggaccgttccatttattccagggcaactagagtgtg

SEQ ID NO: 6801657 - DNA, 90 bp, Homo sapiens
caggctggggacttggaggctagaagtgagtcctgtttcctccatgaaagccacagcactttacttctcagtgactcagtttcccacttg

SEQ ID NO: 6801658 - DNA, 120 bp, Homo sapiens
cattccacaccagcattttagtccctcagtctgttgcatgttgcatatattgtttctcattactcaagtttgtagaaatgtaaccaggagatagaagagaaaaagagcttgtggggaatg

SEQ ID NO: 6801659 - DNA, 78 bp, Homo sapiens
tagaggtcagaagtgcaaaatcagtttcttggggttaaacctaggtgttggcagagcttgttccttctgtttcctctg

SEQ ID NO: 6801660 - DNA, 61 bp, Homo sapiens
gaaaacactgcagggtttacttgacttgcccaagatcactaaactagtcctgcatgttttc

SEQ ID NO: 6801661 - DNA, 58 bp, Homo sapiens
ggacgcttaccagtaacgacttcacagcagccctgcctgccaagtgctggcaaggtct

SEQ ID NO: 6801662 - DNA, 71 bp, Homo sapiens
ctcaagtgtgcatgtgtgtgtgtatgtgtgtgtatacatgcatagggaacctcatgcattaaacatttgag

SEQ ID NO: 6801663 - DNA, 101 bp, Homo sapiens
ctgactgtggcttctttacattgaagtgtctggcctcctcctctacaaccaagatgatggggagttgtcaggggttcaaccagagaagcagaatcagtcgg

SEQ ID NO: 6801664 - DNA, 56 bp, Homo sapiens
gcagtccagtgggtgttaattaggtgaacctgcaaataaacatgcattagaactgc

SEQ ID NO: 6801665 - DNA, 78 bp, Homo sapiens
agataactaattagtatttttggattgaacacgacagggtttatacaggctgcttctaatctactgcattagttatct

SEQ ID NO: 6801666 - DNA, 78 bp, Homo sapiens
acagtttcctcaggtgctacaaagcagccagggtgtgcgtgcgctcccgcctcgtcgcttagcaacctgagaagctgt

SEQ ID NO: 6801667 - DNA, 114 bp, Homo sapiens
agaaacaaacaaaaagaaatgaagaaaggtagagagaaggaggaagataggctggtacgtcaatatttcactattctctgtaactacttttcttgaaaatctttctaagtatct

SEQ ID NO: 6801668 - DNA, 87 bp, Homo sapiens
ggtatttctatgttttatctggactgtgatataaattagctttaccattttaagtgattttcatgttgtattcagggaagcaatgcc

SEQ ID NO: 6801669 - DNA, 61 bp, Homo sapiens
gctcacttctacattattgcctttctcatgctactagcaggcactgaatgtgtcagtgagt

SEQ ID NO: 6801670 - DNA, 105 bp, Homo sapiens
actcacagtccatggtgtgactgagctgtggcagcagccgtggcattggccttgcaacagtgtcagggcatgcggtccagcctttcttgtgatttggctctgagt

SEQ ID NO: 6801671 - DNA, 55 bp, Homo sapiens
ctggagcctaggttgacctgggtgaaggaaaatacccaactgcagtgggctccag

SEQ ID NO: 6801672 - DNA, 85 bp, Homo sapiens
tgcttaatatgtgttatccactgtaatatcattgtggtgagggtgtaaataagatcaggcgtggaaaacactgaacacttaagta

SEQ ID NO: 6801673 - DNA, 108 bp, Homo sapiens
gggaaagggaaggcccacggggccctggagctgtcttcacaggccttcaactgtcagagggatgtatttaggacacagatctggccacgccgtggcccaccctcaccc

SEQ ID NO: 6801674 - DNA, 63 bp, Homo sapiens
accatgctggcaccttgatctcagaaaataaatgtctgttgtataagccatccagcctgtggt

SEQ ID NO: 6801675 - DNA, 67 bp, Homo sapiens
cagatatagaacaagttatttatgctcagttctctaggaaaaggatggaggcttgttctgagatgtg

SEQ ID NO: 6801676 - DNA, 59 bp, Homo sapiens
gtggggctaaaaactgtgcagttagacaagggtctctctctgatgggtgttggcctcac

SEQ ID NO: 6801677 - DNA, 112 bp, Homo sapiens
ccagcactccaggccttgacaatcagtaatctgttttctgcctctatgaatttgcctattctggacgtttcaggtaaatggaatcatacgatatgcagccttttgtgactgg

SEQ ID NO: 6801678 - DNA, 82 bp, Homo sapiens
gtaacagtattaagaggcagggccttcaagagctggtcaggccatgagggccctgtcctcctgactgagtgaatgctgttat

SEQ ID NO: 6801679 - DNA, 55 bp, Homo sapiens
taggatctggttacgtaagagtcttttattgaaggctgtatttgattgagacctg

SEQ ID NO: 6801680 - DNA, 72 bp, Homo sapiens
agtcccttcctcattccactttagagtctccttctagcttcatatcctctggggccaagtgaggaagggtct

SEQ ID NO: 6801681 - DNA, 89 bp, Homo sapiens
gctaaaatcaaagtttgaactaagaccttgggagtaataaaaaattccacttttgtggtgtttccaggttttttcaagcatattgtagc

SEQ ID NO: 6801682 - DNA, 66 bp, Homo sapiens
gagggactgaggaaggagttaggcagttgctcaaagcaggcagcctggatagacccctctcccctc

SEQ ID NO: 6801683 - DNA, 93 bp, Homo sapiens
atttttgttgtcacgcagaacagattatataccattgttgtaagtgattaatacatacatatgaatgatttggctcaggtaagcagcagaagt

SEQ ID NO: 6801684 - DNA, 96 bp, Homo sapiens
ttagtatgtcgcatttattctaggcactatgattgatgctaggaataaagacaaaaataccacacagtccttgctctgggatgatgtacatactga

SEQ ID NO: 6801685 - DNA, 62 bp, Homo sapiens
ccagcatgagacgatgatgaagcttgtcctggaagacccactgcttgtgtctctcaggctgg

SEQ ID NO: 6801686 - DNA, 94 bp, Homo sapiens
tcactgacgtagcttgcctcatattctaagggctgacaatggttatttcctgaaggccctgctgagtggagtggaggcgtgggttaggtcagga

SEQ ID NO: 6801687 - DNA, 56 bp, Homo sapiens
acactgagtattgagtagggtaattaaaaatacatctcgatctagacactcagtgt

SEQ ID NO: 6801688 - DNA, 62 bp, Homo sapiens
ctctaagtcatgatcagacagagagcggtcacaacgctttcagatgatgcatgcgctcagag

SEQ ID NO: 6801689 - DNA, 77 bp, Homo sapiens
actctccttcttggcacaagctgtaatagcttctacattcggtagcaaatggcttttgatgctaagccaaggaaagt

SEQ ID NO: 6801690 - DNA, 55 bp, Homo sapiens
tccatttaactgtccccagcactagaaatgtgaactccttgagggcaggagtgga

SEQ ID NO: 6801691 - DNA, 83 bp, Homo sapiens
ggcttctgacaccatggctggtgcacctctgggaggctgtgccctctcggggctgccccatgccacagtgcccacagcaagct

SEQ ID NO: 6801692 - DNA, 67 bp, Homo sapiens
gtgggacacagtggttaacacctgtgatctcagtgctttgagaggcaggaggttgacttgagcccac

SEQ ID NO: 6801693 - DNA, 96 bp, Homo sapiens
ggaagcactcaaatattaatgggatttagtcaggagagcgtggaagctagcttgaaggggctcccattgaccaaatttggggccatttaagaatcc

SEQ ID NO: 6801694 - DNA, 99 bp, Homo sapiens
gccaaggtgtccaaaaagcctcacttcctccagaagctgtaggggaggatccattgcctggtctcttccagcttctagaggatgcccacattccttggc

SEQ ID NO: 6801695 - DNA, 64 bp, Homo sapiens
tgtcacaatggaggtagcagtttccttttgagggactggaaatgtgacctacttccttgtaaca

SEQ ID NO: 6801696 - DNA, 60 bp, Homo sapiens
tctaacaagtttgaagtcttttaagttattgtgagctcatgtcccttggaacttgttggg

SEQ ID NO: 6801697 - DNA, 59 bp, Homo sapiens
ggtgcagtgaaggaagtttgtcttgggctgcctccaagcaccccttcctccctgactcc

SEQ ID NO: 6801698 - DNA, 60 bp, Homo sapiens
gatgtgtgcacagatggatggggcttatctgattccctgtccatccacgcccacacactc

SEQ ID NO: 6801699 - DNA, 98 bp, Homo sapiens
gaggcaggaaaatcgcttgaacccggagttggaggttgcagtgagccaagatcatgccactgcactccagcccgggtgacagagcaaggctccgtctc

SEQ ID NO: 6801700 - DNA, 60 bp, Homo sapiens
tctggtctccaggagtggtggtagaatgtggttcctaagcatgcagattctggagccaga

SEQ ID NO: 6801701 - DNA, 65 bp, Homo sapiens
tatctccagagcgggagccagacgccgacccaagcggaagtgacgttaggtgtccgccggaggtg

SEQ ID NO: 6801702 - DNA, 63 bp, Homo sapiens
tcccaaagggtgtcagcagcaagctccatcgacttgcctacattgcccaccccaagcttggga

SEQ ID NO: 6801703 - DNA, 59 bp, Homo sapiens
agcccttgagtgtatctcaaatatctttcattgttaatgagccaaattctccaagggct

SEQ ID NO: 6801704 - DNA, 62 bp, Homo sapiens
cctgaactgagattacaagagacattttgaaatacaaaagtttctgtcttctcagtggcagg

SEQ ID NO: 6801705 - DNA, 67 bp, Homo sapiens
tgatatctaccctgcaggattgctgtgcagattaaatacaataaagaatttgaaagcgcagggttca

SEQ ID NO: 6801706 - DNA, 58 bp, Homo sapiens
ggagggggaagaagctaaagacttgccagccagaggtttcatgcggtcttcccctttc

SEQ ID NO: 6801707 - DNA, 56 bp, Homo sapiens
gtggaggtggtttgtattcctggctcttatcaaggcactattacattcatttccac

SEQ ID NO: 6801708 - DNA, 65 bp, Homo sapiens
atacatctaaagtgtcataagtagctttattctagggctgcagtctagtcactttaaaaatgtgt

SEQ ID NO: 6801709 - DNA, 61 bp, Homo sapiens
aggccaagtgagcactaaagcttcctgtcataatgaggaggcagtgggggccactttgctt

SEQ ID NO: 6801710 - DNA, 69 bp, Homo sapiens
gttcaggccagatgatgttcctaatcctgcaaggtctggggtactttcatctgataagagcccatgagc

SEQ ID NO: 6801711 - DNA, 88 bp, Homo sapiens
ttatcatcaccagtatcatctgcaaagcattttgataaatacctggttttacatgactgcccttgtcagggcctgctggtgtagataa

SEQ ID NO: 6801712 - DNA, 69 bp, Homo sapiens
cctggccctggggtaggggctgtgaggctgtgggggctcgcttgcccacatgacctgacctaggctagg

SEQ ID NO: 6801713 - DNA, 79 bp, Homo sapiens
ctgtcaggggacagccagggatgtgtgagctccttcaggacacagactcctttccatccgtggttgtatcactgcacag

SEQ ID NO: 6801714 - DNA, 57 bp, Homo sapiens
atgttagttatatttactgctgtcagttttttagacagttatagctgtgaataacat

SEQ ID NO: 6801715 - DNA, 130 bp, Homo sapiens
ttgcaataattcagatgaggaataatagtgacttgatccagagtaatacagaatgcagtgaaaagtgatgcaattcagagtatattttgacagtgaagctagtattataatctgccatctttacatgcca

SEQ ID NO: 6801716 - DNA, 56 bp, Homo sapiens
atgtttgttgatcatttatgaaacagcagactgtattaaaaatgcttggcaaatat

SEQ ID NO: 6801717 - DNA, 77 bp, Homo sapiens
tggcttaaagatgattatgtagattgggagttaaaagagaatattcatttcacagtggtagtgcatttagtgagcca

SEQ ID NO: 6801718 - DNA, 80 bp, Homo sapiens
tgggaatgaaacagagatttaattcagtttattccttttaagcaattgagtgaaacctctttattagttttcctttccca

SEQ ID NO: 6801719 - DNA, 75 bp, Homo sapiens
tggggaagaaaaaactaggtttgtggccaaaagtaatcatataataggcctgataagccttttctttctgcccca

SEQ ID NO: 6801720 - DNA, 57 bp, Homo sapiens
tgtcagtgttttatgtgcccttccagaattaaaaaagtgcatatacaaatactgata

SEQ ID NO: 6801721 - DNA, 101 bp, Homo sapiens
acaggtttaagctgcaaaacattgtcaattgaatgaatgaggaggcattggctcccattgtttctgctttatttagggcttgtgtttagcttgtactctgt

SEQ ID NO: 6801722 - DNA, 80 bp, Homo sapiens
tgaagaagctcaaaggcttgtaggattgagggggcctgtctccatacttgcccaccttcattgcaaggagctcactatca

SEQ ID NO: 6801723 - DNA, 76 bp, Homo sapiens
gcagcagaattttatgttaatggattcggtggaaaatacggctttaatgaaacattgactatgattactctgttgt

SEQ ID NO: 6801724 - DNA, 82 bp, Homo sapiens
gttacccagcctctcacagcctctttccacatcaggcaaatggagacgctgctttcacaggatgggggctgggagtggggac

SEQ ID NO: 6801725 - DNA, 56 bp, Homo sapiens
gaggtctcactttgttgtccatgctggtctcaaactcctgggctcaaaggatcctc

SEQ ID NO: 6801726 - DNA, 89 bp, Homo sapiens
ttttcttttgtataagagcatttccactggcactgggacattatttctctgtggcctttgttggaggtccctttcttcctaagagagag

SEQ ID NO: 6801727 - DNA, 67 bp, Homo sapiens
taggttctaagccacagccatttttccttatttatttctggcaaaatttggtgttgtttggagccta

SEQ ID NO: 6801728 - DNA, 74 bp, Homo sapiens
accctggacttaggaagttgttacacactttgtagatgcagtatctttaggtcagcttcttaatgtttcagggt

SEQ ID NO: 6801729 - DNA, 68 bp, Homo sapiens
tggccccacagggccttttcagaccagcagccctttccggcctgcactgccctgggcctatggggcca

SEQ ID NO: 6801730 - DNA, 75 bp, Homo sapiens
gcatttaggccccctttgcccagtatattctaggttagcaccagaaatatatatgggtcagagccaaccttaggc

SEQ ID NO: 6801731 - DNA, 84 bp, Homo sapiens
tttctgtgcaatgtttgcaacttgctgtattttggcaggaataacaaagccaagtgcagagagctgacgaacttctctcagaag

SEQ ID NO: 6801732 - DNA, 121 bp, Homo sapiens
acaaacatgtgatactgaattactgaagattgagaaattatccaagtccactttcatcctgagttaagaaattgggagatttatcaatttattgtcttggcagtttagttaccatggctgt

SEQ ID NO: 6801733 - DNA, 130 bp, Homo sapiens
gcacagggtaagaagtctgcatgaagtctgtctgaggctagagcaggggctcaataaggtcatacaggactcaggttcctttgctctttctgactactggttctcagcaggttgcctttttgtgctgtgc

SEQ ID NO: 6801734 - DNA, 73 bp, Homo sapiens
tggccttaatagatatgcctctagagttttacccgtaagcataatgaaggctgttggtatatttattacgtca

SEQ ID NO: 6801735 - DNA, 69 bp, Homo sapiens
catgtctgtacatttttagagggcttcagcagggcattgaggaggtgctctgtgtatgcatagaatttg

SEQ ID NO: 6801736 - DNA, 74 bp, Homo sapiens
gcatccaggctgcccctctgcgtctgccccgctcaccatgaccttgcgcagcttgtagttccgggcccggatgt

SEQ ID NO: 6801737 - DNA, 57 bp, Homo sapiens
gcccttacagggtggtcagccatgtatggatttccagctctgtaccaccctgagggc

SEQ ID NO: 6801738 - DNA, 88 bp, Homo sapiens
caacatttggctctcaactggaattgggcattagactacaaggtcagggatggctggctagttctcaaattcctgaagttgaatgttg

SEQ ID NO: 6801739 - DNA, 64 bp, Homo sapiens
gctggcctcgcaaatctcagctagcgccgcttccaggcgctgccaagggaagcgcagtgctagc

SEQ ID NO: 6801740 - DNA, 70 bp, Homo sapiens
gcccaccgcagccgagacctgggagcccgcctgggcctcacactccctcgggtcgcggactgcgctgggt

SEQ ID NO: 6801741 - DNA, 67 bp, Homo sapiens
ggctggttatcccacttccctgacatatgtatttcttcaaagggagctcataacaaggtagccagct

SEQ ID NO: 6801742 - DNA, 99 bp, Homo sapiens
ctcaagagtttagaatgggaggaagtggcagataggcaacagatatgacaagatcattctatgtcctttctcccattcctgacccatctcattcttgag

SEQ ID NO: 6801743 - DNA, 58 bp, Homo sapiens
ccccagctgagatttgaggagattgctaattctaactttcctcacaggcacactgggg

SEQ ID NO: 6801744 - DNA, 121 bp, Homo sapiens
ctttcttttttttaggaggtgatttagattatttagttcataattggatgaggaggttcaactgtgaattttatgataccaagaaacactatttagaatattttaaatgttaaggagaaag

SEQ ID NO: 6801745 - DNA, 57 bp, Homo sapiens
ggcctgattctgcagcctggtgggcagaggagactggcaggaggcaaggtcaaggtc

SEQ ID NO: 6801746 - DNA, 100 bp, Homo sapiens
atggggttggggtaggtcttctgaaaaccaaaagaataaaatttattttctttgctaccctgtggttttttgacactgaagatctacagtacaaccccat

SEQ ID NO: 6801747 - DNA, 66 bp, Homo sapiens
cacactgtgaacggactgaagcccacttaactgttcactctaaagtggttcagttcgttacgtgtg

SEQ ID NO: 6801748 - DNA, 75 bp, Homo sapiens
agcaggtcaactgagcagtagcgtctggagtcagaggagcaggagctccaggcataatgcccagtggtacttgct

SEQ ID NO: 6801749 - DNA, 78 bp, Homo sapiens
agtgccatcttcaattgaaaactagcctttgcctaacttatcaactagaaaacaaggttaattcagtgaagatcaact

SEQ ID NO: 6801750 - DNA, 62 bp, Homo sapiens
gaggatgggctagaaaataggagccaaagaggatggaatattacacatctagacccattttt

SEQ ID NO: 6801751 - DNA, 63 bp, Homo sapiens
agatgagtgagagcatcaacttctctgacaacctaggccagtaagtagtgcttgtgctcatct

SEQ ID NO: 6801752 - DNA, 77 bp, Homo sapiens
atgtgtctcagagtatccctgaactggatgtcctcatctcagtttagagttcagggtttctcaggatgatgatacat

SEQ ID NO: 6801753 - DNA, 64 bp, Homo sapiens
aggagatttgagttgtagttccacttctgccactaacttctgtgggatctgaggcaagtctcct

SEQ ID NO: 6801754 - DNA, 56 bp, Homo sapiens
gcgtttgttcccactggaggatgcagcaacaagctgccatcctgggagcagacagc

SEQ ID NO: 6801755 - DNA, 57 bp, Homo sapiens
agtacagttactgagttaggaaaaccaagaaagtgtggtttcctaaaaagctgtgct

SEQ ID NO: 6801756 - DNA, 86 bp, Homo sapiens
tttactgtctattttagtttaggaacaagtagtggaaaacagaactgctagagctccctacatgtttttaggctgagactggtaaa

SEQ ID NO: 6801757 - DNA, 63 bp, Homo sapiens
gtggatcagccgggagtgctggctctcccctcggaagctgagtcaccgacctggctggtttat

SEQ ID NO: 6801758 - DNA, 94 bp, Homo sapiens
gctggaggtcagaaaagggtgtttgttcagggctgcttgagtgggtaacgagctgaacctctctgaacatggcttcctcttcacagcctccagc

SEQ ID NO: 6801759 - DNA, 60 bp, Homo sapiens
tgggtgcaggatgagtgctggctgctgctattgcaatgtccagtgctccctgcacgccca

SEQ ID NO: 6801760 - DNA, 127 bp, Homo sapiens
aaaagcctgcagtgaaggaaggtgatttagataattgaacattggtaccttacatcgttaatattactgttgattatggtaacaatgattaaaaattgggcactattttttcatgtagttagttttt

SEQ ID NO: 6801761 - DNA, 76 bp, Homo sapiens
ttcagcaccctctgaggcatccttctcccagtggggcttgtttatttcctcgctttccatgtcacagagggctgaa

SEQ ID NO: 6801762 - DNA, 60 bp, Homo sapiens
cctgaatccggaacggggcttctggcttgtgagaacccctagccctcttccagatgaagg

SEQ ID NO: 6801763 - DNA, 85 bp, Homo sapiens
agcccaattaagatatatttgcttttgtgccacagattctatgcttttccaaatagaactgttagatgctaagcaaatggggact

SEQ ID NO: 6801764 - DNA, 55 bp, Homo sapiens
tcaccagttaaaataacagtaaccatatttattggctctgtttttgctttggtga

SEQ ID NO: 6801765 - DNA, 63 bp, Homo sapiens
tctgttgtccaggctaaagtgcagtggtgcaattatggctcactgtagccttgacctcccagg

SEQ ID NO: 6801766 - DNA, 73 bp, Homo sapiens
acctcagaatgtgactgtatttggatataagatctttaaggaggcaattaaatttagatgaggtccctgaggt

SEQ ID NO: 6801767 - DNA, 69 bp, Homo sapiens
acagtcacgggttgcttaacaatgggaacatgttgtaagacatgcattgtcaggcaatttcatcattgt

SEQ ID NO: 6801768 - DNA, 80 bp, Homo sapiens
tttctctcttttaatgaagcacgttaaatatctttaatgccacctacctgctttattggaggattcatgatgttgagaaa

SEQ ID NO: 6801769 - DNA, 130 bp, Homo sapiens
tggcacctaacagatgttccatctttgttgaattcatacacgaaaatgcatgcatgtgtatttgcttgtgtgtgtgtgtgtgtgtgtgtgtgtaaaagagagagggagagagacagaatggtttgtgtgg

SEQ ID NO: 6801770 - DNA, 57 bp, Homo sapiens
gaaattctatcagcttttagtgccctgaatacagtattaacagttgtagagggtttt

SEQ ID NO: 6801771 - DNA, 61 bp, Homo sapiens
gctactctccatcagtatgcttgccagccatagctgccatccccatgtggtggagaggtgt

SEQ ID NO: 6801772 - DNA, 94 bp, Homo sapiens
aatcttggtgaatcgtaattgcttgttttcggtcataagaacataaggaagaatctgtattgcagaaaataggcagtgtttactctgcgagatt

SEQ ID NO: 6801773 - DNA, 75 bp, Homo sapiens
gggaaactaagcagaacacacgtcagagtttcctgcctaggaggtgaggaagctggggtgttcttcataattcct

SEQ ID NO: 6801774 - DNA, 129 bp, Homo sapiens
ctgaaagcataacatggcaaaaaattaagggcatcatttatattgtattctgtaggaacaacagccccttgaaatacacgttttataaaatacaatgtcaatggtactttgtagagttgtgccatgcag

SEQ ID NO: 6801775 - DNA, 63 bp, Homo sapiens
gcttctgacagcacctgaacttctctgtccaatcagtgcgcaagagcaggctgtcaatggggc

SEQ ID NO: 6801776 - DNA, 92 bp, Homo sapiens
aggagccctggttccttacagtgagggtgacatttacaaaccacgatctgggtgcttgttgtgctcactgtcacagggatatcattgcttct

SEQ ID NO: 6801777 - DNA, 57 bp, Homo sapiens
gtgctcttgggggactccctgggggccacctcggtcctcagaagtttcctggagcat

SEQ ID NO: 6801778 - DNA, 91 bp, Homo sapiens
agtagttaaattttaagccagggttagaagatagtcaaaggggaataaaaaagcttctttactaaacatctggcattaaattccaaatact

SEQ ID NO: 6801779 - DNA, 64 bp, Homo sapiens
ttcctggctctctgttgcacagctgacttgtgccattctgctgttgctgtatagagttaaggaa

SEQ ID NO: 6801780 - DNA, 123 bp, Homo sapiens
gttttatatggaattaagttccaaattgcttaaacacagatattgtacttgatcctcacaccggccacagaggggattatcatcttctgttttaaagatgtggaaactgtaaaccagtgagac

SEQ ID NO: 6801781 - DNA, 57 bp, Homo sapiens
ttgagagtctgagtttggactatatgactgacaaaaatgtgaaactatgactctcaa

SEQ ID NO: 6801782 - DNA, 62 bp, Homo sapiens
tgcagagtcccaggacccagagacttacctatccaccccactctcaacaccagggctctgta

SEQ ID NO: 6801783 - DNA, 58 bp, Homo sapiens
ggaggagccagaatccagactcgggctccagctccagagtctgtattcttggctagct

SEQ ID NO: 6801784 - DNA, 77 bp, Homo sapiens
tcaccatttattaagataataccatgggccaggctctgtgctaagtgccttgcatatattatatctttgatgtgtga

SEQ ID NO: 6801785 - DNA, 66 bp, Homo sapiens
gtattttcaaagacagacatcagtcaaaggtcagacacttattagctggtgtttttctttgcatac

SEQ ID NO: 6801786 - DNA, 55 bp, Homo sapiens
gtcttttaggcactggcatgcccggagaatctccccacacactaggcctgatgac

SEQ ID NO: 6801787 - DNA, 73 bp, Homo sapiens
ttcgtaaagcagtgcaatgtgtacagaaaaatttctataggaacctttatgattcacaatgtatttttatgaa

SEQ ID NO: 6801788 - DNA, 71 bp, Homo sapiens
gcacagctcgagctcaggagggagggctgcacctcagccctgactacatcctgctgaaagctccagctggc

SEQ ID NO: 6801789 - DNA, 78 bp, Homo sapiens
aggttcaataacatcctttggttccaaaacaaggtctcttgagcctccctttgttgcaagggaaaagtcactgaacct

SEQ ID NO: 6801790 - DNA, 72 bp, Homo sapiens
ttcatattaaatattgttggtcactatatttaaatatctctaaatggagaatgtgatatagtgatatgtgga

SEQ ID NO: 6801791 - DNA, 80 bp, Homo sapiens
gattgaaactagagggaggatgctgggtgcttctgctatgagctccttgagcaccctccaacttccctgtagtctttgtc

SEQ ID NO: 6801792 - DNA, 55 bp, Homo sapiens
cagggtggcaggcaccatggcctataccaggggctacagcatgcctgccaccctg

SEQ ID NO: 6801793 - DNA, 64 bp, Homo sapiens
ccctttgtgattaactgcagttagagctgaaattcttcagcctcctcatttgtgttattaaggg

SEQ ID NO: 6801794 - DNA, 90 bp, Homo sapiens
cctggcacagtgcagtcctgctgattttcatattgctctcattgccatccacatccgagggagtaaattagcgggatccacaagccacgg

SEQ ID NO: 6801795 - DNA, 57 bp, Homo sapiens
ccccagagaaggtggagcttgtgtgggcagtggcactcagggaaggccttctggagg

SEQ ID NO: 6801796 - DNA, 118 bp, Homo sapiens
agactcataaactggtttgaactagctccagctcaccactgctagagtctattataatactttgcttttagtagacacggaatggtggtaaggatgctaataaaaagaacatgattct

SEQ ID NO: 6801797 - DNA, 81 bp, Homo sapiens
ggagggcaagctccccagctggggcaacgcaccagctccttgaagctgttctgtggctcggccagctgctgaagcctctcc

SEQ ID NO: 6801798 - DNA, 103 bp, Homo sapiens
tgaggctggtgttcggatatggtgcatctgactttccacgtctccactgtgtttcccagactgagatgttctgattaggtttccataagccagcaccatctta

SEQ ID NO: 6801799 - DNA, 64 bp, Homo sapiens
tcatttgctggaaccagacccacttaacattttaataagtgcttgtcagtgtcttcagtagtga

SEQ ID NO: 6801800 - DNA, 83 bp, Homo sapiens
cagtcagcccttacacaatacagagaactagcagcctctactcaattcgctaaagcactctggaaaattgtgtgggggtgctg

SEQ ID NO: 6801801 - DNA, 67 bp, Homo sapiens
ttcaatgatcccatgatgacagagtcatcatttgaaaaagattctattacatggtttatcatatgga

SEQ ID NO: 6801802 - DNA, 61 bp, Homo sapiens
gcctctgggcctcctccgacagccgggcacctgcggtggcgaggggggcggccgggccggc

SEQ ID NO: 6801803 - DNA, 83 bp, Homo sapiens
tagatacccagactggttgattgctgaaagtattttatgactaccaagttgggaaattgtagtaaaacctatctgtggatttg

SEQ ID NO: 6801804 - DNA, 55 bp, Homo sapiens
caggcctggcccccggcacacccagaggaaggagaggctgggtggctcaggtgtg

SEQ ID NO: 6801805 - DNA, 74 bp, Homo sapiens
gtccaatggttgaaaaacattggcttttgccaagagtgtctttaaaaagtcaagcctttcttttccctctggac

SEQ ID NO: 6801806 - DNA, 117 bp, Homo sapiens
agaggaagggtcactatgcagtggtcaggagcactagcttgagtcagactgctcagctctgccaccagctgtgtgactctaagcaagttacttaaccgccttgtgccccattcttct

SEQ ID NO: 6801807 - DNA, 67 bp, Homo sapiens
tttgcatgtaccatggaggcttaggagtcaatttctaggaatgtcttcatctccatgcacagacaga

SEQ ID NO: 6801808 - DNA, 68 bp, Homo sapiens
gagggtggggaaggggcaggcctgttatttgacactttctgttgggcttggcccaggcctcactcctt

SEQ ID NO: 6801809 - DNA, 61 bp, Homo sapiens
tgaagactatgatacatgttatgatgaataaacatcagtcctttgtggacatggctcttca

SEQ ID NO: 6801810 - DNA, 55 bp, Homo sapiens
gttaagccttcagagttggctggtcacatagacaactatggctgagggccttgac

SEQ ID NO: 6801811 - DNA, 74 bp, Homo sapiens
cctaatgcagtaggtattaaagaagtaaatcctattccttaattctgcttctcacttcttgcctctgcataagg

SEQ ID NO: 6801812 - DNA, 68 bp, Homo sapiens
ggaagtacaggggttcttaggtaatgtagaagtttgtcctttaaaataccctagattcctgttattct

SEQ ID NO: 6801813 - DNA, 63 bp, Homo sapiens
agtattttcgccatcacaagaaagccaactagaagtgcgtgatttgtgaatgtgtgaagtgct

SEQ ID NO: 6801814 - DNA, 67 bp, Homo sapiens
ggccttgattccggtcattgaacacactttattcatttctgtgtctggcactgtcctagtcgaggcc

SEQ ID NO: 6801815 - DNA, 67 bp, Homo sapiens
tgaggctctttccaagtaatacttcccaggctgggctctgggatcttagggctttggaaaggtagca

SEQ ID NO: 6801816 - DNA, 70 bp, Homo sapiens
gcttagttagagccctatgttagggttagaatcctctgccctaatgttctgagggttcttgctgttgggc

SEQ ID NO: 6801817 - DNA, 126 bp, Homo sapiens
ggaaatctgagattaaggtgtcagcagggctggttcccctgaggaccaggaaggagggatcgcttccaagccccccttcctggcttgtagatagccatttctctctgtatcttcacatcatcttcc

SEQ ID NO: 6801818 - DNA, 87 bp, Homo sapiens
tatagtcactggaagacactgtaactctgtaatagtgatttcatcaccattattgctgacttgttcagtgttattatgagtgctata

SEQ ID NO: 6801819 - DNA, 76 bp, Homo sapiens
gagcagggagggcaagagttggaaacggtaaagggtacccctctcccctgcccccaaaggctctgctttccttctc

SEQ ID NO: 6801820 - DNA, 77 bp, Homo sapiens
agtttcagaaccgctaaaataaatagtcactcattatggattcctcggactcattttaaaggcagttctgttgaact

SEQ ID NO: 6801821 - DNA, 70 bp, Homo sapiens
caggtgacctgactctcctcaagcataaataggtcattagttactgctttcaggaagtttccctcacctg

SEQ ID NO: 6801822 - DNA, 85 bp, Homo sapiens
ggacttgattcatgaaaatgtatttgcatcctgatgatactttttcagttgtctagattcatatatttttggagaagctgagtcc

SEQ ID NO: 6801823 - DNA, 91 bp, Homo sapiens
tttacaggcttccacttttgggaacagtgagtaggtgtgccttttcttactcctctcgctgagactataaagctgggacattgcatgtaaa

SEQ ID NO: 6801824 - DNA, 79 bp, Homo sapiens
tgaaaaccagttaatacaaccatgatcttctcaacataatggtctgaggtgatttatttgtgttgacagtgtttactca

SEQ ID NO: 6801825 - DNA, 63 bp, Homo sapiens
aaggccttccctttgagccgcaggtatggcacacacaactctgcagctctgggcaagtgcctt

SEQ ID NO: 6801826 - DNA, 61 bp, Homo sapiens
tcaagtggtggggcaggaatgcggcggcacgggctgtctgacttcctaatccatcacagga

SEQ ID NO: 6801827 - DNA, 55 bp, Homo sapiens
ccacagtagaattcatctcccttatgacatgaataggatagatgtcacactgtgg

SEQ ID NO: 6801828 - DNA, 88 bp, Homo sapiens
cgccctcagcagctcacatcctaggaggctcaaggggtgataaaaccagtgaggactacctggggtgggagctgtaggtcagagggtg

SEQ ID NO: 6801829 - DNA, 86 bp, Homo sapiens
agaaaatcaagatgagctgtgattaataagtagggcctgattattggaacttggcattggatataattaagttgatcagaatttct

SEQ ID NO: 6801830 - DNA, 72 bp, Homo sapiens
aaagctaggcatttctgtggcagttcttatatttggtgagaaatgttgaatacacaaaatgcttctggcttt

SEQ ID NO: 6801831 - DNA, 89 bp, Homo sapiens
ggaggattgaggagcatgctgtgggctcaggagactggaggcaagtcccagcctcctccttatggtggcccaggagtgcaggatcttcc

SEQ ID NO: 6801832 - DNA, 70 bp, Homo sapiens
gaacttcttctttaagagactcttaagaaaccaagttattatgaggagctctgagtcttaggagaagttt

SEQ ID NO: 6801833 - DNA, 122 bp, Homo sapiens
ccccctcccagacacccagactggctgcctcaggaagaacaaggctatctggcctccttgcctcagacttgggtgcagggagcccagaaggtcccaggtggcactgggatggccgcaggggg

SEQ ID NO: 6801834 - DNA, 65 bp, Homo sapiens
atgttctgcctccattttgagtggaactccttttccactttcaaactctgaggtaatagaaacat

SEQ ID NO: 6801835 - DNA, 67 bp, Homo sapiens
tacattaaggatatggacatgattcccagtagaaggtggaacatatgttaccatgtcctggaatgtg

SEQ ID NO: 6801836 - DNA, 94 bp, Homo sapiens
ttaaattgattttattttggtaaatgtttgcctggactcagcattttatatgagaaaaacagggacatctaccaaagtacaaaatgttatttaa

SEQ ID NO: 6801837 - DNA, 103 bp, Homo sapiens
gggctggctttgggcctagtagaccgtaaggatacaatgattgagatgcaatgtaagtgctgcaatcatttatgcttgcggaggactaggcagggcaaggttc

SEQ ID NO: 6801838 - DNA, 76 bp, Homo sapiens
cctggctctcacacaactctccatactgatgcagtgctagttttgctctgtatcagttcagaggtgcagagacagg

SEQ ID NO: 6801839 - DNA, 79 bp, Homo sapiens
tcagaattcttgctttctttctctttttgcaaatgttttttgctttcaaagagctcggaaagtgttgaagaaaagctga

SEQ ID NO: 6801840 - DNA, 112 bp, Homo sapiens
tttttgggggaaggggtatgtgtcactaatagaatatctctgaagctggattgatacggggaaaacatctttcccttctagttttgagagacttcctcttggctcccaggag

SEQ ID NO: 6801841 - DNA, 61 bp, Homo sapiens
gtctgtttccagttctgtgtcctcagagccatcctcctcaacacagctgccggagacggat

SEQ ID NO: 6801842 - DNA, 88 bp, Homo sapiens
cttggggctttcctgggcatcccatgtggaagtcagcaggcaagaccaagtccaggctcccgctccactgggcaccaggctccccagg

SEQ ID NO: 6801843 - DNA, 55 bp, Homo sapiens
tcacccctaccaaggagcactgaagtttatacactgccctgggagttgggggtga

SEQ ID NO: 6801844 - DNA, 129 bp, Homo sapiens
ccactgcaggtgaaatggacacctggctctccctggtgtcccctccaggagctgtcactgggcagtccgccttccaggatgggacatagtggagcaggcacggggggccatgtcagcctgtcagtcggg

SEQ ID NO: 6801845 - DNA, 130 bp, Homo sapiens
gagattggaaaagtaaatctgataaataggggcaataactcaaacatgtaaaaattaaggtaagagctgctcttctcccctgcagttttatatatgcttgatcccgttcttttttcctttccaaattttc

SEQ ID NO: 6801846 - DNA, 74 bp, Homo sapiens
gggccagggcagcactcccaggagaaccagcatcttcatgtgccagggtccccttgggaggtgagtctgggcct

SEQ ID NO: 6801847 - DNA, 67 bp, Homo sapiens
ctttctttctcgtaaacttagttctagctgttggttgagcatgatcgcttttatgagaagcaggaag

SEQ ID NO: 6801848 - DNA, 73 bp, Homo sapiens
tccctttggatccaagcttatgattttatcatttttagtgtattacgaatatgggcttatgatttcacaggga

SEQ ID NO: 6801849 - DNA, 55 bp, Homo sapiens
cggtcaggtgcagcgttggcacagggtcctcaatgccagagctgatggctgcccg

SEQ ID NO: 6801850 - DNA, 56 bp, Homo sapiens
tgtccaggagtaaaaagacctgaattctactttggggctttgacattacctggaca

SEQ ID NO: 6801851 - DNA, 91 bp, Homo sapiens
gctgctgatgctggcggtgatcccgatggtgtgagctggaaatggggtgctacgtcatcgttgtcatcgtcatcatcatcatccgagcagc

SEQ ID NO: 6801852 - DNA, 84 bp, Homo sapiens
gggtcctgagaggcacagggatgcggagccaggtatgtattcaggccagtcgcttctctctgtgcctcaatattctgggtaccc

SEQ ID NO: 6801853 - DNA, 78 bp, Homo sapiens
tggacaagggctgggtctttatgggggccaggatcttgattaattcctgggcacttgtggagattagagtcttggcta

SEQ ID NO: 6801854 - DNA, 55 bp, Homo sapiens
ggccatgtgaaaaagacccaggggttttaggtaaccccaaagcttcatatgagcc

SEQ ID NO: 6801855 - DNA, 55 bp, Homo sapiens
ggaaacatgcctgctggacagtggtgcagtatgacaatccagcagcatagtttcc

SEQ ID NO: 6801856 - DNA, 59 bp, Homo sapiens
agcctgtgggagccgctcccgtttcacccctctcctggccagcgtctcttccatgggct

SEQ ID NO: 6801857 - DNA, 71 bp, Homo sapiens
gtattaaatctcattttggtttctacttagtatcaggtgcagctaattgggaaatgaatgagacaagatgc

SEQ ID NO: 6801858 - DNA, 55 bp, Homo sapiens
tagtcacttttttaccatgtgccagacatattaggcattggggagacagttgcta

SEQ ID NO: 6801859 - DNA, 66 bp, Homo sapiens
tctgcaaacttaagttgaaatagcttgtgaccaaccccaaatgattttgctatcagcttttgcaga

SEQ ID NO: 6801860 - DNA, 91 bp, Homo sapiens
gtggtgttcactcaaaattctttccattttgtgtgtgtttaaaatttttttatgctaatactttggaaagaatgtaggacattggacctgc

SEQ ID NO: 6801861 - DNA, 55 bp, Homo sapiens
tgtgctcttctgttacttgtagctaataccaagaggaaagcatcagaagggcaca

SEQ ID NO: 6801862 - DNA, 83 bp, Homo sapiens
cctttctcctggcccagctttcattccttgctgactcaggaattggcagcgttcagctgggagctgggcctgggcagggaagg

SEQ ID NO: 6801863 - DNA, 130 bp, Homo sapiens
ttttaactaagggaaccaaccagctgcttataaccatggatgtatgttttacgcttgtacagtaaaagtacaaagtaatgtataatatcgactctgactgttaaggaatgcttgtatccagaagttttaa

SEQ ID NO: 6801864 - DNA, 59 bp, Homo sapiens
ctccacgtatgtgtacagtcatggctgtacagtcatggcttctaagtgataacgtggag

SEQ ID NO: 6801865 - DNA, 60 bp, Homo sapiens
ctgcctgctccagtcctgtccaccagggaggcaaatggtggcagggaaagggggaggtgg

SEQ ID NO: 6801866 - DNA, 59 bp, Homo sapiens
cgtggggactacggccatgtccgctgactgtgcagatgcggaagcggtagtcaccctcg

SEQ ID NO: 6801867 - DNA, 65 bp, Homo sapiens
catttttggttgccacagctgggcaggggttgttcctggtatctagcaggtggcggccagcgatg

SEQ ID NO: 6801868 - DNA, 100 bp, Homo sapiens
ctgggtaagtgttgcatttctcatgctggctggagtgcctctggaggggtgactgacagctgctcctggtttcccagcagcatgagcagggcccatccag

SEQ ID NO: 6801869 - DNA, 70 bp, Homo sapiens
gccgtttgtagatagggtccttataaagcttagtgagcttaagctgggtacacgttgtcacaaatcaggc

SEQ ID NO: 6801870 - DNA, 75 bp, Homo sapiens
gctggacagggagcagggccacttctgtacctctgcacacttctagaatgcggactcatcctgcatccatccagt

SEQ ID NO: 6801871 - DNA, 65 bp, Homo sapiens
gaggcttagaggctctgtcacttgtctagtatcatacagtcaagaaatggcagagccaaggcttc

SEQ ID NO: 6801872 - DNA, 58 bp, Homo sapiens
cggcgcctctgaggagcccgggcgcttcgtggcctggcagtgtttctaaggggctccg

SEQ ID NO: 6801873 - DNA, 76 bp, Homo sapiens
cctggggctgggctgcaggctggatttgcttttgtgcaggatattactgcaggagctcagcctgcagggagctggg

SEQ ID NO: 6801874 - DNA, 75 bp, Homo sapiens
gtgaggcctgccctggggaagttcgtcacccaagaacagcagaggatgaagggaacagccggggctggcactcac

SEQ ID NO: 6801875 - DNA, 60 bp, Homo sapiens
aagggctgaatgaagggttgaaccagattaacaaaggtctctccaaccttattcatcttt

SEQ ID NO: 6801876 - DNA, 74 bp, Homo sapiens
gctggaaggctaggctcagttgggtctctctctctctctctacatgggtccaagggccacatagtctctccagc

SEQ ID NO: 6801877 - DNA, 83 bp, Homo sapiens
tcttttatgtactttgtttactgggaagtacttagaatgctacatatatagtgaactctcagtaaataaatactgctgaaaga

SEQ ID NO: 6801878 - DNA, 94 bp, Homo sapiens
atttattaccatgaatctcactttctaaaattgctagcactattaaagtttctgacagtgaagcaagccattggaacatgtttgtggtgtgaat

SEQ ID NO: 6801879 - DNA, 59 bp, Homo sapiens
cagctcagcctctctttaaggccacacaccgatgctgagctgaagagtggcctgatctg

SEQ ID NO: 6801880 - DNA, 59 bp, Homo sapiens
ccattacactaatagccacactaatgatttgcagtcatctatcaactgttagtgagtgg

SEQ ID NO: 6801881 - DNA, 70 bp, Homo sapiens
cttgggatcacagtctgtgggttggtttccaagtacctgtctagaaaacctgagtctgtgttttcctaag

SEQ ID NO: 6801882 - DNA, 77 bp, Homo sapiens
cagacctcagaaggctgcaggtttgctgtgtgagatcgccctctggtgagcagtcacctgcaggcttcctgggtttg

SEQ ID NO: 6801883 - DNA, 67 bp, Homo sapiens
tgaataaaggctatgagatagaagataagaaccctcttgtctttagacctctctggcctcagaatca

SEQ ID NO: 6801884 - DNA, 85 bp, Homo sapiens
agtttcattagtagaacagttagggtaatgattggaaatttaaatatgatgcctcattaactgtccttaattactattgacaact

SEQ ID NO: 6801885 - DNA, 83 bp, Homo sapiens
gctctttgcacagtgggtggtcatgtacagcactcgtaacggtttcacgaggaccatgtggccgagacccccagggtaggggc

SEQ ID NO: 6801886 - DNA, 69 bp, Homo sapiens
ttgcctgccagcagaggccagcgctgcaggggctccttggcctgccttcgctgagctgattttaggcag

SEQ ID NO: 6801887 - DNA, 64 bp, Homo sapiens
tcaggggcctctcttttagggtgtaaattcacagcccccatattgtgaacagagaggactctgg

SEQ ID NO: 6801888 - DNA, 61 bp, Homo sapiens
ccctgaggcttctctagttcagctctcccctgttcatagctgctgctttcaagcctcaagg

SEQ ID NO: 6801889 - DNA, 78 bp, Homo sapiens
ggtcagagtcataacagacacaggcgtggagtcgcccgggcagcacgtcgggggctcggcatctgtggactctgcgct

SEQ ID NO: 6801890 - DNA, 67 bp, Homo sapiens
ctccttactgtacacctacaggagagcctccaccaactctccttttctgtaggtgtacagtaaggag

SEQ ID NO: 6801891 - DNA, 107 bp, Homo sapiens
ctcaaattaatggaatgataaactagtgcaaagggctgttgagaagtagggttccctccccatctttttcagaatgtccttttcatgctattatttcagaacttgag

SEQ ID NO: 6801892 - DNA, 70 bp, Homo sapiens
taggctttctgggctatatggtctctgctcacctctatcatggtagcacagaggcagccacagacaccta

SEQ ID NO: 6801893 - DNA, 123 bp, Homo sapiens
ggtccgtcctgtcttgatgtcttgatgtgactgtatgtgccctgggggctcactgtggtttacaagtggcttgtgaagctcctgggagcaggtggtacacccagtgctgaagacagggtcgcc

SEQ ID NO: 6801894 - DNA, 66 bp, Homo sapiens
gggtcttcctcctgttccaccaagctcttctctttcctctttgaagagtaaacaggatggtgacct

SEQ ID NO: 6801895 - DNA, 95 bp, Homo sapiens
ctttcagtaaactttcttgtatgtcatctcttaaaaattgcaataccaatccctttaagttgccgtaaaaaagagagggcaatgcaggatgagag

SEQ ID NO: 6801896 - DNA, 55 bp, Homo sapiens
cagctgcattaattttagtgaatggagaacaagtgctctagatttagtgtagctg

SEQ ID NO: 6801897 - DNA, 67 bp, Homo sapiens
agatcctaggggcttgtaatttaatagaccgtattttgcttttggaactaaatggccccagggctct

SEQ ID NO: 6801898 - DNA, 62 bp, Homo sapiens
gtcggcgctggaacgcagtagctcctctggcggcagcagcactgtgagcaccagcacgccgc

SEQ ID NO: 6801899 - DNA, 60 bp, Homo sapiens
ctttgtgccacagcttgactactgttaaggcagtttggaggtcgtccctgtggtacagag

SEQ ID NO: 6801900 - DNA, 108 bp, Homo sapiens
ccctcttcgctcccttccttgagagtgaagcgtatgccttcactgcctttacggacagagtgaagcatatgcttctctgcctttatggacatttccagtggggggtgg

SEQ ID NO: 6801901 - DNA, 58 bp, Homo sapiens
ggcaagaacatgcttcatggggactcccccgacctggaatttgtgtgtgttcaatgcc

SEQ ID NO: 6801902 - DNA, 74 bp, Homo sapiens
acgtgtgcacaatgacctaggcaagtcagaggctgtccaggaacccttctctatttgcctaggcttgtgcctgt

SEQ ID NO: 6801903 - DNA, 56 bp, Homo sapiens
aggatgtcctgggtgttaggagcatataatggttttaacctaatatgaggggtcct

SEQ ID NO: 6801904 - DNA, 97 bp, Homo sapiens
gcctggtgtctgggttgtgtctggggctgctccctctctcctgccctttgccagagagtctgaggcagctgcagccatggcctccaggataatgggc

SEQ ID NO: 6801905 - DNA, 129 bp, Homo sapiens
cacggagaaagagattacaatatagcagaggaagctcttccagggctcctacagggacctttgggacaaagattcagtgggctttgggacagcttgacttcaactagatggtatttgaataatctgctg

SEQ ID NO: 6801906 - DNA, 80 bp, Homo sapiens
gctgcattttacttacctgttagttgcctgtctctccaactaggctgtaaagagctaggaggaagaatgtgaattgcagc

SEQ ID NO: 6801907 - DNA, 60 bp, Homo sapiens
tatgttgtcgtggcttctcaactctgctactgtaatgtgaaagcagccatagacaatatg

SEQ ID NO: 6801908 - DNA, 61 bp, Homo sapiens
atctcatctgggggaccattttgctttgtggcaaaaatgaagacactccagaccaagagat

SEQ ID NO: 6801909 - DNA, 72 bp, Homo sapiens
tgactgtaaactattctttcaggagcttaaacactaagggaaagttagagttgctgggaaagatttcagtta

SEQ ID NO: 6801910 - DNA, 64 bp, Homo sapiens
cttgcccatttgaccatgtggcccaggccaaagcccagtgttggccttacgcatggtcggcagg

SEQ ID NO: 6801911 - DNA, 68 bp, Homo sapiens
aggagagcctcggctgaaatccgaggttttgaacgcgattttttccgacagaagctgggcgctttctt

SEQ ID NO: 6801912 - DNA, 73 bp, Homo sapiens
tgatgatctgaatagagggcaggctttgtatgtcttcaagacatcagtatccatttgccctctgtagaaatca

SEQ ID NO: 6801913 - DNA, 68 bp, Homo sapiens
tgtttaccattccatgacatcaggactggaaattgcatggcagtactatttatggagtggttatttca

SEQ ID NO: 6801914 - DNA, 80 bp, Homo sapiens
tcctgacactccattgagtaggattcctgcaatgaagaccatacagtacagcacaggaatgatctgctgagtgatcagga

SEQ ID NO: 6801915 - DNA, 86 bp, Homo sapiens
tgaataaatgcctaaggctgggccccaacccgggtcaatgcaaacaggatctttgggagaaggggtcccagcctccatgttgttta

SEQ ID NO: 6801916 - DNA, 60 bp, Homo sapiens
ggctagttctgtgctgtgattccaggagttgcttctggaaatgggtatagagcacatgcc

SEQ ID NO: 6801917 - DNA, 57 bp, Homo sapiens
gcagggaagatcttggagctgctagatctttaagagcaaagtctcaacctttcctgc

SEQ ID NO: 6801918 - DNA, 86 bp, Homo sapiens
gaaaatgatgtgataatgaagatttataattgccttttctctgttggagaggctgtctcatattttgtaatattatatgcattttc

SEQ ID NO: 6801919 - DNA, 55 bp, Homo sapiens
acttggtttcaaatgagtggtaagattttacttaccttaaactttacagccaagt

SEQ ID NO: 6801920 - DNA, 59 bp, Homo sapiens
gggcaggagagaacagtcatggtatttatttcatcactgtcaccatctttcctcacccc

SEQ ID NO: 6801921 - DNA, 65 bp, Homo sapiens
gcatggctttggtgtgaccctgggatgtcacccaaccttgttcctggcccatccacagcccctgc

SEQ ID NO: 6801922 - DNA, 117 bp, Homo sapiens
ctgtgagaaataagtttctgttgtttatagccacacagtttatggtattctgttatagcagttatagcagcccaaacagactaagacaggcatatatacaaataattttacttacag

SEQ ID NO: 6801923 - DNA, 67 bp, Homo sapiens
acagtgcattattgctgaatgcgtctgttataggtagttcctagtttataaagcaatattgtattgt

SEQ ID NO: 6801924 - DNA, 109 bp, Homo sapiens
ggagagttattatttgtgcagatggtgcagggacaggctctggggatgggtgtgtgtgcaggtctcccatctctgtccttgtgcttccatgtggagtttctacctcttc

SEQ ID NO: 6801925 - DNA, 130 bp, Homo sapiens
tcctagttacccagaagtaattatgaaccaactctcgggccaactgggtctgtcctctgatgctatcaaagtcatataggtaggattcagcttcgtggttggctagtaattaaaaagctgcaagctgtga

SEQ ID NO: 6801926 - DNA, 64 bp, Homo sapiens
gcatcttgtgtaggcatattcatagagttgtatagaaatgctgctttactgcctgctactctgc

SEQ ID NO: 6801927 - DNA, 94 bp, Homo sapiens
ggctcttgagggcagggaccctgtatgctatatccctaatacctgtgttagcagataaatatatggtttctgtgtcttcttacacttgagggcc

SEQ ID NO: 6801928 - DNA, 125 bp, Homo sapiens
cttcatttgtactgcatttcttcaatttgatttgattgtaatggctcttaagttaggtcaaacttaaaggggccattttacagtgaacaaagtgagagtaagtccagaaaagcctgcatgtgagg

SEQ ID NO: 6801929 - DNA, 64 bp, Homo sapiens
tctggacaaagcagacaagataattcacctggatgtggtggaaaaggtcactgctttgtgagga

SEQ ID NO: 6801930 - DNA, 66 bp, Homo sapiens
tttgacatcagaatttgattcctgggatattcagatgtagccagagatacagattctcattacaaa

SEQ ID NO: 6801931 - DNA, 84 bp, Homo sapiens
ttgtttagatatttggtggccttgtgttttagagaaagctgagcttccctgatccacaaaggcaatctgtattagtctaagcaa

SEQ ID NO: 6801932 - DNA, 73 bp, Homo sapiens
aagctattttaaaacagagccagtttttgcaaacaggggtactgtttacaaaaccgtggtactggggtagttt

SEQ ID NO: 6801933 - DNA, 65 bp, Homo sapiens
ctctcccatgtgcagagatgggagcaccaatgtctatggaagttccaggtttcgctacaggagag

SEQ ID NO: 6801934 - DNA, 63 bp, Homo sapiens
gatcatttcagtccagtaaatacaggctatcccaggatagcttttacaggtcctgcagtgatc

SEQ ID NO: 6801935 - DNA, 55 bp, Homo sapiens
gtaacagtctccctggagtcaactttctgtcaggtgggcctcaggcagctgtgac

SEQ ID NO: 6801936 - DNA, 61 bp, Homo sapiens
gattcagggtcaccagagatctgcatgaagtttatatttagcagctgtcgttgcccgaatc

SEQ ID NO: 6801937 - DNA, 71 bp, Homo sapiens
ctgagtccttgggcttagagtgagcatgagaatgacccttaggccctgctttcagaccccagagggctcag

SEQ ID NO: 6801938 - DNA, 84 bp, Homo sapiens
tgcctcactaattttgaccattatacactggcttgtattatacttagcacacagcaggtgcttaatgattacttactgaaggta

SEQ ID NO: 6801939 - DNA, 130 bp, Homo sapiens
gcataactgtgtatgagtaatggtcagaggtattttacttacgcatgactttggacttgctagctctagttcaaatggatgagaagtcatgtggaagaataaccttggcaggtacttgttataaacatgt

SEQ ID NO: 6801940 - DNA, 73 bp, Homo sapiens
aagtaaggatagaataactcttgactcacctccaggtcttttggtcagtcctgaaatttctacctcattgctt

SEQ ID NO: 6801941 - DNA, 70 bp, Homo sapiens
gcaccagagaataaaagggcattccttagggttgctgaggattttctttgattgtattctgctaatgtgt

SEQ ID NO: 6801942 - DNA, 57 bp, Homo sapiens
gccctgagccccaggatgaagggcgtgggcacagcctctctttctggtggctaaggt

SEQ ID NO: 6801943 - DNA, 77 bp, Homo sapiens
tggacctatgtactgcccagttagataaaacttaatccgtgtctgggattagcaattgtttcattgatcagtgtcca

SEQ ID NO: 6801944 - DNA, 76 bp, Homo sapiens
ggcagggtcgaggagctcccgtgaggagaccaatcgcctagcgtgagtcttcttccgggattgctcgccctctgcc

SEQ ID NO: 6801945 - DNA, 79 bp, Homo sapiens
gatcttgctggttctgattttatttctgactgggcaaaagtcatttacagacaacaacaaagtcgttgcctagaagatc

SEQ ID NO: 6801946 - DNA, 79 bp, Homo sapiens
cacagcagctttaataaacagctccatttagtgcctcctccttgtatctagggaggtgagctggtctggggctgctgtg

SEQ ID NO: 6801947 - DNA, 57 bp, Homo sapiens
ctggggtctaatcttccatttctatacctaatagctagggtaagacttggaccttgg

SEQ ID NO: 6801948 - DNA, 59 bp, Homo sapiens
ggttcttacatccagacaggaggaataagttatagtgtcctgtaccactgtaagatgcc

SEQ ID NO: 6801949 - DNA, 75 bp, Homo sapiens
cttgtagtttagcagaggctgtctgacttaactgggccctttggtagaggaaagcagccactgccaatctacagg

SEQ ID NO: 6801950 - DNA, 101 bp, Homo sapiens
ctcagactccagcatgcatcagaatcacctggaggtgatcacttgttaaaatgcgcatcgctgggtcccacctccagagtttctcatgctggaagtctggg

SEQ ID NO: 6801951 - DNA, 72 bp, Homo sapiens
tcaaaggggccacctgtggcaccctgggtctgcaccactcagttcccccagaggtgcccaggggccccagga

SEQ ID NO: 6801952 - DNA, 62 bp, Homo sapiens
aagatgagctccagggaacagcagctaccttggtgaagccatgggtccctggggcaaatgtt

SEQ ID NO: 6801953 - DNA, 55 bp, Homo sapiens
cttctgccctttggtaggtaaagtattaatttgtatttctactttagagcggaag

SEQ ID NO: 6801954 - DNA, 63 bp, Homo sapiens
tgctggtttaaccatgtatcctggggacctagaaggagctcagggaacatcgttaaactagta

SEQ ID NO: 6801955 - DNA, 103 bp, Homo sapiens
ccctctggggtcccattggccctgctggagggaggaggctgctattggggccccctcagccacaaccccaagcctactcgcttggcctgggactccagggtgg

SEQ ID NO: 6801956 - DNA, 87 bp, Homo sapiens
cttctaagtaatctttaaagtgttcagttttggaaactttattctaagtacttaggtgaaggtttggtgagctaagattatttaaag

SEQ ID NO: 6801957 - DNA, 70 bp, Homo sapiens
ggtttccagggacctccctgagagctcccaggtgactggcttcaaggctcaaggcaggaccctgggtccc

SEQ ID NO: 6801958 - DNA, 74 bp, Homo sapiens
aggaagtagggctgaggcgagggagatgctgagcaagggtgccatttaagcagtcccagcctcagccccatcct

SEQ ID NO: 6801959 - DNA, 56 bp, Homo sapiens
ggccatgcacctatatgtgaagctttattgatgtttaaacataaccttgtatggct

SEQ ID NO: 6801960 - DNA, 73 bp, Homo sapiens
cctgaactgagctttatcaaaacagtaactgaactttgaaacgaaacaagagtgctgaattgaaagctccagg

SEQ ID NO: 6801961 - DNA, 56 bp, Homo sapiens
gtctgcacagccccatagtggtctgcatttttggatcacggctgctctctgtagac

SEQ ID NO: 6801962 - DNA, 69 bp, Homo sapiens
tgaaaagatggttgaccatagaacatgcgctatctctgtgtcgtatgtaatatggtccacatcttctca

SEQ ID NO: 6801963 - DNA, 70 bp, Homo sapiens
agagacatagtcttttctctgttttaacattgggctttctcccatgattgtctataaaggaagggtctct

SEQ ID NO: 6801964 - DNA, 57 bp, Homo sapiens
atgatttgctgaatatcttggatgtcagaaagacatccaggcagagcaacaaaatat

SEQ ID NO: 6801965 - DNA, 79 bp, Homo sapiens
catcatatatgggaaataatagaggctctttatgatgatactgttctgtagagaggatttgtttttctcctctctgatg

SEQ ID NO: 6801966 - DNA, 56 bp, Homo sapiens
tgcaaaaggctcttcaaaatggaagccactgtggtttctgttgtatggcttctgca

SEQ ID NO: 6801967 - DNA, 103 bp, Homo sapiens
ctgggggctatagagtgtgctgaggacagtctgaaaagcctaggttcaaatcctgatttggccactacccagctgtctttgcacagtttagcacctccctcag

SEQ ID NO: 6801968 - DNA, 62 bp, Homo sapiens
ggactctgctctgtcctgaaaacctggaatcataacatttcatggctaggactagagtgtcc

SEQ ID NO: 6801969 - DNA, 65 bp, Homo sapiens
agtgagagttctgttacgtgtcaccaacaacattctgtatgtttgccatgaacagaattctaact

SEQ ID NO: 6801970 - DNA, 61 bp, Homo sapiens
ctcttatgagtttgccaggagcaaaaagtaacatcccaacctcctgtcaactcaacaagag

SEQ ID NO: 6801971 - DNA, 61 bp, Homo sapiens
tggaccttggcatcaatgctagaataaaaaatatcatttcttcagaggatgccaaggtcca

SEQ ID NO: 6801972 - DNA, 77 bp, Homo sapiens
tggtgcatgtactggaccaaaattacagtcgctcctatttgggggcctattctaaggctggttaatgcctggcacca

SEQ ID NO: 6801973 - DNA, 79 bp, Homo sapiens
gagtgtgtttaacctgaaattctgaattctgagcctttcactggagtaagagtgtttgaaattctagataaacatactt

SEQ ID NO: 6801974 - DNA, 107 bp, Homo sapiens
agaaaacatccttagcttgcagactgagcaggtggtgggccagatttggcctctgggcctttatttgccaacccctgaattaacatttgtaagctggaaggtttttt

SEQ ID NO: 6801975 - DNA, 74 bp, Homo sapiens
tgggcacagttgaggtaggcggactcctccatctgcttagatggggactgcgaggccctgcctgttgtgtccca

SEQ ID NO: 6801976 - DNA, 55 bp, Homo sapiens
ggctctgtggctggccatgatggtcgattggagatcatctgagcccacagaagtc

SEQ ID NO: 6801977 - DNA, 67 bp, Homo sapiens
agagaaattctcagtggaagatttgatattaaatttcttcaccgagtcaacctacttggatttctct

SEQ ID NO: 6801978 - DNA, 71 bp, Homo sapiens
gggagggtgctgccggacaggtgggtccccgggtactcactgctgcccgcccggccgcggcgccccgtccc

SEQ ID NO: 6801979 - DNA, 67 bp, Homo sapiens
gaggaaaataacaactaagggcttccaaaggaaatgtttgccttttgttctttttgttatttttctc

SEQ ID NO: 6801980 - DNA, 108 bp, Homo sapiens
gctcctagaacctgaggaaggggtgagaatcaaggcagctgtagggatttggcaaaacagggacaaatgcacaggctctccagggcctggattccaggtttaatgagc

SEQ ID NO: 6801981 - DNA, 77 bp, Homo sapiens
gccctgagttctggggaaccccaaaagctcctgatccgggagctgacctgcaggttcccctaaccccactcatgggc

SEQ ID NO: 6801982 - DNA, 77 bp, Homo sapiens
gagatctgggaatgtttttagctttctaatgtcttcaacttgaatggagttagaatggatgttgagagccagttctc

SEQ ID NO: 6801983 - DNA, 87 bp, Homo sapiens
tgtgcacgggcgtgcaaagacatgtgcaggcacatttgaatgtgtgcgacatagtgtgcacatatgtgtctgcacatgccctgtaca

SEQ ID NO: 6801984 - DNA, 105 bp, Homo sapiens
gcttatagcaggtgatgggggtagtctgagcaatttccaaaatttgaaaaagcctcatggaaattgtgcatttagcaacacctcctctcataagtctgcacaagc

SEQ ID NO: 6801985 - DNA, 65 bp, Homo sapiens
gctattaggaaatcactttgctcaccattgaaatggtgtcattgggatggtttcctgtgatgggc

SEQ ID NO: 6801986 - DNA, 63 bp, Homo sapiens
cagctgccatgttgtgaggacactcaagcagcctcatggagaggttcacacggcaggcaactg

SEQ ID NO: 6801987 - DNA, 78 bp, Homo sapiens
gggtccaaaggagccaagatggggcaagtatgggagggcccagccctgtgccagctcccttttctcctcccctgaccc

SEQ ID NO: 6801988 - DNA, 62 bp, Homo sapiens
ctcactgagcttcctgtgtttgtctatgtaaacaccagtcccaagagaggctcagtaaagag

SEQ ID NO: 6801989 - DNA, 57 bp, Homo sapiens
aggctggcatacatttgttctttcttttgccagaacaacccatcggtgtggcagctt

SEQ ID NO: 6801990 - DNA, 56 bp, Homo sapiens
tctggggttgagtctgggtcagagtctgcagagactgacaaggaagcaagcccagg

SEQ ID NO: 6801991 - DNA, 64 bp, Homo sapiens
tagcacaggcttcttagattggctggaggctcctgagtaccaccagccaacagagccttcacta

SEQ ID NO: 6801992 - DNA, 94 bp, Homo sapiens
gcctgcgggcctcccagaggtgtcattcgagctgtcttgaaagatgagaaggtgcttgccagacactcgaggggggcacacaatctccgcaggt

SEQ ID NO: 6801993 - DNA, 70 bp, Homo sapiens
gagaacttacaaggatgatagctgcatctttttagatagaaatacgcagttgtgttgttgtacaggactt

SEQ ID NO: 6801994 - DNA, 60 bp, Homo sapiens
gagagctgggggactgtggatgtcatctgaaatccagttttggcagtcatctgagctttt

SEQ ID NO: 6801995 - DNA, 76 bp, Homo sapiens
actctgcttgttacatgtgtgtgtgttgcatgtgtgaatgtacatatgtacaagcacacatgtgacatttgccagt

SEQ ID NO: 6801996 - DNA, 79 bp, Homo sapiens
taatcaaattaggttagctgtttttcagcaaatattctattcttggacattgtgaatgaagaatgctaacctttgattg

SEQ ID NO: 6801997 - DNA, 66 bp, Homo sapiens
aagcctggctgcctatagtctcccttaaaggttaaggagtgatatatgggtgctaaagaaaggctt

SEQ ID NO: 6801998 - DNA, 94 bp, Homo sapiens
gattcaactgcctccctgggacgtggggagaggggggtgtgtgttcacgtcaccctttcttactcacacgctcttttacacacagtcatgattc

SEQ ID NO: 6801999 - DNA, 68 bp, Homo sapiens
tttctggccagctacccatctgcgtcaaagtggtgttggctttggcgcctgggtggctggattggaga

SEQ ID NO: 6802000 - DNA, 55 bp, Homo sapiens
tatgtaatgctctacccacatgaagcttcctctctagtgggacagacattacata

SEQ ID NO: 6802001 - DNA, 110 bp, Homo sapiens
gtaactgctagctattttacttatcatctccaaggccatgattacttgaaggaaaggagaatatgttttctttctcactctttaggaagtcatagtggaggagcaggaac

SEQ ID NO: 6802002 - DNA, 58 bp, Homo sapiens
gccccctagcctgcccgctgctcggggaatattgtcaccagcaggccaggcaggtggc

SEQ ID NO: 6802003 - DNA, 81 bp, Homo sapiens
atgtgcccaaggtcacactagggccaagtggagagtggaattcttcctgactcacctggctctgtgtctccaggggcaggt

SEQ ID NO: 6802004 - DNA, 74 bp, Homo sapiens
agaacagatatcacaggcccagctcttcaccagaagctttgatgatggcctgggctttgaatacatgatgttct

SEQ ID NO: 6802005 - DNA, 55 bp, Homo sapiens
ttctgaggtagccactcactgggtgccagaaaaccctgagcctgtttatccagaa

SEQ ID NO: 6802006 - DNA, 59 bp, Homo sapiens
atgtacacacaagtttgcacgcatactgggcatgcttgtgtgtgaacatgtgtttatgt

SEQ ID NO: 6802007 - DNA, 100 bp, Homo sapiens
cctggctccagcctcccttgaaatcctgcccaaatttgcctggctcctgcgtgggcctgagtaaatatgcggcaggtgcgctgaggggttgcgagctggg

SEQ ID NO: 6802008 - DNA, 87 bp, Homo sapiens
ctcctcagtcctccaaagtctgactagaatctctccctcccttctcagattgggagagggccatagttctaaggacaggattgggag

SEQ ID NO: 6802009 - DNA, 62 bp, Homo sapiens
agctcagttctgctgctgcctagggtgccatgctggccccggttccaatgcagagcctggct

SEQ ID NO: 6802010 - DNA, 76 bp, Homo sapiens
aggcactacctggaattatataaagaatgacaaagatgcggttatccatttattttctaggcaagttagttagcct

SEQ ID NO: 6802011 - DNA, 61 bp, Homo sapiens
agaatacgacattctttcagtctgctcatgtccttgggttaaatggcagagtgtctgttct

SEQ ID NO: 6802012 - DNA, 99 bp, Homo sapiens
ccctaaaggtcttgtgatttcagagtcagagctccatggagttggtgaggggccaactttttggggagttgagcttttgagtcaaatgttgacaaaggg

SEQ ID NO: 6802013 - DNA, 56 bp, Homo sapiens
gccttggcccacagtgctcctggcttggatttagccaggtcctcaccgccagaggc

SEQ ID NO: 6802014 - DNA, 73 bp, Homo sapiens
cctttccttctgtgttatcatttcagtacgtaggtggttgccttgtacagggaagtaatacaagcgggaaagg

SEQ ID NO: 6802015 - DNA, 65 bp, Homo sapiens
tgacaaactgtatagggaaaagtagaatgcatgcttgattctctccctttccttatcagttttca

SEQ ID NO: 6802016 - DNA, 80 bp, Homo sapiens
agtcatagcacccacctcgtggggtttcagtgaaaaaaaagcctggccagcagtgaagcctgatgctggtgggtgtgact

SEQ ID NO: 6802017 - DNA, 58 bp, Homo sapiens
ctgcttgacctgttgttctcacatacagagctggatgtgagaacagcaggtcaagcag

SEQ ID NO: 6802018 - DNA, 71 bp, Homo sapiens
acttctgatggtgagatccttttccttaagaaatgatattctccaagttgatgtttcttaaatcaagaagt

SEQ ID NO: 6802019 - DNA, 121 bp, Homo sapiens
gacttgctcaccaggcaaattttatagttagcaatgttgtgttggcattctatgttaagtatggaatgctggtgataatattctaaaaagtgaaattgggcatctctggtggatttaagtc

SEQ ID NO: 6802020 - DNA, 65 bp, Homo sapiens
gcatcatttctctaatcctcatagcctctattttgcagatgaggaatttgaggttagaatgatgc

SEQ ID NO: 6802021 - DNA, 78 bp, Homo sapiens
gggggcgtgagggtgttggttggttgggatattacctaaaggaagcccagtcctaaagcagacgccagtgctgcctcc

SEQ ID NO: 6802022 - DNA, 129 bp, Homo sapiens
tagtaatatatcacaagtctttgccactcctgcatttggaaagagactagagaaagaaactgaaagttgtagttcatagccttttctgtgattcaggacaataaagtaggcataatttggctatgttta

SEQ ID NO: 6802023 - DNA, 117 bp, Homo sapiens
gtttctgtggttctcatatggaaatagtttacacatgctcacttatttgttcagcaaacatctgagtgcttgctgtgtgcaagaaactgtgttcaatactgtgaagactactgagat

SEQ ID NO: 6802024 - DNA, 56 bp, Homo sapiens
ttgaggtctctacagaagagtgatagatatctattctctgttgaatgagatatcaa

SEQ ID NO: 6802025 - DNA, 59 bp, Homo sapiens
ggtctgccagtagctcgcagagttgggcaccatcagatgttcccagagctactgagact

SEQ ID NO: 6802026 - DNA, 55 bp, Homo sapiens
gtggcccaggcaccctgatgacttcctgtttctcagaaaagtaagcttgggcagc

SEQ ID NO: 6802027 - DNA, 66 bp, Homo sapiens
aggggaggagctgggggctcacacctcggatctaactccagaattgatgtcctcagccactgccct

SEQ ID NO: 6802028 - DNA, 59 bp, Homo sapiens
gtttgtttgtagggaagccgtggggataattgctatgagtgtggtctctacagccagac

SEQ ID NO: 6802029 - DNA, 103 bp, Homo sapiens
ttgagatggagtctcactctgttgcctaggctggagtgcagtgacacaatcttggctcactgcaacctctgcctcccgggttcaggcgattctcctgcctcag

SEQ ID NO: 6802030 - DNA, 78 bp, Homo sapiens
aaatttgaaagtgcagtcagacaaggcagtcacttaaaagcaactaaactgtgatttgcttgacttagtttctcattt

SEQ ID NO: 6802031 - DNA, 75 bp, Homo sapiens
tgtgtgtttttggcaagttatatttcagattcctgttaggcaaatgagattcataaaacttgctttaaaaccata

SEQ ID NO: 6802032 - DNA, 59 bp, Homo sapiens
gcttccaggggctgaactgctctgagggctctgcactcactgtcctgctcctggaacgc

SEQ ID NO: 6802033 - DNA, 57 bp, Homo sapiens
aattgctcacattaggcatccatggctttaaaagccatccaaatattgtgggtaatt

SEQ ID NO: 6802034 - DNA, 60 bp, Homo sapiens
ggccacagggaaccaaggctgggccctgagattctgcagggcaggtgggtctctgttgct

SEQ ID NO: 6802035 - DNA, 57 bp, Homo sapiens
ctgaggctctgagaaagccaaatgtcctctctttcaggatggcttctcaaagcccag

SEQ ID NO: 6802036 - DNA, 77 bp, Homo sapiens
cgcggccggaagcgcaggactggctcacggccgtccaggtaggcggccagtgcctcgccgcgctcctgcaggccgcg

SEQ ID NO: 6802037 - DNA, 55 bp, Homo sapiens
gcattatttactcccactagagatcaggcctcccagtcccaggggtgagtgatgt

SEQ ID NO: 6802038 - DNA, 61 bp, Homo sapiens
aggcattcaggctatttgatcatttctcttatatgtgattctcacagtcagttgagtgctt

SEQ ID NO: 6802039 - DNA, 89 bp, Homo sapiens
tctcaggaccccagccctcctgaggctgccgtgctttatcataaaggcaaggccaagccatcagtgtgtgcgagcaggaggtaatgaga

SEQ ID NO: 6802040 - DNA, 60 bp, Homo sapiens
gatgcaatttggggaagaaagagacagcacgagtgggtcttttctgtaacagattgcatt

SEQ ID NO: 6802041 - DNA, 66 bp, Homo sapiens
acagcttctggaaggctctggaaaaggtaaataatggacctttcctagagtctctagaagaaatgt

SEQ ID NO: 6802042 - DNA, 55 bp, Homo sapiens
gtgctgagcacaaggcccagagtcactactgcagacttctgggcaatctcagtat

SEQ ID NO: 6802043 - DNA, 58 bp, Homo sapiens
ataaggaaattgagacaaaggagattaagtatttttcctgaggtcacaacttgcttat

SEQ ID NO: 6802044 - DNA, 71 bp, Homo sapiens
gtgggggcagtgggcttcgagcgtagccagaaggagctactctgatctcaaggacccacctgactccccac

SEQ ID NO: 6802045 - DNA, 79 bp, Homo sapiens
atttcttccccagtgctcttaaaggtcataagatcattatgattattaattatgggcctttagaagtaccagtagaagt

SEQ ID NO: 6802046 - DNA, 73 bp, Homo sapiens
gattttatccttgtgagacattgtgcctgtacttctgacctacagaactgtgatctcataaatgggtgttatc

SEQ ID NO: 6802047 - DNA, 68 bp, Homo sapiens
tggcttggtcctggcccttccccacgagcccagtggacacagctggagcagggcggggcccaggcaca

SEQ ID NO: 6802048 - DNA, 69 bp, Homo sapiens
tcatctcttgccagtcagaatggtgattattaaaaagtccagaaactatagatgctggcgaggctgtgg

SEQ ID NO: 6802049 - DNA, 55 bp, Homo sapiens
ggtcatcagtcttttaatgataccttaggataaggtagaagaggacctggtgatt

SEQ ID NO: 6802050 - DNA, 74 bp, Homo sapiens
cgcccgtgtggatgcgctggtgctgcatgaggttggagctccagctgaagcgcttgccgcactccaagcaggcg

SEQ ID NO: 6802051 - DNA, 62 bp, Homo sapiens
tgaaggtattccttaccaaatagaaaacactattaccaagcctatttgttgggttgccttta

SEQ ID NO: 6802052 - DNA, 86 bp, Homo sapiens
gaactcagcccagggaaacattgtgttctacagatttaaaaaccaaaatctgttaagaacagaaatgttgggcttgggctgatttc

SEQ ID NO: 6802053 - DNA, 108 bp, Homo sapiens
agcactgatcaattagggaaattgttttaatgagggaggttgattttgtcatgtatgcgttatctttctcttttcttgaccacattatcctctgggaatcagaatgct

SEQ ID NO: 6802054 - DNA, 95 bp, Homo sapiens
gtgagtgtggatgggggtacgcactttgtctttttgtccaaaattgttagaattccaagatggacaggctcctaggggttcccccacccacttac

SEQ ID NO: 6802055 - DNA, 68 bp, Homo sapiens
tagtcacaagaaataagctgcctttctctatgaatcgatgattgggaggttttttgcttggagggcta

SEQ ID NO: 6802056 - DNA, 56 bp, Homo sapiens
ggaagctgcagtcccccccaagaggcctgatggtgctgggcgggtttgcagcatcc

SEQ ID NO: 6802057 - DNA, 57 bp, Homo sapiens
ctcccagattcctgctgtgggaaccttgtttcacccacagactatcagacctgggag

SEQ ID NO: 6802058 - DNA, 79 bp, Homo sapiens
caggtgtaagcagtctagggtgtataaggaagcctcacacttttggggctcttctggcatgctgctctgctgttccctg

SEQ ID NO: 6802059 - DNA, 55 bp, Homo sapiens
tttggagtaagagcagcagtgaggcaaggaacttaaatctgttcctggctccaaa

SEQ ID NO: 6802060 - DNA, 60 bp, Homo sapiens
atggagactgcgtctgccatccctgctcccccccagggatgtaggactaggcttctccat

SEQ ID NO: 6802061 - DNA, 66 bp, Homo sapiens
gaaaattaatttctctctcatgcttcatgtccaaaggatatcagcaaggaggagaggtgctttttc

SEQ ID NO: 6802062 - DNA, 60 bp, Homo sapiens
agggtagcatgtgttattaaaacttgtatcacaatacaggccaatatcacatgctatgct

SEQ ID NO: 6802063 - DNA, 84 bp, Homo sapiens
gcccttttggtatttcaaacaaaagcaatttaattgaggaaattagttacatggttgttggaaatgctgggaaaacaaaagggt

SEQ ID NO: 6802064 - DNA, 71 bp, Homo sapiens
actgacttagcaggtttctggctcttggctcttgaggacaaggcccaaggatgagaccttgttgaaaaagt

SEQ ID NO: 6802065 - DNA, 72 bp, Homo sapiens
catgattgagcttggaagcagatcctcacccagtgaagcttggagatgactgcattcccggcagattccctg

SEQ ID NO: 6802066 - DNA, 75 bp, Homo sapiens
ctgtttcttcactgaccgtcttcccactttctgtccaagggacaggccagatggaagaggtcagtggaggggcag

SEQ ID NO: 6802067 - DNA, 55 bp, Homo sapiens
aagggttgggactattatgactctgactaagggttacatattttttcctaccctt

SEQ ID NO: 6802068 - DNA, 72 bp, Homo sapiens
gcctacaggaattcagactgtctaaatggtttcaatgagaatctttgaaatgacattaggatcctgcatggt

SEQ ID NO: 6802069 - DNA, 94 bp, Homo sapiens
gaagcaccccaattttccagaagcttttccacctgtgtagcatgagcttggctatgagcagctgcacatggcagaggcctttggaaagtgcttc

SEQ ID NO: 6802070 - DNA, 101 bp, Homo sapiens
gtgccatagagtgattgagggtcagagctaggagctggagttcctgggttcaaatcccagctctgccacttcctagctatgtgatgtcatctctctatgcc

SEQ ID NO: 6802071 - DNA, 76 bp, Homo sapiens
cagcatctcctgggagaggctgccatcttgcatagcccttgctgctgcctggaggcttcttctctctaaactgctg

SEQ ID NO: 6802072 - DNA, 67 bp, Homo sapiens
actgagtgatgtgagaaaatgaactctaacactaaagttagtttcatgtagccatatttacctcagt

SEQ ID NO: 6802073 - DNA, 115 bp, Homo sapiens
aggaaacttctaggcccaggcagaagcatcatgctgcttacaccttcctgggaagtggcatccgcgggggtggccagcaagacctcctggctatgggacttttaagatgcatcct

SEQ ID NO: 6802074 - DNA, 129 bp, Homo sapiens
accaattgaactataacttcttttaaagatcttgtgccaagctgagcaatttagagtggcaaaactcaacaaataagtggcacttaaagtcttagcttacagctaaggtccagtgaaactttatttggt

SEQ ID NO: 6802075 - DNA, 62 bp, Homo sapiens
ggacctggtggggctttccttctgcttggccatacagagtagagagaagcctggcctttgct

SEQ ID NO: 6802076 - DNA, 71 bp, Homo sapiens
tgaggaaaggcatgtgggctggttgtacagtagtgatgctggatttgcaatgaggcaacagtaatttctca

SEQ ID NO: 6802077 - DNA, 111 bp, Homo sapiens
aggtgaggaaagagtatgcctgcaggtgagtgacctgctcaaggccacacaggccaggccaggcctaggccttggactcgggtggactcacagccaggtctttctctccct

SEQ ID NO: 6802078 - DNA, 63 bp, Homo sapiens
ctttccactgtgttccttttagttatcttggagctctgatttttccagttacatagaggaaag

SEQ ID NO: 6802079 - DNA, 60 bp, Homo sapiens
aaacaatcagagattgtctctgtttccttaccatcggaaccatgatctgctctggtgttt

SEQ ID NO: 6802080 - DNA, 60 bp, Homo sapiens
gcaccagagtgagtggactgtcgctggctgactgttaatgctgtctgcctcatccggtgc

SEQ ID NO: 6802081 - DNA, 55 bp, Homo sapiens
cacctggctggaagtgctccgggcagggcctggactccttcacctccagcaggtg

SEQ ID NO: 6802082 - DNA, 69 bp, Homo sapiens
atactactgattgctttgccaaaagtatactcaccacccatactatttgtaaagagcaaacggttgtgt

SEQ ID NO: 6802083 - DNA, 69 bp, Homo sapiens
gctttgcagccaagaagcaagaaggagcctcgccctattggggctgccccagtgctcatggctgaaggc

SEQ ID NO: 6802084 - DNA, 60 bp, Homo sapiens
ttctagactgtgtacagattcagaattaagaaacttatgaactcttactgcagtctggaa

SEQ ID NO: 6802085 - DNA, 97 bp, Homo sapiens
tccacagcttgaagttacctccaatctttacaagaaattcttttagagcttcctttgcctgactttagagatgggaggtcatagcttctcacctgga

SEQ ID NO: 6802086 - DNA, 129 bp, Homo sapiens
gcttgcattgctacagtgagttttaaaaggcttgattgctactttcagtttggttcattgtcttagctgagcactttgacacttggaagcttggcaacattacctggaccatcgtggctgtgcagaggc

SEQ ID NO: 6802087 - DNA, 58 bp, Homo sapiens
gcattttgtaagcagtgtttttacaggggtggaattgtctctgtttgtttgcatatgt

SEQ ID NO: 6802088 - DNA, 65 bp, Homo sapiens
agtcaccaggttttagagacctgctaaaaggatggcaatgtggtctatctgcaatctgagttatt

SEQ ID NO: 6802089 - DNA, 76 bp, Homo sapiens
gaaggcaatcaagcagagaggttagaacacaggctttggaattagacctggatttgaattcctctctgatgccttc

SEQ ID NO: 6802090 - DNA, 77 bp, Homo sapiens
ggggacagataatgtctccaggggcagggtctggaggggccaacaccctcatcagagccctcctctggcctgtcccc

SEQ ID NO: 6802091 - DNA, 87 bp, Homo sapiens
aggaaaatcgctgatctacaggaagtaagtaatgaaattaaactagaatatccaagagtttagactttctgtccagtgatttctcct

SEQ ID NO: 6802092 - DNA, 98 bp, Homo sapiens
tagtaggtgtacagtttccactggctctggtaacagaatgctcactcacatagtctgtccctgagagctcaggagctgggagctgtgcacgctgactg

SEQ ID NO: 6802093 - DNA, 93 bp, Homo sapiens
gttgaactgacagtcttgccaagtttcttacatgacagtactgattaagaaagaatggaattcagaaacttgggataagatacccagttggac

SEQ ID NO: 6802094 - DNA, 66 bp, Homo sapiens
tttagtagactggaactgtcttcaggatgatatatttcttaaaggctttattttccagtcattgga

SEQ ID NO: 6802095 - DNA, 75 bp, Homo sapiens
ctttgggataataatacatctcaggattgttttgaggattaaatgagatagtccacaaaaagtcttgacccagag

SEQ ID NO: 6802096 - DNA, 77 bp, Homo sapiens
tccctcccctccaccagccagtagctttgccaggagagcagcaaatgagaagcctggaggctctgggagggcaggga

SEQ ID NO: 6802097 - DNA, 111 bp, Homo sapiens
cacctgggccccattacctctgtaatccaaggttcctactgttgcactccattctgtccaggactcagcacagcactgggaacccaggaggattaaagaagggccagggtg

SEQ ID NO: 6802098 - DNA, 78 bp, Homo sapiens
tccaacactcaacatgaggcactgagtttcattctttggaatgaaatttaaacctgcatctgctgtaaggtgtttgga

SEQ ID NO: 6802099 - DNA, 105 bp, Homo sapiens
gaacttgcttttcaaaggtagcatgcaagacaatctttaaaatccttactggattcttagacatgatcttgttcttacatgcagcagaacttgttgagaagtttc

SEQ ID NO: 6802100 - DNA, 68 bp, Homo sapiens
attgtgttctgaagcaccagaagtccccccttcccctccaaactggggcagccactgccttcaacaat

SEQ ID NO: 6802101 - DNA, 55 bp, Homo sapiens
tagataacagcactggcctcgctcaccaaagagaggagctgtgtgttgttttctg

SEQ ID NO: 6802102 - DNA, 72 bp, Homo sapiens
tgagaactgctagagttttgaacgtcttcacaggaatatttgaaatggtgtttaaaggctcagcaggatttg

SEQ ID NO: 6802103 - DNA, 70 bp, Homo sapiens
actaaatgcctgggactctgttatcttggtacctggaagactagttcagtgtcccaaggcttagtttagt

SEQ ID NO: 6802104 - DNA, 68 bp, Homo sapiens
caaagtctccatggatttggaaatgatgccattgtctctggattaccgctgagtcctatggagagttg

SEQ ID NO: 6802105 - DNA, 57 bp, Homo sapiens
ctgaccttgtgatccacccgctttggcctcccaaagtgctgggattacaggcgtgag

SEQ ID NO: 6802106 - DNA, 58 bp, Homo sapiens
ttttgctttcaatgaattgtatactgggaaaccagtttacccactgttgaaattaaag

SEQ ID NO: 6802107 - DNA, 130 bp, Homo sapiens
agagtgccagccaggccgactgttgtgcaagttctgggctggcctgcgagggcaggctggcagaggagtcatgcctgatcagcggccagcatggtgtctgcccagccctcttggcctgtcctatgagact

SEQ ID NO: 6802108 - DNA, 68 bp, Homo sapiens
agctctgaagcttatctgatgtgtatttaaggagtcaaagatcctcctaagataagacctacagagct

SEQ ID NO: 6802109 - DNA, 127 bp, Homo sapiens
agcttgatacactggggcaaagccagttcttagagaaagcttgatacactacttaatctgtttttcccttaaagaggctggctacaaaataataatgcttctttttatgtttcttaaaaaaaaagct

SEQ ID NO: 6802110 - DNA, 78 bp, Homo sapiens
gctgccacgatctctgctgtagttggggctgtaaaatgctttccccgtgagaaatgcaagcaggaagtggtggacagc

SEQ ID NO: 6802111 - DNA, 88 bp, Homo sapiens
ggcttaaatatcagaccctgatgagctttgttagtatgaatcaccttcccgaatatgctaaatatgttcacattgatgaaattaagtt

SEQ ID NO: 6802112 - DNA, 97 bp, Homo sapiens
gaggcaggagaattgcttgaacccggcggtggaggttgtggtgagccgagattgcgccactgcactccagctgggtgacagagtgagactccgtctc

SEQ ID NO: 6802113 - DNA, 74 bp, Homo sapiens
cactggcacaaatggaaaccaagcctctgagaggagaatttgttttgttttgatttctgagtctgtccccagtg

SEQ ID NO: 6802114 - DNA, 57 bp, Homo sapiens
gcacagcagacttggtggggctaaaatctactctggtccccacttacgatgctgtgt

SEQ ID NO: 6802115 - DNA, 58 bp, Homo sapiens
cttgttctgtgactccagaaggctcataaatgtgagcctctgatgatcacagggggag

SEQ ID NO: 6802116 - DNA, 91 bp, Homo sapiens
atactcgtttatgatatctctgttctctatgtgcaatttcaatttacacagagaaggtctcattcgcatggagaaggagttgcgtgggtat

SEQ ID NO: 6802117 - DNA, 101 bp, Homo sapiens
gccagagagagagagagtgaaacttttatgcccaacggtgtttggatgagcaagataattacacccttgtccatagcagatgctctgttcttcgctttggc

SEQ ID NO: 6802118 - DNA, 71 bp, Homo sapiens
tatggcattctgtttaatacacgaaaggtttccacttgatatacattgtgttaaaacagaagatagccata

SEQ ID NO: 6802119 - DNA, 71 bp, Homo sapiens
ggaggaacactgtgaaattacccttacttcttggcagaaagatatattttggtgatttcattttggctttc

SEQ ID NO: 6802120 - DNA, 73 bp, Homo sapiens
ttgtagtccttcaggaaatgtataattttataaaatttaaagttttgtgaagttattttttctcaggatccaa

SEQ ID NO: 6802121 - DNA, 73 bp, Homo sapiens
gtgctcttgtttatcccctgagcaacaaactgaataccactatgtggcagggattgtgcagggggctagagat

SEQ ID NO: 6802122 - DNA, 118 bp, Homo sapiens
taggagcttacttgcctcccccctgggctgagcacatactgacagcagggagcctgccttgttcaactctgtatcctcagcccctgctgcagggcctgggacatttacatgttcacta

SEQ ID NO: 6802123 - DNA, 83 bp, Homo sapiens
tctggaggacatttatttatggaggacatttattctggatgtggaaggccagaaaatgctctccaaaatgaaagtcatttgga

SEQ ID NO: 6802124 - DNA, 96 bp, Homo sapiens
ccttggaacctcctatgtgctgcatctttggatggaaattggagtcccagagacaaatgaggctccaccctgcttccagaagctcagagtccaggg

SEQ ID NO: 6802125 - DNA, 73 bp, Homo sapiens
ccatctggcttgaagttatgcaccagctcagtgtgagactaaactgtgctatggctgccactcaagccaatgg

SEQ ID NO: 6802126 - DNA, 57 bp, Homo sapiens
ttccagagttgggggagtggttggagaaataaacaactaattacctaacattgtgaa

SEQ ID NO: 6802127 - DNA, 59 bp, Homo sapiens
agccaaggagaggggcctcaggccagcacaagagcacagggcaggcacctcttcctgct

SEQ ID NO: 6802128 - DNA, 70 bp, Homo sapiens
taccttgaaaagaaggtgctcacagatacttggagatacaggtctgagttcaggctttcactcaagagta

SEQ ID NO: 6802129 - DNA, 68 bp, Homo sapiens
atgttttatattttttgcatgtcccctggggctaggtgccagagacaccccagaaaataagagagcgt

SEQ ID NO: 6802130 - DNA, 129 bp, Homo sapiens
ggtaagagggaactactgtaattctaatatgctgtaaggggttatagtgattactgttaattcttctgagactagtaacatgtatcgctttttaatatccttcaaatttattaggttccctcaattgct

SEQ ID NO: 6802131 - DNA, 122 bp, Homo sapiens
taataaggcaaaatataatccaaatcagaaaatactgctccaagtggaatggtgcccaagaatagtgcatacttggttacttttaaacttgtctgagtattttagaattattgaccttgttg

SEQ ID NO: 6802132 - DNA, 57 bp, Homo sapiens
ttcatgaggtacctgtgatcatcagctatgcctgagagacacaggcagtcctcagag

SEQ ID NO: 6802133 - DNA, 66 bp, Homo sapiens
tcagtgcttcctggaggaagccctatgctttgatgcttcttccaggaagcaacccatgatttctga

SEQ ID NO: 6802134 - DNA, 70 bp, Homo sapiens
gcaagtcacttgggctctgtgggccttagtttactgacctgtaaaatgagatctctggtccaaatcttgc

SEQ ID NO: 6802135 - DNA, 97 bp, Homo sapiens
ggagtaaatatagatagcaaagaacctgataccccaagaaaccagtttctaccatgatctgggggattttctcatatgttactatttaatttgcttt

SEQ ID NO: 6802136 - DNA, 73 bp, Homo sapiens
ggctccggactcacctgacaatggctccttcatctttgggggctctgggaccttgggtgggggctctggagct

SEQ ID NO: 6802137 - DNA, 119 bp, Homo sapiens
tgttttccgagtctgctctgcggatagtgagagaggatgccctcatattttaccatgagagtaaagtgttagtgaaaggtgtttatttctgctttgcctcagagacagagcttggcaca

SEQ ID NO: 6802138 - DNA, 74 bp, Homo sapiens
tcttttgaaatttcattgttgggataaagtttgaagtaaattatacagtttataaaaataatgaggtcaggaga

SEQ ID NO: 6802139 - DNA, 65 bp, Homo sapiens
agggcctcagtgttctcatctgtatgtcgagcactacatagaatcagctcatgcgctgaggcttt

SEQ ID NO: 6802140 - DNA, 79 bp, Homo sapiens
ccaagatggtagaaatgctgaattctattttaagtctgattagagcactaggcttctcagcatggttactgtgatttgg

SEQ ID NO: 6802141 - DNA, 83 bp, Homo sapiens
atctggataattcagatttacaacactacttatccttgaaatggtttcaagggaaaaatggttttgtggggacttgtttagat

SEQ ID NO: 6802142 - DNA, 94 bp, Homo sapiens
gcagtatcaacaagcacccccaggtgcttctaatgcacagccaggttgaaaaaccagtgccttagggtacctggtgcttgtctgatttttctgt

SEQ ID NO: 6802143 - DNA, 66 bp, Homo sapiens
cctgggagctgtcagacaggaatgttgcaagtgactacaccttgcagtgcctctggcaggattagg

SEQ ID NO: 6802144 - DNA, 65 bp, Homo sapiens
gaacatggcctttctcagtggtgctttttttctaggagtttcacgtagatcagggtccagggttc

SEQ ID NO: 6802145 - DNA, 84 bp, Homo sapiens
tcccctctgtgcttttctgcagggtcctatgtgaaatagccacatctcatgaactgcttttgtagaaacgggcaccgaggaggg

SEQ ID NO: 6802146 - DNA, 77 bp, Homo sapiens
caggagtagaaccattaagctggtccagacaagttggactccaccatttcaacttccagctttctgtctaatgcctg

SEQ ID NO: 6802147 - DNA, 73 bp, Homo sapiens
gcactcagaactggaagaggttctgcaagctctaccctcgcagtgtgagcagaggcttttacaggctgaatgc

SEQ ID NO: 6802148 - DNA, 127 bp, Homo sapiens
tgttttaatgctttcttttctacctgtctgacattctctctctatgaaaactgatcaaatgttggaaggtaagtttcaagtgtggagagagaccaagggagatggcaagaaggaagttggtaaatca

SEQ ID NO: 6802149 - DNA, 80 bp, Homo sapiens
ggcaaagcacagagcctggaggaaaacaactgcagacagaatcctttgttttggtttaatttcttctactgctgcttttc

SEQ ID NO: 6802150 - DNA, 91 bp, Homo sapiens
ctctgtgatcattcagcttcaggaccctgagccacctcctggcatctgtcattttcagggcctgtctgtagaactgaaggggttacatgag

SEQ ID NO: 6802151 - DNA, 60 bp, Homo sapiens
tgtaaattagtacaagacccaggacgttgcttctgatgtgcttggggttgactagtgtca

SEQ ID NO: 6802152 - DNA, 86 bp, Homo sapiens
gggtcttgctcttttgcccaggctggagttcagtggtgcaaatacagctcagtgcaccctagacctcctgggctcaagcagtcccc

SEQ ID NO: 6802153 - DNA, 93 bp, Homo sapiens
cagaggatggtggcttggcccaggtgtttgtggcagaggtggtgaggatatcagcttttaaatacatttgggcagtagagccaataggatttg

SEQ ID NO: 6802154 - DNA, 60 bp, Homo sapiens
aggctttaagcaagcatattgttgtattttaattacttcaacaatactcttgtggagctt

SEQ ID NO: 6802155 - DNA, 61 bp, Homo sapiens
tcttccttggctctggtcttcattatctaggatggtaaaagtacacacagagccaagaaga

SEQ ID NO: 6802156 - DNA, 65 bp, Homo sapiens
ttctagacacagacagttagaggtaattcacaaagagttgtaaaattgctctgttgtgtctagaa

SEQ ID NO: 6802157 - DNA, 64 bp, Homo sapiens
ttatgcattggattttctgttggtttttaatagcataggcctaatagagacctagatgccatga

SEQ ID NO: 6802158 - DNA, 82 bp, Homo sapiens
gattcttttaggccaccagggttccatttagagaattacaattgccatgtgctaactggtactctggtagcctgaatgagtt

SEQ ID NO: 6802159 - DNA, 94 bp, Homo sapiens
tgacatctaataagttttcaatatatgatagtgatgggagtagtagttgttgagtttgttattattatgtatttaggacattaaacaggtgtta

SEQ ID NO: 6802160 - DNA, 66 bp, Homo sapiens
tgtctttaatcctcatgcatagtcaaggactcatctctggaccatgagctgcaggtgttctagaca

SEQ ID NO: 6802161 - DNA, 66 bp, Homo sapiens
ttgcctgcttgaatacttgtgtttggagcatgtgaggggtggttccaagtcacttaagatgggcag

SEQ ID NO: 6802162 - DNA, 81 bp, Homo sapiens
ttgtaggatagggaagaaagcacacaaacttgagtgagttattctccaattaattttatttgcttattccttctcaaataa

SEQ ID NO: 6802163 - DNA, 94 bp, Homo sapiens
tcctatttctttgttaaggagtattgcttctccaaaaagggctctaacaacctcagagattgcaattccttacatgcaatggaatgccaatgga

SEQ ID NO: 6802164 - DNA, 76 bp, Homo sapiens
ctgttcgcattgtgtatgtatgagacagctgcaaggagtttcatccagcttaagcatgatatatgagtgtgggcag

SEQ ID NO: 6802165 - DNA, 73 bp, Homo sapiens
gcccccttctttcctgggcgccttaggtggtagtcagccacaccacaactgccagccaggaaagggtaagggc

SEQ ID NO: 6802166 - DNA, 58 bp, Homo sapiens
gttcattgctaactgtagagtcaattgttgagttgattcttggggaaatagtatgagc

SEQ ID NO: 6802167 - DNA, 61 bp, Homo sapiens
catctccccgagcttacctcctgatgaccccttatcaggttgtccactgaagctgggagtg

SEQ ID NO: 6802168 - DNA, 81 bp, Homo sapiens
aggctcagaaatggcagatggagagatgtaccttcttgaacttatttttctaacttacctgctgttattttgttctgtcct

SEQ ID NO: 6802169 - DNA, 87 bp, Homo sapiens
gccacctgaagaatgcccagcatataggaaatgttgaatcaataacaattgagtgcagtatcttctgtgtccttttcccttggtggc

SEQ ID NO: 6802170 - DNA, 82 bp, Homo sapiens
gggtatgaagtaagatattgttcagctcctggcttcattgctcatgccttaagctcatgaattcaatttcttcctcttaccc

SEQ ID NO: 6802171 - DNA, 73 bp, Homo sapiens
atgctgaatgggtgattttggagaactagcagatgtgaaaccttagaaagctgctttagaagaacccaagcat

SEQ ID NO: 6802172 - DNA, 70 bp, Homo sapiens
gctctagaacctattagaaatgtattgaaatttggaatttagtatttatgaatgaatatgttctagatgc

SEQ ID NO: 6802173 - DNA, 101 bp, Homo sapiens
gctctatggcaagtgtgcattgtaggttagtatgacacggttataggctctctgtaacaatgaatatagtgactgatattttttgagcacttactataggc

SEQ ID NO: 6802174 - DNA, 84 bp, Homo sapiens
ggaggagcttaaccagcaggtggtagggaaacaatattaaaaacctatcaggatttggccttgtgttctctccatttctccttt

SEQ ID NO: 6802175 - DNA, 89 bp, Homo sapiens
gggtgtaatgaaactttaaagagtctcttgtctgccctggtgttagggcagcatggcagctagagctctttaaagtttaaatgcttccc

SEQ ID NO: 6802176 - DNA, 80 bp, Homo sapiens
cattgagtaatatagctagatgggatgtcagcgttttttgaatgaagcatctcacaatctagtcagcttcttacacaatg

SEQ ID NO: 6802177 - DNA, 66 bp, Homo sapiens
ggggctccggcttggtgtgcagggtgaggctgtccctccagggctcgtacaccagcgtggaggtct

SEQ ID NO: 6802178 - DNA, 62 bp, Homo sapiens
gatctctgtggactcttagcactcaaccttcagatccgagctgcaacgagtttccagaggtt

SEQ ID NO: 6802179 - DNA, 60 bp, Homo sapiens
ctttcccttagccccattctatctgtctcacagagttttgagtcctggctagggtggcag

SEQ ID NO: 6802180 - DNA, 68 bp, Homo sapiens
tctgctgggagctctgagcctgctgtgggtcttctccatgggccttactctaagggcttctggctagg

SEQ ID NO: 6802181 - DNA, 101 bp, Homo sapiens
tttgaattggtgtatacattagagggtaggaatttacttccccctgcttctataaggggaaagataatcaattactccttgtgtatatttatgaaatcaga

SEQ ID NO: 6802182 - DNA, 124 bp, Homo sapiens
caatcttcagtgactttctttccagactgaatcttcagtgtctaaaaagcaacctgtagcagttatgatttggggaagctgtggtgtagttaggaaaacaatgacatggtcaactgaaatgttg

SEQ ID NO: 6802183 - DNA, 57 bp, Homo sapiens
tgggttagggcctggtctctgagaagtcacttcttcctggaacttggcctttaccca

SEQ ID NO: 6802184 - DNA, 119 bp, Homo sapiens
tgggaagggcaagagaatgtaagaggcagggctgaaggtcccaggccagtcaacagcgaggctgggagctctcacttctggatcacttctctcacttctcactcttggcacctttccca

SEQ ID NO: 6802185 - DNA, 59 bp, Homo sapiens
ttaacttcaacactctcttgtaacatgttactttctgttataggtgatgttgagcttga

SEQ ID NO: 6802186 - DNA, 58 bp, Homo sapiens
gcaagtctgaaagcaaggaaatgttctcctcccccacaccactttgcagcagacatgt

SEQ ID NO: 6802187 - DNA, 70 bp, Homo sapiens
ctgttttattgctcagcagttagttggcacagaggtagttgcttaacggttgcatgaacaatatagacag

SEQ ID NO: 6802188 - DNA, 79 bp, Homo sapiens
gaagcaagtataatcaattgctttttgaatcaatatttcaacaaaatgatgataagatggagttgaattctcttgcttc

SEQ ID NO: 6802189 - DNA, 59 bp, Homo sapiens
gcccttatggccaacctttgccttagctgctctttgaggtgggtactggtgatggtggc

SEQ ID NO: 6802190 - DNA, 55 bp, Homo sapiens
gaaggcctaggaaggaagccttaagctacttgatgctgcttcttaactggtcttt

SEQ ID NO: 6802191 - DNA, 70 bp, Homo sapiens
gattgggtgttcactccatgggaattgtgaagacagtccacttcctgctggtgtgaatttggtgcccatc

SEQ ID NO: 6802192 - DNA, 60 bp, Homo sapiens
ctggcagagggcactcaggatgtcttctcatcctcatggacctcagactgtcctttccag

SEQ ID NO: 6802193 - DNA, 116 bp, Homo sapiens
ctacaactcagacagcagagccaccctcaggaggctgcaaccctgaggccccaggggcctgtaggtcagcctccttttctgtagcacggggtgtctgaatgcctggaacatggtgg

SEQ ID NO: 6802194 - DNA, 87 bp, Homo sapiens
gcgtttattttttaatttgctacttagactaactgtagggactagaagattctgtctctttccctgtgttagcctgtagctaaatgc

SEQ ID NO: 6802195 - DNA, 63 bp, Homo sapiens
tcctgagaggtttataacgcagatcagataacaccagcttctcctgtcttttgcctctttggg

SEQ ID NO: 6802196 - DNA, 64 bp, Homo sapiens
ctagtttggttagataagtctcccaattgcagtgtcagcatgcagactagtctagtccagagag

SEQ ID NO: 6802197 - DNA, 55 bp, Homo sapiens
ggtgaattctcagcttttacaacttcatcaaatgttgaatactgagtaattcact

SEQ ID NO: 6802198 - DNA, 109 bp, Homo sapiens
cgcagttgaaaaggtttgttgcattcgttgttgaaaggttaaaagtagtattgctaggtaaagctatgcttaatttatcatgtactcaaggggctcttttaggctgacg

SEQ ID NO: 6802199 - DNA, 69 bp, Homo sapiens
taactggtaggtgagtttggggaagatagacaaagtacggtttgttcttctttagaattcattcagttg

SEQ ID NO: 6802200 - DNA, 105 bp, Homo sapiens
tgccgggcataatgggagatagcaatgacaaatatggaagcctgataatggaacatctggtcgggattgcagatgttatggaatggcatccctatggtgatggta

SEQ ID NO: 6802201 - DNA, 92 bp, Homo sapiens
ccaggccaagccagagagcaactgttctgttctcacttacgtggtgagctgtttttcaagaacattttttttcatttggctgtgtggtctgg

SEQ ID NO: 6802202 - DNA, 99 bp, Homo sapiens
tgaaaacatttatgatgtacaataacatgggcacttacctttcctttcactatattttgagagaaaacaagttctccattttatctgggtcagttttta

SEQ ID NO: 6802203 - DNA, 110 bp, Homo sapiens
cttcacaatcatggtgctgggtttggaaggatacactgatgataatggtgtccaggttttcagctgtatcctgagaacagcctggatggcaccgacactgaatgctgagg

SEQ ID NO: 6802204 - DNA, 59 bp, Homo sapiens
tttacatttcctgtcagagatataacaaaatgctctcttgttgtaataggaagtgtagg

SEQ ID NO: 6802205 - DNA, 69 bp, Homo sapiens
gggagaaagattcttaagacattatgtatttttagtgattcaagtacgtgaatcaaggatctatttccc

SEQ ID NO: 6802206 - DNA, 57 bp, Homo sapiens
agcacaccagtgatgtaattattctgcctgttccctgcacacaggagtcactgtgct

SEQ ID NO: 6802207 - DNA, 70 bp, Homo sapiens
tcttatcttggtggcgctagtgagtaattcaattggcatccagtctccacagttttgccactagctgaga

SEQ ID NO: 6802208 - DNA, 65 bp, Homo sapiens
ccttggcttcctgcacttgagtttcagccctctggagcttcatatgttgcagagaatgcctaagg

SEQ ID NO: 6802209 - DNA, 67 bp, Homo sapiens
tacagcacagcaaagaggacggcttcctttctcccaaccatctagccgagtcctgagctctgctgta

SEQ ID NO: 6802210 - DNA, 63 bp, Homo sapiens
cattcacaaagctgattgatggcaaagctgagatttgaaaccaatcagttttgtttcagaatg

SEQ ID NO: 6802211 - DNA, 70 bp, Homo sapiens
aagtctttgctattgtgagtagtgccacaataaacatatgtgtgcatgtgtctttatagcagcatgattt

SEQ ID NO: 6802212 - DNA, 80 bp, Homo sapiens
atgggggtgggccactctgatttttctaatacttcagcatctggttaagtatgttagaaaatcaagtgctaacatcttat

SEQ ID NO: 6802213 - DNA, 67 bp, Homo sapiens
ctgtattttcatgcctacgtacaatttgttcaaacattctggtatgtgctaggcaccgaggatatgg

SEQ ID NO: 6802214 - DNA, 58 bp, Homo sapiens
acccacgaaatctaggagagtaacaaaatggttgttctaagcaactaagttttggggt

SEQ ID NO: 6802215 - DNA, 93 bp, Homo sapiens
tacttatatgggattttactataggattggttcccattttacttgcagaaaagctaaagtgtggacagtatctataccaagtcagtaaaggta

SEQ ID NO: 6802216 - DNA, 129 bp, Homo sapiens
cgagcacagtgaattccagtactttcggaggctgaggcgggtgatcacctgaggtcaggtgttcgagatcagcctgaccaacatggtgaaaccttgtctctactaaaaatacaaaattcacaaggcatg

SEQ ID NO: 6802217 - DNA, 57 bp, Homo sapiens
tatgagcaagagtttgtgaagggagatagaaagtcctgactacaactgttgtttata

SEQ ID NO: 6802218 - DNA, 83 bp, Homo sapiens
tgtctcaatatttgcggttacaagtgttcgagagtgacctcaaaggtgggggattttctgtcatttgtagcattgctgaggca

SEQ ID NO: 6802219 - DNA, 72 bp, Homo sapiens
aggtttgggttagtttctagccctgtcagttagtaaccatgtgacttcaggcaagatattaacttctgacct

SEQ ID NO: 6802220 - DNA, 82 bp, Homo sapiens
ttcaataggtgtctctgtgtcctccagggagatgtaaaatcctcttcacatctccctggaggacacagagacacccattgga

SEQ ID NO: 6802221 - DNA, 83 bp, Homo sapiens
ggcagtgagccaggctggacattagatacatagtcgacttcacctactctgtgatttagcttccagctttaccgtttgctgtc

SEQ ID NO: 6802222 - DNA, 57 bp, Homo sapiens
ctttcttatacctgtcagggccaggttggtcccatcttgatgcaggtggcctggaag

SEQ ID NO: 6802223 - DNA, 77 bp, Homo sapiens
gggtccagggaactttgaaggatccagcacttctgagtttgaggtggtttgttctccagaatttcctgcatagacct

SEQ ID NO: 6802224 - DNA, 113 bp, Homo sapiens
ctccgggttttcttttcgaattaagctagacactgctacccagatgtctttggaggtgacttttaattgaacattaaaattgggtggggtaaacgagaagggaaaacaaggag

SEQ ID NO: 6802225 - DNA, 55 bp, Homo sapiens
aggagacagaatttaaatttgggtcttgctgactccaaagtgaatgctgttttct

SEQ ID NO: 6802226 - DNA, 122 bp, Homo sapiens
aaaacaaatgttgatatgtatacgtgagaatggcaaaatcggtgagattaaaccaataattaaatgtcattagtttcagccattcttttaacatggaatccagatttttaatagcttgtttt

SEQ ID NO: 6802227 - DNA, 75 bp, Homo sapiens
acagaaacccccagagacttgcttctaagaccaacactgggctctattttagtagcaggaatctgaaggtactgt

SEQ ID NO: 6802228 - DNA, 58 bp, Homo sapiens
gtgaacacagtacttgttcgtcttgggactcgccccaggggcaggattgctgtgtcac

SEQ ID NO: 6802229 - DNA, 116 bp, Homo sapiens
tgattggtgccagcttgaatcagttagttagatctagttgcagccagttgggaccagcctgaactggattgacctagtttaagtccttttgtgtcttcaggctgacttgcctttca

SEQ ID NO: 6802230 - DNA, 65 bp, Homo sapiens
gccaggagttcagatgcatgtttacctccttgaatcctttgggacttttgcatctaatatctggt

SEQ ID NO: 6802231 - DNA, 58 bp, Homo sapiens
actgtctagttctcttttctaaagatgtcagctcaatgggaacagaggacttgactgt

SEQ ID NO: 6802232 - DNA, 77 bp, Homo sapiens
agccctccattatgagcagacagtggttttacaaatcctctaatcccctgaaatgtaatactgtctctggagaggct

SEQ ID NO: 6802233 - DNA, 58 bp, Homo sapiens
agaagccactgctcccagtgagcagtagggcctggacttcatttagagcagggcttct

SEQ ID NO: 6802234 - DNA, 76 bp, Homo sapiens
agcaaggaggcacagccagctgcctttcacatctggctctaaatgagccacggcactggctctgtccacatttgct

SEQ ID NO: 6802235 - DNA, 87 bp, Homo sapiens
gtgcacacaccctcagaggacctgtgtggccagagccttctaaatggtgagctggataccagggttcttgacttgggtctgttgcac

SEQ ID NO: 6802236 - DNA, 58 bp, Homo sapiens
aggatggccagtctgactagtttcctcataaaaagaaagcagtctgactggtcctcct

SEQ ID NO: 6802237 - DNA, 60 bp, Homo sapiens
ccccattaagggtccatttttttctaattgccaatgaataaggaggccaaagtaatgggg

SEQ ID NO: 6802238 - DNA, 73 bp, Homo sapiens
cagccacccagcagaggaggcaagagcatggaaaatgtctctttcagccaattttcctgaggaaccctggctg

SEQ ID NO: 6802239 - DNA, 79 bp, Homo sapiens
gtgagtatagtgtagttcttctggtgggaaaattatataacgttaaatcatccttcttcatgaagatatatgtattcat

SEQ ID NO: 6802240 - DNA, 97 bp, Homo sapiens
gagaaaccatggagcaaggctggtcagatgtggtgaaataaatacagaaagctccctggaaacctttcctacatctgtatctctctttccctttctc

SEQ ID NO: 6802241 - DNA, 130 bp, Homo sapiens
cacccttgtataatcccctccttttcaatgtagttagaacctgttaccatagtacataatacattttacctgagtgaatagttatgttatatggcacagttgacctcaagatagggagattatcagggtg

SEQ ID NO: 6802242 - DNA, 75 bp, Homo sapiens
agctttgagaagctcatgtcttacttggataatgatcatctgagcaggttcccagagatagagctgtacgaggct

SEQ ID NO: 6802243 - DNA, 105 bp, Homo sapiens
aatagtagcacttgtttgtacttcgtagtttacaagttcttttcacatgtaacattcagaatcttgtaaaatcttgtgacttaggaaggacacatacatattatt

SEQ ID NO: 6802244 - DNA, 71 bp, Homo sapiens
tttcaaaagaaccctcaggcagaatgtattctcttattaaatgaatgtgagggatctgcctgctcttgaaa

SEQ ID NO: 6802245 - DNA, 96 bp, Homo sapiens
gacgtcggggctgttcaggcttctgctgtattaacacttgtcttcagaaagaaagcagtggagtttggtgcagtgagcacaagcagcctactagtc

SEQ ID NO: 6802246 - DNA, 89 bp, Homo sapiens
ccatttgtgtttttcacggtcttttagatgacaagtctagatagggtagatggcctcattagctgttatttattgtgtgatacaagtgg

SEQ ID NO: 6802247 - DNA, 74 bp, Homo sapiens
gttattgcagatggcacagatttagagtgcatcttttatgtatatgaaaatgttctgtgcatttatagcaaaac

SEQ ID NO: 6802248 - DNA, 74 bp, Homo sapiens
cccagtgggtgttgagtgggggttcgctgactaattgactgagtgagtgaagccctgtgtcagcttccactggg

SEQ ID NO: 6802249 - DNA, 70 bp, Homo sapiens
agtacaccagtgggagagaagcaagtagtaagtgcatttcctccttgttttcctgtttacacagtgtact

SEQ ID NO: 6802250 - DNA, 58 bp, Homo sapiens
cctggctccctggacctcattacctcagaccctggagataagagaaaaaggggcaagg

SEQ ID NO: 6802251 - DNA, 69 bp, Homo sapiens
gaggggacgtgtgggctgcacaggattctggggggctgacctaggaggggcagcagtgcaagtcctctt

SEQ ID NO: 6802252 - DNA, 58 bp, Homo sapiens
tgactttttaacttttgcctacagaaatgtccgtgctggctttaaggttaaagtgtca

SEQ ID NO: 6802253 - DNA, 78 bp, Homo sapiens
gaccttgaatttgtactgaccaattatttgaaagcctttgttaaaaagcatcagatttttagtcatttaagtgtggtt

SEQ ID NO: 6802254 - DNA, 60 bp, Homo sapiens
tggcagagtgcggcatcccctgtcaacctgctgtggtttcctggtgggctcactttgcca

SEQ ID NO: 6802255 - DNA, 71 bp, Homo sapiens
tccttcagctgcaagtccaaaggaattagctagcaaggctgaccttcctaagaggctggcagagaggagga

SEQ ID NO: 6802256 - DNA, 79 bp, Homo sapiens
ggtcagaggtgagatcgtatgcgcggcctaggggcgtctggcatgagcaggccctgcggaaatgatcattctcctgacc

SEQ ID NO: 6802257 - DNA, 81 bp, Homo sapiens
gcttgaggagcagtagagtacatggctccgcaatgtcttcaaagacctgggctttcgtttctctactctgccatcctctgc

SEQ ID NO: 6802258 - DNA, 67 bp, Homo sapiens
acaaaactagagcagcggggctgggttaggtcatcacttaccccactcctctgttttaactgtttgt

SEQ ID NO: 6802259 - DNA, 56 bp, Homo sapiens
cacccaggctggaatgcagtggtgccatctcggctcactgcaagctccgccttgtg

SEQ ID NO: 6802260 - DNA, 64 bp, Homo sapiens
gcgccctgttctccggccagtccagagcctcagtagggcagggctgcctgggagagcaaagtgc

SEQ ID NO: 6802261 - DNA, 93 bp, Homo sapiens
agcagggagcaaagttgcagaaaattaatatttgccacaaagaagtccttttcttcctgtgccttatgaattctttctgtacaagcacctgtt

SEQ ID NO: 6802262 - DNA, 99 bp, Homo sapiens
ttacctccattgaggctcagttttatcatctgtgaaatggggacagtcagccctgtctcacaggtaataggacacatgggcccagtatcctggacataa

SEQ ID NO: 6802263 - DNA, 70 bp, Homo sapiens
caacttggttgaatgctctcttgaaattctgaataattctagaacagggagccccagcatttccattttg

SEQ ID NO: 6802264 - DNA, 88 bp, Homo sapiens
ggagaatcacttgaacccaggaggcagaggttgcagtgagcccagatcacatcactgtactccagcctgggtgacagagtgagattcc

SEQ ID NO: 6802265 - DNA, 129 bp, Homo sapiens
tgaagaatgtagtcttataatcatttttgtcaacatggttttgaagggaggtcaaattcctgctaataatatgttggttttgaatctttataaagacatgacagcatgattttcaagaactttttttta

SEQ ID NO: 6802266 - DNA, 70 bp, Homo sapiens
gcggcttcctcagctgctggtgtatcgggtcctagttcggctggcggcccgggtccccagcagcagccgc

SEQ ID NO: 6802267 - DNA, 61 bp, Homo sapiens
gcagccaatgggggacttggccaagcgtcaggcactgatggaagactcctctcttggctgc

SEQ ID NO: 6802268 - DNA, 72 bp, Homo sapiens
tgggatgctagcttttagtcaactgtttaaaaaattattatctttaacagctcttgaaagattagctttcta

SEQ ID NO: 6802269 - DNA, 67 bp, Homo sapiens
attcagtgggtgctcagcacaatctctctctcttaaaagactgtctttatagagcattcatttggat

SEQ ID NO: 6802270 - DNA, 77 bp, Homo sapiens
gtccacctggcttcagttcctgtgttgttttcctagcactatggtggacagcacacaagctggctgctaagagggac

SEQ ID NO: 6802271 - DNA, 62 bp, Homo sapiens
tgacagctttgtcatttgatttgggacatgccgatggctccacatcaagggcagagaggtca

SEQ ID NO: 6802272 - DNA, 86 bp, Homo sapiens
tctcatgatttgcttagtgtcaaatagcctgagcttgctttaccagaactatctgcaacatcaggatcttgttacagtaaatgaga

SEQ ID NO: 6802273 - DNA, 60 bp, Homo sapiens
ctgctttttctaggaggacaattatatttttgattaatattgtaattttagagaaagtgg

SEQ ID NO: 6802274 - DNA, 57 bp, Homo sapiens
tagaattgttgtacagaataaatgagcatttgatgtgctcattacagagtagttcta

SEQ ID NO: 6802275 - DNA, 100 bp, Homo sapiens
gcagagtattttggttgaactacaaaaatcaacatttagtgatatatcctaagtggactgtctttgatatttgttttcttttagcacaatgaatttctgt

SEQ ID NO: 6802276 - DNA, 103 bp, Homo sapiens
gctgattaaattcctcaattttataattacttgataggtctaatatgcaagaaaatgcgtccttacgcctgctgagtttagtgaaattagaaattctgacagc

SEQ ID NO: 6802277 - DNA, 78 bp, Homo sapiens
tttggcagagtcttttgtcagtaatgttagagatgggagtggacaaccagagacaactgagcagaggaaatgaccaag

SEQ ID NO: 6802278 - DNA, 75 bp, Homo sapiens
ggaggtgacatcccggcagcagaggccctcttcttccagggggttctcgccactgctgttgaaggtgacatagcc

SEQ ID NO: 6802279 - DNA, 80 bp, Homo sapiens
gttggaaggcacagttaaagggtcatgtgaccaaggagggaaatgcctttgtcacatgactttttggtggcctgattagc

SEQ ID NO: 6802280 - DNA, 55 bp, Homo sapiens
agtgccctgtcactggaactgacaatacttgctccagccatccagtggaggcact

SEQ ID NO: 6802281 - DNA, 91 bp, Homo sapiens
ctcccctgccaggccgtgtggggctccctggcagcctgtcattactgcattatggcaggatcctagccacagccccagctccggtagggag

SEQ ID NO: 6802282 - DNA, 68 bp, Homo sapiens
gactacttcccagaacaatgtaggctttacacccaagagacaagcctcaggacattcaggaagaagtc

SEQ ID NO: 6802283 - DNA, 81 bp, Homo sapiens
ccttgctgattttagagcttctgttcatgcctgctggcagcatgccagtacagaaggagctttggattcactaatgcttgg

SEQ ID NO: 6802284 - DNA, 77 bp, Homo sapiens
ctggccttaaagatacggagatgaagacagcccagctctggtcctcgggcagctcacctctggtccagggagggcag

SEQ ID NO: 6802285 - DNA, 130 bp, Homo sapiens
cagggcgcgtcgcgctggccgttccagccggggtcaccgcgctgctcgccccacatgccctcatggctgttgttccagggggggcagtggggtgggccgccctggtggtgcgggtagggtggctgctctg

SEQ ID NO: 6802286 - DNA, 57 bp, Homo sapiens
tggggctgggctcatgcagggcagacacttgaatctgcctgtccaagctccacccca

SEQ ID NO: 6802287 - DNA, 61 bp, Homo sapiens
gccctccccacttgctccaccttcctcccaggacgaaacctgagccagagtggggacaagc

SEQ ID NO: 6802288 - DNA, 68 bp, Homo sapiens
tgtatcactcagcaaagtgtctggctgcagttggtgttcagcagtaaatattttagaatgagtgaaca

SEQ ID NO: 6802289 - DNA, 128 bp, Homo sapiens
tcgctgcttgccaaaaataagccgtgaaacgtatttcagagtagatcgttatttacttgctggcgaggagccacagaataccatttacatttgaaaatagagcgctgcaaagtttttataagtagtga

SEQ ID NO: 6802290 - DNA, 82 bp, Homo sapiens
tatttgtattctagtagaatcaacctatgagagagtctgttaagaccctataacactttccgtaggtttagtaataaaaata

SEQ ID NO: 6802291 - DNA, 77 bp, Homo sapiens
tgaatctaaagtcgtgagatttctactttttggctccacgctagagctaagagtggaagctcatctaacaaaattta

SEQ ID NO: 6802292 - DNA, 72 bp, Homo sapiens
ttctcactgtataccagggcctgtgctgagtagacgatctctttgagaccaccacagtcctacgggtgagga

SEQ ID NO: 6802293 - DNA, 62 bp, Homo sapiens
ttttggggatgacaggttaggaaccttgttgctaagtattcctgtggcatgtctccttggag

SEQ ID NO: 6802294 - DNA, 61 bp, Homo sapiens
ggcagctgggtcacaccgatctgtgtttgggaaagaccggagttggattgtacttgctgct

SEQ ID NO: 6802295 - DNA, 69 bp, Homo sapiens
gcatggagtgtctattggggtaaagaaagagcaaggtcattcgttcttaactcaaatatatatccatgt

SEQ ID NO: 6802296 - DNA, 67 bp, Homo sapiens
gaatttcaggacaactggaaggacagaagtggaaatatcacaatggatttcagttatcttgaccttc

SEQ ID NO: 6802297 - DNA, 69 bp, Homo sapiens
ggcaggactggcgtgaaggtggccatgaggagttaactctgccttattctatgtcttctgccacctgcc

SEQ ID NO: 6802298 - DNA, 74 bp, Homo sapiens
gaatattagggctgctttgtattctgctaatttcaaaagatatgtagctcaagtgcaagcattctattgtattc

SEQ ID NO: 6802299 - DNA, 125 bp, Homo sapiens
gctccggccttaggcggcacccgggcctgaaggggttgtttgggcctcaggcggcgtccagggcggccgaacttgagggccaggcggggacagagcgcccgagtagccgcgccacggccggccgc

SEQ ID NO: 6802300 - DNA, 61 bp, Homo sapiens
ttcttagccataattgtttttcccagggacacaagatcgtcttggcatgtttggctaagga

SEQ ID NO: 6802301 - DNA, 112 bp, Homo sapiens
ctctgcttataatgtgtgcttttcggaggcttttcttagcattaacggacgctctgggagaggagaaagttggcagagagaagcctagcaaatatataaataagctttggag

SEQ ID NO: 6802302 - DNA, 66 bp, Homo sapiens
ccatctcaatccccacacccctggcccagtggtcagagctgtggtcactgttggggaatgaggagg

SEQ ID NO: 6802303 - DNA, 90 bp, Homo sapiens
ttgtgtttcctgacattccaagaagtcctgcaaaactgaaaaatacaatcatcgctgcaaggtgctttttggtgtcacagatatgcacaa

SEQ ID NO: 6802304 - DNA, 65 bp, Homo sapiens
atggaccagagcctcattctgtgatgctatcatttctgcatccacagattcactgcactggccat

SEQ ID NO: 6802305 - DNA, 63 bp, Homo sapiens
actctcagtggattgacatgaaaaaggctgattgctttataattatcacagtccagtgcaggt

SEQ ID NO: 6802306 - DNA, 73 bp, Homo sapiens
tttttatctgacctcacttcttaatttagctccatttcagatcccttgctaagttagaagggccagatgaagg

SEQ ID NO: 6802307 - DNA, 97 bp, Homo sapiens
taagtttaaagctcagtcatgttatcagacacagagtacttcattcattttgatactatgaagtgctctgtggtaggtatgactatctcacaattta

SEQ ID NO: 6802308 - DNA, 108 bp, Homo sapiens
gagtgctggcttctggacccagaggctgattcggggaacagcaatcttctagcagaagagtctgcctggtcacttggctgtctgcatctgggtcaatattcagcactc

SEQ ID NO: 6802309 - DNA, 76 bp, Homo sapiens
ggccctcaggaaaggtgagagcggccgcgtccctccgctcacgtgggcctcgcacgctcctcaccgctcccgggct

SEQ ID NO: 6802310 - DNA, 76 bp, Homo sapiens
gtcccatgctgagatgagggagctggaggaggggagactggctctcactcctcattgctgcccattgggatgggat

SEQ ID NO: 6802311 - DNA, 66 bp, Homo sapiens
actttcgggcatcttttcccttctactaatcatgaaaacaagaggggcaaatgtgagcctggaagt

SEQ ID NO: 6802312 - DNA, 60 bp, Homo sapiens
cctgccttctaaagcgcccgccaggacaggctcctggtgggttgtaaggagaacggcagg

SEQ ID NO: 6802313 - DNA, 61 bp, Homo sapiens
taggtctgtgcagaggctgagccacatggttcagtatattagcgttgcagaggtgtttcta

SEQ ID NO: 6802314 - DNA, 90 bp, Homo sapiens
ggtaacttaaaaatgtactcaaactcactaagacagatggtctgaaataatctgaattatctgtgggtagagtgagtacttgattaaacc

SEQ ID NO: 6802315 - DNA, 81 bp, Homo sapiens
aggctgttgaggcaatttactgcttctcaataatttagtctcatgaaaaagtacagtggcagtaacattccacaatagctt

SEQ ID NO: 6802316 - DNA, 90 bp, Homo sapiens
acagatggtttgtggtagagcccagatctgaaccttgcctgttgggccccaagggacccaaagttcaggctctatcccagaccgctctgt

SEQ ID NO: 6802317 - DNA, 83 bp, Homo sapiens
tgttaggctgaaacatatgaagatgtctttttgtaggtcaaaatctgtcaaatattgacagctttattacattcaatctgata

SEQ ID NO: 6802318 - DNA, 79 bp, Homo sapiens
cccaggctggagtgcaatggcgtgatctcagctcactgcaagctctgcctcctgggttcacgccattctcctgcttcgg

SEQ ID NO: 6802319 - DNA, 65 bp, Homo sapiens
gaacaggatcataattattctgtaaccagcagtctgtgttggttacagaaagtatgcttttgttt

SEQ ID NO: 6802320 - DNA, 91 bp, Homo sapiens
ggcctgagtctctctagtctttggggcatggccagtccttcatttcctgggcaggaactgttccctcacaggctggagaccttacagtgcc

SEQ ID NO: 6802321 - DNA, 71 bp, Homo sapiens
cagtgataattatggccactaaccatattgagcaattgagcaattgcaatgtgttagatggttttacattg

SEQ ID NO: 6802322 - DNA, 90 bp, Homo sapiens
tgtaaaaattgaaaccaaagatgtcccctcactgtgctgccctcagatgcaggtattagacagcaggggagtctggttttcaaaactgcg

SEQ ID NO: 6802323 - DNA, 69 bp, Homo sapiens
ctctggctttcccagggaggaggaagaagagctgaacctgcccatccgccctgaggaagagcgccagag

SEQ ID NO: 6802324 - DNA, 68 bp, Homo sapiens
ctgctgcattactgtgatggtggtcctaagtagtttcctttccataaaagctcaaagaatgcatgcag

SEQ ID NO: 6802325 - DNA, 55 bp, Homo sapiens
ggcgcgctctccttctggcacccaggtcgttttgcctgggccggggcagcgcgcc

SEQ ID NO: 6802326 - DNA, 66 bp, Homo sapiens
ggagactgcattgtccaagggttcacagcaagcattggtagaaccagaagcagaatgcaagtttcc

SEQ ID NO: 6802327 - DNA, 118 bp, Homo sapiens
cagctttctattcctatgtgctcactgtgcctactgtgggagcgtcagttggtaggagagagttccagttagaggctttcagcggtaggtcccaggaagcaatgaaagagatacgttg

SEQ ID NO: 6802328 - DNA, 60 bp, Homo sapiens
aggggagcgcacctgtatgtgtgtgcgtcttgcatctgtgcacatgctgtgtgtttctct

SEQ ID NO: 6802329 - DNA, 84 bp, Homo sapiens
acaagagcccaacatctgtatcattagtacatcaatacgcttgtgtgtatgtgtggatagatgtatatactacatgttctatgt

SEQ ID NO: 6802330 - DNA, 74 bp, Homo sapiens
gtggtatgtctcttgagccactaatagattgtcatgtaatatgcagttttcaaaagtttacaggataatgccat

SEQ ID NO: 6802331 - DNA, 58 bp, Homo sapiens
ttagtgagctttattgaagactgctcaaaagaggaaatctttgattaagcttgactag

SEQ ID NO: 6802332 - DNA, 79 bp, Homo sapiens
ctcaagcatatatgggcttaataaataacatgtcattccatgatgatagggacagacatatttggcccatagcttagag

SEQ ID NO: 6802333 - DNA, 85 bp, Homo sapiens
ttgtattgggtttctgtcattttcatcctaaggagcacctatgaattcagggcccttgtcctgtaagttgactgatacaatgcag

SEQ ID NO: 6802334 - DNA, 65 bp, Homo sapiens
gattgcttgctcaactctgttgtttgggaaggtgttcttgaattataggcagttggtaaacagtt

SEQ ID NO: 6802335 - DNA, 77 bp, Homo sapiens
ttgtgttttttcacagtggccctctctgagttttaaaactgggaattagaagggagttattgatatgaaaaccacga

SEQ ID NO: 6802336 - DNA, 65 bp, Homo sapiens
ggaacttagaatatgttcaagatttcattcctgttttcatctgagacttggcgtttttaagtacc

SEQ ID NO: 6802337 - DNA, 56 bp, Homo sapiens
gcatggcagggattagtagtagctgggaggggacagttactcagttcctgccatgc

SEQ ID NO: 6802338 - DNA, 130 bp, Homo sapiens
acactgtactctcttttggtctttgttaggttttttttccccctttttttctatcactcactctgtggcagctgagaagtactacaagagagggaggacagagatactgaacaaggctgtgtatatgtgt

SEQ ID NO: 6802339 - DNA, 74 bp, Homo sapiens
gtgtgattcttaatctgcttctgacatctttgaaggtgaagtccatttcagacagcagggagcaggattcacac

SEQ ID NO: 6802340 - DNA, 81 bp, Homo sapiens
attaagtaggtgcaaaagtaatgcaggttatgccattattttcaatggcaaaaactgcaattacttttgcatcaacctaat

SEQ ID NO: 6802341 - DNA, 59 bp, Homo sapiens
caaagtgctggaattacaggtgtgagccaccgtgcctggcaaggagccagatactcttg

SEQ ID NO: 6802342 - DNA, 63 bp, Homo sapiens
acttggatctcaatttcagtggagaccttactgtttttgtctgccctgatcttgatctattgt

SEQ ID NO: 6802343 - DNA, 57 bp, Homo sapiens
accagggcacattccggccagatacccccactgttctgctgcttctttgccctgtgt

SEQ ID NO: 6802344 - DNA, 120 bp, Homo sapiens
ggggcttgttgtgagaatgcagtggaaagtggggcagccccagaaacagttcagcagctgtactttgacctgagctccggggctgcttccttctggctgtatctcaccttctcatgcccc

SEQ ID NO: 6802345 - DNA, 63 bp, Homo sapiens
ggtctggctgggccgcctattttgggagcaggagtggccagcccgaggcttcccaggcaggcc

SEQ ID NO: 6802346 - DNA, 56 bp, Homo sapiens
tcatggatctggtgaacatttacaggaatctgtaaatgaaacagctaaatccttga

SEQ ID NO: 6802347 - DNA, 71 bp, Homo sapiens
ccttctcaccaggtgtaaagtggttagttaaacatctaactttggccacaagtaccctgaagcagagaagg

SEQ ID NO: 6802348 - DNA, 70 bp, Homo sapiens
gtaagttactagtaccaggccccaattatttaaagcaccaccattttggggtagtgtgactaaaacttat

SEQ ID NO: 6802349 - DNA, 59 bp, Homo sapiens
tccttctatatgacttctaggcaggtcatagaacctctgtaagccttagtctagatgga

SEQ ID NO: 6802350 - DNA, 72 bp, Homo sapiens
gggtctcaaactgtggcatgttgaatttgttggcctatttaccaacaaacagctaacatatgttaatgactc

SEQ ID NO: 6802351 - DNA, 69 bp, Homo sapiens
ggtagtaaaatatgtgagcagcgttctgtggaagacacacaatttcctgtccatatgtgctgtgctacc

SEQ ID NO: 6802352 - DNA, 120 bp, Homo sapiens
ggccatgcccttcccttggtggagggaaaaaggaggtggcagaactatgtgattgctgttgaagacacactcaaaagggcatttgttacttttcccattgaccaaaagaagtcatatgcc

SEQ ID NO: 6802353 - DNA, 59 bp, Homo sapiens
gagcctttcttggtttgtcaggcagatacacctctggcctgattttgctaagagaattc

SEQ ID NO: 6802354 - DNA, 74 bp, Homo sapiens
ggtgtggggcaagggtgggattggaggaagctgcctgggcaagcgaggtcctcctcacgctgttgcttgtcacc

SEQ ID NO: 6802355 - DNA, 103 bp, Homo sapiens
agccagaggcttgttagagaggggtgtggagaagaaggccactgcagggatgagccctgggcctgatttatcatcttcacagctgatctgagcaagaggggtt

SEQ ID NO: 6802356 - DNA, 60 bp, Homo sapiens
tggaattcagtggccagacatgatgcttgttggcatcacatagtggggcattggaatcca

SEQ ID NO: 6802357 - DNA, 85 bp, Homo sapiens
gattttccctggactaacagtaaagtaagttagcttaggtttaattggaatggggctgtcttacttgattgaactaatgaaaatt

SEQ ID NO: 6802358 - DNA, 68 bp, Homo sapiens
ggatggccagagttgagggggtttcacatggtgatgagctccttgaagactctgagctctaggcagcc

SEQ ID NO: 6802359 - DNA, 76 bp, Homo sapiens
gttttcttgtagtgccaggtttctgtgataaaggtataaacacagtctaacagaaattctgacaaaatgagaagat

SEQ ID NO: 6802360 - DNA, 116 bp, Homo sapiens
gcttgtaatgtgtcattccttttactgtgtcacatggtttactgcagcatatccctacaaaatttatattgtgctgtgctggagtgactggtatgttggagtggatttttattagc

SEQ ID NO: 6802361 - DNA, 70 bp, Homo sapiens
tcactgtgagcaattcaaaggcaggaattaagtcttattaatttctctcttccgttgcccagcatagtga

SEQ ID NO: 6802362 - DNA, 57 bp, Homo sapiens
gttctgaatgatagtcttgaactcttgagctcagaagttcctcttgtcatcagatgc

SEQ ID NO: 6802363 - DNA, 82 bp, Homo sapiens
gggccaagctggcctctcagaccaaactgtccgatgcaaatctagaatccccagagggtggaggccaggctctactaggccc

SEQ ID NO: 6802364 - DNA, 94 bp, Homo sapiens
cgtgccaaacactgtttttgttggtggaattgatgctagggtattgtatttgtacctcatttttaccttaacatacatcatgaacaatgggatg

SEQ ID NO: 6802365 - DNA, 74 bp, Homo sapiens
ggttttcatttgctttgaatttctggtacctccttttcttggagagttgacaggccaaggcccatctgaaaacc

SEQ ID NO: 6802366 - DNA, 59 bp, Homo sapiens
gtgctctttataaaagtcattatgtctatttttagacatttcagtgtttatgaagacat

SEQ ID NO: 6802367 - DNA, 66 bp, Homo sapiens
cagcaggtctcagactggcaggcagtgagctagattatgcctgaaaacctgttttgttggcctatg

SEQ ID NO: 6802368 - DNA, 84 bp, Homo sapiens
tctgtggccaggcagacacactgtccagaggaccctgtgaccaagggaacagggctcctaggtggtgtgctttctggtaccaga

SEQ ID NO: 6802369 - DNA, 62 bp, Homo sapiens
gcttgcatttcacaaatggccacatcattttgtcaaattgtggagccacttggaaattgggc

SEQ ID NO: 6802370 - DNA, 76 bp, Homo sapiens
gtctctgttggtgcttttcctggctgtcatgccctagtaacctactgaggtctcaggtggggaagccacagttggc

SEQ ID NO: 6802371 - DNA, 55 bp, Homo sapiens
ttgatgtagcctaagacagaacctgcacctcccactgctgcttgggagacgtcag

SEQ ID NO: 6802372 - DNA, 65 bp, Homo sapiens
gggtgcagccttttaggactatttgtgtttggttatgatacaagtatgttttaaaatgttttccc

SEQ ID NO: 6802373 - DNA, 72 bp, Homo sapiens
cctttcacacttttgttctaatccggttcttttaaccgaggacttcaaatggaaacaaaacaaattgaaagg

SEQ ID NO: 6802374 - DNA, 56 bp, Homo sapiens
tccagaaaattttacagtgccttgttgtcagtgtgaagaactgttgattttctggg

SEQ ID NO: 6802375 - DNA, 95 bp, Homo sapiens
tatttcctgaaattctctctttggagttataacagttactagattaaactggtaatttaattctctgacttgaagaagtggtatttctggaaatg

SEQ ID NO: 6802376 - DNA, 95 bp, Homo sapiens
tccatgctgtatatactgcctgtctaccagtcacttagcggccatctaggctgttagatggactgtagcagcaacatagtgcttatggtcaagga

SEQ ID NO: 6802377 - DNA, 65 bp, Homo sapiens
cagcctcccgagtagctgggattacaggcacctgccacaatgcccagctgattcggtggtggttg

SEQ ID NO: 6802378 - DNA, 59 bp, Homo sapiens
gttccaaagttagagtgtattgtagggcattaactaattatgcctctaattttgcaaac

SEQ ID NO: 6802379 - DNA, 55 bp, Homo sapiens
gactggggttggtatgtgggaagaaaccgatttgtccctgctttctggcccagtc

SEQ ID NO: 6802380 - DNA, 56 bp, Homo sapiens
gcttggccagcagccgggatgcccacttctgcttgatctcgggcttctcgcccagc

SEQ ID NO: 6802381 - DNA, 69 bp, Homo sapiens
gtgccaggcaagggggcgccaccttccgcggtgtggcgcgggggccgggggtccctttgggctgggcac

SEQ ID NO: 6802382 - DNA, 78 bp, Homo sapiens
agaggttggggcaggcagtgactgttcagacgtccaatctctttgggacgcctcttcagcgctgtcttccctgcctct

SEQ ID NO: 6802383 - DNA, 56 bp, Homo sapiens
gtctcatagatattcatgtagtagagcttggactgtcacagaaatgtaagtgagac

SEQ ID NO: 6802384 - DNA, 62 bp, Homo sapiens
gccacctgtgtgggcctttgtgcaaatccaaggaaagcatccggtgcccaacacaggctggc

SEQ ID NO: 6802385 - DNA, 62 bp, Homo sapiens
atagaggtgaaataaaacattagaggtaaatgattttacccactgatgcattttctctctgt

SEQ ID NO: 6802386 - DNA, 57 bp, Homo sapiens
gtggcagtctcatctgtggctctccttgggactgggacactcaatgagacctgcagc

SEQ ID NO: 6802387 - DNA, 61 bp, Homo sapiens
cctctctttccagatgttagattatgtctgcctgatcatgtctgccaatttggaaggaagg

SEQ ID NO: 6802388 - DNA, 55 bp, Homo sapiens
ggtaatactcttcctagcgctgaaatggaatagttttaggaattgaagagtggcc

SEQ ID NO: 6802389 - DNA, 58 bp, Homo sapiens
gctatagggtacatttgtgtttgacttatcccttgtgaaacatggatagctctgtggc

SEQ ID NO: 6802390 - DNA, 58 bp, Homo sapiens
agggatatgtatgcatatgtatatgcatgtgtatgtatacatatgtgtgcatatcttt

SEQ ID NO: 6802391 - DNA, 88 bp, Homo sapiens
acattttcataataatttacagcccatgatttgttatttatatataattaatatgtgaagaattaatgtgaatcattattttaaatgt

SEQ ID NO: 6802392 - DNA, 106 bp, Homo sapiens
tactctcatgaaaactctcttaactgttttataaagtccaaaagtggttggagaaaagaaataactaatggtattgtgatatggtgagaaagataatgtgagagta

SEQ ID NO: 6802393 - DNA, 111 bp, Homo sapiens
ggataagggtggcattgtgaggatctaaggagataccacctaccaaactgcattgatctaacttggcatgtattatcttcatagatttttacaccaatgccattctaatcc

SEQ ID NO: 6802394 - DNA, 100 bp, Homo sapiens
gcttttcaactcctaaggctagttcttttgaatattctcaatggtggcagatatttgtcctattagaatgattaaattcttggaaataggagtaaaaggc

SEQ ID NO: 6802395 - DNA, 56 bp, Homo sapiens
accctgtcggtccatgatgatgagaacttcccatctatccagcgccaggcagaggt

SEQ ID NO: 6802396 - DNA, 101 bp, Homo sapiens
caggagaggggtccgggcgggagccctgggctgtagataagcaaaacgcacccattttctctcctatttactccagaggcacctctcctcccccactcctg

SEQ ID NO: 6802397 - DNA, 109 bp, Homo sapiens
tataatcaaggaaatgcggcatatgtttctaggtctaaaatgcaagctccttgagaagaagcttattcatcttgtgacctaaacacttagctcaaagtctttcattgtg

SEQ ID NO: 6802398 - DNA, 59 bp, Homo sapiens
tggtctttaaggtagctgtcatggaaataaacaccatcatgcctgcttttaaaggctca

SEQ ID NO: 6802399 - DNA, 79 bp, Homo sapiens
cctaccacagttacagccttcatctttgccttgcagggtaaggcacgcataagagggggccacgttgtgcaagggtggg

SEQ ID NO: 6802400 - DNA, 81 bp, Homo sapiens
gtactggtgttgaaacctttttattgaaggctggatgcttctaaaatggtacctgcatacaaaggtttacaactgatgtac

SEQ ID NO: 6802401 - DNA, 62 bp, Homo sapiens
gggatgcagactacagggcttaggggccagttcattctctttcctctggagtcattgctccc

SEQ ID NO: 6802402 - DNA, 55 bp, Homo sapiens
gagtagcagtggagccagcgctgaacccaactgcctggctccaaagctgtgactc

SEQ ID NO: 6802403 - DNA, 83 bp, Homo sapiens
tcaccaactgaacaggtgttctggaaatcagcagatcctgaggacccgggacggctactgcaattctagagcaccagtgggga

SEQ ID NO: 6802404 - DNA, 77 bp, Homo sapiens
tttcccatggggttcagccttgtgccagcctttggggttccagaggtgaacaggaggctgtttctcccctcaggagg

SEQ ID NO: 6802405 - DNA, 81 bp, Homo sapiens
agcattcacattttagtttctaatgttagggtaaggattgtaggtgtttggcccatcatggaaaataaagtgaaaaatgtt

SEQ ID NO: 6802406 - DNA, 94 bp, Homo sapiens
gaggcagatatggcattttggtaatgtggtatacagattactgaataattacataagctctggacagccacatttcctaacatgcatgtgcctc

SEQ ID NO: 6802407 - DNA, 119 bp, Homo sapiens
agcggggcgggggggaggtgctcttttcgtctctggccacaaggggtcgctgtgacctcgcctgtgcatccggtggtcattgacatcaaagccaggtctccccctccccagccccgact

SEQ ID NO: 6802408 - DNA, 78 bp, Homo sapiens
gtgcttatgactaattaggtattcactttagagttttaagtaattggtcagaggcttatacctgattaggatatgtac

SEQ ID NO: 6802409 - DNA, 55 bp, Homo sapiens
tgtgcatttgagagatatccaggcacagtccccctgggtgattcttatttgtaca

SEQ ID NO: 6802410 - DNA, 62 bp, Homo sapiens
tgccagtgtgtgccttaagctcacttgcttctgtaagccatctctttagacacacctggaca

SEQ ID NO: 6802411 - DNA, 64 bp, Homo sapiens
caagttcctgttactccccagaatttattattggtgtattattttggtaagaaggaggagattg

SEQ ID NO: 6802412 - DNA, 75 bp, Homo sapiens
tattatgctgggaactgcaggtgttacataaataaggtagacagtttgtgtcctcatgaggtttgcagggtaata

SEQ ID NO: 6802413 - DNA, 55 bp, Homo sapiens
tcagtcccaaggtcctgaggtggtcccgtaggacctcagaaccatctttgggtga

SEQ ID NO: 6802414 - DNA, 86 bp, Homo sapiens
tcacatcaattgattgtacatgtgctatttgttttgtattcccctcagtgcatagtacatcagcatataacagttaatagtagtgg

SEQ ID NO: 6802415 - DNA, 116 bp, Homo sapiens
ctgatggaagtgacgctccttacgtccagctccagcttttgcaccaaggcactggggtctatcttggtcctggcaaagatgttggtgttgacgaacggaggtataattcttattag

SEQ ID NO: 6802416 - DNA, 66 bp, Homo sapiens
gtcattctcagatcttagaggaatattaaagtgtgaatgttttatttctaagattgggaaactgat

SEQ ID NO: 6802417 - DNA, 67 bp, Homo sapiens
aaaggtggttaacgttggatcacttgtaaaacggaacctcaaggagtctaaacaaaaatgcaccttt

SEQ ID NO: 6802418 - DNA, 99 bp, Homo sapiens
gcaggggtgctcaggggctgctccccttttattaatgacagcggtttctctcaaggaagtgtagtgccctcccctttgggatagttgcctgacccctgt

SEQ ID NO: 6802419 - DNA, 76 bp, Homo sapiens
gtccccgacgtttggcttgatgaaacattttcttgatatttttcaacagttatcagcgtgcaaatctttggaggac

SEQ ID NO: 6802420 - DNA, 96 bp, Homo sapiens
gacaacatttttatttgatattcccgatttaaggtaaaagctgcgtgagattaacacaagttacagaattagattattagagatagaatgtacatc

SEQ ID NO: 6802421 - DNA, 65 bp, Homo sapiens
atgtggttgcttcatctgtaaataaggataaattatttcctcatttacaggtgaagcaactatat

SEQ ID NO: 6802422 - DNA, 76 bp, Homo sapiens
aggaggcggaagggaaaggagggaaacagagcggtgaggagtttcacttttgttctctcttttctgtgtgcttcct

SEQ ID NO: 6802423 - DNA, 56 bp, Homo sapiens
ggctgctatattggttcaggcttgggcacatgacccaagccagaccaatagcagcc

SEQ ID NO: 6802424 - DNA, 63 bp, Homo sapiens
atgtcttattaagaccagtgactcttgtgactaattcacaagtcatgttttttggaaagatat

SEQ ID NO: 6802425 - DNA, 75 bp, Homo sapiens
gtctcagttaccatctctgtagtcagtaatgttgagatgaagcaatgttcactgtactggtgatggttttgagat

SEQ ID NO: 6802426 - DNA, 63 bp, Homo sapiens
gctcaagagccagcgtctcctggcagtgccagagatacagtggagctggaccctttcttgagc

SEQ ID NO: 6802427 - DNA, 76 bp, Homo sapiens
actttattcataatcaccaaaaactggaagcaacccaaatgtccttcagttggtgaatagaaaaacaaactgaggt

SEQ ID NO: 6802428 - DNA, 57 bp, Homo sapiens
gctgcttggtgtccctctgagtcttgtcttggtgagggtccagggatcaccaggtgt

SEQ ID NO: 6802429 - DNA, 84 bp, Homo sapiens
caatgccctgcccaaattgcttactgtttttcaccttgttcccaaggttgaggaacagaaagtagcctgtggttggaggaagtg

SEQ ID NO: 6802430 - DNA, 77 bp, Homo sapiens
aatgttgtccctggccaatctagggctgttatgagattgctcataacagttgctacttaaattagctagaatgcatt

SEQ ID NO: 6802431 - DNA, 68 bp, Homo sapiens
tcagaataaaacttattagaattgtgtaccatcaccaagtatgaattctgcaataggtttagttttgg

SEQ ID NO: 6802432 - DNA, 91 bp, Homo sapiens
ggccgcgtgcgtccccactccaggcccacgtcgaggaggggcacgtggtcggccccctttgttgggagctgggcactggaagggaccggcc

SEQ ID NO: 6802433 - DNA, 61 bp, Homo sapiens
caccgttcagccctgtggcaggcaactgtgcctgtgtatacaacttataggagccacggtg

SEQ ID NO: 6802434 - DNA, 62 bp, Homo sapiens
acaggaaatgaaatggtatctaaaataaacaagctgtggtatgatgattattcattttctgt

SEQ ID NO: 6802435 - DNA, 77 bp, Homo sapiens
atcagtgggcataggcatttggagtgttgtgaattttgcagttcaagagtactgttgatgttgttgaccccattgat

SEQ ID NO: 6802436 - DNA, 56 bp, Homo sapiens
gtggcagcatggcttttagctgggaattgccctccagcctaagagctagctgtcac

SEQ ID NO: 6802437 - DNA, 75 bp, Homo sapiens
ttccttttgtatttttcccagctagcttctgcacccagaaccaactataattttggggatccagtgcaaaatgaa

SEQ ID NO: 6802438 - DNA, 59 bp, Homo sapiens
attgggtgtgagtgcgtaggatcagaaaataaaattttccagtatctcgctctcccaat

SEQ ID NO: 6802439 - DNA, 82 bp, Homo sapiens
gggcagaattggggaaagagggagtgtcggtcaatgggtggaaaaggtcccgtggctgtcatgcccttcttacctcctgccc

SEQ ID NO: 6802440 - DNA, 124 bp, Homo sapiens
tcctatagaccatgtgttgaaatcttgtgataatgtgtgtgtgtatgtttacttttccttgttgtatttacagggaattgtgcttgatacatactaggtacttcataaatacttgttgaatgga

SEQ ID NO: 6802441 - DNA, 56 bp, Homo sapiens
tacacaggctgcctctttgcatgttccttgaagttgtgcaggacagagcctgtgtg

SEQ ID NO: 6802442 - DNA, 118 bp, Homo sapiens
ggttgtgctctttatatatctgctggttgacatggtgggcctcatcacagtgcattagttcacccgggctcagagagaggctcaccattctgtcagcagtgcaacatcatgtgcttcc

SEQ ID NO: 6802443 - DNA, 66 bp, Homo sapiens
gatgtccagggggcttgactggtttctctgcttagggtcttactagatattgtccagcctgggctc

SEQ ID NO: 6802444 - DNA, 58 bp, Homo sapiens
tatgcaatgcgctgacatgcaggttgattgaaaggcttcattcacagggtattgtata

SEQ ID NO: 6802445 - DNA, 75 bp, Homo sapiens
agtcctaggttaagaaactttaatctatggtcaagttaaccaaggagtttggtattttaggaagaggctagggct

SEQ ID NO: 6802446 - DNA, 92 bp, Homo sapiens
ctgtaggctcttctccaggtccaggttccgtttctgcgggtcgctctgcctgagctgcgggctctgcggcctcaaggactggacgcccacag

SEQ ID NO: 6802447 - DNA, 62 bp, Homo sapiens
catgggggtgctgaggggcttggctgggactttgccccctgcccacttggccaccttctatg

SEQ ID NO: 6802448 - DNA, 55 bp, Homo sapiens
tttggaatagcatagaagctcatctgtataacaagagttaatatggtgtttcaaa

SEQ ID NO: 6802449 - DNA, 57 bp, Homo sapiens
gagagaagggacttctacactttcttgccatgtgggaatgtgctagtgtcttctctc

SEQ ID NO: 6802450 - DNA, 103 bp, Homo sapiens
gaggtgatgtaagcaaagcatcagaacagtacctagcacatagtaagtggttatcatcagcttgtgtgtctgctgtatatgctgaactgcttgagtccatctc

SEQ ID NO: 6802451 - DNA, 85 bp, Homo sapiens
tcggcagccagcgctgcgggggaggacgtggctcctgggattttgcctgtcggagctgtccgcccctgggccgagcgcctgctga

SEQ ID NO: 6802452 - DNA, 58 bp, Homo sapiens
atctgaagtccttataatctgattttcactatattagatttgtgtaggggctacagat

SEQ ID NO: 6802453 - DNA, 64 bp, Homo sapiens
tgcccaaggccatatgatataagttctcttaccttctacacttgtgtcatggttgactttggca

SEQ ID NO: 6802454 - DNA, 98 bp, Homo sapiens
ctgaatacttgtgtctcctgaaaatccttatgttgaagacctaacctccaatgcaatggtgttaggatgtggggactttgggagagaattaggtttag

SEQ ID NO: 6802455 - DNA, 64 bp, Homo sapiens
tgaatacatgaaccctcctgtggttcactgaataaatgaaaccacaggagggttcatttattca

SEQ ID NO: 6802456 - DNA, 117 bp, Homo sapiens
ttcagcctgtgggccagttttccaatctctgatttacagcatctctgagatttcttactgaacagggagtgttatagataggaatgattgatggctaaaagctccataaaggcagag

SEQ ID NO: 6802457 - DNA, 98 bp, Homo sapiens
ttcataggatgtggttaggttaccagtaatgtaactttgcaaacagcttttgggaattatttactagctgggaaaattttaatcaatccttctctgaa

SEQ ID NO: 6802458 - DNA, 83 bp, Homo sapiens
aggagcttaccatctttagtgtgaatttattgagggaaattaagtccctgcatttcacagactgagaaatggcttctgttcct

SEQ ID NO: 6802459 - DNA, 66 bp, Homo sapiens
ccaggacactgcttcacagcagagagcggctggagaagacagccgaagctttgagcagtgatttgg

SEQ ID NO: 6802460 - DNA, 82 bp, Homo sapiens
cagttaacactagctgtggccaatagtggaaaaggaagtattacttagaaaattccaactaggcacacagctggtaaagctg

SEQ ID NO: 6802461 - DNA, 67 bp, Homo sapiens
ggaatgatatgcagattgaccttacagtcatttataggctgtgattctcaaattgtgatatcgaacc

SEQ ID NO: 6802462 - DNA, 67 bp, Homo sapiens
ggtacatttttagtgagggctaggttataagtcttctcttattcctacatctttcctggaaatggcc

SEQ ID NO: 6802463 - DNA, 67 bp, Homo sapiens
gccaggtcctcacttcctgccctgggtgcacacatgaatggggcagccagcaggaagcgggagaggc

SEQ ID NO: 6802464 - DNA, 78 bp, Homo sapiens
ccgttccttacacagcttcagtttctgacttgggaattattcttagttatgatgatggtgaggctttagcaggaacgg

SEQ ID NO: 6802465 - DNA, 63 bp, Homo sapiens
tgcaggtcacgttttttggtttgagtccacaagactctgacaatgctgaaggaggtgcctgca

SEQ ID NO: 6802466 - DNA, 63 bp, Homo sapiens
tccttaaaggactagaagtcaagtgatcaaaatgtgaagacctttgttctagttctctagggg

SEQ ID NO: 6802467 - DNA, 82 bp, Homo sapiens
ggcaaacagcattggaactcgtgttacttgtatgacttcttgagtgtcgtagtgtcaagctagatgattttcaacgtttgcc

SEQ ID NO: 6802468 - DNA, 58 bp, Homo sapiens
cattgtctactgtggaggcaaatcctttgattgataggtcaatgctctatagtcagtg

SEQ ID NO: 6802469 - DNA, 104 bp, Homo sapiens
tctcttaatcgactaaagggaatccacaggaggatgttcagacaagccagggcacacctttgactgtgttttattgtggtttctgtggctttgggactgagggg

SEQ ID NO: 6802470 - DNA, 104 bp, Homo sapiens
gcaggttagaagacacaagcaaagacagtttgagtggagatgtgatgaggcggtcatcaaacagtccttcaaataagttgttttgttggttttttacaatctgc

SEQ ID NO: 6802471 - DNA, 63 bp, Homo sapiens
gcaagttaagtaccatgttcatttgccgggattcctccctgcaggatttcatgggctgactgc

SEQ ID NO: 6802472 - DNA, 58 bp, Homo sapiens
gatgaaagcatcttggggcagatagccatctttgttgttattgctaaaggttttcatt

SEQ ID NO: 6802473 - DNA, 59 bp, Homo sapiens
atttctcaccctacctcactccccaggaataaggggaaagcagaagtagtgtgggaaat

SEQ ID NO: 6802474 - DNA, 60 bp, Homo sapiens
ccacactgcctgttatctcccagaggaagcagagaacctggcatgaaaactccagtgtgg

SEQ ID NO: 6802475 - DNA, 129 bp, Homo sapiens
gattttgattttatcttcttcaaatattctatggccaagaagtattcctgaccttatgttttccaaccactgttcataaaactgttgatcatttcttggctgtagtgaggtgaaaggatgatcaccatt

SEQ ID NO: 6802476 - DNA, 55 bp, Homo sapiens
tgtggtcattgcttgaaagatcaagaatgaaagtcccttgaaggccatgaccacg

SEQ ID NO: 6802477 - DNA, 61 bp, Homo sapiens
gggaaaagtcctgactgcaggggatgctgagcgaggggctgcagacccctcaggacctccc

SEQ ID NO: 6802478 - DNA, 84 bp, Homo sapiens
aaggaggaaggccagccttggaaccctgagtctctgtggtcaggagcgcctcagggggctggacttttcactcatcttgtcctt

SEQ ID NO: 6802479 - DNA, 68 bp, Homo sapiens
acggagacatgtggaggaggcgagggtaacatttttctgtgcactgcctttcttggcatgacctttgt

SEQ ID NO: 6802480 - DNA, 93 bp, Homo sapiens
gtagatagaaggccaactaggatgagctaggcggaaatatctgttaatgaaaaattagatcattttagctaaatggctttcagaaatatctac

SEQ ID NO: 6802481 - DNA, 101 bp, Homo sapiens
tggttgatgtggtcggcacctggctggctagttgaaaaaggaacacctgcatcttttatcaaacaaattatccagcctacctgcagctgctggcccaacca

SEQ ID NO: 6802482 - DNA, 79 bp, Homo sapiens
cttggcaaggccactgtcctttactggtagatgttggtcactcagacctgtgaccctttgcctagaggggctttgagag

SEQ ID NO: 6802483 - DNA, 129 bp, Homo sapiens
gaggtgtggccagaacaagccagctcctggggtggggttactcattgtgcctagggcgaggtggaaggaagagatggccccacagaggaggtgacattgagactggctgtggaggtagaacagcatttc

SEQ ID NO: 6802484 - DNA, 77 bp, Homo sapiens
tgtcatgctgtgtttgagaacctaggatatcccagaaaaactttaggaagcttgggtctcaaatattgtatcttaca

SEQ ID NO: 6802485 - DNA, 70 bp, Homo sapiens
gagtggtagaggtagacttccttgtcttattctagttctttgagaaaaggttttcagcttttccccattc

SEQ ID NO: 6802486 - DNA, 66 bp, Homo sapiens
tcccgtgcttgctggtaggcttgtgtttgcagttagctggcagacacttcccactgcagcgcgggg

SEQ ID NO: 6802487 - DNA, 67 bp, Homo sapiens
agaaatacttacacagagcctcagacaaacctgtaatgacagatgaatttgtctgttaagtgtttct

SEQ ID NO: 6802488 - DNA, 66 bp, Homo sapiens
catctaaatttgactccaaggagcaccagcactattatcaactcccactgcagttaaattaagatg

SEQ ID NO: 6802489 - DNA, 59 bp, Homo sapiens
ggtctgtagtctagacctgttagatagctgagcctaacagggctggcagctgcaagacc

SEQ ID NO: 6802490 - DNA, 72 bp, Homo sapiens
tttccaggaatgacccaacagtttcatatattgtgaaatatttgagatcgtgtcgtcatttattcctggaag

SEQ ID NO: 6802491 - DNA, 59 bp, Homo sapiens
gagagaaatgccagaacccagccgagctgcggctggtccacatcctggtacgtctcctc

SEQ ID NO: 6802492 - DNA, 79 bp, Homo sapiens
gaatatcttaagatttatagtaggatgtgacaagtctaacagaggcttacaaactgtcatatagtattttaggatattt

SEQ ID NO: 6802493 - DNA, 75 bp, Homo sapiens
cattggcattgtctatttgcattcatgatagccactctactgttaggaatttattcagcagttagatttgcagtg

SEQ ID NO: 6802494 - DNA, 70 bp, Homo sapiens
ggaggctgggctttgagctcggtcacctttgcacccagcttgggagtgagagagtttaaggtcatcctcc

SEQ ID NO: 6802495 - DNA, 57 bp, Homo sapiens
tttgcgggtgagggcataaggaggtggttgtatttgtttccaggctccattggcaga

SEQ ID NO: 6802496 - DNA, 61 bp, Homo sapiens
atagagctatgaacttggaattttggtgtcagaaggacctaggttcaagttcaggctctat

SEQ ID NO: 6802497 - DNA, 61 bp, Homo sapiens
tgctgcctggagctactggacactgagagcgtgcatctcagaccagagttctaggcctgca

SEQ ID NO: 6802498 - DNA, 57 bp, Homo sapiens
ccagccccttgacctcctgtccgggactccatccactgaaccaggacaaggggctgg

SEQ ID NO: 6802499 - DNA, 79 bp, Homo sapiens
ggaattgtaccagtcttcggagggacagcttaatgcattaagtccctgcccttctggtgattggtctaaaaaagattcc

SEQ ID NO: 6802500 - DNA, 60 bp, Homo sapiens
gccatgctgatgtgccaggtttgccctgcacacaggcaacagaccattgcatgagcaggt

SEQ ID NO: 6802501 - DNA, 129 bp, Homo sapiens
gacctgcaggtgtgggaatgtgtgatccagtgctggaaggagccgtgcagcaaggcttcctaggttctcagcactgtgctccttccttagcacccggctgctcatattactccacgactccacaccctc

SEQ ID NO: 6802502 - DNA, 130 bp, Homo sapiens
gaggcaggactgatatttaactggtaaggaaggtagccttgtaagaatcgatgtttatttagactgtctgctctgattggtcagtgttgaattttttgcaaatcattcttgccatcagatcatctgtctc

SEQ ID NO: 6802503 - DNA, 55 bp, Homo sapiens
ggagttggaagtaggataaagagcagttctcctctaggtcactagttcaaacttc

SEQ ID NO: 6802504 - DNA, 63 bp, Homo sapiens
gctgtcctcgtctctcacgcaaaccttcagtttttgcgataaatccaaggaggccaggagagc

SEQ ID NO: 6802505 - DNA, 86 bp, Homo sapiens
gaagagctataggttgctgtgaccgctgccacaaccatttgggtatcactgcccaaatcaggggccacaagcatttctgcctcttc

SEQ ID NO: 6802506 - DNA, 70 bp, Homo sapiens
ttgaagtacaaattttgaagagcttgcttctgtttctattttagagagttacacaaaatttctatttcag

SEQ ID NO: 6802507 - DNA, 69 bp, Homo sapiens
caaaattgagttttcataaaattagtgtcaatattggtgaactgactgtactttatgagttcaattttg

SEQ ID NO: 6802508 - DNA, 62 bp, Homo sapiens
gagatgattggggtcgttttaggaagtatagctctcaaaggacccataattaaaaccttctc

SEQ ID NO: 6802509 - DNA, 69 bp, Homo sapiens
gttttgtcactggtaaattatgcgactttggacaaattattcagtctcagatgtttaccagtgttgtac

SEQ ID NO: 6802510 - DNA, 78 bp, Homo sapiens
gtagtgtctggtttctgctgtctgaatatattgagtataatctgattatattgagtataaccagagaaatgcaactgc

SEQ ID NO: 6802511 - DNA, 61 bp, Homo sapiens
ttacagaactgccctagttggcttaaaagctactaggtgttaagcagttacatatctgtag

SEQ ID NO: 6802512 - DNA, 118 bp, Homo sapiens
gacttctgggggtcacaggcctctttgaggaagcttttgatcgcccagtagtatgcacatcaaccattttgcattcgattttgggttcacagggctcctgaaacccactcccagaatc

SEQ ID NO: 6802513 - DNA, 109 bp, Homo sapiens
catgtgctaaatatgtgactaggcagtgttcttctaagggcaacttgagtgcttaaactgtaaaattccactgactttaaagctcactctttttcacaagtagtccatg

SEQ ID NO: 6802514 - DNA, 77 bp, Homo sapiens
gtgagatactaacctttggtcatttacttttcagttcttggattaaaaggtctggatcagtggttcttggttctcac

SEQ ID NO: 6802515 - DNA, 90 bp, Homo sapiens
ttcttctggctggcactaatatatcatgtttaagtgaggacagcttcccatcaactaggaacatttatattagatagctatgtgagtgaa

SEQ ID NO: 6802516 - DNA, 87 bp, Homo sapiens
ggccataattcctgaggtttggatctctgatacaacaggtgttgtattcagtttgattgtctacaatctcagatgataaaactggcc

SEQ ID NO: 6802517 - DNA, 61 bp, Homo sapiens
gccttaggcaggataagaagttgtaaactcacccatcagcagctgcctccacttctgaggc

SEQ ID NO: 6802518 - DNA, 56 bp, Homo sapiens
aagccctgggatgttcagcagttacctagggaggctagtacacatgttaggagctt

SEQ ID NO: 6802519 - DNA, 65 bp, Homo sapiens
cagccttatgttgctacttcgcttgtcacatagacataaacttggctagatggtatataaggatg

SEQ ID NO: 6802520 - DNA, 78 bp, Homo sapiens
gttggaagcttgtaacaggtactaaataactgccaacaattcttattttaaggcactttatttcctattgcatccagc

SEQ ID NO: 6802521 - DNA, 88 bp, Homo sapiens
tctgtcatttctgatagatttctgacacaggaatgccagcaacaatactaagggtgttcttaatcccacaaatcttcaaggtgacaga

SEQ ID NO: 6802522 - DNA, 64 bp, Homo sapiens
gaaaacagcatgaagctccttgattgatgcttccagttagaggaattattttctgctgtgtatc

SEQ ID NO: 6802523 - DNA, 97 bp, Homo sapiens
agtcacagtgtcttcaggatatgtagagataaaatccaaatatgattatttcaaattccagggtcagctcatacatgatcaactgaggtactggact

SEQ ID NO: 6802524 - DNA, 59 bp, Homo sapiens
agaggaagctcctatgagaaatatctgtggtgcacagaagtaaaaatgggcttaccttt

SEQ ID NO: 6802525 - DNA, 64 bp, Homo sapiens
agcaggactgatgttcctccagcccccttggcccatttggtggctgcaaaacttcagtcctact

SEQ ID NO: 6802526 - DNA, 72 bp, Homo sapiens
gttgaaccatatgatattgctatttttgtaggtcaagatctgtcaattagtggcaatttcatacagtttaac

SEQ ID NO: 6802527 - DNA, 64 bp, Homo sapiens
gactggcctttttatttgtacttttcctgtgtttcagaattgcagagtataataaaggcatgtc

SEQ ID NO: 6802528 - DNA, 58 bp, Homo sapiens
gactccacagagaatactcgattggcacatttccaatactctttctccctgtgtagtc

SEQ ID NO: 6802529 - DNA, 83 bp, Homo sapiens
caggtaaggggaattggggcagagagattataattaacctagccatagttttgggaatgtctgtgccttaaaacttcttaatg

SEQ ID NO: 6802530 - DNA, 55 bp, Homo sapiens
tctactgttggtacttaatctgctctgccttcttggtgtagcagccagcactgga

SEQ ID NO: 6802531 - DNA, 61 bp, Homo sapiens
aacaatgaccacacaatgtactaagtcaacatggctaagggtgcactatgggttatttgtt

SEQ ID NO: 6802532 - DNA, 71 bp, Homo sapiens
tttttcctatgtgctatgggtgtttagtttaatttgagaatcaatatgactcatgcatgacactggaaagg

SEQ ID NO: 6802533 - DNA, 55 bp, Homo sapiens
gtgtgggatccgaggtgaattaggcatcatgggcctggccttggggagctcacac

SEQ ID NO: 6802534 - DNA, 62 bp, Homo sapiens
ctggctggggctgggctgaggaagaggaggaagctgctctccttctccccaccccagcccag

SEQ ID NO: 6802535 - DNA, 61 bp, Homo sapiens
actggatgtatgtagcaaaccctaagtccatgttttaagaggcttatggggtacaaccagt

SEQ ID NO: 6802536 - DNA, 58 bp, Homo sapiens
gactctagattcatggtggagttgatacctgtctgtaaatacccatgaatctggggtt

SEQ ID NO: 6802537 - DNA, 126 bp, Homo sapiens
gatacattgaaagtgttgagaagtgatttgagattgtgcttcctgaaatttgataataaaatgctataatctaggttaccagtgaggtgatattcttttgagagaatcactgaactcaacaaaatc

SEQ ID NO: 6802538 - DNA, 127 bp, Homo sapiens
gagggagcgaaagatcctaacctgctacaggggtcactcagagatagcctcatttccatactcaggagacaggatgcatactcttggttaatcttctgtgtgtctcattagtctttatccttccctt

SEQ ID NO: 6802539 - DNA, 59 bp, Homo sapiens
atttatcttctaatatggtataggtgagacatcctgaccatgtttgaaaaggagtaaat

SEQ ID NO: 6802540 - DNA, 60 bp, Homo sapiens
taggaggccatccagcctgccttcaagccactgatggagagaggctgactggctgtcctg

SEQ ID NO: 6802541 - DNA, 56 bp, Homo sapiens
agccaggatttgaacctgcatccagtgatgtactgggtaatatttaactcctggct

SEQ ID NO: 6802542 - DNA, 60 bp, Homo sapiens
tcttcacagatgcatatacttcatcctggcttccacccacagaggttgcatctgtgcaga

SEQ ID NO: 6802543 - DNA, 60 bp, Homo sapiens
agagagcttccattctagtgattggccctgagtcactaaccaatgatggtgagttcatct

SEQ ID NO: 6802544 - DNA, 57 bp, Homo sapiens
tgggctgagagtaccttataaacagggacagtgtgtcttaaaaagtgctcaggccta

SEQ ID NO: 6802545 - DNA, 72 bp, Homo sapiens
gctctgaatgagggattctgagggctaaggtcagagtctatagaccgggtccttctttccccacctcaaagc

SEQ ID NO: 6802546 - DNA, 62 bp, Homo sapiens
ctatggctgatttcatttgtttcccagaagatgagctgaagacacataggagcagctattgg

SEQ ID NO: 6802547 - DNA, 59 bp, Homo sapiens
tggctcaggcacagacgcaaacttcttgataatgtcttcaagcgcctggagcccagcca

SEQ ID NO: 6802548 - DNA, 94 bp, Homo sapiens
gggacatggagccacactgccctaacagtgggctggggtctgcctcctggtctacactgcattggggatgctttgacagggtgcttcatattcc

SEQ ID NO: 6802549 - DNA, 80 bp, Homo sapiens
ggagagtttctcagtctctgtcatctcatgggaattctcccactgagtttccataggttgcagagaatgacaaggttgcc

SEQ ID NO: 6802550 - DNA, 62 bp, Homo sapiens
cactcgctcactgacccagccagagcaacttccagtcctgaaagctgcattcatggtgagtg

SEQ ID NO: 6802551 - DNA, 74 bp, Homo sapiens
tctgtgagctggcacttttcctgggaaggtccagagctggccttcagggcaccaaaaaagatgccactcctaga

SEQ ID NO: 6802552 - DNA, 129 bp, Homo sapiens
tagccacatgtaggtagtggctacctcattggacagtgcagtactagagcaccaggaagatcttactgcctctcttcctggctcactgatgccaacaagtttgcctctagaactttcttcatttggcta

SEQ ID NO: 6802553 - DNA, 71 bp, Homo sapiens
cagaactctaggtaaatgagatatttcactgctcatgctgtgtgaccttcatgtcccatctgcctagactg

SEQ ID NO: 6802554 - DNA, 109 bp, Homo sapiens
agggttgcgactgttctgatacagctgctctgtgtgtggttatttccgtaggtgattacctaaggaaacacacccagagaagcagatcctcagattagcctgcgaaact

SEQ ID NO: 6802555 - DNA, 73 bp, Homo sapiens
gtgtgaaggcaatggaaaaaatattgggactacttagtccttgagtattttaatccataatgactactaccac

SEQ ID NO: 6802556 - DNA, 70 bp, Homo sapiens
ttgaaagcaacttctgctttcttccttgccacaaacctgtcctgaggcaaggaagcagagttgctatcag

SEQ ID NO: 6802557 - DNA, 62 bp, Homo sapiens
gcagaggattatggagatggtctcagcaacaagactgcctggatttccatcctagttcctgc

SEQ ID NO: 6802558 - DNA, 111 bp, Homo sapiens
tggagatgagctcgtcatgattggccaggtgtgctctgcagtggatacagctgtacgttcggtgacagttcggcagatacgcttggaaagttttggactttgtcattttca

SEQ ID NO: 6802559 - DNA, 65 bp, Homo sapiens
cttatttccaccttcccttgcacttagcttgtatctagttatagccaatagaatgtggagataag

SEQ ID NO: 6802560 - DNA, 71 bp, Homo sapiens
agtgactctgacagctctggctagtagaataatgctgattttatatttatctttggatgttgtctgtcact

SEQ ID NO: 6802561 - DNA, 63 bp, Homo sapiens
gctggaaggcgcagtgatgatgctcgtcatctgaccttcacgagccactgccagcctccatgt

SEQ ID NO: 6802562 - DNA, 129 bp, Homo sapiens
attgatcttcaaaggtggagttctgtggaatgtcaggaggctcctagggctctgtcagagtcatctttgagcactgcttggtagctttctcagtctgaaacatcactccatccttacggagcaaaatat

SEQ ID NO: 6802563 - DNA, 56 bp, Homo sapiens
gagaactgggaatctcaggaacatgggatcccagatcaaaagaatcccagtgtctc

SEQ ID NO: 6802564 - DNA, 67 bp, Homo sapiens
ttcaatccgctcctctaagcgcggtcctgagctttggtcccagacgcgcagaaggaagcggcctgaa

SEQ ID NO: 6802565 - DNA, 64 bp, Homo sapiens
ctggtgaccggacctcagttttacatgctcaattgcacattgtttaattgcctgtctctgccag

SEQ ID NO: 6802566 - DNA, 71 bp, Homo sapiens
cttgccctcaagaacaatccaccattagaactattcagaggttgtaatcgctttcttgtcttgaggccagg

SEQ ID NO: 6802567 - DNA, 86 bp, Homo sapiens
cacagaaaggtctgtttcctgcatgccatgtctgtaagagtcttgactgtggcccaggtgcaagagacagacatccttttgttgtg

SEQ ID NO: 6802568 - DNA, 82 bp, Homo sapiens
tcacacccctctcccccgacacccaacataacacctatagtccatgctgttcaaggctgtggtgctgaaggagggggtgtgg

SEQ ID NO: 6802569 - DNA, 57 bp, Homo sapiens
gtattgcattttgaatgcatggtattgattgccagagaatcagttaaattgcagtat

SEQ ID NO: 6802570 - DNA, 67 bp, Homo sapiens
gatggtcaggtcatctcatggatggaaagagcttaaaccacccacccatttttgaaaccttgacctc

SEQ ID NO: 6802571 - DNA, 59 bp, Homo sapiens
tcagatggttacctttgaaaggagagagctttccaagctctcctgggctgaccgtccga

SEQ ID NO: 6802572 - DNA, 56 bp, Homo sapiens
tgctgaagatggattttcaacttggcctttgcggaggctaagaaagattcattgca

SEQ ID NO: 6802573 - DNA, 112 bp, Homo sapiens
gatgtgctagaggatgatgatgatggtgctgatagtaacaataataactatgacatgtatatagagtattacaatttacattgcactttcagacacattatctctttcaatc

SEQ ID NO: 6802574 - DNA, 62 bp, Homo sapiens
gtgcttcaggcaaagggacccccatgtgcaaaggcatggaggcatgacagtgtctggagcac

SEQ ID NO: 6802575 - DNA, 125 bp, Homo sapiens
caagtcttcaggtacttcgatactgttctactagtaggtagagtctatgtcccttccccttgcacctgaggggcttctgtacctacctggaagaataggacacaaaggaagtggctatcagtttg

SEQ ID NO: 6802576 - DNA, 64 bp, Homo sapiens
tatatattgctagtggtactgtaaattgattccattttacagaagagtaacttggcaatatatg

SEQ ID NO: 6802577 - DNA, 121 bp, Homo sapiens
gagtaagatggagaatttccttgcttttcccaagacttgccatttagaggttaaacctgaccctaattagagactgcaatgagtggtagggagtggggcaaggaggtcaaaagagggactt

SEQ ID NO: 6802578 - DNA, 55 bp, Homo sapiens
taatgacttgaaggacccatggcacacccatgtggagacttccagcaggacatta

SEQ ID NO: 6802579 - DNA, 72 bp, Homo sapiens
agtgtctgtgaggggaattcctgttcctggcccaaacccacaggccttgctcgtgaaggcctctcacacact

SEQ ID NO: 6802580 - DNA, 56 bp, Homo sapiens
ttgccttgggttcacatctaggccttgtcactaactagctgtgtgaccttgggcaa

SEQ ID NO: 6802581 - DNA, 69 bp, Homo sapiens
ctcaattttctcatctataaagtggggataataacacctacctcacagaagtgtagtgaggaaaaagag

SEQ ID NO: 6802582 - DNA, 68 bp, Homo sapiens
tgagcccatagaatacatttcatggagatctccatcagaaaccatgctttgatgattttagtggctta

SEQ ID NO: 6802583 - DNA, 104 bp, Homo sapiens
ggggatttcactgccccaggcttggtgttgtgattgtagtcgaagctgacctgggttgccttggtggcagtctgcggtgtccaggtggggagggggcagtccct

SEQ ID NO: 6802584 - DNA, 59 bp, Homo sapiens
tcccaagattattgagggagggagttcctatgcatttctctttgagcaagatcctgggg

SEQ ID NO: 6802585 - DNA, 89 bp, Homo sapiens
gctgtgtctatagggcatacaaaattttccagaacttttgttaatttcacataactgaagagcaaaaattggagtcatgtcaggacagc

SEQ ID NO: 6802586 - DNA, 83 bp, Homo sapiens
gtgtattggttagagacagactgaaaagtaaacaaaccagccaacctggtccttgtggcttttcagtacagtctgacaagcac

SEQ ID NO: 6802587 - DNA, 88 bp, Homo sapiens
ggagtctcgtcctgttgcccaggctggagtgcagtggcacgatctcagctcactgcaatatctgcatcctgggttcaagcgattctcc

SEQ ID NO: 6802588 - DNA, 55 bp, Homo sapiens
ggcatgagggcagcccaggaagtcagcccacacagtcctgagcctccaccatgtc

SEQ ID NO: 6802589 - DNA, 72 bp, Homo sapiens
gtgatgaaatcaaaggagtttaagttactggatttactaaattcaatttaaggtactactttgggatatcac

SEQ ID NO: 6802590 - DNA, 73 bp, Homo sapiens
tttaatgtgggctcatctttaaatttatgacgttaactacgtacatcattttggagatgagcattgctataga

SEQ ID NO: 6802591 - DNA, 86 bp, Homo sapiens
ggtgtgcattgcaagtatcttcaagtttcttctagactttaaagaaattaaaactggaaattggagatgatgttttatgtgtcgct

SEQ ID NO: 6802592 - DNA, 57 bp, Homo sapiens
tggcatgtatttgtggtgaattatgaatagaaataatttttcatgcatacatgcaca

SEQ ID NO: 6802593 - DNA, 73 bp, Homo sapiens
gattaaatagtctggcttcaactttactgaaaagatttaagtaatcttgccagagaggagaaagcatttgatc

SEQ ID NO: 6802594 - DNA, 67 bp, Homo sapiens
ctgaaactatggggaggggagcagagttcaagtaccaaattgtggttcacccttctctggctttcag

SEQ ID NO: 6802595 - DNA, 73 bp, Homo sapiens
ctgtattgcatttgacaaattatttaacctctctggttatgagaggttaaatattatgttgtctgcaaaatag

SEQ ID NO: 6802596 - DNA, 78 bp, Homo sapiens
aggaagagcatcaggtcatgttttttgagaactaactacctgcagaggcagcaataaacatgtttgatgcgcttgcct

SEQ ID NO: 6802597 - DNA, 64 bp, Homo sapiens
tctctaggcagtgtcagaatcattctcaatgaagataataatgttgaatccatctgccaagaga

SEQ ID NO: 6802598 - DNA, 79 bp, Homo sapiens
gcaggtgggctccctggtcggcgtggtgacggcgcgggaccccgacgccgccaaccggcccgtccggtgagacccccgc

SEQ ID NO: 6802599 - DNA, 80 bp, Homo sapiens
gctggtgcctccaggaggaggaaggctgccaggcttcctggatgacagatctcagcccccttttcttggatagcatctgt

SEQ ID NO: 6802600 - DNA, 98 bp, Homo sapiens
gagagttcatgtatttatgttgtcttaaggttttcaaactactgtatgatcgtaaacacagtttgtaaacttgagctagccatgtacactgtactttt

SEQ ID NO: 6802601 - DNA, 76 bp, Homo sapiens
ctaggcacattatattcaggctcttaatgcactgctggtcctcgtgttttgcataaagaaagcctggagagcttgg

SEQ ID NO: 6802602 - DNA, 61 bp, Homo sapiens
tacatttcacaaggtgatatggtttggctgtgtccccactcaaatctcatcttgaattgta

SEQ ID NO: 6802603 - DNA, 59 bp, Homo sapiens
ctgaattttagggtaacagatgtttgcttattataggaagacaatgctgtaaaattcag

SEQ ID NO: 6802604 - DNA, 74 bp, Homo sapiens
gccctcctgagctagcacgtgtttgcctggttcacacctgtccccatattgggtctgcagctagccaggggggc

SEQ ID NO: 6802605 - DNA, 58 bp, Homo sapiens
ccccgcaggtgtcggcagatggggtagcgaatggtcctgtgcctccacctgctccggg

SEQ ID NO: 6802606 - DNA, 60 bp, Homo sapiens
gctgcccggtgcctgctgcgccctgcgagctccgcggcggtggagccaggcctgggctgc

SEQ ID NO: 6802607 - DNA, 107 bp, Homo sapiens
ttcagtccaaagcatatgtgctttcatagtatttatttacatggagttctggctaaagctattctgcatgaaaataaacagatttatgaaaggtactagtgcctgaa

SEQ ID NO: 6802608 - DNA, 73 bp, Homo sapiens
cggaagggcccagcgtggttccatctgcacattcccctacctattccagacctacacacgcatgggttgtctg

SEQ ID NO: 6802609 - DNA, 87 bp, Homo sapiens
gtaatatcattgtaatcatatctattttgtaaaggtcccctttgtagagaataaaacaaattaggtgtgtgttacaggttgaattat

SEQ ID NO: 6802610 - DNA, 55 bp, Homo sapiens
ggccctcaaggcagttcaagagctactagtttcaccaactgcttctgaaggagcc

SEQ ID NO: 6802611 - DNA, 102 bp, Homo sapiens
ggggacccaggaccatcccccgtgggagctggggttggacgtcttcaggccggagagggaacagcctcaccagccctggaggaggagggtcctggcttctcc

SEQ ID NO: 6802612 - DNA, 102 bp, Homo sapiens
tcctgaagcagcaacctctcgaagtggggaagcaacaggagaacatcttgctctcttgagcgtctcccacaaagtgagctggttacggcgctgactctagga

SEQ ID NO: 6802613 - DNA, 63 bp, Homo sapiens
gggcttcttcatgcacattttctgtgtttgtagctttcactttaaatggcacatgggaagtcc

SEQ ID NO: 6802614 - DNA, 76 bp, Homo sapiens
tcagttgctaatgtacatactgcattttcaaagaattatatattctatgtgttgtggatgtataaaatgcaattga

SEQ ID NO: 6802615 - DNA, 61 bp, Homo sapiens
gggtccctggaagtccctcttctgatgacccagaaccttcttccaggccttccagggaacc

SEQ ID NO: 6802616 - DNA, 87 bp, Homo sapiens
cctattctgtgagtccagtctctttccaagcccatgtatctacatattgcaggaacatagagactgcccactcagggcaacaaaagg

SEQ ID NO: 6802617 - DNA, 56 bp, Homo sapiens
gctctcactttaggttggaccgataccaagcggccacttacacctttagtgaaagc

SEQ ID NO: 6802618 - DNA, 105 bp, Homo sapiens
tgagatgttacagtcacccagattacatcctgtcaaaaggtcctcacaaactagtaatgaaagacaacctgtcaggagtagtcatggagttgttacacactttta

SEQ ID NO: 6802619 - DNA, 91 bp, Homo sapiens
tgaggttagagaatttactgttttaccacagatgtccctgtgttaaaatctagcacttcattagtaggtagtcaatggattctagcactca

SEQ ID NO: 6802620 - DNA, 55 bp, Homo sapiens
actaccttatctgtctcggactatgaagtctttggaagctttcagagaaggtagt

SEQ ID NO: 6802621 - DNA, 55 bp, Homo sapiens
ttaagaggtgaggcctttaagaggcaattaggccattatggctcctaccttgtga

SEQ ID NO: 6802622 - DNA, 88 bp, Homo sapiens
atgcaggcaataagcgtatattttcaaatgtgtccatatcctcaagtaggattcacatgtgggaaatggtgcttatatgccagtgcat

SEQ ID NO: 6802623 - DNA, 55 bp, Homo sapiens
tgaagtgcagccattccctggggcttcacagtcctggctggattctctgcattca

SEQ ID NO: 6802624 - DNA, 80 bp, Homo sapiens
tgtagtaacctaaggaggcctttgtgctccattaagtggttttgcaagttggaatacagggcctttgatggattataaca

SEQ ID NO: 6802625 - DNA, 93 bp, Homo sapiens
gtggcaagaagtaaacaaagacatttatgaaaagtgctgtgtgcctggcacagaatagacgctccaaaaatgtctctttgctgttttagtcat

SEQ ID NO: 6802626 - DNA, 55 bp, Homo sapiens
attttagtgaaatttggcctttgtgtctaggcacagaagtcaattgaactgaaat

SEQ ID NO: 6802627 - DNA, 95 bp, Homo sapiens
ctctagggtggtggtgccagggcttaacttttcaggaggccagactatccttggagtttcatgagattaggaccctgtctgtccacttcttggag

SEQ ID NO: 6802628 - DNA, 61 bp, Homo sapiens
ggagtgtgcagttgttctgggactggactgccatctcagggtttgtacaagtgtagacttt

SEQ ID NO: 6802629 - DNA, 98 bp, Homo sapiens
gaggcgggagaattgcttgaacctgacaggcggaggctgcagtgagccaagatcgtgccactgcactccagcctggcaacagagcgagactctgtctc

SEQ ID NO: 6802630 - DNA, 77 bp, Homo sapiens
agccccacatgggcgagagggcggccttcattctgaacccatttaggcagcacgggcagccctcctcgccgtgggct

SEQ ID NO: 6802631 - DNA, 71 bp, Homo sapiens
gaaggcctctcagggattgcaaaattcatcctctaaaccaggatcaaccctctcacaccctggacaccttt

SEQ ID NO: 6802632 - DNA, 100 bp, Homo sapiens
agcttagattaatacatcttttgatatttcttatctatttctcagaaaatagagaaaaactaagagtgggtggtgaagtgtcagagtgagtggcagagtt

SEQ ID NO: 6802633 - DNA, 61 bp, Homo sapiens
gggagtgaggctggaatcatggctgtgtgtttcctccagaccctctccatgcccactgccc

SEQ ID NO: 6802634 - DNA, 60 bp, Homo sapiens
gctccttagaggttcaaacttcataatttcagagcctgaaattagatttgatcctagagc

SEQ ID NO: 6802635 - DNA, 56 bp, Homo sapiens
tttatatttcccaggattggcccatagccaagggctaactgatatgggaatatgaa

SEQ ID NO: 6802636 - DNA, 58 bp, Homo sapiens
gccatgaggttttaagagcactagctcatgggcttcttgtttaaaacttcaataaggc

SEQ ID NO: 6802637 - DNA, 64 bp, Homo sapiens
gggggactgaggcccacttgagggaatagcaagtgtctttccctttcagggtttccagttctct

SEQ ID NO: 6802638 - DNA, 87 bp, Homo sapiens
tgccgtcataatgtcttagtgcagtgcattactcacatgtttatgctgctggtgtaaacagactgcactgccagtcatatgaaagta

SEQ ID NO: 6802639 - DNA, 63 bp, Homo sapiens
gggtatggtgctgcttaccttcctaactaaggaagctgttaataaggtaagaaagccctgccc

SEQ ID NO: 6802640 - DNA, 62 bp, Homo sapiens
ttgtgtttctggccaagatggagtgataaggactggactgactctctggccagaaacaacag

SEQ ID NO: 6802641 - DNA, 57 bp, Homo sapiens
aactctaattggctacaatggaagaggcttaggctttcactgaggttaaatagggtt

SEQ ID NO: 6802642 - DNA, 73 bp, Homo sapiens
ggagagggaagcccgaggaggattggctgggctgggcatgttccagcctcatttctcctgctttgccctctct

SEQ ID NO: 6802643 - DNA, 76 bp, Homo sapiens
tattctccagaacatgtagactttcctccctccatcaccctcaaggataaggattctagtccatgaatggaggatg

SEQ ID NO: 6802644 - DNA, 65 bp, Homo sapiens
tctcataaaggtgccactcagttttagccatgtcttcactgaaattgcaaaagtacttttaggga

SEQ ID NO: 6802645 - DNA, 63 bp, Homo sapiens
tattgttttatcatgggtatcagcttcaccctaaaagaagagattcctatccctgaaacagtg

SEQ ID NO: 6802646 - DNA, 76 bp, Homo sapiens
cctcttagcttagattcagcattgcaaactctgttctgtccaagagccaggcaggcaatgttgactggtggagcgg

SEQ ID NO: 6802647 - DNA, 59 bp, Homo sapiens
gcagaaaccacagtgtcttttaggccctagcctcagaagacacctactgtcatttctgc

SEQ ID NO: 6802648 - DNA, 69 bp, Homo sapiens
tcccttgtgcattatctttaatgttctcaataaccttcccagttgttatgatcatgatattgcagggga

SEQ ID NO: 6802649 - DNA, 69 bp, Homo sapiens
actagagggaggagttctgtcaccaaggaagctcccaggcattccttcaaacgcctcctgcactctggt

SEQ ID NO: 6802650 - DNA, 80 bp, Homo sapiens
gaattgtgggcaatgtctgtctatagccatgagatcagaacaactctgtttcatggggatagtatttttctccacagttt

SEQ ID NO: 6802651 - DNA, 75 bp, Homo sapiens
gccggcccagctcccgcaggctgcacagcttgggcagccaggtccacgagccatctgcggggggacaggggcggt

SEQ ID NO: 6802652 - DNA, 95 bp, Homo sapiens
ttggcctttggatgataatgatgtgtcagtgtaggttcatcagtcctaacaactaaatgaaactaaactacataagttaaactaaagcttgccaa

SEQ ID NO: 6802653 - DNA, 64 bp, Homo sapiens
ggggcagggcgcgcaggggtctggatccgacggacgtcccaggctcactgtccgcttccgcccc

SEQ ID NO: 6802654 - DNA, 75 bp, Homo sapiens
tgagcaaggctctgcaaaacctccaagtcacccaacctcgtttggcttgtcaaggttcaggcagggcccttgcca

SEQ ID NO: 6802655 - DNA, 68 bp, Homo sapiens
gaggcggagcttgcagtgagccgagattgtgccactgcagcctgggcgacagagcgagactctgtctc

SEQ ID NO: 6802656 - DNA, 81 bp, Homo sapiens
gttatgaggagctgcctgtgtgccatgatgtagaaataatgggaagtatgcatcacatgtaggcagcatcaccattttaac

SEQ ID NO: 6802657 - DNA, 127 bp, Homo sapiens
ggcatttgcaggtccccacggtggcggaggcagctgggccccagcctctccactgtcaccctcaccccaggacgtggtgcgaaggagcctggagcccacctggccgtccccgggaccggctggtgcc

SEQ ID NO: 6802658 - DNA, 88 bp, Homo sapiens
aggagctcagaggtgaggagcattcaggacaagcctcccagagaggcctggctgtcgttttgtgaaatttcctctatttcttcctcct

SEQ ID NO: 6802659 - DNA, 70 bp, Homo sapiens
cctgacacccaggcctgagagacaggagtagccctctgcccgcttctgtgcccagccctggatgcaaagg

SEQ ID NO: 6802660 - DNA, 103 bp, Homo sapiens
caagtagctaggactacgggcacgcaccacgatgcctggctagttttaaaaatttataaagttggtgtcttgctgtgttgcctggtctggtcttgaactcttg

SEQ ID NO: 6802661 - DNA, 57 bp, Homo sapiens
gcccagggttcaaggctgcagtgaactacgattgtgtctctgcacttcagcttgggc

SEQ ID NO: 6802662 - DNA, 113 bp, Homo sapiens
gggattgagggtgagcaaagcccaaaggtccctgtcctcagggttccctgacctctcctctgggagatctcctgagggcaggaccctcctctgggtgtcttgcccccaacccc

SEQ ID NO: 6802663 - DNA, 82 bp, Homo sapiens
gtggttctgtccaggccctgggatgggagcagtcccatactcactggccagtgtccctcccagggccatctggcagagctgc

SEQ ID NO: 6802664 - DNA, 62 bp, Homo sapiens
ttttcaagagggaactgaacacaggtcaacagaattctgtgctgcaattcacttcttgagaa

SEQ ID NO: 6802665 - DNA, 57 bp, Homo sapiens
gcaaagcattctgtggagtctaactgtgatgggtaaaagacctagagagggttttgc

SEQ ID NO: 6802666 - DNA, 90 bp, Homo sapiens
gctggacgaacattctggatgtttgaggactcagaagacgcacatccctgtgcccttcttttttaaacaattatttgaagacagtctagc

SEQ ID NO: 6802667 - DNA, 57 bp, Homo sapiens
gctccagggtggatgacaattccctaggctcccgtcctggctgtgccaccttggagc

SEQ ID NO: 6802668 - DNA, 72 bp, Homo sapiens
gttcttgtttgaactggaagggtggcctgtctgagctatcaacatccacatttattcagtcatataggtaac

SEQ ID NO: 6802669 - DNA, 77 bp, Homo sapiens
gcccctcagctgctgagaattgcaggcaagttgctctgcctctctgtgcctttgttttctcatctctgaaatggggc

SEQ ID NO: 6802670 - DNA, 83 bp, Homo sapiens
aggagctcccctgggcccttcagcttcctctgcagcctcaggtatgagaggaggaggaggaggccccctgggcagtgactcct

SEQ ID NO: 6802671 - DNA, 71 bp, Homo sapiens
gttaaggtaatctcattagggaccgtgaaagaatatgagaattctgtctgtctttagtgagattgccttgc

SEQ ID NO: 6802672 - DNA, 75 bp, Homo sapiens
ggtatgtgtgtatttatatatgaaatgtaaatatattttacatgcatgtgtgtaaatatacatgaaaagcatgcc

SEQ ID NO: 6802673 - DNA, 63 bp, Homo sapiens
gtgaggagcctgggccgctggaggctggctgtgcagcaggcgtgcttccaggcccagctgagc

SEQ ID NO: 6802674 - DNA, 70 bp, Homo sapiens
aacctggaggctgtgtagtctttttggatcttaaccgctagctatccctggattcacagccactcaggtt

SEQ ID NO: 6802675 - DNA, 90 bp, Homo sapiens
tcaccaggcctagagggacgcctgctctccatacactttctaggctggctggagggaggggagggacaggggcctcttatggctctgtga

SEQ ID NO: 6802676 - DNA, 63 bp, Homo sapiens
tcaggagagagttgggtaggcttccacagcacattccagcctcctcatttctcatctccctga

SEQ ID NO: 6802677 - DNA, 130 bp, Homo sapiens
acagcatgcagcattgggttttgatgtttgtgctatagtgttctgtcctgtaggtttatttgtgtctgagaatgacatatttcaatccaagacgtgattagcattaagatgagccttgtgctgctactgt

SEQ ID NO: 6802678 - DNA, 75 bp, Homo sapiens
ggtccctaaagagtcttatcttttacaagtacatactgaaatatttacggatgaaatgatatgatgtcagggatt

SEQ ID NO: 6802679 - DNA, 58 bp, Homo sapiens
aggtaggaataacctttgtaattcatgattacataattacaatgagacgttcttatct

SEQ ID NO: 6802680 - DNA, 64 bp, Homo sapiens
agtctaaagttgagaaaattgccacctttggcctaaaacagagggtacatcttaactatggact

SEQ ID NO: 6802681 - DNA, 55 bp, Homo sapiens
gaggccaggagtgctgtaagttccatacaatgcttaggacagcccccctgccctc

SEQ ID NO: 6802682 - DNA, 97 bp, Homo sapiens
ctggagaccaggaggcgctaaaaggcagccctgcgctgccccctggtggccgatgtggacactgcagccaggaagcctttccctcccggccttccgg

SEQ ID NO: 6802683 - DNA, 60 bp, Homo sapiens
ttctgttttcgtagcagattgcaaaagctctgtgtgcttagcatgtgtatggaaggggga

SEQ ID NO: 6802684 - DNA, 76 bp, Homo sapiens
ggcataaggaaggcagccatgtgctttgggtcatgttagtaaaaagactcagagcttggctccttgctgacatgcc

SEQ ID NO: 6802685 - DNA, 59 bp, Homo sapiens
accgtctcatcatgccctgttgaataataaacattgctcacaggggcagacgagttggt

SEQ ID NO: 6802686 - DNA, 72 bp, Homo sapiens
gtcaacatcagagctcccagcatggaggtctctggcatggctggacttacttgctgaggactggtgcttggc

SEQ ID NO: 6802687 - DNA, 82 bp, Homo sapiens
ccaggtgattcttatgtacacttaagtttgagaaatatcgccaatagttctcaactctggttgcatgttgaaaatcacttgg

SEQ ID NO: 6802688 - DNA, 56 bp, Homo sapiens
ttctctgggatctggcaaaaggaattcagaaactgtatcagtcagatctgcaggag

SEQ ID NO: 6802689 - DNA, 57 bp, Homo sapiens
accctgagatgccacagcatgacttgaaggtgacccagactgaccacatctcggggt

SEQ ID NO: 6802690 - DNA, 62 bp, Homo sapiens
gagtcctgggtccagcaggtcctcaggggagcccctctttgaagcccgtagagccaggactc

SEQ ID NO: 6802691 - DNA, 83 bp, Homo sapiens
ccgtcgtaccagtgttctggaatcctatgagagggacaaacaatcagaacccagtagcagtattccggaatactttttgaggg

SEQ ID NO: 6802692 - DNA, 61 bp, Homo sapiens
actacaaatcccagaaggtcatgcagtgggggcggccgcggtgacttctgggatttgtggt

SEQ ID NO: 6802693 - DNA, 78 bp, Homo sapiens
cagtgaaatcgactttgggctcggaggaggggttcggctgcctggctagcccttttctgagcccacatgaccttcctg

SEQ ID NO: 6802694 - DNA, 74 bp, Homo sapiens
gccttataaacataaatatagctgttcttagccacagatctcttttggccaagaatgatatgtgaaggtagggt

SEQ ID NO: 6802695 - DNA, 60 bp, Homo sapiens
aagtatgtgatacatgttaattagcttaatttagccgttgcacagtgtatacacatattt

SEQ ID NO: 6802696 - DNA, 65 bp, Homo sapiens
gttcttattacagaatcaggcataactgtttaataaatatgccttgattttgtaaagaagagagc

SEQ ID NO: 6802697 - DNA, 76 bp, Homo sapiens
tctggcctcagtctccctcctataaaatgggggtaaatcagtacctttctcagagggtggctgggagcatcacagg

SEQ ID NO: 6802698 - DNA, 84 bp, Homo sapiens
ccatacataggtgctgctgctcagtgtcatcatgttcgttcctatcagcgtggatgtgggtgggtgtttggctcttatgtatgg

SEQ ID NO: 6802699 - DNA, 62 bp, Homo sapiens
acagggtgctcatggataaggcgaatgggatatttccttttctgcttcccatagcactttgt

SEQ ID NO: 6802700 - DNA, 57 bp, Homo sapiens
ggcccttggttttgttgtgggagtccacacccatcccctaaagagccacccagggcc

SEQ ID NO: 6802701 - DNA, 87 bp, Homo sapiens
ttctgtgccctctttgttcaggctgctggcttctgggaggacagacttcaaaaaggcctggtggcctgcagaggccgagcacaagga

SEQ ID NO: 6802702 - DNA, 65 bp, Homo sapiens
gaaggtatatcagacactcatatgtatgggtgcccccatacaggccagtaatttggtatgttttc

SEQ ID NO: 6802703 - DNA, 80 bp, Homo sapiens
tcctgggctcaagcgatgctcctgcctcagcctcccaggaggctgggaggctgaggcaggaggatcacttgagcttggga

SEQ ID NO: 6802704 - DNA, 69 bp, Homo sapiens
tttttgctacctttgatctggaattttaatcttatttggttaaattatttctagtgaggtgttcaaaga

SEQ ID NO: 6802705 - DNA, 108 bp, Homo sapiens
gtgctgaggctcaggctgtggggtcgtggaagggatgcaggaaagaaggttctagaccagggcttgacacttcactctctggggccacatgggctgaggcctgggcat

SEQ ID NO: 6802706 - DNA, 80 bp, Homo sapiens
tggcttctgttctcacatccagacaagctctgcaggagcagaactcccagagcccgggacctggacttgaatggaagtca

SEQ ID NO: 6802707 - DNA, 63 bp, Homo sapiens
cagcagcttctgttgatcagaaacacaaccccactgttaactctgcattcgagggaggctctg

SEQ ID NO: 6802708 - DNA, 71 bp, Homo sapiens
ttccacaatgcatatcacagtctccatgtgcttaggaacattagagcacacttcagcagtatgcttgggag

SEQ ID NO: 6802709 - DNA, 58 bp, Homo sapiens
cttttaaagtatatgtagggcccaaatattgcatgggcatacatacttattctaaaag

SEQ ID NO: 6802710 - DNA, 79 bp, Homo sapiens
caaacattccttgtttcaagccatccacttttccatttagtcgttttcagggaggttttgtacaaggaatagttgtttg

SEQ ID NO: 6802711 - DNA, 82 bp, Homo sapiens
tatgtctgtcagcatttaggagaatttgagaaatgtttttccctttgatattccttaaatgtgatctagatttgagtacgta

SEQ ID NO: 6802712 - DNA, 85 bp, Homo sapiens
aaagagaccctcactgacatctcagtaggacatctaaccctgtgagtgtccactctgttgctgagatgaatagggctgtctcttt

SEQ ID NO: 6802713 - DNA, 67 bp, Homo sapiens
ggcatgctttagtcaagtagggcaaagagtagacatttttctgccttgtagactagaatactatccc

SEQ ID NO: 6802714 - DNA, 94 bp, Homo sapiens
gacagatctttaacagcctgctgcatccaggctattgttctactgactgttgcctgtaggtggatgtgagcatgttgtacaaaggagatctttc

SEQ ID NO: 6802715 - DNA, 60 bp, Homo sapiens
ctctgtgcttcaatttatagtacttatctgtaaaatgggataataaatagaggcagaggg

SEQ ID NO: 6802716 - DNA, 71 bp, Homo sapiens
atcacagtttccataggtcagcagtccagacatggctgagtcctctgctcaatgtcttatgagactgtgat

SEQ ID NO: 6802717 - DNA, 76 bp, Homo sapiens
gcagcgcagcacttttgaagttagacatcgagagtttgagtcctagattcacaccttgctggctgagtgctgttgc

SEQ ID NO: 6802718 - DNA, 89 bp, Homo sapiens
agtaggtatttgaaaaattgattaatgttagggtctgagtttatcatattgagaattctacaatagatcaagtaacaaatagtgctact

SEQ ID NO: 6802719 - DNA, 71 bp, Homo sapiens
tagacagtgggaagagaaatgagtcaagacttgagcctttcagcccttctctcttctcatccaaatgttta

SEQ ID NO: 6802720 - DNA, 64 bp, Homo sapiens
gtggccatgcaggtctggtaggtcccattcccattgggcaggacacccctagactgctgggcat

SEQ ID NO: 6802721 - DNA, 110 bp, Homo sapiens
tacatggcccagagcattgcttctgccacttccaaggcaacagcctaggctggggacccctcaatacccagccctgtgggccttgtggcacgggcactctgtgccgtgta

SEQ ID NO: 6802722 - DNA, 129 bp, Homo sapiens
atccctgatggctgtgtgtcctgggggaatgttaatgctgatggggtgggcaaggagtggtgaccactggcttctagagcccatccttcctctttacctctcccctcagaccccataccctccagggat

SEQ ID NO: 6802723 - DNA, 56 bp, Homo sapiens
ttttctgggcagaagcatttaggctcaatccttgcagaaaaacttagtccagaaag

SEQ ID NO: 6802724 - DNA, 56 bp, Homo sapiens
tgagctcctggtgagaggggataccagtgaagactatcccagcacccaggagtgca

SEQ ID NO: 6802725 - DNA, 62 bp, Homo sapiens
gctttctgcctgggctccatttccctgcactggaatttggaaatttcccacaggcagaaagc

SEQ ID NO: 6802726 - DNA, 129 bp, Homo sapiens
gtcagaattacctaggagcttgtgaaacatgcacatttccaggcctcactccagaattagtgaacctgaatctttgaaagtaggcattgtgaaactgcattttcagaggctgcccaggtgaccctgtac

SEQ ID NO: 6802727 - DNA, 64 bp, Homo sapiens
aagggttctgtagaaggataattttaatgtggagtgttcctcaaaatcccttctctggactctt

SEQ ID NO: 6802728 - DNA, 79 bp, Homo sapiens
cacagagctgggtttgggaaacctcgtgtgacacttcagaggtttccagcaggccatagatttatttactttttctgtg

SEQ ID NO: 6802729 - DNA, 70 bp, Homo sapiens
ggagtctatccagagtctcggagggagcatggctgtgtgaacaccttgattttcgagacttttagcctcc

SEQ ID NO: 6802730 - DNA, 73 bp, Homo sapiens
gtatggagttttaaatggagggcatgttggctgggtaaggaagtttgggtaaatgtctcccgtgagcctcaac

SEQ ID NO: 6802731 - DNA, 127 bp, Homo sapiens
ggtgggacaggagcccagcgtgtaggggaggaataaaagctgtggtcaggcttggaccgcgacctccatggcagcctggcctggctttgtcacggtcctttaagttatcctgcattccgttcccacc

SEQ ID NO: 6802732 - DNA, 55 bp, Homo sapiens
ggagctcaccttggagtctctggtgcctgagagggcatggcttccaggtggctct

SEQ ID NO: 6802733 - DNA, 128 bp, Homo sapiens
aggggaatggaggctcagcagggtggccgggtgcctcgctggctgccagcaccatggtcacttggctgctggcctctacaggccggccaggcactaccaccaaacctccttctagctgcattccctct

SEQ ID NO: 6802734 - DNA, 61 bp, Homo sapiens
agatatcaattgcagtctacgtttacatcattgaggatgtacacatagtgtagttatattt

SEQ ID NO: 6802735 - DNA, 66 bp, Homo sapiens
ggataaagaccagtatcttatgttctctaacttaagaactagaacctgagatactggtctttatcc

SEQ ID NO: 6802736 - DNA, 74 bp, Homo sapiens
ttcccgggacttcatatttccctgtgtgcagatgggtgttgctaacaaccccactcacacatggacctggtgaa

SEQ ID NO: 6802737 - DNA, 103 bp, Homo sapiens
gattggcatttaagagaccttgattcaagacctagctcagccattaattagccctgtagtcgttggctaagagcttgatatccaaggctctcaatttccaatc

SEQ ID NO: 6802738 - DNA, 56 bp, Homo sapiens
ataaagagtctgggaggcccacctgtactgaaggtgaagctttgcctgttctttgt

SEQ ID NO: 6802739 - DNA, 129 bp, Homo sapiens
ggcagcagagctaggattcaaactcaggtctgcctgacttaaaggcttaactttactgttatgcaaaatcaagtgcaaggtaattaagctgtcactgcaaacgagaacgattagctccacctgactgcc

SEQ ID NO: 6802740 - DNA, 57 bp, Homo sapiens
gtggagaaatatagggtgcaataggaacatataactggggcaccttaccaattctac

SEQ ID NO: 6802741 - DNA, 63 bp, Homo sapiens
cactatatctgttcttgtttattgatatttccccagcaatgagccaaagtccaggtgtttgtg

SEQ ID NO: 6802742 - DNA, 58 bp, Homo sapiens
gggcaatggctctgatgttgttgtgacttctgatgtcaccacctgaagagctattctc

SEQ ID NO: 6802743 - DNA, 62 bp, Homo sapiens
cctatgaaagacaggagatgcgagggatccagcagacaattttttctcttttcttctatggg

SEQ ID NO: 6802744 - DNA, 66 bp, Homo sapiens
gctgttctatggctgaaaatagaatttagggttgataatgcccagatttctaggctatgaagcagt

SEQ ID NO: 6802745 - DNA, 65 bp, Homo sapiens
atctaggcacttcatcaagccatggagtcaggaaacaaggaagaatagatgaagctgctggggat

SEQ ID NO: 6802746 - DNA, 108 bp, Homo sapiens
gtttggcagcaactaaatatttgtgagctacatagagattctggagtttgcacagttctgggtaacgttggaatttttgtgagctagagcagaaggactttgctgaac

SEQ ID NO: 6802747 - DNA, 76 bp, Homo sapiens
gggcttggaagacacctctctatgaatgaatgagatacagctcatgttcctattgcagaggatgaaaagcaggccc

SEQ ID NO: 6802748 - DNA, 103 bp, Homo sapiens
cctaggaggatcactgcagattcttaaattttcatctacaagaaactaacagtttcatgggagtgagatgaaaataaataaaggtcacgttgtggtccctggg

SEQ ID NO: 6802749 - DNA, 82 bp, Homo sapiens
gttatctcaaatcccactcagaaactgccattgtcatgcaacaataggccacaatattttggtaggaaaattagagatgtac

SEQ ID NO: 6802750 - DNA, 78 bp, Homo sapiens
agatctagtctcagcttatcaatcgcagcccaggatccataagatttaaacaagctggactgataagtcttgctgtct

SEQ ID NO: 6802751 - DNA, 76 bp, Homo sapiens
atgtggctgtggagctgcagagttggcctttttggggccaccctccagacccagactgcttgcttcccagccccgt

SEQ ID NO: 6802752 - DNA, 85 bp, Homo sapiens
gcaatgttagaatgtctttggttcaggagtacctctcagacttctgggagggccagtgctctctagatgcatctggcaaaattgt

SEQ ID NO: 6802753 - DNA, 68 bp, Homo sapiens
ttccaaggctaggttgtaaaggtgacacaacttctgcctacctcattttagaacacttgctcttggaa

SEQ ID NO: 6802754 - DNA, 71 bp, Homo sapiens
tctgatgggcccctgtccttgaattgtgggactgagtgtggggtttgacatcagggcaggggttgagcaga

SEQ ID NO: 6802755 - DNA, 89 bp, Homo sapiens
gaggtcacacagcagttggttaggtcaggattcagactgagactgatgctccgttgtccttgttcctaacccctctgctgtgcaacttc

SEQ ID NO: 6802756 - DNA, 57 bp, Homo sapiens
ttaatgtcactgttttctgggctgttgattttagcgattgccaagcaatggcattaa

SEQ ID NO: 6802757 - DNA, 70 bp, Homo sapiens
tcatgttctttgagaaatcgtgtttcacttaacaaacatctgtggagctctgagttggggaggagcatgg

SEQ ID NO: 6802758 - DNA, 58 bp, Homo sapiens
gtccttggcattctgagtcttgctgtctctgcttacaccagctctcaggctaaaggat

SEQ ID NO: 6802759 - DNA, 89 bp, Homo sapiens
aactcgcctccctgttcttccacaatacttctgagattctcaatcaggtctgtctatgcaatggaaggactggttgatgcaactgagtt

SEQ ID NO: 6802760 - DNA, 58 bp, Homo sapiens
caggtcagcttggagcatctctgcagaacagggcagtgccgagcttcaggctaacctg

SEQ ID NO: 6802761 - DNA, 77 bp, Homo sapiens
ctgcctgcctctggagcccatcctcttaactgttgtgctaatcagtttctgggtgctcctggggcagttctttgcgg

SEQ ID NO: 6802762 - DNA, 87 bp, Homo sapiens
aggtctgattgctagggagagggaggcatcatgaatccagcccagccctgggcttaggaatgtcccttcccacagctgtcacggcct

SEQ ID NO: 6802763 - DNA, 69 bp, Homo sapiens
cattgttgaacacctgctggatgaccagcccaaaggagaagggagagatgttcggcgtgttcagcagtg

SEQ ID NO: 6802764 - DNA, 122 bp, Homo sapiens
aaataatccaggcagcttttgaaacatactgatgcttgggcttcaccccagagattataattcgattgatctgaaatggggctgaagcactggtatgttttagaagtttcctacttttattt

SEQ ID NO: 6802765 - DNA, 77 bp, Homo sapiens
tgtttcaagaatttctgcatctctggagatctatgggatggctctgggctccagattgcagcgatcactgtggagca

SEQ ID NO: 6802766 - DNA, 59 bp, Homo sapiens
gtttctgagagccacacacagcatgagtgtgagtgccgttctgttcagctgtcagagat

SEQ ID NO: 6802767 - DNA, 62 bp, Homo sapiens
ttgcataatgtgggagaccttccctaccccaggaaagctggagagtgaaggcttcccagcaa

SEQ ID NO: 6802768 - DNA, 58 bp, Homo sapiens
attaggaatcaaattccgaaagggctagatcattgctctccgggagctgatatctaat

SEQ ID NO: 6802769 - DNA, 66 bp, Homo sapiens
cagtggctttagtgttcaacccagataacttaccaacaagtcattttcccactgaagctgtcactg

SEQ ID NO: 6802770 - DNA, 62 bp, Homo sapiens
agtcagctgctgcacacagcagagatgtgttgcttcatctaagagctggttaacagttggct

SEQ ID NO: 6802771 - DNA, 65 bp, Homo sapiens
ataccatcactagaggaagctgcttccttcagagcacagtgcttttgttcctctcctggtggtat

SEQ ID NO: 6802772 - DNA, 61 bp, Homo sapiens
tgattctaagcacgctgaagtcttacagtcagtactgtggagaaatagaagcttagcagca

SEQ ID NO: 6802773 - DNA, 55 bp, Homo sapiens
gcttggagcattcatttcagcgagcagtagctcactagctgaatgtctgctttgc

SEQ ID NO: 6802774 - DNA, 58 bp, Homo sapiens
gtccttggcatcatgatttggtgtctaactccaccattgtcaaacagctgcctgggat

SEQ ID NO: 6802775 - DNA, 57 bp, Homo sapiens
tgagaaaagtgtggaggtcaatagttaagctgcaattgctccattaaagttttctca

SEQ ID NO: 6802776 - DNA, 57 bp, Homo sapiens
gcagctcattcctcaatctaggagaaatttttctaccttgccccaggaaagagctgc

SEQ ID NO: 6802777 - DNA, 105 bp, Homo sapiens
atggcagctggtaatgtcttgcagctggttgaccagtttaatgatgccaaaatctggctacatccctctcctgttctgaccagtgcagggatcagctttcgtcat

SEQ ID NO: 6802778 - DNA, 114 bp, Homo sapiens
aaaactactgaattttgatatttccagctctttattgccaatattcttgggtgataaacttgggaaagcccattgacaaagaagtgattgtattaaaaggaaacagaaagtttt

SEQ ID NO: 6802779 - DNA, 83 bp, Homo sapiens
attattcattgctatatccccagcatctagaatagtccctgccacatagtaggtggccaataaatgttggaggaatgaataat

SEQ ID NO: 6802780 - DNA, 77 bp, Homo sapiens
gggtgtgggatgaggaggctcgaagggcactgggcagggacatgctgaagttcactgagagttcaccatccctgctc

SEQ ID NO: 6802781 - DNA, 63 bp, Homo sapiens
cagaagctgggaaaaaatgggcagttcaagaaaataaaatgactgcaaatacctagttatctg

SEQ ID NO: 6802782 - DNA, 55 bp, Homo sapiens
tatttcatggacatctttggaggcctagtggttttaggtttcactccataaaata

SEQ ID NO: 6802783 - DNA, 61 bp, Homo sapiens
ctcaaccttgactttccttggggcttcagatctggaagaggctcagtgggaacaagctgag

SEQ ID NO: 6802784 - DNA, 69 bp, Homo sapiens
atatttcatggggttccatactaagtagcaatggattttccagagtaacatgaagtccccatctgatgt

SEQ ID NO: 6802785 - DNA, 78 bp, Homo sapiens
ggccgcccgggaactgctgacgcttgatgagaaggacccacggcgtctgtttgaaggcaacgtcctgctgcggcggct

SEQ ID NO: 6802786 - DNA, 73 bp, Homo sapiens
gcctatctgctggggctcttcttttgcctcatgcttatgctgtctgtggagaagcaggcctcacagatctggt

SEQ ID NO: 6802787 - DNA, 129 bp, Homo sapiens
ttgctttaggtactttgaggatttttctggtgcatacatgtttaagtttgttatatgcacatatatattatatttatattgagatttgagcattgtgtccttatgaaatgtcttttttatctctggtaa

SEQ ID NO: 6802788 - DNA, 82 bp, Homo sapiens
acaggagcaacagactaagacattcctccacacaataacagacccaggcagtgcagagccatgtgtgtcttatctgtcctgt

SEQ ID NO: 6802789 - DNA, 113 bp, Homo sapiens
gtaacgtaatgactaccatatggtaaggcttcttggaatactgcagggtagacttttcctgcaacatccaatgacgcctcatcatttttggaatttttcattttttccattac

SEQ ID NO: 6802790 - DNA, 94 bp, Homo sapiens
gtgagcagggctgtgctccttctggaggctccagggaagaacttgttccttgcttcttccagcttccagaggctgcctgcattccatggctcat

SEQ ID NO: 6802791 - DNA, 65 bp, Homo sapiens
aaggtcattggttctgaattctcaggttctctcacctctcaataagaatttagctcaatggactt

SEQ ID NO: 6802792 - DNA, 84 bp, Homo sapiens
actagtatcagcaggcacaccaaaaactgtgtccatcaaatgctgggccataacctcattttatgctgtgcccttggtactagt

SEQ ID NO: 6802793 - DNA, 93 bp, Homo sapiens
ggcctggccgccaccccaatttaccttgaagagcttgagggcctccgtctgcaaggcctcagagggcagggtggtgagggaggcgtataggcc

SEQ ID NO: 6802794 - DNA, 71 bp, Homo sapiens
ggcagaggtggcatgcaggtgaccaggtgtggggctgttggccccctcattcatgtccttgcttcctctcc

SEQ ID NO: 6802795 - DNA, 74 bp, Homo sapiens
gctagagtgcatgacatgatcttggctcactgcaaccttcacctcccgggctcaagcgattgtcctgcctcagc

SEQ ID NO: 6802796 - DNA, 92 bp, Homo sapiens
atcctagtgtttcatgggacacgttttaaggaaaattgttataaatgagtcagaataatttttcttacgtggttccaactggctctggagat

SEQ ID NO: 6802797 - DNA, 61 bp, Homo sapiens
ctcacaggaagtggtcagtgccagtaggaaaaaaaagtcctctttggtatatttccttggg

SEQ ID NO: 6802798 - DNA, 72 bp, Homo sapiens
ggaattttgcctgggctagtaagccagaataatacatttttgcttgaacttggctcttaggaaaataatttc

SEQ ID NO: 6802799 - DNA, 60 bp, Homo sapiens
gcctccttgctgctgatctcgtcctgcctaggcaggcagtcagccctgctagggtctggc

SEQ ID NO: 6802800 - DNA, 99 bp, Homo sapiens
gaatttaacttgatatatatatatgggtatctgtactgattgttataataataataaacaatttctaatatagatcttaccaggtatctggtttttttt

SEQ ID NO: 6802801 - DNA, 62 bp, Homo sapiens
aatgtggtgtgtaaggctctgcatgctctggccccctctcgcctgtgccttatactcacatt

SEQ ID NO: 6802802 - DNA, 74 bp, Homo sapiens
gaggtaactaggactgcaggtgtaatgctctagttatgcggacctctgcccacagtccaatagttgtgctcctc

SEQ ID NO: 6802803 - DNA, 85 bp, Homo sapiens
ggatgaaagcaagaatggatagatggatggatggagtggctggtaggcagatgctccactggcctctgtctttcaggcttcatct

SEQ ID NO: 6802804 - DNA, 91 bp, Homo sapiens
tactatagctataaggtatgcctaacattggatagagtgatttctcctccttaatcgtttttcagtggtcttaggtcttctaggtgtagtg

SEQ ID NO: 6802805 - DNA, 56 bp, Homo sapiens
tggctgttactcttttcatttctggagcataatagaagtagaagggagaagggtta

SEQ ID NO: 6802806 - DNA, 71 bp, Homo sapiens
tagaggaatgttcagctttcttacttaaggatgaaacccaacatttttaatctggcctgaatatttttcta

SEQ ID NO: 6802807 - DNA, 64 bp, Homo sapiens
tccaggctttcaaggaatttggtattttcttgatgagaacatgcagaattcttagagagcagga

SEQ ID NO: 6802808 - DNA, 60 bp, Homo sapiens
agttggacacgttttgctataaaagaaatattttatgtgtgaaatgctgtcttcaagact

SEQ ID NO: 6802809 - DNA, 61 bp, Homo sapiens
ctgttactgctggagccattgagtgagtgcattttttctcagtcttccctgtcagtaatag

SEQ ID NO: 6802810 - DNA, 73 bp, Homo sapiens
caggcagagcggtggccagcagtgaaaggcagacccacggtggggttggtcctctggccgcagctcagctctg

SEQ ID NO: 6802811 - DNA, 127 bp, Homo sapiens
ctggaatgtcacatcagagccgctggaatgtcacatcagagccgctggaatgtcacatcagagccgctggaatgtcacattggagctgctggaatgtcacatcagagctgctggaatgtcacatcag

SEQ ID NO: 6802812 - DNA, 62 bp, Homo sapiens
gacaacagtagtctcaggaataggcagaaacacttctgctagcaaggtgggactactgtgtc

SEQ ID NO: 6802813 - DNA, 80 bp, Homo sapiens
gattggctaatgctctgtggttttagggctgatgtggagaatctcaacagtcagaatgaagctgagctccgacgccagtt

SEQ ID NO: 6802814 - DNA, 82 bp, Homo sapiens
gacccacatctaattttaggctactgtgactttcctgagtcccactacagctgagcatcactagtctggtacagcatgggtc

SEQ ID NO: 6802815 - DNA, 129 bp, Homo sapiens
acatgtataagttgccaacctggtgccaattaatggaaccctgggcaaagtcacatacatgatattcaacacatcatagtaatgcttcacccattcatttgggatccaggaaaagtctctcatacatgt

SEQ ID NO: 6802816 - DNA, 95 bp, Homo sapiens
gctatgaactgggatatcttcatgagggtaatctacaaaggtttacatctttctttgtgtttttcctttagattatgttgacagttacgtttagc

SEQ ID NO: 6802817 - DNA, 77 bp, Homo sapiens
gggctgccatctgagaagcgggagcctgtgaagaagcatctctccctcgctatcttctgcttcatccgatgcagccc

SEQ ID NO: 6802818 - DNA, 56 bp, Homo sapiens
tttagcaaagaagatattattgcatgggacatacatgcaatatatatttgcctgaa

SEQ ID NO: 6802819 - DNA, 81 bp, Homo sapiens
gtcagattggggaggaagtcagatttcagggtgtacagaatgacactcctcaaatccccgttcctcattccctcctttggc

SEQ ID NO: 6802820 - DNA, 86 bp, Homo sapiens
tacatatttttggagattggaaatggaaatggtaaagctggctttatatgctttctgtctgatttgattttcagccattgaatgta

SEQ ID NO: 6802821 - DNA, 71 bp, Homo sapiens
cgcgctgagctcttcgcctgtcgctgaggcgtcggtgccagctgcgtgaaggatggagagggcggggcgcg

SEQ ID NO: 6802822 - DNA, 93 bp, Homo sapiens
caatcattttgtatctccagccaggaacacaatgccaagcttggctcctccaaacttggcattgtgttcctggctggagatacaaaatgattg

SEQ ID NO: 6802823 - DNA, 92 bp, Homo sapiens
aagccatcagaggtgtcctgtttatctgtgtgactcggccctctttgggtcacaaaggccagatgatccagcagctacctggagggtggttt

SEQ ID NO: 6802824 - DNA, 69 bp, Homo sapiens
taggcaagttgcccaatctctctgagccttgttcttccatcattagtaaaaaagagagggttttgccta

SEQ ID NO: 6802825 - DNA, 59 bp, Homo sapiens
ttagtaattggcagagctgggtttaaacctagttgacttagctttagagccattactgg

SEQ ID NO: 6802826 - DNA, 93 bp, Homo sapiens
tggttacttgtaatcatagtcaagagcatctatttcacagtggcaatgccaaacctgtttgataatgtttactgacaattacaggcttagcta

SEQ ID NO: 6802827 - DNA, 78 bp, Homo sapiens
tagattggggcaaaagtaattgcggttcttgcaattaaaagtaatgggaaaaactgcaattacttttgcgccaaccta

SEQ ID NO: 6802828 - DNA, 71 bp, Homo sapiens
ttcccagagggccaggtcggtgaatggtcatctgtctgcccagatggaccgaggcctggcctgccagggag

SEQ ID NO: 6802829 - DNA, 61 bp, Homo sapiens
gcaagctgtccttttgcatggctgactgccttttcaagaccagtgttggaggatggcttgc

SEQ ID NO: 6802830 - DNA, 68 bp, Homo sapiens
gcatcatccttacctgtgcataagcctatctcccctgagtgtaagctccttgctgggagggattatgc

SEQ ID NO: 6802831 - DNA, 64 bp, Homo sapiens
tcaccgggcagcagacccagctcagaggcaggaagggtgttctctgaggcaggatgcgtaggga

SEQ ID NO: 6802832 - DNA, 62 bp, Homo sapiens
actgaaatctgtttccaatacttgctatgaaaaatccatagagtatctgaataggtttgggt

SEQ ID NO: 6802833 - DNA, 114 bp, Homo sapiens
cttcatccttaatcactcacttgctactctgtcatttattttgctgtctgtaaagacttgcaagcagacattcaggtaggtcaacagagtttcaggaaagattataggagaaag

SEQ ID NO: 6802834 - DNA, 82 bp, Homo sapiens
cagacaatagagactcaaacagatggccaagtgcatgggctgaaagagagtccaaactaccttctgaggtttcttatgcctg

SEQ ID NO: 6802835 - DNA, 59 bp, Homo sapiens
gcatactgtccatgacttgcactataatgcttctatttggtgttaagaaatggatgtgc

SEQ ID NO: 6802836 - DNA, 68 bp, Homo sapiens
ggtagatgctgtcaggcccgacaccccatgcagtgcagactgggatgctggtgcctgtggcacagact

SEQ ID NO: 6802837 - DNA, 62 bp, Homo sapiens
gtaaattatttcaagatcatctctttcttatattaatagagatgatggaagggatagttaac

SEQ ID NO: 6802838 - DNA, 55 bp, Homo sapiens
tgcctcccttttgctcttcttatctcccttctgagaagccatagtctgggaggca

SEQ ID NO: 6802839 - DNA, 63 bp, Homo sapiens
acctcatggggctgaagttactttgccaagacttttctgtaattgactcagctctgttcaggt

SEQ ID NO: 6802840 - DNA, 70 bp, Homo sapiens
gggttttcttttatattcttgtcaatgtgatgattccaagaatcttacaagtactgaatatgatttgccc

SEQ ID NO: 6802841 - DNA, 58 bp, Homo sapiens
ggacaggataagagacactgcctatcattaaaaccagggacgatgtctctctccttcc

SEQ ID NO: 6802842 - DNA, 76 bp, Homo sapiens
atggatgtgaagagggagaagcccagatggctgtggaaagcatctcctggtctgtttctctctctgcccactccat

SEQ ID NO: 6802843 - DNA, 83 bp, Homo sapiens
gatagtctcatatggagtgcatccttatgttatgttgagggcagagtcacaaatgatggaggggtggctttagaacaggcatc

SEQ ID NO: 6802844 - DNA, 121 bp, Homo sapiens
ttaaagtagactgtgcaacatttaattccatagcaggtcaaaaagtttaagactcattctagctctagaaatataggttactatggttttagcctttgtcccttctggtcagtctctttga

SEQ ID NO: 6802845 - DNA, 107 bp, Homo sapiens
tctccttctgtctcacaccaaacacactacggtcttcttgagtcttgtgcaatgattacatgattacactgagcaggaagaagtgggggtgaagacagagcaggagg

SEQ ID NO: 6802846 - DNA, 104 bp, Homo sapiens
tctggttggggaatttgacaaatctacaattttgaatttatgtggtatatactgtatgtagtgtgctgtggaagtttagagaagagtggtttctctcaaccgga

SEQ ID NO: 6802847 - DNA, 56 bp, Homo sapiens
ggagggaattgggagtggaagacaccgaaaggaaaccagctttcccaagtcccttt

SEQ ID NO: 6802848 - DNA, 95 bp, Homo sapiens
ggctaggttggagccagcctgcatttgtatctgtatcttggaagcaaacttagaatgcagagacagatgtggcatggacgctgtcagctctagcc

SEQ ID NO: 6802849 - DNA, 91 bp, Homo sapiens
acattaaaggttaaaggatgtttgaaaggaagttaatacttttaaaacattgggagaatggccatcttttcagagatctgaccaaaaatgt

SEQ ID NO: 6802850 - DNA, 80 bp, Homo sapiens
tgagggctgcgtaagacagggtggctcgggcctggggtgctgggccccaggtctccctgcagccctgaacgatgctctca

SEQ ID NO: 6802851 - DNA, 86 bp, Homo sapiens
gatgagggaagatacagggagtaattttgaactgtagtgagttttgatcaactaaaattatcaagataattcctttttctcttgtc

SEQ ID NO: 6802852 - DNA, 67 bp, Homo sapiens
gtgttcaggtagacttccgggtctctgaaatccacaccaacagaggggaaagaccatgcttgaggac

SEQ ID NO: 6802853 - DNA, 55 bp, Homo sapiens
aattctgcataaggtggctctgatttcagataaagttgcataccttggtagaatt

SEQ ID NO: 6802854 - DNA, 80 bp, Homo sapiens
attagggagaaacaccaatttattcatcttctgtaactgtaaaaaaattcaggtaaagtatattggtgttattcctcagt

SEQ ID NO: 6802855 - DNA, 56 bp, Homo sapiens
cctgcacagatggacaggtgttatattatagatggcactgaatgccaaagtgtagg

SEQ ID NO: 6802856 - DNA, 79 bp, Homo sapiens
ttcaaagcatcagagagaagttaactaggccctaatcagtagccagtgtggtctagtccaactaattttgatagttgaa

SEQ ID NO: 6802857 - DNA, 72 bp, Homo sapiens
gtggcctggatagactccatctacccaaaggacccattctgtccatctcattgatagtttatccagtgccac

SEQ ID NO: 6802858 - DNA, 75 bp, Homo sapiens
agacagaagtggctctgaagcaatcagcccaggtaatcttcaggggctgagctgttctgagtttaagcttttgct

SEQ ID NO: 6802859 - DNA, 81 bp, Homo sapiens
caaacagaatgaactccttaatgaagtccagtttttcgattgtggagaaacagatattgttaagagggattacagtgtttg

SEQ ID NO: 6802860 - DNA, 58 bp, Homo sapiens
agtacagatttctgggccctaccatagtctttcgaggtggggaccagtattttatact

SEQ ID NO: 6802861 - DNA, 109 bp, Homo sapiens
atggacacaagcatctgcctgccccagcaacagagtcctgcttcccacagaaaccggttccaaagccggcagagacggcgctttgaacttgctcaggccttttgaccat

SEQ ID NO: 6802862 - DNA, 74 bp, Homo sapiens
gggaagatgtctttgtttgtactgttagaatagctgagactgggtaatttacaaagaacagaaacttatttccc

SEQ ID NO: 6802863 - DNA, 76 bp, Homo sapiens
attactagcaatttccagagcttcagagatgaaagatgtcatcaagacatgttctgaggtctgcaattctagtagt

SEQ ID NO: 6802864 - DNA, 122 bp, Homo sapiens
aatttgatatgtcattttcaatgagtttcctgagcaattcaaaagattttagttgtcttcttttctataacactggatctcaattttgtattgaaaggagcttaaatgtgatgtaaaaagtt

SEQ ID NO: 6802865 - DNA, 72 bp, Homo sapiens
tctgaacatctagttcctatataataacagaaatgtcttaaatatttattaatatgggactggattagtagg

SEQ ID NO: 6802866 - DNA, 76 bp, Homo sapiens
tgggacaaaattacccagaaccgtacagacgtgcgcgaatgagtatgtgttggtagatctgaggtctattgtgcca

SEQ ID NO: 6802867 - DNA, 57 bp, Homo sapiens
agcgctatattcactgctgattgagcattcctacctggcaatcccagtgtatagcct

SEQ ID NO: 6802868 - DNA, 79 bp, Homo sapiens
aaacgatcgaatggattgttgcttctgagaaattgttccttgttttttggataataaacgatcttccttttggtagttt

SEQ ID NO: 6802869 - DNA, 72 bp, Homo sapiens
ttgtcgttctgggaacagcctggctgtgtcgctatttcaaacaaagacatttcatgttttccagagcagcag

SEQ ID NO: 6802870 - DNA, 74 bp, Homo sapiens
caggaatccagatttagagagataaccatgtttttctttaggcaaaagtattatctctttaaatgtgcctcttg

SEQ ID NO: 6802871 - DNA, 82 bp, Homo sapiens
taataattgcttgttgaacagatatatgattgtgtaaatgaataatatttgcttcatagatctgtggacatagtggtaatta

SEQ ID NO: 6802872 - DNA, 84 bp, Homo sapiens
ctttaaatagccccagggtttctctgaggtgacttgtagctaatacaatatcacaggaggagaccaagtgggtgcagtttccag

SEQ ID NO: 6802873 - DNA, 91 bp, Homo sapiens
gctggctggcacgttcgcacgtggccatgtcagctccaaggaggatgctgacatcctgctggctggcacgttcgcacgtgtccatgttagc

SEQ ID NO: 6802874 - DNA, 63 bp, Homo sapiens
cagagtgtttctttgggtgggtgaagaaagaatcaacacctcatataatgagagatgcttctg

SEQ ID NO: 6802875 - DNA, 58 bp, Homo sapiens
ggggggttcctgaccccttggttctcttgagaaatgaccaaaggctatgggacctgcc

SEQ ID NO: 6802876 - DNA, 78 bp, Homo sapiens
tcctttgctttccctactcaccatcttgggtctcctgggggatagcaggacccagaaggtgcagcagagacagcagga

SEQ ID NO: 6802877 - DNA, 68 bp, Homo sapiens
ggaggcagaagtagggggagacaaaatgctaggttttgatggcaatgctgtattcttctccttcctcc

SEQ ID NO: 6802878 - DNA, 72 bp, Homo sapiens
ctatttatgtgctattttgtatttatctggctctgaagtgtggagtctatcaacaaaataggtactgggtag

SEQ ID NO: 6802879 - DNA, 70 bp, Homo sapiens
atccagccccgggatgttcttcaacaacatggcttctttgccacatctgagtcacttcctgggcctggat

SEQ ID NO: 6802880 - DNA, 67 bp, Homo sapiens
gactgagagcgtgtacaaacttattttgaatctgaagcctaatgggttgtatttatgcctctttgtc

SEQ ID NO: 6802881 - DNA, 55 bp, Homo sapiens
cagcccttaaatagatatacagtgtatctgtggtattaagtctatataaggggtg

SEQ ID NO: 6802882 - DNA, 80 bp, Homo sapiens
aggtttgggttttaattatatctgggcagttagaaaatgcaattctttcctatggctcacaaataataaatttcaaatct

SEQ ID NO: 6802883 - DNA, 128 bp, Homo sapiens
ccagggatatttctcttatttggcattatggaaaattttggaggctgagaagtaagagaccagaccatcaaatcttatttcattgatttctaagactaatagtgatgtcttaaaagaatatgttatgg

SEQ ID NO: 6802884 - DNA, 67 bp, Homo sapiens
gtgtggaaccatcttaaaaggtgagtgtaatcttgcagagcattgatcacagttgaggtttctgcac

SEQ ID NO: 6802885 - DNA, 72 bp, Homo sapiens
cagataaagtttattggcaccaccatgtcctccttccctgggctgtgagtggacgtgaccaataaactgctg

SEQ ID NO: 6802886 - DNA, 100 bp, Homo sapiens
gtctttgcaagagttgcattttcggttattgagattatggcatgctaaaatatttgagtttgcttaaatttcagcagcttaattttgtagcagcagggac

SEQ ID NO: 6802887 - DNA, 59 bp, Homo sapiens
ttttcatttaagaaggaaatattgggcattaattctcagtattctttatgaagtgaaaa

SEQ ID NO: 6802888 - DNA, 83 bp, Homo sapiens
atacataaatgagattatttaaaatgcggtaatgttgtgaaaaacaaacacaggcacaactgagtagactcatttgatagtat

SEQ ID NO: 6802889 - DNA, 107 bp, Homo sapiens
cctcataacctagcatgcctttcatggaacatcaggttaagaaatgagcatctcaccttctgaagatgagtttctacagggagcggcagaatgctggcaatgtgggg

SEQ ID NO: 6802890 - DNA, 55 bp, Homo sapiens
gggagcagcagtcagtcaccatctggccaccatttggtgacccctgtctgttccc

SEQ ID NO: 6802891 - DNA, 65 bp, Homo sapiens
gacccttaggtatctattcaaaatggccattcttgtgcacagctggggtatgatgccagtgggtc

SEQ ID NO: 6802892 - DNA, 68 bp, Homo sapiens
gctccttagctagctgcacaggccctgggcactcctgtcactgttgcagccagctttgcggaaggagc

SEQ ID NO: 6802893 - DNA, 68 bp, Homo sapiens
gggtaagcttggagatgtattgtgattcaaacgatagaataaataacccattggccaggcttcactcc

SEQ ID NO: 6802894 - DNA, 64 bp, Homo sapiens
ccaaagctattggcaactctgtggctgagatctccctctaggtattgtagttgctaataattgg

SEQ ID NO: 6802895 - DNA, 84 bp, Homo sapiens
ggccgcaggggtcattatagtggggaggtggtgacatcagactccagggagtgctacttgttcactgtaggtcgccccgctgcc

SEQ ID NO: 6802896 - DNA, 89 bp, Homo sapiens
ggcactgtgtcattcatttaagtatgtttaagcctcacataggcctggtttatagcaagttctcagtgaatgatttaaagagacatgcc

SEQ ID NO: 6802897 - DNA, 70 bp, Homo sapiens
tggctttaagatgtctataaaaccaagaattgacccaagttctcctggctctaaaaggctgtctgggcca

SEQ ID NO: 6802898 - DNA, 81 bp, Homo sapiens
ttttccccaagtggttcagagcattccaaaggacacaaggctatttttattcagtggagcttgggactcttggtaggaaaa

SEQ ID NO: 6802899 - DNA, 64 bp, Homo sapiens
gtgggtggggagctctctggaggccacattgttgctgggttcagggcagcagcttctcacccac

SEQ ID NO: 6802900 - DNA, 70 bp, Homo sapiens
agtttatttatatcatattttatatagatgctttggcattttgctttaaagtgtggatatgattagtatt

SEQ ID NO: 6802901 - DNA, 61 bp, Homo sapiens
ctgtgctttattgtcatatacatggaaaccatttccaatgtgtttgtggcatggatcatag

SEQ ID NO: 6802902 - DNA, 62 bp, Homo sapiens
ggcagctcctgcctgggcagctgtctgagaaggacagagtctgacaggtaggcgcccatgcc

SEQ ID NO: 6802903 - DNA, 63 bp, Homo sapiens
gcatactgagatgttaatagggtgtgcaatttggtgtcatgctttattcgacatctggtaggc

SEQ ID NO: 6802904 - DNA, 98 bp, Homo sapiens
gtggaggatagttacatgggtgctgggtagcaaccaaaaaatgtcaagtactgtgcacccctttggctactcaacatgtactcatacctatcttccac

SEQ ID NO: 6802905 - DNA, 91 bp, Homo sapiens
tcagagcctgttcactctgggggctgccgctgcctgccagggagcctggtgggggctgctcggcagctcctgagccagctgcaccctctga

SEQ ID NO: 6802906 - DNA, 56 bp, Homo sapiens
agagtgggaattttctcccagggaccccatttctctttggctggaattcccgatct

SEQ ID NO: 6802907 - DNA, 65 bp, Homo sapiens
gcagaggtgagtttctcagctgagtgggctttgaaatcaatttcagcttgatttcttacagctgc

SEQ ID NO: 6802908 - DNA, 65 bp, Homo sapiens
ccatttggaatggatgtcctagaggtctcaggaactaagcctgagttggggcatccaccgaatgg

SEQ ID NO: 6802909 - DNA, 67 bp, Homo sapiens
agcgttacttgttaggctgagaattttgaagattatttttcaagttctttgccagacacgtgtggct

SEQ ID NO: 6802910 - DNA, 71 bp, Homo sapiens
tagagcaagcccagatgtgagaactgaggctccgagaggttcagtgacttacctggagccattaacatctg

SEQ ID NO: 6802911 - DNA, 76 bp, Homo sapiens
acttagaataatatgtactactacttgagtgagctcttttggaagttatatcaagttctagtgtttgcttcttagt

SEQ ID NO: 6802912 - DNA, 61 bp, Homo sapiens
cctgtatttgcaacttttcttagtttgaaattctttaaggaacagcatctgcaaacacagg

SEQ ID NO: 6802913 - DNA, 56 bp, Homo sapiens
gctttggtacctcctgctgatctctgtgctgaggcaggcggagagggaccacaagc

SEQ ID NO: 6802914 - DNA, 92 bp, Homo sapiens
gggtgtgagtgctcccctggctgtgggtgctcctcaccaacagctaacgtgcggggccttcctgtgccccagccaaggtgacacgaacaccc

SEQ ID NO: 6802915 - DNA, 55 bp, Homo sapiens
tggcctgctctgactttgggggctcagccaggcatccagggtccagagagtgtca

SEQ ID NO: 6802916 - DNA, 79 bp, Homo sapiens
ctgacaacagtggggagtctgcacaattgatcatggcaaaatgtttttctcctgatatctgcagacctacactgtgcag

SEQ ID NO: 6802917 - DNA, 120 bp, Homo sapiens
tacatactgtataaggaataaaaaacaggctttattattggttagtgttgatactgtatgtctataaaattattcaatcatattaaaagtctgtgttttgaattcatgtgcatgtatgta

SEQ ID NO: 6802918 - DNA, 87 bp, Homo sapiens
tagatttgaggggctgttgccgaaccaatgtaaagctttcagagggaagtatgcaggtctctgcaaggcctatcaagcagcattcta

SEQ ID NO: 6802919 - DNA, 75 bp, Homo sapiens
ttccagtttaagcaagttgacatagcataatccagtacatatgactatgcaagggtttagttgtttaacttggga

SEQ ID NO: 6802920 - DNA, 58 bp, Homo sapiens
ttgtaagtgcttgttagaaaatccctggaggcagagatagttctggatgtacttatag

SEQ ID NO: 6802921 - DNA, 60 bp, Homo sapiens
aaggatgtttaagttttgcagttggttattttaacaaacactgttccttcagacatcctt

SEQ ID NO: 6802922 - DNA, 75 bp, Homo sapiens
cacctcccagagcagtgctggagaggtgcagagagatggcctcctatttcttgttccctccaagttctgggtctg

SEQ ID NO: 6802923 - DNA, 67 bp, Homo sapiens
gggggaagtgtcacagacccaatcaggaggttaaggagggcttccttgaggaggtgacactggagct

SEQ ID NO: 6802924 - DNA, 59 bp, Homo sapiens
ggctgcgaccgcccccgaaccgcgtctacgagccttgcgggctccgggtctttgcagtc

SEQ ID NO: 6802925 - DNA, 130 bp, Homo sapiens
ctgctgcctctgcacttgcaggggtgatggtgatgatcaaataagataatatatgtgaaggccccaggaaatgggggatgttattcaatttgaatccaaccaacactcagtgaggcctcctgaggtcaag

SEQ ID NO: 6802926 - DNA, 130 bp, Homo sapiens
ctttttcacttttattttactagaaacttttgaaagtgcaggtaagtttctggcagtagctagttttttcactgtggccatgtcatctgacttatctgggtatcagtttcctcatttggtaagtggatgg

SEQ ID NO: 6802927 - DNA, 59 bp, Homo sapiens
aagtctttcataagtctcttattaaggcataaatactttggggcatttatggaggactt

SEQ ID NO: 6802928 - DNA, 64 bp, Homo sapiens
ctgtcctagaatgtgcagacttagggggctctcctgtactcctgggtcccgcacatctgtccag

SEQ ID NO: 6802929 - DNA, 80 bp, Homo sapiens
atagtaaacacacccatgtcactggagatacacacaattctgcttgatggtgacagtatacttgtgatgggatttattat

SEQ ID NO: 6802930 - DNA, 101 bp, Homo sapiens
gtctcccgtgcttgccccacttgcaccacagctgaggactcagcagtgagctctgggttttatatgtggtggacacgtcctgggctagtgttacaggagac

SEQ ID NO: 6802931 - DNA, 82 bp, Homo sapiens
ggttactcattgctgaggcactggtaatgggcatgagaattttggctagtttatgcactatataccatgtttttgggtagcc

SEQ ID NO: 6802932 - DNA, 85 bp, Homo sapiens
gctaggcagaattaaaagacctgttgaggttagtggtcattaattgaatttagcagtgcttttttctagtttgttctgctctggt

SEQ ID NO: 6802933 - DNA, 59 bp, Homo sapiens
taggcagaaaggaaggcaagtttttataactttgtctaaatgaactttctaaatgcctg

SEQ ID NO: 6802934 - DNA, 75 bp, Homo sapiens
acctgctccattgttcctttactgtgttctttataattgacttctcagtaagagttgacaatggccatagcaggt

SEQ ID NO: 6802935 - DNA, 109 bp, Homo sapiens
ggctgtggggccgtctttctcctactgggcgcgggaccgagcgaaacaaactgcaagctgggtttccgcgtcgccccgggcaggtactggaaccagacgcccccacacc

SEQ ID NO: 6802936 - DNA, 59 bp, Homo sapiens
cacagctgtgagaagggagccttaattccaagtctcctgaattgtccctcacagctttg

SEQ ID NO: 6802937 - DNA, 56 bp, Homo sapiens
tctcctggtacccttcctagcatcaattctttatttgtaggagtccaatcaggaga

SEQ ID NO: 6802938 - DNA, 81 bp, Homo sapiens
agaaatataccaaaaagttggagcaactgaaataatgacattgtgaactatttctcatgccctgtttttggttggttttct

SEQ ID NO: 6802939 - DNA, 93 bp, Homo sapiens
gtcttaataactgacctccatggaggtctgtgattagcactgggggacataatcttcttgggccaaggcagatctccaaagggcaaaggagac

SEQ ID NO: 6802940 - DNA, 60 bp, Homo sapiens
gaaatgaattctgaagtcttccaatgtttgcatttattggaggggctcccgagttctatc

SEQ ID NO: 6802941 - DNA, 67 bp, Homo sapiens
tttgaaaggagatggagatttgggtaaggtttagtctggatacactaaatcttcatcttttagaaaa

SEQ ID NO: 6802942 - DNA, 77 bp, Homo sapiens
gggaccatccagagacatgtggcctgcacgttgatgagcaatgtgaactgaattactgttgtatctggaggaattcc

SEQ ID NO: 6802943 - DNA, 57 bp, Homo sapiens
agagaagtctcagcacacttgctgttcatctgctctatgtgccctgcagacttcttt

SEQ ID NO: 6802944 - DNA, 61 bp, Homo sapiens
ggtggggaacggggtcctggcctggggtcagcagcctgggctctggttccagttccgcacc

SEQ ID NO: 6802945 - DNA, 56 bp, Homo sapiens
tgggacatctgtgaagctgaatacaaaaatcagtgtgtgcttgactccagtgccca

SEQ ID NO: 6802946 - DNA, 80 bp, Homo sapiens
ccatctcaacttggtcccaggctcttcaaggaagactgcaaaaagggcaggatttctctagcttggacaaggcagggtgg

SEQ ID NO: 6802947 - DNA, 108 bp, Homo sapiens
ttatactattggtgtaataaaagagttaaattgtcatttgagcaatgagtttcttctaagaagtgtgaatattattaaatggcagaatttttgcatctataggtataa

SEQ ID NO: 6802948 - DNA, 68 bp, Homo sapiens
atgcctcacttgcaagattattcaatttgtgataaaatagatgaaaggtctagcacagtgcctggcat

SEQ ID NO: 6802949 - DNA, 72 bp, Homo sapiens
atcactgtcgtcatctgagatttaagaacattgcaattttaaatcaggtaatagcagatgcaacgtggtggt

SEQ ID NO: 6802950 - DNA, 85 bp, Homo sapiens
cagtggtgggggctgtgcggaaatagatagctcctcaccatctcaaaggaggagctgctactgctctgccagaggaatactgttg

SEQ ID NO: 6802951 - DNA, 61 bp, Homo sapiens
ggggctgggtgaggccgtgagagtcggcgaggaagccggtcctgcgggctcggccgacccc

SEQ ID NO: 6802952 - DNA, 62 bp, Homo sapiens
ctggacgacgccctgcctggctgagctgccctgggagctgtcaacacgggtgtgcgtgctgg

SEQ ID NO: 6802953 - DNA, 56 bp, Homo sapiens
actggcagcattaacagagagcagtagaagcatcatgcccctcccagtctgccagt

SEQ ID NO: 6802954 - DNA, 59 bp, Homo sapiens
tggttctgctcaagccagactgaagctgggtctccaacagtgatggcctgggagaatca

SEQ ID NO: 6802955 - DNA, 55 bp, Homo sapiens
gctcctcttatttcatcagggcctctgagaggtttctgctcagtagtaagagtgc

SEQ ID NO: 6802956 - DNA, 89 bp, Homo sapiens
gtgctttactcttttaagcattcaatgcttagcactgtgctttgcatctgccatgtgctggttagtgtttgaatgaatgaaaaaagggc

SEQ ID NO: 6802957 - DNA, 55 bp, Homo sapiens
gtggttgggatcatgggctatggaatcaaaatgtctgtatccaaatcctagctat

SEQ ID NO: 6802958 - DNA, 64 bp, Homo sapiens
atcattggatttgtatggatggaggtcactggtgaccttgaaaaagctattacaatgcagtggt

SEQ ID NO: 6802959 - DNA, 56 bp, Homo sapiens
ggtgagaggccaccccgcccgccctctgtggccgccgggctggccgggccctcacc

SEQ ID NO: 6802960 - DNA, 64 bp, Homo sapiens
attcttctctgggttgggttcagagactgacagtaagctggacagcagttacccagaaaggaat

SEQ ID NO: 6802961 - DNA, 82 bp, Homo sapiens
agattgaagtccaagtctaaacacatatttaaaacgttttgtactgtctgttctaaatatgctgattaggtgactttgatct

SEQ ID NO: 6802962 - DNA, 77 bp, Homo sapiens
ttccagagacacattttcagctctgccaaaccataatgcttaggctttcgtttggatatagctgaggtgtcttggaa

SEQ ID NO: 6802963 - DNA, 85 bp, Homo sapiens
ccagggagctaataaagactcagaggcccaggctcatggaagtaggagagggcctgggcttttgcatttttacaaagttccctgg

SEQ ID NO: 6802964 - DNA, 90 bp, Homo sapiens
tttctggaagcatttctgtatttatggaagagaacaggactaaagaacgatgtgtttagcatgttcctttcatagagagccttccagaaa

SEQ ID NO: 6802965 - DNA, 55 bp, Homo sapiens
ccagcttagagatagtgagtcagatgggaaatcaggattcacatccctgggaagg

SEQ ID NO: 6802966 - DNA, 87 bp, Homo sapiens
tagtctgctggtaaggctcagattcacatttggtttggggaagacccaggatctagccaactgtgatctgagtaccagggaagtcta

SEQ ID NO: 6802967 - DNA, 79 bp, Homo sapiens
ggggccaggctgccggccacaggtggcgggaaggcgcaggcctggtggccacgtgggcgcgagcttgggcctcggcccc

SEQ ID NO: 6802968 - DNA, 88 bp, Homo sapiens
tttggaagtaaaaaacttaaggttaagtttgagaaaggagagagcactttcctcctcctcaaattagcttttgttctgtttttctagg

SEQ ID NO: 6802969 - DNA, 69 bp, Homo sapiens
gagcagtgtgggttctttgcaaatgttattatcttgtcgatttctcacgggattttgcaaatactgctt

SEQ ID NO: 6802970 - DNA, 103 bp, Homo sapiens
taagtgtttattgaatgaatggttctacttcaaagatttgtgggactgagttctcacagtatcaggtggagtggagaattaagttattaaattaacccactta

SEQ ID NO: 6802971 - DNA, 80 bp, Homo sapiens
gtggagcacggcaaggataggtactatgtaataaagcttttgattcatgttttatatatgtttgtttttgtgtgggccac

SEQ ID NO: 6802972 - DNA, 100 bp, Homo sapiens
cctcatgaatgggatttgtgcccttatgaaagaggcccaagggagcttgtttgccccctctgccacatgagggcacagcaagaaggtgccatccgtgagg

SEQ ID NO: 6802973 - DNA, 85 bp, Homo sapiens
agtgctatggtagacaaggtggaaactgcatggccttttattacctaatcttgaaagtcacatagcatcacttctgtcatacact

SEQ ID NO: 6802974 - DNA, 67 bp, Homo sapiens
tgtcctgaggaaaatggagtgtaattaagggtgagcacccttaattcttgagctgtctttccagata

SEQ ID NO: 6802975 - DNA, 129 bp, Homo sapiens
ggctccagtgttggcaggtctcctcctccatgcagccctcccagggaactggctctgcttgggaagtctgtggggtccctggggcagcagctgggtgagtcctggaatcaatcctcatgtctggctgcc

SEQ ID NO: 6802976 - DNA, 82 bp, Homo sapiens
tacttctctataatgttactgagtaatgtatagatgctttctttatgtctggcatttaacccttataacaatgtgggaagta

SEQ ID NO: 6802977 - DNA, 57 bp, Homo sapiens
gaggggctggctgtggtcccatcgacagtgtgtgaggacagggagctgagcaccctc

SEQ ID NO: 6802978 - DNA, 68 bp, Homo sapiens
ggtgatggatggattaatgagtggagggttggatgaaatgatcacaattcagtgtctactccattgcc

SEQ ID NO: 6802979 - DNA, 56 bp, Homo sapiens
gtttcaggcccatggggtgtggggagaggtggtcccagaggagcagggcgtgagat

SEQ ID NO: 6802980 - DNA, 69 bp, Homo sapiens
gtgcagctgggcgctgaccttccaggtagagcacagatggcacaaccccgaggcagccccaacttgcat

SEQ ID NO: 6802981 - DNA, 64 bp, Homo sapiens
tttgcttttccctgtctctgatttggtacttagcactgggtcatataccacagggaagaccaaa

SEQ ID NO: 6802982 - DNA, 75 bp, Homo sapiens
gaagcatataccttcagctgtttttctgaagcttgtgacaagagacaggcttttatacattgctgaccatgtttt

SEQ ID NO: 6802983 - DNA, 84 bp, Homo sapiens
ggtgggcaattgctgtgtcctcactgtatgcaaggtgctttttatgtttctctgcataattttgaggcagggattattgtcccc

SEQ ID NO: 6802984 - DNA, 87 bp, Homo sapiens
tttgactatttggaaccctaggtttattgatttcagaatatttttaatgaatcatcctgaagtcaataaagttccatgacttgcaag

SEQ ID NO: 6802985 - DNA, 67 bp, Homo sapiens
ccacatgtccaccctgcaactgtacctggcttgtgtcccacaaggaggaagatgcaggggactccgg

SEQ ID NO: 6802986 - DNA, 83 bp, Homo sapiens
aggacagctgctgttgaatcagaagtcctggctctgctgtatgcatggcataggtccttgttcaactgaaaagcagttggcct

SEQ ID NO: 6802987 - DNA, 70 bp, Homo sapiens
tctagtggaaactaactggaattaaaatgggcacaaattccattcaagtgctagttatttattcattaga

SEQ ID NO: 6802988 - DNA, 67 bp, Homo sapiens
gccacactggctctgtgcttctagtatctgcatttaatgcttagattctaccagagctagtttgggc

SEQ ID NO: 6802989 - DNA, 56 bp, Homo sapiens
gggagaaccagccagtgcaagggcccctcatgtcctgcctggcctttgcttttcct

SEQ ID NO: 6802990 - DNA, 82 bp, Homo sapiens
ttctgcatgtgcctgtgtgttttgtatgtaaattcgatcagcaagatcagtcatttcacaaagaacagatgcaggtgtagga

SEQ ID NO: 6802991 - DNA, 61 bp, Homo sapiens
tctgcatggagaggagatgctaatagtaaataattaaatttagcacttcccatgtcttaga

SEQ ID NO: 6802992 - DNA, 57 bp, Homo sapiens
tgctctgtatcttacaacagggtgctctgagtatcagcatgggaagatcgcggagta

SEQ ID NO: 6802993 - DNA, 58 bp, Homo sapiens
cttctctgtgtagagattcagagcctgaaaagggtgagaaggcttctgcctggaggag

SEQ ID NO: 6802994 - DNA, 69 bp, Homo sapiens
aataaatgtctgtaggggctgcaggcttcattgtttggtaagcctgacagatttctcctatcatttgtt

SEQ ID NO: 6802995 - DNA, 65 bp, Homo sapiens
ggaatgaatttccagctgggtcccttgtcataggagggctcgtggtaccttctgggaaacattcc

SEQ ID NO: 6802996 - DNA, 61 bp, Homo sapiens
ttctcagactcctgagggaaggatgctacccagctacagctggttcctcgagagtttggaa

SEQ ID NO: 6802997 - DNA, 68 bp, Homo sapiens
gggagagctgcagccgagagggggagctgaagagaagtgccccttctgtgtcctgtcagcctcatcct

SEQ ID NO: 6802998 - DNA, 58 bp, Homo sapiens
atccaagccagggatggaatgataggggaaagcccatctgcacaattttggttgggat

SEQ ID NO: 6802999 - DNA, 95 bp, Homo sapiens
tagtaggaagtattttaggtttggtttgacaagactgataataatccaagtgacaaaaggatgattagtctcagatctaccttcttcagtgacta

SEQ ID NO: 6803000 - DNA, 114 bp, Homo sapiens
gaataagtgcttaaaggtgaatttgttgtcattgtaaggtccttctgctgcagttaaaagaaaattgagagtggatgcctacaaggattttgacatgttttatgcactcaattc

SEQ ID NO: 6803001 - DNA, 56 bp, Homo sapiens
ggtgggcagagccagttcatgaaggatttaccatttctgggctgctgctgcccatc

SEQ ID NO: 6803002 - DNA, 89 bp, Homo sapiens
gggacttaactgagaggatctgagtagcagacaccctaagagcatgtcattgtcttctcaccagttactctccagttggctagagtccc

SEQ ID NO: 6803003 - DNA, 85 bp, Homo sapiens
ctatgggagtgggagcgagggtctgagtggaatggtagcatgatttaattttacaggattaccctggctgctggcttgagaatag

SEQ ID NO: 6803004 - DNA, 71 bp, Homo sapiens
ctatgttttgatgtacagaattgttcacaggtatgcttatttgtgagtacttatgtatataactcacaaag

SEQ ID NO: 6803005 - DNA, 71 bp, Homo sapiens
agttttaccctggagcaagtttcctcagtcatgttaaattcatggggaaaatcctcctaggatttagaact

SEQ ID NO: 6803006 - DNA, 56 bp, Homo sapiens
ctccccatggcaacagttatgggactcctcccatagtccacgcctgtcttggggag

SEQ ID NO: 6803007 - DNA, 103 bp, Homo sapiens
gccagccctgatgaaaccagctgctctcagcagttccagggccatcatcacctctctggctgctggagcatctgagagcatcctgcaaagtttctgggttggc

SEQ ID NO: 6803008 - DNA, 64 bp, Homo sapiens
gtgatgaatgatgccagttgaaatgcctcatgcttctgactcatttcagaaccattatcatctc

SEQ ID NO: 6803009 - DNA, 61 bp, Homo sapiens
tgcattccagctcccttctggcccgaggaggcggtgggctgcgggaaggtgctggagtgca

SEQ ID NO: 6803010 - DNA, 81 bp, Homo sapiens
tgtcaatgtcaatgacattgtcattgacaattgacaatgacaattgtcaattgacaatgacagtgtcaatgtcagttgaca

SEQ ID NO: 6803011 - DNA, 93 bp, Homo sapiens
gtgaccagtttaagctcttcctgcctgtgtgtatagcatgggacatacaggttctctagggaacagaaagctttcaggaaaatggaaattcac

SEQ ID NO: 6803012 - DNA, 109 bp, Homo sapiens
agaagtccaaactccaatcagggctcagggttttctgctgaagatttcacaagacgaacatctaggtgacatctgaggccaggagttcatctgagacttggtgtcttct

SEQ ID NO: 6803013 - DNA, 73 bp, Homo sapiens
tcctatttgtgaaagtgtcccctacagaggcattctgcatttaccagatgtccaggggcatcacaagtagaga

SEQ ID NO: 6803014 - DNA, 65 bp, Homo sapiens
aggaaatcacattgttcttagtttaccttccctttaaaggaaagctggggaatatgttaaatcct

SEQ ID NO: 6803015 - DNA, 88 bp, Homo sapiens
gtagctaggaaaaagtttgtgcaaacactcagaggcataaaaaattatgcagtagctggaagtttcacacaactacattgtagagtac

SEQ ID NO: 6803016 - DNA, 60 bp, Homo sapiens
ggaactgcttgtaaataatgttgattaatttgcaatcagcactttttaaagcagcattcc

SEQ ID NO: 6803017 - DNA, 92 bp, Homo sapiens
aggagctaaatgaaatgggccaggtgttacacgagtgttaaaatgatggtattttgaccaagcagaatacctgcctcatttctttgcctttt

SEQ ID NO: 6803018 - DNA, 71 bp, Homo sapiens
tggcgatgcaagtgctgtatccaattagaagttttacttctcaataaactgctcaattgcatcaatagcca

SEQ ID NO: 6803019 - DNA, 76 bp, Homo sapiens
gctaaaaggtggcctagttttttctggtaggtacaataagttgtagctaatgacataactgggttctatgctttgc

SEQ ID NO: 6803020 - DNA, 57 bp, Homo sapiens
ggctggttagatttgtggtcttcttcctcctgtggaggaccctagagagagccagcc

SEQ ID NO: 6803021 - DNA, 115 bp, Homo sapiens
aataccaactatacttaagcagtcctgggatactaagaaattttgaagtgcaatcacttccttcaaagtacttacagtatgcttggaaaaaaactgttttaaaagatagtgtatt

SEQ ID NO: 6803022 - DNA, 69 bp, Homo sapiens
agatgactatgatgtattttgcatctagctatagcggttgtatagcatttgtttatcattcattcatct

SEQ ID NO: 6803023 - DNA, 79 bp, Homo sapiens
gtatatcttttccttgatggttaaatattgatctagtatttatattgctgaattattttctgtggaggaccagataagc

SEQ ID NO: 6803024 - DNA, 83 bp, Homo sapiens
aataagcttgatagtaaaggtggcttacttgatagtccacagaaagatagccaagtcaagcatgcccttatttatggcttatt

SEQ ID NO: 6803025 - DNA, 67 bp, Homo sapiens
atgcaaattccacagatgtctatctgtctgggaacctgggatagaaatgggcttgtgggagtaaaat

SEQ ID NO: 6803026 - DNA, 90 bp, Homo sapiens
ggctattttgagaagtcttgcagtgtctaacagatttgggttcagataatattttcaatctaagggaaattggagatgtaaaggatagtc

SEQ ID NO: 6803027 - DNA, 74 bp, Homo sapiens
ggtgagcaggactttaaagagacgcggcatgcccagggtttcatagatgctgcctttgtggggtcactgttccc

SEQ ID NO: 6803028 - DNA, 61 bp, Homo sapiens
gacttcatgctttagagagatgaagataaaataagaatgacttcatttgttagtagaagtt

SEQ ID NO: 6803029 - DNA, 116 bp, Homo sapiens
ggccaactaagtgtgagtgaaatggaaggtggagtgtgccacttctgggccaaggaagttaaacacagatgtgctccaccctcacactcttcccttgtatgctgaccttggaggcc

SEQ ID NO: 6803030 - DNA, 62 bp, Homo sapiens
acccacttcttacctctcttaaaatccagcaggaaccagcgataacagaagtagaagtgggt

SEQ ID NO: 6803031 - DNA, 75 bp, Homo sapiens
tgcataaaacagagtattcctcagtcattttgtaaacctttgttcaacaaaagaatgaatacattgtgttgtgta

SEQ ID NO: 6803032 - DNA, 57 bp, Homo sapiens
tttagcattggagtctgggctacgtgaaggagatgttgacacagatccaatcctaaa

SEQ ID NO: 6803033 - DNA, 82 bp, Homo sapiens
atatgcatggatacacgtatatgtgtgggcctgcatatcctggatatccaggatagtcacaagtgtgtgtgtgagtgcatgt

SEQ ID NO: 6803034 - DNA, 67 bp, Homo sapiens
gcagtgtattcctgctgaaaatctttaacatactgttgaaaatctttagtagaggaatatattctgc

SEQ ID NO: 6803035 - DNA, 55 bp, Homo sapiens
gctgccctgtggtagagggtggaggaaagccccaccacccctggatgaggggggc

SEQ ID NO: 6803036 - DNA, 63 bp, Homo sapiens
gctctgcacagggctgccaggcggcttctgtctgtgcaaggccacaggcaccctgtgttcagt

SEQ ID NO: 6803037 - DNA, 87 bp, Homo sapiens
gctaggggttcaccaaaagtatagggtttggagtcaaatggcccaggattgaatcctaattctatcacttactgtgcaacctccagc

SEQ ID NO: 6803038 - DNA, 68 bp, Homo sapiens
ggcctcgggcacggaaggcgccaggggtgcgggttcctgcaaccccttggagtccgcgcccagaggct

SEQ ID NO: 6803039 - DNA, 88 bp, Homo sapiens
atgtataggttggtgcaaaagtaactgtggttttgccattacattccatggcaaaaaccgcaataacttttgtaccaaccaagtacat

SEQ ID NO: 6803040 - DNA, 127 bp, Homo sapiens
gaagatgaaagtaaattggtctaggtgtatcaatggcaaaggaacctattttaaaaagtcaagaatacttttaagatggtattttataaagatgcatataataataaacttaaactttcacatcttc

SEQ ID NO: 6803041 - DNA, 68 bp, Homo sapiens
ccactgtgcttgtgttcattgttaattgaagtcacactgtgtgcacaagagagcgataagcactctgg

SEQ ID NO: 6803042 - DNA, 58 bp, Homo sapiens
gggcagtttgggcaaggccacatagatgacatacatttcaggctgatccaggcagccc

SEQ ID NO: 6803043 - DNA, 83 bp, Homo sapiens
gcaactctggcacagatcacttgactaaaatgagactgggaattacaattattttagattgagtcattttcccaccatgttgc

SEQ ID NO: 6803044 - DNA, 69 bp, Homo sapiens
ttcattctacattcttcatggcagagggccaccctgtaggaccacctcacccagaggactgttaatgaa

SEQ ID NO: 6803045 - DNA, 59 bp, Homo sapiens
gccgggccgcgctgcgctgcagtaccgcccgcggcctgcagtgtcgctgcgagcccggc

SEQ ID NO: 6803046 - DNA, 56 bp, Homo sapiens
ttgcagctgttgcaaagtctcttcaacttccgttgctttgcctccagcagccgcag

SEQ ID NO: 6803047 - DNA, 69 bp, Homo sapiens
aatggatgaaggcatttttgttgcctgcgtctcatccctctgcactttccaagattgccttgttccatt

SEQ ID NO: 6803048 - DNA, 72 bp, Homo sapiens
ccatagttcagtactgatggaatctgagaaaatttatatgaccgcgaacccatatctctgtactgaatgtgg

SEQ ID NO: 6803049 - DNA, 80 bp, Homo sapiens
aaaaaataccatgcctggactccactctcagagttactaattcaattaatctgagatgaccctagccgctggcatttttt

SEQ ID NO: 6803050 - DNA, 75 bp, Homo sapiens
ctctgcaatttcatggcctactttgcttcaatatactcaagacaggaagttgcagcaaggtcatgaaatgtagag

SEQ ID NO: 6803051 - DNA, 78 bp, Homo sapiens
caaattctgccaaaaattagcaaatatatttcatttttaataatagacatgacagatagttgctagctggtaggtttg

SEQ ID NO: 6803052 - DNA, 56 bp, Homo sapiens
acaggacaggccctgtggggtctgagggttcctcagctttccagacgcctgcctgt

SEQ ID NO: 6803053 - DNA, 74 bp, Homo sapiens
tccatgagccaagcttgttttatgatattaaacatttaaataaaattataaatgtaccataaaatgctgatgga

SEQ ID NO: 6803054 - DNA, 58 bp, Homo sapiens
gaggcctgtcgctaggcctctgctgcctgggggacaaaaggggcctggaacaggcctt

SEQ ID NO: 6803055 - DNA, 95 bp, Homo sapiens
tatgaatttgtatttaaatcaatgttagtcatgaattttcaatacattggaaatttctagtgttgctaatattatggtttaagaaaattgtcata

SEQ ID NO: 6803056 - DNA, 77 bp, Homo sapiens
gattctgttcacactggtgatcaaagggtagaaatgttttctctctcccttctattctggcagtttgaaaaagaatc

SEQ ID NO: 6803057 - DNA, 57 bp, Homo sapiens
gctttcctgccttattcattcatttccaggcaatgaggatgagcaggcaagacaagc

SEQ ID NO: 6803058 - DNA, 58 bp, Homo sapiens
cactgacactcttgatcctatagtagggttgggttccacaatagaatagagtgtggtg

SEQ ID NO: 6803059 - DNA, 67 bp, Homo sapiens
aaagatatagaaagagctgggagtcaatggcaaccaggccaacaattcatgactttttctattcttt

SEQ ID NO: 6803060 - DNA, 68 bp, Homo sapiens
gaggtgctcaagggtttcaattgtagcctgtctgttttgtgacaacatcagctgagaccttcacattc

SEQ ID NO: 6803061 - DNA, 126 bp, Homo sapiens
cactactaagactatttttagtttactttatctttttatgtctgatcttggtaattcttttgtcaagatggacataaggagagaatagaagaaagaaaaaaaattgaaaattcttagaatcaagtg

SEQ ID NO: 6803062 - DNA, 68 bp, Homo sapiens
aagaaaacacagattattgctggagacccctaaggcctactttgtctgtgcaatagtttgttttactt

SEQ ID NO: 6803063 - DNA, 90 bp, Homo sapiens
agctctggatgtgtcatctttcctgccattgcccagtgatagactatgcaacattctctggaatggcaatgggaagtcccaccctcagct

SEQ ID NO: 6803064 - DNA, 74 bp, Homo sapiens
tactttgtgacttctctgtagtgctgagatgccagaaaatataatagtttccagccaagggaggttactaggta

SEQ ID NO: 6803065 - DNA, 90 bp, Homo sapiens
attatttcatggtattgcagaggcaattagttatacaaattaggtaatcatgtatcaacaaaggccttgtgtttgtgccgtataggtaat

SEQ ID NO: 6803066 - DNA, 65 bp, Homo sapiens
agaaagatttggtatcagaagacctaagttcattcttgcacttcaatagataccacatctgatct

SEQ ID NO: 6803067 - DNA, 60 bp, Homo sapiens
aggtcactttggcctctacagccatgccattccatgactgctaacacgccaaagtttctt

SEQ ID NO: 6803068 - DNA, 56 bp, Homo sapiens
tagcacactaaagatattaacagtcggtacctctagactggtgtatcattgtgctg

SEQ ID NO: 6803069 - DNA, 77 bp, Homo sapiens
gtgaagtatatttagctgagcttgtgcatatgacttcagttcataaaaagtttacaagtgcagctggaatgcttagc

SEQ ID NO: 6803070 - DNA, 119 bp, Homo sapiens
tcaaggaaaagtacataccttggaactaacagctaagaaatatgatcacattagcaccagaaattgatttttttctcaagctgtttgccaattgtgtattgattagtcattgtccttga

SEQ ID NO: 6803071 - DNA, 64 bp, Homo sapiens
gggcctggcaggtatctaaagttgtcttgcctctcatgacactctcatggcttgtcagaggccc

SEQ ID NO: 6803072 - DNA, 85 bp, Homo sapiens
gataaaagagagatgatttgtaccatcaaggagcttacaattctccaggagacacaaggtacatagatgcataactctctaattc

SEQ ID NO: 6803073 - DNA, 56 bp, Homo sapiens
agttgcatgtccaagggggtagattttcatcaccctactaaatgtggtatgtcact

SEQ ID NO: 6803074 - DNA, 72 bp, Homo sapiens
gctttcagatggtgtagcatgtgatatgaccagtggatcctgtggtcatgggaccatgcttacctcttttgc

SEQ ID NO: 6803075 - DNA, 60 bp, Homo sapiens
aggaacagtagtggtcaatatgccagggtccacactgtaaatcagccagctactgtctct

SEQ ID NO: 6803076 - DNA, 55 bp, Homo sapiens
gatggaggctgtcttgtgcactatagtatatttagcagcatttttagcctctgtc

SEQ ID NO: 6803077 - DNA, 56 bp, Homo sapiens
gtctctcacaactagaagggaaagatgtttccccacatcagtccagctgtgaagac

SEQ ID NO: 6803078 - DNA, 58 bp, Homo sapiens
tggggatgtgctacacttcaatgaaaatggctttttaaaggaagatctatacacccca

SEQ ID NO: 6803079 - DNA, 64 bp, Homo sapiens
aggcagagaaaaaccagatatgcctggagatacaggtaaggagtctgtgttctctcagctgtct

SEQ ID NO: 6803080 - DNA, 61 bp, Homo sapiens
ccccttcccttctgggagatccattctgcttcagggcctgggtccttgggggcggaagggg

SEQ ID NO: 6803081 - DNA, 65 bp, Homo sapiens
cagctttcagagactagagatgtaagcacaaagcatttccctgagcttctctgaaatgggagctg

SEQ ID NO: 6803082 - DNA, 80 bp, Homo sapiens
aaaagtagagcttcttgggctttacacaaagcaattctgattcagtaaatttatgctgaggcccaggaatatgtattttt

SEQ ID NO: 6803083 - DNA, 58 bp, Homo sapiens
tctaagtcccaagattaggttggaaagggtatttcttgttggcttagtttgggttgga

SEQ ID NO: 6803084 - DNA, 56 bp, Homo sapiens
gctagctgccagtaaaaagatgcagtcccaggctccagctcttactttgcagcagc

SEQ ID NO: 6803085 - DNA, 69 bp, Homo sapiens
gcctctactgccggcgcctgcggttcctcctggccccaaggcaccgctgcaggcgcctgcggtctctgc

SEQ ID NO: 6803086 - DNA, 67 bp, Homo sapiens
tattggagatttagtttcagcttctcttacagttaggtgctggtatatgactgagttttgaccaatg

SEQ ID NO: 6803087 - DNA, 65 bp, Homo sapiens
cctttgtagattttctctccagtatgaattttcttatgtttactagactgagaatcagctgaagg

SEQ ID NO: 6803088 - DNA, 68 bp, Homo sapiens
ttccagcatggccacgggggtaggtaaaagcagaaaatcatagctttgcaagagcccagggccaggaa

SEQ ID NO: 6803089 - DNA, 60 bp, Homo sapiens
cttctagactatgggaatttcctgtagggaaactaaaaaaatcccattgggttatagaag

SEQ ID NO: 6803090 - DNA, 75 bp, Homo sapiens
tctggtgattaatgtaacaaggaaagccagcaaacatcatccttggcctaatctgaatgcacttagttaccaaga

SEQ ID NO: 6803091 - DNA, 82 bp, Homo sapiens
gaggaggagagatggtagattgggtgaggggcatcacataaactctggagctagacccagttctgcggttattcattcattc

SEQ ID NO: 6803092 - DNA, 130 bp, Homo sapiens
ttagttccaagtccagagattctgatttaacaggcatagaacaggacctgggaatctgcattttaaataaactcaaggtccatcttaaatgcactcagaaataagtgattttactacttgagaaatgtaa

SEQ ID NO: 6803093 - DNA, 59 bp, Homo sapiens
agagactgcaaatcataagaatatgtggatgctgcatattcttccatctgtaagtttct

SEQ ID NO: 6803094 - DNA, 72 bp, Homo sapiens
ggagacagagggtatggtggtgccactcccttctgtgtagaagctggagtaggaccatgcttgatgaactcc

SEQ ID NO: 6803095 - DNA, 70 bp, Homo sapiens
gagtagccattgacttaaagcttattcaggaaaaaccacctttcaaataagacttcggttagtgccactc

SEQ ID NO: 6803096 - DNA, 62 bp, Homo sapiens
gtcaactacatgttttccctcagatggaaaattccagaggaattgggaaacatgtacatgat

SEQ ID NO: 6803097 - DNA, 90 bp, Homo sapiens
tcagacatcctgctgcaaaatggctgtggtctggcaaggctgggaacagcttttgtgggtttgcagtgatatttgaagtttgatgaatga

SEQ ID NO: 6803098 - DNA, 73 bp, Homo sapiens
ctcatgggtcccaggcttctgaatcagtacatatacatccatacctgactctgggcctttggtgactctcaag

SEQ ID NO: 6803099 - DNA, 62 bp, Homo sapiens
gcccattcctggcatggctcactgtggtccaggatggaagatagtgaggcagttcagtgggc

SEQ ID NO: 6803100 - DNA, 112 bp, Homo sapiens
cagcaaagagcagcagagccagcctgcagctccggatttctggggccctgaccctggtccttgtcaccccagtctctggagctccagccctgcttcttgtggctttcggctg

SEQ ID NO: 6803101 - DNA, 97 bp, Homo sapiens
ggtggagggttgtactaggggtgtggaaggtatagaatctaattatcaattactgacttggttatcttttaccattcttctggaatggcttaccacc

SEQ ID NO: 6803102 - DNA, 71 bp, Homo sapiens
tcacacattagccatttcatcagaaccacacatcgtttggcagtggagatgaacatggtgatgttaagtga

SEQ ID NO: 6803103 - DNA, 123 bp, Homo sapiens
gcctttgtatgttcagaaggagaagaaaatggagtctggtgaatactcagcaatacctgcctctccagccaggtattccagtggtcaccaagataccccctgtcagtcagaaagtacagttgc

SEQ ID NO: 6803104 - DNA, 74 bp, Homo sapiens
cttcacctctttgcattgcatacaaggaactgagtaataagaacctcagccttgtttgtagttaatagtggaag

SEQ ID NO: 6803105 - DNA, 80 bp, Homo sapiens
tggggctctgggggattgaattgtagctgggcttcttaataactctacttggagaagtcactcatattcctcaagcctca

SEQ ID NO: 6803106 - DNA, 90 bp, Homo sapiens
ttcagttttaagagactagagagatataatatggcatggtctaaaatatacccatataggatctcttctaagaacttcctaaggattgaa

SEQ ID NO: 6803107 - DNA, 60 bp, Homo sapiens
cagtaccagtcaccacattgatggcctgaatttattccattgacctggcagactggactg

SEQ ID NO: 6803108 - DNA, 76 bp, Homo sapiens
ggtatttcaggtggtaaaatgtgaaatggatttttgaaggcaaaatgtttatttggtttatcacttgtttatgtcc

SEQ ID NO: 6803109 - DNA, 67 bp, Homo sapiens
ggggttcttcccagtcccaagaaaagccagtttctctctgcagctaattgggattggggaggagctt

SEQ ID NO: 6803110 - DNA, 72 bp, Homo sapiens
gaatactgagatcccacaaagcaaaatgccatcctacatcttgaagctatgcttagtgggattcagtgattc

SEQ ID NO: 6803111 - DNA, 56 bp, Homo sapiens
tgtgaaggcagccatcgacagtttggaaataggcaaataggcatggctgtgttcca

SEQ ID NO: 6803112 - DNA, 74 bp, Homo sapiens
gccttaacctcttcatttggatgcgtgtttaagcaacacaaaccttgtttagtccaaattaagagtcctatagc

SEQ ID NO: 6803113 - DNA, 69 bp, Homo sapiens
ttgtgagcaggaaggagcacaggaccctgacatttgatgagatacagcagtttgtgatcctagcagcaa

SEQ ID NO: 6803114 - DNA, 87 bp, Homo sapiens
tcccaggatcaggtttttaactctgtggttcaggattctgtttgctaaggacctggcataagggcttgagtccagcttgccctggga

SEQ ID NO: 6803115 - DNA, 69 bp, Homo sapiens
gcagatgttgatgcaagaagaggctaaaagcacactaacagaactgggctcatacttttgtgcatctgc

SEQ ID NO: 6803116 - DNA, 95 bp, Homo sapiens
aaactagggaaagagagaaaagccttctcacataagtagttccctgtgataccactatgcttatgtaaagagacaggagttctgttttatagttt

SEQ ID NO: 6803117 - DNA, 57 bp, Homo sapiens
tggagaagattggtcaccattctggtgagaaggtggaagatgaacccaaattcttca

SEQ ID NO: 6803118 - DNA, 65 bp, Homo sapiens
ccgccctaggcactgaggggagcaaggtggacaatgacatcggcctagctcccgtgggttggtgg

SEQ ID NO: 6803119 - DNA, 105 bp, Homo sapiens
cctggcgtaacctgcctgatgttccattctgttcttctgtaaagttaagttgtggctacttcacaaatatagtgagaaccagatgtatgtaacaagcactccagg

SEQ ID NO: 6803120 - DNA, 76 bp, Homo sapiens
ggaccgctggacggcacatatgctttggaaagggagcacctcccttggctctgtcgccgtttggaataactggtct

SEQ ID NO: 6803121 - DNA, 80 bp, Homo sapiens
gcagaggttggcatataaacctttaatcagtgttatttaaggaaattttgaagagttttatgccaacctacatctactgc

SEQ ID NO: 6803122 - DNA, 82 bp, Homo sapiens
aatcaattaccaaatgaaatagagattttttttaaaggttcaaaccttttcaaatttttatgttatagggtttatattgatt

SEQ ID NO: 6803123 - DNA, 82 bp, Homo sapiens
ccatggtattctggcaggagaacaccaggtagaaaggaaactgggtcctaaggcttggacttctccaaccctgatatagtgg

SEQ ID NO: 6803124 - DNA, 67 bp, Homo sapiens
ttcttaggggcagtcgggtcagaatattctgtgtattaaatatgttcaaaatctgtgctgctaagaa

SEQ ID NO: 6803125 - DNA, 57 bp, Homo sapiens
tgctcagactagctccagggaaggtctgtgtctcttccctcagatgagctcctagca

SEQ ID NO: 6803126 - DNA, 69 bp, Homo sapiens
catcttctagttccttcttccaaacccatcatctcataggtgaggcagggaaggggagccatgagggtg

SEQ ID NO: 6803127 - DNA, 81 bp, Homo sapiens
agtgctcaaggttttggtgagagctgaccgtgcgagggttactggcacgtagttctcaaggcagttctcacctacagcact

SEQ ID NO: 6803128 - DNA, 103 bp, Homo sapiens
gttctgtgtgtttgttttgggtctcttgatatattacatagagttccgattattaaactccatttatccaaggagatgtttccaaagctaaaactcaatgaac

SEQ ID NO: 6803129 - DNA, 76 bp, Homo sapiens
ggcagaggcgggtggatcacttgaggtcaggagttggaaaccagcctggccaacgtggtgaaaccccgcctctact

SEQ ID NO: 6803130 - DNA, 60 bp, Homo sapiens
tgggacacggaggccccagcactcgccaggcttcatgtgcgtggggacccctgtgtgcca

SEQ ID NO: 6803131 - DNA, 65 bp, Homo sapiens
tgccagtgctttcttatatcaggcggattccatgtgtggaacatccatgtgagaatagactagca

SEQ ID NO: 6803132 - DNA, 55 bp, Homo sapiens
aagtccagtatttctagatctttcagtttttaagagaagctagaattctggattt

SEQ ID NO: 6803133 - DNA, 84 bp, Homo sapiens
gcagagcagcgtggaggcctgttccttcctgggcacgcggcacagccagggtgaggcccgagggggaaaggtgcatgactctgc

SEQ ID NO: 6803134 - DNA, 118 bp, Homo sapiens
gctcttcaggagggagtacatgggtgtgtgcagggtggcactcacatggatcaggaggaacatgaccaggttccccagcagagtggctgtgtacatgcccaggaacaccacgaagagc

SEQ ID NO: 6803135 - DNA, 67 bp, Homo sapiens
gtggcaggtggcatgactgcctacaaacacaaagttcccggggtccacatgtcatagactgatccat

SEQ ID NO: 6803136 - DNA, 76 bp, Homo sapiens
tattttggaaaacttaccatgtgccagagactgttctaattattttataaacatgtctcttgtggttttcaagata

SEQ ID NO: 6803137 - DNA, 76 bp, Homo sapiens
ggaccctgtcgccctgaaggcctgtttgctgcacatctgcctgcagagccaaacctcagggcccggtgcagtgtcc

SEQ ID NO: 6803138 - DNA, 58 bp, Homo sapiens
ggtgggagcagcttatgtcaagccagaagggattctctgaaggggagctgtttaagcc

SEQ ID NO: 6803139 - DNA, 74 bp, Homo sapiens
ggcagtataacttccactgttgccataagtgtgttctgaaagaggaaggacagctatgacagatggataatgcc

SEQ ID NO: 6803140 - DNA, 86 bp, Homo sapiens
gcctcagtttttgtgggcatcagcaggaacacaacagccccttcctcagactcagggctgtggctgatgaccagggtactgaaggc

SEQ ID NO: 6803141 - DNA, 87 bp, Homo sapiens
gtggattcatgtacaaaaggcaaatgcctcacatatgttaagcttgaggtaagggttattgcctattgtactgatgagagagtccat

SEQ ID NO: 6803142 - DNA, 96 bp, Homo sapiens
cactgggtctgttggctgttggtgacttgcagaaacagctttgttgtcaggaagcgctgctgaaagtcatgtgacagagctgacttgggcccggtg

SEQ ID NO: 6803143 - DNA, 81 bp, Homo sapiens
tggtgcctgtaatctcagctactggggaggctgaggcatgagaatagcttgaacccaggaggcagaggttggagcaagcca

SEQ ID NO: 6803144 - DNA, 70 bp, Homo sapiens
gcattctgtggggacgggcttttggaagacttctatgctcttgatgaaagcacaagttctaacaggaggt

SEQ ID NO: 6803145 - DNA, 86 bp, Homo sapiens
gtgttctccttgtggctgcagcagccgcactaagacactggccacacctggtttctccacagccgctgcagccacgaggagaaggc

SEQ ID NO: 6803146 - DNA, 74 bp, Homo sapiens
gtttgttttaaacaattggtttcagcatgtttgtccattgaaaatgggaatgctgagcccatgtatagataaac

SEQ ID NO: 6803147 - DNA, 68 bp, Homo sapiens
tctgagttttctggagatagtcaggcattatttggccaatgattcatgccagctctccagtacataga

SEQ ID NO: 6803148 - DNA, 61 bp, Homo sapiens
agtgctatgacagcattgttacctgttgagtacacacagggccattatctgttctaggact

SEQ ID NO: 6803149 - DNA, 74 bp, Homo sapiens
tcaaagtagatagagtaagataccgagcctttgtcccttaggcaagttggttgtttattatatactatgtttga

SEQ ID NO: 6803150 - DNA, 89 bp, Homo sapiens
gaagagcactgtttctgaaaagctaggccagttcagctgatcattgttagctagagataagctggctttgggaaactctgagactcttc

SEQ ID NO: 6803151 - DNA, 79 bp, Homo sapiens
aggttggagtgcaatggtgagttctcagcttattgcaaccttcccctcccaggttcaagcaattctcctgcctcagcct

SEQ ID NO: 6803152 - DNA, 57 bp, Homo sapiens
ctgggaggggtagccaatcctagccaagaactacgttagtgttggtgcttttcccag

SEQ ID NO: 6803153 - DNA, 70 bp, Homo sapiens
caatactgagatattaatgagcaagtaagtgaatgaattttttcattcagcaattattgattgagtgttg

SEQ ID NO: 6803154 - DNA, 66 bp, Homo sapiens
ccacaggaagtgaggcctaggcactgggtgggatactgctactcagtcccagctctcactcatggg

SEQ ID NO: 6803155 - DNA, 75 bp, Homo sapiens
tttggcctttggttggtagtttctgtttcctttccctaggtaaggatttacaatgattctaggtaagtgtgcaaa

SEQ ID NO: 6803156 - DNA, 56 bp, Homo sapiens
tgaacaggcattatcagggatcctctattaagaaaatatccttctgtgccttttca

SEQ ID NO: 6803157 - DNA, 85 bp, Homo sapiens
tgggggaacaagatcggcaagccccacaccgtcccttgcaaggtgacaggccactgcggctctgtgctggtcggcttcatcccca

SEQ ID NO: 6803158 - DNA, 81 bp, Homo sapiens
aggaaggtaagcagagagaagaaagccatggtccttgtcacagttgtgcttagtacccttttattttatgtatacatttct

SEQ ID NO: 6803159 - DNA, 105 bp, Homo sapiens
ctcccagactctaattccagcacagaggcggatccttgcatttctgtggacccgcaggaaagtctgtaaaggaaccgcgcgcttggctgggtgccaggtctggag

SEQ ID NO: 6803160 - DNA, 101 bp, Homo sapiens
gtctctagaagccaagagtggtcactgggatcagctggaaaacagctcagtcctggagctgcaaggctgaattcagctgagaactcaatgaccctggaggc

SEQ ID NO: 6803161 - DNA, 62 bp, Homo sapiens
tgctttctgctctggaaacaggactgggcatgctctgtgttctgtatcttagcagacaagta

SEQ ID NO: 6803162 - DNA, 96 bp, Homo sapiens
catttgatagttttccatccatatcttgttgaggaaaccctgagtttatttgcttcatagagatgcttggattttcttaggagagttctaaaaatg

SEQ ID NO: 6803163 - DNA, 114 bp, Homo sapiens
gttgttgtataaccttttgcttctttttcctcatctgtcaaatgggcataaggatagtgtctacctcatgaagttgcaatgaggatgaaaagtgtgaaaagtatttataatagc

SEQ ID NO: 6803164 - DNA, 60 bp, Homo sapiens
tattccagataccttgtgtaagtgtaatcatgcagtgtttgccctttggtgtctggcata

SEQ ID NO: 6803165 - DNA, 58 bp, Homo sapiens
agtacttagcgcgttgtgtagaatgtaataggcactcaaccaatgttagcttagtact

SEQ ID NO: 6803166 - DNA, 62 bp, Homo sapiens
taccatttacttgaaaataaaatgtctgtgtttcctggcagactatttaaagtagatgagta

SEQ ID NO: 6803167 - DNA, 69 bp, Homo sapiens
gatgtatagagttgtgatttggaaaggtgctttgcatgcaaagttcagcctggttttaatgctaacatc

SEQ ID NO: 6803168 - DNA, 64 bp, Homo sapiens
tttgaatctgaaactctgacattgtctgtgactatttcgaaggcaatgtgagagtttattcaaa

SEQ ID NO: 6803169 - DNA, 82 bp, Homo sapiens
aggtagcgtgttttcatggccaccgcaagtgactactctagataagagatctgttcttcagtgagtcatcaaatacactctt

SEQ ID NO: 6803170 - DNA, 84 bp, Homo sapiens
agtctggtggaaaatagaatgaggctgagaattctgtcttttgacatattctccagtagtcattctatcaagtcaaactaacct

SEQ ID NO: 6803171 - DNA, 62 bp, Homo sapiens
attgtggttgactaaatttgtaattcacagggagtctcgttgcagaagcagacgaccataat

SEQ ID NO: 6803172 - DNA, 56 bp, Homo sapiens
cctccatttcagaagggttatgtgctcacccacttgatcactttggaagttggggg

SEQ ID NO: 6803173 - DNA, 64 bp, Homo sapiens
ctccctaataatagaggtggcatttgagttgttaccaagtggtcaaatctcttatttcatggag

SEQ ID NO: 6803174 - DNA, 96 bp, Homo sapiens
gtgtacctgccacagtgccgccatatcatctgcctcttagctcacttttgaaggtgaatgtcaagggtgaagggtggtggcctagaaggtgagcac

SEQ ID NO: 6803175 - DNA, 69 bp, Homo sapiens
tgcggtgggtgcgggaggcgcgcctaggtgccgaaacccggtctgtgctgccatcctgtggccattgca

SEQ ID NO: 6803176 - DNA, 68 bp, Homo sapiens
ggtctgggaacacctgctgcccagtggtctgggaacacctgccactgggcagcaggtgttcttcagtc

SEQ ID NO: 6803177 - DNA, 56 bp, Homo sapiens
tatgcaccctcatctgccgctctactgtaaactaggccttggtaaagggatgcatg

SEQ ID NO: 6803178 - DNA, 81 bp, Homo sapiens
cggctccccaggtgagctcgtctccgcgggactgggtccgggaaggccccaggaccgcgcggctgagcggcctggaggctg

SEQ ID NO: 6803179 - DNA, 58 bp, Homo sapiens
tacacaattctggatgcatgtctatttgggagaattaaatgcagctggagttggggtg

SEQ ID NO: 6803180 - DNA, 120 bp, Homo sapiens
aaaaagtggagatgaaaatagtactttagtgttgttgtgaggattaaatgaggaaatacatttaaagtacctggaacataacaggcactaaataaatgttagctattattttttcttttt

SEQ ID NO: 6803181 - DNA, 80 bp, Homo sapiens
cctcacaaccctgaggcaagtactttccctttttacagaaagatgaaataatttgcctaaaaggtcacatagttgttagg

SEQ ID NO: 6803182 - DNA, 67 bp, Homo sapiens
gcattgggcctgaggccagaacttccactccgcatgctgtcccgaggttcccccgccaggaccctgc

SEQ ID NO: 6803183 - DNA, 77 bp, Homo sapiens
tgatgtgctaatttgggcaacttaatttacattctggcagtcagtgtagataagtaaaagcccagttaagtatttta

SEQ ID NO: 6803184 - DNA, 55 bp, Homo sapiens
agaaagtgatatagttggaatcctacagtacatgggcttttcagattcactttct

SEQ ID NO: 6803185 - DNA, 56 bp, Homo sapiens
tatatgagccataccatgagagttcaggttcagaaccttagatttggcttactatg

SEQ ID NO: 6803186 - DNA, 64 bp, Homo sapiens
aaagtgtgacactgtgttaattagagaaagttgctgttccctgagattcctagtgtcctacttt

SEQ ID NO: 6803187 - DNA, 58 bp, Homo sapiens
gaaaaggattggtaaaatatctgttatttcacttacaggtggaaggccaccccttttt

SEQ ID NO: 6803188 - DNA, 118 bp, Homo sapiens
gggagggccagctctgtggcggtgcagggtgctggaggtggcctgcggcttgactgattcccagggccaggctccactgtaggcagctccacatcagctaacacaggctgtcccttcc

SEQ ID NO: 6803189 - DNA, 61 bp, Homo sapiens
ggaagtcctgctggatcaacctcacctgctgctggggaggctgccatccttcaggaagacc

SEQ ID NO: 6803190 - DNA, 64 bp, Homo sapiens
ggctcacgcctgtaatcccaacactttgggagtccaaggtgggtggatcacgaggtcaggagtt

SEQ ID NO: 6803191 - DNA, 71 bp, Homo sapiens
aagtccctcccaagagtagccatttagttgtgtgttttggaacacagctcagacatcactgctctggactt

SEQ ID NO: 6803192 - DNA, 71 bp, Homo sapiens
tctggtctagagtcaccagataaagcatggaccatatgcctccatttattatttgctgaatctgattcaga

SEQ ID NO: 6803193 - DNA, 61 bp, Homo sapiens
tgctcaaaacccagccatcaggacttatgaatgtgagctatttggacagagggttttggca

SEQ ID NO: 6803194 - DNA, 58 bp, Homo sapiens
caggggaggtggcagaaatgtgcttctataaagaggggccagcctccatcctcccttg

SEQ ID NO: 6803195 - DNA, 62 bp, Homo sapiens
atgtttggaatttgcatactgggaaagttggggtgttttgcagaatgcaaattttataatat

SEQ ID NO: 6803196 - DNA, 60 bp, Homo sapiens
gaattgctctgcctggccagcctgcattccagcgtttactctggtggcctagggcacctc

SEQ ID NO: 6803197 - DNA, 61 bp, Homo sapiens
taaatcctttggcaatgtggttgtctattctttgttttcaaagacattgaagaaggactta

SEQ ID NO: 6803198 - DNA, 56 bp, Homo sapiens
tgacaatgaggccctccacaaacttgatggcgtgggtgcggatgccgtcattgtca

SEQ ID NO: 6803199 - DNA, 55 bp, Homo sapiens
tccttcttgttttatccatctgggactccctccccagtttaataacaaagaagga

SEQ ID NO: 6803200 - DNA, 83 bp, Homo sapiens
gaagttgatttgatgttcataaatgatacaggctatagtgttaagcagacctggttgttaattctggcgtcagcattggcttt

SEQ ID NO: 6803201 - DNA, 90 bp, Homo sapiens
atgtgcaatcagtatcaggagctgcattatcctgtgcatggagctcagaacagaccacaagattatgcagctccctttgttacttgtcat

SEQ ID NO: 6803202 - DNA, 58 bp, Homo sapiens
gggcactgagaattttccactttgttgcttgtgcaagtgacagtgttctgggttgccc

SEQ ID NO: 6803203 - DNA, 67 bp, Homo sapiens
ccggccactgggacacgttgtgctttaacaagatcgaaattgattgctgccagcgtgtccgtgtcgg

SEQ ID NO: 6803204 - DNA, 55 bp, Homo sapiens
ggaggttgggaagtccaagctggcagatttggtgtctgctaagggcccactcttc

SEQ ID NO: 6803205 - DNA, 81 bp, Homo sapiens
gaaatgtaacagcaacaacaatggcatgcaaagaatgagaaaatcatttattaggtaaatctgttttgtacgttacatttt

SEQ ID NO: 6803206 - DNA, 61 bp, Homo sapiens
tggtcttacttagcattatatttccagtgccagccactgggccggtgcagagtagttgcca

SEQ ID NO: 6803207 - DNA, 70 bp, Homo sapiens
aatgctaacattggtttatatcccttgagcacacaccagctggatagtaggaggaagccagttcagcatt

SEQ ID NO: 6803208 - DNA, 129 bp, Homo sapiens
acaatctggaatggctgtggtgatctaacctttggaggaaaaacgggtgttgagatatgtgtaatcatatgtgatatgtgtaatcatatctgatacctacctctgggggtttgcaagtctttggatagt

SEQ ID NO: 6803209 - DNA, 58 bp, Homo sapiens
agttggatggatcaagctgacctctcctggtgagccagttcttcagatccatccagct

SEQ ID NO: 6803210 - DNA, 87 bp, Homo sapiens
gaagtgtacactttgcccctggccgccttcttccctcctggtgtcctgggtggacacggaggtgtgtctggggaaggtgtgtccttt

SEQ ID NO: 6803211 - DNA, 55 bp, Homo sapiens
cccactgatctgtaaactccatgggaatatggactctgttttcctgatcactggg

SEQ ID NO: 6803212 - DNA, 64 bp, Homo sapiens
aatgctattcgtttctgacttggctttttcaacagctaaatacaggtggcaaatgagtagcatt

SEQ ID NO: 6803213 - DNA, 66 bp, Homo sapiens
acccaatggactcaccctgttactggtggaaggtgtccaagttactagcagtgaatccatacgggt

SEQ ID NO: 6803214 - DNA, 60 bp, Homo sapiens
gttccagttgcaacaggtgtgttttggtgtagcatatacacagacgtctgtgcctgggac

SEQ ID NO: 6803215 - DNA, 89 bp, Homo sapiens
gattacacctctttacctcttcgtgcttcagaaattattttccttcaagtgttctaagaggctaatgaagaatgaagtcatgttttatc

SEQ ID NO: 6803216 - DNA, 56 bp, Homo sapiens
gaaacactggtgcccttgacagagccagcttgtataagctgttggggcccgtgttc

SEQ ID NO: 6803217 - DNA, 84 bp, Homo sapiens
ctggaacaggataaaatggctattgagtgatctctagaggattttttgattttcaggacaatagtgatttttacactggttcgg

SEQ ID NO: 6803218 - DNA, 77 bp, Homo sapiens
tttaaatgtggcaatggaaaagtgaaaatagcttttaagataaagcaattgtctctgaattttcagctgcatctaaa

SEQ ID NO: 6803219 - DNA, 77 bp, Homo sapiens
tggtgctgagcctagctgtctcctgtttgggaaaataccaaaggtgcaggacattcagtgaatgggcagacagctca

SEQ ID NO: 6803220 - DNA, 55 bp, Homo sapiens
aagtagttggaaataagacagagtctcagtacctgactcctagtccaacatgctt

SEQ ID NO: 6803221 - DNA, 65 bp, Homo sapiens
tttcaagagcaggaaaaaggtcactgctttaatcctgttaattgcctttattctggctctagaaa

SEQ ID NO: 6803222 - DNA, 67 bp, Homo sapiens
gagcaatggaagatagataacaaaacttttggtgaagttctacactgcctatctgtctttgatgctt

SEQ ID NO: 6803223 - DNA, 75 bp, Homo sapiens
tctggttcatcttcattttatagcatctgtgttctgtttggaagtacagagtattctattgatggaatgaaaaga

SEQ ID NO: 6803224 - DNA, 77 bp, Homo sapiens
ttgttgagagattaacatatcttgtaatgtaaatgctttatcacacattgttgaaagatatgttaatctttcagtaa

SEQ ID NO: 6803225 - DNA, 67 bp, Homo sapiens
ggttcagaggtaaaaactcactgtatttgattctcacatcaaatttctgaggtcttaccattgtgcc

SEQ ID NO: 6803226 - DNA, 58 bp, Homo sapiens
gactgccttgggggtgaaagaggctagcacttagtttaacgacatccccaaagtggtc

SEQ ID NO: 6803227 - DNA, 57 bp, Homo sapiens
ggacaaatgagtccctgtggtgacctgtgaccttccatcaacagtactggtttgtcc

SEQ ID NO: 6803228 - DNA, 60 bp, Homo sapiens
ggcccaaggtgccaaggcctccagaagaagagaagaaggagcaggctttggagtggggct

SEQ ID NO: 6803229 - DNA, 59 bp, Homo sapiens
tcctacatgaatgggtgtattacttcattaataactgaagttggactgtttcatgggga

SEQ ID NO: 6803230 - DNA, 58 bp, Homo sapiens
tatcagggttggcatttgagcaggagctctggttcctctttaagtggtaacccttata

SEQ ID NO: 6803231 - DNA, 71 bp, Homo sapiens
agttgttatatgtgaaactttgtttatcctgtctagggataggatacacggggatttatgtagacataatt

SEQ ID NO: 6803232 - DNA, 64 bp, Homo sapiens
catggattcgggaaggtcagtatgtgacagtaggaggactgctgctgcctccccgtagttcgtg

SEQ ID NO: 6803233 - DNA, 55 bp, Homo sapiens
ggtggtgtatgcctgcagtcctagctattcgagaggctgagatggcagaatcacc

SEQ ID NO: 6803234 - DNA, 91 bp, Homo sapiens
aaaatgaaggcagggaacaaaggcaacatatacttgtttgacaatatttgaaagcaatgtcaagttgtggtgagattctcctgcccatttt

SEQ ID NO: 6803235 - DNA, 127 bp, Homo sapiens
cacaaaccaccctcaatacactttaaatactcttcccagggttttgtgctcaggagttgtttgaaaggcacaggcacctgggtggttttatggggtaataaaaagatgtggaatggaggtgggtgtg

SEQ ID NO: 6803236 - DNA, 57 bp, Homo sapiens
tccaggaggtagcgagtggacagtgcaggtttctgcagtccctctccctgctcagga

SEQ ID NO: 6803237 - DNA, 89 bp, Homo sapiens
gagtctcgctctgttgcctaggctggagtgcagtgacacgatctcacctgctcactgcaacctccacctcccgggttcaagcgattctc

SEQ ID NO: 6803238 - DNA, 104 bp, Homo sapiens
ctgtactgtgtctgggttgcagggacctgcagaaagctctggctaccagccaggtgtgctcgggtgtggccttctcgctggccttgtcccctgtgcatagacag

SEQ ID NO: 6803239 - DNA, 75 bp, Homo sapiens
agaggctagagagctgcttccagagttgagtggtatagaaggctcacagacttgagaagcaccttactttcctct

SEQ ID NO: 6803240 - DNA, 85 bp, Homo sapiens
tgcctaggattgtcataagctagctgcaccatatttttcccatgcttaaattgagatagtatgtttctggctttgtctcctggca

SEQ ID NO: 6803241 - DNA, 64 bp, Homo sapiens
cattaagctgtcagtgtcaggctaaaagaaacttttcctttatctgagctgatagatagtagtg

SEQ ID NO: 6803242 - DNA, 124 bp, Homo sapiens
tatttaataatagttgacattagattgaagagatatttcagttccacacttaggatattggtctttatttggtaggaaattggaaactcttcactgctatggatgacagaagttttaataaata

SEQ ID NO: 6803243 - DNA, 57 bp, Homo sapiens
tggggctgctgtggtttacaccattgtgggcacaatggaggccatgccagagcccta

SEQ ID NO: 6803244 - DNA, 71 bp, Homo sapiens
gtcgcatggagaaggtagtccattctaagccatttcatataaacttattgggcatctcctctgtgccaggc

SEQ ID NO: 6803245 - DNA, 71 bp, Homo sapiens
ctgtaccccatcatttgcaagcccacacagatatgtttcggtgctgctggctttagtgattggggtgatag

SEQ ID NO: 6803246 - DNA, 56 bp, Homo sapiens
aagaactgaaatatatgtatgtatgtgtgtgtgtgtgtgtgtgtatttcagttctt

SEQ ID NO: 6803247 - DNA, 61 bp, Homo sapiens
tctgaatctgtcacttggccactcttagctgcaagagaggctgtgaaagtgaggatctgga

SEQ ID NO: 6803248 - DNA, 80 bp, Homo sapiens
aacagtaaaagcatccagatgggccaggggtttgttcatgtacttacagaacatctaggttctcatcgatattttctgtt

SEQ ID NO: 6803249 - DNA, 81 bp, Homo sapiens
tcttgatggttgagcttcattgttatgaatgtcaaagactaatttgcatttaagaaaacatgagtctacaataactcagga

SEQ ID NO: 6803250 - DNA, 65 bp, Homo sapiens
tctctgttctctgtgggatctgaatccctcagttatgaaggaagcacaccaaacaggaacaggga

SEQ ID NO: 6803251 - DNA, 66 bp, Homo sapiens
cctgggcctctcagctcccgcgggtccttcttcgacccgcagaaagaccctgagaacggcgccggg

SEQ ID NO: 6803252 - DNA, 103 bp, Homo sapiens
gtgaaaagtatggtaatggactcagatctcaacagctggagtcattgatcagttatgctccccacagcagaagatctgagagcaacattttcattgctgccac

SEQ ID NO: 6803253 - DNA, 57 bp, Homo sapiens
tggggatggggatgggggcacagagggcactccacctggctgctggccctctctcca

SEQ ID NO: 6803254 - DNA, 57 bp, Homo sapiens
gctgagctaattagaagtggccagccagcagttagtcaataaatagcttggctcagc

SEQ ID NO: 6803255 - DNA, 66 bp, Homo sapiens
tgaagtctttcactgtcaattaatgtaattctaaatcaacattctgtcaacagtgagcagatttta

SEQ ID NO: 6803256 - DNA, 75 bp, Homo sapiens
agaatcacaagcaacgactttcaagctgtgggtccccaatctactacttgtctccttttttgttatgtgtatttt

SEQ ID NO: 6803257 - DNA, 74 bp, Homo sapiens
tgtcacagtcgtcttccatgggtgctgtgctctaaccagggctgcaaggcattgatgggagatggtggatggca

SEQ ID NO: 6803258 - DNA, 76 bp, Homo sapiens
gatgctttcatctggaatttatgttataggaattatgtattttttattaagatttttaatttcaggtaaaagtatt

SEQ ID NO: 6803259 - DNA, 61 bp, Homo sapiens
atggctctttattctgctgcatcgaaacagaataagctggagcaagtagaaaaggagctgt

SEQ ID NO: 6803260 - DNA, 68 bp, Homo sapiens
gtcctgcagccactgcaggcagaggaggccctgcttccctgacccatctgcctgcggctgcaggtggc

SEQ ID NO: 6803261 - DNA, 61 bp, Homo sapiens
agccaaagcagcaacgtgcatataacctgcacttgtctggttagcactttgctttttgtct

SEQ ID NO: 6803262 - DNA, 58 bp, Homo sapiens
caagtcaccctcctcagcccagtgtgaattgtgtttctgtcctgaggcaggtggcctg

SEQ ID NO: 6803263 - DNA, 69 bp, Homo sapiens
gtgttgagtgtcctttttgctgacgcatatcttttaatagtccgttcagtgtctagggacagtaatcac

SEQ ID NO: 6803264 - DNA, 63 bp, Homo sapiens
tggtgtgggcagcagcaggtacctcccaagcataggccctgtctggtgtccctgtctacagca

SEQ ID NO: 6803265 - DNA, 58 bp, Homo sapiens
gccctctggcttactgttgggtttgtccaatggcaggcatcagcaagtatcagagggt

SEQ ID NO: 6803266 - DNA, 60 bp, Homo sapiens
ggctgtgcagttcaccaagccctctccatacatcaaggcttcctgtggacattgctggcc

SEQ ID NO: 6803267 - DNA, 82 bp, Homo sapiens
tgtgcatggcaggatgtttgctagcattcctggcctctacccactagatgccagtaacacctcgcagactccaattatgaca

SEQ ID NO: 6803268 - DNA, 63 bp, Homo sapiens
ggtgcaagccagcttgatgacctgtgggacatcacagaagaagttgtccagctggtttgggcc

SEQ ID NO: 6803269 - DNA, 58 bp, Homo sapiens
ggaggaagtgcgttatgccttttaagggcacaacctgaaattgccacacatttcttcc

SEQ ID NO: 6803270 - DNA, 64 bp, Homo sapiens
gtgcagcatttaggggaaaatgagttagtgtgtatactacaggacatgctgctagttcccccac

SEQ ID NO: 6803271 - DNA, 55 bp, Homo sapiens
ccttccattttctttgcagggtagattggactctactcctcagttccatgggagg

SEQ ID NO: 6803272 - DNA, 70 bp, Homo sapiens
cggggcacagggagccgcagttgcagaccccgcaggagctatctcggtgcctgcgctccctgtagctttg

SEQ ID NO: 6803273 - DNA, 73 bp, Homo sapiens
gaagttacacatctagcacacactggcagcttatgttctatttctgctggacagtgctgcttgagatgtcttc

SEQ ID NO: 6803274 - DNA, 63 bp, Homo sapiens
tttcctcctgtacttttatattcgctcgaagtcaggtgagtatatttaccattgggtgggaga

SEQ ID NO: 6803275 - DNA, 78 bp, Homo sapiens
tctgcagagctgaacagtttacttagccaatgaggatataaatatttgcatatctgatagactaatgccagctctaga

SEQ ID NO: 6803276 - DNA, 72 bp, Homo sapiens
aacggataattaggaaattcagccattttgaagttacttgactctggttatggttgttttctaagctctgtt

SEQ ID NO: 6803277 - DNA, 67 bp, Homo sapiens
gcctcagaatctttgctgagctctggagtttccaaagctccagtctctttcggagacactgagttgc

SEQ ID NO: 6803278 - DNA, 76 bp, Homo sapiens
caaggcatttcagctctagtaagcagacaccagcccactgcattgtgtttgagatctgaagctgaatatggctttg

SEQ ID NO: 6803279 - DNA, 67 bp, Homo sapiens
gggatgaccgtagtgacagataaagctaggtgctgagatctggttttgccctctttatgattgtccc

SEQ ID NO: 6803280 - DNA, 64 bp, Homo sapiens
gattaaataatatttataaacatgagagacacacaatgggttctcagtaaatgttagtttaatc

SEQ ID NO: 6803281 - DNA, 56 bp, Homo sapiens
atgtcagagcttccacaatagtctgttgtcaatttagagtatgggtagctttgcat

SEQ ID NO: 6803282 - DNA, 112 bp, Homo sapiens
tttcttgtttccctctcccgattcaggaaatgcgtagttgaacttctcaggtttgcttgaacttctcaggtttgctttgcacagtcctaaatcaaagatgtggaccaggaaa

SEQ ID NO: 6803283 - DNA, 93 bp, Homo sapiens
ccctgacaggcctaattgctgctcattcctcatgctgcccctcacgccgctggttagggagccagggatgcagcacagtgaaggaagtttggg

SEQ ID NO: 6803284 - DNA, 56 bp, Homo sapiens
ggggaggaaggaacaggaaagttcttgcacaaactgttactgttaattcatttccc

SEQ ID NO: 6803285 - DNA, 68 bp, Homo sapiens
ctctgtttcaggcattcctctatgaatattgtttcttgtaatccagtgtttgtaaatgcgtggcggag

SEQ ID NO: 6803286 - DNA, 84 bp, Homo sapiens
gacccaggtgcttttagcaattagaatccagcatgccaactaaccggccatgttatgttcaaatatgtctacttgcaccctgtc

SEQ ID NO: 6803287 - DNA, 79 bp, Homo sapiens
tgagagacttcactagcatggtacaatgttaacataaaaagaagaatgtcagctgtgatccatctatctagtcttctca

SEQ ID NO: 6803288 - DNA, 64 bp, Homo sapiens
ccaacggagtccaagctagagccactcatggtgtggtccatgggtggcagcttcagcatgttgg

SEQ ID NO: 6803289 - DNA, 63 bp, Homo sapiens
tttccttttaagggagaaaaagcatccatatttaggatggtttatgctatactggaagggaaa

SEQ ID NO: 6803290 - DNA, 100 bp, Homo sapiens
gggtgtgtgcagtgggttctgtggtcaggagagtgccgtctggatgggagatatttggttggttttagcttggcccattcctgccactgactgatggccc

SEQ ID NO: 6803291 - DNA, 108 bp, Homo sapiens
tgtagggcatgtgcaggactggtgaggtggtaaagatgtaagagcctcacaagtgtctgggctgtgctgtttccacctctctataccatcttgatgctttgccctcca

SEQ ID NO: 6803292 - DNA, 88 bp, Homo sapiens
gggggggggacatttaacagaatttgcttgggcaatgggtgtttatagttttaaaaagccacccaagagatttggatgtgcctcttcc

SEQ ID NO: 6803293 - DNA, 57 bp, Homo sapiens
ggaaattactttagggtcacagcgagatttctgtgacagccagtaaagtaagctttc

SEQ ID NO: 6803294 - DNA, 84 bp, Homo sapiens
tgtatattgcattgaaaagaaaacaagaatagtttacttggttctgtgtaaactaggaagttcatcttattagtatgatatata

SEQ ID NO: 6803295 - DNA, 64 bp, Homo sapiens
ggggaacatcactgatgccctcactgagctctgtgggaaaactgggctccagagatgtagcttc

SEQ ID NO: 6803296 - DNA, 81 bp, Homo sapiens
gtcccctccaggtctctcttgtttattatgtgaggggggccctccagtgatgctgcaagagtgagctgatggatgggtgat

SEQ ID NO: 6803297 - DNA, 88 bp, Homo sapiens
tctgtttttaatggatttacaagataacctgatgctgtgcggtttgtttactgtagcggctttatggtgttttgtaccagtaaacggg

SEQ ID NO: 6803298 - DNA, 73 bp, Homo sapiens
caaagatctcagatgcccttgcatcacctccctgaagagggcgggtgaagctttggtgtctgcagagaatttg

SEQ ID NO: 6803299 - DNA, 68 bp, Homo sapiens
tgttaagtaatggccaagcttactctgttgtgtattaaggacaagatagattattttggcacttgtca

SEQ ID NO: 6803300 - DNA, 74 bp, Homo sapiens
gaatataaaagatgatgcagactttgatgttcctgccttcaagaagctcacagtctggcatagtctccatattc

SEQ ID NO: 6803301 - DNA, 58 bp, Homo sapiens
agaagtggcagaactggaattcgaatccaggcagtttgtgtccagagctggtgcttct

SEQ ID NO: 6803302 - DNA, 89 bp, Homo sapiens
actaccccattgctataaaatgtcattaaaattgtgctgcatttacaattttgtatttgttgcattttgaagacatagaatggggctgt

SEQ ID NO: 6803303 - DNA, 65 bp, Homo sapiens
gtcacatccaggatgccacgttatatttagtcattatgtcttctttggctcctcttggctgtggc

SEQ ID NO: 6803304 - DNA, 62 bp, Homo sapiens
cctggccctctggcttccgcatggggcttgtgggaagcctcagcaggggaccatagggaagg

SEQ ID NO: 6803305 - DNA, 78 bp, Homo sapiens
tcagtgctgtgaagtcaagaatgcaatttgagctgtgccgacaggaaacaaattgatctttttggcctgtattcctga

SEQ ID NO: 6803306 - DNA, 84 bp, Homo sapiens
catagctccaagacaagttacactttacaatttttttgacggcctgaaatagtagaaatctttgaagtgtaatgtgtagttgtg

SEQ ID NO: 6803307 - DNA, 127 bp, Homo sapiens
gctcctggtaataatctcattttgtaattttgctctttagtcacagggcttcatttgggacactcacatttttgttctctttgtgattatttgtgattaaggagttgaggttatgactttaaggtgc

SEQ ID NO: 6803308 - DNA, 58 bp, Homo sapiens
gctccttccctaggaagtcatttatttacataaatgactaatgatcctgggcaagggc

SEQ ID NO: 6803309 - DNA, 64 bp, Homo sapiens
gtaagtttctctttggtgggttgagagttggaccatcaattctaatctacaaaaggaaattcat

SEQ ID NO: 6803310 - DNA, 57 bp, Homo sapiens
gtgctttgaaatgttagatcctaggcttcattgacctgatcttacagagcagagtac

SEQ ID NO: 6803311 - DNA, 58 bp, Homo sapiens
ctcattcctggcgcacacagttcactttgacatcgaggggcgctctgccaggaaagag

SEQ ID NO: 6803312 - DNA, 79 bp, Homo sapiens
ccatgtgtccatcagaagagcaaagaactgttgtagtattaacatgctattacaacagaagtgtttatttaggaattgg

SEQ ID NO: 6803313 - DNA, 61 bp, Homo sapiens
cttgtctccaatcctaacgtaacagaaatgtatatgaggttacattaggattagagacaag

SEQ ID NO: 6803314 - DNA, 94 bp, Homo sapiens
cctgtgatagcttgcatgaaggatgctctaggaaagtgaattatgcggtactatgttatactgctccaccctggggcccagtaggaatcatggg

SEQ ID NO: 6803315 - DNA, 60 bp, Homo sapiens
aatgctgcataacaacaatgcaatcccacacaattgcagtagtgtacagttatgagcatt

SEQ ID NO: 6803316 - DNA, 82 bp, Homo sapiens
tggaaacaatgataaaaagttcactatgtagcagcgtccctatctcttggacattgttcctgagaacttgggtttgtttcca

SEQ ID NO: 6803317 - DNA, 78 bp, Homo sapiens
agtagatgagattcggaagtcatctgtttcgtacacacactagtattagcaacgtaacctctgaacttgccatttact

SEQ ID NO: 6803318 - DNA, 56 bp, Homo sapiens
cccccggagctggggctcagctcggggtcagggttgggggttaccaggtctggggg

SEQ ID NO: 6803319 - DNA, 130 bp, Homo sapiens
catcagaatcacctggagaacttgttaaaaccatggatggctgggcctcatcctcagagtttctgactctagaagtctggggtggggcccaagaaatgtgaatttttaacaagcccccaggggatgccag

SEQ ID NO: 6803320 - DNA, 97 bp, Homo sapiens
ctggtgtctccatgaggctttgggggtagaggagtcccaagctgcttgagctatttgtgtgttccaggcttcttctgcctgtctttgggagacccag

SEQ ID NO: 6803321 - DNA, 78 bp, Homo sapiens
cttgctggaggcttgaatggcacaggcagcccttcctgcagaatctattgctgcttggctttctgagcttctggcagg

SEQ ID NO: 6803322 - DNA, 61 bp, Homo sapiens
gtattaggttggtgcaacagtaatggcaaaaaccacagttacttttgcaccaacctaatat

SEQ ID NO: 6803323 - DNA, 63 bp, Homo sapiens
cttgaggcatcacttcttgctttgtttccaagtgagcatatgcaagaacaggtgcttggcaag

SEQ ID NO: 6803324 - DNA, 71 bp, Homo sapiens
cctggctgccagccagtttgctgatggctgtcttcaaagacaactgccatttcctggtttcatcagccagg

SEQ ID NO: 6803325 - DNA, 104 bp, Homo sapiens
tctattctctgagcacaaagtacaccaacaccagtagaaaaaaacctgtttgcttcctgtgtgttggtggcagaatgtcagagcctgtaaaaaattcgaatgga

SEQ ID NO: 6803326 - DNA, 80 bp, Homo sapiens
taaaagggtgattctaggttactgtaattaagctcctcaaagccttcatttataaagatccttccagagttaccatttta

SEQ ID NO: 6803327 - DNA, 82 bp, Homo sapiens
ggcatctattgccctggccttcatctcagacattcatttggaatgcagtcacataggatagggcaggggcagggagcatgcc

SEQ ID NO: 6803328 - DNA, 87 bp, Homo sapiens
gaaacaagtgagagaaggcttccaaattctgtgaaagtaattgtacaggtgcattgaatggatgctctgtttcatgatttgtgtttc

SEQ ID NO: 6803329 - DNA, 101 bp, Homo sapiens
gccccttcctaagcagctgaaacacatgcacaacagttctttccatctaggctggataagggccagtgggcagtagcagctgaagtaggtcacaaggtggc

SEQ ID NO: 6803330 - DNA, 80 bp, Homo sapiens
tcacttataaaaatgagggcggtagctagataagttagtatcacatattgttttgttaccgaattccttttttcaagtga

SEQ ID NO: 6803331 - DNA, 58 bp, Homo sapiens
tttcattagccttcacagagcactttgtatagagtgaggcacagagtggctggtgaaa

SEQ ID NO: 6803332 - DNA, 68 bp, Homo sapiens
ggccgctgtggatggcaggacagacagaaggaactgctcgactgtcctccggccacctacagttggcc

SEQ ID NO: 6803333 - DNA, 79 bp, Homo sapiens
cggggaatatggacctggctctaagtgtcagctccccagagctgtggtggctgtgtcactggagttaattctgtccctg

SEQ ID NO: 6803334 - DNA, 56 bp, Homo sapiens
gaggaggcaacacagggtgtgtttctgggcctttgaaagcacgcagattgcctctc

SEQ ID NO: 6803335 - DNA, 68 bp, Homo sapiens
ctctttttgtgggggaggagttgtgtgcattctgtttaatgtgattttctcactcccttacccaagag

SEQ ID NO: 6803336 - DNA, 73 bp, Homo sapiens
gttagttccctctgagtgctttgagggagaatctgtttcatgtctctctcctagtttttagtggtttgctgac

SEQ ID NO: 6803337 - DNA, 67 bp, Homo sapiens
ggagcagctgcagtgcagaccctcagcctcccaggagcaggagggtcccagcagctgggggggctct

SEQ ID NO: 6803338 - DNA, 57 bp, Homo sapiens
agtggacattctgcacttggagtgagcaagataaactccaggctgatgatgtcaact

SEQ ID NO: 6803339 - DNA, 124 bp, Homo sapiens
gttagattatttgactctgtttttgcccaaatcacaatgtgagactgagtcaccaaatacgtagttgaaaacttgtgtgcttcctttctcccattttggttataaaaacatagatttgtcttac

SEQ ID NO: 6803340 - DNA, 87 bp, Homo sapiens
agctgagggacttgaactccactctggctgcggggcgcgtggagatcattgttttctcgtctccacagctgggagactccctcttct

SEQ ID NO: 6803341 - DNA, 90 bp, Homo sapiens
gaagtatctctcgcctgctgaattctaccatccatttccctcttggtggaagcagaatgggctagaatttaggcgagagaagtatgagtc

SEQ ID NO: 6803342 - DNA, 83 bp, Homo sapiens
gctgagttacatgtcctgctggcaaggaagggactggttgtcctgttaccagtcctgaccagaacaggtctgcaaagctcagc

SEQ ID NO: 6803343 - DNA, 127 bp, Homo sapiens
agatttagaaggaacctggtagtgttcctgggagacagaagacagagtgttcatctttgccatatgcagagtgtctcttgcagttttctctttacctcactggcactgctgaaatccttcttagact

SEQ ID NO: 6803344 - DNA, 55 bp, Homo sapiens
ctttgctgaccttgttctgtgaggaatcaaatccataacagtgaaggtggcatag

SEQ ID NO: 6803345 - DNA, 67 bp, Homo sapiens
ccaagctcttcctgcacctgtggctgagctccctgggcctcagtggcagtggctgggcagagctggg

SEQ ID NO: 6803346 - DNA, 71 bp, Homo sapiens
gtctgtttgactttgtaagtctttctccaagatatggcatatattttggagcactgcaaggttgagtagac

SEQ ID NO: 6803347 - DNA, 93 bp, Homo sapiens
agctgctctgttcatttccctggccctggcacgctctgcttagggatacagtggcagggaggctggggctgtggaattcacgagggcttagct

SEQ ID NO: 6803348 - DNA, 86 bp, Homo sapiens
ggataggccagggatgggatggagtcagttctgcctgggaaactaatccgaatcatttacctttctgtattaaccttggcctgtcc

SEQ ID NO: 6803349 - DNA, 113 bp, Homo sapiens
gcttccctcctgcaaaagggtgatgggtgtgtgtgtgtgagtgtgtgtgtgtcacatgtctgtgctcttgggctcatgtttatacatatctgtatattacttagaagggaagc

SEQ ID NO: 6803350 - DNA, 61 bp, Homo sapiens
tatctttgccttgggttttgttctctccacagactgagatccagtgcccgtggaaaagatg

SEQ ID NO: 6803351 - DNA, 61 bp, Homo sapiens
catcatctctcccccaggcctgggccacactgccctgtcctgtggtgacaggtacaagatg

SEQ ID NO: 6803352 - DNA, 56 bp, Homo sapiens
ctgttaggactccccagaagctgccagagaattgctgcactgaagagtcttaggag

SEQ ID NO: 6803353 - DNA, 75 bp, Homo sapiens
ctccccacacagtcctggctctgtctcggggtctctgcagctctgtggggacccagaggggagtctggcagggag

SEQ ID NO: 6803354 - DNA, 78 bp, Homo sapiens
aggctagagtgcagtggcagatcctagctcacgacaacctccatctcctgggctcaagcgattcttccgcctcagtct

SEQ ID NO: 6803355 - DNA, 99 bp, Homo sapiens
gtaccacaggcctgagcacttagcagggctcttaaagtttgattttgtaattggtacagcaggcagtgtagagccttcataggtgctagctttaggtat

SEQ ID NO: 6803356 - DNA, 58 bp, Homo sapiens
cccctgggaagtggtaaagaaaatgtggcagctactttagaccatcttccacagtggg

SEQ ID NO: 6803357 - DNA, 80 bp, Homo sapiens
ctcccccaaaggatggtggtttgcatcccattcccgccaactggctgatggcaggtgatagccgagtcacatggaggggg

SEQ ID NO: 6803358 - DNA, 80 bp, Homo sapiens
aatagagaaggaaacccctagagcaaggagctatggctatagcagaagctaagctgttgccctgctctttcttcttcatt

SEQ ID NO: 6803359 - DNA, 77 bp, Homo sapiens
gtggggtagtaaacatttaaccaaactgtttaattagacacagaagactaataagcagggtcaaatgcctactccac

SEQ ID NO: 6803360 - DNA, 70 bp, Homo sapiens
ttgcaaagagattgttttaaataccaatataccaattggtataaaaagaatttagaaggaaattttgcaa

SEQ ID NO: 6803361 - DNA, 66 bp, Homo sapiens
ctgttgtaaagctattcatttggtactgacactgacaggggctgagacagacggctttatacacag

SEQ ID NO: 6803362 - DNA, 55 bp, Homo sapiens
tattgtgcacccttgcgttctgaccactacatgttagcagcgctttgcaataata

SEQ ID NO: 6803363 - DNA, 56 bp, Homo sapiens
tatcaggggtagaaaatcacatggctttgacttgccagcatttacatcccttggtg

SEQ ID NO: 6803364 - DNA, 69 bp, Homo sapiens
actgagcaattttgtgtgtgtgtagattcccctcagatttcagagaggaacagatatttgattttcagt

SEQ ID NO: 6803365 - DNA, 58 bp, Homo sapiens
gaggcttggccaaagtgggcgcttctggttcagaaggcctaacttgggggcaattctt

SEQ ID NO: 6803366 - DNA, 59 bp, Homo sapiens
ggcctgcccagggtcaccacagaggcctcttgccttctggtcccttccactgggctgcc

SEQ ID NO: 6803367 - DNA, 58 bp, Homo sapiens
gggatgtatgtttgtgtggagatgtttttttctgtctgtaggcacatgtatatatccc

SEQ ID NO: 6803368 - DNA, 63 bp, Homo sapiens
tacctatttattgaccacctgctttgcgcaggacagcacagcgggaatgtggtaggtggagtg

SEQ ID NO: 6803369 - DNA, 66 bp, Homo sapiens
acttgtcgacaggggcagtagtctcgtagagtgtttcactttccagatttgtccagttattcaggt

SEQ ID NO: 6803370 - DNA, 70 bp, Homo sapiens
cccgctgccaagtaatgcctgggctcccgggctacacgctgcttagggctccggcttttgcaaggagggg

SEQ ID NO: 6803371 - DNA, 56 bp, Homo sapiens
tatgttagagtctggtggggagggagacattccgccctcccaagcactctgacata

SEQ ID NO: 6803372 - DNA, 59 bp, Homo sapiens
gtctgcagtcccggggaggtgatgggttaaatgctgtttgttgaccgtggactgcagat

SEQ ID NO: 6803373 - DNA, 85 bp, Homo sapiens
attggaaacagaaggtggtgtctttagaaagaagcagacaacagcatgtgcctcaaacctggagatataccttctctctgctagt

SEQ ID NO: 6803374 - DNA, 75 bp, Homo sapiens
tcttttctttgccctgtggattaatgagcaggcatggagatgtctattatttgggctacagtgcagaagaaatga

SEQ ID NO: 6803375 - DNA, 77 bp, Homo sapiens
tgctcggccagatcagagattgctgcccttcagaggcaccctcttcaggatcagagctttgtttctgagtaagagca

SEQ ID NO: 6803376 - DNA, 56 bp, Homo sapiens
ataaagtagaagagttaagcaggcttctttaaagcctgctttatgctatactttgt

SEQ ID NO: 6803377 - DNA, 60 bp, Homo sapiens
gctctaatatggccttgtttgggaaacactcctttaggctcagataggctgtcttagagt

SEQ ID NO: 6803378 - DNA, 65 bp, Homo sapiens
agacagtgaagtgatagtttgcctagtttgagccttggtcttctaggccttctgttttcctgttt

SEQ ID NO: 6803379 - DNA, 65 bp, Homo sapiens
tatgctggattggagcaatagagtcttggggcacttttagagatccgttgcaaccaattagcatg

SEQ ID NO: 6803380 - DNA, 75 bp, Homo sapiens
ttcccaactattgatggatgtgacatgcccactctaaaatatgaaagagtacaaaatgcagcatcatcatgggaa

SEQ ID NO: 6803381 - DNA, 64 bp, Homo sapiens
attgggcatggcactactattatctccattttatagatgtggaaaattgaggctcatgttaaat

SEQ ID NO: 6803382 - DNA, 78 bp, Homo sapiens
tgtcctcacctacttactatcactctgccttcaggtccaagctccctgaagatgatgatactaaggataatgatgaca

SEQ ID NO: 6803383 - DNA, 61 bp, Homo sapiens
ccgtgcccaaacttactggtttaaaactactaatttatttagttcaggagtttgtggatgg

SEQ ID NO: 6803384 - DNA, 71 bp, Homo sapiens
cctgacctttgttcaaacagaccctttgtgcactgatgggcatatgtcaagattttgagcagagaaacagg

SEQ ID NO: 6803385 - DNA, 84 bp, Homo sapiens
gaagtaggtagaatgcattttggatggcatattttcttcttgattgtttcttttctcttccagaatgcattctcttttgacttt

SEQ ID NO: 6803386 - DNA, 69 bp, Homo sapiens
tcttcagaggctgccagccatgtgcaaccagagatgatgtattccactgtgtagctggagctctgacga

SEQ ID NO: 6803387 - DNA, 56 bp, Homo sapiens
cgcgcccggaactgcgccctggtctccctcccagcgcccgcgcagctcctggcgcg

SEQ ID NO: 6803388 - DNA, 56 bp, Homo sapiens
gacctttcaaatgtttacatgagttgaatctctgaactgctaatgtttggaaggtc

SEQ ID NO: 6803389 - DNA, 88 bp, Homo sapiens
cttccaactccatgccttaatcttgagtatcagaccaagaattctggatttttgtcgttgttattagaggcaaaggacatgatggaag

SEQ ID NO: 6803390 - DNA, 56 bp, Homo sapiens
cttgccttctctggggtggcagtggaaaccgatactgttttccaccttgaggcaag

SEQ ID NO: 6803391 - DNA, 68 bp, Homo sapiens
cggcttatgtacacacatatattgtaccaagctggccaatgcaatatttatgtttgtactttgagctg

SEQ ID NO: 6803392 - DNA, 74 bp, Homo sapiens
tcttacggtgagctgccagtagttggagctccaagtttgacttggagggcaaaacctgcagttattatttaaga

SEQ ID NO: 6803393 - DNA, 92 bp, Homo sapiens
gtgagcctggtggaggctccatgagctcctgcacaaggcactgggagacttggttatactgctggggttctggattcctcccacagggtcac

SEQ ID NO: 6803394 - DNA, 110 bp, Homo sapiens
ggggagaatgtggatgtgtctgaggtcacatggctggccagtgggagtggagcagatgaagatgactattcccatctggccgctggctcctacagaagccaaggctcctt

SEQ ID NO: 6803395 - DNA, 64 bp, Homo sapiens
tatagtacatggaatcttcatagcagaaactgaggttgtgatatgaaatcattccaatactgtg

SEQ ID NO: 6803396 - DNA, 120 bp, Homo sapiens
tctgtcttaactaaaaacgttggcattttctgggaagttggctgtatgcttattgagaaagagagacttctcttcagtacagtgtgacatttctacaaaaatcaatgatttagaaacagg

SEQ ID NO: 6803397 - DNA, 95 bp, Homo sapiens
gaaagcctgaaataacagaactgtactttggataatgaattcttcatctgtggagaactttaaaacaaagtacagtgttggcatttttttctttt

SEQ ID NO: 6803398 - DNA, 68 bp, Homo sapiens
cttcacaaacttcatgatggcacacagcaggtttctcaaataactgttggtgtatgtaagttgtgagg

SEQ ID NO: 6803399 - DNA, 83 bp, Homo sapiens
cttcctgcccccagagagcaccatgaagcccaatgaaggtggatatggggcaggagctcgctggggctctggtgtgcaggaag

SEQ ID NO: 6803400 - DNA, 81 bp, Homo sapiens
gtgcactggggtggacagagccctgggccgggagacatttgtcgtgggctctggtcccagctctgccaccaattcttgtat

SEQ ID NO: 6803401 - DNA, 72 bp, Homo sapiens
cctcacagctgaagtagccatgtggccaggacagaaagcttgagttagcacaattatttcagttgtcattgg

SEQ ID NO: 6803402 - DNA, 61 bp, Homo sapiens
tttctagagtgggcatgtcttatacatatttaggtttttaaaatatgcagctactcagaaa

SEQ ID NO: 6803403 - DNA, 59 bp, Homo sapiens
cattgatcatctgcagtttaagctggacacagccctgaggcaatgcagatagatgaatg

SEQ ID NO: 6803404 - DNA, 55 bp, Homo sapiens
tcttaacttgatgtctctctgctgtacactacatgcacaggccatgaagttgaga

SEQ ID NO: 6803405 - DNA, 55 bp, Homo sapiens
aaaagggctagctgcatatatattgaatcattcaattttgtgctggggctctttt

SEQ ID NO: 6803406 - DNA, 56 bp, Homo sapiens
ggcgcaagcgggggttgtgagcgttggtcaaacatgctggctcaaatgcttgtgtc

SEQ ID NO: 6803407 - DNA, 58 bp, Homo sapiens
gcatgcagacagtctgagaccacagggccactctttccacaggacaatgtctgcatgc

SEQ ID NO: 6803408 - DNA, 88 bp, Homo sapiens
aggagattaccaatttatacaccatcactgccttggcctggaagcgggatggctcacggctctgtgtggtgtgttactagtaatccct

SEQ ID NO: 6803409 - DNA, 87 bp, Homo sapiens
cttggagattctgatcccgtggctctggagtggagtgctcccctaccagggaacagggatattaataagcgcctcagagacaccaag

SEQ ID NO: 6803410 - DNA, 63 bp, Homo sapiens
ccagggttccagcagaggagggtttgtccagaataaggaacccatggtctggtggggccctgg

SEQ ID NO: 6803411 - DNA, 92 bp, Homo sapiens
ggggaggtggcccagggagctggcttcaaagggcggctgtcggagggtgactcatggtactcttcacttcccctgccagcggtttcctcccc

SEQ ID NO: 6803412 - DNA, 130 bp, Homo sapiens
ctggataattcttggttttgggggggtctgtctttggcattgtagggtgtttagcggcatacctggcctctactgactggatgccaatagcactctctccgcaagttgtgaaaatcaaaaatgactccag

SEQ ID NO: 6803413 - DNA, 69 bp, Homo sapiens
atgggagagctaagagtcaaacccagggattcagactccagggtctttgctgtctttgctctcaaccat

SEQ ID NO: 6803414 - DNA, 88 bp, Homo sapiens
gagtaacagatgcacagtgaccaatcactgaatgattttgaaagaagtaatgcgattggtcactgattatgatgaacatttgtcactt

SEQ ID NO: 6803415 - DNA, 66 bp, Homo sapiens
atgctctatactgataattttgactggtgctaatttaccagtcagttctgattatgtggattgcat

SEQ ID NO: 6803416 - DNA, 89 bp, Homo sapiens
tccacattctgttgatactgttagagccagaaacctacagagtaattagtttaggttttgtctacatagcaccaacagaagcaattgga

SEQ ID NO: 6803417 - DNA, 75 bp, Homo sapiens
cccttacaatgatgatactttactggatacccttggaccactgagtttagcccatgtggttttgttatttgaggg

SEQ ID NO: 6803418 - DNA, 67 bp, Homo sapiens
gtgatcgtggtggggatattttacaggagatctgctagcagagtcttgggatctcttcaccacctac

SEQ ID NO: 6803419 - DNA, 82 bp, Homo sapiens
ttcagactctagtgtccatattgacaggactttaaatccactacgtgtgcatctggagcttgttagatgtttatagtttgaa

SEQ ID NO: 6803420 - DNA, 58 bp, Homo sapiens
acagcaaacaggccagttaaatgaagtgaattccattcactggcagcctgcctgctgt

SEQ ID NO: 6803421 - DNA, 92 bp, Homo sapiens
aaatacttttgttagcattttgtacaactttgctggaaaattggagcacagtaatgtgagcgttggacagtgctaggtgctaagaaagattt

SEQ ID NO: 6803422 - DNA, 66 bp, Homo sapiens
gactctggtggcatctctttccagatttgttttgaaacaagcttgaaaacaagatttcacccagtc

SEQ ID NO: 6803423 - DNA, 77 bp, Homo sapiens
cccagtacttgtttagcacagacagaatggtcatacttcttctgaccttgtgataaatcttctgtgctgaatttggg

SEQ ID NO: 6803424 - DNA, 74 bp, Homo sapiens
cttgattttgggtgcaaattgtttgtttttaggagtatagatttgataggaaataagggcacttcagattcaag

SEQ ID NO: 6803425 - DNA, 115 bp, Homo sapiens
ctctgctattatacctctctttgactttctggcatttcaggcatctatagtagaatcttatactatctggaaaaatccaagtgttagaaagtggtttggtataagaagcctagag

SEQ ID NO: 6803426 - DNA, 99 bp, Homo sapiens
ctgaagacccccggatgagggtgctcagggcctggctggggagactcttgccttgttctccccagtgtccaggcctgggctgcccaggggacacttcag

SEQ ID NO: 6803427 - DNA, 55 bp, Homo sapiens
gcagctgcgaagaagtctatctcccatatggcttttaggacactttgcagtatgc

SEQ ID NO: 6803428 - DNA, 69 bp, Homo sapiens
ggtctggcttctgcagaaaccaattcaagtaagtgtttccatttctatgaaaggggctctgaccagacc

SEQ ID NO: 6803429 - DNA, 56 bp, Homo sapiens
acctaaccatcattgtgctggtattaggaggtgagaccagtgggaagtgattaggt

SEQ ID NO: 6803430 - DNA, 59 bp, Homo sapiens
gtgaagactaagtaacagctcttctctttggatgagacttgctcacttcaggttttcac

SEQ ID NO: 6803431 - DNA, 71 bp, Homo sapiens
gacagtcacagttttaagtgtgatccacagtggtcagaaatttggattccatgtcaaaatacagaactgtc

SEQ ID NO: 6803432 - DNA, 68 bp, Homo sapiens
cagagaaaggctttggcccgagggaagaaagttcattttttcttcctttgcaccatggctatgctgtg

SEQ ID NO: 6803433 - DNA, 60 bp, Homo sapiens
gctggtagagtggcaaggtcacttgatttaatgtcagaagaccttgatattatatgcagt

SEQ ID NO: 6803434 - DNA, 62 bp, Homo sapiens
tacaggtgcatgctaccatgtctgtttaattctcttttttgtagagatggggtatcaccgta

SEQ ID NO: 6803435 - DNA, 61 bp, Homo sapiens
tagaaaagggattcaggattggaattcaaatctgtccaagtcttaatacagctcttttcta

SEQ ID NO: 6803436 - DNA, 68 bp, Homo sapiens
agtagcattgataaattctagttttaggcttactttccataggccagcaaagcaagttgtcagctact

SEQ ID NO: 6803437 - DNA, 56 bp, Homo sapiens
tagctcttcaatcactgtctccattctttgtacttggggatcaggaaaggaggcta

SEQ ID NO: 6803438 - DNA, 73 bp, Homo sapiens
gaccctaagctcctcgtgtgctaggatccaggtctcttctctgggggcttggctcctggctcacaggttggtc

SEQ ID NO: 6803439 - DNA, 55 bp, Homo sapiens
gggcgccggtccatggggccagccgaactacctgcttagtcctaactggcagttc

SEQ ID NO: 6803440 - DNA, 59 bp, Homo sapiens
caggaggagggcagccgcctcctctccaaacaactagcgagcgccgctcacctcccctg

SEQ ID NO: 6803441 - DNA, 56 bp, Homo sapiens
tctcactccccaggctgggatggctgcaatggtggtagaccctctggggagggagg

SEQ ID NO: 6803442 - DNA, 61 bp, Homo sapiens
ctgaatgctttggttctaaaagtctaaaaactcctataggctttttgatctttggtttcag

SEQ ID NO: 6803443 - DNA, 83 bp, Homo sapiens
tcccttcttgggtcaagcagacaccagtggtagcccaatttcaaactgggatctgctagggtctgttttccaggtgttaggga

SEQ ID NO: 6803444 - DNA, 76 bp, Homo sapiens
gatttcagctcactcaggagtgagccaccacacctggcctgtgattggctctattttgagtgattacgtgtaaatc

SEQ ID NO: 6803445 - DNA, 63 bp, Homo sapiens
ccttgtttttatgaacatccaggatgcccaggagagtgtccctggttacgtataaagatgagg

SEQ ID NO: 6803446 - DNA, 129 bp, Homo sapiens
caaaccaacaggaaacactttcagatgaacatctgttaaataaaggtatacttgtgttcagaataacgtccattgctttagtttagcaggaatgactttcaacttattaacactttcaagttaggtctg

SEQ ID NO: 6803447 - DNA, 66 bp, Homo sapiens
tggtaacgctaggtatatgtgtgcacacgtgcacgtgtgcgtgtgtgtttgtgtatgtgcgtacca

SEQ ID NO: 6803448 - DNA, 78 bp, Homo sapiens
cataatatatagacttgtctaccatgaatatttaggaacctagatacatgaaatggcagatagtgttatttcattatg

SEQ ID NO: 6803449 - DNA, 72 bp, Homo sapiens
tggcataaaacagaaattctttctttaagtgtgttcaatctggttgcttaggaaagtttctgcttatgtcca

SEQ ID NO: 6803450 - DNA, 97 bp, Homo sapiens
ggaactctagaggaaccttgcagtggaggtttagtgcccagagggacagatttactgagagcacatgtgacttacccactgtagatttttggagtcc

SEQ ID NO: 6803451 - DNA, 68 bp, Homo sapiens
ggcctggagctgggctagggtaggagtcccctgtgaggctccacctctgcctctccagctccttggcc

SEQ ID NO: 6803452 - DNA, 63 bp, Homo sapiens
attctaatcagtttggattgttcctcctttgaggcacaaataaaatgcaaatagatttggaat

SEQ ID NO: 6803453 - DNA, 60 bp, Homo sapiens
tccctcagattggcaattagatcttaacaatggtgatcttaaagagcgcaatttgagggg

SEQ ID NO: 6803454 - DNA, 64 bp, Homo sapiens
cacgtctttgcacacatcccttcccgagatgtcatgcaggttgggccggattgtgaaggacgtg

SEQ ID NO: 6803455 - DNA, 55 bp, Homo sapiens
gctctggcttggggcactcgtcggcgaagtcagcgtgggtgttccagacccaggc

SEQ ID NO: 6803456 - DNA, 91 bp, Homo sapiens
atctcctggagagctgttgaaatgcagactgtgaatcagtaggtctggggtactgctgagaatctgcttttctaacaagctcccaggtgat

SEQ ID NO: 6803457 - DNA, 66 bp, Homo sapiens
ccatgccctgatgatgtgtttcttccagagagaagtggggaaggacctatattgtcagaggaaagg

SEQ ID NO: 6803458 - DNA, 67 bp, Homo sapiens
gcagggctcaggtgttacctcctctagggaccttgcttcttttgtgccctacagcacctgtgcctgc

SEQ ID NO: 6803459 - DNA, 118 bp, Homo sapiens
ttatattaggaaaacaatgtatgtaaccttttttgtgagctgagaaatgtatagtctaccaacaagataagtgcagattagagctctaaaataaatacatgaaatagtgctaatataa

SEQ ID NO: 6803460 - DNA, 55 bp, Homo sapiens
tccaagtatctgcctctgttggattattttcccccaaaagagactgattcttgga

SEQ ID NO: 6803461 - DNA, 73 bp, Homo sapiens
gtagtccccattgatccacagtttcgcttaattccataattaagtgaattatgtggtcaaaataggtgagtac

SEQ ID NO: 6803462 - DNA, 61 bp, Homo sapiens
gtccctttacagaaatgtctgctactcctttcaaagagtcacagaaatttgtaaaagggat

SEQ ID NO: 6803463 - DNA, 62 bp, Homo sapiens
agtgcacagatttaattttattcttggagaaggttgaagatgagaagccctgtctgtgcact

SEQ ID NO: 6803464 - DNA, 68 bp, Homo sapiens
gctcttacataatttatggaatggtatacaacatctactgtgtactaaacttccatatattactgggt

SEQ ID NO: 6803465 - DNA, 70 bp, Homo sapiens
tggccctgccccctggtggccagagccggcttcacaggacaagagccagctaagttccaggggctttcca

SEQ ID NO: 6803466 - DNA, 59 bp, Homo sapiens
tggagcgagctcaaaggcaggaagttaacatctagaatccctaccttttggctgcccca

SEQ ID NO: 6803467 - DNA, 110 bp, Homo sapiens
gaggttggagaactgcttttgctacagggctttgatgtccatgaggagaaggtatttctccttcctgcagcacaaacccctaaatggcaaatgcaatcgctcataacttc

SEQ ID NO: 6803468 - DNA, 102 bp, Homo sapiens
agctaataatctatgagccataatttcccaagagattgaaagtatgtatgaagttaaaacaagtacttttaaagtggcaaattaggtagtagagttattact

SEQ ID NO: 6803469 - DNA, 79 bp, Homo sapiens
tgggagatggtgtggaagtggccctgagctttccttactgaaaggccagaaagctggggcatttatccactaactccca

SEQ ID NO: 6803470 - DNA, 73 bp, Homo sapiens
acagctgctgtgtttctgctagaaaataaataacaaatatattgacatgccttttccttagaacagcagctgt

SEQ ID NO: 6803471 - DNA, 80 bp, Homo sapiens
tcctttcaagcatggctcaggtcttacccatgcctgagaagattttcttagctgggaattatctggttgcatggaagaga

SEQ ID NO: 6803472 - DNA, 77 bp, Homo sapiens
ataagctggtaaaatttgtgagattttcagaaggcaaaatccatgttttttgtctattcactgattcagccacttat

SEQ ID NO: 6803473 - DNA, 76 bp, Homo sapiens
tgtttggcttataataatactggccaaaaacatgattctccactaaaaatgtcagtgttggttgggaagccaagca

SEQ ID NO: 6803474 - DNA, 84 bp, Homo sapiens
ggtggtggtgcaatgtggagctgggggagagaagcccagaaatcgggtgggctgagctcagtcccagctctacagccactgacc

SEQ ID NO: 6803475 - DNA, 67 bp, Homo sapiens
gacagataagtttcttaaagggccttctgcataaagaaaaacaaacttcataggacgactgtctgtc

SEQ ID NO: 6803476 - DNA, 78 bp, Homo sapiens
agtcattagtttcttctccttgaaaagctgcatcttttcagatggctctttgaaggggaattttttggaattaacgct

SEQ ID NO: 6803477 - DNA, 56 bp, Homo sapiens
gactgcttccctgggattgctcaaaaactgagaccccagcatctggaagtgatgtc

SEQ ID NO: 6803478 - DNA, 80 bp, Homo sapiens
agtcctggaggagtaattagtgtccagcttctgcttatcaaagctttgccaggaggcttggtccacatgattccaggatt

SEQ ID NO: 6803479 - DNA, 73 bp, Homo sapiens
ctgacaaaggtttccgagctttaatttactagaacatataacgggcaaaggagaggctgggaaacacagtcag

SEQ ID NO: 6803480 - DNA, 94 bp, Homo sapiens
tattctctaccctgtccctatttttctgtaccctaatttaatgtttgattgttaattctgagttgggaaggagagggactacaggtaggagata

SEQ ID NO: 6803481 - DNA, 88 bp, Homo sapiens
ttgcactcatcttatgttagtgattttcatattacattagcaaatttaatctctgctcatgtgataggaagttactaacacaatgcga

SEQ ID NO: 6803482 - DNA, 82 bp, Homo sapiens
attttatatttattatgcagtgaaaaagtgcaccctgtgtagaattacaaggctctaatttcattgaaagtttctgtaaggt

SEQ ID NO: 6803483 - DNA, 59 bp, Homo sapiens
tggtttatattttgtgtgatctcttaaagaaatagagatcagagcaatggataaaatca

SEQ ID NO: 6803484 - DNA, 68 bp, Homo sapiens
gcagactgttcacgatgtcagatggttcatgatttttttccaggtttgatacagaagaatcagtttgt

SEQ ID NO: 6803485 - DNA, 71 bp, Homo sapiens
gtgatatgatagagagtaactgtggtcactttacgattgggaggccaggaggatctctctaaagatgttac

SEQ ID NO: 6803486 - DNA, 56 bp, Homo sapiens
ctctttgtgctattatgatcctcattttttagatgaggacactaaggcactgagag

SEQ ID NO: 6803487 - DNA, 55 bp, Homo sapiens
gggaagtaaattaggacagctttcctttccatttaagttgtctcttttggttcct

SEQ ID NO: 6803488 - DNA, 58 bp, Homo sapiens
gctgggtgttcaggagctgggctcatgtcacatgagggcccatgtgggagcacttggc

SEQ ID NO: 6803489 - DNA, 84 bp, Homo sapiens
ctagggccacatagctagtcagtagtgaagcctggatccaaacccagatctgtctgtctgcacagctcatgggaaaaaccctag

SEQ ID NO: 6803490 - DNA, 59 bp, Homo sapiens
atgtgtcattattgtgtaggctgctgaggtttcaaatctctataactatagtgacagat

SEQ ID NO: 6803491 - DNA, 79 bp, Homo sapiens
tggagtatgcaaatatgttataagacatagtaacacatagcatgcgttgaatgcttacaatatgttaggcactgctcta

SEQ ID NO: 6803492 - DNA, 94 bp, Homo sapiens
acgggaggtcagagggctgcctggcgcagtttctctgctgcctggattgaccatgaggacaaggactagctgtgcccagccccctgcttcccgt

SEQ ID NO: 6803493 - DNA, 85 bp, Homo sapiens
caagaaaatagtaaaaaggcagaaagaatacttcctattgctacaaaaggaatgttagttctgtatacaaagtattattttgttg

SEQ ID NO: 6803494 - DNA, 95 bp, Homo sapiens
gtccaaaagtatacttgaattgggggttttgcaaggcatagtgaaattcatccatccatctgtcttgaaaattcctaatgttggtctatgaaggc

SEQ ID NO: 6803495 - DNA, 128 bp, Homo sapiens
gtgttaggacagtcaattctttatctaatgttgagtatgaattgctttgcctgtatcttcccatgaactctatagcaaaatagtttccacactttcagaggtgaacttgaatttacttagcctcccac

SEQ ID NO: 6803496 - DNA, 55 bp, Homo sapiens
agcagtgtcttcctcctttgttgggtcagtcaaaagagcacaggtggacaatgct

SEQ ID NO: 6803497 - DNA, 65 bp, Homo sapiens
caataatggtgcatcaatataggttcattgattgtaacaaatggaccactctggtgcccatgttg

SEQ ID NO: 6803498 - DNA, 92 bp, Homo sapiens
tggatggctgatgaaaagcatgggagttttctctgatgctcacacaaatagagttggggtggggtagggtgggagaatttccattagctcca

SEQ ID NO: 6803499 - DNA, 62 bp, Homo sapiens
ctggctttgctgatctgtgccctgctcatggacatagcaggactggtgccagacaaggtagg

SEQ ID NO: 6803500 - DNA, 68 bp, Homo sapiens
cagcctggctccgtgtcacgtgccctctgctgttccctaggcactgggacgctgcactgaccagtctg

SEQ ID NO: 6803501 - DNA, 55 bp, Homo sapiens
agacagaggctggtgtgggttccatgtttggggcccaggagacctagatctgttt

SEQ ID NO: 6803502 - DNA, 62 bp, Homo sapiens
caggcagggctgccttctgctttttcaaattcttgctggtcttagcagtggagccatgcctg

SEQ ID NO: 6803503 - DNA, 80 bp, Homo sapiens
ccacacctcctggggctgaggggcagttcagtgggagcacctgaaactgctcccagccccatgatctaggagggaactgg

SEQ ID NO: 6803504 - DNA, 129 bp, Homo sapiens
gtttgattatattttattgcctggcttatgtagcaggctcgcaataaaatgtttcttaaagcaatgaataaaagactgcattttataaagagttatttgctgcagaggcatttgaaaatatgagcattc

SEQ ID NO: 6803505 - DNA, 56 bp, Homo sapiens
ccggggtggctaggtatcccccattttgtagaaataggcagtgtcttccatctggg

SEQ ID NO: 6803506 - DNA, 71 bp, Homo sapiens
gataaaatgtgtatcccagaggcactattcagaaccttctgagctatgttcctcgatgctcagtttttatt

SEQ ID NO: 6803507 - DNA, 67 bp, Homo sapiens
agatatgaagatttcccagagacatgcacagctaatctgaagcacagctgggacagttttcacctct

SEQ ID NO: 6803508 - DNA, 61 bp, Homo sapiens
gggaagggtgcatggagggaagtccagaggaaactaggcacacgctttggtgtctctcccc

SEQ ID NO: 6803509 - DNA, 90 bp, Homo sapiens
gattggtgtatcatagggccccagttcttggctgagccagggctcaccttgagtccagttagtgaggctgggtaatggagtatagcagtc

SEQ ID NO: 6803510 - DNA, 124 bp, Homo sapiens
gattatagtttgtaacatgtttgaaacagaagcttcgaaagagtgatttctcaacttagtgttaaatgattttgtctgaagtctgactctttgtaagcttgtttgtttcatcaaattttaagtc

SEQ ID NO: 6803511 - DNA, 68 bp, Homo sapiens
agcagtcagcctctatgcccccgtcacccagccagctctctgggtttcggggcgggaggctgagggct

SEQ ID NO: 6803512 - DNA, 58 bp, Homo sapiens
ccagatggggaaggtagagctgggcaagggattgctcacatatcacctacctaattgg

SEQ ID NO: 6803513 - DNA, 96 bp, Homo sapiens
tgtgacatcatgggaggagcacctggtccttgacgcgtgggaggcgggctttggcccgtgtcgtcatgggaggcgggtctggtacgtgacgtcacg

SEQ ID NO: 6803514 - DNA, 56 bp, Homo sapiens
cagcaggctgattaggcctcgtccattatagagagtgacttcctaatcgccagctg

SEQ ID NO: 6803515 - DNA, 66 bp, Homo sapiens
ccttgatccttgctcagccactactcctgatatgccctcaagaagtgcatagtaatggagtcaagg

SEQ ID NO: 6803516 - DNA, 77 bp, Homo sapiens
aggagatcatgtagcaaaagcagccactctctctgcctcagcccaaggctagggaggatgggctttatctggtccct

SEQ ID NO: 6803517 - DNA, 81 bp, Homo sapiens
ataaaaataaagctaagggtgtttaagcaggcaaaatgtttggaattttgtttcttaaatgtctttaaggtttgtttttgt

SEQ ID NO: 6803518 - DNA, 59 bp, Homo sapiens
cctctctgtagcagcccccagtgctctgctctgtagcactgggggtggctacagagagg

SEQ ID NO: 6803519 - DNA, 69 bp, Homo sapiens
agaattccataatcaccttattctttgttaggacccttcagagagtcagggaaggtggtgtggacatct

SEQ ID NO: 6803520 - DNA, 126 bp, Homo sapiens
ttcccaggttgggctaaagctcatgttgtccaggtggtaccttcctgtcagctctccacgattcatttatgagtctggagtttgctactggacctacccaacaatgttcccagccttccctgagaa

SEQ ID NO: 6803521 - DNA, 77 bp, Homo sapiens
agtaagatagttaaagagatccacattccagagctgtttaactttgggcaagttacttaatctctctgacccttact

SEQ ID NO: 6803522 - DNA, 58 bp, Homo sapiens
caaatggagggacagagaccagaaagagctccctggaatctctgagtttcctaatttg

SEQ ID NO: 6803523 - DNA, 72 bp, Homo sapiens
gggtgacagagtgagaccctgtctcaaaatataaacaaataggcggggggcagtggctcacgcctgtaatcc

SEQ ID NO: 6803524 - DNA, 63 bp, Homo sapiens
gtctggaagagcaggaataaacttgtctgggcaagtaataacttcttcctcttatccatggac

SEQ ID NO: 6803525 - DNA, 130 bp, Homo sapiens
tatcgtcataacctggaagctggtgagaaacgcagattctcaggtcacaccccagacagactgaatcaggaactctggaggtgaggcccagtgatctgtgtttcaacaagccctccagatgattctgatg

SEQ ID NO: 6803526 - DNA, 76 bp, Homo sapiens
gtgtttaagtgaggtttcctgttaggacaagggtaaattgtttagttatcctagtcacaggaaaatttcaaaatac

SEQ ID NO: 6803527 - DNA, 60 bp, Homo sapiens
tcctggagccatgattcccctcttagcatctagcctggagaggatttaagtttaaaagga

SEQ ID NO: 6803528 - DNA, 73 bp, Homo sapiens
ggctcagggccagggctgtgctctgtggagaccattctgagacaaggaaacatggagagcccttgcctgagtc

SEQ ID NO: 6803529 - DNA, 69 bp, Homo sapiens
aagccatctccttccaaacccagggtatgggctgggtgactgctctgattcttttgggaggtgaggttt

SEQ ID NO: 6803530 - DNA, 63 bp, Homo sapiens
ggaagcctctgaccagagtgtacagagcttttccaggaaggacaggcacagtggtggaggccc

SEQ ID NO: 6803531 - DNA, 77 bp, Homo sapiens
aagcactcaatcagggatgtaattgtgagctaaaaaaaattacagtatattttcttgattgttccatctcacggctt

SEQ ID NO: 6803532 - DNA, 59 bp, Homo sapiens
tctttgcatgtgcttcttggccataggagttggattttagcctggaggcaatgggaaga

SEQ ID NO: 6803533 - DNA, 130 bp, Homo sapiens
gcagacgccgcacttgtggcgcaggttgtgcgtgagcaggtgcatggcgagcgcgggcatggacacgtaggccttgccgcacgtcgggcatttgcgcgccagctggctgtccaggctgcggtgcgtctgc

SEQ ID NO: 6803534 - DNA, 109 bp, Homo sapiens
tgcatttctccaaggccattctcctagcctgtttggaatctgtttaatttctttgtttgaattaatggttccaaaaggccagaatagcagttcattcttgagtcttgca

SEQ ID NO: 6803535 - DNA, 62 bp, Homo sapiens
taggtctgccctgggtggaggcgctgccctaggtggtgggtctgcactgggtggcgggtctg

SEQ ID NO: 6803536 - DNA, 78 bp, Homo sapiens
ttttggtagagatggaatctttctatgttgcccaggttggtcccaacctcctggcctcaagcaatcctcctgccaaag

SEQ ID NO: 6803537 - DNA, 67 bp, Homo sapiens
cagaaggcaccattgtcaacggtaaagtcctaggagggacccattgccggtgaggtgaggctttctg

SEQ ID NO: 6803538 - DNA, 107 bp, Homo sapiens
ttgtccaaaaaaatctctcttggagttgacagtttagaagcttgtggttacttaataaagtttcaggctaatagaagttaacttctggtgagttatcaagtgaacga

SEQ ID NO: 6803539 - DNA, 55 bp, Homo sapiens
catacatttgctttgattttcagccagtcccttggcttttgcaaaccaatgtgtg

SEQ ID NO: 6803540 - DNA, 69 bp, Homo sapiens
gagctcacaccattgaagcaggctgttgaggatcagtcactattcctgctgccatttcaagtgctgctt

SEQ ID NO: 6803541 - DNA, 55 bp, Homo sapiens
acagtaattgtgaacttaacgtctcagaattgggccaagaaagtgcagttactgt

SEQ ID NO: 6803542 - DNA, 60 bp, Homo sapiens
tctttttcatgggtgatgagtgggtacatagatggctgcacacagttctcaggaaagaga

SEQ ID NO: 6803543 - DNA, 76 bp, Homo sapiens
ggttttacaaggatattattattttctttcagagtgctaagctattcttaaaggcacatagtgtctatgataaatc

SEQ ID NO: 6803544 - DNA, 69 bp, Homo sapiens
atgccttattgcattttgtgaattccttttcatgtataacattaagattcacagagtgaatgaaagtat

SEQ ID NO: 6803545 - DNA, 68 bp, Homo sapiens
ccagcccttcagggggctgcaggcgctttttgctctgggcattacgtcttcttcagcccctgggctgg

SEQ ID NO: 6803546 - DNA, 70 bp, Homo sapiens
cccataaaaattcactcctgggataaataccaacctgaaataacactcacttggctcagatttttatggg

SEQ ID NO: 6803547 - DNA, 57 bp, Homo sapiens
ctccctcgtctctctctgacaggtattcagctaccacctactagagagggcagggag

SEQ ID NO: 6803548 - DNA, 62 bp, Homo sapiens
ggggcattgtgacatatctctgggcctacacccaggttatatgactgtcatgcctgtgcccc

SEQ ID NO: 6803549 - DNA, 71 bp, Homo sapiens
ttggatttctcctagagcaaaccgcaaaccaaggacttgggtgcaagtaacttgtttgggaggtaatccaa

SEQ ID NO: 6803550 - DNA, 83 bp, Homo sapiens
gtcatgtgaggtataattttcagtgtaaatgttttattacaatataacatacatacagaaaagtgcataaaccttatgtgtac

SEQ ID NO: 6803551 - DNA, 57 bp, Homo sapiens
agatgacaggtttttttggcttgctttctctggcccatgactaaaagaactgtcact

SEQ ID NO: 6803552 - DNA, 58 bp, Homo sapiens
ctgtgtgtagcatatagcaagagcatatatggtatgcaagagcaatatggtatgcaag

SEQ ID NO: 6803553 - DNA, 73 bp, Homo sapiens
ttccagctagttcaggttttctcattttcttcatatgttgagtaattttggagtataacctggatattgtgaa

SEQ ID NO: 6803554 - DNA, 92 bp, Homo sapiens
gcagggtactcggagggtcaaaaacttcttgctgcattttctgttttcgcgctggacagacttgcccagaagtcaccctctgagaacactgt

SEQ ID NO: 6803555 - DNA, 59 bp, Homo sapiens
tagcacactgccttcactgagggtcctcccagagtcttgtgtgaagggcagtgcagcta

SEQ ID NO: 6803556 - DNA, 99 bp, Homo sapiens
gctttcctggaggaggtgatattggagctctttggcagacaagtaggactttgtcaggcctatgagagatctattgggcattcttttctaggtggaggt

SEQ ID NO: 6803557 - DNA, 57 bp, Homo sapiens
gcatggaattcccttatgggccccaaactctggattgcactctgagggagtccatgt

SEQ ID NO: 6803558 - DNA, 59 bp, Homo sapiens
gccgtggggcttcctggggcaagttggccatcccagccctcatggaacagctcctaggt

SEQ ID NO: 6803559 - DNA, 87 bp, Homo sapiens
taaattaatttttgtaattctgtgttttactccaattatatttaatggtataggcagagacatggagtgggcagggagatgaattta

SEQ ID NO: 6803560 - DNA, 67 bp, Homo sapiens
aaacagcatgactcccttagcctttgctcactttattctgagccaaaagagctgatagcatctgttt

SEQ ID NO: 6803561 - DNA, 130 bp, Homo sapiens
ttttatttttctaaatcacttccagttattttttctgatgacccaagtagtgccttttctgttacccaggaacatggtagaggggctgattggggtcagaagtccgggggaccaagttggggacctcata

SEQ ID NO: 6803562 - DNA, 62 bp, Homo sapiens
ctgtggtaaccctctgagtgcctcacccttccttttcctagtaaacatagtggataccacag

SEQ ID NO: 6803563 - DNA, 65 bp, Homo sapiens
taaaactgcaggtcatgacccattagtagattgtgaaattaagtgggttgagaccagcattttta

SEQ ID NO: 6803564 - DNA, 124 bp, Homo sapiens
gcttatcaaaattgttttcatatagcaatttgacattacaacacaatctctataggctcccccttggaatgttatgatgatggtaaattgcattcaaatgagtgggaatagaattatgataagc

SEQ ID NO: 6803565 - DNA, 55 bp, Homo sapiens
tctgcatcagagtttgctgctgctgctgctgctagcaaagctatctctatggaga

SEQ ID NO: 6803566 - DNA, 106 bp, Homo sapiens
agaaagtggggtaagaaagggcacatggcacagttaaagttgtagaaatcaaattactatcattttttgttgccaaaacaaagtcttacatttaacccccctttct

SEQ ID NO: 6803567 - DNA, 60 bp, Homo sapiens
ctctggagggaggctgagctggagatgggagggagtctttgctgccagcgccctgcaggg

SEQ ID NO: 6803568 - DNA, 58 bp, Homo sapiens
tagtttaggtcgtacaagcaaaggaagggagctgtatccttgcagatgagctgaacta

SEQ ID NO: 6803569 - DNA, 89 bp, Homo sapiens
ttcttgttcctcagtaagaaacccaggaatttcttacctgtgtgatagagtaataaagatgtgggctttgaaactgggaaacactagaa

SEQ ID NO: 6803570 - DNA, 73 bp, Homo sapiens
tcctcagggcatacaagctccttattcagctggggctagtgctccaagctgataggagcttggagtcggagga

SEQ ID NO: 6803571 - DNA, 63 bp, Homo sapiens
tctcccatagtgtctgctgagctggatagtccctctccagggagctttgcaggggatgggtga

SEQ ID NO: 6803572 - DNA, 67 bp, Homo sapiens
cctgcaacagctcagacacgggacctgagcgcctaagccaggctctggagtgtggtgctggtccagg

SEQ ID NO: 6803573 - DNA, 69 bp, Homo sapiens
tgttttatatatatgtaatatgtgtgtgtatatatatatacacacgtatatatacgtatgtgcgaaata

SEQ ID NO: 6803574 - DNA, 65 bp, Homo sapiens
ttctttctcagtgggcagatactgttgccatacacttctctgtttccctgcctcctgtggaggag

SEQ ID NO: 6803575 - DNA, 56 bp, Homo sapiens
ttacaagggtcagtgtgtttgtgctgtacttggcattttcacaaattactctgtag

SEQ ID NO: 6803576 - DNA, 105 bp, Homo sapiens
ggctggttgaagcagggctatgcccaggaggccagcgtttgttctgagctgctcgtgacccaggaaggctggccattccccattcccctgatcctgtgcccagcc

SEQ ID NO: 6803577 - DNA, 76 bp, Homo sapiens
tgagttttggaagacaacacaatgcaacagaaggaacactaattttgaagctggtaggttttgtttgcagaactta

SEQ ID NO: 6803578 - DNA, 55 bp, Homo sapiens
gatacctctaaatagctcactaagtcctataaggatcatggctgctgagaggttc

SEQ ID NO: 6803579 - DNA, 59 bp, Homo sapiens
tcacttaccctgtaaggttgctaggaaggactcaaactttaagcaagacagtggtgtga

SEQ ID NO: 6803580 - DNA, 56 bp, Homo sapiens
ggtgactagataagccccatgggacagcacatctgtcacagggctgtggggtcact

SEQ ID NO: 6803581 - DNA, 69 bp, Homo sapiens
gcactagttttagtcccattttacagacaggacatggaaacctatctgtaaagatcacagagctggtgc

SEQ ID NO: 6803582 - DNA, 58 bp, Homo sapiens
ttactggagtgagctgttcttgaagttatttcaagttctagtgttcacttctaagtaa

SEQ ID NO: 6803583 - DNA, 115 bp, Homo sapiens
taactttgaaaaactaagtctgtggcagtgtttgtatagaatatgcagctttgaataatcaaaaggactgcattcattttttataatattccatccagctttttgttgaaggttg

SEQ ID NO: 6803584 - DNA, 78 bp, Homo sapiens
cggctctaatttcagctctgccggagagagactgggacaactcagccttcttttcccagagcaaaaatgaagatgctg

SEQ ID NO: 6803585 - DNA, 84 bp, Homo sapiens
tgggacacagctagcctcaatacggatatgcaaaatgcatcttaagtcttttgtgtgcttggtattgaagacaggctaaactca

SEQ ID NO: 6803586 - DNA, 81 bp, Homo sapiens
tctgggaagacttcctggcgtagctgacatttggccatttgagccgagtaggaggtgaatatgtcgggatggcatcctagg

SEQ ID NO: 6803587 - DNA, 57 bp, Homo sapiens
gacttcatatggacagcaaactagtcaaggctcagtggatcatgtccttgtcaagtt

SEQ ID NO: 6803588 - DNA, 61 bp, Homo sapiens
ggcatcaccaggtcagagaatggctggggtgtaattgagaagttctttggtggtggtgacc

SEQ ID NO: 6803589 - DNA, 83 bp, Homo sapiens
tttagagtagcagagttttgtgaacaacttggtgtttcagggcaacagcatcccaagaggtaatacgagatatctgctctaag

SEQ ID NO: 6803590 - DNA, 80 bp, Homo sapiens
tcagtgccccacctacagagaactcagctgccctcagacttacttaggaacaagccagattctgtaaggaggggatttga

SEQ ID NO: 6803591 - DNA, 82 bp, Homo sapiens
taggttggcttcatgttattgactcataatatcatggccaactgaaatattttgaagttaataatgtgtacctctaacacta

SEQ ID NO: 6803592 - DNA, 59 bp, Homo sapiens
cattgttggcagagggacagaggcccagaggggagactgagagccttctagccacaatg

SEQ ID NO: 6803593 - DNA, 70 bp, Homo sapiens
ggaaaagcatctctatgtggagagtggagagcagtggcgcattttatttgacatggtggatttgctttcc

SEQ ID NO: 6803594 - DNA, 64 bp, Homo sapiens
tctaagggaaggtgatatgttattccttgcaggaaataattctttatatgtcccgttccctaga

SEQ ID NO: 6803595 - DNA, 56 bp, Homo sapiens
gcgggtgcacagttctgcagtgagatctttttttaagaggtggaacagcaattcgt

SEQ ID NO: 6803596 - DNA, 93 bp, Homo sapiens
ggagaaaaagaagcttttgtttggattttacccaaagaaatgtcctttggtaacaaccctacaaatccacatagcaggtacatttttttttcc

SEQ ID NO: 6803597 - DNA, 64 bp, Homo sapiens
gagcaaagcttttagggcctttcacaaggaaaaaggcccttccaacccagagggcaacttgctc

SEQ ID NO: 6803598 - DNA, 69 bp, Homo sapiens
gctcttgaggaagtgcagggcagtgagattccagagcagctgccacccctctgcaccctcaggtcaggc

SEQ ID NO: 6803599 - DNA, 88 bp, Homo sapiens
tatcctccaaaaatttgtcttgaagctctaatccccaaagtgatagtatttacaggtggaggctttaggaggtgattaggtttagata

SEQ ID NO: 6803600 - DNA, 69 bp, Homo sapiens
tttgggatccatggagaaggaggtgtctgtgggatctccaggctctatccctccttcttcactcccaga

SEQ ID NO: 6803601 - DNA, 57 bp, Homo sapiens
agaaattatgcagtagttttataggctgacctgtgtaaactccttgtcataattttt

SEQ ID NO: 6803602 - DNA, 102 bp, Homo sapiens
gcaaactcacttgagtcactcgcttgaaatgtaatcagtctgagagatggggaataaagactgagctgcaagtcagggaggtatcaggccaaagagggaggc

SEQ ID NO: 6803603 - DNA, 65 bp, Homo sapiens
cttgtgagagctgcttcagccaggacttctgcatccggtgcaagaggcagttttacttgtacaag

SEQ ID NO: 6803604 - DNA, 85 bp, Homo sapiens
atttctcagggctctttcgggtttccagctctaagatgcagtaaatgcaaagagaaacttagaagcctgaaaggcggtggggaat

SEQ ID NO: 6803605 - DNA, 73 bp, Homo sapiens
gccagctggcatgctctttgtccacagtaattcaactattgactgacagcctacaatgggcatgtgaagtggc

SEQ ID NO: 6803606 - DNA, 70 bp, Homo sapiens
ctggcggggagtggtctgggaaggtcagggatgggggacctgcctgctgcacagcccacttccctgccgg

SEQ ID NO: 6803607 - DNA, 55 bp, Homo sapiens
tcctctacaaactaaggagggtaataatacttggtattcttaaagtttgtgaggg

SEQ ID NO: 6803608 - DNA, 78 bp, Homo sapiens
gaaagaccgtttgggctctaaaatggttacatatgtcttggttaatgtcctcagtcatggtgccttcagctgtctttt

SEQ ID NO: 6803609 - DNA, 57 bp, Homo sapiens
attagaactaggctaagtaaaacgagatttcttggtctgattgtgtgtagttctgat

SEQ ID NO: 6803610 - DNA, 68 bp, Homo sapiens
tgagggacaccagggctggagctcagtgctgggcagagcagggcgtgctccctaggccttggtcctca

SEQ ID NO: 6803611 - DNA, 62 bp, Homo sapiens
gccacgcctgtctgagtgatgtcattcctggccaataggaagccaagcattggacccgtggc

SEQ ID NO: 6803612 - DNA, 86 bp, Homo sapiens
ttcctctactacccgcccatcagtggcaaataaacaccttaccatgacattcactgtgagtattgctagcgggagaagtggaggag

SEQ ID NO: 6803613 - DNA, 82 bp, Homo sapiens
gtggcatgtataataagtcttagagaatgcaagcaaacctctgattggcaatgaagtgcattctctggcactcagcagccac

SEQ ID NO: 6803614 - DNA, 91 bp, Homo sapiens
gttgcttgcattgcaaaccaaggagcaaggctcaacaaggtcacttccaattctaccttacccgagtgtttcttgtttgatctgtggcagc

SEQ ID NO: 6803615 - DNA, 59 bp, Homo sapiens
tattaggttgttgcaaaagtaattgtggtttttgccattacttttgtgacaacctaata

SEQ ID NO: 6803616 - DNA, 117 bp, Homo sapiens
gggaatgtaggggtgaagtattggatcgttgcaatagtggttgtggttctggccattaccttcaatggcaaaaaccgcaattacttttgtgccattgtaataattcccagcatttcc

SEQ ID NO: 6803617 - DNA, 130 bp, Homo sapiens
cctcctctccttcccaggggccagacctgcatctcgatctgaaggcttttcttgcctcctcctgcaccctaccccaagaaatctctagcacatcgaatcccatgttagtgtctgcttctcaggacatttg

SEQ ID NO: 6803618 - DNA, 66 bp, Homo sapiens
ttgcatatctagaggagggctgctggattacattagtgattctattagcattttatggaaatgcaa

SEQ ID NO: 6803619 - DNA, 57 bp, Homo sapiens
ggcttcccctccagtgctctgtgtccccctcacaccagcctggcccagggggaggct

SEQ ID NO: 6803620 - DNA, 116 bp, Homo sapiens
tgtgtctgcatgttccagagtgtggttttggagttcagactgcctagatttgaatcctggctcaagcccctgttagctctgtgagtctaggcaaactcatgccattgcggacctca

SEQ ID NO: 6803621 - DNA, 113 bp, Homo sapiens
aactggtgcatgtcagaagcgtggcgggctcatgctatgagcgagggcctgggctccctccctccccaggttgcatacatcagcagagcctctacttctgcatgtgaacagtt

SEQ ID NO: 6803622 - DNA, 76 bp, Homo sapiens
cttggtaatatttttaagagcttcagatctctctctatcaaagaactggagtcaggatcttataaatatttctggg

SEQ ID NO: 6803623 - DNA, 78 bp, Homo sapiens
ttgtggggattaaaaaaatgtggcatcaaaaatttttagcttagctttatgtctggcacatatttttagtgctcataa

SEQ ID NO: 6803624 - DNA, 58 bp, Homo sapiens
ataatgaagccacgttaaattggctgtacaaacatccaaacaaatgaggcctcactgt

SEQ ID NO: 6803625 - DNA, 79 bp, Homo sapiens
aaatttatattgcagggactcaataagaatgttgtttatgttaacagaaagttttcattgattctctgcaggctgattt

SEQ ID NO: 6803626 - DNA, 56 bp, Homo sapiens
agtcaaggttattaactagagaggatcgaatcctggcagtcaaataaccttgcact

SEQ ID NO: 6803627 - DNA, 57 bp, Homo sapiens
ggagccaggaaggataccaaaggctgtaagaacaattttggcctctgcctgagctcc

SEQ ID NO: 6803628 - DNA, 130 bp, Homo sapiens
gataaacaacgaatccctttttaatgtatgtcccatgcaatatgtgtgataaagaataatttttttagcataattatgtctcaggtattgaatgggaacactgttactaatacaagatcagttgtttatc

SEQ ID NO: 6803629 - DNA, 72 bp, Homo sapiens
gcttcctccctgcttggaatgacccttacttaccacgtggcacttagatcaggttgggtcccaacaggaagc

SEQ ID NO: 6803630 - DNA, 59 bp, Homo sapiens
ccatgcttctcttttcctcacctaactcaaggtagaatctgcctagggcgggaagcagg

SEQ ID NO: 6803631 - DNA, 95 bp, Homo sapiens
tcctccttccctccttcttaagtgtcataatttccaagatctgccttattctttactatctttatggaacggtgaactttggcaggggaggggga

SEQ ID NO: 6803632 - DNA, 63 bp, Homo sapiens
gtaggggctggggctgggaatggctcctggggtcagtttattcttggccccagtgacttctac

SEQ ID NO: 6803633 - DNA, 77 bp, Homo sapiens
ctggtgccctttctttcagaacacaagtgattattactgctgatatgaatcaaggtgatttggagctgggcatgcag

SEQ ID NO: 6803634 - DNA, 129 bp, Homo sapiens
gtgtggtcagggagagtgttgggaaatgagggtgggatacagagagaaggatgatttaaaggtttagatggtctggttatttttagtttttctattcccatttctgcaatagtttttatttttcctcat

SEQ ID NO: 6803635 - DNA, 82 bp, Homo sapiens
ggttcttggtttcagggaaaacatcccgcctaacccacccaggttaggccccttccctgaagcctcccagtccccaagagcc

SEQ ID NO: 6803636 - DNA, 62 bp, Homo sapiens
gaaacacacacagtgtaataaccatctggcccctttatttctcagtggagctgcgtgtgttc

SEQ ID NO: 6803637 - DNA, 85 bp, Homo sapiens
tagctatgtgacattggaagattacttagttttctcttttgtaagatgaaaatagtaatatctaccttagagtgttatagagtta

SEQ ID NO: 6803638 - DNA, 64 bp, Homo sapiens
ggtcaagggggccacacctggtgtgagctttcttggggctgcatctggtggaagccttcttgct

SEQ ID NO: 6803639 - DNA, 57 bp, Homo sapiens
cttctttagtcattgtcattcctttgaggcgcaagttccaaagaatcattagagaag

SEQ ID NO: 6803640 - DNA, 91 bp, Homo sapiens
aagcatttttaattcctatttccatgaaacacaaaaagttgatttgaatgcttcttagtttactcatggagataggtatttgggaattctt

SEQ ID NO: 6803641 - DNA, 66 bp, Homo sapiens
taaatgttcctttggattaaactcaaggtggaatttacccacaagttgctttaaaaggagcattta

SEQ ID NO: 6803642 - DNA, 82 bp, Homo sapiens
ctttactgtaacaatttcttactattgtattgcctttcttttcaatttaaaaggataataagagaaatagttacagggaaag

SEQ ID NO: 6803643 - DNA, 86 bp, Homo sapiens
ggtttgacatggccagaggccttgttgcgtccgttcggctttggcgccactcgatgtaaatggtctttggcagaaggtgtggaatc

SEQ ID NO: 6803644 - DNA, 79 bp, Homo sapiens
ggacacgctgggaaatggcttcgagctcacacactgattttcgtgagtggaaagagaagccctttcttaggcgtcttcc

SEQ ID NO: 6803645 - DNA, 61 bp, Homo sapiens
tccaggcaaagccttgtagacgtattctcgttattgagtctttttctttagggtttctgga

SEQ ID NO: 6803646 - DNA, 80 bp, Homo sapiens
gagggctgctgtctctttgcaagatgaaagatgtggcattgttgctgtgtcttcacaaagcagaagggatgaaagctctc

SEQ ID NO: 6803647 - DNA, 87 bp, Homo sapiens
ggagaattgcttgaacccaagaggcggaggttgcagtgagccgagattgcgccattgcactccagcctgggccacaggcaagattcc

SEQ ID NO: 6803648 - DNA, 94 bp, Homo sapiens
tggtggctattaactgctctaattgtgctgtaggctcgttaacaagtttgttgaagttgcacattataattttaaaggagttaattgaatacta

SEQ ID NO: 6803649 - DNA, 55 bp, Homo sapiens
tcttatggagtgggattttgtagttcctctggaattcctgtcttgctttatcgga

SEQ ID NO: 6803650 - DNA, 65 bp, Homo sapiens
tatactatcagactcctggacacatagctagatggagaaaggtggacagtgaatctggaggtata

SEQ ID NO: 6803651 - DNA, 64 bp, Homo sapiens
tcctgctgctcttgggaaacctgcaaccactgccacaggaatgagcccaggttagcctgcgggg

SEQ ID NO: 6803652 - DNA, 55 bp, Homo sapiens
gctgcgcagccaggccgtggtgctaatgacatccaggcctcttccatgcagcagc

SEQ ID NO: 6803653 - DNA, 59 bp, Homo sapiens
attctgcttttgctgacctaccattctacagccatggtgataggtcaggaaagcagagt

SEQ ID NO: 6803654 - DNA, 61 bp, Homo sapiens
gtgattgagtcacaacaaatccagattcctggaatctgtgagaaaggcttgtgctcatcac

SEQ ID NO: 6803655 - DNA, 101 bp, Homo sapiens
caagggtattggaaagtttaattgtattttgaaattctttgcatctgtcaaagagtaaagacatgcaaagtctaattaggagcgatgagttagtattcttg

SEQ ID NO: 6803656 - DNA, 75 bp, Homo sapiens
atcacctcccccagcaaagcctgatggtcaaagtccttcagcccctttctccacgccagcttgcttaggagggat

SEQ ID NO: 6803657 - DNA, 97 bp, Homo sapiens
gctaaataaattattcaattttaatatcagtgtgatacctcaccaaagaatgtctgcattttcagaggaaatctcattgagaggtcaaaatttaagc

SEQ ID NO: 6803658 - DNA, 64 bp, Homo sapiens
cccaaagagttaggtccacaagatcaatgcagtaattgcatgtgatctggggcttctccctggg

SEQ ID NO: 6803659 - DNA, 92 bp, Homo sapiens
tctcagaatctagaattgtcactggaagttctaaatacccaggacttgtgtgctaaatttagacttcccagcactgtgactggcattttgga

SEQ ID NO: 6803660 - DNA, 71 bp, Homo sapiens
gcaccgctgtggctgcagcccagcggcacggccccgtggctcccgctggccatgcaccctcagtctgtcgc

SEQ ID NO: 6803661 - DNA, 73 bp, Homo sapiens
aggtattagcacaaagcaaggtattaacagggcccaatctctaccaaataccaagtttctttgtctactacct

SEQ ID NO: 6803662 - DNA, 61 bp, Homo sapiens
gtcctacaccggagcctggaaggtatcaaatcctggtaccaccatttgcctgctgtatgac

SEQ ID NO: 6803663 - DNA, 57 bp, Homo sapiens
ataagtgggaaatgaatacgttagtaaatacatattaatagtattcaggccacttgt

SEQ ID NO: 6803664 - DNA, 95 bp, Homo sapiens
gttggccaggctggcctcgaactcctgaccttgtgatccacccgccttggcctcccaaagtgctgggattacaggtgtgagccaccacagccgac

SEQ ID NO: 6803665 - DNA, 63 bp, Homo sapiens
agatgggccttcgagcatgcccccacttcttgggctgtcataactccccttgaagagtcctct

SEQ ID NO: 6803666 - DNA, 75 bp, Homo sapiens
ttaaaattgcttgaaatgtttgtcaactgcttcattaaagcccaaaggcagcatatattcagtgggcaattttga

SEQ ID NO: 6803667 - DNA, 84 bp, Homo sapiens
cagtttcctttcctccatatttggaagtttttgtgggaattctcagatttttgtgaacttaccaacatggtttctggaaagctg

SEQ ID NO: 6803668 - DNA, 66 bp, Homo sapiens
ggtgctcagctggtgaatggactcatctggagggtccacgatggcttcacttacatggctggtgcc

SEQ ID NO: 6803669 - DNA, 56 bp, Homo sapiens
gaactgaaacttggtttaaagcaggacttaaactctttactaagtttgtacggttc

SEQ ID NO: 6803670 - DNA, 55 bp, Homo sapiens
aaaggaggaaattctgatccctggaattaacccagcatctctccattcctccttt

SEQ ID NO: 6803671 - DNA, 125 bp, Homo sapiens
atctgtagatgcagagagactggagaccagaagacaaagacagcctcatgtgcatgaacttagccaagttgcacactggcttgctgactaatctgtcttatctccttatctctgtgaatgcagat

SEQ ID NO: 6803672 - DNA, 77 bp, Homo sapiens
aaggtgaaggacccagggtggtcacctgaaatgtgtttgtcagatgcaggtcatccttcctgggaatctttggcctt

SEQ ID NO: 6803673 - DNA, 56 bp, Homo sapiens
tgctcgcgtctgcagggctgagccctttgtctggctcgctttgcacgcggcgggca

SEQ ID NO: 6803674 - DNA, 127 bp, Homo sapiens
gttgatgtagggaaagtaaaagatgccactcttctaacctgaaagtagtaaaagctggaatggacattttagcactagtttgaggtggcaataaaagagaggaactgtgacagaatcctattagaac

SEQ ID NO: 6803675 - DNA, 56 bp, Homo sapiens
actatccgtgtctgttgacagttacagtaatgatacgtcaacattttatgaatagt

SEQ ID NO: 6803676 - DNA, 65 bp, Homo sapiens
atgcagcttcaggtcctttataacatgaggtaacaatttcagtgtcttgggcttgaatgctgcat

SEQ ID NO: 6803677 - DNA, 95 bp, Homo sapiens
ttttgagcatgtgaggggatggcgtggagaaggttgggttcatcatgtggtttcttggcactatttttctccagtttctcccttcagtgtcaaag

SEQ ID NO: 6803678 - DNA, 62 bp, Homo sapiens
ggctggcatcactggcttcggtgtattattatcttggtgcctggttctaatgaatgccattc

SEQ ID NO: 6803679 - DNA, 60 bp, Homo sapiens
tatttattctttgtactgccttgtatgaaaaccgtctaagaaggcttgcaaagataagta

SEQ ID NO: 6803680 - DNA, 80 bp, Homo sapiens
tgaaacagtgggctcctgaaattccattatctgcagagactgcccagcagttaggagaagagtcagggcctaatgtctca

SEQ ID NO: 6803681 - DNA, 89 bp, Homo sapiens
atggcaggcagccagctgttctttaatttaaccctttgtctttgcagggacaaaacacattagtttaaaaagaagctgctgctagctat

SEQ ID NO: 6803682 - DNA, 57 bp, Homo sapiens
tcctaggctaaagctccggctctgggtggaccagagacaaggagctggagtccaggg

SEQ ID NO: 6803683 - DNA, 95 bp, Homo sapiens
gcgccgctgtaagtaccttcccgcttcttccgaatcgcgaagagacggtactgatcgcggggaagtggtgggctaaggggccaagccagcggagt

SEQ ID NO: 6803684 - DNA, 58 bp, Homo sapiens
gcctcagtgtcctcctccatgtgacggtcatgtccctgtgggtggatggcagtgaggc

SEQ ID NO: 6803685 - DNA, 78 bp, Homo sapiens
gaaagaactgaagtattactctgaatgtatttgctcacattctagagtggtaaactcagagaatacttcttatctttc

SEQ ID NO: 6803686 - DNA, 98 bp, Homo sapiens
ctgtagtaactctgaatcagttatcattgctgtaaatttataagatattccgtgatgtttagtagcaaaggtagccttatgcttcatttgtactatgg

SEQ ID NO: 6803687 - DNA, 71 bp, Homo sapiens
tttcttcctcaggttgcatgtggagaaaatcgggatgaatttcccctatttcactgcaatgctaggagaaa

SEQ ID NO: 6803688 - DNA, 59 bp, Homo sapiens
cagagctggagggaaccctggctgtccccacggtcactgcatcccatctccagccactg

SEQ ID NO: 6803689 - DNA, 79 bp, Homo sapiens
ttctcctagaattgcattctatgaatataatattttgttgagtagttagtcaaattaaatgcagttttcaaaaggggaa

SEQ ID NO: 6803690 - DNA, 75 bp, Homo sapiens
ggcgtctccaaagcagggtttttccaccgcagcatggttgatattttggggtggataattctgtgtggaggggcc

SEQ ID NO: 6803691 - DNA, 76 bp, Homo sapiens
ggaatctgggtgtggaatatataggaactttctgtactattgatatggtttggctctgtgtcctcacccaaatttc

SEQ ID NO: 6803692 - DNA, 86 bp, Homo sapiens
cccttaaaaatgcttctgagttctttggggcagaagtgcaagaagaatgctttctgtaattaaaagggcaggggcatttgtgaggg

SEQ ID NO: 6803693 - DNA, 55 bp, Homo sapiens
ttttgccacacagagtagcatgttctaccctgggaagtgtttactgtgtgcagaa

SEQ ID NO: 6803694 - DNA, 64 bp, Homo sapiens
ggaaatggcctaattgcatttgcgcaggaacaccaaatccctcgcagctgcacggggctgagcc

SEQ ID NO: 6803695 - DNA, 67 bp, Homo sapiens
ccttccctcttgttgctgtgagatacctccattggctttcagaatgatttcagcgagcaggggctgg

SEQ ID NO: 6803696 - DNA, 79 bp, Homo sapiens
cacaaagactcctgtttattacactggatagcagagacactcttctgctgtctttgaaaaagtaaactgtcatgttgtg

SEQ ID NO: 6803697 - DNA, 82 bp, Homo sapiens
gaggagggtggaaggcctggaaggaggctgaagaaggagcctcattttctggatgcttccatctatgtcttcatcattcctc

SEQ ID NO: 6803698 - DNA, 55 bp, Homo sapiens
atgaccgcagccgtaacagcctgcattcagcaaatgctggccatgtgctgggcat

SEQ ID NO: 6803699 - DNA, 57 bp, Homo sapiens
ctatgtgctgggcattgtgttgtagggaggcactttgcattaagtgtctgcatatgg

SEQ ID NO: 6803700 - DNA, 91 bp, Homo sapiens
gagttgctcatggtgagtgaggataggagcccagactgggtcagacagaagtgtcttcaaaccctggctcttcctctagccttgggaactt

SEQ ID NO: 6803701 - DNA, 55 bp, Homo sapiens
gagccaagcaccacattaagttctgggaatgcagagatggatggggcatggtctc

SEQ ID NO: 6803702 - DNA, 57 bp, Homo sapiens
gacaggtgtctcagctgctggcagggcagaggcactgctgtggttgtggcacaggtc

SEQ ID NO: 6803703 - DNA, 63 bp, Homo sapiens
tctccttgggacatgagaaatattgaccaaattatgagatactattaacagtcaccaaggaga

SEQ ID NO: 6803704 - DNA, 64 bp, Homo sapiens
gctcagtttttagtttgtgagaaccctaaagaacagagtgatacacacactctaagaactgggt

SEQ ID NO: 6803705 - DNA, 84 bp, Homo sapiens
gtttttgtgatgccatgttaatgcaaagcagagggcaagcagctgccaaattgccctcccttcattccactgcaagacagagac

SEQ ID NO: 6803706 - DNA, 62 bp, Homo sapiens
ccaaccagtaaaacacataaatttgaacaattcctcagagtttgttgaatttacttggttgg

SEQ ID NO: 6803707 - DNA, 61 bp, Homo sapiens
gcccagactgagtgtgcttggtgtttctccattaaacagatgaggcccatcagtctgaggc

SEQ ID NO: 6803708 - DNA, 71 bp, Homo sapiens
gaatgcttgggcttgcttccacccagggcctgcccaccactggcgactgtcattggcagcctcaggcgttt

SEQ ID NO: 6803709 - DNA, 64 bp, Homo sapiens
tcctttccacctgaacctcagtggctgactttaccccaggccctgaaggcagaggtggagctga

SEQ ID NO: 6803710 - DNA, 81 bp, Homo sapiens
ggggcttggaggcccaatgcttccctccttctagccaggctgggctgcagggaggggcagcagtgggtcaggaaaggcccc

SEQ ID NO: 6803711 - DNA, 85 bp, Homo sapiens
gtgtcttctactcaagatagggaaagtacaactcccctggttattatcaggaccaattgattttgcctgatctgagagaaaacat

SEQ ID NO: 6803712 - DNA, 56 bp, Homo sapiens
tagggtcagcccattctcaaacctggtttgaaggcaagggagttgttctgatccta

SEQ ID NO: 6803713 - DNA, 64 bp, Homo sapiens
ggtggatctcagagagctgtgttttcctccaatcttggaaggaaggcaccctctgaatgtcact

SEQ ID NO: 6803714 - DNA, 82 bp, Homo sapiens
tgagctcaaggctgtgtgccccagatgagtagcttgagtgcactgaatctgcttcctaatggggaacaagccacttgactta

SEQ ID NO: 6803715 - DNA, 69 bp, Homo sapiens
gcccctttaggctctctagaaactgtgccttcctttctaggaaggagaacacagtagaaagacctgggt

SEQ ID NO: 6803716 - DNA, 85 bp, Homo sapiens
ccactctgagtagacccgctggctgccttactttgtggagtctgaggccagttttatagagaaaggggccagccactctgagtgg

SEQ ID NO: 6803717 - DNA, 60 bp, Homo sapiens
gagatgagagtccaactggggcttatttttaaaaagtcctgcctgttctaactccatttc

SEQ ID NO: 6803718 - DNA, 128 bp, Homo sapiens
cctgacaatagctggcttttcttccagctccgggagcatcttttctggcaggtggaaatgtaatatcacgtggtcagaaggaagggctcctacttggatggtgagactaggatctagtaattgccagg

SEQ ID NO: 6803719 - DNA, 70 bp, Homo sapiens
gtggtccctggaatcctcattacatcagggtcacaaactgattcttgtctttgaggtattgtattgccac

SEQ ID NO: 6803720 - DNA, 55 bp, Homo sapiens
gtgattttctcctcctagaagttcttaaatgacgcgaaaaggtggagaagttcac

SEQ ID NO: 6803721 - DNA, 56 bp, Homo sapiens
ggcttctgccttgccagttctttattccagaataaagaactggaaaggcaaaagcc

SEQ ID NO: 6803722 - DNA, 59 bp, Homo sapiens
gttcagtttgagattaccatggtgggagtagttacatcatggaaattggcaaatactac

SEQ ID NO: 6803723 - DNA, 60 bp, Homo sapiens
cctcgctcagggccacccttgtctggggctccccatgccctggggctacctctgagcagg

SEQ ID NO: 6803724 - DNA, 60 bp, Homo sapiens
gctctcagcctagacaaggccttcctaggaggcctaggagccctgcgggaggcagagtgc

SEQ ID NO: 6803725 - DNA, 104 bp, Homo sapiens
agcaaagtggggacacgtagcttccccttgcagttataagtaaatgtgaattctgttctgtgacttcaaggttcagcaccttctgtcctcaaaacttctttgct

SEQ ID NO: 6803726 - DNA, 58 bp, Homo sapiens
ctttggctgctagatggtgttagaccaaagaactggtttcacgttgtctcagttaagg

SEQ ID NO: 6803727 - DNA, 64 bp, Homo sapiens
gtagcagagctgggactagattagaatgttggtcttctcaatcgtggctctatgctctttctac

SEQ ID NO: 6803728 - DNA, 63 bp, Homo sapiens
agaagtcaattagctaaaatttggtaatcatgtttttgatatcatgtgcgcttattgattttt

SEQ ID NO: 6803729 - DNA, 73 bp, Homo sapiens
caggacaaacctcttcctagtcacttggaaagaagaactttccgagttgaagtaggatagcggttagtgcctg

SEQ ID NO: 6803730 - DNA, 62 bp, Homo sapiens
caaaggctgccactgtggctgtgcattttatgcattgcacagagacatttgggctgcttttg

SEQ ID NO: 6803731 - DNA, 83 bp, Homo sapiens
acatagaaggtctaaaatgatatttattgaatagatgagtggaagcagtgcactgttctccaaatgtctggactctttcatgt

SEQ ID NO: 6803732 - DNA, 62 bp, Homo sapiens
tgtacagtaggaacttgttattcatttgtttctccaaatatttattgagtacctactgtata

SEQ ID NO: 6803733 - DNA, 94 bp, Homo sapiens
tgagtgaaaattaggctgttatgtgggtggctgttaagggtgcttcatttccacatcggagagctgcccacacagcagattttagtagcactta

SEQ ID NO: 6803734 - DNA, 83 bp, Homo sapiens
aatgtttaacagctcatcagaggcagggtaacttgaacttcatttggtaatgcttttgctctaccctgatcagttaaaacatt

SEQ ID NO: 6803735 - DNA, 66 bp, Homo sapiens
gcctgacttaatgcttcattaccttactcacctcaacacaggatgtaatgttgagcattgagcagc

SEQ ID NO: 6803736 - DNA, 55 bp, Homo sapiens
gtggagtgcctcggggttgcagggtcaggcaatccagctgcccagagcatttcat

SEQ ID NO: 6803737 - DNA, 61 bp, Homo sapiens
ggcccttcctcttgtgctggcaccatgttctccaggcgtgtcagggcctgaggactgggcc

SEQ ID NO: 6803738 - DNA, 70 bp, Homo sapiens
ttgcaggtcaacaagctgaccggctgctgccctttggtgggacacttagcctcagtttgctcacctgtaa

SEQ ID NO: 6803739 - DNA, 114 bp, Homo sapiens
gctaccagatgagactgaaaaagacacagaagtttattattcaacttcatgtttggaaagcaaaagcaaggggcagtgaaagtgtgcaactggtcaagggtctaactttggagc

SEQ ID NO: 6803740 - DNA, 84 bp, Homo sapiens
ctctgttctgtcttgtaagcatggtgatttcagggtagctgggtttagggatcccaagttgcttgttccaagacaaagaaagag

SEQ ID NO: 6803741 - DNA, 61 bp, Homo sapiens
gtggttggattccagagaggttctggaggtgctggcaccaccaaaactttctggggactgc

SEQ ID NO: 6803742 - DNA, 66 bp, Homo sapiens
gtaacatagcaatggcaacaactaagcgaagaggacttgccctagtggacattgttatggagttac

SEQ ID NO: 6803743 - DNA, 60 bp, Homo sapiens
tctacagactcctatgtaacacattaaccaaacaaggacctgaaaacatagagtctgaga

SEQ ID NO: 6803744 - DNA, 58 bp, Homo sapiens
atcagaggtactttccatttttcatctgccacacagtgcaaaggtagtaacctctgat

SEQ ID NO: 6803745 - DNA, 58 bp, Homo sapiens
ctctgagtagatagggaacctgcagccgggctgctcaagggcctctgtgtactggggg

SEQ ID NO: 6803746 - DNA, 71 bp, Homo sapiens
gggtctggcatcccagctctgcctgctgaaggctgagagcatcagtggtatgcgtgggagctgccttcccc

SEQ ID NO: 6803747 - DNA, 58 bp, Homo sapiens
agctggccaggaagagtctcagactgtggtgtaggtctgagaaggtttcagccagact

SEQ ID NO: 6803748 - DNA, 121 bp, Homo sapiens
ccctctggtggtgtttagttttagttccgtaagagaaatgattcctagtttgctaaattggtggcatctttgggaggggtttctgtttatggttagagtctcttacacccttgttggaggg

SEQ ID NO: 6803749 - DNA, 72 bp, Homo sapiens
ttatgttccttacgcctcttgcctgggcttcaaagggaagaagtacaggaggcaagggtgtaaaggaaatga

SEQ ID NO: 6803750 - DNA, 67 bp, Homo sapiens
agagatgtctagtgaatgacacttaagaagatgatctcattttatatgtatcaatcacggcatcttt

SEQ ID NO: 6803751 - DNA, 68 bp, Homo sapiens
agctggctctgttcgccatcaggagttcacacccacagagattctttgatgagaaacagggtaatgct

SEQ ID NO: 6803752 - DNA, 76 bp, Homo sapiens
ttactggaagtatctgcttgttttttataactaatttgagaatgttacttggaatgtagcaaatgcttaagagtaa

SEQ ID NO: 6803753 - DNA, 64 bp, Homo sapiens
agtctttgaaatctggtgtgtgttttatacctacagcacacagactaaccatatttcaggcact

SEQ ID NO: 6803754 - DNA, 58 bp, Homo sapiens
tggaaactgtggtatttctttatctcttcagaatgacataaggatacctgagttttca

SEQ ID NO: 6803755 - DNA, 68 bp, Homo sapiens
ggaatccaaggatgtgactcagtcagctacagtaatgtggccagtactgcacgttcccaatgggttcc

SEQ ID NO: 6803756 - DNA, 64 bp, Homo sapiens
caggaggtgacttccaggggttgttagcatctctaaagctctacccttgggggtcacgcttttg

SEQ ID NO: 6803757 - DNA, 67 bp, Homo sapiens
ctttggacacaggcagtctggccagtttccacttccttaaccactctgctagactgctttctcagag

SEQ ID NO: 6803758 - DNA, 75 bp, Homo sapiens
ggccacatgccctgcccatggctgaggcagaagctttgtcagaagtgtctgcctggcctggagggcacaggggcc

SEQ ID NO: 6803759 - DNA, 74 bp, Homo sapiens
tttgcgcgaccctccaggcggttcccgagcagctcaccgaacaggctctgcagggccgctggaggtcatggaaa

SEQ ID NO: 6803760 - DNA, 76 bp, Homo sapiens
ttctgcctgcatgcccgcccccttctagtactggaagtaaacatcttacttgatagggggatggggttagggagaa

SEQ ID NO: 6803761 - DNA, 55 bp, Homo sapiens
gagaggccagcagtgcctatctgtcttgagagtcaggagaacctgtggctctttc

SEQ ID NO: 6803762 - DNA, 67 bp, Homo sapiens
gagccacctgccctggccactgtgcccaggtcatccttcattgcttggtgagcacacccagggtctc

SEQ ID NO: 6803763 - DNA, 71 bp, Homo sapiens
cccagctactagcacggctgtgagcttggtctctgcagagcacccagcccagggcgtgatgtttagcaggg

SEQ ID NO: 6803764 - DNA, 71 bp, Homo sapiens
tgaagcagaaacaatctgatttagggggcagtcagataagagactgttaaagtaattaattgtctatttca

SEQ ID NO: 6803765 - DNA, 114 bp, Homo sapiens
atccccttcttggtagccattactttgattgtgctttgtcttcaggatcataccagtaaagctgtgtttcatctcctatcacaatccttcaaagaaaagctttaagaccttgat

SEQ ID NO: 6803766 - DNA, 102 bp, Homo sapiens
agatcacaatgtattcagtttggcaggagagcagggcacttgtgggaaggagtcagaggtgtccttgcagtttgaagaaagaagtttgagaaattgtgatct

SEQ ID NO: 6803767 - DNA, 58 bp, Homo sapiens
gtgatagccacctgaattctgaacaatatttataacagttagggttagggggcattgc

SEQ ID NO: 6803768 - DNA, 106 bp, Homo sapiens
ctggatcatgaaaacaaagggtgagtatagttcagatgcatttgaaggcataggcagaaaatgcatcatgctttattgcttctgggcacgcttcccttctttccag

SEQ ID NO: 6803769 - DNA, 71 bp, Homo sapiens
tcttccctttttctgccattcaaagaggatctgtgtccctcagatctttgcagtggtgaataaagagaaga

SEQ ID NO: 6803770 - DNA, 122 bp, Homo sapiens
gcctgccctatgctcagaatgccagtgtgaaggggcatcattctggctctttccatggtctcaagcagaccctttaggtggagaagggtgagaagaaccctccagataggtcatggggtggc

SEQ ID NO: 6803771 - DNA, 83 bp, Homo sapiens
aggcccattttaaatggatctttttataatgcagatacctctcatctatctgttttgtaatgatggatttgttttgggggctt

SEQ ID NO: 6803772 - DNA, 91 bp, Homo sapiens
ttgtcaagagtctcaacagtgccagctacctctatgaggtcatggagcggccccgccatgggaggttggcttggcatgggacacaggacaa

SEQ ID NO: 6803773 - DNA, 74 bp, Homo sapiens
tctgattctataggattgtatacctttgattgcctttgattaactaggctgtcttacagttctgtagaagtaga

SEQ ID NO: 6803774 - DNA, 100 bp, Homo sapiens
tcatgagggtcaaataccttgagataacagagttgggaagtgaaaccagattggttttactccagaattcctattctgtgacgttcaaataactccgtga

SEQ ID NO: 6803775 - DNA, 64 bp, Homo sapiens
acagggaattgaagtgatgcaggaaatactggaaatctgcctgcctgctgctacttctctctgt

SEQ ID NO: 6803776 - DNA, 57 bp, Homo sapiens
tggccagctttgactgtaaaccttcttcttcctctggttcaacctgcaggttggcca

SEQ ID NO: 6803777 - DNA, 57 bp, Homo sapiens
ccattgagaactgtgaactgtgatgaagaaagcattcatccgtttatatctctgtgg

SEQ ID NO: 6803778 - DNA, 60 bp, Homo sapiens
gttcaagtttctgagctttaatttgaaagaatgacaaaataaggatttggaagcctgaat

SEQ ID NO: 6803779 - DNA, 77 bp, Homo sapiens
gctggatataggcagtgctctgtgcttcagtgtgcaagcgtgtacatgggtgtactgggtagcctgtggagtgcagc

SEQ ID NO: 6803780 - DNA, 57 bp, Homo sapiens
cactggatttccaggaatactcactatcctatgatatgctgtctctgaattccagtg

SEQ ID NO: 6803781 - DNA, 67 bp, Homo sapiens
gggtccttcccttccttagcctcgaagcgggaataaccactagacagaaggctgtgagggaggactc

SEQ ID NO: 6803782 - DNA, 57 bp, Homo sapiens
gatttccaggtcattaataaagttgtttaataagatcttttgtgcagcctgggaatt

SEQ ID NO: 6803783 - DNA, 126 bp, Homo sapiens
cgagagctgattaggcaccgcggagctgctgagctgcggcaggcacctggaacttaatcaggtccccaggggccggcgcagttagggcagctccacttaggaattggtgctaattggcgccccttg

SEQ ID NO: 6803784 - DNA, 64 bp, Homo sapiens
ctgggcttctcagagaggctttagggtaggtaattattttaaggtcttggctgattgagtcaag

SEQ ID NO: 6803785 - DNA, 85 bp, Homo sapiens
ggctttgtcttctctatatgtgtttttctgcagacaagccattgagtttagaagggaatgcatcacatataacctagacaaggcc

SEQ ID NO: 6803786 - DNA, 106 bp, Homo sapiens
aggtaagatcgccacatggtccctggtgcaaacttctgataaagagcatgtgcttaaggaacatgccaacgttacgaaggcacctgggcctgcagcctaattacct

SEQ ID NO: 6803787 - DNA, 86 bp, Homo sapiens
aggtacacagtaactgttttatattgcaagtgtttgcaatccgctaatgtaatacagcaatgcctgaaatagtaactctcaagcct

SEQ ID NO: 6803788 - DNA, 62 bp, Homo sapiens
gatcctgtctgtggagtcagcacagacagaaactgttccctggctccgaagactccaggatc

SEQ ID NO: 6803789 - DNA, 114 bp, Homo sapiens
aagagtggagaggctccatttggtttgaatttgaaccattatttggagtattcaaccaactgagtacttcaaacaatggtacaaactgaaaccaaatggagcctctcaactctt

SEQ ID NO: 6803790 - DNA, 77 bp, Homo sapiens
ctggaacacagggcaatgcattgtaactcactgatgtatccagatacataaactatgtaatttgctctatgtatcag

SEQ ID NO: 6803791 - DNA, 62 bp, Homo sapiens
tgtgagacaattcctcagtagacttcgtggttctaaaatacgttgttttgaattgtcttaca

SEQ ID NO: 6803792 - DNA, 78 bp, Homo sapiens
tcttgttagcgtctcaatggaagtgagcattccggtttgatacaaatggagtcacttccatatgggaacgtgacatga

SEQ ID NO: 6803793 - DNA, 63 bp, Homo sapiens
aggcacttctcaaattcatgcctagacattcaaagagtatggcaggaaggagagaggcagcct

SEQ ID NO: 6803794 - DNA, 57 bp, Homo sapiens
gttgtgagccactgggcaggatggcagccccacaccccaacctgcctgagccatagc

SEQ ID NO: 6803795 - DNA, 113 bp, Homo sapiens
gggttaaaagtcgttttagaagcagaatgcatgtgaagcaaagaatgttataggtaaatgggattttagagatcatgttcatttaatgctttctactactaatcttttgttcc

SEQ ID NO: 6803796 - DNA, 78 bp, Homo sapiens
accctaaaattataccaaaaaattaatgtgattaggatgataattcacagtcacatagtgttttggaatctttgtggt

SEQ ID NO: 6803797 - DNA, 56 bp, Homo sapiens
tgaccgttttggcacccatgctgcgggcgatgtccgctgtggggccaggggggtca

SEQ ID NO: 6803798 - DNA, 68 bp, Homo sapiens
agctttgtggctttgcaagacttacctgatctatcatgtctactgaaggacttagaagcctcaaggtt

SEQ ID NO: 6803799 - DNA, 105 bp, Homo sapiens
gaagtgaccaaactgtgttgccagggcacagtgttccagagcagtggttcccaaatttgcatgagaagcacctggagggcttgttaaaatacagattgcagcttc

SEQ ID NO: 6803800 - DNA, 65 bp, Homo sapiens
aggaggggcaggcttggaaataacctggggggtctgttcccagtgaggtcctggctgtctcccct

SEQ ID NO: 6803801 - DNA, 55 bp, Homo sapiens
ccatacccccaacacccctttcaccagaaccctctgtgcagcacttgggggtagg

SEQ ID NO: 6803802 - DNA, 125 bp, Homo sapiens
ttagaatgccttttaaagtaatgtactccagtgttatcataagtaattgaaataagcctacacatagtttactcaattattttgatgttcattgagatgagttttgtttccagtaaatattctga

SEQ ID NO: 6803803 - DNA, 80 bp, Homo sapiens
tagagctagattctttgctagatcattgggaggtcaggaggacccagcagtggtatgggaggggatttgggataattcta

SEQ ID NO: 6803804 - DNA, 64 bp, Homo sapiens
ccctagagagatcagatggggacactagatacagataccccatgtcctctgctcagctctaggg

SEQ ID NO: 6803805 - DNA, 79 bp, Homo sapiens
atgtattaggtttgaatagtgttatgattctgtctgaagtgaaaaaattagaatcagtcattagctctgacctcagcat

SEQ ID NO: 6803806 - DNA, 86 bp, Homo sapiens
taatgcaattatttagtagttcaggattcttttaattctgtttgaagaacttaagaggttaagggcttgaaatgataaatgcatta

SEQ ID NO: 6803807 - DNA, 95 bp, Homo sapiens
tctgcaatcagatttctcagcctggtacattatgaacagcttagtgctgttgagtaatttatatcaggatgattaggaaagcttttctctgcaga

SEQ ID NO: 6803808 - DNA, 84 bp, Homo sapiens
cctcctcctgtggccacatcttcactggtttctggaatccaacctggggccttcctgaagccaagtgagaaactcaggacaagg

SEQ ID NO: 6803809 - DNA, 74 bp, Homo sapiens
ttgattatagaatcttggctttgatgggacaacttgggaaggggtccaaggaagtgaaggttactctagattgg

SEQ ID NO: 6803810 - DNA, 89 bp, Homo sapiens
gaggctgcgtggctttctgagctgctttggggatgaatgagatggccagagctgagcatccttcgtccacagaggggcttgtagttctc

SEQ ID NO: 6803811 - DNA, 68 bp, Homo sapiens
tgctaaatgcattttattatatgtgacttgtttgaaaaactgtcactttctgtgagatgtagttagta

SEQ ID NO: 6803812 - DNA, 71 bp, Homo sapiens
ggaagccccaaaccctcgccatcgagagacccccatggcccggggtgatggctgtggggcttggtgctccc

SEQ ID NO: 6803813 - DNA, 59 bp, Homo sapiens
gctagagagcatgtggtctagttttagtccctccactaacctagtgatatgcctcaggc

SEQ ID NO: 6803814 - DNA, 69 bp, Homo sapiens
ggagcttgcaggccagggtggacagaggggctgtgaatggcacaggctcagcttatctgggcaggctcc

SEQ ID NO: 6803815 - DNA, 75 bp, Homo sapiens
gcaactcccatgctctctctgagaagcatccatggcctcagccaggctatttcagcagaagccggagacacttgc

SEQ ID NO: 6803816 - DNA, 66 bp, Homo sapiens
tgtttgtttgtttggaatatgtggcctgtgtggaactggacactgaagtcactaagcaggcaggca

SEQ ID NO: 6803817 - DNA, 74 bp, Homo sapiens
gaggccttggatttctcagtttgtgtgatattgtcttactttgttaagatcactgaattgaaagtaatggtgtt

SEQ ID NO: 6803818 - DNA, 64 bp, Homo sapiens
atggaccagagttgactacaaaccacagatttcacctgtgacatttgttaattttgaagttcat

SEQ ID NO: 6803819 - DNA, 79 bp, Homo sapiens
ctaccacaatacagatgttaaagcaatttccaaggatttggcacattgcttgcccattgtaagtacatatttgtggtag

SEQ ID NO: 6803820 - DNA, 61 bp, Homo sapiens
cggaagagcgctcccggccccagacttcccattggataattggcagcaagaggctcttctg

SEQ ID NO: 6803821 - DNA, 68 bp, Homo sapiens
gctttctggctctctgatttcacattccgaagaccaggagtgaaaaaggaagggccataatttaaggc

SEQ ID NO: 6803822 - DNA, 55 bp, Homo sapiens
gggaatggaattctaagttagatttcagtctatttggagcctatccatagatccc

SEQ ID NO: 6803823 - DNA, 71 bp, Homo sapiens
ggacatcaaactctgtgtctgatttctggctatgttggttatgtgacagcaggagatcatgatagatgttt

SEQ ID NO: 6803824 - DNA, 59 bp, Homo sapiens
cttcagctgttagacgtggaaacagatacacattccgctgtcctccaaaacaggtgaag

SEQ ID NO: 6803825 - DNA, 91 bp, Homo sapiens
caggcaccatgccaccacgctgggctaatttgtgtattttttattagagacggggtttcacaatattggccgggctggtctcgaactcctg

SEQ ID NO: 6803826 - DNA, 86 bp, Homo sapiens
cctttattattgctacagctgatcattttgaagaatgtgactcacaccttcaagtatgtgggctgaaaatttatagcatagagagg

SEQ ID NO: 6803827 - DNA, 94 bp, Homo sapiens
ttccataagagctatttcataacagcttccttttactcccataaagtcacccagtgactaaaggttagttcttagaagtgcacttcacatggaa

SEQ ID NO: 6803828 - DNA, 72 bp, Homo sapiens
ccggtgacctgggagagaggagccggcggaacatgtgtcttggtctctcgcctcctgtcttccagtctccgg

SEQ ID NO: 6803829 - DNA, 63 bp, Homo sapiens
tatctttatctttttattctcctaataaccacctgtgagtgggagaatcaggaaggattgatg

SEQ ID NO: 6803830 - DNA, 71 bp, Homo sapiens
cagactcctctctgtcacaccagtggcccctagcattttaaagggggccatggggacagagggtgaatctg

SEQ ID NO: 6803831 - DNA, 85 bp, Homo sapiens
gggtgagataacaagtggaatattgagtccctctaagcacagggtgcagggttttccttagaatttcatttgaaaagatcttccc

SEQ ID NO: 6803832 - DNA, 130 bp, Homo sapiens
ccttagccagtgagtcagtagctttttgttgggctgtgatggaggcagcagtttcatcagcaatatttcctgataggccagatatgctcgcagtcatcccaagtaaaagcaaacaaatactgactctagg

SEQ ID NO: 6803833 - DNA, 63 bp, Homo sapiens
caaatcctgcagggcttagatggcagtggcctggtgcaaaggaaaatttaagcccccaggttg

SEQ ID NO: 6803834 - DNA, 59 bp, Homo sapiens
gatgcttctttaattcagatttgaagggatgagtttccttgttctggattaaacagctc

SEQ ID NO: 6803835 - DNA, 59 bp, Homo sapiens
ggctctggtgtgaagcagcctccatgaggtcacacaggtagctgcggcatcccagggcc

SEQ ID NO: 6803836 - DNA, 56 bp, Homo sapiens
ttgctttctctctaccccactttgtagatattctttaaaaggagagagaaaagtaa

SEQ ID NO: 6803837 - DNA, 115 bp, Homo sapiens
atgggtgccagcagtacatgtgccaggtgaggcagttcttacttgtatttgtcataaactgatacctgccaagctgcactcaggcccttggggctgtagctttgctggcatccat

SEQ ID NO: 6803838 - DNA, 57 bp, Homo sapiens
aactgtggacttgagactgatgaaatccgagttttatttctgtctctgccactagtt

SEQ ID NO: 6803839 - DNA, 85 bp, Homo sapiens
tcctttgacaacaataatgtggagctgaacactcatgactgcattagtgacttttaattaactccaccttaagtgtgtctgagga

SEQ ID NO: 6803840 - DNA, 55 bp, Homo sapiens
aggccacagatactgtgaagtaactttgagtaactttgtgtgtgtgtgtgtgtct

SEQ ID NO: 6803841 - DNA, 129 bp, Homo sapiens
gggtgcagcccggggggtgtccgggctgagcgggctcacccggttgttgtggcgcgcctgctccagagtggcggtgaagaggaagcagcggcaggggacgcccgcggctcgggcacactggacgtacct

SEQ ID NO: 6803842 - DNA, 80 bp, Homo sapiens
tttatctctgcatagaagtgatctcagtctctaagaaaaggaaggatattagttagtctatgcctgaccagggaggtaga

SEQ ID NO: 6803843 - DNA, 85 bp, Homo sapiens
aatccatgtgaagtgtgttcttgagtcactcctgagtttgcagtctgaaccagaagtcaccctcagaataactccttcatggatt

SEQ ID NO: 6803844 - DNA, 57 bp, Homo sapiens
acacttatcagttgtctctaatgtggagagactacatggagaggtcattgtaggtgt

SEQ ID NO: 6803845 - DNA, 66 bp, Homo sapiens
ggctagcactgatcacactgtgttctgattattagtttaaataacaggctcatcagatgctgagct

SEQ ID NO: 6803846 - DNA, 70 bp, Homo sapiens
caggcaggctgctttttgttcaaggtaaacaaaaatattaaaattgtttaacatcgagctagtctgcctg

SEQ ID NO: 6803847 - DNA, 84 bp, Homo sapiens
cagaaaataaagctgattgtcaccattagtgttaccaatgtatatgacacagcaggtaacacaggtgcagttttaaagtttctg

SEQ ID NO: 6803848 - DNA, 77 bp, Homo sapiens
ttgggagttgggattcttagtctgaatgggcttgttttcagaatctctcagaacagctctcagatatccactaacaa

SEQ ID NO: 6803849 - DNA, 63 bp, Homo sapiens
caaagccctggaatctctccatgggaaagtggatgtacaatctcagaggattcctgggccttg

SEQ ID NO: 6803850 - DNA, 60 bp, Homo sapiens
agatggggtttcactgtgttggtcaggccggtctcaaactcctgacctcgtgatccatct

SEQ ID NO: 6803851 - DNA, 63 bp, Homo sapiens
ccctggcagctgcccgagatgccctgtaaacactacggctagcagaaagcaggctgctcaggg

SEQ ID NO: 6803852 - DNA, 58 bp, Homo sapiens
ctgatcaatggtgtaacttgtcctgtgtcacataggcaagtttggacccttgagtcag

SEQ ID NO: 6803853 - DNA, 96 bp, Homo sapiens
gtggagataagttgggcagtgatgagctcaggtgtgcaaaataaaacttactttatttctacattactgaggtcaactcagctcataagatcccat

SEQ ID NO: 6803854 - DNA, 82 bp, Homo sapiens
ggcaactgctgttctactttctgtgtctttgaaattgactaatttagatacctcatgtaagtggaatcagacagtatttgcc

SEQ ID NO: 6803855 - DNA, 89 bp, Homo sapiens
gagccggtctctttacatctcaaataccaggtatttaggtggctttcttggaacctggcattagggacacgtgtgaacgggccaggctc

SEQ ID NO: 6803856 - DNA, 57 bp, Homo sapiens
catttactactaggtgcagtaataatccaggtgactgcatgtccactggtgtaaatg

SEQ ID NO: 6803857 - DNA, 62 bp, Homo sapiens
cctactctcacccagcccccttcttggttccctaggggaggaaggcttgggtgagtattagg

SEQ ID NO: 6803858 - DNA, 60 bp, Homo sapiens
gggctacagaaaatcagccacaggccgcatttggccattgggctgtagttttttgacccc

SEQ ID NO: 6803859 - DNA, 68 bp, Homo sapiens
ggctccactgggctgggcttccctttggaatgagctctgctaagaggcctcagctcagtgtgacagcc

SEQ ID NO: 6803860 - DNA, 88 bp, Homo sapiens
gattccctggcagttctcattagttcagcattcccgaagtgtcccctgtttggaggcagaggggaagctgaggaattgaaggagaatc

SEQ ID NO: 6803861 - DNA, 74 bp, Homo sapiens
tggagctgtgagaatcctccactgtgaggtggattcactgtccacaggaaggccttctcacaatgcaatttcca

SEQ ID NO: 6803862 - DNA, 86 bp, Homo sapiens
ttaaattactaaaagctctgagaagcactgcaacagagaaatctaatagttttttgtgtattccagggctttttaagtttatttga

SEQ ID NO: 6803863 - DNA, 56 bp, Homo sapiens
agggctaccaccaagctgcacattccgtcactatggtcagttaggtttatagcctt

SEQ ID NO: 6803864 - DNA, 84 bp, Homo sapiens
aataagaaagcaatgcttgtggaatgtacagtgcatattggcagcacatgcctcattacgattcaccagcttgcttctcctgtt

SEQ ID NO: 6803865 - DNA, 68 bp, Homo sapiens
aagcaggtcctggcatcaggcaggtctggtctttaaatattctggatctgggtgaccttgggcaactt

SEQ ID NO: 6803866 - DNA, 127 bp, Homo sapiens
ttttctgtgcatgcccccacacacatttatgataggagcttgagcctccttattctccatccttgctctttctctcttccttttcctccctcatctcacatgtgtgtgccaaggatgtgccagaaag

SEQ ID NO: 6803867 - DNA, 65 bp, Homo sapiens
gcagcgcagacatgttcctttctgtcacctatttgtgtcaaaatgggctatgtctctagtgttgc

SEQ ID NO: 6803868 - DNA, 77 bp, Homo sapiens
ttgaatgcagatgctttcttaagtcagtaggtagtggtgggtgggccacctggtcaaggagagtctctgcaactcaa

SEQ ID NO: 6803869 - DNA, 80 bp, Homo sapiens
aacaggattgaattgagttctacataacctgctctattttagcctgtcaactgtgtataactcttaattcattagctgtt

SEQ ID NO: 6803870 - DNA, 105 bp, Homo sapiens
cggttgaggagcgctggttcgctgcagggctgggtcctgtctcattcagtatttggtgtcaagtgagggaggtatcagactctgaaggaatcctcctagtaattg

SEQ ID NO: 6803871 - DNA, 72 bp, Homo sapiens
ctccctgggcagatgtggctctccttgggcaggtgtggctctccttgggcaggtgtggctctccttgggcag

SEQ ID NO: 6803872 - DNA, 62 bp, Homo sapiens
gcatctgatgttctgtccgagtcacattccttgtgtgcctgacctctggagaacaatagtgc

SEQ ID NO: 6803873 - DNA, 78 bp, Homo sapiens
caattagagaaaggttttgcttccttcatgtggattagtccacactgcccactgagaagcacagcttgtctttagatg

SEQ ID NO: 6803874 - DNA, 92 bp, Homo sapiens
ataattaactaatgcatacacagtgtataaaatcttaaagatactaaagagtatctgatattaaaaacattggactgagcatggtggtttat

SEQ ID NO: 6803875 - DNA, 61 bp, Homo sapiens
tgaggtctgtcctgtctttggagtgagacataatattcctgcaaagaactaagcagcctta

SEQ ID NO: 6803876 - DNA, 61 bp, Homo sapiens
ctctttgaggcatggttatatcatctggaaaacagaggtcaataatatgtgctttattgag

SEQ ID NO: 6803877 - DNA, 60 bp, Homo sapiens
ttattgggcttctcagaatagaggggcattggtttcctctctggaattaaagcccaataa

SEQ ID NO: 6803878 - DNA, 111 bp, Homo sapiens
ctatgccactgaagggcattcatcacatcatgatgtttagtgctacttttcctaacgaaatacagatgcttgctcgtgactttttggatgaatatatctttttggctgtag

SEQ ID NO: 6803879 - DNA, 65 bp, Homo sapiens
ctggccctgggcatctttcgtgacctgctgataaaaacggtcaaggttaggcgccccaggcccag

SEQ ID NO: 6803880 - DNA, 60 bp, Homo sapiens
ggctgctcctgtccagcagggccaccccacaggcagtgtgctgagctgagaggagcggct

SEQ ID NO: 6803881 - DNA, 57 bp, Homo sapiens
ggcgagggaagtttactgtgagttgggcttgtctttctctaggtaaggttctcagcc

SEQ ID NO: 6803882 - DNA, 77 bp, Homo sapiens
gcataaaattcatgtactggcattctaatttgggggccatcaactctcaatatggcttgtagcatgaataatttagc

SEQ ID NO: 6803883 - DNA, 92 bp, Homo sapiens
cagagtgtgtattcctactacattaataaaacattcagtacccactgaaagtttgagaatagtggaggaatagaatagaatgttatagtctg

SEQ ID NO: 6803884 - DNA, 75 bp, Homo sapiens
atactttaacttccatctccttggttagaacttagtcacatggccaacctagctacaaggaagaatggaaagtgt

SEQ ID NO: 6803885 - DNA, 59 bp, Homo sapiens
ggacatcgctctgagtatactgtgcatatatggatcacgaggtagggcagggtgtgtct

SEQ ID NO: 6803886 - DNA, 78 bp, Homo sapiens
tctcttctttcctgatctttcctcctgtggtggtgaggtgacttctcaaatatttggagagaggaggtcagaagcaga

SEQ ID NO: 6803887 - DNA, 96 bp, Homo sapiens
gacctactgtgatctcagaagccctaaattatctttattttctatatgtgaacagaaaagccagcaggacttttagggaattcggaacacactgtc

SEQ ID NO: 6803888 - DNA, 83 bp, Homo sapiens
ctgtgcagccccaggagacgcccaggcaagagacgagtggtcgccacgccacactccctgggccactggtggctgtggaatag

SEQ ID NO: 6803889 - DNA, 57 bp, Homo sapiens
cactggaatatggcgttgaacctgtcttcttgctgtcatggcctttgtattctagtg

SEQ ID NO: 6803890 - DNA, 81 bp, Homo sapiens
agacttgacgaatgacccgggaaagtgattggttttcagtccgaccacagttcatgcactggggctccacttgtcaggtct

SEQ ID NO: 6803891 - DNA, 59 bp, Homo sapiens
cagaattgggagtgtcctgatatcccgatatcttgagaacagaagcattcctaattttg

SEQ ID NO: 6803892 - DNA, 69 bp, Homo sapiens
ccaggtctggtgagagcaggtgctactgagttctggccacagaaaaccagctgcctgctctggacctgg

SEQ ID NO: 6803893 - DNA, 125 bp, Homo sapiens
ctgtcacatgggctgtaattatatttaagacttctggtgacatgacagatggtgagaatgaagctctcatgttctgaacatgatgtcatctggaagctgcaaaatgcacgtatagctttggacag

SEQ ID NO: 6803894 - DNA, 57 bp, Homo sapiens
tccattgtgtatgtgtgtatactgcaataaaatccccagtgttgcgagcataatgga

SEQ ID NO: 6803895 - DNA, 57 bp, Homo sapiens
caatgaacccttcaagctctgatttgtcagaactcagagaaacagcagggtgtgttg

SEQ ID NO: 6803896 - DNA, 73 bp, Homo sapiens
ggcaaacagacttgaccatcttcagacccactgcattctcaagctgaagtggtctgctcatagtttgtgtgcc

SEQ ID NO: 6803897 - DNA, 61 bp, Homo sapiens
ctcttcagctctgaggctctggctcaaatgtgaccacatgttgtcacctttgactgttgag

SEQ ID NO: 6803898 - DNA, 77 bp, Homo sapiens
taggttggtgcaaaagtaattgcagttttgtcattacttttagtgacagaaaccacaattacttttgcaccaaccta

SEQ ID NO: 6803899 - DNA, 56 bp, Homo sapiens
cttagtaccatcaggtagcttgccctatggaaggagaagaaacttgaaagtacaag

SEQ ID NO: 6803900 - DNA, 69 bp, Homo sapiens
gccgaattggtgagggattgtctatcaaatggcactttctgggtggtggagacctcgctaacccccggc

SEQ ID NO: 6803901 - DNA, 79 bp, Homo sapiens
gtgtgggctgcggataggcctcggacctgtgtaggccttcctagctggccagtttctgtccgggtctcgctccccacac

SEQ ID NO: 6803902 - DNA, 58 bp, Homo sapiens
gtagtaattgttttaagccaccagcctgtagtcctgtggtggtttgcgcaattggtat

SEQ ID NO: 6803903 - DNA, 55 bp, Homo sapiens
tgtgttggctgtacatgtatctgttaccttttagtggcagagtgcagtctataca

SEQ ID NO: 6803904 - DNA, 108 bp, Homo sapiens
ggtggagcttaactctcatgaatgtattttgagggcctcatacctgattctggcctaaccttagagtcacatgaggcccttcattaaaacgtgatagatgcttccacc

SEQ ID NO: 6803905 - DNA, 67 bp, Homo sapiens
ctgtcagcctgactggctctttcctagctaggctagtcagctcggctgaggagtcaagggaggacag

SEQ ID NO: 6803906 - DNA, 123 bp, Homo sapiens
gccacccaagttcatagctgctatttgctggcagcacgacaggagtggaaggaaacagcgtagtgaccccacctttcttttgagctggtaggaagaaaacagaagatggacttggggttgggc

SEQ ID NO: 6803907 - DNA, 87 bp, Homo sapiens
catagtgcctgttttatttctggcattgttgcacgtacttgtattgctcttttaattgtcataacaacctgtaggacaggtactatg

SEQ ID NO: 6803908 - DNA, 58 bp, Homo sapiens
catctcggctaggctatggtgccctcttgtttggttaaacactagtctagatgggatg

SEQ ID NO: 6803909 - DNA, 86 bp, Homo sapiens
ccaccctccttctacccttcctgctctggcctgggctgtggtagctcccagactgcagagcgggcagagcacaagtaggtgggtgg

SEQ ID NO: 6803910 - DNA, 55 bp, Homo sapiens
agcctggaggtaatgaggaaactactttttccatgtatacgttaccttttaggct

SEQ ID NO: 6803911 - DNA, 76 bp, Homo sapiens
aagagcatgtggctggtggacgggcatgcctggctcctcacctggcagtctcctgccctctaaccggctgtctctt

SEQ ID NO: 6803912 - DNA, 67 bp, Homo sapiens
ggggacttataactcttcttttagggaagaagtgcagacatttgttctcataaagaatgaaggctcc

SEQ ID NO: 6803913 - DNA, 67 bp, Homo sapiens
cctctatccaaagaaggtcacattcatggtaccaggagtccatggatctggatctatcttttggggg

SEQ ID NO: 6803914 - DNA, 60 bp, Homo sapiens
ccagagtctgtgtgtgtcatcctcataatgatttgcttgaaatgaaacacagtggcctgg

SEQ ID NO: 6803915 - DNA, 62 bp, Homo sapiens
ctgcagtgatcagagagaagcagtggaatcaagcatgacttcagtagttttgatctgagcag

SEQ ID NO: 6803916 - DNA, 64 bp, Homo sapiens
ttctttgtgcatccaattttctccctgagaacgtgaacccaggggagtggaacgtacacaagaa

SEQ ID NO: 6803917 - DNA, 57 bp, Homo sapiens
ataaagctttgaaatggagataactcccaccatacctgtctcctattatagctttgt

SEQ ID NO: 6803918 - DNA, 101 bp, Homo sapiens
catggaggattggaatagcagacaacccagatgacccagccaacatgaaatagcccagggactggattttcttttgtttgtttggtttggttttatttgtg

SEQ ID NO: 6803919 - DNA, 82 bp, Homo sapiens
ggtaaattgtaaactagacagtgctgagccatatctaatttatactttaggtgtcctcatgattttctagaaaaaaattact

SEQ ID NO: 6803920 - DNA, 59 bp, Homo sapiens
aattgctttgaagaagggagcgccttgactcttgcgcaccggccattttcacagcagtt

SEQ ID NO: 6803921 - DNA, 76 bp, Homo sapiens
gcctgatgcttgctttcagtttacatcagaactttgagttatgaaaggagttgacagatggaagcaagggtagggc

SEQ ID NO: 6803922 - DNA, 97 bp, Homo sapiens
gactctccgtaggattttctgggaactgagctcccctaggacaatcaggttcttgctcttgggaattagggagctcagtcctcagattttctctgtc

SEQ ID NO: 6803923 - DNA, 83 bp, Homo sapiens
agtcttcatctgtctagctcaccaacttcaattgatgggtaacagaaggtcacacctggttggtcagctcaatggagagggtt

SEQ ID NO: 6803924 - DNA, 59 bp, Homo sapiens
cacacagatgctaggccaattcctgaacatagttcagtggaatacttacattatgtgtg

SEQ ID NO: 6803925 - DNA, 95 bp, Homo sapiens
tgtttctgtgtctgtctcttacgaattcttagaggacaagtatgtagtatattcagttttgtacctcaaaatttgaagatacagaaaacaaagca

SEQ ID NO: 6803926 - DNA, 113 bp, Homo sapiens
acaaagttctttgattatgacacaaagccactgcatgtgtagtattcatctggactcagtacaaacaagatgctcatgctgcgtgctgtgctgtgagtaataaagtcctttgt

SEQ ID NO: 6803927 - DNA, 75 bp, Homo sapiens
gatgtttgttgagtacctgctttatgtcatgtactaacgtgggtgctaaggatatggtattgaatcataaacatt

SEQ ID NO: 6803928 - DNA, 56 bp, Homo sapiens
tcactggctcttcagtgcttggttcctatgctttaggagaatggtggggccactga

SEQ ID NO: 6803929 - DNA, 58 bp, Homo sapiens
tggtggggaagtgggggccactctgagccaggagatgtgatcactgcttcttccacca

SEQ ID NO: 6803930 - DNA, 55 bp, Homo sapiens
tactctgccactaggagttctgcctgtaggagggaaaatagaaaatggaagagta

SEQ ID NO: 6803931 - DNA, 70 bp, Homo sapiens
cgtcccggcagctggcccctgggcacggcccccagcccggcgtcccagttccagccgcgctgcaggggcg

SEQ ID NO: 6803932 - DNA, 117 bp, Homo sapiens
ctacccctgcagtgccaactctgcagtgcccacatctctcatcaggacagctgtagagtcattgcctgcctgtcagggggagtgggaaatgagcagattgcagacactgggaggtag

SEQ ID NO: 6803933 - DNA, 75 bp, Homo sapiens
ggccctagcgggtcttgcagagtcaacctgccttgagaagggcagccaggctcaaggcctgctcctagaagggcc

SEQ ID NO: 6803934 - DNA, 73 bp, Homo sapiens
attcaacaaatgttccctgagcactttctttgtgctgaacactgttctaagtgctagggatacagtggtgaat

SEQ ID NO: 6803935 - DNA, 100 bp, Homo sapiens
tgttctcattgttaaagaaggcatcaccaacattgaaactcgggtctgtccgtctctaaagaggcccccatttcacctgtgggtgtgctcagtgaggaca

SEQ ID NO: 6803936 - DNA, 72 bp, Homo sapiens
agtgggttccgctggaggctaatgctctaacaaaggcacagtggggagcaagctagggccccagcacctact

SEQ ID NO: 6803937 - DNA, 60 bp, Homo sapiens
tccatggagatggatgactgtaacctgttggaacctcagttttctcatctgcaaaatgga

SEQ ID NO: 6803938 - DNA, 57 bp, Homo sapiens
acaacctacagctggccatggtctccctgaagacttgtttattggccttgtggttgt

SEQ ID NO: 6803939 - DNA, 116 bp, Homo sapiens
catgatatgggcatatcatattttatgtatctgttcatcagttaatgggcacatggattgtttccactttttggctggtgaataatgctgctttgaatatttgtgtacagattttg

SEQ ID NO: 6803940 - DNA, 71 bp, Homo sapiens
ggagatgcatggcctgggcccgcttcagatggtctcccttctactcccttgcgacgctcgggctgccctcc

SEQ ID NO: 6803941 - DNA, 62 bp, Homo sapiens
gcttatataattcaaaatggcttatgtatagtgggctatattctccatttggatagtgaagc

SEQ ID NO: 6803942 - DNA, 74 bp, Homo sapiens
gaaaggaatcaacttgctcattggattgttcttacccttgaggaagaaaattactccagagacaagttcttttc

SEQ ID NO: 6803943 - DNA, 106 bp, Homo sapiens
agttggtagttcgctcccgggctgatctcagagtgtggaacttgaggagctgcggtgacatcctgcagccacacgggaggtggctcctcaggggcgattgctggct

SEQ ID NO: 6803944 - DNA, 81 bp, Homo sapiens
gacttgagaggattgaaagagttgagtgcttacaaagtacacacagtaagtgctaaatgttttagttaatatattacggtc

SEQ ID NO: 6803945 - DNA, 61 bp, Homo sapiens
atctggatccctgtctcagattgggtttccctgaagcagagcctgagacagggatttgggt

SEQ ID NO: 6803946 - DNA, 61 bp, Homo sapiens
tatgtaatggagattcaatcctcatggaaatttggtaggagatatggtctccgagtgcata

SEQ ID NO: 6803947 - DNA, 63 bp, Homo sapiens
cctttgtggatgcagacgctgtcacactcattaattagttaatctgcacagccccgcaggagg

SEQ ID NO: 6803948 - DNA, 63 bp, Homo sapiens
gaaaagaggtttaactgactcacagttctgcatggctggggaggcctcaggaaacctacaatc

SEQ ID NO: 6803949 - DNA, 76 bp, Homo sapiens
gggatcttctttgcatgtagaatactcaactttcttgaaaacagagcagtagagatggcctatagtggaagaaacc

SEQ ID NO: 6803950 - DNA, 93 bp, Homo sapiens
tccaatgtgactatgtccttacaaaaaggtagaagtttggagaaagacatgcaaaccaggactatgccatgtgaggataaaggcagagttggg

SEQ ID NO: 6803951 - DNA, 80 bp, Homo sapiens
ttgtaggatgcaagtcgggaggaaaggctctaaagagaagcaaacttctctgtggcctccttccacttacagctctggga

SEQ ID NO: 6803952 - DNA, 62 bp, Homo sapiens
tatatgcatgcacatgtaggtatggtatttgggggtgtccatttgaaatgtgcatgcagata

SEQ ID NO: 6803953 - DNA, 63 bp, Homo sapiens
ggagttaagggtattctctccggtaggcccaaatctacaaaggttgaggtgccctggtgaccc

SEQ ID NO: 6803954 - DNA, 81 bp, Homo sapiens
gcaagggttgaggactggttgaaagctttgccacattctatacatttgaaaggtttttttccagtatctcttatcttatgt

SEQ ID NO: 6803955 - DNA, 67 bp, Homo sapiens
tttctccctcctcaaatatctttgtgttctcatcattaaaaggaagacaaagaaaggagaggggaaa

SEQ ID NO: 6803956 - DNA, 97 bp, Homo sapiens
gggaggctttaggggtcttggcttgcttggggagcccactcacctccccttaccctgggggattgttctgggtgccctcggggccttgctgcctccc

SEQ ID NO: 6803957 - DNA, 78 bp, Homo sapiens
ggcggaacaggaaagaaggcgaagggaccagacggtagaggactactgcttcttctcatttgtttttctatttctgct

SEQ ID NO: 6803958 - DNA, 85 bp, Homo sapiens
cttctgatatctgatagcatttatttctttgaaaaatggataaaaatgatctacaaaggcatagtgaatgttttgggtatggaag

SEQ ID NO: 6803959 - DNA, 83 bp, Homo sapiens
gttgccactatgtatgccaatgttacggaatgtcaaggacttcacagaagtcacacttcgtatctctagcatggcaagggaac

SEQ ID NO: 6803960 - DNA, 129 bp, Homo sapiens
ttgttaattcgtgatgtcacaattcaagtgtgcttcctgtcacttatgtgtagtttaaaatgttctttaatgtagcgtgaaatgattggttagctttgaaatggttgtgaagtcatgtgaagaaaataa

SEQ ID NO: 6803961 - DNA, 61 bp, Homo sapiens
tacatctgtctggctttccattccttgggtggaattaccttggcaaggccagcttgatgtg

SEQ ID NO: 6803962 - DNA, 83 bp, Homo sapiens
tgcctgctggggagtgggctaggaggagggcagcatgtaggcttgggagctgccatctctcttcaacccttaactagcgacca

SEQ ID NO: 6803963 - DNA, 102 bp, Homo sapiens
ggagggggcaggagggccgggggaggccgcgaagggcctgctcgcaaaccgttatagtccttcagcacctccctcggccggtggccctcctagcctgcctcc

SEQ ID NO: 6803964 - DNA, 61 bp, Homo sapiens
gagggctgtgggagggcctggaatatgggtgactgaacgcagcctctaagcacagcctctc

SEQ ID NO: 6803965 - DNA, 81 bp, Homo sapiens
tgtttttggcagctgttgatccaaattattttttagaggattatattgtctactttgtggtttggaaagaagtcaaaaata

SEQ ID NO: 6803966 - DNA, 63 bp, Homo sapiens
ttggcagaaaatgcttcctcagtaaagcaaagcccatcagtttcagtgaagcatttctgttaa

SEQ ID NO: 6803967 - DNA, 79 bp, Homo sapiens
cagaaaataacagtgtggagcatattctggagcttggtatctgattgctgtagtttccataattgccctgcattttctg

SEQ ID NO: 6803968 - DNA, 65 bp, Homo sapiens
atacactgtgtgtgtatgtgtgtgcatgcacatgcacacattcatgagtgcatgcacatgtgtgt

SEQ ID NO: 6803969 - DNA, 55 bp, Homo sapiens
ggagcctgcagtccagactctgagccagggtggccagtgtctgggcctcaggccc

SEQ ID NO: 6803970 - DNA, 55 bp, Homo sapiens
gccagtgaatagaggtgctgcctcttatctgtgcttaataacctctctcgctggc

SEQ ID NO: 6803971 - DNA, 86 bp, Homo sapiens
tttgggacacttatttactttccctcatcaacaatcatggattattatgtcatgattatgagtggcaaagtcttatatgcctcaag

SEQ ID NO: 6803972 - DNA, 65 bp, Homo sapiens
acttacctggaacttggtcatttttcccctcctccttctgggaaaaggcagagttccggggaagt

SEQ ID NO: 6803973 - DNA, 77 bp, Homo sapiens
gagatctctaatcaccagctctagcagcctcataggctgtatatcaccccaagcagctgagactcttagagatgctc

SEQ ID NO: 6803974 - DNA, 56 bp, Homo sapiens
gcttctattgtcatatttggacagatagatactgtgcagatacagtatgtggaagc

SEQ ID NO: 6803975 - DNA, 91 bp, Homo sapiens
gctcagccctggctaatcagcaggaaccactgcccccctgtgggggcagggacaaggcaggtgttctgagcttgggagccagggccagggc

SEQ ID NO: 6803976 - DNA, 63 bp, Homo sapiens
tcttctttagcacttgcacctgtgtggaatactacaggaaggctctggaggtgctgatgaaga

SEQ ID NO: 6803977 - DNA, 72 bp, Homo sapiens
tgggtgtggcagttccgcactgacctcggtgcattcctgctctggagtctagcatgggaaaatcacagccca

SEQ ID NO: 6803978 - DNA, 56 bp, Homo sapiens
gtcccaattacattatgctgtgcatttttacatacgtatagtattggattggggac

SEQ ID NO: 6803979 - DNA, 91 bp, Homo sapiens
atatcagtgagagttaatcagcatttccattttgagtaaatgtatatctttcagtaatcaacatgagaaagcaggttagcaattattatat

SEQ ID NO: 6803980 - DNA, 68 bp, Homo sapiens
ttttctattcaacttgactgtttcaccagctaaaactggtgaatgatttgaaagttgagttttgaaag

SEQ ID NO: 6803981 - DNA, 65 bp, Homo sapiens
cacctggtcaagggaggagacacagccctaccagcggtcaggtttggtcaactccttattaggtg

SEQ ID NO: 6803982 - DNA, 63 bp, Homo sapiens
tctaaagaagttgtgatgacgggtggactcaccttgcacctgtgcagcatttcttgctatagg

SEQ ID NO: 6803983 - DNA, 70 bp, Homo sapiens
tctgtgaaatgtgtaatgtggatgccataaaaccataatactggtagccaatttaaacatttcctaagga

SEQ ID NO: 6803984 - DNA, 63 bp, Homo sapiens
caaggagagtaattgaatgagaggccctgacattgcagaaagtctaaattaattcttttcttg

SEQ ID NO: 6803985 - DNA, 60 bp, Homo sapiens
atttgtttcaaagaaagaaaatatagatggtatttgtgtgttccttctctgagacctgat

SEQ ID NO: 6803986 - DNA, 100 bp, Homo sapiens
gagacaggagaatcgcttgaaccttggaggcggaggttgcagtgagtcgagatcgcgccactgcacttcagcctgggcgacaagagtgaaactccgtctc

SEQ ID NO: 6803987 - DNA, 76 bp, Homo sapiens
ttgtgctaaactgcagttttatccagcattgtttttgtatcaacagtgcaaatatctacgcggtgaaaaaggccaa

SEQ ID NO: 6803988 - DNA, 77 bp, Homo sapiens
aagggaaaatgtgttgaaatttggagataccactacaaactgtgagtaatagtgtctaaatgcaatggatttccttt

SEQ ID NO: 6803989 - DNA, 61 bp, Homo sapiens
actatatgaaattgccattttgtagctcaaagatgttcaaataccagcaatttcatgtggt

SEQ ID NO: 6803990 - DNA, 74 bp, Homo sapiens
gtcagtgatgtctcagagacggaagcaactggctttcccgtggccaaaaccatttccgttctgaggccattggc

SEQ ID NO: 6803991 - DNA, 75 bp, Homo sapiens
cggtgtagtccaactgttcactagtgagggttgattagaaataatcacccttcatgagagaatagtggtgacctg

SEQ ID NO: 6803992 - DNA, 61 bp, Homo sapiens
gggggaaatataccaagtgctcagtgctgcacaacgtactggcaaaatagtatattccttt

SEQ ID NO: 6803993 - DNA, 57 bp, Homo sapiens
gggcgagggcgaaagcgagagccaggaaagcccgggctctcgctgtaagccccgcgc

SEQ ID NO: 6803994 - DNA, 62 bp, Homo sapiens
ttattttacctgtccattatgtgctgctttctatagactatgcacaagggcaggcaaggtga

SEQ ID NO: 6803995 - DNA, 99 bp, Homo sapiens
gagacaggagaatcagttgaacccgggaggcagaggttgcagtgagcccggattgtgccactgtactccagcctgggggacaaagtgagactccatctc

SEQ ID NO: 6803996 - DNA, 61 bp, Homo sapiens
agattaatgagctttgagtgggtaaaacagcacatgcccattattcagccattaaatttct

SEQ ID NO: 6803997 - DNA, 59 bp, Homo sapiens
ggctgtggtctgggtgctccccatccactatctaaagtgcagcccccagacagcaggcc

SEQ ID NO: 6803998 - DNA, 99 bp, Homo sapiens
gccagctccttctgaatgaacatgtgctaaagagaagggcagctgataacctcttgagcatcttaattagcactggatttcatcagaatggtgctgtgt

SEQ ID NO: 6803999 - DNA, 57 bp, Homo sapiens
gcatgaattcttccccagaatgattccctctggagggaactgggccagagtttctgc

SEQ ID NO: 6804000 - DNA, 71 bp, Homo sapiens
cttacatttaatcatgtgtcatgtcatgaatttgcaaggaatgtaatggaatacagtggtatgaatgtagg

SEQ ID NO: 6804001 - DNA, 81 bp, Homo sapiens
agcgtccagtcagggcaggagcctggtataggccactgaccacaggacacagccaggtctcctgactcacgggaaggcgct

SEQ ID NO: 6804002 - DNA, 57 bp, Homo sapiens
gcaacagagttatctatttaaaatgtccataaatggactaggtgtgatggctcatgc

SEQ ID NO: 6804003 - DNA, 61 bp, Homo sapiens
gcctttcaatgtgcctgccttggggatagaacctagctcccaggagtttcactgcaaaggt

SEQ ID NO: 6804004 - DNA, 66 bp, Homo sapiens
ggcctggagaaaggaaggtgggaaggccaggactcggacttaccacctgactcctactccagtgct

SEQ ID NO: 6804005 - DNA, 80 bp, Homo sapiens
ttccaggcacaaagtctatgcccgatgtgcttggcatcctttattatcagccaaaaagtacatttaggtgtgccatggaa

SEQ ID NO: 6804006 - DNA, 96 bp, Homo sapiens
taatatcctagttcacagactccatgaatctgagcctcggtttcctcatattgaaatgtgggtcatagtatcgtgttaagagctgttaggagattg

SEQ ID NO: 6804007 - DNA, 88 bp, Homo sapiens
gggttggttccaagtctttgctactgtgaatagtgccacaataatcatatgtgtgcatgtgtctttatagtagcatgatttataatcc

SEQ ID NO: 6804008 - DNA, 71 bp, Homo sapiens
ctctatctttgtctgtcagctcttcctcccagaagtagctcagagacttgctgagcacacctagggtagag

SEQ ID NO: 6804009 - DNA, 63 bp, Homo sapiens
gcattttaatgaggtttatgaggatgcagacaaacatagtccccagaaaaccctttgagatgc

SEQ ID NO: 6804010 - DNA, 77 bp, Homo sapiens
gcctgaccctggggctgccttgctctctgagcatgctgttcctgctgcttctggggacaggctgcctgggtcaaggc

SEQ ID NO: 6804011 - DNA, 67 bp, Homo sapiens
ttataatgacagggcattgcaactggtccagactcctgtgtctccattaagtcatgcctaattatga

SEQ ID NO: 6804012 - DNA, 71 bp, Homo sapiens
gagataatgagtggtaattatttggctgaaacatcaagaaatgttagctatggctattactagttcctctc

SEQ ID NO: 6804013 - DNA, 89 bp, Homo sapiens
gaggttgtgtaacttgtacacggtcacagggctggggagattcaaaccccaaacccatctgtctgtctgcagatcacacacactacctc

SEQ ID NO: 6804014 - DNA, 67 bp, Homo sapiens
agctgggagagaaaagcatgcatttatattgtctgaaatattgttccattgcagttttctctaagtt

SEQ ID NO: 6804015 - DNA, 127 bp, Homo sapiens
acttttaaattaatgatgttcttatatgtattattttaacttttgtgttatgtgtgagtgcgtgtttgcccctacacattttcaacactgtcaaggttaaaatcaagtgttgtggttgtataaaggt

SEQ ID NO: 6804016 - DNA, 84 bp, Homo sapiens
aggcgacagctcagacgcaggtcgagcacctgggtccggactccaccctccacatgctgccccgacctcgttctgaaactccct

SEQ ID NO: 6804017 - DNA, 86 bp, Homo sapiens
tttccagtgataggaatttgtttagtccattagtgcccaggatttctttttgactgagggatttaataaattttagtagctggaag

SEQ ID NO: 6804018 - DNA, 74 bp, Homo sapiens
tcgttcaatcaaccaatatctattcagcagctacttggtgccaggcactgaagtgggtgttgggtacacaatga

SEQ ID NO: 6804019 - DNA, 79 bp, Homo sapiens
gccagacttttagggttgaattggggctctgtcactcagaagctctgtgatcttgggagctcctttaacctttctgtgc

SEQ ID NO: 6804020 - DNA, 55 bp, Homo sapiens
agccctctccctttcttcttagggctcaaattcaggatctgaaatggagggggct

SEQ ID NO: 6804021 - DNA, 96 bp, Homo sapiens
gagtagacacagaggagggcagtcaggctcagcctctctgaaagcgctccaccccagagggctgcctgtctgtttcttttatgcaaatgtcagttc

SEQ ID NO: 6804022 - DNA, 88 bp, Homo sapiens
gctgtcgacttaacttttgccagtttccctggatgtgtaagtagaattatattttcacagaacttgcaaaaatctcagactcggctgc

SEQ ID NO: 6804023 - DNA, 77 bp, Homo sapiens
cagagtgggagctctagaaagattgttgaccaatcatcttattgactagaccatctttctagagtataactattttg

SEQ ID NO: 6804024 - DNA, 129 bp, Homo sapiens
tgaatgtttcttccatgcctatacctgtgctatgcatagtggaattagcaaaacttatgacataatccaaaacctgaggtttataatcccatttgtaaagtcaaggcatacaccactggaatgacaaaa

SEQ ID NO: 6804025 - DNA, 57 bp, Homo sapiens
cagagactagtgctttttagtacaaaccacttttcggtttgtccagcgtctactctg

SEQ ID NO: 6804026 - DNA, 64 bp, Homo sapiens
gtctcctgaggcatccattgaagttctattttttaataaagagtatcaaaggcttttaggagac

SEQ ID NO: 6804027 - DNA, 90 bp, Homo sapiens
ccaaggctctcttgcattgctcaggccctgggccatcctgaagctggcaggatggctttgggcttagcctcaatagtgggtgggttctgg

SEQ ID NO: 6804028 - DNA, 74 bp, Homo sapiens
ggaatccagagaaagtaggttctgaggtgaatgttctcataacttcgtcataatttactgttcatttgggctct

SEQ ID NO: 6804029 - DNA, 63 bp, Homo sapiens
tagggtagtaaaggagttactcataaagctttattaagtgatgtcaagactccttcctccctg

SEQ ID NO: 6804030 - DNA, 56 bp, Homo sapiens
tcaggcacgttgatgcctagcttgtgaattgtgaagcaacatatatcaatgcctga

SEQ ID NO: 6804031 - DNA, 59 bp, Homo sapiens
tttgggggcttacttgtgagattcagttttcactggttagaagaagtaagcactccggg

SEQ ID NO: 6804032 - DNA, 78 bp, Homo sapiens
agagtaatgtggagtttgtgctaactctagccagcttaattagtgactggataaattgcacaactctcacattcttct

SEQ ID NO: 6804033 - DNA, 60 bp, Homo sapiens
ccctcttctttcccatgctcttttcttgtgagaaaagcatccaacaggagggaagggtgg

SEQ ID NO: 6804034 - DNA, 97 bp, Homo sapiens
gttggggggcctcgagctcagatcttcgcagagcagagcagcggctggagcgttctgccggctcagcgtggacctggagcttacagcgtcttacgac

SEQ ID NO: 6804035 - DNA, 121 bp, Homo sapiens
gagggtggctgggctctttctgcctccgtagccgctgtctcttgggccgcggtgggaactgtcaaccgctgcaagtgtccacgatggcggccgggctcgggccggctccgcccgcgccctc

SEQ ID NO: 6804036 - DNA, 69 bp, Homo sapiens
agattgggattagagatctgtatgcaggtataatttccatccctgtcctttagtctttattcttaattt

SEQ ID NO: 6804037 - DNA, 90 bp, Homo sapiens
ttactgagcatgaagtggtatctcatgtggttttgatttgcatttttgtaatgactaatgacatggagcatcttttcatgtgctcagtgg

SEQ ID NO: 6804038 - DNA, 109 bp, Homo sapiens
tttgccttgtttaccaactttgagtttagcaacaggaactatttgtattccattatgtttataaaagatggaaatatattttctgttttttcttggtggaaggggcaaa

SEQ ID NO: 6804039 - DNA, 61 bp, Homo sapiens
acccacccccaagaggggccttcagctttggggctcagaggcacgacctcttggggagggt

SEQ ID NO: 6804040 - DNA, 61 bp, Homo sapiens
aaacacagcatgtccttggggaaggagtgaacagaccacatctctaacacagcttgtgttt

SEQ ID NO: 6804041 - DNA, 99 bp, Homo sapiens
gaagaggacaatatgcctgacataaatctaaaggaaagggtgccaattcttgatcttttggccctttctttcagactttatattaacattgaactcttt

SEQ ID NO: 6804042 - DNA, 62 bp, Homo sapiens
gtggcacatggtgcttctggatgtgggttcatatttgcagctagagggatgctgtgtgaaac

SEQ ID NO: 6804043 - DNA, 63 bp, Homo sapiens
tgggaaggggatcagaggaggactcaaaaccaacagtcttcagagactctgagcccctcccca

SEQ ID NO: 6804044 - DNA, 74 bp, Homo sapiens
ggtgctggcaaggtaggtttcattctgtggcctcttcttttggcttgtaggtgatgaccatctggctgtgtgcc

SEQ ID NO: 6804045 - DNA, 89 bp, Homo sapiens
ctccccactgcagagcagctggctgcatctagaagtttctgcacctccgtctgggcatcagatgtttacctctggtctgcgggtaggag

SEQ ID NO: 6804046 - DNA, 55 bp, Homo sapiens
ggatggattgagggggagagttggaaaactgcttaaaaagctccatcaataatcc

SEQ ID NO: 6804047 - DNA, 56 bp, Homo sapiens
ttttttttgcacagcttatagtacagaaatgtgatatacagctatggcaagacaaa

SEQ ID NO: 6804048 - DNA, 71 bp, Homo sapiens
ggctcaaccagaggctgagcagtcagtttgctattattaccatatggcttcttcagcctcctggataggtt

SEQ ID NO: 6804049 - DNA, 60 bp, Homo sapiens
gcacatacccactgtcaagcacagtaactgtcatttagcaggtgctcagtacgtatttgt

SEQ ID NO: 6804050 - DNA, 73 bp, Homo sapiens
gtccattcttcttggtgactatttggtaaatgttttaaaatttgacatccttatataggccaatgaagaagac

SEQ ID NO: 6804051 - DNA, 86 bp, Homo sapiens
ggaatcccccggcgccagagcagcggctgccgggacccgcccagagctttcccacaggcggccgcagctcttgctctgtctgatcc

SEQ ID NO: 6804052 - DNA, 65 bp, Homo sapiens
catctagtaagcagcagagcaggggcagattctagaaccctggctctcaatggctgtactatatg

SEQ ID NO: 6804053 - DNA, 76 bp, Homo sapiens
tctctgcctgggaatgtttgctcccttcagggcaccccgcctgctggacctcaacacatttcatactaggttgaga

SEQ ID NO: 6804054 - DNA, 60 bp, Homo sapiens
gaataattacccatctttttgtatgctttggaagagtttacataagatggtaatttgttt

SEQ ID NO: 6804055 - DNA, 70 bp, Homo sapiens
gctcttgcctcatggcggctgccccaggccaagtttctgcctgcctgccagcagcctcaacaggcacagc

SEQ ID NO: 6804056 - DNA, 103 bp, Homo sapiens
ttgagatggagtcttgctctgttgcccaggctggagtgcagtggcacaatcttggctcactgcaagctccgcctcccgggttcacgccattctcctgcctcag

SEQ ID NO: 6804057 - DNA, 130 bp, Homo sapiens
ccaaattctttgtgaattcatggcattggtagccccattctttgtgtttgtacaatgcactagtctccagagtgtgcattccttgaatgatagaggtttttagttatagtggcatgggccatcactaggg

SEQ ID NO: 6804058 - DNA, 61 bp, Homo sapiens
cagtgggactccagctcttctccttgcccacggaggcatctctggaagtttgggtcccctg

SEQ ID NO: 6804059 - DNA, 77 bp, Homo sapiens
ggcccctgcgaggggtcacatgggctggcttatttggagaacaaagttagataactcatgtgatcccacagagggcc

SEQ ID NO: 6804060 - DNA, 58 bp, Homo sapiens
gtcacataaagatttcttgatgagccatacaaccttatccaggtatgaattgtgtgac

SEQ ID NO: 6804061 - DNA, 109 bp, Homo sapiens
ggggcgggctggggcggggctgcgcagtggtgctgcgcgcggagctctgttgccggaactggtccgagtcgtgcgccgggccgcgcgcagccccgccccgccccgcccc

SEQ ID NO: 6804062 - DNA, 124 bp, Homo sapiens
gcaagtgcagacagaagacatagatgccccagtactcttgcctgcctcatctaggataaagcatcttccccaggagaggggactggatgaggggaaagagacaggtacttcctgttccacttgt

SEQ ID NO: 6804063 - DNA, 80 bp, Homo sapiens
ttccagccttctagaagtccaaagttaaatagaacgtccagcagccttttatctagcagggatttttgtgggggcgggaa

SEQ ID NO: 6804064 - DNA, 56 bp, Homo sapiens
caggcactttggtgagccacgtgaccctgcgcctgctgaagccagagtgtgtcctg

SEQ ID NO: 6804065 - DNA, 58 bp, Homo sapiens
gtatatggcattttgtaagggcttgccacgtaataagcctctaactgatgtcaaatat

SEQ ID NO: 6804066 - DNA, 103 bp, Homo sapiens
cttatgtcatcttccatcttcctctctaattgatcagacaagccatacctcattgtgtgactaaaacttaagaggtgttagtgagaattgcccaaaacataag

SEQ ID NO: 6804067 - DNA, 69 bp, Homo sapiens
acatgacagctaaggctccttctaggtataaaacgttataatgtctagaatataagcttagccacatgt

SEQ ID NO: 6804068 - DNA, 129 bp, Homo sapiens
ggtgtgagcagttccatgaattaaagcaggggtgccgtagaatgctgtgtaggttgcattcttcataacttgcacaataccatgcaggggccctgactgtaagttcaagttatggagatggcgaaaacc

SEQ ID NO: 6804069 - DNA, 56 bp, Homo sapiens
tgatcagtaaagtcagttgtcacttggtagagtggcagggctggctgctgcactca

SEQ ID NO: 6804070 - DNA, 76 bp, Homo sapiens
ctgtgatgctgttattctaatgtgtgagctggtgaatgagagttcatgctaaaataaccgtatcattcaaattcag

SEQ ID NO: 6804071 - DNA, 119 bp, Homo sapiens
actgatctactccttcattaatatcccaaatttaggtaacagtctgtagagtgtgccagttagtacagcctgttacctatatttgggatatgaatatattatccaaggagtagaacagt

SEQ ID NO: 6804072 - DNA, 61 bp, Homo sapiens
ccctttaaggaaaggaaggatgagaagtatgtggcactttctgtttttgctccataaaggg

SEQ ID NO: 6804073 - DNA, 57 bp, Homo sapiens
gtggtgacccttcaggtctcagtacttttccaaggagctgggatacaggcttactgc

SEQ ID NO: 6804074 - DNA, 57 bp, Homo sapiens
gctgtgggttcctggcatttgagtgaataatgttcagatgattaagtggcccaaggc

SEQ ID NO: 6804075 - DNA, 85 bp, Homo sapiens
tggatcttaaaggacaagtagtatttgcatcagaaaataagcaacagtgtattccagataaaggcaacagcttgtctaaggtcta

SEQ ID NO: 6804076 - DNA, 58 bp, Homo sapiens
gcctatatgttaataggagggaaataagtatcattcttttctagctgacatttggagc

SEQ ID NO: 6804077 - DNA, 78 bp, Homo sapiens
gcctcctgcggggcctggacagggagggggccagaccacagcggcccctcctccggtcattgtgcgggcctctgaggc

SEQ ID NO: 6804078 - DNA, 78 bp, Homo sapiens
ggatggactcgatctcttgacctcgtgatccgcctgctttggcctcccaaagtacttggattacaggcatgagccacc

SEQ ID NO: 6804079 - DNA, 62 bp, Homo sapiens
taagacctcatggaattaaagcagaagtgaaacaccttttattctgtagtctatgaggctta

SEQ ID NO: 6804080 - DNA, 61 bp, Homo sapiens
ctgctataatttatcatgtcacagttctggaggctagaagtccatgatcaagatgtggcag

SEQ ID NO: 6804081 - DNA, 55 bp, Homo sapiens
ccttgaaagccaggcagaggaacctgagtttaccttgtggtcctggtattcaggg

SEQ ID NO: 6804082 - DNA, 73 bp, Homo sapiens
ggaagtcatgggcagctactggttccctactaggagacttggggaacatttgaaaggtgctgccttggttttt

SEQ ID NO: 6804083 - DNA, 125 bp, Homo sapiens
cacaggattataaaggaaatcaatcattgaaatgtagtttcatctgtcttctcaggactctgatgtagacctacattatcagcacttcatggatgatttctaaattgtagtagaagactcctctg

SEQ ID NO: 6804084 - DNA, 62 bp, Homo sapiens
agttgggactgtatgtgtatacacacaattacacaaacaaatatacacatattcttgcaact

SEQ ID NO: 6804085 - DNA, 76 bp, Homo sapiens
ggaaattttaacagatctcattttgagtcagacactatgctgggcatagaatgatgagcaaaagaggtgaatttcc

SEQ ID NO: 6804086 - DNA, 58 bp, Homo sapiens
ctttgagggacttagctaggtttagaaagacttttggagagcagctaggcccttttgg

SEQ ID NO: 6804087 - DNA, 71 bp, Homo sapiens
gagaaggtgggcttgtagccaggatgccagcaatcagcaaggacacctgcacagccccagaatgccagctc

SEQ ID NO: 6804088 - DNA, 95 bp, Homo sapiens
catgtgtctagctttgtggagatatgttttacttaagatcccagggcagatttcttagaagtaaagcattgtcttcagagtcagacctatatatg

SEQ ID NO: 6804089 - DNA, 75 bp, Homo sapiens
tagaaatgcactgtttaaatatttgggctggaaaaaactttgagtagcatttatttaatacagttggcatagctg

SEQ ID NO: 6804090 - DNA, 68 bp, Homo sapiens
caggagtgttccatccaagccctgcccagttcccaagggggcaggaagctcggagagggcaaatcctg

SEQ ID NO: 6804091 - DNA, 70 bp, Homo sapiens
agtttgttgttgttcaaaatatgcagtgtcagatatgatctgacactgcatatattgaagttggctaact

SEQ ID NO: 6804092 - DNA, 88 bp, Homo sapiens
gtttattctgaatgcatacatttaaatacctatgtttctataccattcatatttggaggagatgtttgtgtttattcagaaagtagac

SEQ ID NO: 6804093 - DNA, 72 bp, Homo sapiens
gtggaccatacaaaaataggtgattggcagaatttggcttgccggctgtagtttaccaatcccttggtttac

SEQ ID NO: 6804094 - DNA, 72 bp, Homo sapiens
cactttctggatcttcagagatcaccagattgatgtttaccatactgagatcaaaatctgaagataaaagtg

SEQ ID NO: 6804095 - DNA, 88 bp, Homo sapiens
gctgaaatatgtctcctatgttgaaacaaaatgctgtatttaaaatagaaaatttcctgtattctcgtaggagacaaaataggtcagc

SEQ ID NO: 6804096 - DNA, 57 bp, Homo sapiens
ggacctcgaaacatagcagttctaaacaagtatgtgaactgctggtcttttctgtct

SEQ ID NO: 6804097 - DNA, 59 bp, Homo sapiens
gtcaataagtttgtaactggatttctctctggagccagtggatgaggacttaacttggc

SEQ ID NO: 6804098 - DNA, 61 bp, Homo sapiens
acatttaatgtgcaaagagatagggcattataaagttatatgtcatgagcatattgaatgt

SEQ ID NO: 6804099 - DNA, 72 bp, Homo sapiens
cccgtggcttcacccgtcctccccacgctcccaggttcagtgggtggagactgggtgcaagcaggttgaggg

SEQ ID NO: 6804100 - DNA, 70 bp, Homo sapiens
gctcttgtggaggaaagaggaagcatgtcctggctttgggaggatcactgcttccattgttcacctgagc

SEQ ID NO: 6804101 - DNA, 91 bp, Homo sapiens
ctaaagagaagcagaacaccgtatggacaccctctcctgcctcttgcccaaggcatggcctctgtgcttgttgctgctgcttttctattag

SEQ ID NO: 6804102 - DNA, 82 bp, Homo sapiens
cccactcagagaccagtgtgaggaattagtgtccaggccacagatccagggactgggcacaaacatctgcctgttgagtagg

SEQ ID NO: 6804103 - DNA, 102 bp, Homo sapiens
aagaatggatgaggcttttatggtggtcagggagcagagccatgatgaatattcccacgtgtcatctgagccttgggcgatttgaaatcctacacccatctt

SEQ ID NO: 6804104 - DNA, 66 bp, Homo sapiens
ggcctctgcagcgtgcaggctggtgctcttccagcatttcctcaatcacgctgacacccccaggcc

SEQ ID NO: 6804105 - DNA, 66 bp, Homo sapiens
catggattttggagcaagctggagagaacatctccatattgactgattctttctatgcctttcatg

SEQ ID NO: 6804106 - DNA, 122 bp, Homo sapiens
gaaacaactgcttccttggcttctgagagtggtcatctatttatgtagaacaagggttctctcgagaaaatttgtttttaaagagacatcccctcctcaaaagacaagaggtttgttgtttt

SEQ ID NO: 6804107 - DNA, 130 bp, Homo sapiens
aaggacaggacaggtgaggcagggccaggtggagcatgtgaggactgagttgctggcaggtgcacctgtgtccacccctcccatgtccttcatgcccatgtctccaaccctacgtgtgtccccagtgctt

SEQ ID NO: 6804108 - DNA, 80 bp, Homo sapiens
agttctggactggcaaattctttaagtatctcttgttttatggaataatacagtgaatacttacagtgtttgcaagaact

SEQ ID NO: 6804109 - DNA, 72 bp, Homo sapiens
tagagttttttggtctttttgagttcctaatgttgcatgctacagtgatttatggaaggccaaaatgtttta

SEQ ID NO: 6804110 - DNA, 87 bp, Homo sapiens
aaaatgcttcatgtataaggaatttagaatagggaaaatatattaggtattcgttgtgctcattttccggcagtacagaagcatttt

SEQ ID NO: 6804111 - DNA, 62 bp, Homo sapiens
gctaggcacagtcaccattcaaattcatagccagatctgtatcatttgaaagctgtgcttgc

SEQ ID NO: 6804112 - DNA, 68 bp, Homo sapiens
cctccttcagttagagtttacaaagttgtgtggttttgattcattaatggcttgctttatgaaggggg

SEQ ID NO: 6804113 - DNA, 76 bp, Homo sapiens
gcttctcttggggtatgtggggttgaaggaggagacacattcttccaaacaccctccatgctgcaaaatggggagc

SEQ ID NO: 6804114 - DNA, 94 bp, Homo sapiens
tccaaatagaagcagtttggcttaacttacatgatattcattcacatcaaggagaaatgcatgagaattgtagctaatctgaattccctttgga

SEQ ID NO: 6804115 - DNA, 77 bp, Homo sapiens
agtatgtctctaaatcttaacaggctgatcatatatcctctatatctccaagagaggctgtaggtttcaggcatact

SEQ ID NO: 6804116 - DNA, 87 bp, Homo sapiens
agatcaacagatcgtgggtagaaagatggaacgttgaagccaggcaaccaaacttgaattttcttcttcttgccagatgtgtgatct

SEQ ID NO: 6804117 - DNA, 69 bp, Homo sapiens
tctgtttcacgtcctgaatctcacttcagcccgcatacagctgctttaggagacagagactgaaataga

SEQ ID NO: 6804118 - DNA, 76 bp, Homo sapiens
ggccacttacctcccagagatgctgcgtgttcctcacggcgcctgcctgcaccttctctgggggcagaagcacgcc

SEQ ID NO: 6804119 - DNA, 65 bp, Homo sapiens
atgtgtttggttatatggtattgcccctggtcccactgggggcttaggtcatatactatatatat

SEQ ID NO: 6804120 - DNA, 67 bp, Homo sapiens
ttgaagcagctcaggaggcttagcttggatatgagaaagctcagagacaccagagagctgtgttcag

SEQ ID NO: 6804121 - DNA, 60 bp, Homo sapiens
tggcagaggtcaaatacctcatttccaatgccttgaggaaaatggtctgtgattctgtca

SEQ ID NO: 6804122 - DNA, 64 bp, Homo sapiens
accagaggaagggaatctcaagtctttacctcccacagtctggtgtgattctctctcttttggt

SEQ ID NO: 6804123 - DNA, 82 bp, Homo sapiens
acttaaaaacctattttataatttaatgtgcatcattagtggtgagtgtattaagttatgaagttagtagggtcagtaaagt

SEQ ID NO: 6804124 - DNA, 85 bp, Homo sapiens
ctgagatgatagagctggattttatcattgtagtttatgccaatgcttaaacaccatgtaaaaagtcttaacctcattcttccag

SEQ ID NO: 6804125 - DNA, 73 bp, Homo sapiens
gtggagagaaagtaaacattattctgggaacatgttcaaattatgtgactttcagtgatttatctttttccac

SEQ ID NO: 6804126 - DNA, 58 bp, Homo sapiens
attgttttccaaagatgctgcttcctctgcagttttgcaggttgtttttggatacaat

SEQ ID NO: 6804127 - DNA, 73 bp, Homo sapiens
aggctggagtgcagtggcgtgatctcagctcgctgcaagctccgcctcctgggttcacgccattctcctgcct

SEQ ID NO: 6804128 - DNA, 61 bp, Homo sapiens
ggcctcaggtccagaaaccaaaggatttagacaaagtcccaagtttggacttgatgatgcc

SEQ ID NO: 6804129 - DNA, 80 bp, Homo sapiens
ctgccaggttttgaggcctgataacacactgagattaatacatggctcaatgatagtacaatcagcctatgacctggtgg

SEQ ID NO: 6804130 - DNA, 65 bp, Homo sapiens
tttgcatttgttcaagtattgatttgatttagcaaatatgacaccaatcttggataaagtgcgaa

SEQ ID NO: 6804131 - DNA, 64 bp, Homo sapiens
ggagtgtaaagttgtagatccctgtgggaggcaccagtccctggagggatttctcaatcacttc

SEQ ID NO: 6804132 - DNA, 84 bp, Homo sapiens
gtgccttacgccgacactcagggctccctctggctcccaggtcactcctgtggccccagagggcggtccgtgcggtcatggccc

SEQ ID NO: 6804133 - DNA, 58 bp, Homo sapiens
ggggaccaggactggtggtatctcccggatgggggatgagagctagtgctggcttccc

SEQ ID NO: 6804134 - DNA, 65 bp, Homo sapiens
gggaaccgactaggataagccaggctcaccccagaggcctctgctgcaagcctggttggcagccc

SEQ ID NO: 6804135 - DNA, 69 bp, Homo sapiens
ccctaatgagctgtatgatctgaggcaagttacttcacttctcatgtcagtttcttctataaattgggg

SEQ ID NO: 6804136 - DNA, 63 bp, Homo sapiens
gtcaaggggaggacacagggccatgaaggtgaggggacgatggccctcagtccttccttggat

SEQ ID NO: 6804137 - DNA, 118 bp, Homo sapiens
gagtgatttagtttatttacctggcaacttcatttataatgtcattatgtaagtattaaatcattgatgagtaaataaggttgagttgatttgactagggaaaaagacaaaattattt

SEQ ID NO: 6804138 - DNA, 58 bp, Homo sapiens
ttgttaaaggatagcctctatgaaaatatgtggcataacaggcattgttctttagcaa

SEQ ID NO: 6804139 - DNA, 81 bp, Homo sapiens
gtaaaaatgcttccaattttacgtctgtataaaaagtgaattttttaaaaagccaatgtgaagtatctgagagcattgcac

SEQ ID NO: 6804140 - DNA, 95 bp, Homo sapiens
ggctggtaccaggcttgccgtccctggagctgagcagtgctgttccctctagaaggagcatttgctgtccagggcactgagcctgtggccatgcc

SEQ ID NO: 6804141 - DNA, 70 bp, Homo sapiens
tcctaaaaatatgtttgagaaattccaagaatcgctatccaagacgattgattttcagactatgcgagga

SEQ ID NO: 6804142 - DNA, 74 bp, Homo sapiens
taggaagatgataccccatggagaagatataaaaatcacgttgtaaatccaccagggtttcatctcccttccta

SEQ ID NO: 6804143 - DNA, 80 bp, Homo sapiens
gttgtcaattatgtgacacatcttccagggggaagccagccaaataaaacccaagctgaagatatcacatggagacacac

SEQ ID NO: 6804144 - DNA, 96 bp, Homo sapiens
gtatacctcaaaatcctcaaacatttgacttctctcaggctcttctttttcagatctgtcatcagtcaagggtttgagggctttggggaggtatac

SEQ ID NO: 6804145 - DNA, 62 bp, Homo sapiens
tcagctgtccgcagcccacttcctaatcagatcgagagctgggtgggaacgcggacagatgg

SEQ ID NO: 6804146 - DNA, 57 bp, Homo sapiens
atccttgctcagagaaggtcagtcttttgttctattctggccttcaactgattggat

SEQ ID NO: 6804147 - DNA, 78 bp, Homo sapiens
gtagaaagtgacaataacttctttggtttaaagagaactttcattctcacagtgagcctgaggtcggtcattttctgc

SEQ ID NO: 6804148 - DNA, 60 bp, Homo sapiens
agaggaataaatttctgtagtgagatagttacccaaactacaacagttatttatttcttt

SEQ ID NO: 6804149 - DNA, 87 bp, Homo sapiens
gaagcaggtgtcaattggatttcgagaggtgtgaggcctgctgcattctgcatgtctgctctggaggtctgcttagggacctgcttt

SEQ ID NO: 6804150 - DNA, 106 bp, Homo sapiens
acagattccacagtttctcataatgataatgcaaatggcaatgagtgaccttaaactgaggtgccattaatagttgtggtgattgtgagtttttgtggtattttgt

SEQ ID NO: 6804151 - DNA, 99 bp, Homo sapiens
agtttgggtgtttgaagctgtgccttgtggagggccttgcacagaggatgactcagttagtgtctgcccattcatgggcacaggccaagctaccctgct

SEQ ID NO: 6804152 - DNA, 76 bp, Homo sapiens
aggttggtacaaaagtaattacggtttttgcttttaaaggtaatggcaaagattgcagtcacttttgcaccaagtt

SEQ ID NO: 6804153 - DNA, 69 bp, Homo sapiens
agtgcgataccccagtttggcagcaacatggcgagatcccacctctgcttgttgatgtgaaacagcact

SEQ ID NO: 6804154 - DNA, 63 bp, Homo sapiens
tccccagagtctcatttggacaaggacagagccttgtcctttacttgagactcaatgtgggga

SEQ ID NO: 6804155 - DNA, 63 bp, Homo sapiens
ctatgcctgaccctcatcctataccaaataaattaaataatggtagatggggtccaggcatag

SEQ ID NO: 6804156 - DNA, 74 bp, Homo sapiens
accagatgatgtaccactttctcagttctgagtttgctgagtgactggatagagagtcggtacaacagcaaggt

SEQ ID NO: 6804157 - DNA, 60 bp, Homo sapiens
tcacctgcccttaggaatcctctggtcaactgtacgagaagaaggaagggggcaaggtga

SEQ ID NO: 6804158 - DNA, 82 bp, Homo sapiens
tgctctccagatactaaatgctctataaatatgacatgtccagacactggatgttccccatacaatagatgctctggaggta

SEQ ID NO: 6804159 - DNA, 81 bp, Homo sapiens
gatgaggtcattctgcctcagctgatttcagatttatttttcaagctggagccagtgtgaggctttggagatagccttttc

SEQ ID NO: 6804160 - DNA, 82 bp, Homo sapiens
gtggcattcagcactttttgtaaagctttgagactacatcaaaccaaaaatagggatgtaagctgaaaagtctggaaactac

SEQ ID NO: 6804161 - DNA, 126 bp, Homo sapiens
ttcggaagtgaggctgcagccagggattgagcattgggtttctgcatgcatctgcacatttcctcaaatgcagtccacaggccacagtgcaattaaacacccaaactgccaagttgagtttctgaa

SEQ ID NO: 6804162 - DNA, 87 bp, Homo sapiens
gccgagggcttggagccctagatgaggccccagccagccggagggcttcctgggggcagcagtcttgaagggcttgtaggacttggc

SEQ ID NO: 6804163 - DNA, 77 bp, Homo sapiens
ggcctaacctacaggcagggctgggattagactccaagggtggggttttccaaacagtgctgtgttctgtggtagcc

SEQ ID NO: 6804164 - DNA, 83 bp, Homo sapiens
gttagggaggacctcacttagaagatgcagtaaagcaatgaagaagttgccctgcggctatctagatgaagagttttccaggc

SEQ ID NO: 6804165 - DNA, 57 bp, Homo sapiens
ggcttcttgctattttccaatgcatcagattcactgatatgttggctacaggaagct

SEQ ID NO: 6804166 - DNA, 67 bp, Homo sapiens
gtggtcctgtcctgacggcttcttacctgatgattgtcagagggatgaagtacaccaggaaggccac

SEQ ID NO: 6804167 - DNA, 69 bp, Homo sapiens
gcagggatagtagaatgttctatgtcaatgtgtgtgtgttcacgcattgtgaacctttctcatgcctgc

SEQ ID NO: 6804168 - DNA, 130 bp, Homo sapiens
cctaagaatcacttggggtgcttgctaaaatgcagatttcttgacccctgtctcagagattgattcagtaattcttgagtaggcatcaggaatcagtatttttaaacatacaccccaggttattctgatg

SEQ ID NO: 6804169 - DNA, 124 bp, Homo sapiens
ttaggtgtgcattgacaacgtactcagaagattatgttccaccatatgattatcagccacatgtgagtacaagaaccgtagtcttctacctatttgtgtacttgaaatgattatttgcacctag

SEQ ID NO: 6804170 - DNA, 83 bp, Homo sapiens
tgtctttcttcagctgctccctatcctttccttttcaaagagaaataaagagaaagggacagcaccttgaatgaaccaagata

SEQ ID NO: 6804171 - DNA, 57 bp, Homo sapiens
ttcgtctggcagttgcactgtttatgtgtgttgattgagatggtgaaggccagggag

SEQ ID NO: 6804172 - DNA, 64 bp, Homo sapiens
ttaaaccactgagtggagactaagaaagggaacaaatattcagggtttttataaagtgggttaa

SEQ ID NO: 6804173 - DNA, 62 bp, Homo sapiens
ggtgagtagaggtcaggggtgctgctaaatatcttaccatgcacaggacagcctctactccc

SEQ ID NO: 6804174 - DNA, 90 bp, Homo sapiens
aggagctgaattgcttggggtaggagagaagggactttgctactactagttgtccttccagactcttccacccagcagtcaacagcttct

SEQ ID NO: 6804175 - DNA, 72 bp, Homo sapiens
gtccatccatgttgtattatgtgccagaatttccttcctttttaaggctaaataatattccatggtatttac

SEQ ID NO: 6804176 - DNA, 75 bp, Homo sapiens
gagcaagggagggtggtgagcagtagcactttgtacatttgaaatggtcattagcattgtcgacattttcccctc

SEQ ID NO: 6804177 - DNA, 78 bp, Homo sapiens
ccatgttgcacaactttaggaaccacattcacttacatagaagacagtgtgaatggagacctcagacttggcacctgg

SEQ ID NO: 6804178 - DNA, 73 bp, Homo sapiens
tccttcatggacctgccagctcctcacttttcgaaggatgaaggtgaaactggaagctggccagggtggagga

SEQ ID NO: 6804179 - DNA, 59 bp, Homo sapiens
gcatggcaagaccctgtctctacaaaaaagacaaaagttagctagggttggtggcgtgc

SEQ ID NO: 6804180 - DNA, 79 bp, Homo sapiens
ccctcactcagctctgagcactgtgcggctggggctgtgcttgcctcaccggcactcaggctcactgggttgctgaggg

SEQ ID NO: 6804181 - DNA, 96 bp, Homo sapiens
cagttgctggctctaactctgccttggtgtcacaagaagaggaccttaattcctctgttttgcatccccaagaatagagaatagatgtcaaaactg

SEQ ID NO: 6804182 - DNA, 55 bp, Homo sapiens
gcatcatttgagcaagtgactggagtgatccacattacaaagctacagatgttgc

SEQ ID NO: 6804183 - DNA, 57 bp, Homo sapiens
tgagactgattgatagatggaagacataaaacgaaacttctatctcttcaagtttca

SEQ ID NO: 6804184 - DNA, 55 bp, Homo sapiens
agtagcccgggcggctgctgtagtaactgggtgttaagaaagctgcctgggtgct

SEQ ID NO: 6804185 - DNA, 63 bp, Homo sapiens
gttctttctattctgatgtcatagaatactgtaggtgtgtgattactgaatagaaaatagagc

SEQ ID NO: 6804186 - DNA, 74 bp, Homo sapiens
tcaaatactatttgtaaagtgcctggtgtagtgcctggcacattttaagcgctatataagtttgtcaagtttga

SEQ ID NO: 6804187 - DNA, 61 bp, Homo sapiens
cattttcatgggctgacaactcagacaatatcacgattctgttggtcattctcagaaaatg

SEQ ID NO: 6804188 - DNA, 67 bp, Homo sapiens
ctgcaagccaggaagagaatcctcactagaaactgaactagtaggaaccttgatcttggatttctag

SEQ ID NO: 6804189 - DNA, 78 bp, Homo sapiens
agaggaaatgtggctttaagagatttaggaacattattttaaaagaagacaatgtttctctttagtcattcttctttt

SEQ ID NO: 6804190 - DNA, 73 bp, Homo sapiens
tcagagtaggcggggcagggggaatcagagcagtggctccaaagtcacccttcccagctgtccgccactctgg

SEQ ID NO: 6804191 - DNA, 62 bp, Homo sapiens
actccaggtgtatttactgaagtaaaaaaatcacttgtattttcttcagatgcttttggagt

SEQ ID NO: 6804192 - DNA, 71 bp, Homo sapiens
gactgagacagctccgctgcccgctgaactccatcctcccggcggtcgggcggcggcggctgcggtcggtc

SEQ ID NO: 6804193 - DNA, 61 bp, Homo sapiens
aggtctgtctggccccatgaatcttttggtgagataaatgcaagggaaaggcaagagacct

SEQ ID NO: 6804194 - DNA, 90 bp, Homo sapiens
gctattgacatctagggccagatatttctttgtttcagggtctgtcctttgcattctagatgtttagtctacccactagatgccattagc

SEQ ID NO: 6804195 - DNA, 74 bp, Homo sapiens
ccaggacacatgcactttccctgaccaggcctacacaaatgcttatcatgttagggagggtgcatatgtgttgg

SEQ ID NO: 6804196 - DNA, 61 bp, Homo sapiens
gaagctgctctgccaagacaacatcatcaatcaataagagaatgtgtcagcagggggcttc

SEQ ID NO: 6804197 - DNA, 70 bp, Homo sapiens
ggtgccctgagaaagtgagggttaaacattgattcaggtgtcagtgataactctcagtttctcatgaacc

SEQ ID NO: 6804198 - DNA, 68 bp, Homo sapiens
ggcagttggcaggatttgcccggaaggatcaggatagggtctttgggtctgagtcctgcgtgacttcc

SEQ ID NO: 6804199 - DNA, 85 bp, Homo sapiens
gaaatatactaaaaaacattgaattgcacactatacgtgttttaaattagtcgattgtatggtatgtgatatatgtgtatatttt

SEQ ID NO: 6804200 - DNA, 74 bp, Homo sapiens
agaaatgcttatgggttccataataccgcttggcattgcacactaagcaatattgttcttgctcaagttcttct

SEQ ID NO: 6804201 - DNA, 67 bp, Homo sapiens
gggtatgttcatgtggtttttaaaggattattgttctgtaatcaaaaatgaacatgaacttaatccc

SEQ ID NO: 6804202 - DNA, 76 bp, Homo sapiens
aggaatgaatggagaacaactttgaaacatgaagagatgttttcttctagtacagactgttgttcctgttctacct

SEQ ID NO: 6804203 - DNA, 119 bp, Homo sapiens
tagtgtattttaccaccatgtataaaagtatttgtgtttatatgtaaaatggagttcacctctaggttcgggcacttacaaatggttttgtacccacatgaatttgtggtggaacatta

SEQ ID NO: 6804204 - DNA, 58 bp, Homo sapiens
tcctgcacagcatgctctgatttagaattttttggattgggcttgaactgtgtgtggg

SEQ ID NO: 6804205 - DNA, 61 bp, Homo sapiens
tgtgaaggtttttatgggatatcaagttctctcacttacattatctcactggattttcata

SEQ ID NO: 6804206 - DNA, 98 bp, Homo sapiens
tccacttaatcataatcactatacaccaaaatattaaggctggtggtatttcaagtgacctttattttgtgtgtgtttagctggagtgaagaagaggg

SEQ ID NO: 6804207 - DNA, 68 bp, Homo sapiens
gctaagttctatggcttgcaggcagcagtcagcaaagaacatcagctgaggcaggcctagaacttggt

SEQ ID NO: 6804208 - DNA, 92 bp, Homo sapiens
aaagattctatatgtgtaaggtaatatttttctctctaaggtatagtgaatcttatttgggacatatgttgaaagactgcataggaattttt

SEQ ID NO: 6804209 - DNA, 111 bp, Homo sapiens
gcctctcacgatatgctaaccacaattaatcacttttctctaatgtagctgagctgctttataacaccggctacacaaaaggagagtgagttaaagtaaggaactaaaggc

SEQ ID NO: 6804210 - DNA, 80 bp, Homo sapiens
gctaaagatgcaagtgagcttttagtaacttccctgattactttcaggctttgcaaaaaagctcatatatggtattgggc

SEQ ID NO: 6804211 - DNA, 83 bp, Homo sapiens
aggaacacagggtaggaagtgttagagaatcctgagtctaaacaggcctaagagatctctagcacttcctgtactggtgtctt

SEQ ID NO: 6804212 - DNA, 64 bp, Homo sapiens
cctacgggattactcaggcctcaggggaagatttggggtgcctggtatctgagaatgctggagg

SEQ ID NO: 6804213 - DNA, 65 bp, Homo sapiens
tactttttattcctattttcaatgccaaaggaggtatgtatatctgaaagttggagtcaaatgta

SEQ ID NO: 6804214 - DNA, 74 bp, Homo sapiens
agcatctgatgcaatgtaagtcttggttatatactctgatatgtttccacagatatttatttagtcagaatgct

SEQ ID NO: 6804215 - DNA, 72 bp, Homo sapiens
tctagtgccaagctaatgccagaattaattattagcaattattgttctttctttcaatagctggcatatgga

SEQ ID NO: 6804216 - DNA, 58 bp, Homo sapiens
agcatccaggccaggttgggcagggtttaataagcgctgggcctttcacctggatgct

SEQ ID NO: 6804217 - DNA, 85 bp, Homo sapiens
ctgaaaagtgtctaatgagaattctttttgggtacctattaaaaatagtggttatttagaactgagtttttattgtgattatcag

SEQ ID NO: 6804218 - DNA, 55 bp, Homo sapiens
caaagtgctgggattataggcatgagccaccttgcctggccaattccagcttttg

SEQ ID NO: 6804219 - DNA, 66 bp, Homo sapiens
aagcatgtagtgaagatttatatgataagggaaaagagaacctctttgtcacatcatcccatgctt

SEQ ID NO: 6804220 - DNA, 90 bp, Homo sapiens
agctattctaactctcaaaagggctggctttcccatacatacaaagaagaaaatgctgtgcttgcatgagtgtctgaatcaagaaaagct

SEQ ID NO: 6804221 - DNA, 82 bp, Homo sapiens
attatgtctaagagttgaagtataatagggattatgtaattatgataattctaacttttttttagctttctgggagcataat

SEQ ID NO: 6804222 - DNA, 104 bp, Homo sapiens
ttttgacagtgtcttatttatgtgtctctgagtttgtgtatgagtgtgggtaagtgtaggtactgcacaagtcagagtaacatttaaggttaatatggttgaaa

SEQ ID NO: 6804223 - DNA, 56 bp, Homo sapiens
tgtgtttagagagcacattcagtgagttttctgtctgaacattctttctgaacata

SEQ ID NO: 6804224 - DNA, 61 bp, Homo sapiens
ggagtggaatttttttgtgtcaaattgtaaaatttcagtgaaatgtagaggaattccacct

SEQ ID NO: 6804225 - DNA, 59 bp, Homo sapiens
gaatcttagtctcctaacggctgcgatttatttatttatagtttttgagactgagtttc

SEQ ID NO: 6804226 - DNA, 56 bp, Homo sapiens
caggggtgggctgaggtggggagggagcctcctctctggcagaggccctatccctg

SEQ ID NO: 6804227 - DNA, 129 bp, Homo sapiens
gaaacgtggggaggggatccacaggccaaggcgccgcacagtgatgccctgctccatcccatgacagggcctggaaggggactggcagctgcagaaatggtttccggccttcccacatcccccacgcac

SEQ ID NO: 6804228 - DNA, 68 bp, Homo sapiens
ggggctttgattacccatagtgcagttagtaaaggtttgctggcatgcattgtgggtaattaagtccc

SEQ ID NO: 6804229 - DNA, 64 bp, Homo sapiens
tgcatagagtcataattacatatattttgcttgaggcgaatcaatgtctgttctgattggtgcg

SEQ ID NO: 6804230 - DNA, 58 bp, Homo sapiens
gacaatgatggttcactcttgtgggtcacattttgctaactgggtgaagcattatgtc

SEQ ID NO: 6804231 - DNA, 75 bp, Homo sapiens
gcttggttcaaaacatggaagggtgttctgataagtatatacataagagcacacacctttccttttgcctcaagc

SEQ ID NO: 6804232 - DNA, 69 bp, Homo sapiens
ggtggcggtttgcaaactttttctatatagggccagatagtaaatatttcaggttttgcaggccgcccc

SEQ ID NO: 6804233 - DNA, 129 bp, Homo sapiens
atctcttttccacagtgacaatcctgagtgtctcctgcagttctgcatgtgacactgttttgagtcatcatttaagaccttgtctaaacatgtagatattgtcaatgctactatgtctttattaatatt

SEQ ID NO: 6804234 - DNA, 74 bp, Homo sapiens
ttacatggtgagagctggggcaagagagagaggaggaggtgcctggctcctttaaacaaccagctctcatgtga

SEQ ID NO: 6804235 - DNA, 80 bp, Homo sapiens
ctgggcatactttggctgagagaggaaaagggcctggcgacctgctcaagttttggattcttttttgccttcttgctcag

SEQ ID NO: 6804236 - DNA, 60 bp, Homo sapiens
gcaaattgattttgtgctttcctacgttgatgatgtaaagaaagacgcagagttaaaggc

SEQ ID NO: 6804237 - DNA, 74 bp, Homo sapiens
ggtggctacaggcctggggtcccggcttagaggacctctgagagctctggggccccttcttggtcgtggttgcc

SEQ ID NO: 6804238 - DNA, 76 bp, Homo sapiens
cacacgctggtagtcggccagagataaagcagccctcatacatattgcagcctggctttgacttaccagaagtgtg

SEQ ID NO: 6804239 - DNA, 55 bp, Homo sapiens
tgatgcttcacgctgaatatgctacaaatgatgtagcatcaggtggtttggcaca

SEQ ID NO: 6804240 - DNA, 67 bp, Homo sapiens
agcaaacccatgcattgattgacaggaaagtaaaatcaatttacattgaaatcaatggatgtgtgct

SEQ ID NO: 6804241 - DNA, 70 bp, Homo sapiens
ttgtatttcactgtaactgcaaatacttaaccagaattttgaaggtttgcattgttgcaatgaagtatag

SEQ ID NO: 6804242 - DNA, 57 bp, Homo sapiens
cccggtagcttaggatgcggcccccttggttagggagggatctgctaggcaatgggg

SEQ ID NO: 6804243 - DNA, 62 bp, Homo sapiens
cagtgatggggaaagtgagtcagagagttttcaagtttagaattcattttgcccagtccctg

SEQ ID NO: 6804244 - DNA, 108 bp, Homo sapiens
cttgatttgggccagtgaagactctcagggagattgtttagctaccatggcatctgagaagcaaagctgaggccttagcaagagacagccctgctagcccaagttgag

SEQ ID NO: 6804245 - DNA, 70 bp, Homo sapiens
tcactttttgagctatgcttcatggagaataaagtcttctagaagaggagcatgggtcagaactcagtgg

SEQ ID NO: 6804246 - DNA, 79 bp, Homo sapiens
acctagctttctatgcatctgaacaatagagaggtccccatttgccacgttctctaagtctgtacagatcaacctaggt

SEQ ID NO: 6804247 - DNA, 87 bp, Homo sapiens
gctgacaagctgcttagactaatacttaggactagcgcagtgtcacttttcctaagttcagttggtcgaagtagtcacagactcagc

SEQ ID NO: 6804248 - DNA, 62 bp, Homo sapiens
ttccaaagctgctttatttagttgagcaacggtacataccattggaagaagcagcttgggaa

SEQ ID NO: 6804249 - DNA, 58 bp, Homo sapiens
gtatttagtccattgcacagtgtaacctcattataacactgtctcatggatagactgc

SEQ ID NO: 6804250 - DNA, 100 bp, Homo sapiens
gaggcaggagaatcgcttgaacccgggaggtggaggttatggtgagccgagatcacgccattgcactccagcctgggcaataagagcgaaactctgtctc

SEQ ID NO: 6804251 - DNA, 77 bp, Homo sapiens
gtggacagagggctaactgggaagcagggcaagggcttctctccctttccacctgccccgattactcccatctccac

SEQ ID NO: 6804252 - DNA, 84 bp, Homo sapiens
attgctgtggtgtgtagactgccagtaatatctcaaggatgagctgggcctagatattaccagcagtctatgcaccatagtaat

SEQ ID NO: 6804253 - DNA, 82 bp, Homo sapiens
ccagagtcacaagaagtcacatctaggagtggatagcaacccttccaggcccgaggagaggattctgttttgtgttctttgg

SEQ ID NO: 6804254 - DNA, 89 bp, Homo sapiens
caaagcttctggtaggtattctggaaaagcgataaaccatttaatcaccaccactgattaagctccttctatatgccacccctgttttg

SEQ ID NO: 6804255 - DNA, 85 bp, Homo sapiens
gtggtatgtggagggggtgggagcagtgaggtgaaagggaagatccaggagcccagctcccatgttctccaattttccattccac

SEQ ID NO: 6804256 - DNA, 85 bp, Homo sapiens
gggtacctggcattaaacaaccttgaatcaatcctggtgggattaactggactgagtttctgtatactgcacatgctatggatct

SEQ ID NO: 6804257 - DNA, 100 bp, Homo sapiens
gctttaaagagggctgagcagctcaggaagcctgtaatgtgggcataactctttggacctgatcttgatgcttctgctgctctgttggcctctgaagagc

SEQ ID NO: 6804258 - DNA, 55 bp, Homo sapiens
agagaaggatggcggtgggaggatagtcagggttctgcccccagccaaattctct

SEQ ID NO: 6804259 - DNA, 96 bp, Homo sapiens
gacacattgacgggttctactttttttcaacttccttttgttctacttaagaacaaattctctaggcaaggaagaatagaaattgtcacttggatc

SEQ ID NO: 6804260 - DNA, 59 bp, Homo sapiens
gcctcctctgtgattttgtgagccagagctccctgcttgaatgctctttccggaggggt

SEQ ID NO: 6804261 - DNA, 70 bp, Homo sapiens
tttcttgctatagcaagctttgagctttcagagaacttatatttgaaaactggatcttctatggcagaga

SEQ ID NO: 6804262 - DNA, 65 bp, Homo sapiens
actcacagcatgagcttggcagagttccccataccctctttctgtcatttggctacctgtgaagt

SEQ ID NO: 6804263 - DNA, 63 bp, Homo sapiens
cacctttggaaataaatgattatggttcgattaagtagatctctatgatgttgtttcaaggtg

SEQ ID NO: 6804264 - DNA, 64 bp, Homo sapiens
ggtgaggccatggcaagacgacctgtaagcccaggccttgcgtcccatggcctgtgatcccgcc

SEQ ID NO: 6804265 - DNA, 123 bp, Homo sapiens
tacataataaaaacaagaggctggttaatgttctttgttatgtgtacatctggttgagcagaatattgcttagctttttaccatcaaagttacacttttgactcagcacatgctttgaatgta

SEQ ID NO: 6804266 - DNA, 74 bp, Homo sapiens
gtaaaagtcggaagcattcttctgaatggcacagaaagaacattcagtaatgtgtttttccattcaacttttgc

SEQ ID NO: 6804267 - DNA, 129 bp, Homo sapiens
ggggtcaggccctttgctggcatcagaagatgacttaattactgtccaatatgcacacctgctgcatatcaagacagagattattgctctttggtgatctttgccagtaaatctttgccttgatgattt

SEQ ID NO: 6804268 - DNA, 94 bp, Homo sapiens
tccaggtgcaagaggacactccagcttttggctcaagcagaaaattatgattgaaagaagaagctgcgatgtttaaattcacccgcaatctgga

SEQ ID NO: 6804269 - DNA, 58 bp, Homo sapiens
acaaaggtgcgtcccttcagctcttctccgtggagctcggggctttctgtatttatgt

SEQ ID NO: 6804270 - DNA, 66 bp, Homo sapiens
tcagatttcctcctgtggttgctttgttcctttccaatatggcagccagtgttggaggaaagatgg

SEQ ID NO: 6804271 - DNA, 66 bp, Homo sapiens
caactgtggggtaatggatcgtagccatagaggtatacattttaggcagccattgctgcacacctg

SEQ ID NO: 6804272 - DNA, 86 bp, Homo sapiens
tataattagtttgaaccatatgacagtgttgattttgaacctttttaacctatgaaaatggcaatttcttatggttcaacattata

SEQ ID NO: 6804273 - DNA, 75 bp, Homo sapiens
gagctgggagttatagcatgtttttaaattgtttaaagtaaagctttgctgttaacaagcactcatccctggctc

SEQ ID NO: 6804274 - DNA, 75 bp, Homo sapiens
agcctgttatgtttacaaaaaggaggcttgacttacacagggtaaggctcctcatttgctagatgtggcttagct

SEQ ID NO: 6804275 - DNA, 78 bp, Homo sapiens
attctccagttgggatttgtcctggttttaacatttgcctgcaacatcagccagataattccaatattcggcaagagt

SEQ ID NO: 6804276 - DNA, 66 bp, Homo sapiens
agaggcaggttatctgggattaaacagctcaggcccccatggcccaggctggaattccaggcctct

SEQ ID NO: 6804277 - DNA, 88 bp, Homo sapiens
aaatatggaaaatcatgcacatcactgaccaaacataactcggtggccatatttacaacttggttgtgatgtcattgttaccatcttt

SEQ ID NO: 6804278 - DNA, 79 bp, Homo sapiens
caggatgctcaacaaacactgaagacctatctggtaccagctttggtgaccaagaaagaaaatcagtgaggtactcctg

SEQ ID NO: 6804279 - DNA, 71 bp, Homo sapiens
gggtatgctgtttcagaagagtagctgaacaagttcattagggggacttctcggcaccctttggcagcccc

SEQ ID NO: 6804280 - DNA, 68 bp, Homo sapiens
ccttgattagatatttttattgcaaaaagtaaaaaatatttttattgcaataaagtgtgtatttgagg

SEQ ID NO: 6804281 - DNA, 75 bp, Homo sapiens
tggggattatgagagcatccacttcacaatgattgagaggatcaagtaggatgctttatatgaaagtactctcta

SEQ ID NO: 6804282 - DNA, 75 bp, Homo sapiens
gatgttgttgatgctgctagtacaggctttgtgtagagcaagactcaaactgtaatgcaggatcaagaaagtatc

SEQ ID NO: 6804283 - DNA, 56 bp, Homo sapiens
gctgttcattaaactactgtgtgggagccccactggagaacgtctgatgaagaagc

SEQ ID NO: 6804284 - DNA, 63 bp, Homo sapiens
ctatgtggagcagcatgaacaatccagacaccaaaaagggcaaggcatgtctgcgccacaagg

SEQ ID NO: 6804285 - DNA, 63 bp, Homo sapiens
cttgtctgctacttggttctaccacggaagttgtcctggtatttggctgagtggcatgagagg

SEQ ID NO: 6804286 - DNA, 58 bp, Homo sapiens
taaataagttcaggtaaagaaatcagcctaaagtataaggtgagactgagcttatttg

SEQ ID NO: 6804287 - DNA, 95 bp, Homo sapiens
gagatggggccaggaaggggttaaagcaggaagcatcttgcagggctgttaggaaaatgatattctgctgtttgacgtcattttaattccatttc

SEQ ID NO: 6804288 - DNA, 68 bp, Homo sapiens
cacagtgggctggtgtctgattctcccctgagaaatctcaaggatgaaagattggccatgtagctgtg

SEQ ID NO: 6804289 - DNA, 80 bp, Homo sapiens
tgccatcagtaggcctgtcagagtcaatgcttcagtttcataactgtaattggattgtctgacttcctattcaattggta

SEQ ID NO: 6804290 - DNA, 64 bp, Homo sapiens
atttaaatgcttaagagggttttgcttattactattgtaagtttaccctgccaggcatgtgaat

SEQ ID NO: 6804291 - DNA, 85 bp, Homo sapiens
aagatggttgcagctgtagaggggagaaagagcaaaactccatatatattagtcttcctttatcttacagtgctgcatttatttt

SEQ ID NO: 6804292 - DNA, 93 bp, Homo sapiens
gattattaactaaatatttgttttgtgcatttacaacatggagttgctgctttaacactatttgaaagtgtacaaaaactgtcagtgataatt

SEQ ID NO: 6804293 - DNA, 59 bp, Homo sapiens
gctgggcaagtgccttgggtttagatgctatgaatggatgaatctagggtcactccagc

SEQ ID NO: 6804294 - DNA, 64 bp, Homo sapiens
tccaagcctgccccttcctgggcagggtgctggaagctagccctgcccatcggggcggcctgga

SEQ ID NO: 6804295 - DNA, 90 bp, Homo sapiens
cccgagccctggagtcctctcctaggtcctgggcatccagacaacaaatggggggcacaggccatgggaggacagcatgagaggtttggg

SEQ ID NO: 6804296 - DNA, 65 bp, Homo sapiens
gattcagccatactatcgtctcctcacttcaccagagggaatatatatgctgatggctgccagtc

SEQ ID NO: 6804297 - DNA, 59 bp, Homo sapiens
gctacattgtgtctctatctagtctgggtatttcagataaaaggaatcatatatgtggc

SEQ ID NO: 6804298 - DNA, 77 bp, Homo sapiens
ggagtaggatgtgatactccttctagtggaaataccagtcaaatgtccgtgggtcttgaagtgtcactgcatactcc

SEQ ID NO: 6804299 - DNA, 129 bp, Homo sapiens
ttttccttacattataattttatgtgttcatgatgctaaccatttggatatttggaagcatatggaaggttgaatatttcactttatatccagatgtttggtgttattcaatactgatatataggaaaa

SEQ ID NO: 6804300 - DNA, 57 bp, Homo sapiens
tatttgggaacgctgaaaaaggcatgtgtatcactctcatatcagtgttccagaata

SEQ ID NO: 6804301 - DNA, 88 bp, Homo sapiens
ggtggagaagggctgggagggggtctggggtggcctaggggtctcctcatggaagacactccttcacaaccagccctcgatgtccacc

SEQ ID NO: 6804302 - DNA, 63 bp, Homo sapiens
tttactgtttgaaaaatgaatgttagttcagaagtaccaatatggcattttcaagtcagtgga

SEQ ID NO: 6804303 - DNA, 56 bp, Homo sapiens
gtggttttctccaacccagaactctgcaagaagtaaagcttgggagagaaaggtat

SEQ ID NO: 6804304 - DNA, 113 bp, Homo sapiens
gccaagaatgagatgggggctgtgggacccgcttcaggcgcatggtgagcagatgatgcatccgtttctctgtctcccgtgtgtccgggtcaaggcggcctctggtctctggc

SEQ ID NO: 6804305 - DNA, 63 bp, Homo sapiens
gcagggggcagctgggatctggctgtgcaggaaagggcagcccggagccagtgcacctacagc

SEQ ID NO: 6804306 - DNA, 128 bp, Homo sapiens
gggcagtcagaagtggcattttcagcctgagctcctgtggagcccccaggagtggggtccagcaccagcccccagccctagggcctcctagacctgagctctcctagaacccacacctccctttgccc

SEQ ID NO: 6804307 - DNA, 66 bp, Homo sapiens
gcagaagtggtgctgtgccacttatgggcctaagccttgagaagacttggcagcctccacttttgc

SEQ ID NO: 6804308 - DNA, 70 bp, Homo sapiens
gacaaatgaatagggagtgtgatgtctctggccaagagccgtgatttgttccatgctttgttggtttgtc

SEQ ID NO: 6804309 - DNA, 67 bp, Homo sapiens
ctcaatcctaaagccattaggtgcagcagaagagggcagatatctacaacgggtggagtagggtgag

SEQ ID NO: 6804310 - DNA, 57 bp, Homo sapiens
tgctaggggtcagcaccatatctggacccttccatgacacagtggtgtgccttggca

SEQ ID NO: 6804311 - DNA, 56 bp, Homo sapiens
gtgattgtccacaggccaaactccagggggcaggaccctggagctgagggcaatgc

SEQ ID NO: 6804312 - DNA, 59 bp, Homo sapiens
ctgggcattttatctgttttgttcagtgctttatcctcaggacctagaaaagtgcctag

SEQ ID NO: 6804313 - DNA, 119 bp, Homo sapiens
ggtctggcagaaaagctgtcccaatgtccttccatctctctaggccaacagcttcctgttaatattattaagctgtggcttggaggaaacaggctggcagcagttgttttagcctgtcc

SEQ ID NO: 6804314 - DNA, 105 bp, Homo sapiens
cccaggggctctgggggaagaagaggctatttgtaaaaggaaccttatataaacctgtcctgattccttttacaaatagcctcctattcccccaggggctctggg

SEQ ID NO: 6804315 - DNA, 100 bp, Homo sapiens
gtccctgagctgtgttttgtgagcttgctccatgcccatcctcagggtgagacgtagtcctcaggatacaggagccacagaacgacattcctcaatgggc

SEQ ID NO: 6804316 - DNA, 69 bp, Homo sapiens
ctttctacaggtcagtaagacctagacagaagaatgtttgtgtttactaaacttgtaagtaagagaaag

SEQ ID NO: 6804317 - DNA, 77 bp, Homo sapiens
actcagtttacacagctctgaattttaactacacaaagataagcaaatattttgggataaattcatgagcactgagt

SEQ ID NO: 6804318 - DNA, 71 bp, Homo sapiens
tgaaaatgctcactaaataacaggaagaatgaacaactatttatatctagatggattttagtgaattttca

SEQ ID NO: 6804319 - DNA, 91 bp, Homo sapiens
tggcatcatcactgtcttaaacatgcttgcttagaatcagcttcctcccagatgctgaagctaacggctatgtctaaaaccagatgggcca

SEQ ID NO: 6804320 - DNA, 117 bp, Homo sapiens
gtcagggccacagagggtgcagagcgtggctggggatcctacctggctgtgttccaccagctggtttaggatggtctccagcacctggctctgctccatgacctccatggccctgat

SEQ ID NO: 6804321 - DNA, 63 bp, Homo sapiens
agaagaaatgtgaaggccactgtgcacatgaaacagcacagagtggacccagctatttctttt

SEQ ID NO: 6804322 - DNA, 63 bp, Homo sapiens
gggtagtggtagaacttgaatgtgaaatcaggtaagctcacctgattccagagttcctaaccc

SEQ ID NO: 6804323 - DNA, 60 bp, Homo sapiens
ctgctcttcccactcactcccacctctgtgctgaggctggggccaggcagggagaatcag

SEQ ID NO: 6804324 - DNA, 126 bp, Homo sapiens
gacagcaagttgattacctttttgtgtctcccttttcaaacacatcgctgaagccaagagtaattgtgcattcagcattggtatgaaaacccatgatcacgttaaagtaattgtagcttttcattc

SEQ ID NO: 6804325 - DNA, 90 bp, Homo sapiens
tgtgtgtgtgtatgtgtaaattgttaggtttaagatacatttaaaatgttgattagataaagataaacttataccataatacataataca

SEQ ID NO: 6804326 - DNA, 83 bp, Homo sapiens
cactggttgaactgaggggttggagagtgaggtgaaaggcagatcttccacgctttcatacctcttgaattttgaaccatgtg

SEQ ID NO: 6804327 - DNA, 69 bp, Homo sapiens
ctgccctgcctggccagtgtggctcctttccctgagctgtgatttcagcctggccctggccagtggcag

SEQ ID NO: 6804328 - DNA, 82 bp, Homo sapiens
agaagacggatcatcatctttcaggcaagtttgtaataaacatttaacgaatgaatgggttagtgatgaacattcgttatct

SEQ ID NO: 6804329 - DNA, 56 bp, Homo sapiens
tgatccaatgggagaagctgttcagtaaatgcatagaatatttctcattgtcatca

SEQ ID NO: 6804330 - DNA, 61 bp, Homo sapiens
gatgacagcaggattggatacatctcatggtcttaccatttgagatccctctgttgccatc

SEQ ID NO: 6804331 - DNA, 61 bp, Homo sapiens
tggggatggaagagaagccacgttggttttcaggaccagaaatggaattttccatcacccg

SEQ ID NO: 6804332 - DNA, 57 bp, Homo sapiens
ggaacagttgcgtcatgggcctgctggtacattgaccacagggccccgcggctctcc

SEQ ID NO: 6804333 - DNA, 90 bp, Homo sapiens
ggagagtggatgagcgccaggcatgtgcagtggcctcggcacgcagacccctgccccaggcactgcccggctctgcttcttctcgccttc

SEQ ID NO: 6804334 - DNA, 91 bp, Homo sapiens
actatgtcctgttacattttgttccacggtccagaatacgttccaatgaacacattttggctaggtggagaagtggtagcaatgaagtagt

SEQ ID NO: 6804335 - DNA, 74 bp, Homo sapiens
cttgctgagaaactgcacttgtgtgtgtgcatcgctgagcatgtaacagctacacacacaggtgttttaatggg

SEQ ID NO: 6804336 - DNA, 59 bp, Homo sapiens
gcacctgcctgggactgaagatacaagaaagattcagtttaaaattatgaggtgggtgt

SEQ ID NO: 6804337 - DNA, 58 bp, Homo sapiens
gctcctctctgtctgctgtctatagaaggaggctaatagcagcagatctggtgagggc

SEQ ID NO: 6804338 - DNA, 60 bp, Homo sapiens
tgactgtgcctggttaaaggctaccatttaagagaataaatggccaaaaccaggtggtta

SEQ ID NO: 6804339 - DNA, 72 bp, Homo sapiens
ttacatgacaaagctttggctcagagatgtggagtgaactgtgcatagcaagcttaaagccagtccatgtga

SEQ ID NO: 6804340 - DNA, 75 bp, Homo sapiens
ctttaggaacatgcccttaccttccttatataaagagtacggatctgaaagagaaattaaaggctgtttcttaag

SEQ ID NO: 6804341 - DNA, 58 bp, Homo sapiens
agctccttttctgacatagggaattctgtgtttgtttttcttattgtcttgaggagtt

SEQ ID NO: 6804342 - DNA, 130 bp, Homo sapiens
gtatcttaaatgtatcatgaaatacctggcactattgttcataaatccatgcatttcaatatatgcctattttttgaagtgcataagtatgattatttgtgtatacaggctccaagtttctttgagatgt

SEQ ID NO: 6804343 - DNA, 92 bp, Homo sapiens
aaatcaggaggcaagcagctatggtgacaaggtcaggtccagggtctctactgttctcctggccttttctcatgctggctacttcaggattt

SEQ ID NO: 6804344 - DNA, 60 bp, Homo sapiens
caccctggcagttcatcaaatggcagtgccaaggctctgcctcagtggaatgtgagggtg

SEQ ID NO: 6804345 - DNA, 62 bp, Homo sapiens
aactatgaatacctatttggggttgaattgtgttccctcaatcccaagaatatgcataagtt

SEQ ID NO: 6804346 - DNA, 60 bp, Homo sapiens
tttattctcagcaacacacatggaggtgtaatgacctaccaaagttttctgagtgataag

SEQ ID NO: 6804347 - DNA, 102 bp, Homo sapiens
tgttggtcctgaaccttgttttctgatgaccacacttgatcactctgaggttcctagctgttgtacctggagtgcagttgggaggacacccggttcccaaca

SEQ ID NO: 6804348 - DNA, 64 bp, Homo sapiens
gaccacagccaggtaaaggcatggcaggcacttggcctccaagctctacgtcctgtgctttgtc

SEQ ID NO: 6804349 - DNA, 130 bp, Homo sapiens
gcctctagccttttgttcagtttctcctgcttagggcacctttcatcccatctagatgtgtctctctttaactattctaggagttgataaaagggctaggaagtaggaagttgggaagaaggggaggggc

SEQ ID NO: 6804350 - DNA, 68 bp, Homo sapiens
atcagaggatggcctccaaagaattccctggacattatgggaattacattgttagccttcctactgat

SEQ ID NO: 6804351 - DNA, 129 bp, Homo sapiens
gtgctgtgcatatgcaggtgtgcacttatgtgtgtgtgtgtgttgtgcatgcacatatatgttgccttatggggcacatgtgattgcatgcatgcgtgtttgtgcttgtgcatatatgtgtgtgcacat

SEQ ID NO: 6804352 - DNA, 68 bp, Homo sapiens
catgagataatttttctccagtcttcatcatgagaatcttgtgtgtctcctggaggaaaaatctcatg

SEQ ID NO: 6804353 - DNA, 80 bp, Homo sapiens
gttttttaagttgagccaaaatgtttaataagatatttctttgtttatgaacctttgtgttggacctgggcttaaaaagc

SEQ ID NO: 6804354 - DNA, 76 bp, Homo sapiens
gcagagcaaggatggctttgtgcaccatgattttcacttccaaatttcaaacagggctgtcccaaaccttgcctgc

SEQ ID NO: 6804355 - DNA, 55 bp, Homo sapiens
ggctcaggcatagagatggaggattttgcaccaaaggtctgagttttgccaggcc

SEQ ID NO: 6804356 - DNA, 90 bp, Homo sapiens
ggggaatttttaaggtgaccaaatatcagatagatttatctagagttttatatataggtatttctgtgtatttgtgacctgtatgtctcc

SEQ ID NO: 6804357 - DNA, 63 bp, Homo sapiens
actgcagagttatcaacagatctgttttctccatggaaaacaggagttttggtaggctgaagt

SEQ ID NO: 6804358 - DNA, 55 bp, Homo sapiens
gcagacctcctgtttctgggctgggtcttcattcctgggaaaaggagtgtctagc

SEQ ID NO: 6804359 - DNA, 65 bp, Homo sapiens
cgcagccccgcacagcaggggaacccaggtcttccttccctcccttagggctgggtgggtgtgtg

SEQ ID NO: 6804360 - DNA, 81 bp, Homo sapiens
gctagtgggatcttgtttaatattgtttatttcttgtccaaggcatgatcaaaagcagtataaagcagggatcaagatggc

SEQ ID NO: 6804361 - DNA, 61 bp, Homo sapiens
gcatagtgtcatctcctctttgttcagataagacaactgaggcagagtaagatacatgagc

SEQ ID NO: 6804362 - DNA, 89 bp, Homo sapiens
acttttgtaagatttccttcagtagagctattggaaacacagctgctaaataaactaatgctttattttaggaatattttaactagggt

SEQ ID NO: 6804363 - DNA, 80 bp, Homo sapiens
agtatagaataatggctaagagcacaggtgctggagcccagatgcctgggttcagatcccagctctgtccatttctagct

SEQ ID NO: 6804364 - DNA, 60 bp, Homo sapiens
taactagtcatgtcataacaccatcaaaatgctaattaggttgtctggcatgatttgtta

SEQ ID NO: 6804365 - DNA, 63 bp, Homo sapiens
gggcatttacttttgaaaatatagaccctacttataaaagtcaatatttcaggtagtgtgccc

SEQ ID NO: 6804366 - DNA, 104 bp, Homo sapiens
attatattaagatgcaataatttctaatgtgtcttggagttttaatgtcattttatgatgtttgaacactaaggctatttctataattgtcaaattaatctgat

SEQ ID NO: 6804367 - DNA, 65 bp, Homo sapiens
gggagtagcaggctggtccgtccacattccatcaggccctgggaaacttggatgccagcactccc

SEQ ID NO: 6804368 - DNA, 70 bp, Homo sapiens
ccagatagtaaatgttttagattttgtgagccatacggtctctgtcacaattactcaactttgctgctgg

SEQ ID NO: 6804369 - DNA, 75 bp, Homo sapiens
ttcatggactctgtcactccaacctctacggcaggagttcttaatctggggaagaagttggaggatgtccatgaa

SEQ ID NO: 6804370 - DNA, 81 bp, Homo sapiens
tcctaacactgagaactgttggtggtccttctcccatgatggtgaaagcagatacactaatcatgtgctcagtgaaaggta

SEQ ID NO: 6804371 - DNA, 56 bp, Homo sapiens
actggctggagttgccaaggctggaggtaaggccaaaagcacttcacccagctagt

SEQ ID NO: 6804372 - DNA, 106 bp, Homo sapiens
taactgtgggtgtggttatttgcatatgaagctgacttaaataggtgagatgtctacaaagttttaaggagagttttactgccaaaataaccataagcttgggtta

SEQ ID NO: 6804373 - DNA, 66 bp, Homo sapiens
gtcatggagaaccttgtaggccacagtacatacaaggctttggagggttcttagcaaaaaagtgac

SEQ ID NO: 6804374 - DNA, 62 bp, Homo sapiens
ttcattggcttctctaccgaattagttctataatttctctcatctttggggaagctcgtgag

SEQ ID NO: 6804375 - DNA, 73 bp, Homo sapiens
gagttaaacatgtaagttcagatcaccatcatgaaacagagctgaaggtgcttcttttattgcagtataattt

SEQ ID NO: 6804376 - DNA, 59 bp, Homo sapiens
gagaaatttctctctacttctgttctcaaaaggcatttcggatgtgagagaatcttctt

SEQ ID NO: 6804377 - DNA, 68 bp, Homo sapiens
cttcacagtcacagccattcctctagtgggccccatcctgggtccatctggatggtatgtgtaagagg

SEQ ID NO: 6804378 - DNA, 58 bp, Homo sapiens
tgctctctcaggcctggcccacatcttccagtcaatgtgaaaaccaggttttagggca

SEQ ID NO: 6804379 - DNA, 94 bp, Homo sapiens
tgtcttgatcagtagtgtgagaacggactaataaatatatcatgctttgaggtatatattgttagttttcaatacgtatcaactaatcaaaaca

SEQ ID NO: 6804380 - DNA, 64 bp, Homo sapiens
atagaaattttgttttatatgagctaacagatggatcctgaaagctatggaacagagtggctgt

SEQ ID NO: 6804381 - DNA, 71 bp, Homo sapiens
tggtctcggacagggtttgcaaggacttcggagctaaccagtttggagccataaccctttcgtacttgcca

SEQ ID NO: 6804382 - DNA, 55 bp, Homo sapiens
acaaccacccaaacctttctctctgcccaagccagagccacttttgggtgattgt

SEQ ID NO: 6804383 - DNA, 57 bp, Homo sapiens
agccagtccatcactaatgggtcatttaccttgattgactcagtgttaggacttgct

SEQ ID NO: 6804384 - DNA, 69 bp, Homo sapiens
tctctttaactcccattctgtcctttttcataaaagcagccagagggacactgtataagttagagtaga

SEQ ID NO: 6804385 - DNA, 75 bp, Homo sapiens
gaatgagggtctgggcactcctggggacagctgagtggtaggactcctgggtccccagggggcaggtccatcttc

SEQ ID NO: 6804386 - DNA, 67 bp, Homo sapiens
gctctaaggccagccagcaaatctgtgggagtgattttaacccacgggggagcggcaggcctagggc

SEQ ID NO: 6804387 - DNA, 72 bp, Homo sapiens
gatggagactgaatgaggggtgatctgggaccctcccacgggaccccaggaagccatatttatttcttcatc

SEQ ID NO: 6804388 - DNA, 70 bp, Homo sapiens
gcactgggcctggttcgggaagctgacaatcaaacaccctgcagcatttgctgaagcaggagccagctgt

SEQ ID NO: 6804389 - DNA, 61 bp, Homo sapiens
ggaaatttcagtggacacgagctctcccgaggaaaggtctcacagttgtccactgaaaacc

SEQ ID NO: 6804390 - DNA, 90 bp, Homo sapiens
ggctgggctcctatctgtgcctccgtaacacaccaggcccactttctctccctggttcctggggaggcacagagaagagtgtgaccagtt

SEQ ID NO: 6804391 - DNA, 58 bp, Homo sapiens
tcagaatctctggaggcttggccatgtgcattttatcaagctccacaaatgattttga

SEQ ID NO: 6804392 - DNA, 70 bp, Homo sapiens
tagcttccacacttctattcagtgatgcttagaattaactcaggcttctgtctttaggagttggtagctg

SEQ ID NO: 6804393 - DNA, 66 bp, Homo sapiens
caggggatgggggtggaggagaggggctctcttttgatgtccctgagggtctctctgatgtccctg

SEQ ID NO: 6804394 - DNA, 83 bp, Homo sapiens
gcttccattctggagttctccagagacccattcactaaaagagaaacaggctgctctggggttaagcttccatggatgctggc

SEQ ID NO: 6804395 - DNA, 62 bp, Homo sapiens
gaggcctggagagttggaagatggactctgaggatcaagtctactcttgctttcctgggctc

SEQ ID NO: 6804396 - DNA, 65 bp, Homo sapiens
tgaagttttctggttgattaagatctatgccagcaggagggtataaaatcaccagcaatacttca

SEQ ID NO: 6804397 - DNA, 56 bp, Homo sapiens
gctttacgggaggtttgtcccatgttactggagataaattactatctccctagagc

SEQ ID NO: 6804398 - DNA, 62 bp, Homo sapiens
tctcatagctgtagtggtgaatgattttggcttcacaaaagaccatgtttacagctaggagg

SEQ ID NO: 6804399 - DNA, 75 bp, Homo sapiens
ctcatggttgaatatgacatttttctgcttttccctctaagaagtttttgagaatgttaatgttgaagtatgcag

SEQ ID NO: 6804400 - DNA, 65 bp, Homo sapiens
ggaacgagatcttttatttcctttgtactgtcttggaagtgttaggagaaaggaagatattttcc

SEQ ID NO: 6804401 - DNA, 79 bp, Homo sapiens
ctgtaatctgaaacactttcaattacatatatagttagaaatgctagaatatgttgactagaaagtgtaagatgtgcag

SEQ ID NO: 6804402 - DNA, 67 bp, Homo sapiens
gaacatggctctgttttttatgctctattgaaaatgatcatcagaagcagaaactgggcttgtgttc

SEQ ID NO: 6804403 - DNA, 72 bp, Homo sapiens
ggcacaaagtggcaggagaggagacttgtgacctgcagcttccaggttgcctctcccctctctgtcctggcc

SEQ ID NO: 6804404 - DNA, 83 bp, Homo sapiens
gggccagcggcctgtcctcgggttcactgctatttctgccaaaggggagaggtaattatagcctggccgctgccagctggccc

SEQ ID NO: 6804405 - DNA, 66 bp, Homo sapiens
gccaggaggggcgggttcttggcacatggaattcctgagtagcacaagtatctgcttttcctcagc

SEQ ID NO: 6804406 - DNA, 63 bp, Homo sapiens
tgcagagggagtgacggttcactaaagagataatgtgataagtggccttcttctcccttagca

SEQ ID NO: 6804407 - DNA, 68 bp, Homo sapiens
agtgagcttctgacagatgcacctgtgacatcactctgccatccctggtgacactgtggatgttcact

SEQ ID NO: 6804408 - DNA, 74 bp, Homo sapiens
gtagagatggggacttgccttgttgctcaggctgttcttgaactcctgagctcaagcaattcacccgcctcagc

SEQ ID NO: 6804409 - DNA, 104 bp, Homo sapiens
tgggagacactatcttaactcatctcattactcaagccatttgttgtccttcaggctttgacagccaggagatgggaaagtagcagaggtgatgtgatctctca

SEQ ID NO: 6804410 - DNA, 88 bp, Homo sapiens
gggacagtggatccaaggacactgttcatggggaggggattgtttggaatcccctcctcccagaatacgtgtggatcctgcttttccc

SEQ ID NO: 6804411 - DNA, 71 bp, Homo sapiens
ggagcgggcatgttctctccagactgcagtgggtatcaggcccctgctgctggagaggaaatggctgtgcc

SEQ ID NO: 6804412 - DNA, 97 bp, Homo sapiens
ttcattactctttttatgtttctgtcttttttattattttggagtaataaatatttatttgttcttatgatgaagcactgattcatagattgatgaa

SEQ ID NO: 6804413 - DNA, 67 bp, Homo sapiens
tcctctgaattcgctctgtgatttggcttcttaaaactaacttacatctcacagagttcttacggga

SEQ ID NO: 6804414 - DNA, 77 bp, Homo sapiens
ttagagagtttggctttcaggctggaaatctaagacttggaagaactaagagactagcctcaagtcacagtctctga

SEQ ID NO: 6804415 - DNA, 76 bp, Homo sapiens
atgcaaacataatgtatgtgcaatgtttatatgtgtacacatacacacatatgtatgtacatacataatgaggcat

SEQ ID NO: 6804416 - DNA, 60 bp, Homo sapiens
acagagccactttggtgcctacccctccacaagtaggtaggcacatccaggtagctctgt

SEQ ID NO: 6804417 - DNA, 61 bp, Homo sapiens
gagttcagtgcctgtccacagcttccagtaatgagaagaaggtagaagacacactgttctc

SEQ ID NO: 6804418 - DNA, 65 bp, Homo sapiens
tgggtaaggtactgtagatctgtaccagccttcatgtgaatagcacctcacagtgctcttgccta

SEQ ID NO: 6804419 - DNA, 60 bp, Homo sapiens
tcaggaaactgtcaagtgggatagaggtgatttggcctatttagaagacagccttcctga

SEQ ID NO: 6804420 - DNA, 93 bp, Homo sapiens
gtctggcacttcctagtgagatgaacccggtacctcagatggaaatgcagaaatcacccgtcttctgcgttggtcacgctgggagctgtagac

SEQ ID NO: 6804421 - DNA, 63 bp, Homo sapiens
ctgagctacatgtgtttgctaaccctgcaagatgttatctctgggccaggcacatgaagccag

SEQ ID NO: 6804422 - DNA, 66 bp, Homo sapiens
tgggtgtcaagactacctttctggagtccttagagagactcccggaagagtatctgaagtttccca

SEQ ID NO: 6804423 - DNA, 90 bp, Homo sapiens
aaagggatgaggatttcagatggcacacagagcctgctgagcgcatagccatgcaccgctgtgctgtgccttttcctctgacatcccttt

SEQ ID NO: 6804424 - DNA, 78 bp, Homo sapiens
tatgaagtccctgaaacacagctttacttgttaaaacactacccccaaagaggtgcactgtctaattaggtcttcatg

SEQ ID NO: 6804425 - DNA, 67 bp, Homo sapiens
ggacttttctgagattttctggtaatgccaatacaatgcccgctgccagagattttagaactagtcc

SEQ ID NO: 6804426 - DNA, 69 bp, Homo sapiens
aatacttcatgaaagttgggctgtttaaaaaacatactagcaacaagcccacattggtgcatgaatgtt

SEQ ID NO: 6804427 - DNA, 80 bp, Homo sapiens
accagaagcctcatcctctctagtgtttaggcaacatatatatgcaatcttattgcactggggaaaacaggcttcttcgt

SEQ ID NO: 6804428 - DNA, 103 bp, Homo sapiens
cttccaattctggtttttctaattcaaaagtctgttgtcttttccttctagcagtgtttctgaaaatgagatgtgcagacctgggttagaaccactagggaag

SEQ ID NO: 6804429 - DNA, 62 bp, Homo sapiens
tctgggacaggggagcagaggggatgggttacccctcagatctctgcagccctgcttccagg

SEQ ID NO: 6804430 - DNA, 60 bp, Homo sapiens
gatcaccttgggctgacacaacgatctactccaccagcttgttctatcagctcaggtgtc

SEQ ID NO: 6804431 - DNA, 69 bp, Homo sapiens
gtggttcatgcatctgttcagagctgtcgatcaaaaaatgttcagagttctctgtccagatgagaccat

SEQ ID NO: 6804432 - DNA, 65 bp, Homo sapiens
cacttttcaaagtactactcagttcagcagttcctttctgctgctgtttgaagactttgtaagtg

SEQ ID NO: 6804433 - DNA, 98 bp, Homo sapiens
tcaagcttttgttcttttgaggcctggtttccagcatccttgctgctaaatttggagaggatcaggttgccaggactcgggggccaggagagtcttga

SEQ ID NO: 6804434 - DNA, 64 bp, Homo sapiens
ggcagatgagtggtgggagtgagtgtttggcacaaacaagcttctctctttgcactcacaggct

SEQ ID NO: 6804435 - DNA, 80 bp, Homo sapiens
gtgtctccagcactgtataggtgtctggaattgagataagaatcaatttcaatacaaaatacattttttgcttaaagcac

SEQ ID NO: 6804436 - DNA, 84 bp, Homo sapiens
gagccatgtgcagtcgctggaccatcagagccttgagctgcagcaagttctgagattcagtgactgggagatttacgaaggctc

SEQ ID NO: 6804437 - DNA, 101 bp, Homo sapiens
aattgcctttgtccaagaacattcctgaatgggcacatttacttatgaaagtgaagtcacctgggttctggctggatggctttgagatagaaaaatcaatt

SEQ ID NO: 6804438 - DNA, 85 bp, Homo sapiens
tgggtggcacttaggaagcgagcatctaactagttgcagggccatgtgcaagtcaccagtttccatgcctcggtttccccaccta

SEQ ID NO: 6804439 - DNA, 68 bp, Homo sapiens
gctgactctcctgagatggggagtttcctgaatctcaaacatcaagattccccgctgggtgagtcagc

SEQ ID NO: 6804440 - DNA, 129 bp, Homo sapiens
acctagccttggggacttctttagaaagaaggcatattttcactgaaccaaagtaaatcttaattacatatttgcttaccatggagagcctttttgcttctgaatgggaatctgtaaccgataaaaggt

SEQ ID NO: 6804441 - DNA, 64 bp, Homo sapiens
ggctattttttgttagtggagaataatggggtcttttgcattttcttccaccaatatccaagcc

SEQ ID NO: 6804442 - DNA, 78 bp, Homo sapiens
ggggatggggggaagggttgttaatgatctgagtttattaaatgtcagaattatgtaggcctggttctttcctctgcc

SEQ ID NO: 6804443 - DNA, 89 bp, Homo sapiens
ggacttgagagctccctgtggtttactctgtggctagaaaacactgccggccagatggatcacaaatgtctatggtagcttagaagctc

SEQ ID NO: 6804444 - DNA, 78 bp, Homo sapiens
ccagttcagctcttcttcttgtctactgtgtgaaatagccgttcatttttcaaactgtttacagtgagataggactgg

SEQ ID NO: 6804445 - DNA, 63 bp, Homo sapiens
gggtcttgaagtttagcaatcttaggatcacctggaggccttacagattgctgagctctacct

SEQ ID NO: 6804446 - DNA, 77 bp, Homo sapiens
agtctggtgcaaatatcatggtgcgcacaaactaggctactcactgtttcctgcacacgtgttatattcacccaact

SEQ ID NO: 6804447 - DNA, 121 bp, Homo sapiens
tctacaaatcctactacttagtatcctgggcacattttgactagtgttttgaatttagaaataactttatcagctatgtattagtcctgacagctaaaaatagtattggaaaatttatagg

SEQ ID NO: 6804448 - DNA, 76 bp, Homo sapiens
aggaaaggtttggcttttcagtagatgatgaccaataatttaccatctctgctgagataaaggcaaattttgcact

SEQ ID NO: 6804449 - DNA, 67 bp, Homo sapiens
gggctactgcacagtcatttcctctcaatgcactatttacattgtcaggaactatgattatgccccc

SEQ ID NO: 6804450 - DNA, 64 bp, Homo sapiens
tagaatagtcaggagtaggagttttggagtctacctgcccagggtttaaattctgactatgctg

SEQ ID NO: 6804451 - DNA, 59 bp, Homo sapiens
gggcagccccagcgcgttggctccaggagcccgggtgggggccgaccgttggggtgccc

SEQ ID NO: 6804452 - DNA, 69 bp, Homo sapiens
tgtggtgggcttcatggagttctacaccaaggaggtacttgggggacgaccagggagccccctaccgca

SEQ ID NO: 6804453 - DNA, 65 bp, Homo sapiens
actaattccacaattttacaagttaaaaatattcttagttttagcttgaaagttttggaggttgt

SEQ ID NO: 6804454 - DNA, 79 bp, Homo sapiens
ctttgacatcatctggaatgtcacagcaggagtattctttgcaaactagtgcaagggttggatttattccatgtcaggg

SEQ ID NO: 6804455 - DNA, 74 bp, Homo sapiens
tcccacacaggcagcggctggctcagtgcaactccagagactaggagctgcctgccatgccgctggtaagggga

SEQ ID NO: 6804456 - DNA, 73 bp, Homo sapiens
aggaaggctccagctcgtggctcccagccaggtcctgagacttcagttgtgaaagctgagctggggcctccct

SEQ ID NO: 6804457 - DNA, 108 bp, Homo sapiens
ggagacttctgactaaggaaggtgagagtaattgagatttgtatgaagggtagaactttcatagacccagaactcattaacttcacatatctcagagtagaagcatcc

SEQ ID NO: 6804458 - DNA, 64 bp, Homo sapiens
cagtatttttaaaggctggattttagaggtgacaactatgtaagatccaccttgaaatggactg

SEQ ID NO: 6804459 - DNA, 65 bp, Homo sapiens
tgggcacccaggcatcacgggcatgtggcctcccatgggcggcctcattccaggagcaggtccca

SEQ ID NO: 6804460 - DNA, 60 bp, Homo sapiens
agccctggggtgcagaaccatggaaatgataatggatgctattggtggtgaccccaggct

SEQ ID NO: 6804461 - DNA, 91 bp, Homo sapiens
gatgtttggtccccagtgttccctcgggttcatggggaggatggcttggagggggcaaacatggagtcgggggaacatatgggaggctgtc

SEQ ID NO: 6804462 - DNA, 60 bp, Homo sapiens
gtcaggaagcaaggttgggcatttgtagacaatcagtagcccaccctccaattctatgac

SEQ ID NO: 6804463 - DNA, 94 bp, Homo sapiens
tgtagaaatttggaaatgtagaaaagcagattgaagcatttgagggtattttctttgaagttggtctttcttttacatatttgtgatttttata

SEQ ID NO: 6804464 - DNA, 63 bp, Homo sapiens
agtccaataacctctttccttcttattactcatctgtttttgaggggaagtagagttttgatt

SEQ ID NO: 6804465 - DNA, 80 bp, Homo sapiens
ggtttaacctgggaagcagctgagcttcaggaatggggggctgggcccagagtctggagttgaagttcttcccccagacc

SEQ ID NO: 6804466 - DNA, 83 bp, Homo sapiens
aacttcttatgaaaacagaattgtacaccagggagatagattataatttccttgggaataataattctgagctttcagacgtt

SEQ ID NO: 6804467 - DNA, 64 bp, Homo sapiens
ttggcctggagaggcgctgcagaggaccctgcacatctggtcgttctcagtacttccaggacag

SEQ ID NO: 6804468 - DNA, 84 bp, Homo sapiens
gacaggtgtgccatgattggaaggaagccaaggaaggtttctaggatgctggtgacgttctgtttctccatcaggatgcttgtt

SEQ ID NO: 6804469 - DNA, 80 bp, Homo sapiens
tgattatccattcaggttaaatcaggcatcatttcagtcacctccaggtattaatgtgtatgatataaattggaaagtca

SEQ ID NO: 6804470 - DNA, 55 bp, Homo sapiens
tcttgtcctgctgagcggttctttctgtagagcatccatcggccaggacccagga

SEQ ID NO: 6804471 - DNA, 99 bp, Homo sapiens
gttacagatgccggttgttgctactgatcaggtttgctttagtgggaatggtgagattagaggacctgggtggtggattggatcaacagcatctgcaac

SEQ ID NO: 6804472 - DNA, 74 bp, Homo sapiens
gccaagcaagttgaatgataatactcccctgggacaaaaaggtgttccgataagttatgtaacttgctcaaggt

SEQ ID NO: 6804473 - DNA, 61 bp, Homo sapiens
ctaagaaggaaaaaacctgctagctgtccagtgttgaacaggtattgatttttcttctagg

SEQ ID NO: 6804474 - DNA, 59 bp, Homo sapiens
cagagcagagccagtgacctgggacacagcttcactgacactcagtctggctctgcctg

SEQ ID NO: 6804475 - DNA, 106 bp, Homo sapiens
cctgtcttttttttttagttcagcactttgttttgctcatccagaaacagccccttttagtgaggatgagcaggggagaggggatgcaagaaaaatcagttacagg

SEQ ID NO: 6804476 - DNA, 78 bp, Homo sapiens
gtcttccacttttctacccactgtgacaatgatcttcccaggattctaagtcaacccggtgaggtaagcaggggagac

SEQ ID NO: 6804477 - DNA, 61 bp, Homo sapiens
caggcgatggttctggctgcttgtattccagcccgaggatgcagtgcccagaccacgactg

SEQ ID NO: 6804478 - DNA, 85 bp, Homo sapiens
gaagaaagtatcagtggtactctcagatgtttaattggcctgcctaagagcttctaggcctaagagatactactgtgatctcttc

SEQ ID NO: 6804479 - DNA, 58 bp, Homo sapiens
gagctatttcttcgggattcaagctagtatgcaactggctaaacagtggagaaagctt

SEQ ID NO: 6804480 - DNA, 72 bp, Homo sapiens
cacagccatcttctcaagcagcatcctgtgcaactaacgtccgcagaaggttgtttgggaaaggtccctgtg

SEQ ID NO: 6804481 - DNA, 66 bp, Homo sapiens
cccattgtgatcattgtagtttcccactgaacaaacaacagaaactctgcagtgacttataaaggg

SEQ ID NO: 6804482 - DNA, 102 bp, Homo sapiens
tctaaagactgatgggcatgaaaataacattgttgtgaataagtgagaaagtaactaacatactagtcatataatatgttattcgtaattattggtccaaga

SEQ ID NO: 6804483 - DNA, 57 bp, Homo sapiens
cttttccagaatacctccctgggagtctccgtctgcacccaggagagcttggagaag

SEQ ID NO: 6804484 - DNA, 103 bp, Homo sapiens
gtttattttggaattgaatgtcctttagtaaaaacaacccatgtctgctaagggctatggatataactctttttactgaagtattcaattcagttcaataaac

SEQ ID NO: 6804485 - DNA, 59 bp, Homo sapiens
ggcagaatgaggcttaggaatgcatttcacttaattgatagacctgtcttgtttctgcc

SEQ ID NO: 6804486 - DNA, 118 bp, Homo sapiens
ttgcttgtgacaccgtgaagataggctacaactctccacatttgctaggtctactaagagtctatacaaacaagcttatggaagtgcaaattgtgtgatgagtgtggctcacaggcaa

SEQ ID NO: 6804487 - DNA, 73 bp, Homo sapiens
ggcagcactgactccaggcctctggctgcttagtcattctccatgaaggcagcaagtgtctgcagtgccggtc

SEQ ID NO: 6804488 - DNA, 80 bp, Homo sapiens
cctcactgcagggccctcattcctgtccttcttcagcaccagctgccttggaccccagggaatgagctcagcaagcgggg

SEQ ID NO: 6804489 - DNA, 122 bp, Homo sapiens
caatgtccacatggagatccaaagccttctgtctgttctaggcttgctgagcctcggggtggacctgggcctgctaacctgaaacggagcatgagcctggcttgattttcacaagggcgttg

SEQ ID NO: 6804490 - DNA, 89 bp, Homo sapiens
gctgggtgctgtgggtgaaggaggggtctgtgcaagcatgtgcacatgtgtgcagcctctgtctttggtgccagacgtaggtatccagc

SEQ ID NO: 6804491 - DNA, 57 bp, Homo sapiens
gaccttaggttgttcatctgttaaatgaacggataggaccaggtaacctctaaggtc

SEQ ID NO: 6804492 - DNA, 70 bp, Homo sapiens
agaggccttcacttatttaagggaatgtcaccagtaaacttatatccctcccatgactgtggaggtctct

SEQ ID NO: 6804493 - DNA, 82 bp, Homo sapiens
gccccgccccgcgcccggctccctgctcccggcgggctcgggcctcgccgcttgccgtagggagccgggatgctgggaaggc

SEQ ID NO: 6804494 - DNA, 65 bp, Homo sapiens
cctgtggctctctttggaggtctggccaaactgacccaccagtgctcctcaggaccagccacagg

SEQ ID NO: 6804495 - DNA, 59 bp, Homo sapiens
tatgcattgtgagactgtgggaatggcctcttcagtctccccaggatctccagtgcata

SEQ ID NO: 6804496 - DNA, 72 bp, Homo sapiens
gcttagtgtgggctgacagaggagtgctgggatcttaccatggaactagcttcatgcttcaccacgctaagt

SEQ ID NO: 6804497 - DNA, 64 bp, Homo sapiens
ggggcaaggctgggtaacctgtccactgcctgatgtcagagtggcagagaccccagccagccct

SEQ ID NO: 6804498 - DNA, 61 bp, Homo sapiens
tagaaatattccttgtggctcgtaggctgcctatgcggtaaagacagccttcaggattctg

SEQ ID NO: 6804499 - DNA, 66 bp, Homo sapiens
ggaagtcttggcagtgatgcagcttgttcattggctgaacagctataatcatctgtccaaacgtct

SEQ ID NO: 6804500 - DNA, 61 bp, Homo sapiens
atgaacctttgggagggtgacagtcattaggatggacagatgttacagtccaaatgtttgt

SEQ ID NO: 6804501 - DNA, 85 bp, Homo sapiens
gctcttccccacaggggctacctggccagaggctgctgggtcaggcagtgctcacctgtcaggtcaaggaggcccagggaggtgt

SEQ ID NO: 6804502 - DNA, 68 bp, Homo sapiens
agaattgtgtttcagggtacttgatctgattaagcatccagatccaagggcatgctgaaataagttct

SEQ ID NO: 6804503 - DNA, 59 bp, Homo sapiens
gctgtcaaggtagaaaacagagaatttctttataacttgcaatttctacagttggcagc

SEQ ID NO: 6804504 - DNA, 83 bp, Homo sapiens
agagtgcatgcagtggccgatattagaggtaaagggttggaaacagctccaggtagtgccttatcgtttcaatgtgtaacttt

SEQ ID NO: 6804505 - DNA, 87 bp, Homo sapiens
ccatctcctggcaatgcccctgagggctgcacctgggctcacaccttcagagatggtgctcacccctacagggcattttcaggatgg

SEQ ID NO: 6804506 - DNA, 103 bp, Homo sapiens
gaataattgcattagtaacttgataagtattctctgcattctcagtgtggtcctgggacagccagcatgataatcacttgaggttactcattacaaattattc

SEQ ID NO: 6804507 - DNA, 64 bp, Homo sapiens
gctggcttgtactggtatcggctaaagaattcccattggaatcagcccacatctagtcattagc

SEQ ID NO: 6804508 - DNA, 129 bp, Homo sapiens
gcaatatacacaaggtaatgtttctcaaagagtttccattgaaatgctaattcctcacagtgccccatgaaaaaggaattctgcatgttcagttgggtttgagaaatgctgcatctggtatcctctctt

SEQ ID NO: 6804509 - DNA, 57 bp, Homo sapiens
tgaaggcctaacttccagtgctccatactgtggctgaatttggagatagagtcttta

SEQ ID NO: 6804510 - DNA, 88 bp, Homo sapiens
atcattcagataaaggctgacttctccagatctaaatatttagtcacattagtattttagtggaaaagtcttttgaaaatttgaaggt

SEQ ID NO: 6804511 - DNA, 90 bp, Homo sapiens
gtaaaagaatataatatgctttttttgcctaatggaactttagaacttcgttttccaccagagggcaaaatgaagcttatataagtttac

SEQ ID NO: 6804512 - DNA, 94 bp, Homo sapiens
ggaactttggtgtgcctatagccacttctaaaatccgggcattccttccaaatcctgttcacggtgtgttgttaggacacaaatccagatttcc

SEQ ID NO: 6804513 - DNA, 84 bp, Homo sapiens
tggtgttgtttctgtcactattgagtggatatgtggctacttctagcttagtgtccagaatgtgtggaaattcatgaaacacta

SEQ ID NO: 6804514 - DNA, 101 bp, Homo sapiens
gagaggagaagggttggggagctggtgtgtcctgtccccttgctgctgacagtgactgtcatacagacaggactcaactctctgtccatttgtctcttttc

SEQ ID NO: 6804515 - DNA, 60 bp, Homo sapiens
tgggtaggaggagggcatttgaagtagttgcttctacttttattattgcccctccatcca

SEQ ID NO: 6804516 - DNA, 89 bp, Homo sapiens
aattccttgatactaccagagacccttctcagtggccatgactcactgtggctgtccctggggaaggggcctctatgtggacaggagtt

SEQ ID NO: 6804517 - DNA, 69 bp, Homo sapiens
catgagccaggtacagccctcaaccctcaaccatcatgggagaaggctgagggctgtacctggctcatg

SEQ ID NO: 6804518 - DNA, 60 bp, Homo sapiens
gcagagctgggtctgtatccaagcctctggctcctgctacagcatagatagcagctctgc

SEQ ID NO: 6804519 - DNA, 55 bp, Homo sapiens
ggcatttagagggcttttctgatggccactgaaggagagagagccctcagatgtc

SEQ ID NO: 6804520 - DNA, 77 bp, Homo sapiens
tcctttatttagaaagctggaggaattctttcgggtaactcattttcagagtttaatatccttcaactttccaagga

SEQ ID NO: 6804521 - DNA, 81 bp, Homo sapiens
aaatgaaatggtttgtcttaaatgaaagtgtatctgtggtagcatagttatatccagtctttaaaatggatcatttcattt

SEQ ID NO: 6804522 - DNA, 55 bp, Homo sapiens
gattttattagcccaaactttgaggcttttattgcctttactgggaaatagaatc

SEQ ID NO: 6804523 - DNA, 129 bp, Homo sapiens
ttaataaaggtgctaaaagactggaaaatgggctgaatttcatgaaatgagtgcaaattcctactcctgggaccaagaaattttactgaaatttgtgtgccctttctaagttatttatttttataagaa

SEQ ID NO: 6804524 - DNA, 57 bp, Homo sapiens
gattcagaggtggcaggggtgtccagcagggctgggtgtcaggagccagttctagtc

SEQ ID NO: 6804525 - DNA, 71 bp, Homo sapiens
ggcctggctcttgcccagcctgtatcaacaaaaagaagaagtggggctgaggagacaggggctcccaggct

SEQ ID NO: 6804526 - DNA, 100 bp, Homo sapiens
tacctcagtgagactcctggccagtaagagataggaggcagaaagaagccaacaggaaaactctgctcctatcctcctgctgacaggtagttctgaggtg

SEQ ID NO: 6804527 - DNA, 83 bp, Homo sapiens
tttaatcttgagagatactacatgaatgggaattatgcttaatatcatagtagtttaccattgtgtagtacttcacagttgaa

SEQ ID NO: 6804528 - DNA, 62 bp, Homo sapiens
cccactggagggacgcagacactgagaccccaaggagagtggctgcagaggcccccagtggg

SEQ ID NO: 6804529 - DNA, 58 bp, Homo sapiens
ggacggggcagccagctggtggccactaacatagcgccatctgctgggtgccccggcc

SEQ ID NO: 6804530 - DNA, 66 bp, Homo sapiens
taggaaaaatacagaattatatgacactgtgtgtgtgtgtctgtgtgtgtgtgtgtgtttctcctg

SEQ ID NO: 6804531 - DNA, 83 bp, Homo sapiens
aagtaatgtagctgtttatgcactcctgcctctgaattccttttaactggggcctgaggagaagtgcataagcaacattactt

SEQ ID NO: 6804532 - DNA, 84 bp, Homo sapiens
gccatatgacttgagaaggctggagttaggaaaagataaggtatttattcctgattcctggcttgatgttctttgtgtgtgtgt

SEQ ID NO: 6804533 - DNA, 55 bp, Homo sapiens
ggggctaggtctgatcagagaagcaagtcctacctgtgtttacctgcctggcccc

SEQ ID NO: 6804534 - DNA, 57 bp, Homo sapiens
aatgcctttccactgggtatcaggagtacttgagcagctattagtggaagaggaatt

SEQ ID NO: 6804535 - DNA, 69 bp, Homo sapiens
gatgaaagttgttagattctggaatgcttgcatagatgttttaacctatgcagtttaactaattttatc

SEQ ID NO: 6804536 - DNA, 64 bp, Homo sapiens
gaccattggcacagagctttttacttggctttggaattcaggggagagctagtgtgctgtggtt

SEQ ID NO: 6804537 - DNA, 126 bp, Homo sapiens
gatgattaaacaaaatgtagcatttagtggtgcccctgttatttcatgtgtgtgcactacacctacctgagtgcacacacatgaagtagcatgaacagcagcaaggtccatttcaccctcatcatc

SEQ ID NO: 6804538 - DNA, 125 bp, Homo sapiens
gttcttcatccagtttaggggtggacctgatgtccctgagtgtatgtggtgaacctgaatttgccttgggtttcctcatattcattcaggagtgtcagttgccccttcacgcgacgttggagagc

SEQ ID NO: 6804539 - DNA, 95 bp, Homo sapiens
ccgtaatcaggtaaaaaaggatcacagatgatgagcagttcctcccaagacacacaggctgtaggaacaggcctcgttttctattttcaccgcgg

SEQ ID NO: 6804540 - DNA, 71 bp, Homo sapiens
gaaacagaaaacaggagtatgtaagcttacttctagtgaagtgttaaaagattaaatgctcctgctgtttc

SEQ ID NO: 6804541 - DNA, 76 bp, Homo sapiens
gcctaccgctgcactgtgggagcccctttctgggctggccaaggccagagccggctccctcagcttgcggggaggt

SEQ ID NO: 6804542 - DNA, 60 bp, Homo sapiens
aggccacaatttgatttggtttttgtatttgtgttgctgtggcatgttagtttgtggcct

SEQ ID NO: 6804543 - DNA, 118 bp, Homo sapiens
ttattaaaaaaagtacaggtaatgagggaaggtatgatcttacatgtatgagtttgaaaatatctgtaaagatgtttatacctttacaaacatgactgaatgaagttggttttgatga

SEQ ID NO: 6804544 - DNA, 73 bp, Homo sapiens
ggaactctgtggaagttcacgttgcattgcatagtaataaatgttaatgaactccgaacatttacatagcacc

SEQ ID NO: 6804545 - DNA, 77 bp, Homo sapiens
ttccagtgttgatattgtgtaaatgtgtaagtcagaatgtggcttagaaagctttccatagtcaattggcattggga

SEQ ID NO: 6804546 - DNA, 61 bp, Homo sapiens
catggctcggggacaggaggtaaatcattgcttacccaaacatgccctcctggggtctatg

SEQ ID NO: 6804547 - DNA, 77 bp, Homo sapiens
gaggaactagagagaagctgtgtgaccttccctaacttcacctgagaagttacacagtgtcacttctaccacacttc

SEQ ID NO: 6804548 - DNA, 68 bp, Homo sapiens
actgtgcatcatgtttgtataggacagttcaggtttatatcaattgtcttggtgcaatcatgaatagt

SEQ ID NO: 6804549 - DNA, 56 bp, Homo sapiens
atgtagtaagtgcgcaataaatactgccagtagtagtatttgatgtctttttacat

SEQ ID NO: 6804550 - DNA, 69 bp, Homo sapiens
ggctggtatgaggagtatggcagtaaacatgacagattctgtccctactgttcatgccttcataaagct

SEQ ID NO: 6804551 - DNA, 77 bp, Homo sapiens
cctgtgtgtgcggtgggttctctcgctagcgggggccgactttccctggcctggggcctcagctgctagcggacggg

SEQ ID NO: 6804552 - DNA, 84 bp, Homo sapiens
tgccataagattgtatgccttcaagtcttttggcaagccttccttttgccaggccaatgaaggcagggaatgcaattctaggca

SEQ ID NO: 6804553 - DNA, 62 bp, Homo sapiens
agttcacattccgaggtactgggggtaaggacttcaacatactttccttggagtgtacaact

SEQ ID NO: 6804554 - DNA, 69 bp, Homo sapiens
gggaagcacatttggtcactatcctttttgtcatcttggactcaggatattgggctggagcagtttctc

SEQ ID NO: 6804555 - DNA, 127 bp, Homo sapiens
tgatagggtataaagagagagggatgttgaaaaccaagattctgattttgattttgctggatttttgtttctcttgcattataggtcataatcagttattcaaaatccctttgaccaggcactttca

SEQ ID NO: 6804556 - DNA, 58 bp, Homo sapiens
acttggttgcttctgaaatgacactttaattaattgaagaatgttagaggcatcaagt

SEQ ID NO: 6804557 - DNA, 61 bp, Homo sapiens
aagtaattgtaactattggttgaatgtagcctcggtaattaccaatgtttacagattactt

SEQ ID NO: 6804558 - DNA, 87 bp, Homo sapiens
ccccgcgcccccggtctgtttggggtctgcagagcggcgccagggtaaagcgcagacctgttgatcctaggttctggcgggtcgggg

SEQ ID NO: 6804559 - DNA, 66 bp, Homo sapiens
ggtagtcagggtggcacatcacagcattaactacatttggcctgtgggctgccattcttttctccc

SEQ ID NO: 6804560 - DNA, 90 bp, Homo sapiens
gagaagccagctgcagcaaatgttaagtgactagtaactaatgataataaaagtaataatcacaataacatttattgtaggctaactctc

SEQ ID NO: 6804561 - DNA, 80 bp, Homo sapiens
ctgagaagcagccacggggagacagaagcaccaccagaaagagccttccatgtcactctcacccgcgggcatgtgctcag

SEQ ID NO: 6804562 - DNA, 129 bp, Homo sapiens
ccttcctggtgggactctggtctttgctgccagaacagctcatctggcccagagtgtatcccttctgttggcacaggtggggttcttgtgttagcaacagccaccgagaccaccagccacctggaagag

SEQ ID NO: 6804563 - DNA, 79 bp, Homo sapiens
gtgctgtttggccctttatgggatgggcacaaagaccctgtgtctaccttcccagtgggctgcataagagaccgggcac

SEQ ID NO: 6804564 - DNA, 108 bp, Homo sapiens
tgctctaatttgtttacccaaatgtgacaacgagatgaacagttttgcaaaagcttgacaagtgctgatttatctccctttgatattactttatgaacataacaggta

SEQ ID NO: 6804565 - DNA, 72 bp, Homo sapiens
gagacaccatcagagaagtttcactggcatctttctagaggcctctgggtctctctgtttggccaaagtttc

SEQ ID NO: 6804566 - DNA, 70 bp, Homo sapiens
tcactttaactcatttaaacatttactgaagatatgctctaagaattgtgttgaatagagtgggaggtga

SEQ ID NO: 6804567 - DNA, 63 bp, Homo sapiens
gcctcccaccctgaaggctggccctgacccactggttccgtcaatctctttcagggcccaggc

SEQ ID NO: 6804568 - DNA, 58 bp, Homo sapiens
ccaaagtgctaggattacaggtgtgagtcaccacgcctggcctccgcgtggcctttgg

SEQ ID NO: 6804569 - DNA, 69 bp, Homo sapiens
agggccaggatcacagccaagagggttcctgtcacacagtttctgcttgggctgatgagccctggctct

SEQ ID NO: 6804570 - DNA, 92 bp, Homo sapiens
tgtgtgaggcatgtcaatcctcaactattctgttaatactctcacactttggctgaattacttattagtggggatgacctgagctttgcaca

SEQ ID NO: 6804571 - DNA, 55 bp, Homo sapiens
cctctgtgggacctcagagggtccccttccttggaagcagacaggtccagagagg

SEQ ID NO: 6804572 - DNA, 59 bp, Homo sapiens
ggatgtacccgaacctgttgccttgccctacctctgtgggctggttcagttctgcattc

SEQ ID NO: 6804573 - DNA, 93 bp, Homo sapiens
tagttcaaggaaatcaaagtggggaggctcaggtggagggatggtagcctaaagttaagggttcctgctttgtgcctcacacttagagaatta

SEQ ID NO: 6804574 - DNA, 79 bp, Homo sapiens
ctccatttccgggagcacagctgtcttgcaagctgtccgaacggcagccccgtgcccagcagctggccaccgagtgggg

SEQ ID NO: 6804575 - DNA, 69 bp, Homo sapiens
gaggaagagacccgccctgggagcccgcgagggaaggttcccggctggctggcgggtgcgtcctccctc

SEQ ID NO: 6804576 - DNA, 81 bp, Homo sapiens
tctcagtatatcaaagagtttttaaaataacatgatttaatttacattttttaaaggatagctctggttgctgtgctgaga

SEQ ID NO: 6804577 - DNA, 85 bp, Homo sapiens
aggctccagggcaggggtgtaagaatggtggtggggccagcaggttacagcctcagggctgactgctactctcccctgctagcct

SEQ ID NO: 6804578 - DNA, 67 bp, Homo sapiens
gttatgaacatgggtgttcagtagatgttacttttatgttgctttagaacatctgtgtctttatgat

SEQ ID NO: 6804579 - DNA, 116 bp, Homo sapiens
atgggcactatccacacattgggaggatggcaactaccaaatttcacaaatgagacagcagctgtcatcagtgcccttggggatgccatgctaacaatagtaaataaggtgcccat

SEQ ID NO: 6804580 - DNA, 99 bp, Homo sapiens
gaggcaggaaaagcgcttgaacccaggaggcggaggttgccatgagccgagatcgtgccattgcactccagccttggcaacaagagtgaactctgtctc

SEQ ID NO: 6804581 - DNA, 79 bp, Homo sapiens
cctggttgcctgcccgctagtatctgcacagtcttgctagaggggataaaagcagaaagcttagagggtttgcactagg

SEQ ID NO: 6804582 - DNA, 61 bp, Homo sapiens
tcaggaagtgcctaggctggccaagtctggggaaagtgggctggcccggggctgctcctga

SEQ ID NO: 6804583 - DNA, 59 bp, Homo sapiens
cactaatcctgtgaaatgctttgcgatggtgctaaaccattttgggtattttcagagtg

SEQ ID NO: 6804584 - DNA, 71 bp, Homo sapiens
cttggtcatgaagggctagtcacataagacacgcactctgatttgactcaagccctcatgttagagctgag

SEQ ID NO: 6804585 - DNA, 80 bp, Homo sapiens
taaggataacaaaacccatttcagtctcaatttaagtttaattcccaggtggaacttgaaatgaggctgtaatgaacttg

SEQ ID NO: 6804586 - DNA, 82 bp, Homo sapiens
taaacatggaactgcccagggccccattccagaccaaccgagttagaatctccaggggtggggcccaggcatctgatgttta

SEQ ID NO: 6804587 - DNA, 61 bp, Homo sapiens
cagaactcagtagtatggctttgttgatcagtaatgactagcagggatgttattacttctg

SEQ ID NO: 6804588 - DNA, 102 bp, Homo sapiens
gctggtgcccaggggtgtggtaactgtagatgtgattgtttgtacctctggcttccagagacaatgccaatgcacacgtggcccagattcctgtttcccggt

SEQ ID NO: 6804589 - DNA, 73 bp, Homo sapiens
ctaaatctagttgaaaacaataggaaagaggatacttttccctctagtatttgttctatcaacctagacttag

SEQ ID NO: 6804590 - DNA, 87 bp, Homo sapiens
agagcaggcctgggtgccaggggacctagggatgtctcctcttttgaatggggtataactgctaccacctgatgccttgcctgccct

SEQ ID NO: 6804591 - DNA, 71 bp, Homo sapiens
tcaaccattattttctgagcacgtgacagcattggactcagtgctgcattggctgtagagaataatgatga

SEQ ID NO: 6804592 - DNA, 55 bp, Homo sapiens
cccagatgcaggttcaagagtacttttcctgggatagagccttccagcatgtggg

SEQ ID NO: 6804593 - DNA, 127 bp, Homo sapiens
cacgggagcatggtgctggttccttggggttccctgcctggctgtcagcagagcctaatagatctgggctctgttaggtggggcaggatggactaggttggcacagccagccctcagctgtcccctg

SEQ ID NO: 6804594 - DNA, 74 bp, Homo sapiens
tacaaacagatgttgcttgtcattctcttgttgttaagcaggcaccagattggatcaagcagcagttgtgtgtg

SEQ ID NO: 6804595 - DNA, 84 bp, Homo sapiens
cttgacaaggtgatcacttattctgtgtgtgtatgtgtgtgtgtgtatgcatatgcacatacatacataggtgcactggacagg

SEQ ID NO: 6804596 - DNA, 85 bp, Homo sapiens
ccatgaggaaatgttgacctcagaggcatggttagaatagcagttataggctccctggccattcctctaggccttcctacattgg

SEQ ID NO: 6804597 - DNA, 97 bp, Homo sapiens
tgggctgtggggaagggctggggtggtgcagtagagctgtctggggttaggaactctgcagaagtggctgggccacctcctcctagctcagagccca

SEQ ID NO: 6804598 - DNA, 63 bp, Homo sapiens
ggtgggtaccctactctgctctgtgttgtctgggctgatggaaaggatggtggggtgcccatc

SEQ ID NO: 6804599 - DNA, 81 bp, Homo sapiens
tttactgcctggttgagcgtcaggggctgtgttctgaggactggacttcaggcacacccagtgacctcccgccacagtggg

SEQ ID NO: 6804600 - DNA, 68 bp, Homo sapiens
ggaaacttggcataattttaagtagatgggctggacattatattatgtgtattgtgctaatggtttcc

SEQ ID NO: 6804601 - DNA, 84 bp, Homo sapiens
cacaggaaattgtcttaaatggatggacaatgaaattagaataggcttaaattatttccatttcatttatcatagggttcagtg

SEQ ID NO: 6804602 - DNA, 56 bp, Homo sapiens
gagagggtagagtatcaggcccccagggagctgggagctggacccttacacctttc

SEQ ID NO: 6804603 - DNA, 56 bp, Homo sapiens
actcacagactgcaggtttattgggtgctaagtgtgccctgctgtagtctgttagt

SEQ ID NO: 6804604 - DNA, 60 bp, Homo sapiens
ccactgtggttattatcactgttactgctttcacagtaacggccagcactaccacagtgg

SEQ ID NO: 6804605 - DNA, 60 bp, Homo sapiens
tttgtgaacaaacatgaagatgggcactgccccatccacctttatgtctcggtccacaaa

SEQ ID NO: 6804606 - DNA, 72 bp, Homo sapiens
gctcagtgaggtaggtaccattatcactgctagaaagcagtgaacttatatggtcttactgtggcactgggt

SEQ ID NO: 6804607 - DNA, 64 bp, Homo sapiens
aatctgacatctactagaacagaagattgattcaacttaacttttgttttgttcagatgtgatt

SEQ ID NO: 6804608 - DNA, 59 bp, Homo sapiens
cagtaaatgtcctcgcagggaaatcctcatttaatactccttgaatggacattacactg

SEQ ID NO: 6804609 - DNA, 74 bp, Homo sapiens
ttcctcctctcgggaagagctcctcattgcctttgctttttgtcagttggcaggggttcattttgtcttaggaa

SEQ ID NO: 6804610 - DNA, 68 bp, Homo sapiens
ttttccttagcttctctgcgaggtcacttttcaaaaattttagtctatctcagaaaagctaaggagaa

SEQ ID NO: 6804611 - DNA, 67 bp, Homo sapiens
ctggtgtcttcagcagtcatctggggcaacaatcccacctgcccattgtggttgttgaggatatcag

SEQ ID NO: 6804612 - DNA, 75 bp, Homo sapiens
aggcagctggtgccaagttgcaactcgccacaaatttttatggtccgagttattaacctttgcaaacagctgcct

SEQ ID NO: 6804613 - DNA, 61 bp, Homo sapiens
aggctctgtaatccgtacattattctgaacttttccagagacagagaaaacggaagagtct

SEQ ID NO: 6804614 - DNA, 97 bp, Homo sapiens
ggtaccttaagactattatgctgaaaaagacatatgtgggcattctggtcactagtccaggtgtgcccagtcttctagctatacctgtcaaggtgcc

SEQ ID NO: 6804615 - DNA, 65 bp, Homo sapiens
attgctggcccagatgctttagcgagaaaactgtctacaacagctaagcatctggatgtagcaat

SEQ ID NO: 6804616 - DNA, 59 bp, Homo sapiens
gccctctggtgggtgagccccgggctgggtgagccctggggtgggtgagccggggtggt

SEQ ID NO: 6804617 - DNA, 63 bp, Homo sapiens
tctattccttagggtttggtgaggattaaatgagttaagaaatgtggagcacctaggaataga

SEQ ID NO: 6804618 - DNA, 56 bp, Homo sapiens
gggaaggcaggattctctggtgggcagagcctgttctcagagacaaatgccatccc

SEQ ID NO: 6804619 - DNA, 73 bp, Homo sapiens
caatctaatctatcaagcaacaaagtgctcagccttctaaccttgggtacgttgttggttggttggttaattg

SEQ ID NO: 6804620 - DNA, 63 bp, Homo sapiens
agatgtgtcagcatcatttgttgaagggactattctttcctcattgaatgatcttgactctct

SEQ ID NO: 6804621 - DNA, 81 bp, Homo sapiens
gtgaacatttgttctcttggctataatttgtaaataggtggaagggaagctgcttgttaaaattggagccgagagattcgc

SEQ ID NO: 6804622 - DNA, 69 bp, Homo sapiens
gcccagtgggaatcaccaattggaaaatcggcataagaatgctgatattctacctgctgaccaaggggc

SEQ ID NO: 6804623 - DNA, 74 bp, Homo sapiens
tccaaaactaaggatgcatatgttttgtttgtaagctattttcaacaagatagatatcacttaggtcacttggg

SEQ ID NO: 6804624 - DNA, 75 bp, Homo sapiens
tatagctgtgcaaattccactggaaagcttggggttatatccacagtaaaccacagggatgctgcactgactgtg

SEQ ID NO: 6804625 - DNA, 82 bp, Homo sapiens
agccggagccagtggagtggggcgaagtcggcgagttggaaacttcctgcaatcgtccactcctagcctttggcgttcggct

SEQ ID NO: 6804626 - DNA, 60 bp, Homo sapiens
cagggagtgggaggagagagcactgaaaagagtgtctctttggcctcccatatgtccctg

SEQ ID NO: 6804627 - DNA, 59 bp, Homo sapiens
aatttttaaggtctgtataatattccattgagtggatgtatgcagtttacttaggtatt

SEQ ID NO: 6804628 - DNA, 94 bp, Homo sapiens
aagcatgcctaaaatggtctcatgtggttactttggtcgctcttccagcaggtgatattggataaagtgagtacaaaatgagggtgggcggctt

SEQ ID NO: 6804629 - DNA, 80 bp, Homo sapiens
ggccttgtgggcacaagacagatggaaattaatgattacagaaatacagtagggaccatgtctgaaatgtgctcatagcc

SEQ ID NO: 6804630 - DNA, 92 bp, Homo sapiens
tcttaggtaatttgaggaataaattggtgtcatttgcattctattccagaagacaaacctgctgctattttatccagtattttatcctaaga

SEQ ID NO: 6804631 - DNA, 57 bp, Homo sapiens
gtcacactcttccctccacatgccctgcagggctactcttggaggcagagttctggc

SEQ ID NO: 6804632 - DNA, 57 bp, Homo sapiens
gccaggctggttatttaatgagttttatgatacattaaatcttccagacctcacggc

SEQ ID NO: 6804633 - DNA, 117 bp, Homo sapiens
gcccaagatgcccgaggtggccgaagtccaggctgtgcgcaccgtgtggggactgctggggggcagggatcgcccgtgtgtggtggccatggtgttcggcactgggggtgtgtgggt

SEQ ID NO: 6804634 - DNA, 76 bp, Homo sapiens
tgccgcccatccctgaggttcctcctgagctctgggcccagggctttaggtcctgctagggtatgtggccttggca

SEQ ID NO: 6804635 - DNA, 91 bp, Homo sapiens
acagcaggaatcgcctaaaccagtgaaacaccaggcaagtgctcttctttatgcttcttagtcttgagtgtttgcactaatttctgtctgt

SEQ ID NO: 6804636 - DNA, 69 bp, Homo sapiens
gggtaatatacaagagttgtgtaagtggactgggctggggagcgttcaagggctgtgtatgtggtaccc

SEQ ID NO: 6804637 - DNA, 58 bp, Homo sapiens
ggtagaagtgatgtcatgttatagccaatgctaggttataaaaaggattatttctgcc

SEQ ID NO: 6804638 - DNA, 60 bp, Homo sapiens
tgttttactgaaaatgattacttgataaaaacattgtctagaaataggtttcagaaaaca

SEQ ID NO: 6804639 - DNA, 67 bp, Homo sapiens
gcaggaagagcaggaggtcacgacagaggggagcatgggacactgggaaggctttggctcttaccgc

SEQ ID NO: 6804640 - DNA, 62 bp, Homo sapiens
ctttgtaggataaaaggtcgggtcaacttttctccaggagctgaaattctttgtcctcagag

SEQ ID NO: 6804641 - DNA, 76 bp, Homo sapiens
ctaagtcaccattatatgtgcagacagcatgttcttcgggcacaaacttatgtttcatatgtatcaagtcacttag

SEQ ID NO: 6804642 - DNA, 68 bp, Homo sapiens
ggaggctgctgtattccttggctcatggatctctttctccatctttaagccagcaacacagcatctcc

SEQ ID NO: 6804643 - DNA, 70 bp, Homo sapiens
gctggctctggctggctcggccgggagtgaggagagtgtctcagccactgccgctctgccaggtgccagc

SEQ ID NO: 6804644 - DNA, 64 bp, Homo sapiens
gggggcaggagaaaatcgtgtcgttgagcaataaacagaagagtggtccttctttactgcctcc

SEQ ID NO: 6804645 - DNA, 61 bp, Homo sapiens
gccgtgcagcagtaactcccgtgcagcagtaactcccgtgcagcagtaactgcagccgtgc

SEQ ID NO: 6804646 - DNA, 87 bp, Homo sapiens
tggtgttgtcagtgttctggatttggggcattttgttgtacaagttatcaatacttgccttatggttccaggtcttgtatttcacta

SEQ ID NO: 6804647 - DNA, 58 bp, Homo sapiens
gagaaggatgttctagtttgctgagagaccttaggcaagcagagcccatccatgtctt

SEQ ID NO: 6804648 - DNA, 79 bp, Homo sapiens
gtttctattttaaaaataaacctgtcctactcattcttggagtcaggtgtgggaactacaggtttttaatggaagaaac

SEQ ID NO: 6804649 - DNA, 92 bp, Homo sapiens
tatgatggtggcattacaagctggcgcagttaagatcctggaagtcaggtttgcctatgttgtaactgcactatgctgtgccatgcaccgta

SEQ ID NO: 6804650 - DNA, 94 bp, Homo sapiens
agactttaaatgtaccgaactgtattggttttctattgctgcataacaaattattgcagccttagagacttaaaacaggactcatttactgtct

SEQ ID NO: 6804651 - DNA, 82 bp, Homo sapiens
agcatcctcaggagttttaaatctagcatggcattctgtatccccttctagcaaatcaacataaagaacttctgagattgct

SEQ ID NO: 6804652 - DNA, 62 bp, Homo sapiens
cagaataccagaatcattttatgttggtgttacatgaaacatttgatgatctttggactctg

SEQ ID NO: 6804653 - DNA, 64 bp, Homo sapiens
tggtggtaaatgtttaataacctctttttcaaagaataaaagccgttattggtcatttttgcca

SEQ ID NO: 6804654 - DNA, 117 bp, Homo sapiens
ctttctgcactgaagatgcagcctgtttctagcactgtatgtagttcctaagattcctcaagatagaggtcttacccacagcatctagaaagcaagacagggcaagatgcagcctgg

SEQ ID NO: 6804655 - DNA, 77 bp, Homo sapiens
gttgtgaatctcgaagtgggtacatgatgcactttcccatttaaggtaaagtacacatttatcccttatctcagaac

SEQ ID NO: 6804656 - DNA, 63 bp, Homo sapiens
gacagctgtgacagccagttgatgttaaacacagaagcctcaacagacaggtctacagcagtc

SEQ ID NO: 6804657 - DNA, 71 bp, Homo sapiens
gactctcaaaagtgctgggattacaggtgtgagccaccacgcctggcctaaattagtaattttcaagagtt

SEQ ID NO: 6804658 - DNA, 73 bp, Homo sapiens
ctactgagtctgtggtattttatcatagcagcttgaacaactaagacatatggtggtatcaggattctaagag

SEQ ID NO: 6804659 - DNA, 87 bp, Homo sapiens
aaggggagacttgctctaattatgcatatacatttgactatgtaaaggtagttgtagactatatgtataaataacaagttaacactt

SEQ ID NO: 6804660 - DNA, 70 bp, Homo sapiens
gacatccacgaactaatggaggctgttggacagacaagtctagagcttagagaatgagtttggggtagtt

SEQ ID NO: 6804661 - DNA, 83 bp, Homo sapiens
gtgtggtgtggccctggtgttgtgaagtagccgttctctgattggcaacggcctgattcacaacaccagctgccccaccacac

SEQ ID NO: 6804662 - DNA, 114 bp, Homo sapiens
gggctcccccaagggatcctcgggattgagttatttctgtttttgctcacctgtgcctggccctggggacagagacaggaatcagctgcagtccctgcctccctggaggagctc

SEQ ID NO: 6804663 - DNA, 59 bp, Homo sapiens
ccctccaggctggatccaagtcaagggctgtacctcgctgctggaacctgcctgtgggg

SEQ ID NO: 6804664 - DNA, 65 bp, Homo sapiens
atcacaactttatatttgaatttatttctcccttaaaattaggatttcagaggtgaagttgtggt

SEQ ID NO: 6804665 - DNA, 61 bp, Homo sapiens
atttaatttagagcttttaaaagttgctacagagctagctttatgggagcttagataagat

SEQ ID NO: 6804666 - DNA, 70 bp, Homo sapiens
tcttctatgaggcaggccctgaatgagtcactgagaaggcagttgaatacatggttcctgctctcgaaga

SEQ ID NO: 6804667 - DNA, 66 bp, Homo sapiens
aaaggagatggaaattgttctaatgatgcttctaatttaagcatgtgcaacttttctgtctttttt

SEQ ID NO: 6804668 - DNA, 67 bp, Homo sapiens
gagcatcaacatgagccgggaacgtgctaaatgttttgcgtgagcagtgcctggcacatgtaagctc

SEQ ID NO: 6804669 - DNA, 56 bp, Homo sapiens
tccctctccatggtaagatgcaggacatctattcctgctgccatagacctgaggga

SEQ ID NO: 6804670 - DNA, 69 bp, Homo sapiens
gttaatctatctagtgaaatagtccactaatgtctttaaagtggtacatttctcatctagtagagtagc

SEQ ID NO: 6804671 - DNA, 72 bp, Homo sapiens
ttagtaggagtaggagtagaactcatcattcatctaatcatgggagcaaatgacttctgcttctagaactga

SEQ ID NO: 6804672 - DNA, 61 bp, Homo sapiens
ttgcattcccagccaagttagtgcctgttgctggccagcactaacttggctgggaatgcaa

SEQ ID NO: 6804673 - DNA, 61 bp, Homo sapiens
ataggactttgtatcaggatgagttgaaatctgagtttaccattctgtgtaaatgtcctgt

SEQ ID NO: 6804674 - DNA, 55 bp, Homo sapiens
tgcttttgcacaggtgagttcctggaccccctccaggcccacttgaccagaggca

SEQ ID NO: 6804675 - DNA, 61 bp, Homo sapiens
acgaggtaggcccatctggattagtgatctttgtctacttccagacctgtgcttgctctgt

SEQ ID NO: 6804676 - DNA, 61 bp, Homo sapiens
ctggttatttctgattatatgataggcattgtgtttgaaaaatatttttagaaataattgg

SEQ ID NO: 6804677 - DNA, 71 bp, Homo sapiens
ctaattagttggctatgcaaggaacgtacccgagccgcccgggtagacaactttgtaatagccctgaagag

SEQ ID NO: 6804678 - DNA, 60 bp, Homo sapiens
cagcagtagaggtagtagcactgtcatcagagggaagagacatctgccttagtgctgctg

SEQ ID NO: 6804679 - DNA, 94 bp, Homo sapiens
acctttcaggccaccgaaggattcaggccgaggagctgcatagtgaccgagggtgatgaagctggttttggcttggggatggctggccagaggt

SEQ ID NO: 6804680 - DNA, 82 bp, Homo sapiens
cctgggcctcttcgctgtgctttccctgagagcattccagatccctgaatattcaagggaaaacacagtgaatgggtttagg

SEQ ID NO: 6804681 - DNA, 103 bp, Homo sapiens
cctctcccactctgccccgaattccaatccataggtttttccaagagctgcacagctctggaattgacctgggagggggcacatttgggccgggaggggtagg

SEQ ID NO: 6804682 - DNA, 81 bp, Homo sapiens
cacccttgattgttttttcacacttgcagactttgcctggttacactcctaaccaagcagtctatggagtgtcgagaggtg

SEQ ID NO: 6804683 - DNA, 66 bp, Homo sapiens
ttataatgcagcagttgcaacgatctggggcatgaggccattttgaatgaaattgctgtgttatga

SEQ ID NO: 6804684 - DNA, 64 bp, Homo sapiens
ttgaccaagaggccaccctatgggtcccagtcaacccggcagacccataattgagcctagtcaa

SEQ ID NO: 6804685 - DNA, 59 bp, Homo sapiens
gtagtgtttggatgatagagatgaacttctaaaatgttctcagtgtcagtagccactac

SEQ ID NO: 6804686 - DNA, 91 bp, Homo sapiens
ggcatgaggtaatacaatcaaattcactagcaccactcctggcccttaaaaggtgctgctatttggtaagtattattatcatttgttggcc

SEQ ID NO: 6804687 - DNA, 130 bp, Homo sapiens
tgcttgttaggacaccaccagaaacaccaggccgggtttttcctttcaaatttgggatcccctggagggttaggaggtaacaactgaaatgagaaaggggtttaatgtgtttcaaatgtccattaatgca

SEQ ID NO: 6804688 - DNA, 62 bp, Homo sapiens
catcgtttttctcctggcctgattcttatttgctgaggactcagagtctgagataaatcttg

SEQ ID NO: 6804689 - DNA, 90 bp, Homo sapiens
cctaacattaggcattttctgaggattgagtcaagcagtatgtacgtgtgtgtacatttgctggccttagcccagttagtgtgggttagg

SEQ ID NO: 6804690 - DNA, 66 bp, Homo sapiens
gaacaaggttgtctctttattatcttgggtatttatactggagagacctcagaaacaatctagttc

SEQ ID NO: 6804691 - DNA, 58 bp, Homo sapiens
ttgccaaatcaaaggtggctatgctaatattctgtagcagaaataccacatttggcaa

SEQ ID NO: 6804692 - DNA, 82 bp, Homo sapiens
tctgtaggagcaaaatggctgacttttcatgggagtgaggaagggcttcccagaagagatgccacttgagctgtgccttaga

SEQ ID NO: 6804693 - DNA, 65 bp, Homo sapiens
ccatttccaatctctgcatatggggacctgcgtcatgtttttaagtgccaagatgactggaaagg

SEQ ID NO: 6804694 - DNA, 56 bp, Homo sapiens
gtgagtgttgatttgtattctggccatgatacaggcccctggcatatcacattcat

SEQ ID NO: 6804695 - DNA, 82 bp, Homo sapiens
gtctctcctgcaaggtggggaaaggaaagttaacctgccagtgggttcgaagcccttcctgactttcatacaggagccgggc

SEQ ID NO: 6804696 - DNA, 80 bp, Homo sapiens
gctggaccactctctgtggtggggtcatcgtcagatgcttaccagcatccctggcctggaaccaccagatggtcagcagc

SEQ ID NO: 6804697 - DNA, 102 bp, Homo sapiens
gtgagagtattttgacagcaactgtcagcaaggtgcaagcggctgccatcgcctccgattggctgcagacacctatggcaggatgctgaataatattccagc

SEQ ID NO: 6804698 - DNA, 65 bp, Homo sapiens
gagggattgtagcaagcttgtaagttcaaggatttcttggcactgccaacctgctaggttctctc

SEQ ID NO: 6804699 - DNA, 77 bp, Homo sapiens
tgcttaagactgtctttaagggactgaatttggcaatacacagatgaaatgtcaaattgggatcctcagacaaagca

SEQ ID NO: 6804700 - DNA, 63 bp, Homo sapiens
aggccaagtagctagcattgaattgattgtggtttcatttcagtggattctctattaaggcct

SEQ ID NO: 6804701 - DNA, 87 bp, Homo sapiens
gacagtaatacctttctaacacttgattacagaatcacatttgaactatgtacaagatcttaggatgttggaggtggtaggactgtt

SEQ ID NO: 6804702 - DNA, 94 bp, Homo sapiens
ctcctttgggggtatccctaggcagatggagaagtggcttggtgagccctggtggcgctgagctcctctcctctgcctggcctccgagagggag

SEQ ID NO: 6804703 - DNA, 64 bp, Homo sapiens
gtgaccttctgctatacttatgaatacatatatctgtgtatctgtgtatgtgtaaagggcttgc

SEQ ID NO: 6804704 - DNA, 77 bp, Homo sapiens
ctttctttgccttaatacttagataccagtgtatacgtaagtgtatcctgctttgactgttaagaaccatagggaag

SEQ ID NO: 6804705 - DNA, 61 bp, Homo sapiens
aaaatggtgggtgggggaacctcttgttgcttcatagaaccggatggctccacatcatttt

SEQ ID NO: 6804706 - DNA, 61 bp, Homo sapiens
cttcctgaacaatgccatcaattatccccaagtgtggattaaaggatatagttctagggag

SEQ ID NO: 6804707 - DNA, 87 bp, Homo sapiens
tctcaagctgtgagtctacaaagggaagccctttctgttgtctaaaagaaaagaaagtgcttctctttggtgggttacggtttgaga

SEQ ID NO: 6804708 - DNA, 88 bp, Homo sapiens
cctgctggccctctgtaatgattcactgaatgatgaaatgtccatcagtcctcaggttctgaatcttgtgcctggagaaccagagagg

SEQ ID NO: 6804709 - DNA, 104 bp, Homo sapiens
ctcaggctccatatggtgtggcaactgtggcaaagtttaaaaaaaatccttttgggatttctacttgaacttgctaaataagcaccaccaatattgaccttgag

SEQ ID NO: 6804710 - DNA, 68 bp, Homo sapiens
acctcactaatcttgtaaagtttgcttatttgttaaaatgattaaaagtaaacattagaagttgaggt

SEQ ID NO: 6804711 - DNA, 75 bp, Homo sapiens
gttattatcttgaggaatctgtcggtgaaagtagtatttagacttcaacaagcagaaggcctcttggttaataac

SEQ ID NO: 6804712 - DNA, 65 bp, Homo sapiens
gcccttcccctcctctcctgatatggggacttctgagttccctgggagaagttgagggctggggt

SEQ ID NO: 6804713 - DNA, 87 bp, Homo sapiens
cattctagcagatataaagcaacatcagagttttggctgcagtaggtgcagtgagcactgttgttggttcctgggtcaaatagaatg

SEQ ID NO: 6804714 - DNA, 58 bp, Homo sapiens
tccccagggctgcagagggtgtcctggtcttcccccatcagttctgcacccctgagga

SEQ ID NO: 6804715 - DNA, 84 bp, Homo sapiens
ttgaaactcaggtcccttggaggaagctctaggctctgaaattacttctctcggcctcagtttctccatgggttttggattcag

SEQ ID NO: 6804716 - DNA, 55 bp, Homo sapiens
agcagtgggatattgaagtatatggaactatagtctatgtatgaggtcttctgct

SEQ ID NO: 6804717 - DNA, 71 bp, Homo sapiens
gcttgagtacttttgtttccataattaagtgtgaggcccttgtctcaatgtgaattaagaatacttcaagc

SEQ ID NO: 6804718 - DNA, 74 bp, Homo sapiens
gacaaagaaatgactgaagcaattgcagtgtcacaggtaacctgctgttagatttcagtcacatgcctaatgtc

SEQ ID NO: 6804719 - DNA, 73 bp, Homo sapiens
ggggcaggctctttggggggattttcctaagctggactgcaggctggcttcccagcagagggcgcactgcccc

SEQ ID NO: 6804720 - DNA, 94 bp, Homo sapiens
agttttattacttctttgacgtgtatatgtgtattttatgacaaacattttaagttgcatggagcacacagtatgcttttaatgacatataact

SEQ ID NO: 6804721 - DNA, 79 bp, Homo sapiens
acaatgggggaggctccagggagctgtggaggtttccagaaccggagcacagccttggaactcagccacaccctactgt

SEQ ID NO: 6804722 - DNA, 96 bp, Homo sapiens
catgcagctaatatgatacttaagtgaaacatgtatctctttactccaactttaaggatgtaaatagggtaagcgtgtttactctcaccatgcatg

SEQ ID NO: 6804723 - DNA, 55 bp, Homo sapiens
agctccaggccttgggccccgggcatggtcccaggcccatctcttgctctgggtt

SEQ ID NO: 6804724 - DNA, 62 bp, Homo sapiens
atctcagcctggattcgtgcatccacatgttgaatgagatgagagaaagtcaaggtgaagat

SEQ ID NO: 6804725 - DNA, 72 bp, Homo sapiens
tgtctccatgtaagatgtcaaagggtcacagttgcttacagctgcgactccctgagatctttcatcaggata

SEQ ID NO: 6804726 - DNA, 77 bp, Homo sapiens
ctacaagcctcacaggttagttgtgtggatccatgagacactgtgtgagggacacacaccacctgtcagtcttgtag

SEQ ID NO: 6804727 - DNA, 59 bp, Homo sapiens
gcaagatgttaaaaccacccttggattatacactagaccaacttggttttatattttgc

SEQ ID NO: 6804728 - DNA, 67 bp, Homo sapiens
tgcatcctgctagagacaatgctgtttataatgtcaattacagccagtcatctcagcagggaaagca

SEQ ID NO: 6804729 - DNA, 73 bp, Homo sapiens
ctctttgtgacaggaattcttaaaatggtgtgtatgcacaactgcctgtatcactaacaagaagtcacaagag

SEQ ID NO: 6804730 - DNA, 96 bp, Homo sapiens
gaacaaacacaaggggattttaaatggcagttttacaaatttgtattcctgtgaaagtttgtgtcagagctgttaccatctctgcttgttctgttt

SEQ ID NO: 6804731 - DNA, 67 bp, Homo sapiens
cttcattacatcttggccaaaactctgcctaccacagggggatgtttgatgcctggtgtgtttggag

SEQ ID NO: 6804732 - DNA, 56 bp, Homo sapiens
aggttgtcctggtggaaggagaaaccatggaccaggacctttgaatcaggacactt

SEQ ID NO: 6804733 - DNA, 60 bp, Homo sapiens
aggctatggtggggccagtggcatgggaggcatcatcgccatcatggtcaaccagagcct

SEQ ID NO: 6804734 - DNA, 55 bp, Homo sapiens
gctctgaggagccaagaatgtggacctaggtgtcctcttgtctttgctcagtagc

SEQ ID NO: 6804735 - DNA, 107 bp, Homo sapiens
ttcggcttacagtcctctgttgaagttacctttctgaaacttcgttgcaagcaatataatgaagttgtaaggagagtgggttctggcatagaaagacttgagttgga

SEQ ID NO: 6804736 - DNA, 88 bp, Homo sapiens
tgcatgtatctactgtatctgcatgtatctctctgcatgtatctctctgtatgtatctctctgcatgtatctactgtatctgcatgta

SEQ ID NO: 6804737 - DNA, 82 bp, Homo sapiens
agtttttaaaatgtcaatgtctggaattgattcccagagattgttcttggatccatctcaggcataggaattttttaaagct

SEQ ID NO: 6804738 - DNA, 78 bp, Homo sapiens
ttctttttctttctgcaggagaccatgaaataattccagtatgtttgcttaattgttgggtattcctgtgacaaagaa

SEQ ID NO: 6804739 - DNA, 91 bp, Homo sapiens
gggaacagaaagtgttgcaaaatgccgtttttctcagtgacaaggattccacagaaggaagttggcattttgtttcagctatcatgatcct

SEQ ID NO: 6804740 - DNA, 75 bp, Homo sapiens
tgtctacctacatgcatgtgaatatggacacacctatgtatatgtgtgtgtgcatatatgtgtatgtatattaca

SEQ ID NO: 6804741 - DNA, 73 bp, Homo sapiens
tcttccctcaacaacttccctatccacccaccctccaccgccaccgtggactataagtcacttgagggcagga

SEQ ID NO: 6804742 - DNA, 88 bp, Homo sapiens
ggttttgggacttattgtctgtccgggtcaaagcaccccatttctatgatgggagctctgacccagacacacaataaggcccaaaact

SEQ ID NO: 6804743 - DNA, 58 bp, Homo sapiens
ctgtgcactttccacgtgtttgcaagttttgattgaacaaacactggctggggcacag

SEQ ID NO: 6804744 - DNA, 73 bp, Homo sapiens
ttcctctttctctgtgctatgtaaggtttaaaaatagtaaatagccaagagatagcagggagaagtgggggaa

SEQ ID NO: 6804745 - DNA, 65 bp, Homo sapiens
ggtttggatttgataagtaaaatggcagcgtgaaaatgttagcctcatgcttaataggctaggct

SEQ ID NO: 6804746 - DNA, 78 bp, Homo sapiens
agcccttgaagtggatgttggtataacctctgcagacctcagcactacgtttcataccatatccacacatcacaggct

SEQ ID NO: 6804747 - DNA, 60 bp, Homo sapiens
aaggcctaaataaaatgatattccctgaaggaaatgtccagagggttttattttggcctt

SEQ ID NO: 6804748 - DNA, 62 bp, Homo sapiens
gggtggttctggattctggcagatctgggccccagcactgccacataatctcagcatgacct

SEQ ID NO: 6804749 - DNA, 77 bp, Homo sapiens
tgcagctcttcaggattttcccaaggctctggcaatccaatatttccagctgcccaagaggcatcctgcttggctca

SEQ ID NO: 6804750 - DNA, 55 bp, Homo sapiens
agtggttcagggtgaagatacaaggtcaggaagctgactgtgctcgggaaccact

SEQ ID NO: 6804751 - DNA, 113 bp, Homo sapiens
cctgctggaaatgtcttaaggtaggaacacatcctcctctagcacaaagcacaagatttggctcttggaagacaggatgtgtttgctgaatgattgaaatatatcagagcagg

SEQ ID NO: 6804752 - DNA, 67 bp, Homo sapiens
ttctgacatcattagtaacatagcttgtttctacacacatgggcttggctatgattaatgactagga

SEQ ID NO: 6804753 - DNA, 110 bp, Homo sapiens
ggctgttggggaccttccaggcgtgttacctgtatgctgcctggtggcgcctgggggattccaaggggactgccatgtagtctatggggcgcagtctggccctgacagcc

SEQ ID NO: 6804754 - DNA, 70 bp, Homo sapiens
atttaggttgttatgaaaagcataatttgagtcatcttagaccatgttgtagtatcataatggtttgaat

SEQ ID NO: 6804755 - DNA, 57 bp, Homo sapiens
ggggcccgtcgctgtaccaggctgagggccttacattcagccctgtgacctggccct

SEQ ID NO: 6804756 - DNA, 81 bp, Homo sapiens
gagtggaattaggttagtgtgcaagagaacaaaaggaagtaatggatattcatttttcttcgtattctgattggtccactc

SEQ ID NO: 6804757 - DNA, 55 bp, Homo sapiens
ggagctggggttggcatcttcccggatggtgaagttggcctgcagcctgggctcc

SEQ ID NO: 6804758 - DNA, 74 bp, Homo sapiens
cctgatttcctttcagttagatgaatcatggcctggctgagaacaaaggactcatctgactggtgggaatgagg

SEQ ID NO: 6804759 - DNA, 56 bp, Homo sapiens
actgctctgttgtttgtttccctttgcttccctgctgcaagcagacagcagacagt

SEQ ID NO: 6804760 - DNA, 58 bp, Homo sapiens
gcactgtgctagagagaacaagaacattcctcttgctctccagaggctcacagcatgc

SEQ ID NO: 6804761 - DNA, 66 bp, Homo sapiens
gccctggaggtcaagactgcagtgagccgtgattgcaccactgcactccagtctgggcaacagagc

SEQ ID NO: 6804762 - DNA, 101 bp, Homo sapiens
cggggttcgtgcaggggctccgtggggccgcgtcgggcaggggccgcccgggcccgagcacggcacccacaaacaggctggcgtcccgcgacggagacccg

SEQ ID NO: 6804763 - DNA, 58 bp, Homo sapiens
cattctcttgacaggacagcccccttgccctatctggctccccatgtgaggagcgatg

SEQ ID NO: 6804764 - DNA, 78 bp, Homo sapiens
ccaggtcactgttcgaggctgacaaagtatattgaaaggtttgctttggataaatagcttcctaatgatgaatcctgg

SEQ ID NO: 6804765 - DNA, 72 bp, Homo sapiens
tccatgtcctttagtgttctaagaacatccatgcaggctttggcccgtctgggattggaaactgggattgga

SEQ ID NO: 6804766 - DNA, 58 bp, Homo sapiens
tagctcatctaggctaccacagttaagtctgaagcagggctgtggcgtgggtgaacta

SEQ ID NO: 6804767 - DNA, 57 bp, Homo sapiens
gatgaataatgaccctaattaggggaatatcctagtcaggattttggattattcgtc

SEQ ID NO: 6804768 - DNA, 77 bp, Homo sapiens
gcagttgccctggggaggtgctggagagaagcctggggctcccaccaggagccagttccaccccaggataaggctgt

SEQ ID NO: 6804769 - DNA, 81 bp, Homo sapiens
gcggctggaagcgggaggccagtcctggccgggctgggcgacccgaatggagccagggccggcgctggtcccagcggccgc

SEQ ID NO: 6804770 - DNA, 60 bp, Homo sapiens
tcatgatctccctactctggtcctggttgccttctcatgaccctagttcttggatcatga

SEQ ID NO: 6804771 - DNA, 98 bp, Homo sapiens
tcatttgatttagaaaatttagtaaccctgtgagtagctgttattatcctcaatacacagatgagggcacagaggattccagagctagagtcaagtgg

SEQ ID NO: 6804772 - DNA, 60 bp, Homo sapiens
ttgaagggacctcagaactccccactctccgctttgggaaggctttgaatcatccttcga

SEQ ID NO: 6804773 - DNA, 57 bp, Homo sapiens
gagacacaggcacagaagaggctggccaagcccagaggaatcttctcctgtgtgttc

SEQ ID NO: 6804774 - DNA, 62 bp, Homo sapiens
cctgtgtgtctgtcactgcacaatattctcatgactctcttcttgtagtgacaggatacagg

SEQ ID NO: 6804775 - DNA, 95 bp, Homo sapiens
aatgtagttatattaatccatatttggatgcttttttaagatctgtaggatgctactgaataggtgtccaataaggatttgttgaagattgcatt

SEQ ID NO: 6804776 - DNA, 57 bp, Homo sapiens
gcttatagatggctatgttctccctgtgtttcttcacagggcatttcctctatgtgt

SEQ ID NO: 6804777 - DNA, 76 bp, Homo sapiens
gactgtgtggactgtccatgaccagattgagaatgtccactggtatctcctgtctgtccatgagtagttccatgtc

SEQ ID NO: 6804778 - DNA, 94 bp, Homo sapiens
ccggtctgcggccccgccctcctcgcaagttttaggcgctcccaagtccccgccccagactagcccaaacctgcgagcagagcggtagagccgg

SEQ ID NO: 6804779 - DNA, 57 bp, Homo sapiens
aattctgattagatgcctttgttccagaaaacttggtgaaaggctttaattaaaatt

SEQ ID NO: 6804780 - DNA, 93 bp, Homo sapiens
acaaaatggtgccagactacttgcctttgaatcccagctctgccacttaattaattgcagggtgactttgggcaagttacttaaattatttgt

SEQ ID NO: 6804781 - DNA, 80 bp, Homo sapiens
ttctcttgagttcttacccccagggcaagcactccatccccagaggtgtgtgctgttaaatggggaggagctggagagag

SEQ ID NO: 6804782 - DNA, 82 bp, Homo sapiens
gctttgtgccagaaaggtaaacactggattgcattgtggattaaaacaataagaaatccctttcctctcaggctttcaaggc

SEQ ID NO: 6804783 - DNA, 117 bp, Homo sapiens
gcacctgccagccgggtaagcagatgagcagggaccctactagctcacacctggatggagatcaggaacaggaagcagtgggagtccctgccttttgttgtccagtttgcattctgc

SEQ ID NO: 6804784 - DNA, 55 bp, Homo sapiens
gtcactgtttcactgttcattaacacctccaggagagggtgagctgagtcaggac

SEQ ID NO: 6804785 - DNA, 97 bp, Homo sapiens
gcttgaaccccgctgcaacctctagactctgggatctggggccagggaaattccagccctggctctaccagagcctagcaggccgccctggacaagc

SEQ ID NO: 6804786 - DNA, 86 bp, Homo sapiens
ctattaggttggtgcaaatgtaattgtggtttttgacattactgttaattgcaaaatctgcaattacgtttgcaccaacctaatgg

SEQ ID NO: 6804787 - DNA, 103 bp, Homo sapiens
gcaataaaacaggtttatgcaggaggatgcatagtgaagctgacagaagtgacatttgctgtcagaaccttcaggtgcttttcaaagctcacccttaccttgc

SEQ ID NO: 6804788 - DNA, 82 bp, Homo sapiens
gctgtcctagaagagctgctcagaacatgatgcttttgttcctaatgactgaataatcatttttaagagactcttctatagc

SEQ ID NO: 6804789 - DNA, 103 bp, Homo sapiens
ctgtgtgcaaagcagtgtatattttttctgtcttgaactcccactgactatagcatgctcatggggctcttcaagtggaggagacacgcagctttgctcacgg

SEQ ID NO: 6804790 - DNA, 59 bp, Homo sapiens
ctagtgaatttcctagtgctggcagagatgtccaacaggcacttggaaacttcaactag

SEQ ID NO: 6804791 - DNA, 56 bp, Homo sapiens
agctgtattctctttgtattaatatctttaccgtgtttcacagggcagaaacagct

SEQ ID NO: 6804792 - DNA, 83 bp, Homo sapiens
ccatcccacagcggagaggcagactggcagggcctggagccttcctgctccagcctggagccgcctgctggtcttgtgggggg

SEQ ID NO: 6804793 - DNA, 125 bp, Homo sapiens
tttctgcagagagctgctgattgatagctgacagtttttgctgtattgtaatgtcccttttatcccagctctatagttgcagtaaaaaatgtttttgtgtggcgaaatacagtagtatccagaaa

SEQ ID NO: 6804794 - DNA, 89 bp, Homo sapiens
gtcagacatgggatttagaggcaggagggttttacctaagaacatagactgtgtgcccagactgcctcagtgaaaatctcagccctggc

SEQ ID NO: 6804795 - DNA, 69 bp, Homo sapiens
acaagcttgggctcttctcaggagctatctccttcaggaagccttccatgagagggccctgtgccatgt

SEQ ID NO: 6804796 - DNA, 69 bp, Homo sapiens
gacagcttaaggactccctgcattatcttccagggcaacctgacagccaggagagctccttcaggtttc

SEQ ID NO: 6804797 - DNA, 107 bp, Homo sapiens
ccttttatcacatataaaacccttctcatgcatagttatagagacagtctaaatctgaccatcagggtctttacaatctaagcatagttttggcatatgttgaaagg

SEQ ID NO: 6804798 - DNA, 69 bp, Homo sapiens
tcttggtgccaaaaggagcattgtatttacatagaatgcattgtttagaactctttggcctgccagtga

SEQ ID NO: 6804799 - DNA, 89 bp, Homo sapiens
ccaatggaacattttccatcctccagtagtgtagtcagatgtacacggaaggtggatgactggctgcggggtggaagaagaattcatgg

SEQ ID NO: 6804800 - DNA, 71 bp, Homo sapiens
ttggaaatggatgtgtctggctcccctgcaagggtacactgcccttggaaacagacatgtccatcatttgg

SEQ ID NO: 6804801 - DNA, 98 bp, Homo sapiens
gagaaactgggatatagctggtgcaggcacctcgtggagtggaagaactgccacctcccatccccaaggtattctgcctcaatgtcttccctcttctc

SEQ ID NO: 6804802 - DNA, 77 bp, Homo sapiens
acctgaattgcacatctaataatgctagataaagactgtctcaagcttgttggtatgtttacactgcttgattaggt

SEQ ID NO: 6804803 - DNA, 118 bp, Homo sapiens
tcctccattaattttcttctcttgcatcccgctttcttcaaatttatcctgcatgcaagtatctcaggaaataggatttgagttggggcttgatgtgagagactgagaagatgtggga

SEQ ID NO: 6804804 - DNA, 69 bp, Homo sapiens
tctggactataggctgccaagtgctgcataaataaatcatcaagtcattttggcatcctgtgggccaga

SEQ ID NO: 6804805 - DNA, 61 bp, Homo sapiens
gaatgggtcagtgtgtcaaagagggaaagaggagaagggcccactttggacctgatgtatc

SEQ ID NO: 6804806 - DNA, 59 bp, Homo sapiens
ttattaagataacacaatgcatctaggacagggtccagagctttccagtttcttggtga

SEQ ID NO: 6804807 - DNA, 85 bp, Homo sapiens
gctgtgaccttagaaatgatttcacctctttctacttctgtttccccaggtgtgaaaaggggataaattttctgttctgtacagc

SEQ ID NO: 6804808 - DNA, 72 bp, Homo sapiens
tctacctccatgtggctgctgacaacagagatatataacttctggggtacatccaacacatgaaaggttaga

SEQ ID NO: 6804809 - DNA, 66 bp, Homo sapiens
ggtcatagcactgttcacacaatgttctggggagcccaggagctccttgaaggcagtagctggacc

SEQ ID NO: 6804810 - DNA, 89 bp, Homo sapiens
ggttttgatgtgccttatgttatgaatggatgatctgagctatttgcaaagatttgcataatcattacatacattatatacaatcaacc

SEQ ID NO: 6804811 - DNA, 74 bp, Homo sapiens
cggggtcggccatgggttgctgggggccatggtcctgtgcctatgggccaggctcagcagtcaacctggccctg

SEQ ID NO: 6804812 - DNA, 70 bp, Homo sapiens
gtcttttccctctttcccaggtaactcatatgcctcccagatgtttatatttggaaagagggaagaagac

SEQ ID NO: 6804813 - DNA, 71 bp, Homo sapiens
tctttagttttcctttgggactttcaggattagttgatccagaaggcaaacaaaaggatttcgatagaaga

SEQ ID NO: 6804814 - DNA, 88 bp, Homo sapiens
gttgggtgtctggcagcaggtcacacgcagattcaactattagctattgagctatgttctttgctgggctctgtgccagacatttaac

SEQ ID NO: 6804815 - DNA, 58 bp, Homo sapiens
ctcttcatctcagtcccctaatccttctccctttgagcagggcttctgggatcaagag

SEQ ID NO: 6804816 - DNA, 84 bp, Homo sapiens
gcacgtatttagttttgtaagaaactgccaagcctctttttcagagtggctggaccattttgcattcccactagcaatatgtgc

SEQ ID NO: 6804817 - DNA, 58 bp, Homo sapiens
tgtcttagtgtcttgggctttttcttctggccaaaaccagagagtgcagacacaagca

SEQ ID NO: 6804818 - DNA, 61 bp, Homo sapiens
taattttacttcctgagcacctttctttcctccaaaggctgcaaagttcaggatagagtta

SEQ ID NO: 6804819 - DNA, 80 bp, Homo sapiens
aagcaatgtgtactctctgcacagaagtagatagctgagtccccagtctgggtgtctgcaatgcgcagagacagatgttt

SEQ ID NO: 6804820 - DNA, 57 bp, Homo sapiens
caatggggaagcaattggatttcctctgaaagagaggagaacatatctcccacattg

SEQ ID NO: 6804821 - DNA, 87 bp, Homo sapiens
cagtatgaatttgattggtcagccacgtagggaatatgtagaagagagaacaaatttgctttgattccctagtggttctaccagctg

SEQ ID NO: 6804822 - DNA, 80 bp, Homo sapiens
aggtgaaattgatggactgtaaagagaactgtgggctggccatgccaccataattttctcttgctgtcattttttcccct

SEQ ID NO: 6804823 - DNA, 59 bp, Homo sapiens
gccatgctacttgctatgcaaaaacagtgggattgctttctgcatgccagaagcagggc

SEQ ID NO: 6804824 - DNA, 61 bp, Homo sapiens
ctagatcctattgctattagtgccattattgagataactggaaaattcaaatggggtctgg

SEQ ID NO: 6804825 - DNA, 65 bp, Homo sapiens
acttaacagtggtctgtggtatctgaggaaactttagatgaacagaaagccactgttttatgagt

SEQ ID NO: 6804826 - DNA, 121 bp, Homo sapiens
tcgccttccttggcaggtctgtctggtgctgactctgtcgtgagcagtagttgctccagagtttgttccttcctgttcctctggtcagagtctcaccatgagatgccttcagctcaggcga

SEQ ID NO: 6804827 - DNA, 89 bp, Homo sapiens
tcccttgataaaacctttggagcatgcattttcttgactagtgtttctgaactaatcctcagttatggatgttttaagggttcaaggga

SEQ ID NO: 6804828 - DNA, 68 bp, Homo sapiens
ccaccttagggagggatgctcccctcagctctgtcctctgagggagagacatttccttcttgacttgg

SEQ ID NO: 6804829 - DNA, 76 bp, Homo sapiens
ttcagccttttaaaaattgcttttatgcagggcatggtggcatgtgcctgtggttccagttttttcggaggctgag

SEQ ID NO: 6804830 - DNA, 75 bp, Homo sapiens
cagatttagattcgctggggctggggtggagcctgggagtccttgtttctaaccagctcccaggtctgaggactg

SEQ ID NO: 6804831 - DNA, 63 bp, Homo sapiens
gctggaggaccacagaagctggtggggtaattcagcacgagtctgaaggcctgaaaacccagc

SEQ ID NO: 6804832 - DNA, 59 bp, Homo sapiens
attctgaaattttccacatatcaaagtggcctcaatggctcttggaaaaagttcagaat

SEQ ID NO: 6804833 - DNA, 75 bp, Homo sapiens
tggtagagacttgcctaaggtcatgcaactagtaattagtggagctagtatttgacctcaggaagtagaactccg

SEQ ID NO: 6804834 - DNA, 56 bp, Homo sapiens
accacctcagctctggatggcacttaagtcagcctcaattcattggccagggtggt

SEQ ID NO: 6804835 - DNA, 68 bp, Homo sapiens
ctgggaggtggcccttgctcagccttccacacccctctttgtgcaagtctgagggcagcccctctcag

SEQ ID NO: 6804836 - DNA, 64 bp, Homo sapiens
gtgaaagagaaaatgatctgtacatgcagatatggatgtagcagaagatgttttcctaaatcgc

SEQ ID NO: 6804837 - DNA, 88 bp, Homo sapiens
agtttgaatttatgtagcattcaaaacacattaaagccatttgaccatgacaaaggcctttcctgctttgaatgatgaagccagtact

SEQ ID NO: 6804838 - DNA, 102 bp, Homo sapiens
ttgagatggagtctagctctgtcaccaggctggagtgcagtggcacaaccttggctcactgcaacctctgcctcccgggttcaagcgattctcctgcctcag

SEQ ID NO: 6804839 - DNA, 82 bp, Homo sapiens
gcctttgctattgtaaatagtgccacaataaacatatgtgtgcgtgtgtctttatagtagcatcatttataatcctttgggt

SEQ ID NO: 6804840 - DNA, 69 bp, Homo sapiens
tgtctcgcaagccccacctgagcctgactgaacttagcagagccatggtatgggcttgtgctctagata

SEQ ID NO: 6804841 - DNA, 87 bp, Homo sapiens
attgtctgttggcatttttctgagaatatgagaggaaaacaagattcccttgaaaacatagttcagaaaaagtccgtacttgacaat

SEQ ID NO: 6804842 - DNA, 77 bp, Homo sapiens
ccttttccactaccctggtctctacttcacagaaggggctgacttccataaagtagagaccagggtagtggaaaagg

SEQ ID NO: 6804843 - DNA, 60 bp, Homo sapiens
ggcatgcattacatgggatatgccctagcagggggtgggcgttaacatgtgttgtatgct

SEQ ID NO: 6804844 - DNA, 107 bp, Homo sapiens
agtcatctttacaggcggatttcttagtgtttttcattggcagaggcaggcttttccttgtgtgacctcaatgaaagtatatttgatcatccttagaggagatgact

SEQ ID NO: 6804845 - DNA, 84 bp, Homo sapiens
gcaaatacagaagcagcaacattacatggtccaggatatatattaatatgtggtaggagtgtgtgtgtgtgtgtgtgtgtgtgt

SEQ ID NO: 6804846 - DNA, 76 bp, Homo sapiens
attctttgtttccacaaggccttgtcctgctgtgggctgctccttcccacagttggaccttgggaaaaggtagagt

SEQ ID NO: 6804847 - DNA, 88 bp, Homo sapiens
agagggctgtttctaaattcagtttattttgatactttaatggcagtcaaagcctggatcaaaatggaagaatttggctgcactttct

SEQ ID NO: 6804848 - DNA, 66 bp, Homo sapiens
gattagaatgggaagatacaagatgacctgtgaggaaatgtaaggccactttatccccatttagtc

SEQ ID NO: 6804849 - DNA, 67 bp, Homo sapiens
gtggacataccgtgccccaatgcggaatcggggttcctggaggtgctggagtggcactgtgtggcac

SEQ ID NO: 6804850 - DNA, 64 bp, Homo sapiens
gacacacacagctgtgggcctgacgtggcagaaccatctgctataagctccacgctgtagctgc

SEQ ID NO: 6804851 - DNA, 83 bp, Homo sapiens
gcaggaccaaattcttcttcctccacagggcccaccaggctggtagggcagattcggtggagtttgaggagagctgtttctgt

SEQ ID NO: 6804852 - DNA, 65 bp, Homo sapiens
ctaccttccagggagcccaacctacaacaccaagataaattgcttgtattttttcctggcggtgg

SEQ ID NO: 6804853 - DNA, 70 bp, Homo sapiens
attatatctgttcatggaaaaatagttgggaaggtgattccagagtagaatgcctgaacattggtataat

SEQ ID NO: 6804854 - DNA, 77 bp, Homo sapiens
ttgcttgaacccaggaggtggaggttgcagtgagctgagatcgcgccattgcacaccagcctgggcaacaagagcga

SEQ ID NO: 6804855 - DNA, 84 bp, Homo sapiens
acagagaaggctgttctagtctgtaagtcacccattaccataaactctggttttgagctacttgcagcagcagctattggctgt

SEQ ID NO: 6804856 - DNA, 130 bp, Homo sapiens
tgtaacagagtatgaaaagtttattgatgtagtttcagatttcactttgcacctaaccattaaggaagtaccacttgttgagttttggcataatatcaaagaaggttatcataattacctgaaaagacta

SEQ ID NO: 6804857 - DNA, 71 bp, Homo sapiens
ccagaaaatgttgggttattaaattgatagacatgtagtgtctacaatgagaaatgatcagtcttttctgg

SEQ ID NO: 6804858 - DNA, 61 bp, Homo sapiens
ccaacggggaagctgctcctggttttacagtttagtttgaaatcagaggcttcctagttgg

SEQ ID NO: 6804859 - DNA, 73 bp, Homo sapiens
agtactgggtacaagctggagggatagaagtatattttggtttattctgttcatgttgggcttttccctgtct

SEQ ID NO: 6804860 - DNA, 65 bp, Homo sapiens
attgagaatgccataagagctattcatccccactcaagtgattatttttatatggctttcttgat

SEQ ID NO: 6804861 - DNA, 81 bp, Homo sapiens
actgctgccaaaataatattcctaaagcatgattctcattgccatcactgctttcaaaaattattgctggcaggaagcagt

SEQ ID NO: 6804862 - DNA, 59 bp, Homo sapiens
gcaaagtcacttcgtgagcactgactgtaccagaataatcagcatgctctgtggctggc

SEQ ID NO: 6804863 - DNA, 56 bp, Homo sapiens
tctcttcatttgctatgggtcatgtagatatggaccatcgaaggagatgaagaaga

SEQ ID NO: 6804864 - DNA, 59 bp, Homo sapiens
gatgactgtgtgggctccgaggaccagaacactggaatcttggctgtgcatgcatcttc

SEQ ID NO: 6804865 - DNA, 79 bp, Homo sapiens
ttgatggcattatttaaaagcctcactatctaacacagatttttcaatgttgacagtgatggctgcaaattgtcagaaa

SEQ ID NO: 6804866 - DNA, 75 bp, Homo sapiens
caggaccagagtacataggagcaaatcagtcatcgcctactcaggcttgtttgcagttgtgtgtttgtggtcctg

SEQ ID NO: 6804867 - DNA, 80 bp, Homo sapiens
ggccttgctatttaagcaggatgaactaacacctgcagaataatatctgcatctgtcactgcttagttggatttcaggcc

SEQ ID NO: 6804868 - DNA, 61 bp, Homo sapiens
gggagctgggctggttttgctgggccatactgtactgcctctgtggaactgccaggctccc

SEQ ID NO: 6804869 - DNA, 66 bp, Homo sapiens
gaagttattgcaattctggcacctttctggacttccttccagagcagtgaggagttgtgtaacctc

SEQ ID NO: 6804870 - DNA, 75 bp, Homo sapiens
actgaaataaacgtatttggaagacagtgaaacagcacttcacaagtgaacattttcttgcaaattgatttcagt

SEQ ID NO: 6804871 - DNA, 69 bp, Homo sapiens
tgtgccatgaggctctgatatgtgccctgcactgtggggggtgccaaaaattagagctacatggctaca

SEQ ID NO: 6804872 - DNA, 65 bp, Homo sapiens
ctctgaggatggggaaaaaatggatcttttctacataaagactcaattgttccctaatcttagag

SEQ ID NO: 6804873 - DNA, 67 bp, Homo sapiens
ggggtataagcaggaggtctaggaggagctgttctctgccctccagagcttgacctgctgaggcccc

SEQ ID NO: 6804874 - DNA, 80 bp, Homo sapiens
gccagtgggtgaatgcaggaacagcaccaggagctagagcccaactctggcctgtgggctgtctccgggtcctcagaggc

SEQ ID NO: 6804875 - DNA, 130 bp, Homo sapiens
agaggaaggcactgcaaaatctcgacttacttctgacaacatctttgtgcttttgtggagtttctagcttaagttttcaaaaaacacagatgtctgtgtagtatttgtatctttttttaaggtctttctt

SEQ ID NO: 6804876 - DNA, 66 bp, Homo sapiens
cttaatacactattttgtgctcagtgatagaaaatagtgtttcagtgagtatgtgatagtgttgag

SEQ ID NO: 6804877 - DNA, 95 bp, Homo sapiens
agcaggggatgggtagaggtggcagctgctgctactgcaggtgcttcccctcacaccacagatgcaggtctgctcacctgacctctcaccctgct

SEQ ID NO: 6804878 - DNA, 57 bp, Homo sapiens
ggtatgcatgttcatcagctcatttttaacatgaatgtgctttttgacatgcaagtc

SEQ ID NO: 6804879 - DNA, 114 bp, Homo sapiens
ggcaggcccttgggacacagagtgactgagcctgaggagttttccatacctagtgcaggactttcagtgctcaaacctatgaagtcccaggtaaaagggaatgagttggtctcc

SEQ ID NO: 6804880 - DNA, 90 bp, Homo sapiens
gcactttgtgaagtaatatgttctgagtttttcacatcttttaaatttatttttaaagctgtagagttacttgctgttctttcaacatgc

SEQ ID NO: 6804881 - DNA, 87 bp, Homo sapiens
atttgcttaaggtaaaattctattggttgaaaacagtaacaaatgaatatacatgtgacaaacaggtagggttttccttagataaat

SEQ ID NO: 6804882 - DNA, 106 bp, Homo sapiens
cagagtgcagacagaggtcaggatatgccagcccatgaatatggccctgtgtgttttgtgggccttgttactgtgcatatgtactgaggctcagtgtcacattctg

SEQ ID NO: 6804883 - DNA, 57 bp, Homo sapiens
agtggagaatatgcagaaagcctgaaaagaactagagcctctgctctcttttccatt

SEQ ID NO: 6804884 - DNA, 61 bp, Homo sapiens
tgggtgttcctggggtgcaagggcaggccaggtaagtcttgcctgcaccctaagggcccca

SEQ ID NO: 6804885 - DNA, 113 bp, Homo sapiens
ggactaagtgaagctctgcagtgcactgaacaggccctcctgctcaaaataccagtagcagaacagacttaacagggctgttcagtgcaccgcagagcttcatttcctggtcc

SEQ ID NO: 6804886 - DNA, 85 bp, Homo sapiens
ccacctttcccttcctgaatctgtagggactcagctcaaaaatggagataaccacagctgccctggtaagattgatgggcggtgg

SEQ ID NO: 6804887 - DNA, 74 bp, Homo sapiens
gctgccgtccactgtcccctgggaggcgtccagagccgtctccacctgggcaacagtgcctcgacggtccatgc

SEQ ID NO: 6804888 - DNA, 92 bp, Homo sapiens
tgaggggctgggagtggcagcagatttctagattttccaggtttgtgcaacctaatgggagataaagcatctgttcttgatcctgctcctca

SEQ ID NO: 6804889 - DNA, 75 bp, Homo sapiens
ccagtgtgctgtcattagcatctagagggtgcaacgtgaattcaatcttcaggagtcaagtgagagcatgactgg

SEQ ID NO: 6804890 - DNA, 65 bp, Homo sapiens
atgcattctgtgagctgctggcttttctatcagatggaaagcaagacaggagtttcagaaagtat

SEQ ID NO: 6804891 - DNA, 71 bp, Homo sapiens
cttgccaggtggcctgactcctgggcaaaaccaatgatgtcgcttggtcagtgctagtcccacctggcagg

SEQ ID NO: 6804892 - DNA, 94 bp, Homo sapiens
ctctgggttcaagcaattctcctgcctcaggctctggagtagctgggattacaggtgcctaccaccatgcctgggtaattttttgtatctttag

SEQ ID NO: 6804893 - DNA, 84 bp, Homo sapiens
tttatttggcagctgtcttctggatgaatgtggaagggaacccttggacacaggaaagtcagccagaagattaagccaggtaag

SEQ ID NO: 6804894 - DNA, 65 bp, Homo sapiens
gaggagcttgaggctaggagcctgatttacttcctgtggacttgcaccctagcccagtgcttctc

SEQ ID NO: 6804895 - DNA, 66 bp, Homo sapiens
tgtttctctgaagatatttattattatgcaataacttaatagtttgtaaatatcttcatggtggca

SEQ ID NO: 6804896 - DNA, 99 bp, Homo sapiens
tgcctctctgtttggccagacctgtgggcctagtctggcctagtcttgacagaggacaagaaagaagaggcttatgtgtgtgtgcaagagagaggggta

SEQ ID NO: 6804897 - DNA, 70 bp, Homo sapiens
gtgtgattagaggtatatatgtatgtatgtgtgtctgcatatgtgtgtgttcctcctcagctaattccat

SEQ ID NO: 6804898 - DNA, 107 bp, Homo sapiens
gaacagggagcctagaggccagagttcagggcagctagaaccaggaatgagcgctagagcagttctcatctagactctgcccttgaatgaccaggactcatttgttt

SEQ ID NO: 6804899 - DNA, 80 bp, Homo sapiens
gcaggagtccaggcgagccattgctcctgatgcatagagctgcccgtgcagctggcaggggcactggctgcggggcaggc

SEQ ID NO: 6804900 - DNA, 74 bp, Homo sapiens
cagactgtgggaagacagccaggtggcacgactccggcagccacttgccgcccggccatctcggctcccatctg

SEQ ID NO: 6804901 - DNA, 71 bp, Homo sapiens
tgaggtatgtgatgtcttttagctaaacattcatcaaaacaaattattagagtaaaagcacgagtgcctca

SEQ ID NO: 6804902 - DNA, 111 bp, Homo sapiens
gtttgaattcatagtgcctaattctgtacctggcacataaaagatgttcagttaatgtgtgctgaatacagaattctttgaacaccaggccttcccttactgatttcaaac

SEQ ID NO: 6804903 - DNA, 92 bp, Homo sapiens
gagatacaatcccaaggtagcctcttgagatgaacatggataattgctccaatgttattatctagaggcaaggaccttgagaaatgagtctt

SEQ ID NO: 6804904 - DNA, 80 bp, Homo sapiens
tcctggaaaattgactagtattaagtgtgagtaaaaggtgtccacttttttttaagttttgattttagttttgtcttgga

SEQ ID NO: 6804905 - DNA, 61 bp, Homo sapiens
cattcccgtgacaatgttggatcgtacaaggattgaacagatggaatgtgttatgggaatg

SEQ ID NO: 6804906 - DNA, 62 bp, Homo sapiens
cagagattctaatataaggatgggggtgatttttccccatacctgcatgtgagaatttagtg

SEQ ID NO: 6804907 - DNA, 80 bp, Homo sapiens
gaggtcctcataattataaactgcagtaggtataacaagaggctaaatacatagctgtggttttaattagctggtgcttc

SEQ ID NO: 6804908 - DNA, 55 bp, Homo sapiens
tgtatgcaggaccccaaaactctgacgctttcatagagtccaggggcctgtagca

SEQ ID NO: 6804909 - DNA, 83 bp, Homo sapiens
gtgtgtgtgtgtgtgtgtgtgtggtgctgtgtgcagagtgcagtgagcgtgtacagggtgcagcgagcggacacagtgtatgc

SEQ ID NO: 6804910 - DNA, 77 bp, Homo sapiens
gagaatactaggcttcagaaaggttttctaaatttaattgaaaaaaaccctctattttgatacctggtaatatgctc

SEQ ID NO: 6804911 - DNA, 85 bp, Homo sapiens
ctgaggctggagaagggaggcgagtcttagtgagttccctttaagctctgagacaacagaggccgcctctctcacggccttccag

SEQ ID NO: 6804912 - DNA, 59 bp, Homo sapiens
cattcctttaaatctgtctacatgaaggacgctcttctagatcagtgcataaaggaatg

SEQ ID NO: 6804913 - DNA, 85 bp, Homo sapiens
ggctttcttgaagcagaaccaggtgaggtgcaggcggtaaatgaactccgctgggcactcagtaccaggtcactgctcattggct

SEQ ID NO: 6804914 - DNA, 88 bp, Homo sapiens
aaaaactatttggtgataaagcagcttgggttgatgattaattataaaatattaacagcaaccacagtgctggtcctagatatttttt

SEQ ID NO: 6804915 - DNA, 83 bp, Homo sapiens
agaatgcagagtgttgcacatttcctagaatttcaatagattgaaaaaactataaaaggtgatgtagctaattttgtcattct

SEQ ID NO: 6804916 - DNA, 71 bp, Homo sapiens
agggtggtcatgaaaagcactttaacatcaggacagatgttaagttctgaggttctgttttcaactgctct

SEQ ID NO: 6804917 - DNA, 81 bp, Homo sapiens
gcagagagtgagcagcaacgcggccctactgctttggagtgagagtcgaaagcgatggaacctgcctgcaccacatcctgc

SEQ ID NO: 6804918 - DNA, 71 bp, Homo sapiens
tctgtctctcttagtctgctttttttccaccgatgtaacagacctggagccagcaggactcagaggaaagg

SEQ ID NO: 6804919 - DNA, 71 bp, Homo sapiens
gagttcaagttctctgcatgacccaaggctgaatcatctgcagttcggcctctgcccagtagagtgaactt

SEQ ID NO: 6804920 - DNA, 63 bp, Homo sapiens
tggctgagaagttctggtgggaaggaaccatggagggcccatctggatatccttcctcagcta

SEQ ID NO: 6804921 - DNA, 103 bp, Homo sapiens
gtggaaagcactgcattgcagagctctagggggcgcctttcacaaagactacaaagtaaatggtgcctgctgcagctgagcagtgtacaacctgcacaaccat

SEQ ID NO: 6804922 - DNA, 60 bp, Homo sapiens
cacctcacaggtccaagagatcctcctacttcagccccttgagtggttggaccagaggtg

SEQ ID NO: 6804923 - DNA, 62 bp, Homo sapiens
ttggtttggtttttctgtctgcttaattatatgttttgatttgcatttagaaagatcactgg

SEQ ID NO: 6804924 - DNA, 71 bp, Homo sapiens
cacatctatttctcctggtaagctttctctagaatcaccttctctgagtttattcaggaaatagccatgtg

SEQ ID NO: 6804925 - DNA, 64 bp, Homo sapiens
cataagtgcccagtgaagcagtggtgggaactcctgaccagcacaatgctggctgggtgttatg

SEQ ID NO: 6804926 - DNA, 59 bp, Homo sapiens
taggcaccacctagggtgacccagccccagcctaggtggccccaccctgggtagtcctg

SEQ ID NO: 6804927 - DNA, 61 bp, Homo sapiens
gcagctttgaagacttatttgcatcttggttcttggtgttttctggataagttgaggttgc

SEQ ID NO: 6804928 - DNA, 78 bp, Homo sapiens
tattgctctagcaatcagctattgagatgtgcgtgcctcattgaggctttgcaaaagttaattgttgactaagcaata

SEQ ID NO: 6804929 - DNA, 67 bp, Homo sapiens
ctgcaagccaaggggagaggcctcaggagaaatcaaacctgctgacaccttgatcttggacttctag

SEQ ID NO: 6804930 - DNA, 56 bp, Homo sapiens
gagctgcatcccaggcattctatgatttataacagaatagcattcaggatgggctc

SEQ ID NO: 6804931 - DNA, 129 bp, Homo sapiens
tctccgcagttgaaatgagtttttaaatgggccttgcacaggctcgtgcgcgcacgtgtgtctgtgatgaatgggacggtgccggtggtgatgagcctggcctgttgattcctttcacaacgtaaaaga

SEQ ID NO: 6804932 - DNA, 58 bp, Homo sapiens
tctgagaagtgcaggacttggcctcctcacagtgagtgcagagacctgtcttcacaga

SEQ ID NO: 6804933 - DNA, 68 bp, Homo sapiens
gaggagcagggctttgcagacttgggcgattccatcaatttattgtccttttgtaaaccctgctgctt

SEQ ID NO: 6804934 - DNA, 56 bp, Homo sapiens
agagttctttactgtgtaatgctaaatatcttgttgcggttacacaggagagctct

SEQ ID NO: 6804935 - DNA, 57 bp, Homo sapiens
tattatgatcccagccctggagagaaagggcactttacagttttggtgatgatgatg

SEQ ID NO: 6804936 - DNA, 79 bp, Homo sapiens
gctgtacccggaagttccagtgatataaaactattttgagttttcaaccatcataaggaactgtgactgaggtttgagc

SEQ ID NO: 6804937 - DNA, 57 bp, Homo sapiens
ggggcattttataaccggttattagtctcggctagactaaaggctgtgaggtggccc

SEQ ID NO: 6804938 - DNA, 92 bp, Homo sapiens
gccccccatacctcctccagaatcctgtcttggggatgctgggttggcagtggccttgattcctaagagggggcatggaggggctggggggc

SEQ ID NO: 6804939 - DNA, 108 bp, Homo sapiens
gctggtctgtttctctgctataattatgctcaaaatgtaggcattcatatatgctcaggagtgcttgtacatgagctgagtgtaattacaggtaataaagaagaaagc

SEQ ID NO: 6804940 - DNA, 84 bp, Homo sapiens
gaccttttgattacagtgcaagtatcttagttccattgccttcctgaaagatcaataactttgatattttgcggtaagaaggtc

SEQ ID NO: 6804941 - DNA, 55 bp, Homo sapiens
acccctaaacccaggagtggtcggttcttaaaggactgtgactgggtgtatgggt

SEQ ID NO: 6804942 - DNA, 79 bp, Homo sapiens
gtggcctaaggaggtagccaggcctggaggactgagtgtagcgagtggagacctcaggctgggctgcccctggggccac

SEQ ID NO: 6804943 - DNA, 68 bp, Homo sapiens
ggcttccatgtactgcagtaattttgaattggatatgttatgtccaaattgacagtagtgattaagcc

SEQ ID NO: 6804944 - DNA, 75 bp, Homo sapiens
tcgccggaactcgctttcaggtgggtctacaattagttgggaaacaacgggttgcaaggctgacctggtctggga

SEQ ID NO: 6804945 - DNA, 104 bp, Homo sapiens
tttatttatcctatgtttcactacaaatatgttaaggtgtttgatcatggagctgctccgaacacattcatatatctgcagtgaaacatggggtgttagataga

SEQ ID NO: 6804946 - DNA, 71 bp, Homo sapiens
gcaggtgggaggggctggggggacttgggcctctgccctttggtccagaagtggcctctatctcactctgc

SEQ ID NO: 6804947 - DNA, 56 bp, Homo sapiens
ttaggcctagttactgcttacttctgaggcttgaggagtacagaattgggacctaa

SEQ ID NO: 6804948 - DNA, 108 bp, Homo sapiens
gtggcctcaagaggattaattataaaatgatttaagttaacctgacatgctgaagggtcctgtaactttgccctttatatggttgactatgagttacttgaaggctat

SEQ ID NO: 6804949 - DNA, 72 bp, Homo sapiens
atgggaaggtgattttccaaaagctcacctttttaaaggcaatttttaaaaggaaatcctcactttctccat

SEQ ID NO: 6804950 - DNA, 72 bp, Homo sapiens
cagctcaggagcctttctagggttcagaaagctatggctgtaagagcattcctggagggtagagttgggctg

SEQ ID NO: 6804951 - DNA, 61 bp, Homo sapiens
gggcctgtctcactccctggtttgatccaagacccaggactctttccagggtgggcggccc

SEQ ID NO: 6804952 - DNA, 74 bp, Homo sapiens
ggcagtttataagctctgaaatctcctaacaaatgaatggaaaatttctttggaggttccatgatttgtctgcc

SEQ ID NO: 6804953 - DNA, 57 bp, Homo sapiens
ctccctgttgttagatgagtttagaagggaagttcctgattcctctgagaactggag

SEQ ID NO: 6804954 - DNA, 56 bp, Homo sapiens
ctactgtcttccttggtaacaacatcttctaggtaaaatatttgggaatacagtag

SEQ ID NO: 6804955 - DNA, 60 bp, Homo sapiens
ctggacctcagctgtggggatgctgccagctcgtgacagcctccactagctgcaggacag

SEQ ID NO: 6804956 - DNA, 82 bp, Homo sapiens
ggaactgtggtgcattcatcttcctccatgcagattaaatagcagagaaagctgcagagagagataagaatgaagcagcccc

SEQ ID NO: 6804957 - DNA, 56 bp, Homo sapiens
gccacgactgggttctgcagtctccggaaggattttagttgacccccagtcctggc

SEQ ID NO: 6804958 - DNA, 101 bp, Homo sapiens
gtggcacgatcatacctcactgcagtctcaaactcctaggctcgagcaatattctcgcctcagcctcccaagtagctgagactaaaagtctgtgatgccac

SEQ ID NO: 6804959 - DNA, 70 bp, Homo sapiens
tgtcagtagtgccaaggttgagaaactgtaggatataaagattctcaagttttgctttgggataattgca

SEQ ID NO: 6804960 - DNA, 59 bp, Homo sapiens
gtttgtgtacatacacatatatgtcccatacacgtgtacgcatgtgcatgcacacggat

SEQ ID NO: 6804961 - DNA, 57 bp, Homo sapiens
agctgttgcagggatcagcacctgtgccatccccacagtggctccctgaggacagct

SEQ ID NO: 6804962 - DNA, 80 bp, Homo sapiens
ggaagggaaaattcatgggtccagagccctgggctttgttcccaaggctcctgggaaaggctggacacatttttctttcc

SEQ ID NO: 6804963 - DNA, 81 bp, Homo sapiens
tagcagacatactcaagagctttggaagacagttgatatgaggttttcaactgtcctcagatattcttctgtaagtctctg

SEQ ID NO: 6804964 - DNA, 65 bp, Homo sapiens
cctctctgttctcctctgttgcccacagcaacctcagcagttggtaccagcacagagtggagagg

SEQ ID NO: 6804965 - DNA, 90 bp, Homo sapiens
tgctcattcgctcatacactctttgccactccgtgcctggctcccccttggcaggtgtgagatcgaggccagtagtgtgagccaagcgca

SEQ ID NO: 6804966 - DNA, 111 bp, Homo sapiens
caaatctgatggattttctctagtggctgtcctggctctaactggaaaaggattctgaggttgtatctgggcttaggcaggaagagaggtgaaatctattagcaacatttg

SEQ ID NO: 6804967 - DNA, 59 bp, Homo sapiens
gtctttgtggtagtcctcagcctagatttgatgaccatcttcttggattatccagagac

SEQ ID NO: 6804968 - DNA, 56 bp, Homo sapiens
tgcaaggcacccactctgctttttttgtgatgagatggagcatgactggccttgca

SEQ ID NO: 6804969 - DNA, 66 bp, Homo sapiens
agctcctaggtagcaggaataaaaatgtacccagtttcctgactcaggggttcctgattgcctgct

SEQ ID NO: 6804970 - DNA, 57 bp, Homo sapiens
cctggatcacactgtgaagaattgctgtgagagaaattcaaattcagtgtgactagg

SEQ ID NO: 6804971 - DNA, 59 bp, Homo sapiens
gaaacattgagcagaaggagaatggggcccacatattactaccctccacttaatgtttc

SEQ ID NO: 6804972 - DNA, 71 bp, Homo sapiens
gaaaagcaatggaatcaaggattgcatgtgaaagcactgagtgtggggcctgggtttcagagctgcttttc

SEQ ID NO: 6804973 - DNA, 63 bp, Homo sapiens
gctggcaagcaggcctggctggaccgtgggatgcagcccataggcccaggcctgccttgaggc

SEQ ID NO: 6804974 - DNA, 76 bp, Homo sapiens
gttggccttcacagagcgggatgctgggagtaggctggtgacacgtctccacgagcggccagctctgctggtcagc

SEQ ID NO: 6804975 - DNA, 94 bp, Homo sapiens
gggtgagtccatgacataaaattcaataatttgtggcgaaataattaagttgccttgacaagcctaatgttgattttactgtcttctctttccc

SEQ ID NO: 6804976 - DNA, 76 bp, Homo sapiens
ctctgggccctgctgtttggcattggtgtctgtatctctgaccagatgaaggctgtgtagatggatggatgaagag

SEQ ID NO: 6804977 - DNA, 92 bp, Homo sapiens
aggactcaataggtgttattcaacttgtgtctcttaatttctacaactaaaagtaatggactagttgaagacacactagttctttgggtctt

SEQ ID NO: 6804978 - DNA, 107 bp, Homo sapiens
ggtggaatagaggtacaattgggagatcctgaagtatctatggatataagattagaatatacttatattgtactttgattgtctcagtgaattcatcaacacacacc

SEQ ID NO: 6804979 - DNA, 59 bp, Homo sapiens
gtcagcatccagctgtgaaagggaaacactcaggctcttttaactttgagaatgttgac

SEQ ID NO: 6804980 - DNA, 64 bp, Homo sapiens
ttcagaccaagtactaatggcattaatgttttgctagtgctgtgcatcatagtgtttggctgaa

SEQ ID NO: 6804981 - DNA, 64 bp, Homo sapiens
ttgttgcctttggtttgctacatgcctgaactcctcgtggcatatagaaaaccaaagatgacaa

SEQ ID NO: 6804982 - DNA, 70 bp, Homo sapiens
tcggccacatcactctaggcttatcagaaaatagaacctcattttcttgtctaggacagtgatgtgctga

SEQ ID NO: 6804983 - DNA, 79 bp, Homo sapiens
aggctggagtgcagtggcgtgatctctgctcactgcaaactctgcctcccggaatcacgccattgtcctgcctcagcct

SEQ ID NO: 6804984 - DNA, 81 bp, Homo sapiens
acttatgccccttttagtgattcatttagaaaaatatatttttaagacatttttcagaatactaagggagggtttttaggt

SEQ ID NO: 6804985 - DNA, 62 bp, Homo sapiens
aggcagtttggtcactggatttggctgtctctgaaagacagcattccctttggctgcttcct

SEQ ID NO: 6804986 - DNA, 124 bp, Homo sapiens
ctttttaaaaaagatgaaaagaatatctttgagcagaaagcttttttattatttgggcttagttccttaggactgatccccaggaatgaaattatttgttcaaagggaagaactatttgaaagg

SEQ ID NO: 6804987 - DNA, 77 bp, Homo sapiens
ccaggtacctgttctctgcagcaacctttcacctcccatacttgggagtgagttctgttcctgcagagtgccctgtg

SEQ ID NO: 6804988 - DNA, 108 bp, Homo sapiens
ggaaaaggaacgatggacatagcttcatactgtcagagcctgaaggggtcttggaaaagctctaggtcaggaatggcttgcaggctgtcactttccattcccttatcc

SEQ ID NO: 6804989 - DNA, 61 bp, Homo sapiens
atcatgaatgttttgtatagatcactggacaacagaactcagagactgaagcatttatgat

SEQ ID NO: 6804990 - DNA, 92 bp, Homo sapiens
ttaagggataccttttgccagtctgttctcacctctgagttctaataacatagaatcaggtgaaatagtctggctacattaatattccttga

SEQ ID NO: 6804991 - DNA, 75 bp, Homo sapiens
ttttatcagttaaatcattactgacagagatttacttttatttgatgttagcagtgatttgggcagcagatgaaa

SEQ ID NO: 6804992 - DNA, 106 bp, Homo sapiens
tgttcctagtagccctttagccatagagatggtagaacagtcataaggacttgtttaattccttatatctttttacatctctccttcgggtgttactaccataaca

SEQ ID NO: 6804993 - DNA, 65 bp, Homo sapiens
tggcacagtacccagggctagtaaaaagggcctgggcctattatttattgctagcccttggtcca

SEQ ID NO: 6804994 - DNA, 79 bp, Homo sapiens
agtaacaggtgttttaaatctttctgagtcattggtacacctaagagccagactggtaaggtattggaattctgtgact

SEQ ID NO: 6804995 - DNA, 76 bp, Homo sapiens
ttttggttttaagtcctgtgagatttatgctttaaagatgttgtgttttgatgtgtttccaggatttgtttcaaga

SEQ ID NO: 6804996 - DNA, 62 bp, Homo sapiens
gaggaagaacctggccaaggctcaatccaacatccaaagccagaggccatatttcttcactc

SEQ ID NO: 6804997 - DNA, 60 bp, Homo sapiens
tgttctgggcccattctgctggatagtaactaagtgattaatgccaatgggccttgggca

SEQ ID NO: 6804998 - DNA, 90 bp, Homo sapiens
ggaagtccattctgagtcagttttctaggccctggggttagtgagcacttgggccaccaggttctgggttaagctgactttattaggtcc

SEQ ID NO: 6804999 - DNA, 86 bp, Homo sapiens
gctcacatgggcccttggaagagaatgctatggtgaaaagagaaaatcagaatgtgtttattttcatagttggcccagcaacgagc

SEQ ID NO: 6805000 - DNA, 62 bp, Homo sapiens
ggaggctgtgttgcaaatgtgtatgttgtgttactgcaaatatcacacccagtacagtctcc

SEQ ID NO: 6805001 - DNA, 98 bp, Homo sapiens
agagcgaggtgctcccggacaggctggctgagctgcagcctgcatcctctgtgctgccacaaattcagctgcctattgggggtgtcggcaccagctct

SEQ ID NO: 6805002 - DNA, 56 bp, Homo sapiens
ctaactacaatatgtatgtatgtatgtatgtatgtacatgtgtatgtatgtattag

SEQ ID NO: 6805003 - DNA, 129 bp, Homo sapiens
acctggggtgccggtgtgttttacaaggctggctttcatggcgcagttgagttcccacttgcagaacatactcaccctgtggctataaggcaaagcgctggggcttgtaggcactggaccccaagcagt

SEQ ID NO: 6805004 - DNA, 62 bp, Homo sapiens
ggggaaaaatatgatataaagtggatttgccacacatccagtttatgtcatattctttcacc

SEQ ID NO: 6805005 - DNA, 77 bp, Homo sapiens
attctcatgtatgatgggaggaatggaattttattacttttgaaatggctagtcaatgtcccatttattaaaagagt

SEQ ID NO: 6805006 - DNA, 59 bp, Homo sapiens
ggacagccttccctgagagaagtgtcctgttcttttcttcaagggtaaaggcaacgtct

SEQ ID NO: 6805007 - DNA, 59 bp, Homo sapiens
cagggcactgaatgccaagctaggaggcttgggtgggattctcttggcattagtgactg

SEQ ID NO: 6805008 - DNA, 61 bp, Homo sapiens
gtggctggaatggagctgagcctgtggggtccctgcaggctcacagtgctagtccacccgc

SEQ ID NO: 6805009 - DNA, 88 bp, Homo sapiens
tgtagggcaaaggcttgcgattccttgtaacaatatttcataatttatatatttgattaaaaaccggaatctgggccagcagcctgca

SEQ ID NO: 6805010 - DNA, 102 bp, Homo sapiens
atgtgaaataatttctggggctgtccttagtctgagagcggcttcagcattactgtctctcttaggctgcagacagttctgaaaactgaactaacttcacat

SEQ ID NO: 6805011 - DNA, 76 bp, Homo sapiens
gtaattataaggcctctgtctttatatgactcaagacttttaggagctcacagcataccaagcatggcctcattac

SEQ ID NO: 6805012 - DNA, 73 bp, Homo sapiens
ggaaattacttttgctaacattacaaaaggcctaaagagcaagtgaattttaatcttggcaaatgtagcttcc

SEQ ID NO: 6805013 - DNA, 82 bp, Homo sapiens
ctataaacacataacatacattagctcatatgattaatataatccttgacgtaaatgctaacgatgtaaagatgtgggatag

SEQ ID NO: 6805014 - DNA, 71 bp, Homo sapiens
tttcatttggagtagggctttagcgatggcgtctttgtggaggtgacattttaagagtgttctcagtgaaa

SEQ ID NO: 6805015 - DNA, 56 bp, Homo sapiens
ctcatcttgtgtgttataggtgtgtacatttccatctgagacactcttgtgatggg

SEQ ID NO: 6805016 - DNA, 80 bp, Homo sapiens
ttcagtggcacaattgcagcaataaacaaagacagatgacaattcagcttagatgtttctgctgcagtcttggtcctgaa

SEQ ID NO: 6805017 - DNA, 58 bp, Homo sapiens
agggcggggacagtggctgttttgtttgccagcatagctagcataatgtctggctcct

SEQ ID NO: 6805018 - DNA, 59 bp, Homo sapiens
caggggtcactgagtgagcctcctctgcccctcatgggagagctcctcgtgactcactg

SEQ ID NO: 6805019 - DNA, 65 bp, Homo sapiens
ttcccaagcctacaatgtattagttggtttccacacttcatttacattataggctgctgctggaa

SEQ ID NO: 6805020 - DNA, 82 bp, Homo sapiens
gcgggcaccctcaggtatcctgggctgcaccctcagcctctgggacaccaagggcaagggggtagttgaggagtgggcctgc

SEQ ID NO: 6805021 - DNA, 55 bp, Homo sapiens
caggagaggggttccagacaagttgacaaggaaacctggagaaagcctctccctg

SEQ ID NO: 6805022 - DNA, 61 bp, Homo sapiens
caaagcatagttcatctgtccatgtgacatgaagtattcatggaaggtgaagctagaagtg

SEQ ID NO: 6805023 - DNA, 61 bp, Homo sapiens
caaaccttgcagaactgggcagccaactaattaattgttgcatcaataaagccagggtttg

SEQ ID NO: 6805024 - DNA, 92 bp, Homo sapiens
tcagcatttttcttctttctaaatgtaaatagtatgatgcagtgtcctgtaaatgatgctgtttatcatatactgtcagaagatgctgctga

SEQ ID NO: 6805025 - DNA, 60 bp, Homo sapiens
aaggcagctttgtagtaaagctagtcaatttttgtatggttggtgctcaaagcatgcctt

SEQ ID NO: 6805026 - DNA, 78 bp, Homo sapiens
ttcccaggagggtaattggaaatattaatagaagggacatttttacttgaaaaccaccagtatttgcatatctgggag

SEQ ID NO: 6805027 - DNA, 60 bp, Homo sapiens
caatatcccaggaggccacctgtcagcctaggttgttagatgcttgctcctgggagattg

SEQ ID NO: 6805028 - DNA, 116 bp, Homo sapiens
gtcatctggagtttaggtgaacagtgcaatttctgggcctcacacaagacttgatgatttggggtctatggggttgagtcccagagatctgcattgcaatgggatttttggatgat

SEQ ID NO: 6805029 - DNA, 61 bp, Homo sapiens
tttcataggtggatgctgccaggttagcaacttgccttcttctgtgtaactatctgtgaaa

SEQ ID NO: 6805030 - DNA, 84 bp, Homo sapiens
caagagacagcagagccagatggagccgtgtgttgaaggcttggtgcctatgcggggagctatgggcagcctgcctgtctcatg

SEQ ID NO: 6805031 - DNA, 79 bp, Homo sapiens
tatctgctcaaagagatgatgagataaggataacttcaaagtaatggaagaactaactagtctcatctctgaggagata

SEQ ID NO: 6805032 - DNA, 69 bp, Homo sapiens
attgcattgtgttttaggaggtaaaaatttaaaggagaaaataaacctcctctcaagggcacaggtaat

SEQ ID NO: 6805033 - DNA, 77 bp, Homo sapiens
gcaacaaggcagggggaggctcccagctaatccagacttgaatctcagctgtgggtgggagcaccctgtctggaggc

SEQ ID NO: 6805034 - DNA, 130 bp, Homo sapiens
aataaagttttattggaacacagccatgcccattcatcatgcccattgtctatggctgctgtcctgctgaaaggcgaagctgaagcactgggatggaagcagtatgaccacaaatctggaaatatttact

SEQ ID NO: 6805035 - DNA, 68 bp, Homo sapiens
tgggactgaagtttcttaacaagggtctactttatcagtctccctcctttctaggcttccagctccta

SEQ ID NO: 6805036 - DNA, 62 bp, Homo sapiens
cgggcttacggccgagcttaggaaacccagctcagatgtgaaaccctaggcttggcagctcg

SEQ ID NO: 6805037 - DNA, 109 bp, Homo sapiens
gggggggagaggggagcatttttaatgttaatgttttaagttatagagaatattcaattacattttactaaaatgggcttaaaattagatatggttgtctcttcccttt

SEQ ID NO: 6805038 - DNA, 56 bp, Homo sapiens
ccagggtccccgggtcgctggcaagtttgtggaagggccaggcctgcgggcgttgg

SEQ ID NO: 6805039 - DNA, 63 bp, Homo sapiens
caactatttgtggcctctaggagttgaggatagtctccagctgaagagccaacaaaaagcttg

SEQ ID NO: 6805040 - DNA, 62 bp, Homo sapiens
ttgctgagtctctaggtatgatgagcacagtaatttgaaactgtaacctgagattaaggcaa

SEQ ID NO: 6805041 - DNA, 107 bp, Homo sapiens
tgcagcatgcaggagaggctctggtgcagcatgcaggagaggctctggtgcagcatgcaggagaggctctggtgcagcatgcaggagaggctctggtgcagcatgca

SEQ ID NO: 6805042 - DNA, 80 bp, Homo sapiens
ctctgcatgatgaacaaatgagcaaatgaagaacacacatacagattctctcccacacgctcacatgttcatttgcacag

SEQ ID NO: 6805043 - DNA, 75 bp, Homo sapiens
ttgtgttaaggtgcatctagtgcagttagtgaagcagcttagaatctactgccctaaatgccccttctggcacag

SEQ ID NO: 6805044 - DNA, 98 bp, Homo sapiens
gggtttgatccttggacttcgagtaacccaggctgggaattccaaggcttcaaatggggccaggaaaaaccggccctgctagccgactccacaagccc

SEQ ID NO: 6805045 - DNA, 63 bp, Homo sapiens
ctacaagtatgggggctccaaagcaagacaaaagagtatttttgagagcttctaagcttgtgg

SEQ ID NO: 6805046 - DNA, 103 bp, Homo sapiens
tgatctctggtgaagactactgttgcactcatatgaagctgtgccttttgcccagaaaatcgtgcatctttgtgtgaacagtatgtcatttcacaatttgtca

SEQ ID NO: 6805047 - DNA, 56 bp, Homo sapiens
gcccaccgtggctagaagtacttgagccgtcaacagtaaagctactcactgtgggc

SEQ ID NO: 6805048 - DNA, 127 bp, Homo sapiens
ggaaggatatcttgaaggtgtcatttcccagggaatgggcaggcagcctccatccacagggtgtcctctgaggtccttgactgcttgcctattttaaggagagcatccagatcttaggtttccctct

SEQ ID NO: 6805049 - DNA, 63 bp, Homo sapiens
tcctaaaagttccccactggcctcacacaggactctgggcagagtgaggaagagcttccaggg

SEQ ID NO: 6805050 - DNA, 64 bp, Homo sapiens
cacccaagatagcacctttgtggaatgtctgtaaggcatacaacacagaggcgctgtatggctg

SEQ ID NO: 6805051 - DNA, 61 bp, Homo sapiens
actgggctgtaaagagaggcaatgatgaacaattttaagaccatcagctttggagtccagt

SEQ ID NO: 6805052 - DNA, 80 bp, Homo sapiens
cagggattttggaatctgggaaaacagtgtgttaaatttatgatgtgcattttttctccacttttcagcattattctttg

SEQ ID NO: 6805053 - DNA, 117 bp, Homo sapiens
caattatctgtataatgaaagaagagaaacaagactgcataggaccaaatagtaaaggcaaaagccatgtatactatgttctgtagcaggttttacttgtgattttacaattaattg

SEQ ID NO: 6805054 - DNA, 96 bp, Homo sapiens
agtgattaagggctccaaaggtgagtgtcttaagagagccaggagaaaccttcatggcctcttacgacatagccttggaagttacctggtgtcact

SEQ ID NO: 6805055 - DNA, 97 bp, Homo sapiens
attttaattatattaggtcagatttgatgtggttttctaataaagcagattcttgcttagagcgactacgcattaaatcaattaaatatgtgaaaat

SEQ ID NO: 6805056 - DNA, 75 bp, Homo sapiens
gatgaactgcagcatggccatctgggccgtccatcctgcatggtcacgctgtccggccactgctgcaggtacgtc

SEQ ID NO: 6805057 - DNA, 87 bp, Homo sapiens
catctctttgcaaaactaggaaaagttgaagccttgtggaaagactgctacataacccatggctttcagatttctatgttggaggtg

SEQ ID NO: 6805058 - DNA, 122 bp, Homo sapiens
aaatctggctgaacattataatcattcatacccatgcaatcagaatctttaaggatggggacaggcctaggactctgcattttaaaggtatgccgaagaaatcctaatgtttattcagattt

SEQ ID NO: 6805059 - DNA, 57 bp, Homo sapiens
tgctattacctgctggacagtcagcagtggggcaccatcactgtggcaggtgaagca

SEQ ID NO: 6805060 - DNA, 67 bp, Homo sapiens
ggtcttgaattcctgcccttaagtgacccacccacctcggcctcctaaagtgctgggattataggcc

SEQ ID NO: 6805061 - DNA, 59 bp, Homo sapiens
tctctcacattttagatccaacttggatctaaccgtgacttggatctaaaatgtgggga

SEQ ID NO: 6805062 - DNA, 97 bp, Homo sapiens
ggagaaaaacagcattacatactagtacaggtttaagtcagtgaggccaagagctggccagagcacaggctggtagtaaatgcctgacatgttcttc

SEQ ID NO: 6805063 - DNA, 73 bp, Homo sapiens
ggtgttttccacagtgtggcataaactgtaagtcaaggatgtattagttatctattgctgtgtaacaaatacc

SEQ ID NO: 6805064 - DNA, 61 bp, Homo sapiens
aaaatgttgtgtttcagttcaagaaatgtgtcaaatggttctgaacatcctacaacatttt

SEQ ID NO: 6805065 - DNA, 63 bp, Homo sapiens
atggtgatattcctttggcatgcgagactattaatatgactcgtgctggaaaaagtcactcat

SEQ ID NO: 6805066 - DNA, 75 bp, Homo sapiens
cccaaggagcttttaaaaaatactggttctggggccatattccagaccagttacattagaacttctagaactggg

SEQ ID NO: 6805067 - DNA, 78 bp, Homo sapiens
gaagttatatgacttatccaaggctatatctcaatactattggaatcaaaagtagatgtggctgagtcttctgaattc

SEQ ID NO: 6805068 - DNA, 106 bp, Homo sapiens
ccagatcctcaaaatatctaggttttgatgtggtgcagggcagtgctttccaaggagtgtttctggggcattcatagttgttacctaggtgaaaaaaagagtctgg

SEQ ID NO: 6805069 - DNA, 56 bp, Homo sapiens
tcctgccttgcctgggacatcaggagctgagggtctatataggtcaggacccagga

SEQ ID NO: 6805070 - DNA, 65 bp, Homo sapiens
gtcacccaggctggagtgcagtggcacgatcttggctcactgcaagctccacctcccgggttcac

SEQ ID NO: 6805071 - DNA, 80 bp, Homo sapiens
agagaagtcatcagagaacattttgccttacctctcactgtcctatagataaggtgaagctcccgatgagaactatcttt

SEQ ID NO: 6805072 - DNA, 64 bp, Homo sapiens
cagggtggagttttcagccctctgacattaaaaggtgaagcagaggacatgaaaactcgctctg

SEQ ID NO: 6805073 - DNA, 77 bp, Homo sapiens
aaggcagcctggtttagtagtcgcatatcatctataagacctgtaggcttttgtgagattaagctactcatgacctt

SEQ ID NO: 6805074 - DNA, 76 bp, Homo sapiens
tctgccttgggaggaaggtgagcagggcactggtgtcccagaaaatgcccctggctggccagctcctcctcgtaga

SEQ ID NO: 6805075 - DNA, 74 bp, Homo sapiens
gccaggttatcaaggtcaacattgacagtgataagtgataacatgtaccctcgatatgatctgatgaaaatggc

SEQ ID NO: 6805076 - DNA, 57 bp, Homo sapiens
gttggagagggtggtagctgatatgaaataatctattattgcaccttcctcactaac

SEQ ID NO: 6805077 - DNA, 86 bp, Homo sapiens
ggtgtcctcctgctgtgaagccaggcctgtaggagcctgcaagcctcggggggcacaggggacaggcctgacacacagagggctcc

SEQ ID NO: 6805078 - DNA, 77 bp, Homo sapiens
gaattggttccttctgcgggtcatcagggagaacgtgttccacgcccctctcattggcttgtagatatggccatctc

SEQ ID NO: 6805079 - DNA, 80 bp, Homo sapiens
gtgcctttgttagtattcttattatttgtgtctatattattaagtaacatggaagataaaaatactcatagctagagcat

SEQ ID NO: 6805080 - DNA, 55 bp, Homo sapiens
gtcaccagtcccagctcctgaatgcccacatggccatcccagctgccactgggac

SEQ ID NO: 6805081 - DNA, 67 bp, Homo sapiens
gctcatgctcactgggctctgggacagcattttctcctttctgcctcctgcccagatgagtgatggc

SEQ ID NO: 6805082 - DNA, 74 bp, Homo sapiens
gagtttttaacattcttaacttagaaacagggaaactggtgtttatggaattaagtaatgcgtcccaaagactc

SEQ ID NO: 6805083 - DNA, 89 bp, Homo sapiens
agtagatttaatgtagaggaaagatgaaggccggatgtttgaggtttttcttctggtctttctgtttcctgtagtatctgaatatagct

SEQ ID NO: 6805084 - DNA, 70 bp, Homo sapiens
ttctaagaaagatgttgactcctttgatgtaggatgcttcgactcaaattgcttagcacctagcttagaa

SEQ ID NO: 6805085 - DNA, 71 bp, Homo sapiens
tctaaggagccccaaattagaaccagaagccatattgtcaaagcaagttcaaggctctagagttccttaga

SEQ ID NO: 6805086 - DNA, 77 bp, Homo sapiens
ctaattctccggcttaattctaactgtaaggtacatttgtaaatcttacagattttattagggcaaaagattattag

SEQ ID NO: 6805087 - DNA, 73 bp, Homo sapiens
cgccgagacagaatattggttactgttgctgcaaccatgacagcaataatttcttcaagcgttctgctaggtg

SEQ ID NO: 6805088 - DNA, 89 bp, Homo sapiens
cagagcatacaaattactcagagaattcgattaaatgcatattcttgttcatttaatcagaatctctaagtaatttggagtgtggcctg

SEQ ID NO: 6805089 - DNA, 79 bp, Homo sapiens
tttttccatagatagataggtagcatcattgatttgaaataaattaaattgcattgagctgcttattaatccagagaaa

SEQ ID NO: 6805090 - DNA, 85 bp, Homo sapiens
agcctggccaacatggtgaaaccccatctctactaaaaatacaaaaattagctgggcatggtggcaggcacctgtaatcccagct

SEQ ID NO: 6805091 - DNA, 97 bp, Homo sapiens
ggagcctgctggccacaggaatcaaacactggccacagccactttgcagtggatcattgcaggctggcagtgctgaaatcctggccacagaggctct

SEQ ID NO: 6805092 - DNA, 63 bp, Homo sapiens
gcagcaggcacggtctcgacatgcagaaagacgccagcaagttcgtggatctgtgcgtgctgc

SEQ ID NO: 6805093 - DNA, 129 bp, Homo sapiens
tattggaagggaaatgacaagttaatgaaggtttgtggttaaccgcacatttttgtgcctacaaataaacaaggggtgcaagttaatcagcatatactccattaacttggattcttacccttctgttta

SEQ ID NO: 6805094 - DNA, 57 bp, Homo sapiens
atggccagtcaagcctctggctgctcattctggtaggtctgaggttagtttggctat

SEQ ID NO: 6805095 - DNA, 66 bp, Homo sapiens
tttcttacactttccgaaagcttgtttacagacttcagactaacagggacaaggaaaggtaagaga

SEQ ID NO: 6805096 - DNA, 81 bp, Homo sapiens
caggctgtgaccctcttgagggaagcactttctgttgtctgaaagaagagaaagtgcttccttttagaggcttactgtctg

SEQ ID NO: 6805097 - DNA, 56 bp, Homo sapiens
tccaggctagagtgcagtggcccgatctcggtgcactgcaacctctgcttcccggg

SEQ ID NO: 6805098 - DNA, 102 bp, Homo sapiens
gtgtgttctttgtggttggggccaaaatttgaataagccttgccaaatcactttaaagtttagcttgaatcttgtttaaattccttatcactcagatttaac

SEQ ID NO: 6805099 - DNA, 99 bp, Homo sapiens
tatatacacatacatttgcacatacacataagcgaactgtgtgtgtgtgtgcatgtatgtatgtatgtctgtgtgtgtgtgtgtgtgtgtgtgtgtgtg

SEQ ID NO: 6805100 - DNA, 67 bp, Homo sapiens
cttatgtataggggctgcagggagaggttaggctgtggcattgagccctgatagcccctatcatcag

SEQ ID NO: 6805101 - DNA, 65 bp, Homo sapiens
gcaggatggtgccctttctgcccccagggaggctttggccaggtaggaaaggcagatatcactgt

SEQ ID NO: 6805102 - DNA, 69 bp, Homo sapiens
gctgcaactcagatgccaaaggcagcgggcatttcttggcaaactccctttggctctgatcagtggagc

SEQ ID NO: 6805103 - DNA, 61 bp, Homo sapiens
ttttcatattcaaatactctgcttggttccgcattgccaagcttgtaaggagtcatgagga

SEQ ID NO: 6805104 - DNA, 79 bp, Homo sapiens
ttttggttcagagcctgcccagtatagcactacaataagctgaattttataaattgggttttgagttaaggaatcaaaa

SEQ ID NO: 6805105 - DNA, 79 bp, Homo sapiens
gagagcatctttttctccaaggtgtggaccagtgtaaggaaacccatgcctaccacactatggagaagtgggttttctt

SEQ ID NO: 6805106 - DNA, 62 bp, Homo sapiens
gcaaagccttccctggcacccctagtagatgccattggtttttctctatgccaggggcctgc

SEQ ID NO: 6805107 - DNA, 100 bp, Homo sapiens
tttaaaattattcagtgttgccttcttaaggttttgactcttaattatcgttcatttgaaagacaagactatgtagaaagtattctgttgttcttttgaa

SEQ ID NO: 6805108 - DNA, 88 bp, Homo sapiens
gcagccgctgttcattgaggcactccaggatgctgttgccgaagttcgggatctccatctgcagtgtctgggccatggcagcggctgc

SEQ ID NO: 6805109 - DNA, 75 bp, Homo sapiens
agcactgtgtttgcaggtggagtatcagggtttgcctcctagctgtgttattccttaactgcatgaacattggct

SEQ ID NO: 6805110 - DNA, 83 bp, Homo sapiens
ttctgttctggcatttgctagtacacagctgtttctttcaattctgtagaacaaacctgaactggcacctttcctggatagga

SEQ ID NO: 6805111 - DNA, 97 bp, Homo sapiens
gctttcctaccggcaccgcctctgctcctgcccacagccagccctgagaactagctctgcctggcatggagaagagaaggtctggccgtagggtggc

SEQ ID NO: 6805112 - DNA, 61 bp, Homo sapiens
ctcacatagcagagagcagagagagaagaagcaagctctcccatgtctcttcttatgtggg

SEQ ID NO: 6805113 - DNA, 107 bp, Homo sapiens
gcttggactgtctgaggcttttagaatttgagctttctccccagtatgcatcctttgatgctgggctagggtggagctctggctgaaggccttcccacactccttgc

SEQ ID NO: 6805114 - DNA, 78 bp, Homo sapiens
cactttatagaatgcattgattgctggaaatatcatcttactcattccatgtgtttctagatttcagttttctaagtg

SEQ ID NO: 6805115 - DNA, 76 bp, Homo sapiens
ggcatatggtaggccctccattgatgtttattggatgtgaataaatgaatgtgtcatcaagaggatttgcgatgcc

SEQ ID NO: 6805116 - DNA, 55 bp, Homo sapiens
tgggctcagggtcgaggactttgcccaaagccaggtctgcctgattcagagccca

SEQ ID NO: 6805117 - DNA, 81 bp, Homo sapiens
ggtttttgtttaatgatgtttatgtttggggatttttatgtctcttagtaatccaaagtaacattaaacagaacaaatgct

SEQ ID NO: 6805118 - DNA, 63 bp, Homo sapiens
ggagcacagaggaagcacagactctgcctacaaggcaaagagaaaggatgctgctctgtgtcc

SEQ ID NO: 6805119 - DNA, 63 bp, Homo sapiens
gccctggatgctcatggcatcaagcacctggaataccaaatcatgaggtcagagcataggggt

SEQ ID NO: 6805120 - DNA, 64 bp, Homo sapiens
tagtatgaagaagccattgatagttgtaataactttgcattgttaattggtatcttacaaatta

SEQ ID NO: 6805121 - DNA, 112 bp, Homo sapiens
tttccgttaattcctgggaactcttttcagtactcagttttgtagtttctgaggaaatcattatagtaaacacaagattgtgtattgaattaaagtgacaggaatccagaga

SEQ ID NO: 6805122 - DNA, 68 bp, Homo sapiens
aagagattctgtgtcaaaacgaacttgtaggagatgagaagccatagctttgttccatagagtctctt

SEQ ID NO: 6805123 - DNA, 70 bp, Homo sapiens
tgtctaccaagtgtattatgctttgtttggaaatgttggacctcggtactattgcatttggtaaaaggca

SEQ ID NO: 6805124 - DNA, 58 bp, Homo sapiens
tcactgtcactaggcaccaaacctcatcttctctgatttgcagctttagtggcagtga

SEQ ID NO: 6805125 - DNA, 74 bp, Homo sapiens
ttcaatttagcatatttgataaccaatattccttgttcatttgggagcaaatttatcaagatgttatggttgaa

SEQ ID NO: 6805126 - DNA, 72 bp, Homo sapiens
gaagtgttaaggacaatcaggttagtagctaactcagctctgacctcctgcttgttaattacttggtgcttc

SEQ ID NO: 6805127 - DNA, 56 bp, Homo sapiens
gtctgtttatatgtttttcagacctgagatattatggtcgaaaaagataaacaggc

SEQ ID NO: 6805128 - DNA, 81 bp, Homo sapiens
cctatctgtgggattgcaatggtctttttctgaatctaggcaatgctaccttctgaaattcgactatccaatccagctagg

SEQ ID NO: 6805129 - DNA, 56 bp, Homo sapiens
agacacatcttaggttgtcaggtggcagggagttggttgacaggttttatgtgttt

SEQ ID NO: 6805130 - DNA, 77 bp, Homo sapiens
tgagtttcctgtgaaaagagaaggcagttgaattttggttagttgtactgcctgtagctcttcatctcaggaactca

SEQ ID NO: 6805131 - DNA, 78 bp, Homo sapiens
tgaaatgagtggcagtttgggagctacaggacagcaaaatgcattcagttcatgtcagtttgtaaattactcacttta

SEQ ID NO: 6805132 - DNA, 63 bp, Homo sapiens
gctgatctcagagctggagggtttatgcgggactggccagccccttcagctgagtgggacagc

SEQ ID NO: 6805133 - DNA, 77 bp, Homo sapiens
tttgttatctggttgtctgattacttacataatttcatgcggaatttaagatggtggtcagaaatctcagtggcaaa

SEQ ID NO: 6805134 - DNA, 62 bp, Homo sapiens
tctaaaagccgtgagtctctcccctgggcctctagaagcagcaggactcatggtttctcaga

SEQ ID NO: 6805135 - DNA, 59 bp, Homo sapiens
aggttttggagacctagcactgaacaatataggctaggccacttgctctcatggaactt

SEQ ID NO: 6805136 - DNA, 82 bp, Homo sapiens
tctcctcagaacacactgccacctgcatgccctgattggtcaggagtgcatctggagggggtcagttataaggctgaggaga

SEQ ID NO: 6805137 - DNA, 58 bp, Homo sapiens
cttaggcaaccaggtcaatgctggcacatttgccaagatggtgactactggttccagg

SEQ ID NO: 6805138 - DNA, 125 bp, Homo sapiens
tccaactcatttactaagtgcctacaacaccaggccctgggacacaacaccgaacaagatagacacaatctccgccttttggtgcttatgttctaggacggtgtgcatgtgacagatgatatgga

SEQ ID NO: 6805139 - DNA, 65 bp, Homo sapiens
cagaaagcaagccattcactgtcacctataactcttggttaacagggaatggctttgctttattg

SEQ ID NO: 6805140 - DNA, 66 bp, Homo sapiens
tatttaaattgacaaatcatacttgtatacctttatggagtacagtgtgatattgtcatgtaggta

SEQ ID NO: 6805141 - DNA, 68 bp, Homo sapiens
tgtgacatttttactgatgagagttctagtaacagttaactcaagttttctcctacagaagagtcaca

SEQ ID NO: 6805142 - DNA, 77 bp, Homo sapiens
gtgttgagtgctgaggtacacaaattctaagttgcatatttaaagtggttatttgcattgtcttcagaagccaacac

SEQ ID NO: 6805143 - DNA, 76 bp, Homo sapiens
ggcctttggtgcaggttgcctggtaggtgcgacacgcaggtctcctctgggctgcctgcacgggtgggagcaggcc

SEQ ID NO: 6805144 - DNA, 108 bp, Homo sapiens
gttctgatttttctttttagtcaaactaggttctgatttccaagataaggcgaaatccagagcagtttgggaaatgaaggaatctgactgaacaataagagtcagaac

SEQ ID NO: 6805145 - DNA, 58 bp, Homo sapiens
tcactcgttaaaaaaatgcagatgctaaatgtcacgcgtttacattttgaaacagtga

SEQ ID NO: 6805146 - DNA, 55 bp, Homo sapiens
tcagaggttcttctcagtggccactgacaagtctgcaggctgtgaagagctctga

SEQ ID NO: 6805147 - DNA, 89 bp, Homo sapiens
gtgtccttgggtcagatctttggggatgctgtggttctgaaaacaaaggtacatcccacagttctccagtgggatctgcctgtggacac

SEQ ID NO: 6805148 - DNA, 67 bp, Homo sapiens
gtgtcgcccaggctggattgcagtggtgctatctcggctcactgcaagctctgccacctgggttcac

SEQ ID NO: 6805149 - DNA, 103 bp, Homo sapiens
ttgaggcagagtctcgctttatcacccaggctggattgcagtggtgtgatctcggctcactgcagcctccgccttgtggcttcaagtgattttcccgcctcag

SEQ ID NO: 6805150 - DNA, 62 bp, Homo sapiens
atttagagctgtgctgccacatgtggacagaggctatctcattggacagcacaactctagat

SEQ ID NO: 6805151 - DNA, 90 bp, Homo sapiens
ctgccctggcactctcagctgtaggtatggatgtccctaatctacatgtttagggtcatcctgtttctgagctgatcttgaccaaggcag

SEQ ID NO: 6805152 - DNA, 65 bp, Homo sapiens
cactcaggaatggggctgggactcctctgatgttcgaggtgacagtctgggctctgttctggttg

SEQ ID NO: 6805153 - DNA, 56 bp, Homo sapiens
gtagtcttggattttaaaaagtgaccaggaaggtatttattaaaatttaagcctac

SEQ ID NO: 6805154 - DNA, 56 bp, Homo sapiens
tccctgtagggtgagatgtctctgttgtcacaggcagttagtccactttgcagaga

SEQ ID NO: 6805155 - DNA, 102 bp, Homo sapiens
tgagacagagttttgctcttgttccccaggctggagtgcagtggtacgatctcggctcactgcagcttccgcctcctgggttcaagcaattctcctgcctca

SEQ ID NO: 6805156 - DNA, 58 bp, Homo sapiens
ggcaggaggtggcctgagcgtgcccggccctggctgaggtcagtgggggcctcctgcc

SEQ ID NO: 6805157 - DNA, 65 bp, Homo sapiens
gtggtgagatggagttggtgtcttttggttttattaacctagggactatttacccatctcactat

SEQ ID NO: 6805158 - DNA, 70 bp, Homo sapiens
ctgagccagggtgagagggctttgtatttggagagtgaaaagaatacggttgtttaggctttggactcag

SEQ ID NO: 6805159 - DNA, 89 bp, Homo sapiens
cctttgtgcacattgccagggcatcaccattgctcacaggaatgtgtctgtccagcagtgcttgccttagtgtgaaaatagcacggagg

SEQ ID NO: 6805160 - DNA, 66 bp, Homo sapiens
aggggtgagcctagcaggtgttcgaatcacatccgcggattggtacatggcactgctgttcccctt

SEQ ID NO: 6805161 - DNA, 59 bp, Homo sapiens
ggctagcactgtaaaggccaaagtagacaatttgcaggctctggtttatagtgccttct

SEQ ID NO: 6805162 - DNA, 80 bp, Homo sapiens
tcagaatctgtgggtatgcatgtgtgtgtatgtgtaaggcctggcagtacgcatttaaaatgtgctcccagggtttttga

SEQ ID NO: 6805163 - DNA, 99 bp, Homo sapiens
ctcagctggcattgccactagcttgggcctgggtcagatgcaaggtgtgaatctgggaccaggaaggcccaaactatcctggcaatcagagtggctgag

SEQ ID NO: 6805164 - DNA, 90 bp, Homo sapiens
ccagaggctgcctgtgctgtgatattgaagatagaaatactaccctgaagttcctggcatgaaaaatatcacagtacaggcagcctctgg

SEQ ID NO: 6805165 - DNA, 55 bp, Homo sapiens
tgcctttttggagagatgctatttactctgatagctgaaagcttgcaacgaggca

SEQ ID NO: 6805166 - DNA, 90 bp, Homo sapiens
ccagtgtaaatgttttccagttcttctgtaagcactttattctatgaattagtgaacagtttggaacacatggcagaatctgtacactgg

SEQ ID NO: 6805167 - DNA, 69 bp, Homo sapiens
ggaggacggtgagttctgtgaaggtaaggcagaaactgctttaacacatccctgctctacccgttcgcc

SEQ ID NO: 6805168 - DNA, 62 bp, Homo sapiens
cctctcttacatatacgtcatttagtatataaatgtaatgtgatgtagtgtaagagtacagg

SEQ ID NO: 6805169 - DNA, 69 bp, Homo sapiens
agatgtctgttagtgataactgttttaatggctactcttcatgaagcgcttaccagttggcagtcattt

SEQ ID NO: 6805170 - DNA, 66 bp, Homo sapiens
ggaaaggggcctggatcttttgttccatcctgagcagaggggtttctttggctgaccattctttcc

SEQ ID NO: 6805171 - DNA, 59 bp, Homo sapiens
ttatagatagcctgtgagtgttctgtgaagttagagaagatacacagagctgtctttgg

SEQ ID NO: 6805172 - DNA, 81 bp, Homo sapiens
tttttgcttattgctttcaagactgtttcaaacatgatttctttcggtatactatctttgacagtagtgagaaaacaagag

SEQ ID NO: 6805173 - DNA, 82 bp, Homo sapiens
gaccaagcatctggatggaaagcaaggaatatggtcagcaaagttctgccatctgaattttccttttcattcagatgttgtc

SEQ ID NO: 6805174 - DNA, 57 bp, Homo sapiens
gcctgtctcttggaacttggtactacgagagtccttacttccttctcagagacaggt

SEQ ID NO: 6805175 - DNA, 71 bp, Homo sapiens
tccatctgcaaccttaattcctctttgaatgtaagcaacatattcacaggttccagggatgagaacatgga

SEQ ID NO: 6805176 - DNA, 90 bp, Homo sapiens
tcacctccccagggaatgctcaagcccagctttcacccctctgggaaatcggagcagcaaaagcatgggccaatgggcaaggggagttgg

SEQ ID NO: 6805177 - DNA, 70 bp, Homo sapiens
tcagtctaacagggcatgtgcaagagacatcatggaaatgccagaaatgtcatgggcatgcactcactga

SEQ ID NO: 6805178 - DNA, 72 bp, Homo sapiens
tgtaggtcctgttgtcccattttttatatattggggaaaattgagtaatagatgaaacaatgtggagctatg

SEQ ID NO: 6805179 - DNA, 81 bp, Homo sapiens
tagagtttgtttagacagaatgagttcttcacaaactgcctttggaaataagaaaacattcattgtgttgtcaaaattctg

SEQ ID NO: 6805180 - DNA, 68 bp, Homo sapiens
ggctgtgtcccccagatacatgcacaggtgtatgcatgtgtctgtgggcacacacacacaattttgcc

SEQ ID NO: 6805181 - DNA, 93 bp, Homo sapiens
tggggcttctctacagcttttgtgcagtaggggtggtgacagtccttcagtggggcgactggtcctctgccagcagctgcagcacttgctcca

SEQ ID NO: 6805182 - DNA, 68 bp, Homo sapiens
tgatcatgtaagccaggtgtcattatcatctctatcttagtgatgaggagactgtggcttggaggtca

SEQ ID NO: 6805183 - DNA, 56 bp, Homo sapiens
ttcaggttatttggttggcctttctctctttcacggaagggctgctctggcctggg

SEQ ID NO: 6805184 - DNA, 113 bp, Homo sapiens
tggcacatgtaggcctgaggaggcctctgtccatgtgaggttctctggcctagagaagctgagactgtccctgcaggggcttggccacctctcaggttcccctgcatgttcca

SEQ ID NO: 6805185 - DNA, 77 bp, Homo sapiens
agagagccacgcaggggttgcaatgctgggtgagttgggccgtttgtctcttctgtattgttaactcagggttctct

SEQ ID NO: 6805186 - DNA, 65 bp, Homo sapiens
tggcccagaagaaaaagctggtattagaaccgaagatgtctaatgaagtatatttttcttagcca

SEQ ID NO: 6805187 - DNA, 66 bp, Homo sapiens
acatttgtctctgaaatatgtggctccagtggcccagcaggatagcagcctttcagagccagatgt

SEQ ID NO: 6805188 - DNA, 60 bp, Homo sapiens
ttcaagtccaggtcccgggctctgggagttctgctcctgcagagcttgtctggatgtgag

SEQ ID NO: 6805189 - DNA, 72 bp, Homo sapiens
tgagttttagtgtaacggagtgtgaaagcttcactgacatggtttcatattccatattgcaactaatactca

SEQ ID NO: 6805190 - DNA, 55 bp, Homo sapiens
tggacatcttccggatcgccaccccgcacagcctgggtagcgtgtggaagatccg

SEQ ID NO: 6805191 - DNA, 64 bp, Homo sapiens
ttggaaaatttgctgatggcatttgagctgggggcactagttaaatgttcagtaagtaatctag

SEQ ID NO: 6805192 - DNA, 129 bp, Homo sapiens
gctcctgccttcccctatgtgggattcccattggcctgccattccctactctaatggaagaatctgatgagcttcctgttgagagagggagggaaggagtggttccagcaaggggttagttagcagggc

SEQ ID NO: 6805193 - DNA, 56 bp, Homo sapiens
gctagagtgttaccagcatccttttaaggaatgtgtagaggtaagtaacacttagc

SEQ ID NO: 6805194 - DNA, 127 bp, Homo sapiens
ggctgagagtcaggtgccaggctttgtctgaattccagcctgctggatgggctgtcccccaggaagtcctctctggggctagaatcctgcaggaactggggaagagctgtttgcacacactccagct

SEQ ID NO: 6805195 - DNA, 101 bp, Homo sapiens
gtgtaaatatttgtcttttggtcttttgctagccagagagctcttgtcagagatattagctctgctttctaagcagaagtttctgtaggcagagactgcac

SEQ ID NO: 6805196 - DNA, 100 bp, Homo sapiens
aacccccaacttgcgtgggtctgcaattttttagcacaaggagagccttttaaagacctggttcttcaaggaaagaatgcaggtagtgtggttgggggtt

SEQ ID NO: 6805197 - DNA, 102 bp, Homo sapiens
gtataagttaaaggaactggaatttttgtcgtggagtagcgtggttaagatataagccaaccaatcagtgccctgatacaaaatttcagtctaggcttaaac

SEQ ID NO: 6805198 - DNA, 70 bp, Homo sapiens
aggaattgggaaatatggattgttattcctttaaatcaccttgggaaaatgatttatcttctctggtcct

SEQ ID NO: 6805199 - DNA, 75 bp, Homo sapiens
tgatgatgtactagttaaatattactgtgtaacaaatcaccacaaaacttagtgattttaaaaagtaagttatca

SEQ ID NO: 6805200 - DNA, 55 bp, Homo sapiens
ggactggtctgagagggattcatgatggaagcatgttcattctgtgacctggttc

SEQ ID NO: 6805201 - DNA, 86 bp, Homo sapiens
gggaggtctgctatgtgtctgacagtgtgcaagaaatgggggatatgtccctaggattcctccacttagcgccactgggccctccc

SEQ ID NO: 6805202 - DNA, 68 bp, Homo sapiens
gtgtaagctaggaacatgccttattcccttaagcccatatggaggggatgggcaagcctagtgcctac

SEQ ID NO: 6805203 - DNA, 56 bp, Homo sapiens
atccttaaaggaattctgatttcaagtttgaaataagaaccatcctttgtgtggat

SEQ ID NO: 6805204 - DNA, 70 bp, Homo sapiens
tgtaggggtttctgatggatgataaagtagctttttttggcctactctgaaaacccagaaactcctgtca

SEQ ID NO: 6805205 - DNA, 61 bp, Homo sapiens
tgtttctcagatcttgctgcttctttcaaaatggaaagaggccaccttctcttgagaaaca

SEQ ID NO: 6805206 - DNA, 58 bp, Homo sapiens
ggcgaggtgtcctcagccaactctgctacacctgaagcttgtccctgaggtcgctgcc

SEQ ID NO: 6805207 - DNA, 66 bp, Homo sapiens
gaaacttgaattctgccattcagagactgttttcactctctgtggcttctatttaactttagattc

SEQ ID NO: 6805208 - DNA, 127 bp, Homo sapiens
gttcacctgcagggctgtatccacctagtggggaaatcatttgctcatttgtacaaaggctctggagccatatgggctaacgaaggccttgccaatgagagaactccctaccccttgcctcggtgac

SEQ ID NO: 6805209 - DNA, 74 bp, Homo sapiens
cccaggtttccaactagtatgatcaggtgcttaaaaataaatatgtgcctaggtttatatctatggacattggg

SEQ ID NO: 6805210 - DNA, 58 bp, Homo sapiens
ctctcacatttcttttaagaggtgctttgccatgagagtatttccaagaattggagag

SEQ ID NO: 6805211 - DNA, 87 bp, Homo sapiens
tctgtgtcaaaaagtgtctgcaaaatgacagagccaccttgtcacagtggctctttcattttgcagacactttttgccttctacaga

SEQ ID NO: 6805212 - DNA, 64 bp, Homo sapiens
cctgtgcctgccattggagtcctcagggcagagagtggtctgtcctggcaatggcaggttcagg

SEQ ID NO: 6805213 - DNA, 82 bp, Homo sapiens
acagtctgggcatattagaaatgtttactcacccccttccattcctggaagcagggagaaatttttcttcagtcttcactgt

SEQ ID NO: 6805214 - DNA, 71 bp, Homo sapiens
cacgtgctcttgggggtgtatgtttacttaaaatgcaatgagtcagccttggcagccccttcaccactgtg

SEQ ID NO: 6805215 - DNA, 77 bp, Homo sapiens
ttgctgatttgggggtgctgccattgcctctaagtgtgtcaaccttttgcaaacattcagggctccaaagtcagtag

SEQ ID NO: 6805216 - DNA, 58 bp, Homo sapiens
cacttataaaatgtggaaagtcatcaaaacataggatgatggtcaacaattttgagtg

SEQ ID NO: 6805217 - DNA, 64 bp, Homo sapiens
agaggcggaaaggattagatacttttgaggaaaaatgtaacctagtatatccattcatgcctct

SEQ ID NO: 6805218 - DNA, 66 bp, Homo sapiens
gcagaaccatggggcctttgttcaccaccattcctggtgcccattctggtcccatgcgtcctctgc

SEQ ID NO: 6805219 - DNA, 57 bp, Homo sapiens
cagctcttggagaaaccagagcctccatgggtccaggctggttgagccaaggtgctg

SEQ ID NO: 6805220 - DNA, 123 bp, Homo sapiens
gtgagatctgacctataattactaggagccctctcataaggcaaagcactctgcagttgtgttctgatttcataaatgtaccttctgccttactggcttatagttttactgggcatatctcat

SEQ ID NO: 6805221 - DNA, 84 bp, Homo sapiens
ttgactcacgcctcgggctggctccctacctctcccaggagttcagagcctgcgtgtggggcagtggcctgggagcaaagtcaa

SEQ ID NO: 6805222 - DNA, 63 bp, Homo sapiens
gcgggggcgcgcacgccagacagcctcccgtgcggcctcgggctgagcgtgcgcgccaccggc

SEQ ID NO: 6805223 - DNA, 57 bp, Homo sapiens
gcacagttagctccagtcttagccccactggatggggttgtgtgatcctgagtgtgt

SEQ ID NO: 6805224 - DNA, 60 bp, Homo sapiens
tcctcagctcctatctctgtatggcctggcttttcctaggttatgattatagagcgagga

SEQ ID NO: 6805225 - DNA, 79 bp, Homo sapiens
agctactgttgtcttatcaagggaggaaaatgagcaaactcaccggtttatacttctttgaaaaaggcagtcagttgct

SEQ ID NO: 6805226 - DNA, 83 bp, Homo sapiens
catatgtgtgcctgtgcatgacagcatacaaacgtgcatagtgtgtatgtgtgtatgcatgtgtgcatgagtgtgcacatgtg

SEQ ID NO: 6805227 - DNA, 65 bp, Homo sapiens
gctgacctccctgtgtgtacaggctggcacacgtgtgtacacatcctgacccatgggaggggagc

SEQ ID NO: 6805228 - DNA, 58 bp, Homo sapiens
tgccagctgtaggtggtgggttgccttgacaattcacagaaacgtacgtgccgtggca

SEQ ID NO: 6805229 - DNA, 107 bp, Homo sapiens
gcagcactctgtaaatgcagggcggtagatgtttgtaaacacactgctgggctacccagtagttgtgtgtatgcatgtctatatatctgtaaagactgtggtgctgc

SEQ ID NO: 6805230 - DNA, 61 bp, Homo sapiens
cccaggccctggtgccaactcctgctgctcagggactgaacatggcccagatggtcctggg

SEQ ID NO: 6805231 - DNA, 87 bp, Homo sapiens
aaatacatatatgtaagttgcaaatgaaggacatggaagatgaaggagtccatgcattagattcttctttccaattacatggtattt

SEQ ID NO: 6805232 - DNA, 81 bp, Homo sapiens
ttgtgatttgaattaggtttcatggagtatgggtcataggagtttgactcaatacccagggactctagactctaatgacag

SEQ ID NO: 6805233 - DNA, 66 bp, Homo sapiens
cccttttcagtccctattcacaataaatacagaggcaaatttatgtgacagggtcattgaaaaggg

SEQ ID NO: 6805234 - DNA, 84 bp, Homo sapiens
acaatatttcaagtcatttgactgtgtgttaccagggagggacaacaccttgaacatatcataggatgtcattgaatatattgt

SEQ ID NO: 6805235 - DNA, 78 bp, Homo sapiens
agctgctcttgaacttctcttgtagagggttttctagggggaagccctgagcactgcagagaacagttggaagcaact

SEQ ID NO: 6805236 - DNA, 77 bp, Homo sapiens
gaggaaagtagtattagcagcagttcaatccagtgcacgaaatatttgttgcctgttgggatgcaatactacaactc

SEQ ID NO: 6805237 - DNA, 84 bp, Homo sapiens
tgatacagatggaacatgctgcctttctacgagtagttgctcatgcttattagcaaggtattatgtaagtatcaactgttgtta

SEQ ID NO: 6805238 - DNA, 78 bp, Homo sapiens
taggttgaaccatatgaaatgactggtatttggccatttttgaccaatgaacacagcaatttcatagagttctaccta

SEQ ID NO: 6805239 - DNA, 129 bp, Homo sapiens
actctgtcctttctcccaggagcagctggccggagagtaacacgactccagccggacatggtcatgactatttcagcctgcaaggtcatgactctctggcccacctaggactcctaggggaaaggaagt

SEQ ID NO: 6805240 - DNA, 91 bp, Homo sapiens
ttctcctgatctcatgccctgtatacttggtactatatttcattttcctataattttgtaatgcttttgatacagggacatttcagaggaa

SEQ ID NO: 6805241 - DNA, 67 bp, Homo sapiens
tctatctgcttgggaggcaagcattccattaatgatgcggatagttagcctctcagttcagaaaaga

SEQ ID NO: 6805242 - DNA, 98 bp, Homo sapiens
gcctggtgggacaggtagcatttttcctctttcccagctgaaaattgaagttcagagagattaaatgacttgtccaagttcacctgaaaaaataaggc

SEQ ID NO: 6805243 - DNA, 63 bp, Homo sapiens
tgtcttcatgtcctgttgctgctagtgatgagttgtaacatcttcactcaggaaatgatgaca

SEQ ID NO: 6805244 - DNA, 71 bp, Homo sapiens
gagtgattcacatataatgtctttaaaatggccattggcctattttactcagaatatgttgaatgcagctc

SEQ ID NO: 6805245 - DNA, 55 bp, Homo sapiens
aaccacttatttaagctctgatgggacttgagaccagctgggcttggagagggtt

SEQ ID NO: 6805246 - DNA, 83 bp, Homo sapiens
aggcagagaaaattatttttaaaactctgggaatttctcataagaaaataagaatagtgttttctagaatggttttatctcct

SEQ ID NO: 6805247 - DNA, 72 bp, Homo sapiens
gatgttagccaatgttataggattatttgaatgaacccttcatcctccattttggtgtgacattgggacatt

SEQ ID NO: 6805248 - DNA, 67 bp, Homo sapiens
gtttgggaattattttgcttttgtcactacatttaagtggtatcttcaagtcagctagttcctatac

SEQ ID NO: 6805249 - DNA, 71 bp, Homo sapiens
tacctggttagaggcttcttgcttggtcctctgtacctatatatagattaagcagagccctgaactaggtg

SEQ ID NO: 6805250 - DNA, 89 bp, Homo sapiens
ccaggcaccttttttcatctcagggcaattctcagcgacagctgccaggtgacgctggatgtgcccttgattcctgaaggggtgtctgg

SEQ ID NO: 6805251 - DNA, 58 bp, Homo sapiens
ctcagttaggatgcttccatagccagggaaaggcaatggtcagaattttccagctgag

SEQ ID NO: 6805252 - DNA, 63 bp, Homo sapiens
cagtaggtgctcaacaagtacagcctaatccctctgcttgcttgactttgtgtacctgtcctg

SEQ ID NO: 6805253 - DNA, 75 bp, Homo sapiens
gcctggcaaatctttctctccaagtctttttcctcaatgaactgaaggctccttgagggaaggacttggtcacgt

SEQ ID NO: 6805254 - DNA, 78 bp, Homo sapiens
gacacagttcataatttgaaggaataggctgttcaaaagagaaacttgtatcagatcaaataatgatcatactgtgtt

SEQ ID NO: 6805255 - DNA, 56 bp, Homo sapiens
tgacccggacagcaaacacccaggaaacgaagtgctgggcctgattcccagggtca

SEQ ID NO: 6805256 - DNA, 75 bp, Homo sapiens
aggctgctgcctggtttttgtagtccatcgatgtcttcttcctgggctcacagccaaggctccatatcccagcct

SEQ ID NO: 6805257 - DNA, 56 bp, Homo sapiens
tcacatccaggtcctgtctttactgaactgtctacacagccttacctggggtgtga

SEQ ID NO: 6805258 - DNA, 69 bp, Homo sapiens
tttcagggtgctccagacacccatggccacttcatgtaaaccactgacaatttctagagcactttgaga

SEQ ID NO: 6805259 - DNA, 126 bp, Homo sapiens
gacgttcaatgaaaaggcacggaggcctgcaggacaggctgttggggtccagggtttcttgagtgttggatttggatgcttgggacactgcaggggcttcagtcttgcagggtgacctttcatttc

SEQ ID NO: 6805260 - DNA, 103 bp, Homo sapiens
ggggtaccagaaaattgcatggatctttaaggcttaccctggaggccctctgaggcctcctgactggggtttcttgagggtgcatgtgtgtcatccaggcccc

SEQ ID NO: 6805261 - DNA, 103 bp, Homo sapiens
atgcttgtgtactggtgaagtactttttctggaggataacactaggcaagaaagaagatgcaagggaaaccttcatgaggaagatttcacaactgcagagcat

SEQ ID NO: 6805262 - DNA, 129 bp, Homo sapiens
gcagctcctggctggaagagggaggcctggcctttggtgtctggctgtatggacttccactcctttgaggttatctcagcatttgatagcagaaggctggtttaaaacattttcatgtgagagaaatgc

SEQ ID NO: 6805263 - DNA, 70 bp, Homo sapiens
gtcagtgaaccttcaccaaaccccacgtgcattttatcctcagtgaattgttggtggaggtgcacctgac

SEQ ID NO: 6805264 - DNA, 72 bp, Homo sapiens
gtgtctagcagagatcggacactcagtaaatatttgatgaatgtttatagtgtgactgtctcgccagtgcac

SEQ ID NO: 6805265 - DNA, 123 bp, Homo sapiens
gtttctatagttttggagatacatgagtcaccctgcagggctaatggggcaagtaggctgccctacttattcttttggcttatgagtttgataatggaagtgaaaattgagaattgaagaaat

SEQ ID NO: 6805266 - DNA, 63 bp, Homo sapiens
attagaatcctggccaagtttttaagacagtaatgtacagacttcactcccagagattctgat

SEQ ID NO: 6805267 - DNA, 62 bp, Homo sapiens
tccactcagcaggtaccacatgatctttgggaaaaatttgtgttatacctgctcctggtggg

SEQ ID NO: 6805268 - DNA, 57 bp, Homo sapiens
gtctctgtggcaactacttagctctgcagttggagcacaaaagcagccacagatgat

SEQ ID NO: 6805269 - DNA, 68 bp, Homo sapiens
agggaataggatgaggggtggccaagtaagagtttatctttcttgtagaattcttatttgaattcttt

SEQ ID NO: 6805270 - DNA, 64 bp, Homo sapiens
aaggactgacaaatgtcttcctggtgctaaattctaagcaaaatgggtcatgtgtgtggtcctt

SEQ ID NO: 6805271 - DNA, 88 bp, Homo sapiens
cctaagaatgtccactactagggctcaggcctacctagatatgcatgataaactggtggggcagaccctagacaggacagttcatagg

SEQ ID NO: 6805272 - DNA, 64 bp, Homo sapiens
tcctggccctgtggcctgcagtttgagtttccctcgaccagctgtgggaccgggggagccggga

SEQ ID NO: 6805273 - DNA, 64 bp, Homo sapiens
ccggtatgttttgtctcttgaaacgttggcccaaatggcattttcaaacattcaaataaaccgg

SEQ ID NO: 6805274 - DNA, 101 bp, Homo sapiens
ggtgctccaggggtggtatgaacaacaaaatgtagaagctgacagtgctgtccccacctactggggacataccacttctattcatgctgcttaaggctacc

SEQ ID NO: 6805275 - DNA, 55 bp, Homo sapiens
ctgcaggcatctaactgtgggccagagagggcctggaccaggatggtggctgcag

SEQ ID NO: 6805276 - DNA, 62 bp, Homo sapiens
ttgatcggccatggaatacctttttcaagtgctctggaaagttaggttgcattggtcatcaa

SEQ ID NO: 6805277 - DNA, 58 bp, Homo sapiens
gctgtgtttgacagtagcagacccctaggttggcaagtatagctaaggtaagcgcagc

SEQ ID NO: 6805278 - DNA, 92 bp, Homo sapiens
tcttgctgaatttgttgcatttgtttgagtagaatgagacattgtatagctttcatctagttcacaaatgatgataatgctagctaaaaaga

SEQ ID NO: 6805279 - DNA, 67 bp, Homo sapiens
tgcaaatcattcagcctaagcaagtacagaaaatgcaagctgtgtgcaaggggtgaagataggggca

SEQ ID NO: 6805280 - DNA, 60 bp, Homo sapiens
tctggccctgggtggaatgtcccatttccttcatcactgagtgggcttccccagggcaga

SEQ ID NO: 6805281 - DNA, 68 bp, Homo sapiens
gttatgaataatgctgctgtgaacattggcatataaatatctgttcacataggagcatggtttttaac

SEQ ID NO: 6805282 - DNA, 98 bp, Homo sapiens
cacagcacctttccacatctatcttttgggtcccagatcaagtgctctacccctcagcatgcatgaagattcagcaagattcagtgggaggtggtgtg

SEQ ID NO: 6805283 - DNA, 86 bp, Homo sapiens
gctgtatcaatttgatctgaaacacaaggataatgttcccagctgtggcatctgggtccttggaaatttcatcagacagtgccagc

SEQ ID NO: 6805284 - DNA, 79 bp, Homo sapiens
agaatgtcagcaagatggaagtcacagtcttttattacctaatcttggaggtgacattccatcctttttgccatattct

SEQ ID NO: 6805285 - DNA, 61 bp, Homo sapiens
ctggctcactagccctgccctgctctgggctttcccagcctggggctcccctggtggccgg

SEQ ID NO: 6805286 - DNA, 68 bp, Homo sapiens
cccattctgacttcattgcctcagccgggcctctcctccgtgaagcagttctcagaagtgggggtggg

SEQ ID NO: 6805287 - DNA, 77 bp, Homo sapiens
gatgtttgcctgcccaaggtcacctagttagtaaatgatggagtcaggacattacctgaccttggctgactgacatc

SEQ ID NO: 6805288 - DNA, 65 bp, Homo sapiens
gtctgcagcctccacctcctgggctcaaatgatcctcctgcctcagcctctggagtagctgggac

SEQ ID NO: 6805289 - DNA, 56 bp, Homo sapiens
gctcctggatgttcaagtcggccaaggtcaagttggaccggacagcctcctggagt

SEQ ID NO: 6805290 - DNA, 64 bp, Homo sapiens
ggctgcccggcccgctgcgagtgcaccgtgcagacccgcgcggtggcctgcacgcgccgccgcc

SEQ ID NO: 6805291 - DNA, 65 bp, Homo sapiens
gcctcagagagttctcatgctttccagtgtggcacaggaagcagtagaacttttccttatgtggc

SEQ ID NO: 6805292 - DNA, 91 bp, Homo sapiens
tgtaccacagtgtctatttagccaattgtccatctttagctattctgaatgcctaaagatagacaattggctaaatagaaattgtggtaca

SEQ ID NO: 6805293 - DNA, 67 bp, Homo sapiens
gggtggtggctgctcaagggaggaggctgcaatttaaggcaccctctgccttgagcagtgcccaccc

SEQ ID NO: 6805294 - DNA, 63 bp, Homo sapiens
taggcccctagtgccacgtggcaggctgtgacgccagagccacacgtggccaccagtggctta

SEQ ID NO: 6805295 - DNA, 80 bp, Homo sapiens
gatagctctggtgtagggtaaggatgggagcctctgttttcttaacagctaagctctcagatactaagccagtagttctc

SEQ ID NO: 6805296 - DNA, 78 bp, Homo sapiens
cttacagatcttagtttcttggtcacagttttcaatttagacacactggctgaaatatggagtgagaaggatttgaag

SEQ ID NO: 6805297 - DNA, 98 bp, Homo sapiens
cggtagcattcaaccagcccattagccagtcttctgattacaaagtagttggagcctgttttgtttagaaagagattggtgcttttcagaatgcactg

SEQ ID NO: 6805298 - DNA, 60 bp, Homo sapiens
agaatgcagtttgaaataaggtagcgtggaattgggctattttccttttaactgtgttct

SEQ ID NO: 6805299 - DNA, 119 bp, Homo sapiens
acaagtgagaagggaaagggaccttgtgctagaaccagtacagaattcagagccatttctcttggctgattatttggtgttggatagtggacaaagtgtttggtcctctctgatgaggt

SEQ ID NO: 6805300 - DNA, 95 bp, Homo sapiens
gcgggaaaaaccctcagcaggcggttccttgtgggggctccagagagaggtgaaggaggccacgcggggcaccgcctgctgagcgggaatcccgt

SEQ ID NO: 6805301 - DNA, 62 bp, Homo sapiens
cctcactttgttttcattgaatgccatatgtaccaagcactgcagtgaacacaaagagaagg

SEQ ID NO: 6805302 - DNA, 68 bp, Homo sapiens
gcagtatgagtgttttagacatcatttaaagtagacatcattaaggaaaatgttgatattcatgctgc

SEQ ID NO: 6805303 - DNA, 55 bp, Homo sapiens
cagcagctggttgaatccttctcatgcttgaaaactctgacttcaacttctgctg

SEQ ID NO: 6805304 - DNA, 55 bp, Homo sapiens
tgacatgacacttagcttattccacctcttgggatagttatttctgtcactgtca

SEQ ID NO: 6805305 - DNA, 55 bp, Homo sapiens
aggaaatattgtcatggtgatttttacaagccagtcacctgcagtaataattcct

SEQ ID NO: 6805306 - DNA, 73 bp, Homo sapiens
actcccgctgacgcactgaaggctggttaccgagtgccagctgggggccagcttcgcgtgctcttccgggagt

SEQ ID NO: 6805307 - DNA, 64 bp, Homo sapiens
gtatttgagctttatgtatatttttaaaaataatccattgatgtgcataaagaaatacaaatac

SEQ ID NO: 6805308 - DNA, 95 bp, Homo sapiens
cgcagtaacccatcaattcagtgaaacaactactattgatttctgggggttttccaccccactggttgtttaactgaattgatgggtgttctgtg

SEQ ID NO: 6805309 - DNA, 81 bp, Homo sapiens
ctcagattagtatccaatggagtgtgtcagactgaagcatctagttgtgatgttaaagttatatgccgtcctgcatctgag

SEQ ID NO: 6805310 - DNA, 78 bp, Homo sapiens
caaaacaggacatcactcgccgcctgtctcgaagtggtgagcgccaccacatcgggcggacactggggtcctggtgtg

SEQ ID NO: 6805311 - DNA, 57 bp, Homo sapiens
gtaaatataaatgctagctgccctcccactcaacatgggctgttagtagatatttac

SEQ ID NO: 6805312 - DNA, 59 bp, Homo sapiens
gaaaaggctgcccacttattgagtcttgagtccaaaaatcaatgtgaggtagtcagttc

SEQ ID NO: 6805313 - DNA, 88 bp, Homo sapiens
ggttttattagacatgacacatgaagacctaattggatttcattcttcatgttgatttaataatttcatgtgcaagtttatgatgacc

SEQ ID NO: 6805314 - DNA, 114 bp, Homo sapiens
ctttgctagtcttctatttttgtttgaatactgaatcacattacagcatatctgtataaataaatagtagtacagtaggttgaatgtaattcagtttgtagattgactgcaaag

SEQ ID NO: 6805315 - DNA, 74 bp, Homo sapiens
ctagctttatgcaaacctggtacttatagtacctattattcactttaagtgcttagaagttgcattagggctag

SEQ ID NO: 6805316 - DNA, 84 bp, Homo sapiens
tacgtcatgtagtaggagggtgcttactgattttggtatcaagatacagtgttacatttttatctgctccatgttaaccatgtg

SEQ ID NO: 6805317 - DNA, 87 bp, Homo sapiens
tggtttcagctgcacaaggtgtcatccaggatggtgggatttatttcacccctaattgcgccatggcagccagctttatagaaacta

SEQ ID NO: 6805318 - DNA, 74 bp, Homo sapiens
gctgcgggctgtgtcggtgttccatgtggtgggagagtccgccccagccagttgagcggcgacacctcccgagt

SEQ ID NO: 6805319 - DNA, 58 bp, Homo sapiens
gctcgtgagagcggctcgtcatggcagcttgctagaaatgtgaggccctcccacgagt

SEQ ID NO: 6805320 - DNA, 87 bp, Homo sapiens
tacctctgtcagcttccaaggtgttctgctggttttctaaagaaagaaaattatgcaattgtttttggtacagttgactatatggta

SEQ ID NO: 6805321 - DNA, 92 bp, Homo sapiens
gctttggaaagctagacttttacaaatccccagtctctaaaagttttcccacgatgaattttggggcaggaggaagagttagcacccagggc

SEQ ID NO: 6805322 - DNA, 77 bp, Homo sapiens
gcatgacccagggctgcccgcagatatctctgagcttccacagctgtgggcatgagaggtcctggggattgtcatgc

SEQ ID NO: 6805323 - DNA, 67 bp, Homo sapiens
tcctgccctagagatgacacaatcctggatctacgtaactagcccatgttggtcactttgagcagga

SEQ ID NO: 6805324 - DNA, 79 bp, Homo sapiens
ttcttttagtcattcagggaagctgattatactgacaaaaaataagtatgtttgttatcttctgggccactaaaatgaa

SEQ ID NO: 6805325 - DNA, 62 bp, Homo sapiens
taattcatgcacttatctggtccattttaataatggcctgggccagaagtatgcatgtttta

SEQ ID NO: 6805326 - DNA, 62 bp, Homo sapiens
atccagaggcacagagccctaggagctggtagccccagtgcctaggctgtgcctctagtgat

SEQ ID NO: 6805327 - DNA, 87 bp, Homo sapiens
aataagttattatcatctcagctttgattcaccaggcaattgaatcatatcttgatgagtcagaactgaaggaataatatatttgtt

SEQ ID NO: 6805328 - DNA, 99 bp, Homo sapiens
atattgatatcaaaggagaagtaactcaggaaatgaagactggttatggactcatggcctggctttcctggtggttctctaaactttgaagatttttgt

SEQ ID NO: 6805329 - DNA, 80 bp, Homo sapiens
agaaggagacaaccttgcgagcacagagcaggaccgggatttccacttggatctgtctgctccaaagtgtgtatttttct

SEQ ID NO: 6805330 - DNA, 71 bp, Homo sapiens
gggggctggaatatccatcaaccaacgcccacctatagttggttgaggtctccaagtgttctagccagccc

SEQ ID NO: 6805331 - DNA, 88 bp, Homo sapiens
tattggggctgagtgtataatatttagtagtttattattgaaacagtaatagagattttaatgtccagtgcataataggtcctcagta

SEQ ID NO: 6805332 - DNA, 62 bp, Homo sapiens
cttcttctacccttgcctgtggctgcggtcctgctgaatctgtaggtgagggcagatagagg

SEQ ID NO: 6805333 - DNA, 92 bp, Homo sapiens
ccagttgaatagaggatgaaaattatgttattttcatacaacagaatacagttttgcgatgaaaataaatgaactacatctatgtgcaatgg

SEQ ID NO: 6805334 - DNA, 59 bp, Homo sapiens
gggatagttgtgtggggattctggtagtttctgagccagttgtaatccacacctgtttt

SEQ ID NO: 6805335 - DNA, 129 bp, Homo sapiens
taacatcagcctctagctgtttaaaatgtattatttagcaaggtaggtccatggacatcacaatttactggcgtacaggacacctatgctcaaattttcattttttattttggagactttttttttttg

SEQ ID NO: 6805336 - DNA, 68 bp, Homo sapiens
gcatcatggttttgagaaacagagtgcctacacaggtttgttaatgcactcatctgaagctatggtgc

SEQ ID NO: 6805337 - DNA, 128 bp, Homo sapiens
ggatggagagtggatgtggaggggcaattggcagagacaccgaatgactctgtggaaagacatctcagtgtctgtgcaagagtgctcatcagtctctctacttattgtctaccattactgtccattcc

SEQ ID NO: 6805338 - DNA, 56 bp, Homo sapiens
ttaggctgcattccaggccctttgtattctctcccagacctgccatgacagcctga

SEQ ID NO: 6805339 - DNA, 59 bp, Homo sapiens
gtatgatcaacttcatgtcctacagatattcgtcttaaggaaactgggtatggttatac

SEQ ID NO: 6805340 - DNA, 55 bp, Homo sapiens
cttctagaggtgcaagggaagaatccattctcttgccttgttgagcttttagaag

SEQ ID NO: 6805341 - DNA, 55 bp, Homo sapiens
acatgtcagggactctgggaggaaggaaactcaggcctggggtacactggcatgt

SEQ ID NO: 6805342 - DNA, 81 bp, Homo sapiens
cagggctttattaagatgcgaatgctgatcttctcttatcttctatgggccttcagcgtctggatttttatgggcttgctg

SEQ ID NO: 6805343 - DNA, 84 bp, Homo sapiens
cattgtgaagcaggtttggggttcatttttaagtgatatttatatcataaaaatagactctaaagttttcccctgctttagatg

SEQ ID NO: 6805344 - DNA, 64 bp, Homo sapiens
gagtgtttttggctgtagctggaaatctggaagtcatcagtattgggcaacagttaattcattc

SEQ ID NO: 6805345 - DNA, 97 bp, Homo sapiens
agagtttcatgtatggctgaattcatcaagaaaatctccttctctattccttgaaatgattttcttgagggtttgctttgttctcacagaaggctct

SEQ ID NO: 6805346 - DNA, 101 bp, Homo sapiens
ttgagaccgagtctcgctgtcacccaggctggagtgcagtagctcgatctcagctcactgcaagctccgcctcccgggttcacgccattctcctgcctcag

SEQ ID NO: 6805347 - DNA, 86 bp, Homo sapiens
agcttttgtttgtctgggaaagtctttatttctctttcatgtttgaaggatatttttaccagatatactattacaggataaaagtt

SEQ ID NO: 6805348 - DNA, 77 bp, Homo sapiens
tctactgaaatctgaacaacagctgtcagctgaaagtgtaagctctctgacttcctcgtttttcatgtttctctgga

SEQ ID NO: 6805349 - DNA, 71 bp, Homo sapiens
atgtcaatgtgtacaggagctcagagactataattattagctatgggctaagaacctggcatacatcacat

SEQ ID NO: 6805350 - DNA, 72 bp, Homo sapiens
actcaggcctcccaggcacagggaggagccacagaggctctcggctcctcccgaagccggctgggcctgggt

SEQ ID NO: 6805351 - DNA, 64 bp, Homo sapiens
gatcagatgtggttcatcatctttgaataatattaagtgtttaataatgttgaattactagatc

SEQ ID NO: 6805352 - DNA, 89 bp, Homo sapiens
ttatttaaaaaataataatagtaaatgaaagcaattttagaggtggaaaataccttagaatggaatcatttgcattatttgacaaatga

SEQ ID NO: 6805353 - DNA, 59 bp, Homo sapiens
ctggagtcggcgccccaacagaagtacatcccgcttctgcgccctgtcgcctgctccgg

SEQ ID NO: 6805354 - DNA, 60 bp, Homo sapiens
ctctatcattcttctcacctttgaacttgcataatttcaatggtctttgaggagttagag

SEQ ID NO: 6805355 - DNA, 58 bp, Homo sapiens
cttccaattgagattgaggatggacaaacccttcctgaaccaaattcagtgctggaag

SEQ ID NO: 6805356 - DNA, 62 bp, Homo sapiens
acagcattgctgagggaggggttttccagggcaggttcaagacccttctctgcagcccctgt

SEQ ID NO: 6805357 - DNA, 64 bp, Homo sapiens
ccatgttctggagtgttatggtcaagtcagagatatcatgactacatggacagtccagaactgg

SEQ ID NO: 6805358 - DNA, 83 bp, Homo sapiens
taatgtgatttactctcgtcctgctgtcctgacgtttaaacagatgtcagaggaatagaaggcatggtgggaggaacacatta

SEQ ID NO: 6805359 - DNA, 59 bp, Homo sapiens
attgcagggcatctatgtctggtctcaggattttcttgtatcagcaactgccactcagt

SEQ ID NO: 6805360 - DNA, 113 bp, Homo sapiens
ctctgtcacttactactagtgtgtgtgactttgggcaagctcactgattcattcatttaacacatatgtattgagtgcttgctctgttctagacattgtactaggtgctaggg

SEQ ID NO: 6805361 - DNA, 81 bp, Homo sapiens
aggtaagactgctgcaaaagtcattgtggtttttgccattacttttaatggcaaagactgcaaggacttttgcaccaacct

SEQ ID NO: 6805362 - DNA, 80 bp, Homo sapiens
tgtgccaatctcctagttttgatcattgtattattgttatgtaagatattgtcattgaggaaaactaggtgaaggacaca

SEQ ID NO: 6805363 - DNA, 55 bp, Homo sapiens
tgttgggggctcagagtctttaacctgtgagaaaagagcctgagatcttccagca

SEQ ID NO: 6805364 - DNA, 68 bp, Homo sapiens
gcctaactactgatgtaaaggagcaattttctttattactacgattcctctaaaatcagttagttggc

SEQ ID NO: 6805365 - DNA, 55 bp, Homo sapiens
gaagacgagatctgtgcctccagtgttcggtttattaggtccaatgctcgtcttc

SEQ ID NO: 6805366 - DNA, 56 bp, Homo sapiens
gggttgaggcggatgtcggcgggaacatcggccttgtcctcgtccgcctcgaactc

SEQ ID NO: 6805367 - DNA, 85 bp, Homo sapiens
tgaaactataaagccaaataatgtaggtacataaaatattcatttgatattaatgtatttgcttgttatggatttgaaagtatca

SEQ ID NO: 6805368 - DNA, 56 bp, Homo sapiens
gtctagagaggaaggaagtgtgtgaaggtgaacatgacttcctgtgtccctcaggc

SEQ ID NO: 6805369 - DNA, 66 bp, Homo sapiens
gcgcccggcttcctgcctctcgccgcccgccctccgggccgcggcatggcgagcaggactgggcgc

SEQ ID NO: 6805370 - DNA, 57 bp, Homo sapiens
tcttattttgttagatgctgtacagcaagtaaaagctgtagcttcttaagaataagg

SEQ ID NO: 6805371 - DNA, 62 bp, Homo sapiens
ctgacagatacttatgacataaagttgaccccagggggtccagtgcagtgagtgtttgtgag

SEQ ID NO: 6805372 - DNA, 96 bp, Homo sapiens
cagacagttaggaaaaatagggtgagtgggtgctggctggcagaaaccgacctgcaaagcctttcattcacatcccttgcattgcctgcctctctg

SEQ ID NO: 6805373 - DNA, 57 bp, Homo sapiens
gtgttaaatgcaatcacatgcatccttgtaagagggaggcagaaggagatttgacac

SEQ ID NO: 6805374 - DNA, 67 bp, Homo sapiens
ccattggtttaggaactggcttggagccgatgtttaattggcttgcggctacctcctcaaccaatgg

SEQ ID NO: 6805375 - DNA, 75 bp, Homo sapiens
cattactccacctcccagagccacagcttctttaaaatatctatttcaatggcttgctctgggagggatgtgatg

SEQ ID NO: 6805376 - DNA, 74 bp, Homo sapiens
atgtatgtagaataatgctggagattgagtgttgtatacttttgcatttagaaccagcatttgtcctggatcat

SEQ ID NO: 6805377 - DNA, 98 bp, Homo sapiens
attttatttttgacataatggttagaaaggttttgctctgaaatatctgaaattgaaatttgagagggcttttttggctctataaggttaaatgaaat

SEQ ID NO: 6805378 - DNA, 73 bp, Homo sapiens
agatcccatcgtgaatgtgatttaactgtgatgattaatttaacttgcagttttcttgttatatttgggagct

SEQ ID NO: 6805379 - DNA, 65 bp, Homo sapiens
gacctgtggagctggcaatatgggcaagtgtcatggactgtctactgccaggaagctccattgtc

SEQ ID NO: 6805380 - DNA, 102 bp, Homo sapiens
ggaacatctgagcagctggaattgatagaagggagctgagcgtaacaaatctccccaaattgcacccggctccatttgtatcagctcccagactgcatctcc

SEQ ID NO: 6805381 - DNA, 75 bp, Homo sapiens
ggtctccttgggaaagcaggaattaaaggggtcatcactttcagccttcccttaatctgttgttttagggagtcc

SEQ ID NO: 6805382 - DNA, 60 bp, Homo sapiens
ggagacacagtacagtggagagagaagctaacttctccaaatacaatattgttgttagcc

SEQ ID NO: 6805383 - DNA, 129 bp, Homo sapiens
agacgaggacttaacactatagagttggggtcaaaagccaggtttttgtcatctatttctggtgatatttctatcatcagaaaccttgaggaaactgcttaatttttctaagtattagtgccttgatct

SEQ ID NO: 6805384 - DNA, 70 bp, Homo sapiens
agggatttgtaggtcttttcctggtacaggcttattgttctctagaaagatacttaaatcaagattccct

SEQ ID NO: 6805385 - DNA, 106 bp, Homo sapiens
ttggaaaggattaaaagtttgacaaaacttaaaaatagcagggatgtgggaaaattgacattctcttgcactgttgttagaaatgtaaattggtattcctttctgg

SEQ ID NO: 6805386 - DNA, 56 bp, Homo sapiens
atctgtaattttgaatgcaaatatagtaattatatttgcatggccggattatggat

SEQ ID NO: 6805387 - DNA, 65 bp, Homo sapiens
ccatctcaaactacactgtaaattgcacagctcagttctgatgtcattttgtttgtttggggtgg

SEQ ID NO: 6805388 - DNA, 63 bp, Homo sapiens
ggtcttctcaacaattgtgtgagatgtattacgatacccattttatcaatcagaaagaagact

SEQ ID NO: 6805389 - DNA, 70 bp, Homo sapiens
agtgacttaatggtggttgtggactctgagggcgttggagatgttcagttaacacagacaccaggccact

SEQ ID NO: 6805390 - DNA, 92 bp, Homo sapiens
gtgcgttacagcctggaggggcgctgtcgggtcaccttgaccccaggtggcctggaacagccccccaccttacacatcttgccctgccgcac

SEQ ID NO: 6805391 - DNA, 74 bp, Homo sapiens
atgcatttgcttgatttaatgctagttgtcttctacttcttagactgagctaaccagcatgaaatctgcagcat

SEQ ID NO: 6805392 - DNA, 58 bp, Homo sapiens
ggcacttctaggctgccatgcctgtggttacagcaggctccagcagccagaggaagcc

SEQ ID NO: 6805393 - DNA, 79 bp, Homo sapiens
tagcaagccaaatatttattcttctgagagcacatgtttaatggcactattttcagagaactgagtccttgctctgtta

SEQ ID NO: 6805394 - DNA, 62 bp, Homo sapiens
tttctgacctactttcagacatggacttgcaaactccaggtccctaggagagtaggaagaaa

SEQ ID NO: 6805395 - DNA, 80 bp, Homo sapiens
tagattctcataaggagctcacaacctagatccctcacatgtgcaggtcacgatagggttcgcacttctgtgagaatcta

SEQ ID NO: 6805396 - DNA, 130 bp, Homo sapiens
cagggtgggatgtgttgaatgagtcttcgtggagcatgtcacggtccccttcccatctcattttggtgatgtgtctagattgctgtaccgcgtgggctccattgaggtagtgcttagggcaggagctctg

SEQ ID NO: 6805397 - DNA, 77 bp, Homo sapiens
ttattcacctgaatcttggacttcagaatagcaagctaaggctactttgaagtcaaagattgattccaggagggtaa

SEQ ID NO: 6805398 - DNA, 116 bp, Homo sapiens
agggaaggggcaggggagcagcagcagctgtctaggcccctaaagcatctcctggctcttcagcaggaggagctggccgcctcattcagctccctgctgacctacggcctctccct

SEQ ID NO: 6805399 - DNA, 56 bp, Homo sapiens
gggtgaggagctgccagtcatgtccagatggaatgactcccatcctctcctcatct

SEQ ID NO: 6805400 - DNA, 59 bp, Homo sapiens
gagtaattcttgggagactccacggtatgatgtaccaggaagtggcttgggaactgctt

SEQ ID NO: 6805401 - DNA, 83 bp, Homo sapiens
ccttcatgcctggctgctctctttcagagacaggtcaacattagctggcctcctgaaaggaagagctccagagcagtttaagg

SEQ ID NO: 6805402 - DNA, 79 bp, Homo sapiens
ttgctgaacagtggttcatgtcacggatttcttctgctgataattatttagtaccgtcgataggacatagtggaagtaa

SEQ ID NO: 6805403 - DNA, 60 bp, Homo sapiens
cttctcatctattcacattaactgtctgagagttgagcacgggaagtgggagatgggagg

SEQ ID NO: 6805404 - DNA, 71 bp, Homo sapiens
gattacgtttgagtacagctgcctttttgtacccatcatataacccaaaggcaatgtctcgattggtagtt

SEQ ID NO: 6805405 - DNA, 120 bp, Homo sapiens
aagagaggcactgggatagcgccatcacaactgttcacaaaattctggccagtggaacagctagtcacaaggccaaggttttgtgaactgtgtctatggctgtatctcagtacatctctt

SEQ ID NO: 6805406 - DNA, 80 bp, Homo sapiens
ccgctggtctagcctttatactgtgtaaggcaaaggatatttccttgccacctgcactatatactccaggaagccagagg

SEQ ID NO: 6805407 - DNA, 90 bp, Homo sapiens
ggcaatgttttggacatacttgaagcaagtgatcatcaatttatagtgattatcaatctgctttgtggtatcattttctccaatattgct

SEQ ID NO: 6805408 - DNA, 60 bp, Homo sapiens
gctggaagatgagtcagggggtgcaactggggagagcagctctgaatcctgcttctcagt

SEQ ID NO: 6805409 - DNA, 57 bp, Homo sapiens
agcagtgatgcatgacagcctagccccactgggaagcatgtgatggcataaccagct

SEQ ID NO: 6805410 - DNA, 71 bp, Homo sapiens
acaggaatgggccataatccttggttgacaataaatggacaaagcagctgggtgcggtggctcatgcctgt

SEQ ID NO: 6805411 - DNA, 79 bp, Homo sapiens
agagggtacagagggcagtctcagattgggaagtgcgtccacaggcttcccacagaggctctgccctttggtacctcct

SEQ ID NO: 6805412 - DNA, 62 bp, Homo sapiens
atagctttcttaaatatataaaaacctgaggaatggcaggggatgtgaagtaggaagggtgt

SEQ ID NO: 6805413 - DNA, 62 bp, Homo sapiens
gcataggaacacatggacatttctgatcttatataagtattatacttttgttgttcctgtgc

SEQ ID NO: 6805414 - DNA, 64 bp, Homo sapiens
gtttgcctgtctaaattgccaagctttttgataaagctggcagtgtgaatgacaagccgcaaac

SEQ ID NO: 6805415 - DNA, 68 bp, Homo sapiens
tatttccagaggagtatagaaggaatagcaatatctttgattctcaggtctgatacttttttgaaata

SEQ ID NO: 6805416 - DNA, 60 bp, Homo sapiens
tagccaatctccagcataaatcaccattgatggttatgtatttatctgtgggattgttta

SEQ ID NO: 6805417 - DNA, 83 bp, Homo sapiens
catcaaatatatcagtggtcacaagatacatataggcccaaaagaggcttcatgatgatgttgccatcatggtgtgggtggtg

SEQ ID NO: 6805418 - DNA, 75 bp, Homo sapiens
ggtgagtctaggtagagaaatgcaagctcagaagtgtgctgcaagtagtttgccttcctccgcgcctgactcacc

SEQ ID NO: 6805419 - DNA, 61 bp, Homo sapiens
gaaatggtgtgtatatgtaaatggacctgaaaggcagtggttcttcaatacatggcatttc

SEQ ID NO: 6805420 - DNA, 106 bp, Homo sapiens
tagggagaaggtaaaactttactgcagatgtctcaattttattcagatgtttcttttgagtataggccctttttgcaaggataagtattgcttttttttcccccta

SEQ ID NO: 6805421 - DNA, 80 bp, Homo sapiens
acatcttgatatttttccttttttcacctggcctttcagagctgaaaggtcattgaaaaggaggaagtacttttaagtgt

SEQ ID NO: 6805422 - DNA, 73 bp, Homo sapiens
tatgatgagaaaaagagctgaaagattactgatgtaatttataacaggttagtatttttagttcatcattata

SEQ ID NO: 6805423 - DNA, 63 bp, Homo sapiens
tgggagttgggcagaacaagtggcttgagtgtgtcctggacttgtttgtcctgccctttctca

SEQ ID NO: 6805424 - DNA, 67 bp, Homo sapiens
gaaacttgggtgaccctgagcaaaaattactgaaactcatacctgtacttgctcccaccccagtttt

SEQ ID NO: 6805425 - DNA, 58 bp, Homo sapiens
tgctcccagctcctgcagcaacccaagtaaccgggggaagtgccggaggtggtgagca

SEQ ID NO: 6805426 - DNA, 96 bp, Homo sapiens
agggccggactcccagttggagccagcaggacttaagccagatgagaggaagcacattctagggtccgtggtgctgagtttctgggggctggttct

SEQ ID NO: 6805427 - DNA, 130 bp, Homo sapiens
ggagggacctgaccctatagatctttccagaatagagggagacaccctaggactctgagcccatagacatatggcttccagggtgggggatgtttttaatttatctctggaaagcatttagagtccagct

SEQ ID NO: 6805428 - DNA, 55 bp, Homo sapiens
tgtggctgattggtaccatcttcagagaccccatctgagtgctccattctgccca

SEQ ID NO: 6805429 - DNA, 78 bp, Homo sapiens
ccttccaaccttcagacacttattgagcaagtactaagaatgggcactgcaggtaagtgctgtcagttaagagggagg

SEQ ID NO: 6805430 - DNA, 56 bp, Homo sapiens
ctgtgactgggtgacagtcctcattcttggctgaacactgacatacctggttacag

SEQ ID NO: 6805431 - DNA, 68 bp, Homo sapiens
cttaactgaagctggaagcgctggcatagcccggggaggtcagcactgtgtccagtctcccggttaag

SEQ ID NO: 6805432 - DNA, 77 bp, Homo sapiens
ggctaaatcattacagtgccacctcgtggtccagcctcttgagaggtaacaggccactgtgagtacaatggtgtgcc

SEQ ID NO: 6805433 - DNA, 126 bp, Homo sapiens
ttagcaattttctagctttttccattaaatatatagttaccggataatttgttatgtcttcaatgagcacttttattagcacataagaggtataggtattaatggtttagttaaaaaatgtgttga

SEQ ID NO: 6805434 - DNA, 63 bp, Homo sapiens
gctgctggtgagattttatgtttcccctgtgccggggacaaaatatttttctcccatctaagc

SEQ ID NO: 6805435 - DNA, 72 bp, Homo sapiens
aggacatttcaggatggaaagaggccagaaagccactgagagctgcctcctcttttcccaaccatgaattct

SEQ ID NO: 6805436 - DNA, 83 bp, Homo sapiens
tcctggtgagaggttctagaagccttgttctcactaataaaatggtgaagccccagaaaagcttctagtcaatttcaccagga

SEQ ID NO: 6805437 - DNA, 78 bp, Homo sapiens
cctgggtcgtctcagtctgactgaagtgccctagcatgggccaagcaagttcctagtgagactggaggaaatcccagg

SEQ ID NO: 6805438 - DNA, 84 bp, Homo sapiens
gtgatctgccatgccactgtgactgcattgaaagatgtccctttctctgccagtcagttggtgtgggacaaaacacagatatac

SEQ ID NO: 6805439 - DNA, 60 bp, Homo sapiens
ttgacagcaacacatgcttagtgcagagacctctctgaggaccatatctgtgtgctgcaa

SEQ ID NO: 6805440 - DNA, 71 bp, Homo sapiens
gctttcttcttgttctctggaaatcccctttcctgaggtgcactgatttctagcagggcaggaaagaatgt

SEQ ID NO: 6805441 - DNA, 66 bp, Homo sapiens
ctgcaggcagaagggatggtgagggggcgcaaccctctgccctgtcagccccacttctgcctgcag

SEQ ID NO: 6805442 - DNA, 82 bp, Homo sapiens
ggaatgtggaggaagggattcagaccaggtgatctctgtgggtctcttggtggtctgatattttttcttacctttgaattcc

SEQ ID NO: 6805443 - DNA, 81 bp, Homo sapiens
tctctggcagttctggtcgatcctactgagtgtgttctctggccagagaacacatgcagactgggtagagctgtctgcagg

SEQ ID NO: 6805444 - DNA, 55 bp, Homo sapiens
gggcggcttcagccagaggaagctgatgagcccaagagcttcctgaaagctgccc

SEQ ID NO: 6805445 - DNA, 69 bp, Homo sapiens
caaaaagtgtctgcaaaatgaaagagccactgtgacaaggtggctctgtcattttgcagacactttttg

SEQ ID NO: 6805446 - DNA, 82 bp, Homo sapiens
ggaaggagccaatcaaaagcttaccttttcagtctttgttattgttcaaggatgattggtaatgacactatcttctcctttc

SEQ ID NO: 6805447 - DNA, 65 bp, Homo sapiens
tagactcatagaattggatagtgcaagataagtcaaagacagaccgcttcccaattcttgatctg

SEQ ID NO: 6805448 - DNA, 100 bp, Homo sapiens
ctgcccacttcttttctattttcaggattctttcagactgggggtgtagctccagcaggctgtggaaatcctggagctgatcagaaaaggaagtgtgaag

SEQ ID NO: 6805449 - DNA, 100 bp, Homo sapiens
gaggcaggaggatcacttgtaccctggaggtggaggttgcagtgagcggagattgcctcactgcactccagcctgggggacaagagggagactccgtctc

SEQ ID NO: 6805450 - DNA, 61 bp, Homo sapiens
cccaggaaaaagagaaacatggtgtccgttttcacatgtaccatatactttctttcctggg

SEQ ID NO: 6805451 - DNA, 69 bp, Homo sapiens
ggagtcaaggcattaaaaaggaatacattatttaaggtggcttatattcctttttagtgtttggagttt

SEQ ID NO: 6805452 - DNA, 57 bp, Homo sapiens
tcaatgagctggggacgtgtactctttctgttctgtttccgcccgtcagctcggtga

SEQ ID NO: 6805453 - DNA, 81 bp, Homo sapiens
cagagccagctacatctcccctctctagtctcatccatgaggccctgctgtttagagagctacagaggtgggctggaaatg

SEQ ID NO: 6805454 - DNA, 59 bp, Homo sapiens
acaacttcaattgggattctcccctgattctaccttggagaacctttcttgagtgttgt

SEQ ID NO: 6805455 - DNA, 64 bp, Homo sapiens
tcctgtttgaattttgctaacgtgtgaggtggaattttaattatactgagtttggttcaaggga

SEQ ID NO: 6805456 - DNA, 58 bp, Homo sapiens
gtgtgcacagtatactagggttctccagagggacaggaccaatagtatctctgtatat

SEQ ID NO: 6805457 - DNA, 55 bp, Homo sapiens
ggcagcaacttggacagcagtcttggcaacaagtacccaatattaggatgttgcc

SEQ ID NO: 6805458 - DNA, 73 bp, Homo sapiens
tgctccttgtatatgctaatggtgccattcctgcagtttttaaggcaggaatcgcatagtatatatttcatca

SEQ ID NO: 6805459 - DNA, 65 bp, Homo sapiens
gtgctgatgtcaggacagagtccacaagaatgaagtggcctggctctggcagcttgtgtcagcac

SEQ ID NO: 6805460 - DNA, 67 bp, Homo sapiens
agcaggatctggaagaaagggagggcagacatattaactgctgcctacctctctccgtatcagtgct

SEQ ID NO: 6805461 - DNA, 68 bp, Homo sapiens
gcccagctctgtgtattttccccacatttggatgaatgaggtaatgtgctacttacagggagcttggt

SEQ ID NO: 6805462 - DNA, 64 bp, Homo sapiens
gggctggccctgtctgcacacaggattagggtcaccagtctggtgggcaggcacgggctgaccc

SEQ ID NO: 6805463 - DNA, 76 bp, Homo sapiens
gcaccctccaggcgggttcagggctgccatggcaacaaggacatgccgtgagcaaaatggacactccctgaggggc

SEQ ID NO: 6805464 - DNA, 66 bp, Homo sapiens
atgctgaggaacatctatcacataaacgagattccttaattgtttagcataaagattttccagcat

SEQ ID NO: 6805465 - DNA, 71 bp, Homo sapiens
ggtagtttgagtttgcgttggggttttctgtcactttttgactggaagagtcctaaacagatatacatgcc

SEQ ID NO: 6805466 - DNA, 63 bp, Homo sapiens
tgcacccatgtgtatgagtgtgcttcttttaaaggaataggagcttttatacaatgtggtgca

SEQ ID NO: 6805467 - DNA, 81 bp, Homo sapiens
gattgggtccatgttctcctggtctgaggctgcctcatcatcatctggggactcctggatcagagccagagaagcccagtc

SEQ ID NO: 6805468 - DNA, 70 bp, Homo sapiens
tgccacctccttcctctttcaaatttgtttctcttactgttgggaaccaagagtccaagtgaggttggca

SEQ ID NO: 6805469 - DNA, 89 bp, Homo sapiens
cacctagcatctcactgatttactgtgcctaagacaggaaatattggcaaacatgtttagttagaatcaatggagtatgttccaaggtg

SEQ ID NO: 6805470 - DNA, 69 bp, Homo sapiens
tggagttcctcagatagctgatcacattgtaggctgaaaacatctacaagtcaagtctatcaaggacca

SEQ ID NO: 6805471 - DNA, 90 bp, Homo sapiens
gcatccctaatcagctctcacgtttcacacttcccttgcaatctctggattttgtgaagagtagacatgtggtgccccattactggatgc

SEQ ID NO: 6805472 - DNA, 61 bp, Homo sapiens
agccatcagatcctagtaatattatatgataaatgctctaatagtgctagaatcagaggct

SEQ ID NO: 6805473 - DNA, 89 bp, Homo sapiens
ccttagatttttgctgcctttgcccttgacactgtcctttccctggagctgaatgtctgggggtagaggaatgactttaaaagtcgagg

SEQ ID NO: 6805474 - DNA, 99 bp, Homo sapiens
atgctagggccttcaggcaggaggtggtgtggaagtaacattttgtaacatttatctgggactctataaagatacctcaattgtgtgaaactctggcat

SEQ ID NO: 6805475 - DNA, 75 bp, Homo sapiens
tctgtgtgtgtgtgtacatgcatgcatgtttgtgtgttgtgtatgcttgcatgcatgtgtgcagacagtcacaga

SEQ ID NO: 6805476 - DNA, 69 bp, Homo sapiens
gaaaaggtacaaagtagtgtgtatgtgtaaaagcctttagttttaccaaatgctttgtgccctgatttc

SEQ ID NO: 6805477 - DNA, 106 bp, Homo sapiens
tgtacttgagaatgtccacattgtcatgacatggtatatttcattttcagtggaattgcaccatgtaagaaatgtacgatgttatgcagtattattctataataca

SEQ ID NO: 6805478 - DNA, 99 bp, Homo sapiens
gcgggggaaatccagttggcattaaggaagggggctccggcattccttggcatgcagtggcagctagctgttttcatgctcatctgtgattatcctggt

SEQ ID NO: 6805479 - DNA, 60 bp, Homo sapiens
taagtttttatgttttagctgtgatgactgaagtcatgatgctttagttcaaaggactta

SEQ ID NO: 6805480 - DNA, 71 bp, Homo sapiens
tgccatgcaggaagtttcatgtggaggtagactggtgtagctgttctgaacagtctggcatgatgcaggca

SEQ ID NO: 6805481 - DNA, 55 bp, Homo sapiens
gtttctcccttgcataactggttgggcaatggtgccagtcacagggaagaggaac

SEQ ID NO: 6805482 - DNA, 98 bp, Homo sapiens
ttgggaggattgcctgagcctgggaggcagaggttgtagtgagccgagattgtgccactgcacttcagcctgggtgacagagcaaggcccgctctcaa

SEQ ID NO: 6805483 - DNA, 58 bp, Homo sapiens
aaaagtgtgaattaatcaattcttggtaccagccaattattccatagttggcactttt

SEQ ID NO: 6805484 - DNA, 62 bp, Homo sapiens
agagctgctgctgtactgggatccaatttcactttaggaatttgctcaggcagagaagcttt

SEQ ID NO: 6805485 - DNA, 65 bp, Homo sapiens
agacttgatgttaaaagaaactgctactgtcattcacttgattgattgcatcttttattaggtct

SEQ ID NO: 6805486 - DNA, 74 bp, Homo sapiens
gcctatactgattttggaattggaaagtgctgtggtcacctcatgagctagttccaagtccatgagtaacaggt

SEQ ID NO: 6805487 - DNA, 94 bp, Homo sapiens
gactggctttttcattaagtagatgaatgtgaatgtttcttgacagcaaggacaatgtttccatgttcaatttactatgaaaagaacgccagtc

SEQ ID NO: 6805488 - DNA, 85 bp, Homo sapiens
cttaccattttatgagattttactttttttaaaagtttatgctatttggcgtgatgcaatcctttagaagtaactcggtggtgag

SEQ ID NO: 6805489 - DNA, 100 bp, Homo sapiens
ctggagcatagccacaccgacatctttgcatatcgttcctatctgtcagtgtgacatgacagcagagttgagtagttgcaatgcaggttgtttagcccgg

SEQ ID NO: 6805490 - DNA, 56 bp, Homo sapiens
gctgtcacaaattgggttctttggaaacagatgctgagacatagtttgtggcatgc

SEQ ID NO: 6805491 - DNA, 120 bp, Homo sapiens
tcctttatgatatgtgtctttgaaaggcaaggagtggcagtaagcagagtgatataaacatggggcctgggctttaattctgtctgccctcatcctttatgaggcgcatgatttagaggg

SEQ ID NO: 6805492 - DNA, 64 bp, Homo sapiens
catcagaaagagtcctggacttgacatcagaaaatccacattcaaatctaggctcttttcagtg

SEQ ID NO: 6805493 - DNA, 57 bp, Homo sapiens
gggctcctttccagcatcttccatcaattcaaaagggggatggccggaccagagcct

SEQ ID NO: 6805494 - DNA, 88 bp, Homo sapiens
ccattaaagttattttgctttctctgaccagagtgagatcatcaattactttccttctctgaagaactgagtaaacatgactctaagg

SEQ ID NO: 6805495 - DNA, 66 bp, Homo sapiens
gccacattagccctcaccatctgagattactgaaaaaacagattgtggtgagaattgctagttggc

SEQ ID NO: 6805496 - DNA, 78 bp, Homo sapiens
gcagcaagagggaggctgagccactgtggagagcacacaggctctgcctaggaaacctcatgcttctcatgtgcttgc

SEQ ID NO: 6805497 - DNA, 110 bp, Homo sapiens
attccatgtatttctagggccttcaggatcactaaaccctccaccaagagaatgcaatagaagtggcggttatgaaagtttctggaagtggcccagtagtacagaagaat

SEQ ID NO: 6805498 - DNA, 77 bp, Homo sapiens
tttttctcttttgatagttgctgagcaggctctcagacctgcacataggcttttcagaaccaaagcgcagagaaaaa

SEQ ID NO: 6805499 - DNA, 69 bp, Homo sapiens
aggcagtttatccccagagcctggacacctaaacactatttgtcatgttgctctgggtggtaaatgact

SEQ ID NO: 6805500 - DNA, 71 bp, Homo sapiens
caagattacatgcagtgcctctggattcttgctggtccttacagcagaaatcttgtctgtgtgtctccttg

SEQ ID NO: 6805501 - DNA, 77 bp, Homo sapiens
gagtctgatcctgttataatttggatgtgaaataaatagttccttttcatatattttaaaattgaaataggaaattc

SEQ ID NO: 6805502 - DNA, 67 bp, Homo sapiens
ggctttgcagggattaccttattttttcctttctcacagaaatcagaaatgggtattcctcagggct

SEQ ID NO: 6805503 - DNA, 82 bp, Homo sapiens
tgtctcttggagcaacctactctggcaggtttgtgccttggctggcacaggaggttaggaagtggtcggttcccagagcaca

SEQ ID NO: 6805504 - DNA, 70 bp, Homo sapiens
tggagacctggaagggtcagagtgatgaggctgaggccagctcacaactcaggctctttctgctgctcca

SEQ ID NO: 6805505 - DNA, 56 bp, Homo sapiens
gattcaaagttaatgaagatgcctcatttcgttggtttcttcgatgattttgtgtc

SEQ ID NO: 6805506 - DNA, 58 bp, Homo sapiens
cccaaagcaggcttgtcaaattgccatggcttaggtcaaagcaaaagacttctttggg

SEQ ID NO: 6805507 - DNA, 60 bp, Homo sapiens
tgaattcaggggctattatattttccctcttccagagagaaatataattctctgaattta

SEQ ID NO: 6805508 - DNA, 74 bp, Homo sapiens
gataagggtgggttcattattcttgggcgtcctggctgtgctgtgacaccagagactgatgaggccaccccatc

SEQ ID NO: 6805509 - DNA, 126 bp, Homo sapiens
atctgcatcatcagcatcacataggcgcttgctagaaatgcaaattctctctcgctctagaggcttgtggtagggtctagaatttgtatttctagtaagctcccagatgatgctgattctgctggt

SEQ ID NO: 6805510 - DNA, 87 bp, Homo sapiens
ggcaggaatctgtttgtgattagcagtgggttttagtgttgccgaggaatgtacccaacgttaccgttacccccgcaggttgctgcc

SEQ ID NO: 6805511 - DNA, 65 bp, Homo sapiens
tgtccctcaggctggagtgcagtggcgcgatctccgctcactgcaagctctgcctcccgggttca

SEQ ID NO: 6805512 - DNA, 80 bp, Homo sapiens
aaacttgtctagaaaaggtgtcaggcttgggaaagtgacatatggtggagctttgcctgtagcattggcctagagagttt

SEQ ID NO: 6805513 - DNA, 56 bp, Homo sapiens
gtctgatttactggaaaaaaggagagcagcctttcttttctcccagatgattagac

SEQ ID NO: 6805514 - DNA, 84 bp, Homo sapiens
gcttcaataatttgatttctttttgctgcagtgattaatatttagaatccaccaagagcattagaagaaatgattatagacagc

SEQ ID NO: 6805515 - DNA, 64 bp, Homo sapiens
ttactagctgagggaacttgggcttgccatataatttctctaagactattgtcctcagctgtaa

SEQ ID NO: 6805516 - DNA, 66 bp, Homo sapiens
ggtggttgtgagggtgggctagccacgggttgggggaatcataatgccagctttccctgcagcatc

SEQ ID NO: 6805517 - DNA, 75 bp, Homo sapiens
ggatcagcagacagacttgaaaatgttcttttccttcctggaaagggttcatttagcaggatctgatcgctgccc

SEQ ID NO: 6805518 - DNA, 96 bp, Homo sapiens
gttgcaaaataacttggtgtctatgattcagtttatgtaaaataataaatgtatgtaggaatacgtgtgttgaaagatgtacatcaatttgctaac

SEQ ID NO: 6805519 - DNA, 56 bp, Homo sapiens
gatagttttttttcagtgcaatgtatatcatgtctttgtctgaaaaggaagctatc

SEQ ID NO: 6805520 - DNA, 59 bp, Homo sapiens
tgtggtttgtaagcaaagcaaacatttttggaaatgtttgcaaattggacacaaccaca

SEQ ID NO: 6805521 - DNA, 83 bp, Homo sapiens
gttcttaccatgacatcactacattattcctgttttagtaatattgttacattgaggaattatgtaggagtttaagtaagcac

SEQ ID NO: 6805522 - DNA, 104 bp, Homo sapiens
ggctctccctgggcaggtggggctctccctgggcagatgtggctctccttgggcaggtgtggctctccttgggcaggtgtggctctccttgggcaggtgtggct

SEQ ID NO: 6805523 - DNA, 62 bp, Homo sapiens
gctcctattggatttcagctgaaatcccttagacttttggctatgtccaatacctttggagt

SEQ ID NO: 6805524 - DNA, 59 bp, Homo sapiens
gcagtcctagggtgctctgcagagttcccagacagcttgcaggtggctccagggactgc

SEQ ID NO: 6805525 - DNA, 79 bp, Homo sapiens
aggctggagtgcagtggcgtgatctcagctcactgcaagctctgcctcttgggtccatgccattctcctgcttcagcct

SEQ ID NO: 6805526 - DNA, 62 bp, Homo sapiens
gtgcagtgtgcaacctcctgtgtttggaattagcaggcccaggggtaaggcgcagcgtgcat

SEQ ID NO: 6805527 - DNA, 59 bp, Homo sapiens
tgctttgcagtgtctaacagaaatgggtgctccataaatatttgtagaactgaaaagca

SEQ ID NO: 6805528 - DNA, 67 bp, Homo sapiens
catttctagacaagtcctggagctccctgcaggccggaaaaaggggcctccgggaatgtctgacgtg

SEQ ID NO: 6805529 - DNA, 55 bp, Homo sapiens
ctgttggctatagggagatggggcagggaagcccagatcctctataagccagtgg

SEQ ID NO: 6805530 - DNA, 80 bp, Homo sapiens
caatgcagtcagtggtattttgttatggcagcccaagcagactaatacagctgtcattatttgcctactgacttgcactg

SEQ ID NO: 6805531 - DNA, 57 bp, Homo sapiens
gggagagtcagactaagccatggtgaatgaaatttacctggccaagctaactttgcc

SEQ ID NO: 6805532 - DNA, 78 bp, Homo sapiens
gaggtaacttgcatttaaatattgaatattcaatcaataattaaagtgatgtttaataaggaaatgcaagacagcctt

SEQ ID NO: 6805533 - DNA, 66 bp, Homo sapiens
agaagtcaagtggtctatgaaatcacaggtaataatgaaaaaaatgcctcatgaccattggcttct

SEQ ID NO: 6805534 - DNA, 79 bp, Homo sapiens
ggacctgaccaggctatcctgctgttaacagggaagaaagaaaactacctacagcagagaccagccacatcagtcatcc

SEQ ID NO: 6805535 - DNA, 129 bp, Homo sapiens
cagagacaaggtgggcgctgctatggctgccgcacttccagagtctgggctgggtgtcccccactccctttcagcctcctggaagcccctccctgaggcagccatgtcccagttgacccccttcctctg

SEQ ID NO: 6805536 - DNA, 80 bp, Homo sapiens
tgtggcatcccagggagcggcccatctgtggtccccccaaaaaaggggtctccacagcccagctgccacctatgctcaca

SEQ ID NO: 6805537 - DNA, 62 bp, Homo sapiens
cctctcaggtccttactgtgctccctccgcagatgagaaggagacgccagggcctggggagg

SEQ ID NO: 6805538 - DNA, 92 bp, Homo sapiens
atggaagaggtgtgacaggaaaggtctgctgtcccagggccaccatatataggagtgactcccatcctgggcaggacctttctttcttttgt

SEQ ID NO: 6805539 - DNA, 69 bp, Homo sapiens
agggaatgtgaaacagtaagggaagttgagggtttttaccagccccatagtctccattgtcacttccct

SEQ ID NO: 6805540 - DNA, 87 bp, Homo sapiens
caaagagaaaaaggcggtatcttgttatcaggaaaacagtagcttttacagaggagcttcccggtagacaactgcctgttctcattg

SEQ ID NO: 6805541 - DNA, 74 bp, Homo sapiens
tagagttactgtcactccaactgagtcgtcaaaacccatttttaagtcttatgacttttaggagcagtgctctg

SEQ ID NO: 6805542 - DNA, 76 bp, Homo sapiens
tcaaagagttgaggcagttatccaggaggtctgaaatcacagaaggtgtttggagagcgtgcttagcactctgtga

SEQ ID NO: 6805543 - DNA, 62 bp, Homo sapiens
ctgtagtgctggtctgtccaggggcttttcttttctctaattcaaccagacacttataacag

SEQ ID NO: 6805544 - DNA, 55 bp, Homo sapiens
ttgttgtggtttatcaaagtggtatcacatacatcacatttgaacctcacagcaa

SEQ ID NO: 6805545 - DNA, 70 bp, Homo sapiens
tagcagaggtaaaatttgaaccaggctctgtccaattacaaagctcaagttcttttaccatattatgcta

SEQ ID NO: 6805546 - DNA, 84 bp, Homo sapiens
ttttgtgtgtgttgtttatagttatgaaagactgaggcgtatataaaacttttcagaaaatttaattatgaacacatgtcaaag

SEQ ID NO: 6805547 - DNA, 63 bp, Homo sapiens
aatgcatacatgtgcacacatggttatgtgggtcaccgtagctttgccacacatgtagatatt

SEQ ID NO: 6805548 - DNA, 85 bp, Homo sapiens
atatcaaagcttcttaaagtattggtttaaccaaatcttttgatttttaggaccattttacttgtaggtgagaatactttgatat

SEQ ID NO: 6805549 - DNA, 68 bp, Homo sapiens
tgaaggctggtttccttgatgtttctcagcttccattatgctccagcaaatacagaaacttgttttca

SEQ ID NO: 6805550 - DNA, 61 bp, Homo sapiens
cccagtgggtcactgcatctcactaccaaccatcatagggagcgtgctgcttcccactggg

SEQ ID NO: 6805551 - DNA, 66 bp, Homo sapiens
tatacatatatatgtgtgtgtatatatgtgtatctctgtgtgtgtaaacatatgtatgtatgtatg

SEQ ID NO: 6805552 - DNA, 89 bp, Homo sapiens
atgttaagatttattaaatctgggtgataggtatgtgggtattcatgatactattctgtctacttttctataggtttgaaatttttcat

SEQ ID NO: 6805553 - DNA, 65 bp, Homo sapiens
ggtttctagatgcggggcttgtgctgaagcctctcccattggactagaccttgcttctggatgtc

SEQ ID NO: 6805554 - DNA, 81 bp, Homo sapiens
ttatctcttcctttctaaaatcctaatgacaagtttagttcagcatggatttaactattcatgaggtttgggaataggtag

SEQ ID NO: 6805555 - DNA, 61 bp, Homo sapiens
tcactgtcctccgagggccgaatatctacacgcaattgcaggtaaggtttggaggcagtgg

SEQ ID NO: 6805556 - DNA, 71 bp, Homo sapiens
ggtgcaaagatgctgatgttggatcaaccgaggaaatacagttttggtcacaaaagtggtatttatgcact

SEQ ID NO: 6805557 - DNA, 67 bp, Homo sapiens
actttttatatgaaggatagtgcgtttgaactggagcagtacacaagctttcatgtattcagagagt

SEQ ID NO: 6805558 - DNA, 74 bp, Homo sapiens
gctttgatctgtagtccaggtttgctaatttagaagacgtaagttagaacttaaacttcagaaagtctcaatgc

SEQ ID NO: 6805559 - DNA, 76 bp, Homo sapiens
aggaaagtgtggctagttggcagagaacagggtgaactcagttggctcccaaaatggctactgaattaattttctt

SEQ ID NO: 6805560 - DNA, 60 bp, Homo sapiens
gattcaggaagaactcttaggaaaatttctctctcttcccagctgagacttcctgaactc

SEQ ID NO: 6805561 - DNA, 56 bp, Homo sapiens
tggcagaaagtttaggtttcatttcctctgtgtgaaatggccttcctctctgtcca

SEQ ID NO: 6805562 - DNA, 85 bp, Homo sapiens
tgaagtttgtggacctgtgtagaatattttgttctactatgggagattccacatgtgaatataatgtattacctgtcccagttca

SEQ ID NO: 6805563 - DNA, 102 bp, Homo sapiens
gggaccgtgcacccgtggctatcagagcccctccgctgtcccaccctgggcctgggacacgggcctggggcagtgtgtgtctgctggtcatgtgctggtgcc

SEQ ID NO: 6805564 - DNA, 63 bp, Homo sapiens
aatagcaaaaatgaacaaagcttgcattttaaaaacagcaggaatagaggttcatttgttatt

SEQ ID NO: 6805565 - DNA, 71 bp, Homo sapiens
aatcaggagaccaggaaggcctacagatagagcaggtgctttgatttttcatggttttctggctcctggtt

SEQ ID NO: 6805566 - DNA, 129 bp, Homo sapiens
gttagtggtccctcatctgggcaaagcagacccaaggtggtgctgagtgcagagtgcagagcattcttgtgctctcctctcatggctggaactatctgggctttgcgccctggtccagtgctacgtatc

SEQ ID NO: 6805567 - DNA, 113 bp, Homo sapiens
gctgcagagctgagtgcgcaccttcttgggccaggccttaccatagctgtagcaccgtctgccgcagtgcggggagggccccatgtgccacagggtccactcggacctgcagc

SEQ ID NO: 6805568 - DNA, 77 bp, Homo sapiens
gactgccccagtgccaggcaggtgtgccctgggctctgccgccaccctccacgcttgctggcaacactggtatggtt

SEQ ID NO: 6805569 - DNA, 79 bp, Homo sapiens
gcatgctttatgtgtggagccagcctggagtcagcatcccctgtcctcttggtttgcctccatggacaaaaacgtaggt

SEQ ID NO: 6805570 - DNA, 80 bp, Homo sapiens
tctgttaggacttgtaaacataccagagccaagtcctctgaacttcgcgaactgatttggtgtgtttgctggtacccaga

SEQ ID NO: 6805571 - DNA, 65 bp, Homo sapiens
gaggcgggcagatcacctgaggtcagaagttcaagtccagcctggccatggtgaaaccccgtctc

SEQ ID NO: 6805572 - DNA, 93 bp, Homo sapiens
ctgagacagaatacgtagaaatgtgtgaattgagagaagagccctaaggttcttacattactttacatgtgttttttaaaaaaattgttttag

SEQ ID NO: 6805573 - DNA, 82 bp, Homo sapiens
gtcagagagagtcaaatctttgctgctcaaaatcagtgctttaggcattgataacacaagtaagcatttgtttctcttaggc

SEQ ID NO: 6805574 - DNA, 59 bp, Homo sapiens
gctgatgtgaagcttgtgctaacatatgaaaagtatttagaaagagcttggcatgtagt

SEQ ID NO: 6805575 - DNA, 62 bp, Homo sapiens
ggatgtggctctgtaaaatgcctgcataatttctgtgttagtaaagacgtgggccgcagtcc

SEQ ID NO: 6805576 - DNA, 63 bp, Homo sapiens
gggaatgtaagatatatactagtctcttagtggccagagaaagccagtgtaacttacatttct

SEQ ID NO: 6805577 - DNA, 59 bp, Homo sapiens
tgaaatttctgcacgcagtaggtaggtaggcacttgattactatgtgttgaaagctgca

SEQ ID NO: 6805578 - DNA, 66 bp, Homo sapiens
tatgtgtaagctgtttatctttttcctcttattatactttggccaaggtggaaaaagcttaccatg

SEQ ID NO: 6805579 - DNA, 61 bp, Homo sapiens
cagtctctggtgagttgacagtagctaatagaatctagtctctgtttgctatcatgagctg

SEQ ID NO: 6805580 - DNA, 74 bp, Homo sapiens
gtgaattactgttagggaaaatatatcagtagcagagatactgattctgtaatttttcctaaataggcacttac

SEQ ID NO: 6805581 - DNA, 63 bp, Homo sapiens
cattattcaatgttatttcagtgcttaccaagctgggcaggcactggagaagtattgctgatg

SEQ ID NO: 6805582 - DNA, 97 bp, Homo sapiens
ttttctgctctgtgtacttttatgacattttgtaagcattaatgatatgctacagcattttgtagagtactataacagagaattatatattagagaa

SEQ ID NO: 6805583 - DNA, 78 bp, Homo sapiens
aggaaaatttgtgtctgtggaacagagctgttttctataagaagtcaatttatgttctcagacccatagatggagcct

SEQ ID NO: 6805584 - DNA, 112 bp, Homo sapiens
cagaccctggctggagcccctatggcttggggtggggagtgggagtacccaccccaggccctccccttccttcctcagacagcctccttgagggctcaagccatttcttctg

SEQ ID NO: 6805585 - DNA, 102 bp, Homo sapiens
aggcaggggatggtttaggaggtgacagagacccactcacagatgctatcttggaggcattctaggggggatcttggtccatcctggctggacccctggcct

SEQ ID NO: 6805586 - DNA, 75 bp, Homo sapiens
ctccatggaatgtcacagttgcaacatgaatcaacaatgattcctgtcaccagacttgatgccttccatctcgag

SEQ ID NO: 6805587 - DNA, 57 bp, Homo sapiens
gctggagttagaactagcctggctgactccaagttctgggctctttctgtctccagc

SEQ ID NO: 6805588 - DNA, 85 bp, Homo sapiens
tatggcttgctttaggggaggagagagcagaagggcagagggacctccctgcttccgctgttttctcagatgccaagttgccata

SEQ ID NO: 6805589 - DNA, 85 bp, Homo sapiens
ttcatctttaaaaagacctacgattttggttctaatgtaatccaaatattacagatgaaaaagcttgtggatatttatagatgaa

SEQ ID NO: 6805590 - DNA, 76 bp, Homo sapiens
tctgggttttaataagctctccaggtgatcatgatgcacattagaaccacctggagagcttttaacaaaacctagg

SEQ ID NO: 6805591 - DNA, 90 bp, Homo sapiens
agctaaactacatttcgaagacaagtcaggcggatttctagattaaattcccctgtccactgctgtgtgcttcaccgaatgtggtaagct

SEQ ID NO: 6805592 - DNA, 61 bp, Homo sapiens
agtacacagtagactttctcatcctaggcatgtggctggagaggaggaaatatctggtgct

SEQ ID NO: 6805593 - DNA, 76 bp, Homo sapiens
tttttaagtgtacagtttggtggcattatgtatattcacattgctgtatagccaccaccactgtccatctccagaa

SEQ ID NO: 6805594 - DNA, 58 bp, Homo sapiens
gcactgtctctgtcttaactcccaggtaggctctgaaattgatgacagggatggaagc

SEQ ID NO: 6805595 - DNA, 70 bp, Homo sapiens
gcattgttctcccagtcctctgtgcttaccctcagcacagagggtaagctaagtgattaggactacatgc

SEQ ID NO: 6805596 - DNA, 62 bp, Homo sapiens
ctggaccagcacggattagaatgctttcttcattgcagaaagttctattagtgctggtctag

SEQ ID NO: 6805597 - DNA, 129 bp, Homo sapiens
ccccacatagtaagaaaatgctgattgttgattttgaagagattaagttggttttgaattaccaaaatttatttaaaacacataaactctctatttgagtacaaagtcatttttttttattctaagggg

SEQ ID NO: 6805598 - DNA, 88 bp, Homo sapiens
aaatgtaggtgctatgaatatttctctcctgtagaagtaatgtagctatgtcaataccaacttcagagactttatggtccaagcattt

SEQ ID NO: 6805599 - DNA, 63 bp, Homo sapiens
agtcttggttgggttattactagaggtgtgacctctgatatcgcactaaactctgccaagcct

SEQ ID NO: 6805600 - DNA, 65 bp, Homo sapiens
ctagcctcggaggaccttggtgctgagggagtgtcccttgccttcagtgtccctttgcaggctgg

SEQ ID NO: 6805601 - DNA, 115 bp, Homo sapiens
cctgtaatctcagcacttagtatggggccttgtacaggaataaaaggaataaggatttccatcctactatttctttattactgactttactctttgccggtgtttccattacagg

SEQ ID NO: 6805602 - DNA, 63 bp, Homo sapiens
tgctggaaagagagtttcaatgaggtaaacaacctgtttatggaaaatgctctaatttcagta

SEQ ID NO: 6805603 - DNA, 55 bp, Homo sapiens
gacaggtcactgagggagggtgactgaggtcccaaaactttctccaggacctgtt

SEQ ID NO: 6805604 - DNA, 57 bp, Homo sapiens
agttctatgccgatagggaagttgatcaattctttcatttccacttgggttagaatt

SEQ ID NO: 6805605 - DNA, 64 bp, Homo sapiens
agttctactctcactcactgaagacgccctgtgtgcaagtccctgaacaggtgagagtaggatt

SEQ ID NO: 6805606 - DNA, 63 bp, Homo sapiens
acatctagactcttgccctcttttctaataatatttcagagaggcagctcccagtttgggtgt

SEQ ID NO: 6805607 - DNA, 93 bp, Homo sapiens
gcttatgtagctcataattatagacaatggtttgccaagaaattcctttgtatttttttcagcctgtctgtgccaagagccgtacaaatgagc

SEQ ID NO: 6805608 - DNA, 74 bp, Homo sapiens
tttttagtttgtatgcataccatttccatgttacattaatagtattgatgctttggtgatggtggaactaaaag

SEQ ID NO: 6805609 - DNA, 82 bp, Homo sapiens
ttcaccagggatgagtgctaagtcttgtgttgaggttccaaaaaactggttacataagaatagcactgggaaatctggtgag

SEQ ID NO: 6805610 - DNA, 81 bp, Homo sapiens
gcattgttgtaaactgtgtaatatgatgtctaacttttcctacttagcattattttatatatggtttataaaactatgtgc

SEQ ID NO: 6805611 - DNA, 95 bp, Homo sapiens
taactgattggtgcgtcctttgaattgaggtctttgagctatatccacatttccttagggaaaattccttcagattggtacgttctaattagtta

SEQ ID NO: 6805612 - DNA, 78 bp, Homo sapiens
gaggcagtggcagtggagacccgagcctgggtgaggccagggatctggggccttctctaaacgctgcttaaatggctc

SEQ ID NO: 6805613 - DNA, 76 bp, Homo sapiens
tccagagacctggctgacttcctttcctctgcactaacctgctgagggaacttgggcaagtcttcgcctctttgga

SEQ ID NO: 6805614 - DNA, 57 bp, Homo sapiens
ctggtgaatggataaactgttgtagattaatgcaatagaattattatttcagcccag

SEQ ID NO: 6805615 - DNA, 69 bp, Homo sapiens
cccaaaggctgcctgttccaatctccttccctgctagggacaaggcaaagagagagaaggaggcctggg

SEQ ID NO: 6805616 - DNA, 57 bp, Homo sapiens
gggcagcagaattggacagaaacagcatgaggttttgatgccagtctctgcctgtct

SEQ ID NO: 6805617 - DNA, 59 bp, Homo sapiens
cctggtgactattcattgcccatgtttgtgaattatcagaaagcagaattcttgccagg

SEQ ID NO: 6805618 - DNA, 70 bp, Homo sapiens
caaaggagagtaggttactccattcctctgttcccttttggaaatggagtacttttttactttctctgtg

SEQ ID NO: 6805619 - DNA, 83 bp, Homo sapiens
cagatcttctttccctgttcccaaaccatctttcttcatagccggctctggggatgaggagcctgggttaggaggaaggtttg

SEQ ID NO: 6805620 - DNA, 66 bp, Homo sapiens
catagaattgtttcaaatgtctagatactgtagcctcacagtactcttatttgaaatatgcagatg

SEQ ID NO: 6805621 - DNA, 77 bp, Homo sapiens
gccatccacatatgtgtccctgctactcaacagggatcctgttgattggcatggatacagcaagcagaggtgaaggc

SEQ ID NO: 6805622 - DNA, 77 bp, Homo sapiens
tattctgaagtgtttatatgaacttcatacccaggatctcccttgaagaaattattttatatagtcacttggggata

SEQ ID NO: 6805623 - DNA, 82 bp, Homo sapiens
cacgcagcgcgcgggccggttcgatccgtatgcgcgccgcgtgcgcccattggtatgcgggagccggcccggcgcgggcgtg

SEQ ID NO: 6805624 - DNA, 87 bp, Homo sapiens
gccctggtgtaacctcagaatcttgcaaacatttgacaaatatttattaatagctgttagttattgaagatgtgctatatgccaggc

SEQ ID NO: 6805625 - DNA, 80 bp, Homo sapiens
gtgtttgtgtctgtgcacacgtgcccaacagttatataaggtgtacataaactactgtagcacattgcatatataaacat

SEQ ID NO: 6805626 - DNA, 64 bp, Homo sapiens
ctaagcagcaggcaaggcagcctctgccagccggggcctcctcctggggctgttcctgcgctgg

SEQ ID NO: 6805627 - DNA, 82 bp, Homo sapiens
ccgacaattcagtgtgctgtcccccgtgtctgggctggcttggtgggctgggaatggcgggggaatgggacacttattttgg

SEQ ID NO: 6805628 - DNA, 72 bp, Homo sapiens
tgtggtccaggactggtggtacccttcactctgcaaagcccctgtaagggagacccaccgtcctggactgca

SEQ ID NO: 6805629 - DNA, 65 bp, Homo sapiens
gagtattagaagcagcctaattttagagagattatccataatcctttatgtgagttgtttccctc

SEQ ID NO: 6805630 - DNA, 62 bp, Homo sapiens
ggtgggaccatcacttgagcccaggagttcaagaccagcctggaccacatagtgaggccccc

SEQ ID NO: 6805631 - DNA, 61 bp, Homo sapiens
agctactagggtgccagacatgtgagggaggccggttggatgttctggccccagtcaagct

SEQ ID NO: 6805632 - DNA, 86 bp, Homo sapiens
ctgttgctccttcttgcattgggctggcctgtatcaagtgaaggggttgggcactgtagctggtgctggggggagctaattgacag

SEQ ID NO: 6805633 - DNA, 58 bp, Homo sapiens
attcctgttttggttatccttgcaatttgagtactaggcaaacctataaaataggaat

SEQ ID NO: 6805634 - DNA, 82 bp, Homo sapiens
gagctaatttttagcatatttccatgaaggcagattttatcttccataaatgcttagattcatagaaatggtgagttggctc

SEQ ID NO: 6805635 - DNA, 74 bp, Homo sapiens
ggccctgtccctgtgtgggtggggcctcttccatttccctgacttagaaaccacactccacttagaacagggtt

SEQ ID NO: 6805636 - DNA, 55 bp, Homo sapiens
tgggcctcccatgtcttagggacgcagaggccagcctgggtagaatgggagccta

SEQ ID NO: 6805637 - DNA, 63 bp, Homo sapiens
gctgaaatcccagcattccccatgccccagcccatctcagccaggacagagtgctggctcagc

SEQ ID NO: 6805638 - DNA, 105 bp, Homo sapiens
tatttttatttttgcttttctccttaaatattagtttgacctctggattgcaatgcaatgcacatgttgtaataaataaaaggggcttggataaaagtgaaaata

SEQ ID NO: 6805639 - DNA, 68 bp, Homo sapiens
tggtgcaaaactaattgcggtttttggatttacctttaatggcaagaccagcaattctttttgcacca

SEQ ID NO: 6805640 - DNA, 75 bp, Homo sapiens
gatttgttcttatacctgaagcaggtgatgtttctgtagagacatctgaatgacagcgggagtgaaggacaaatc

SEQ ID NO: 6805641 - DNA, 74 bp, Homo sapiens
cgcctccttctccgtttgagctaggtttacctgaacaaataaaccagttggtttcaatgggacaggtgagggcg

SEQ ID NO: 6805642 - DNA, 81 bp, Homo sapiens
cctctcacagagggatctgccaggacttgggtgcacagggtgtagggcctaggtaccagcagagagccaggctctgagagg

SEQ ID NO: 6805643 - DNA, 64 bp, Homo sapiens
ttcagcctcagggagtcatcttgcttattgacatttgtcctggtgaggactctggaggcatgag

SEQ ID NO: 6805644 - DNA, 67 bp, Homo sapiens
ctgctggcgaggccaggccagggccttagaagtggctttcaagaggtcctctcctgcctgccggcag

SEQ ID NO: 6805645 - DNA, 75 bp, Homo sapiens
tcctgatggaggggtcatctttgtggtcacaccccagacactagacagagaggtaggccagttctttagccagga

SEQ ID NO: 6805646 - DNA, 62 bp, Homo sapiens
aagatgagtgaccagaaatgattctccagctcatatgtgggccactgaattttctgcatctt

SEQ ID NO: 6805647 - DNA, 70 bp, Homo sapiens
tgatcaaagcacacttagtggtagaaccgggtcttgaacttcattcttctacctccaagtgtctctggca

SEQ ID NO: 6805648 - DNA, 82 bp, Homo sapiens
cacatgggggatggtcagctccagcacagcggggtggttcgccccagagccccctccctagtgactggaatttcctccagtg

SEQ ID NO: 6805649 - DNA, 56 bp, Homo sapiens
ttgcctgggctgggctgggtgccaaacacttaatgcacacagctctgctcagggaa

SEQ ID NO: 6805650 - DNA, 55 bp, Homo sapiens
gaatagcttagattccttagtgcctgagtcagggcctaataaataatagctactc

SEQ ID NO: 6805651 - DNA, 77 bp, Homo sapiens
gatttttaatacacttcatgttttcatctgtggatgttaattacagaatagctgacagcagaagagtattttaggtt

SEQ ID NO: 6805652 - DNA, 96 bp, Homo sapiens
cctcagcctcccaaactgttgggattacaggtgtaagccaccatgcccaggtgagatgctggctcatttctaaacccagctcattggcaagtgagg

SEQ ID NO: 6805653 - DNA, 86 bp, Homo sapiens
gaggatggcttgaggccaggagttcaaggttgcagtgagctaagatggtgtcactgcacttcagcttgggcaacaaagcgagactc

SEQ ID NO: 6805654 - DNA, 110 bp, Homo sapiens
gacactgattctctgtgaagcagggcagtgcttcagctctcatgcagtggggggtgtgactgcttagactggccaagacactgattccctggaaagcagggcaccaagtc

SEQ ID NO: 6805655 - DNA, 59 bp, Homo sapiens
agctcagtgagggttacaggaagcatggcaagctttgctgcttgggggcttcaggagct

SEQ ID NO: 6805656 - DNA, 78 bp, Homo sapiens
cccttttgcattcttcagactccctctttaagaagctgtgttgggcctgcttatatgggatttgaaggggagctaggg

SEQ ID NO: 6805657 - DNA, 67 bp, Homo sapiens
tgaagggaagagcctgtagggacaccagcctaagccttggttcttttgccctggggctcttccctca

SEQ ID NO: 6805658 - DNA, 118 bp, Homo sapiens
gtgggaactggcacaggtggggagtgggtaaaggagtccagcaggctgaatgccttcaacaatcattttaccacatggtcctcatttactctcagctgcctcatatgtgtcacctcac

SEQ ID NO: 6805659 - DNA, 112 bp, Homo sapiens
gtttcttttttaattcttaagtgtgtgcaagagaaccagaggaaaacatttatctgtaggaaaataagtaaatgagatttgttcttttgttcaccttatgtaaaaaggtaac

SEQ ID NO: 6805660 - DNA, 55 bp, Homo sapiens
gcagatgcaagggtactggggccacagcctctcacagtatgaattgttcacctgc

SEQ ID NO: 6805661 - DNA, 60 bp, Homo sapiens
gaagtgtcttttataaatctccaggaaatctcctaggaagcatttaaagagatggatttc

SEQ ID NO: 6805662 - DNA, 64 bp, Homo sapiens
tttcctgtatgtcagtgaagagcagggcacttctgttcttggacagtcactggcatatggtaga

SEQ ID NO: 6805663 - DNA, 99 bp, Homo sapiens
ggagccaataaggaaggcagtttggagactaagccagggctgcgagcagacagggtgaacctcacttctcccaggacctgggcccacactgctggctcc

SEQ ID NO: 6805664 - DNA, 102 bp, Homo sapiens
ctgtacaccagcaattttcaatcttggtgcgacaacaaactattgtgtttcaatatgttgtggggtgcatcaaaaagagtgtgttgctaatggtagttgcag

SEQ ID NO: 6805665 - DNA, 127 bp, Homo sapiens
ctctcacagagggtaaaaccacagaacccatgagactccctttaagacttttcaaaggcaaacattcccaatggcaaactggaaagcttgagtttagagatgggtttttggaagaccaaatatgagg

SEQ ID NO: 6805666 - DNA, 65 bp, Homo sapiens
gcagtagctatttagcccagataagtgttttactgtctgagctgattgagctaaatgtatcttgc

SEQ ID NO: 6805667 - DNA, 57 bp, Homo sapiens
tcgcctgctgtgcagtctatttcgggactcagtctcagttgctgctgctgcaggtga

SEQ ID NO: 6805668 - DNA, 60 bp, Homo sapiens
ggtcacatctaaatggagcattgaggagtatttctccttgagtgtagcacagatgttacc

SEQ ID NO: 6805669 - DNA, 128 bp, Homo sapiens
gaggggtggggccggcctcaacgcagcagtgtgctagcaagaactggggacatttttaccctgccatcccatcatctgttctggctacacaaaatgagtgtgaattatgggggcctgctgagcctttc

SEQ ID NO: 6805670 - DNA, 63 bp, Homo sapiens
ttctttgaggacattttagaaagttgttaaatttaatagcagcatattgtgtcttcataagga

SEQ ID NO: 6805671 - DNA, 65 bp, Homo sapiens
gctcacatgcacactgcaacaaggactggcatccttcatccatgtttagagggtgtatatggagc

SEQ ID NO: 6805672 - DNA, 56 bp, Homo sapiens
ctccatcctctccagcagtggagtgacctgtacacagcaacctggaggggaagggg

SEQ ID NO: 6805673 - DNA, 81 bp, Homo sapiens
gtggtagcaaaatagtttatatagcttaaaatactgaaaataatgtatatgtagatgtcatataaattgtagtgctgacac

SEQ ID NO: 6805674 - DNA, 63 bp, Homo sapiens
gttttcccaatgagtctatttgtccttgtggaacagtttaggggagagtagcattgaggaaac

SEQ ID NO: 6805675 - DNA, 87 bp, Homo sapiens
taggagtagttcttgatctttttatcaagttatccattgttaggaattgcatgggtcactatttgcagagacgtgaaatactcgcta

SEQ ID NO: 6805676 - DNA, 60 bp, Homo sapiens
cccaggttagtttcccttttgattaactcaaagtcaactgaataggaacctgatcatggg

SEQ ID NO: 6805677 - DNA, 63 bp, Homo sapiens
actgcatttggtaaagtcaagaacaaaataaagatggccctcttgctgttttcccaatgcagt

SEQ ID NO: 6805678 - DNA, 67 bp, Homo sapiens
attgccaattaacactgagtattatgtgataacacacacagcaaaatgcttaggttaaatttgtaat

SEQ ID NO: 6805679 - DNA, 72 bp, Homo sapiens
accactaagttccttttcacttctaggagtataataccctcatttgacagatgtggaaagaagttagaaggt

SEQ ID NO: 6805680 - DNA, 80 bp, Homo sapiens
gtaaatgaggtaaaatgtgtacagtaagtgaatctaggtaaaacatatgtagatgatatttgtaccatttttattcttgc

SEQ ID NO: 6805681 - DNA, 61 bp, Homo sapiens
gggttcccaggatgcctctgctgctaattaggaatgaggcagtgagaggtctcctggtccc

SEQ ID NO: 6805682 - DNA, 55 bp, Homo sapiens
aagctgccacacggtgagtactctacaaatatggaaatcactgggtgtgcagctt

SEQ ID NO: 6805683 - DNA, 61 bp, Homo sapiens
ttttctatctcctagaactgcctggttgtccacctccagattgcagatgggagaaagagaa

SEQ ID NO: 6805684 - DNA, 61 bp, Homo sapiens
agcccgagtggttcaccctcacagtctctctgttagagaagtgagttgtgactatggggtt

SEQ ID NO: 6805685 - DNA, 64 bp, Homo sapiens
ttcagtacacactatttaaagtgtttaatccagaatttaggtgcattgtagtgtgtattttgag

SEQ ID NO: 6805686 - DNA, 59 bp, Homo sapiens
gtggacggcggtgccaggacagggagggcggcctttcaccagcttggcacctctgccat

SEQ ID NO: 6805687 - DNA, 129 bp, Homo sapiens
cttgttttaaaaaaatgaggctaatataaatgtcagtctttctgtctcagatgtgctttgtgtatcagaggagacgagacatgtgaattcacatttatgtgactagacctaaaatcactttgaaataag

SEQ ID NO: 6805688 - DNA, 63 bp, Homo sapiens
gtaagtttgaggtccatgaagggttataattgcgagagagctctcagggagcccagtacttac

SEQ ID NO: 6805689 - DNA, 55 bp, Homo sapiens
gagctgggacatgggtcctctcctgccctcagactggaactcacgtcatcagctc

SEQ ID NO: 6805690 - DNA, 65 bp, Homo sapiens
tcctgatggtggtggggtgggtctgagcaggaaggggcctggaatccatcccatcttcaccaggg

SEQ ID NO: 6805691 - DNA, 76 bp, Homo sapiens
aaatacagaaattgccaccagctctgtatgagagaacccacacagctccagagctgtggtctgatttcatgtattt

SEQ ID NO: 6805692 - DNA, 66 bp, Homo sapiens
gctctgttgtctaggctgcagtacagtggtgtgaacatggctcactgtagccttgacctcctgagt

SEQ ID NO: 6805693 - DNA, 70 bp, Homo sapiens
gagcttctgccttctttctgggtggttctgagaacatgagagttgctgggtccagagagtggcaaagctc

SEQ ID NO: 6805694 - DNA, 81 bp, Homo sapiens
ctgtaccctgaggcacttaataaggattcaattttggtaatgaataatattagtttcttcattaagtggcttaaagaatag

SEQ ID NO: 6805695 - DNA, 62 bp, Homo sapiens
gtgcacagaaattggtaagacttgtaaaaccttggtttaccaggtctggtgatgtcttgcat

SEQ ID NO: 6805696 - DNA, 91 bp, Homo sapiens
gaaaaaaatgttgcggaagctttctttatgtgtatcatcttctagcctacgataaaccagaagtaaaagctaccttccacagcttattttc

SEQ ID NO: 6805697 - DNA, 79 bp, Homo sapiens
aacagaacccgagtgtgaatctttcaccactggatttgcgtttcctccataaaacttcatgcttaacagggtttctgtt

SEQ ID NO: 6805698 - DNA, 100 bp, Homo sapiens
acagcttccatttgctcccaagttcaatgcattctttcatggacctggctctgctgacatccaggaaggaggtatcttgctggggaggggatagcactgt

SEQ ID NO: 6805699 - DNA, 55 bp, Homo sapiens
cagttcagctgtcagcctcccacagaaagttcaggagaggagagacagctgactg

SEQ ID NO: 6805700 - DNA, 102 bp, Homo sapiens
gctgtaatctctagtgcggggtttctcaacagtggcaccactggtggtttgaactgataatcttctgttgtgggagcttctgtgcattgtaggatacttagc

SEQ ID NO: 6805701 - DNA, 67 bp, Homo sapiens
gaaatgatagattattgtaatgactgccagaatggccttttggcatgtttaaatggcaataaatttc

SEQ ID NO: 6805702 - DNA, 88 bp, Homo sapiens
gcattaaaggctcttgacatacttaagctcttgactgagggcgtgttggagattaccccttgtttttgagtacaatagttttgtttgc

SEQ ID NO: 6805703 - DNA, 79 bp, Homo sapiens
tgtcccttatgaatctgttcccgaaatggctctggactcttttcccaggagaatatttttgggtcatagactttagaca

SEQ ID NO: 6805704 - DNA, 63 bp, Homo sapiens
tgatttgcatggagaataacagaattgaagtagcttgagtctgttactttgtctttgcaatca

SEQ ID NO: 6805705 - DNA, 106 bp, Homo sapiens
ggcagctgcgattgtgggaagcagttccttgagaatggttgcttcagcacccaaggctgagatggtagcaggcacttcatagggttccttcagatttgcagaagct

SEQ ID NO: 6805706 - DNA, 66 bp, Homo sapiens
gcccaggtttcatctgctccgtggccggcactgtgcaggcagaggtgagccagtgagcctctgggt

SEQ ID NO: 6805707 - DNA, 58 bp, Homo sapiens
gtgtgagctccctctcctcctgagcttcttggcagcaaggtgagaaaggaacttagac

SEQ ID NO: 6805708 - DNA, 89 bp, Homo sapiens
ttttagatttttctggttctacacttttcaagtcagtagatttacttacaaagagaagttgtagaattgttcgctgggaagtcttaaaa

SEQ ID NO: 6805709 - DNA, 83 bp, Homo sapiens
cttttgaattgtagtcttttcaatgattgtgtattacttttgtaatttaaaacacttgttaagaagaggatatgcttcaaaag

SEQ ID NO: 6805710 - DNA, 77 bp, Homo sapiens
tcctcatttgtaggaagggctcagggctcggtgggtaagccagacactgagctaggtccttcttgcccagctgggga

SEQ ID NO: 6805711 - DNA, 55 bp, Homo sapiens
acctcaggtatcacttctgctgagaagcccagcagtcagtctcttgccttgaggt

SEQ ID NO: 6805712 - DNA, 61 bp, Homo sapiens
gtctgcccttggcctgggactttgggctttggttctaagttcctaaagtcaggggtcaagc

SEQ ID NO: 6805713 - DNA, 124 bp, Homo sapiens
gtagtttgtgtgtgtttgtgtgtgtgtgtgtgtgtgtgtgtgtttacttctatgcagtttcatcacatgagcatatttgtgtaaccaccaccacagtcaagatacagtacagttccatgactac

SEQ ID NO: 6805714 - DNA, 73 bp, Homo sapiens
gctgtctctctacagatcctatatagaaagcaatcgtgaaaatcacttgtcttttagggatgagatgagcagc

SEQ ID NO: 6805715 - DNA, 75 bp, Homo sapiens
agctgatggaacagattaaagtgagggctagatcttccccctctgccctatcccctcacttctcttcctccacct

SEQ ID NO: 6805716 - DNA, 70 bp, Homo sapiens
tgacatcttctccccagaaaagatttctgtccacagatggtgatctataactctgagggaggcagtttca

SEQ ID NO: 6805717 - DNA, 64 bp, Homo sapiens
ggcaaatctggaagaacggggcatgctgaattcctactctgtaactcacctttcaggtaatgct

SEQ ID NO: 6805718 - DNA, 55 bp, Homo sapiens
gggtcactgctctaaacaaaagtagtgatcttaatcatgactgagcagcagactc

SEQ ID NO: 6805719 - DNA, 66 bp, Homo sapiens
gaggtctgtgcgctgttgatagaaatcctgcagacatgatgctgagctctgtcagtgcatcacctc

SEQ ID NO: 6805720 - DNA, 78 bp, Homo sapiens
tgctaattcgagaatgaaaggggttgagttacagctactgcactgggagctgcacacaatcctgttcctccaagggca

SEQ ID NO: 6805721 - DNA, 128 bp, Homo sapiens
tcaacaggcaggcactgagtattcagtataaatttttgagcagggaatccaccagaagaactatgcatctggaggattaatctggaaagattgtgtagaatgttatgcagtgaaagagtctgagatga

SEQ ID NO: 6805722 - DNA, 75 bp, Homo sapiens
gagtggggtatggagattagaatacttcgattgtttaataataatttgcataatagtgatttgtatatctcattt

SEQ ID NO: 6805723 - DNA, 128 bp, Homo sapiens
tcagcattgagtaaaaggtttggatagtgagaagtttgaaagaccaattagattttacttctgtgagagctggaaaagttgttttaatctgccttactttaacgtttcccattcctcaccaaaactga

SEQ ID NO: 6805724 - DNA, 96 bp, Homo sapiens
tttcttgctgagctatataatggttcatgagctcttaactgagacttataaaagtgttctcaattgttagttcaaggtctgtagccagcttagaaa

SEQ ID NO: 6805725 - DNA, 77 bp, Homo sapiens
atctgttgttaggaattataaaaaggtattattactgaagtaaattaagaaaatgttttatgatttttaacctaggt

SEQ ID NO: 6805726 - DNA, 81 bp, Homo sapiens
gcctcggcctcccaaagtgctgagattacaggtgtgagccaccacgcctggctaatttttgtattttagtagagatggggt

SEQ ID NO: 6805727 - DNA, 59 bp, Homo sapiens
gaagaaaggacagagtgaaactgtcagctcatgttgcctcagtgcttcctcctttcttt

SEQ ID NO: 6805728 - DNA, 74 bp, Homo sapiens
gttgagaagtcgaagcaggatggaaggatgcaggttcctaagacatgatccctcacttctctttgggttttcac

SEQ ID NO: 6805729 - DNA, 58 bp, Homo sapiens
agtctcattgccttagtatcattctacgaattagaatgtgttactgtgtaagagcact

SEQ ID NO: 6805730 - DNA, 64 bp, Homo sapiens
tggaaattgtgatgacagctggtggtgggaaacatcactgaaatactgaaattactagtgacca

SEQ ID NO: 6805731 - DNA, 63 bp, Homo sapiens
gcatggtggcagctgggacagaggtgggtgctcagccgccgttgtcactgttgccactgctgc

SEQ ID NO: 6805732 - DNA, 56 bp, Homo sapiens
atttagacaccagcttgtaaggtaccaaaactgctttcccaggtggtgttataaat

SEQ ID NO: 6805733 - DNA, 69 bp, Homo sapiens
gcttccgtgtgaccagcatgtcagtgtcgtttgtgtcccggaatgaagcaagctgctgtgtttggaagc

SEQ ID NO: 6805734 - DNA, 91 bp, Homo sapiens
tgctgttctcttttagaactccaaaaaaactctaattatgcagttcttatggcacacatagactgagtagattttaggagtggaatgtgca

SEQ ID NO: 6805735 - DNA, 92 bp, Homo sapiens
gaaattttttgctgtggctaaagaaaatgtgaaatgagatatttataaccatggatacctggtttttatttacagtcataagaaagaaattc

SEQ ID NO: 6805736 - DNA, 99 bp, Homo sapiens
gaggcttaaggggctgtggggtcagcaggcctggcctgttccagccatcccaggcaggcgagtgttgctctgcagacccagaatcacagccttggcctc

SEQ ID NO: 6805737 - DNA, 79 bp, Homo sapiens
ttatatttcctgctgtaaatcactgattaaagttagaatgatgcattattttaattcaaagtgaatagtggagttgtga

SEQ ID NO: 6805738 - DNA, 81 bp, Homo sapiens
taagggtggtccatgtcgataggagtgccatcggccaggcccaccgaggtcatcccactcctctccacaatcacgcccttg

SEQ ID NO: 6805739 - DNA, 58 bp, Homo sapiens
ttctcttttggtaaattgagtaaaggaaagaatgtattcaggtgtggccagaggagaa

SEQ ID NO: 6805740 - DNA, 62 bp, Homo sapiens
cctgtgggcgcagctggagtcaaggcttggggtcttggggtatgcttccagcagccagcagg

SEQ ID NO: 6805741 - DNA, 80 bp, Homo sapiens
ttaaatattagacaactcaatcacactctgctctttgtaggtaagacagacgtagtgtgagagtaaaatgaaataattga

SEQ ID NO: 6805742 - DNA, 60 bp, Homo sapiens
tatattgaacaaactactagaggacacactaaaattcctcctggttgttgttatagtata

SEQ ID NO: 6805743 - DNA, 57 bp, Homo sapiens
gctgccaggacggagaggagcgagcgctaccctcgcaccccagcccctccaggcagc

SEQ ID NO: 6805744 - DNA, 56 bp, Homo sapiens
ctgagccaagaggacatggcggagggccagccacacgaggtgagctcttggctcag

SEQ ID NO: 6805745 - DNA, 74 bp, Homo sapiens
aaagggacatcgaaccagtaggaggttaaccctgtggtaaactgggttcttcctcattgctttgaagttttttt

SEQ ID NO: 6805746 - DNA, 58 bp, Homo sapiens
aggctgggcggtgcagcagagtgagtggagttccacggaccctgaggctccccagcct

SEQ ID NO: 6805747 - DNA, 94 bp, Homo sapiens
gttaggcgacacccccacccatcgatggaagtagtatagggtgatgtgggtccactcctggatagggaacacgggtgggtggcggtgcctgcac

SEQ ID NO: 6805748 - DNA, 60 bp, Homo sapiens
gtcgagcttggacagctatattgaaactgaggagaggttcagtatagcttctaaactaac

SEQ ID NO: 6805749 - DNA, 76 bp, Homo sapiens
tcccaaccaccgtgcagcttccctgagcccactccctggcccagctcagagcccgaggcttgcatgtttgttggga

SEQ ID NO: 6805750 - DNA, 74 bp, Homo sapiens
agaacttaggaacaacagcttaggggactctttgacttgtccttatccttctttgcctgtgttctctaacttct

SEQ ID NO: 6805751 - DNA, 82 bp, Homo sapiens
gcccacgcccgaccttgggctgaaccctgcagctgagggtgtccctctcagccccacggggtcagccaaggaggccctgggt

SEQ ID NO: 6805752 - DNA, 58 bp, Homo sapiens
tggactagaagggcaagagtccctgaagcaaattcaaactgttggcttttctgggcca

SEQ ID NO: 6805753 - DNA, 81 bp, Homo sapiens
tctttgttggctttctctgtatctgaatgagctcagagcctcttaccatctcatttaagatgctagaagggtccatactga

SEQ ID NO: 6805754 - DNA, 92 bp, Homo sapiens
gaccgctggggtggccttgctgggctggcaggggatcgccctctccctgagcagatgaccagccccagcagggcccaggctcacggacggtc

SEQ ID NO: 6805755 - DNA, 56 bp, Homo sapiens
tctctggatgacgaatccagaaagatggagcttctttctgatattcatttagaaga

SEQ ID NO: 6805756 - DNA, 77 bp, Homo sapiens
gctgccagagacagagtgttttttaaggtactgtactgctctttgctctgtactcagagaacattcccagtcttagc

SEQ ID NO: 6805757 - DNA, 90 bp, Homo sapiens
atatagcttgttttgttcaagtagaaagtgaccaaattctcctagactgagaaaagattggcatgtttgcttgtgcatatcagattgtgt

SEQ ID NO: 6805758 - DNA, 55 bp, Homo sapiens
tttggggcatggggagttttcaacagtgcccagaaaattctaacatgcagccaag

SEQ ID NO: 6805759 - DNA, 68 bp, Homo sapiens
gaacatttttggctgagaaaatggttttaggttttgtagaggcctactagtatgtctcagttatgttc

SEQ ID NO: 6805760 - DNA, 121 bp, Homo sapiens
aatttgggtaaatttaaggtattgaaaaccaggcaagtagtgtttgtcataaattctgtcctatctgaacatgattcttgataggcattgtgctttgttttatggctttttaacctaaatt

SEQ ID NO: 6805761 - DNA, 72 bp, Homo sapiens
ggttagtttgcctttgcccttctgctcccagccttttattgctggcctgctgccagaggcaaacacttgacc

SEQ ID NO: 6805762 - DNA, 61 bp, Homo sapiens
ggctgagtgctgctgttcacgagtcctgtggactcgcgtggacactggcagcagctcagct

SEQ ID NO: 6805763 - DNA, 60 bp, Homo sapiens
cccccagatgcgagccatagcctaccatgtcctggcggcctactactcgcacttggaggg

SEQ ID NO: 6805764 - DNA, 130 bp, Homo sapiens
ccagagctgccagcctgcaagggggtgttcccaggacaggccacatggaaggtgcagatcagaacccagtccttccatctgtctctggtagccatccctcaacatcaggctggccctcccctcgctctgg

SEQ ID NO: 6805765 - DNA, 61 bp, Homo sapiens
agtgagctgagcttaactccttgaattcctgtatgactttttctgttgtgctcggctgact

SEQ ID NO: 6805766 - DNA, 79 bp, Homo sapiens
ggaaactattaggatgcttaccgacttacagtgctgcttagatgctatagcaagtaggaagtgtcctccttcagttttt

SEQ ID NO: 6805767 - DNA, 60 bp, Homo sapiens
ttcctccctgcccacattgtgctgacactgaaagagacacaatcatcaggcggggaggaa

SEQ ID NO: 6805768 - DNA, 66 bp, Homo sapiens
ggtggtaactttgatgatttgggtaaggtggtgtctatcggatttttctccttcaaagttactatt

SEQ ID NO: 6805769 - DNA, 75 bp, Homo sapiens
ggcaattcttgtgtggagtgtcctgtgcattgtaggatgttcagcagtgtctttgacctccacccacgaaatgcc

SEQ ID NO: 6805770 - DNA, 97 bp, Homo sapiens
ttaactttatgcctgccaagcagcaaacttccacaagtagataatttgaaagcctgacttttatttgctcttgctgcttggggcaaaatgaagttga

SEQ ID NO: 6805771 - DNA, 77 bp, Homo sapiens
ggcaggtcattgggggccatctcagaggctgcccaacacaggctactctttggcccccgatgattcatgttccttcc

SEQ ID NO: 6805772 - DNA, 56 bp, Homo sapiens
tctcagctctttgggaggccaaggcgagcagattgcttgagcccaggagttcgaga

SEQ ID NO: 6805773 - DNA, 67 bp, Homo sapiens
ggaagcttcagaagctgaggttccaggagccccagtccagctcctgacctatttttctcagctgccc

SEQ ID NO: 6805774 - DNA, 77 bp, Homo sapiens
ccccctcaaacgcattcttacatgcttccacctctaaacaggagaggggaagctgttgtgagtgcagcaggaggggg

SEQ ID NO: 6805775 - DNA, 80 bp, Homo sapiens
ctgtcactttgcctgtgtcagcaggtggaagtgctcaccagacattaaatattcagcttgctgactgcggcagaggggag

SEQ ID NO: 6805776 - DNA, 117 bp, Homo sapiens
gtttttgtaaaatgagctgtatttgtgaatatttaattttctgaactttgatctataataggcacttacatgtttacggatacactttaaattttaataaggctcaattgcaaaaac

SEQ ID NO: 6805777 - DNA, 108 bp, Homo sapiens
gttcttagagggaagagtgcccaggcaagactgagaacccctgcattaaatggtgatgcagagcctgacgggatttttctctgtgcctttgcctttccgtttgtaaac

SEQ ID NO: 6805778 - DNA, 74 bp, Homo sapiens
gtagctttgatggctcagctatgttaatagccttctatggtaataggagtgattgatatatgctgtaatcctac

SEQ ID NO: 6805779 - DNA, 65 bp, Homo sapiens
aagagatatatatttgtttaccacaagccgtggggagtatgatggtatgtagaaatatgtccctt

SEQ ID NO: 6805780 - DNA, 61 bp, Homo sapiens
gtgggaagaacttccggcatggggaaactaatatgaaatctattgctggggtagaatccac

SEQ ID NO: 6805781 - DNA, 81 bp, Homo sapiens
gtccttagtaaactgaggtattgaagtatcttctttttctttcagaaaatatttgtcaagcaccttctgtgttctaagaac

SEQ ID NO: 6805782 - DNA, 66 bp, Homo sapiens
tcacttccccatcatgtagagcagctcaggtcttctctagctcttccacctcatgatgggtagtga

SEQ ID NO: 6805783 - DNA, 64 bp, Homo sapiens
tcatagccttagggttgtcaggttaggtagctgatgtcctaatatggacggctccaagggatga

SEQ ID NO: 6805784 - DNA, 55 bp, Homo sapiens
gctggtccctttctactgagcacagtcagccttctgtgcctgaaacagacctagc

SEQ ID NO: 6805785 - DNA, 79 bp, Homo sapiens
gagccactgctttaacaggtaaagtaaatgtgctaaccaggcacacgcacatgcctgattgacaagcatatgtcggctc

SEQ ID NO: 6805786 - DNA, 118 bp, Homo sapiens
cttagcaaggatgttgagttagcctcatccttccagattctgaaattttcagtgtgagctggtttgtttgagaaaacagaactggagaaaacggttatattcgctattctgagttaag

SEQ ID NO: 6805787 - DNA, 85 bp, Homo sapiens
ggggccctgggagaggctgctccgctctcaatcccgcaaccgcggtcccggagggccctgggcttctgcctttcccgcgggcccc

SEQ ID NO: 6805788 - DNA, 103 bp, Homo sapiens
aattttttatatacttctgaacaaactgaatgggttttctgtcaaactttgtgcatttttttaagagtacaagagccctttcagattgacgaggaaaaaaatt

SEQ ID NO: 6805789 - DNA, 99 bp, Homo sapiens
gggctgggcaatctccctgtcagtgtttattgcggtgtgtactaggtcttatgctgcatgctatggtgatactgagaggtagaagacagaatcctgccc

SEQ ID NO: 6805790 - DNA, 112 bp, Homo sapiens
acatctatttttataactttgaaaactttaattagcttatcccatttctgaaacgtattagatgtttcataagtggagtaagtttaaagataattaaaggttagttagatgt

SEQ ID NO: 6805791 - DNA, 59 bp, Homo sapiens
tgtctttaagcaaacagtgtttgtgtaaccaccttgtagcaacattcagcttgaagata

SEQ ID NO: 6805792 - DNA, 62 bp, Homo sapiens
ataaagttactctcactgagaatggtatattatttgccattatctatgtagaatgattttat

SEQ ID NO: 6805793 - DNA, 56 bp, Homo sapiens
ttactttatagaacactgggggatagattgcccagaaaatatgtactataaagtaa

SEQ ID NO: 6805794 - DNA, 126 bp, Homo sapiens
attttggtgaagagaaggcagagtggagaacaggatacagcaggctagagaattgagttgtgcatggcacgtctgttttctgagcctattcttttcactcccaccgcctataaccttcccccagat

SEQ ID NO: 6805795 - DNA, 55 bp, Homo sapiens
gagggctccacacgggcccagcgcacagtaggtgcttggccagtgttatgctctt

SEQ ID NO: 6805796 - DNA, 62 bp, Homo sapiens
ctggactttggcccatctgccagctctgagtcagctggcaggaaaaagggccagaggctcag

SEQ ID NO: 6805797 - DNA, 67 bp, Homo sapiens
ctccttctccagtctcaagacattgagtcccaaggatggccctctgttttctgagacagacggggag

SEQ ID NO: 6805798 - DNA, 58 bp, Homo sapiens
aggaaaacaatattgagagcagcctgtgacctttctggcagctttcaatttctttcct

SEQ ID NO: 6805799 - DNA, 102 bp, Homo sapiens
gcagagtcccagggattcatccaaaggcctgggaggcctctcttcctgctgccgatgcggatgaagacaggccccttgctgctgcatgcgccgtggttctgc

SEQ ID NO: 6805800 - DNA, 62 bp, Homo sapiens
cccagtttaattcaagtccttgacttcgagattaatgaggagaaaggcttggctgagctggg

SEQ ID NO: 6805801 - DNA, 56 bp, Homo sapiens
ttgagtatctacttcaagtcttttcctcttggttaggaacttaggaggtacctcaa

SEQ ID NO: 6805802 - DNA, 56 bp, Homo sapiens
ttgttgttccaaactggataatgtaggtaatatattgtagcagttctggactgcga

SEQ ID NO: 6805803 - DNA, 65 bp, Homo sapiens
gcatttcagacataccagttattgaaagcaaatccgttttaagtgacttctcaatgctgaaaagc

SEQ ID NO: 6805804 - DNA, 61 bp, Homo sapiens
acactggagatggacctcacaaatgcaagatatgtgggaaagcctttgtttatcccagtgt

SEQ ID NO: 6805805 - DNA, 56 bp, Homo sapiens
ctgtgtcctccccatcacttcttccctaattgtaggagagagtcagggaggcaggg

SEQ ID NO: 6805806 - DNA, 66 bp, Homo sapiens
ggattctgccagaaccagtcaccgatttcttctgatggaatcactgattcattgtggtgattatcc

SEQ ID NO: 6805807 - DNA, 123 bp, Homo sapiens
gcttctttatttgctgaaacacaggtctttggtatgagctgtttttcctgcacctcctaataaggtgcagtgtttaaaagtagcaatcaaacactgatttgtcaatattctaaatagagttgc

SEQ ID NO: 6805808 - DNA, 58 bp, Homo sapiens
cacatgcacacacgtgcatgtacgcatgcatgtgcgcacgtgtgtgtgtgtgtgtgtg

SEQ ID NO: 6805809 - DNA, 92 bp, Homo sapiens
ttttgttcttttgaacctaatgcagtttcctttctagtcttttcttaatagtttgcaaaaagggggaattgcagattggttcatgaatggag

SEQ ID NO: 6805810 - DNA, 55 bp, Homo sapiens
tcgcatgggtcccccagagacggtgtaaccctgcaagcattttggtgaccctgga

SEQ ID NO: 6805811 - DNA, 101 bp, Homo sapiens
ttctctgtcattctctgagacactctgtctatcatgcatgagactaattgtttctgcaagcgtcacatgattctgcagagcttagaatgagctgcagtgaa

SEQ ID NO: 6805812 - DNA, 66 bp, Homo sapiens
ctgggatgatagtgctagtattgcagcagctgctgctactgctactattagattatttcatgccag

SEQ ID NO: 6805813 - DNA, 79 bp, Homo sapiens
tggaggttttgtggccagagtcacatgggctgttcaccacttcctctctgtgtgccctctctgagccataaagctccca

SEQ ID NO: 6805814 - DNA, 70 bp, Homo sapiens
caggggggacctctccagggtacagcaggctccatgtttgggatccatccctggagaggactcacccctg

SEQ ID NO: 6805815 - DNA, 64 bp, Homo sapiens
ctctggccgagcatgggggttacataaacaggcacattcgtgactccaaagggcgaggcaagag

SEQ ID NO: 6805816 - DNA, 112 bp, Homo sapiens
gtcatgaccctacaagaaaaagttgaattgattgatatgtactgtagattaaggtctgtacctgtagttgcaggccatttcagacattcaattcatcttgtaaacagatgat

SEQ ID NO: 6805817 - DNA, 57 bp, Homo sapiens
gacacagagtattttaagtactcatgaaaattgggagacttaagatgctttggggtt

SEQ ID NO: 6805818 - DNA, 61 bp, Homo sapiens
tggcagggagccaccggtcatgtcccacttaaaggacacacaaccgagaagcttcttgtca

SEQ ID NO: 6805819 - DNA, 57 bp, Homo sapiens
tgtgttggtaaactttctcagggctgttattcaaagggctctgaccatatcaagaca

SEQ ID NO: 6805820 - DNA, 130 bp, Homo sapiens
attattgcagccatataggtatggcctgtgttgatttatgtgacactccttaatgttctgaagaatcctgaatacatgaggctcatttatgtcatgtcacaggattgtaccatgatgaaatagaaatcat

SEQ ID NO: 6805821 - DNA, 84 bp, Homo sapiens
tacttgtcttgttagatgagttagtaaggctggtaaataatttataataaccaggtcttattaaaaatctaatccctttaggta

SEQ ID NO: 6805822 - DNA, 63 bp, Homo sapiens
gaggaatgaaatgggaaagagactagatgctgtgctcatcatccttcgtcccgttttcacctc

SEQ ID NO: 6805823 - DNA, 104 bp, Homo sapiens
taaaaacagatttagcaatgctccaagtagttagtccgcctgctctgtaatggtttatcatagtcataaagctgactgttggggtcagctgatctctgctttta

SEQ ID NO: 6805824 - DNA, 58 bp, Homo sapiens
tttgatgcatggatgtattttcgaggtaaactcctgaaaatgagattgctgcattgaa

SEQ ID NO: 6805825 - DNA, 59 bp, Homo sapiens
agttctattcggggggccacaccatctatttgaggaggaaaatctctctgaatgcaatt

SEQ ID NO: 6805826 - DNA, 86 bp, Homo sapiens
gtgtgggggctcagggccttgttggtgagcgtgcatggtgagtgtgcattcaggggttgacaggagccactggctgggcctcacac

SEQ ID NO: 6805827 - DNA, 100 bp, Homo sapiens
ccttagactacctcctgggccacttctgctctgtactgcactggccaggcctatctggcagggtctgaggcacagggacagggtggtgtggggtgtcagg

SEQ ID NO: 6805828 - DNA, 72 bp, Homo sapiens
gaggttggtgcaaaagtaattgcggttttgtcatttaatggtaaaaacctcaattacttttgcaccaacctc

SEQ ID NO: 6805829 - DNA, 81 bp, Homo sapiens
cagtgcgtcgaagtcacatggagtagggcagctgtgcactagaaaggcaaactgctgtgctccattgtcttcactgcactg

SEQ ID NO: 6805830 - DNA, 64 bp, Homo sapiens
tcatgttctgggagatctgactttacaaccaaaattctgtgttagaatttacccagcaacgtgg

SEQ ID NO: 6805831 - DNA, 76 bp, Homo sapiens
tcactgattacgtcactcttgcctctaagaaacagagtagttttatgtaattaggatagagttatgctattagtga

SEQ ID NO: 6805832 - DNA, 61 bp, Homo sapiens
ggcaggttatccaactacaatgtgctgttttcttaacacgtttgttgatggattactagct

SEQ ID NO: 6805833 - DNA, 130 bp, Homo sapiens
tccttctccctgtctctgtgaagtcctctgcacaatggccaccagcagctgacaaagatgaacaatgcctgcatgcttcatctagtgtgctcgtaacggatgcaagaggaatagaggaaggggctgagga

SEQ ID NO: 6805834 - DNA, 91 bp, Homo sapiens
gcatagctctgatccacaaattcaaatttcatcagtgtataatgtatatgagctggtagattttgtaatttagattttgaaagagctttgc

SEQ ID NO: 6805835 - DNA, 55 bp, Homo sapiens
agatgtcctgaaaagccctgagacccttcacgtgcagaggctgagagggcaatct

SEQ ID NO: 6805836 - DNA, 67 bp, Homo sapiens
caggagtgctcgggcctctgcctgcaccatccgtgggaccccagcaggaagaggctcgaagcccctg

SEQ ID NO: 6805837 - DNA, 93 bp, Homo sapiens
agttcatctgttggcagtaagaacaataatgtgtttctggttaatatcctgctagatcacagttctctattcgtaagtccaattcagagaatt

SEQ ID NO: 6805838 - DNA, 95 bp, Homo sapiens
taagaacaactctacaagaggtatatagaaacagctctgggcatggaggtcatgcaacattcctgcctttatagcctcttggaggttagttctta

SEQ ID NO: 6805839 - DNA, 82 bp, Homo sapiens
ctgaactgctggagagatgtagcaaagaaccacaaagcaaggggtcgtgagtgttggcattgttcatttcgacagtaatcag

SEQ ID NO: 6805840 - DNA, 78 bp, Homo sapiens
tctccttgttctcttctcattgaacatgttttgctcattagcatcatcattgcacaatgaggaaaggcagaatggaga

SEQ ID NO: 6805841 - DNA, 125 bp, Homo sapiens
tttgatgctgctggggcataattagcagagcctttctggagggcacttggtaatctgtaccaagagctttagaaatgctcattcatttttacctgttgattctacttccagaaattggtatcaga

SEQ ID NO: 6805842 - DNA, 90 bp, Homo sapiens
gaaatccaacctattcctccagtctttcagatgtccctgtatttcatgcaggtagtacatgcttgaggctactgatgaatagtttgcttc

SEQ ID NO: 6805843 - DNA, 90 bp, Homo sapiens
ccagaagcgaggaagaggcaaggcaggattcttctctagagcctccagagacagcatgagcctgctgatgccttgttttctgatttctgg

SEQ ID NO: 6805844 - DNA, 82 bp, Homo sapiens
cctgtcacagaccaggaaaaccacttttgatacctgaaagtcaaagttacttgtggttttctttggttgcactgattaaagg

SEQ ID NO: 6805845 - DNA, 101 bp, Homo sapiens
tgagatgggaggatcgtttgagcccaggaggtcgaagctgcagtgagccatggtcacgctactgcactccagcctgggcaacagagtgagaccctgtctca

SEQ ID NO: 6805846 - DNA, 59 bp, Homo sapiens
tgcacaggtatgccctttagaacataaaatcttctgaagatttttggtaatcatgtgta

SEQ ID NO: 6805847 - DNA, 72 bp, Homo sapiens
attaatttacacatccatgttttgactttggcgtccttaaggaaatagaggcaacatgtatgtgtatataat

SEQ ID NO: 6805848 - DNA, 76 bp, Homo sapiens
gggtcagactgcctgtgggtacaagtggaatcgccttacagtaatattctacagatactggcaggccctcaagccc

SEQ ID NO: 6805849 - DNA, 63 bp, Homo sapiens
cagatggcaacagctctgtgactgccgtatcacaccgcaacctcatatctgctttgctgtctg

SEQ ID NO: 6805850 - DNA, 57 bp, Homo sapiens
accagcagagctggaagtgtgctcttggctttcagagatatctccagtgatgctcgt

SEQ ID NO: 6805851 - DNA, 57 bp, Homo sapiens
atttgtactcaggaattctgctcacgcatcacatgcagtctttcttggtgtacaaat

SEQ ID NO: 6805852 - DNA, 79 bp, Homo sapiens
ccagggtaaggtcatatttctggcttgtctgagttcatgaattttcatagtatttccagaaatagtctagcctcctagg

SEQ ID NO: 6805853 - DNA, 62 bp, Homo sapiens
gggcgggaaggagacctctagttgactgcataacccaatcacatctaattccatttctgccc

SEQ ID NO: 6805854 - DNA, 76 bp, Homo sapiens
tccagctgaaggcaatttggaagaggcagatgcagaaaagctctctaccttccctctatttgcctaaaaagcagga

SEQ ID NO: 6805855 - DNA, 61 bp, Homo sapiens
cctaagaaggaggaaaagtgccaaattagtgtctctatgactggcatgctctctttttagg

SEQ ID NO: 6805856 - DNA, 80 bp, Homo sapiens
gtattgcattctaaaaataagctaggtgctagtcagaaaagtgaatcaggctcaagccctgcttatataaagatgctggc

SEQ ID NO: 6805857 - DNA, 74 bp, Homo sapiens
ctttacctaccactgtcttattgggtccaaggtggccagtggaatacaaggccactggacccagaaagggaaag

SEQ ID NO: 6805858 - DNA, 81 bp, Homo sapiens
tccttctctggcctggtctggcctctccactcctgagctgggctacctgagttgagggtccagcccccggtcatggcagga

SEQ ID NO: 6805859 - DNA, 62 bp, Homo sapiens
tgcgcgtcttcccaaggggtctggggaccaaattccagctcccgccatcgggaggcacggta

SEQ ID NO: 6805860 - DNA, 55 bp, Homo sapiens
attgcaagtcagagtgcaggtgtctaattccaggcatcaggctttctgttgcgat

SEQ ID NO: 6805861 - DNA, 63 bp, Homo sapiens
tttcaattcatgtcttcaaatgatcaatcagcttttgatcatttgcctcaagtgaaagtgaga

SEQ ID NO: 6805862 - DNA, 130 bp, Homo sapiens
acctttagttttcagacctaaaaatgcatttggctgtttttgattttttttggaaggggatgaggttccttgccaaattaacatacagaaattaaagcacatataaccatgatgttacaaaacttgaggt

SEQ ID NO: 6805863 - DNA, 64 bp, Homo sapiens
taagtcacttattccacaagatgctgctcagaaattgtttttgctcttggtgattaaggacttg

SEQ ID NO: 6805864 - DNA, 56 bp, Homo sapiens
ggctgagtggaggtagccctgtgctgagaataggaacattttactgctcacttgcc

SEQ ID NO: 6805865 - DNA, 116 bp, Homo sapiens
gtcagttttcttgcatggtgcagagctagcttagcctgtgaggtataaaatcttaatgccttttatccatgggcaagtttgaagttcccctaaaagcatagtgcaatactgctggc

SEQ ID NO: 6805866 - DNA, 63 bp, Homo sapiens
gcagaagtggattctacaattttcatagtcttaagagaaaaatgttgctgtttctatttctgc

SEQ ID NO: 6805867 - DNA, 123 bp, Homo sapiens
tcccggcacacggtgctgtgtctctccactcttgggctctgcagtgacttgaggggtcaagtctaggaccccaggggaggctgggctcatgaggggaccagagacctcagtgctgtgcaggga

SEQ ID NO: 6805868 - DNA, 69 bp, Homo sapiens
cggagcttcctggtcaggtacttttgtaagctgcagtacttacaagtagtaaattattaggtggtactg

SEQ ID NO: 6805869 - DNA, 87 bp, Homo sapiens
gtggagagatttagagtaagcagaaaaagtgggagttattaaagaactaaatgacttacaggaatttctcctttcaagactttccac

SEQ ID NO: 6805870 - DNA, 80 bp, Homo sapiens
atacaaattgtgtctcaggcagtggttctagagttttcagtgtctctcaagatgatggcaggatgagacaacaattggat

SEQ ID NO: 6805871 - DNA, 66 bp, Homo sapiens
ggaagcaaagactttctcccaaatcctcagcaggcatctgctggagcatgagagtctttagcttcc

SEQ ID NO: 6805872 - DNA, 69 bp, Homo sapiens
gcaacagcaatagtgtgatgaaattacttgccatttctatgggtgtcaatgtcacacgattgctagtgc

SEQ ID NO: 6805873 - DNA, 58 bp, Homo sapiens
tcatccaccataagcacctactgtgtgctccaggcccaggggacagtatggtggatga

SEQ ID NO: 6805874 - DNA, 65 bp, Homo sapiens
gagaatatcttggcagttcctgtgatggtccaaatgtgattgacagagactgccaagatattctc

SEQ ID NO: 6805875 - DNA, 61 bp, Homo sapiens
gtagaatcccagtggctatattggcaaaatgcagcatgcgtggccttcattggggtgttac

SEQ ID NO: 6805876 - DNA, 56 bp, Homo sapiens
taaggcatgagtttatttcatatactttccaagtggtgaattaattatatgcctta

SEQ ID NO: 6805877 - DNA, 57 bp, Homo sapiens
gagtcatgcactgtctttctcccattcccagtctgtggggtttgagagagctgactc

SEQ ID NO: 6805878 - DNA, 64 bp, Homo sapiens
gatgattgttgcattgctgctttatggaggagggaccagagaggcaggcagttcagctgttgtt

SEQ ID NO: 6805879 - DNA, 101 bp, Homo sapiens
ttagagtcagttcagtgctgttccatgtctttgtaggactgtcatcaggagactggaagttctgggaaaaacatggccaatggtttgaattcagattctga

SEQ ID NO: 6805880 - DNA, 93 bp, Homo sapiens
tatttgcatacatttgcattgcattaagtattctaagtaatctagagacgatttaaagtatacgggaggatgtgtgtaggttgtatgcaaata

SEQ ID NO: 6805881 - DNA, 69 bp, Homo sapiens
cgcggtctcagccgctcgcagcgcgccgcccccagacgcgcgtggctgctggcgagggctgagaccgcg

SEQ ID NO: 6805882 - DNA, 56 bp, Homo sapiens
cacatgggaagaataatgtttggcataattataaaaagcaattaccttcccatgtg

SEQ ID NO: 6805883 - DNA, 98 bp, Homo sapiens
ctctcaggccccttctttcctcaagtgtcaccagccccctcacgctgtcacgttgcaccagcttggcagggttgggcctggtggcatgtgtctgggag

SEQ ID NO: 6805884 - DNA, 80 bp, Homo sapiens
gccaagcaaagggaggtacttctggaataggattataaagtgcaaaggctgcgccctttctgatggcctcccagcctggc

SEQ ID NO: 6805885 - DNA, 60 bp, Homo sapiens
aggtcatttccttagaggcagaaatcacaacttatttttctttcattcagggcctgacct

SEQ ID NO: 6805886 - DNA, 57 bp, Homo sapiens
atgaactttgaaacttgggtgatggtagctggtcacatcagcttgggtgaagttcat

SEQ ID NO: 6805887 - DNA, 68 bp, Homo sapiens
gggtggccgagagggccccagctgatctgagctgctgagtctcgggcaggagggccctctcccttccc

SEQ ID NO: 6805888 - DNA, 90 bp, Homo sapiens
cttcaaaacctcactctgctgaaatcgccttgtgtttgagaagctctgtgggatgaggcaggaggtggtgtccagggtgaggaggtgaag

SEQ ID NO: 6805889 - DNA, 83 bp, Homo sapiens
ctggggatgccaacagagatatggatgtcagaaactttttttcaattttctgagtccagaatttacaaaaggcatttacttag

SEQ ID NO: 6805890 - DNA, 60 bp, Homo sapiens
gagttgcagggtagactgagtgagctgataaatgataagctctagcttagtgcctgcctc

SEQ ID NO: 6805891 - DNA, 76 bp, Homo sapiens
tgtctgatggatcagaatgttttggtgtgctcaccaggggctctggagaactagaatgttctgatggagtctgaca

SEQ ID NO: 6805892 - DNA, 76 bp, Homo sapiens
gggcagccagtccagaggagctgagagtagggcagggagttgactccctgagtcttggcttcttggctgtgttccc

SEQ ID NO: 6805893 - DNA, 114 bp, Homo sapiens
cagataattttttggcatggagagattgtaggatgtttagtggtatcgtagtcttttatccactagatgctagtagcacctgaccctctagctcatgacaatgaaaaatgtttg

SEQ ID NO: 6805894 - DNA, 64 bp, Homo sapiens
taatgggcttctaatttcctttgagatttcttcttggacccttgagttatttagaagtctgtta

SEQ ID NO: 6805895 - DNA, 62 bp, Homo sapiens
gttccgtgcagaggacaagcaatcacagctccatctgttaagcttctgtatctagcaggaac

SEQ ID NO: 6805896 - DNA, 62 bp, Homo sapiens
agggaaagaaacaggaagttaaggtaggaaagttatcttcatctgcttcttgattttgccct

SEQ ID NO: 6805897 - DNA, 61 bp, Homo sapiens
gatgccagctggccctttggtagccttgagggggactgaggtcactcacggccagtgtatc

SEQ ID NO: 6805898 - DNA, 94 bp, Homo sapiens
cccacctgctgctgccctgagtcatccctgcctgcctggggcacccaaagcccaggccccagggctggctttccaggtcactgctgccaggggg

SEQ ID NO: 6805899 - DNA, 74 bp, Homo sapiens
gtgtcgcttcagggggctagtgtgctggaggctacaggaagcaaagggcatggctggtgtcctgagggagacac

SEQ ID NO: 6805900 - DNA, 62 bp, Homo sapiens
ctgttaagcaacatgagtaagtacaaattccaaagaactaacttgctgatgctgtttcgcag

SEQ ID NO: 6805901 - DNA, 60 bp, Homo sapiens
cagcttcttcctgaactcttgcaacatcactgctgattctgcactttgggggacaggctg

SEQ ID NO: 6805902 - DNA, 58 bp, Homo sapiens
tgccattctctggctatgggcttctgcacagtgctgatcaccagtgccaagagtggca

SEQ ID NO: 6805903 - DNA, 71 bp, Homo sapiens
ctcagtcaggctgaaaggactccagttatgaactttacttccctcaaggtgatgtccacagcttgcaggag

SEQ ID NO: 6805904 - DNA, 107 bp, Homo sapiens
cccctcccccacgcccactgcctccccagaaccctccaggctgcagctcctgtgtgagatcgggccccagtcctgcggggactggatgggtgggggtggggaagggg

SEQ ID NO: 6805905 - DNA, 58 bp, Homo sapiens
tgctccgttcttctgcttcttgtagctatagagccccacagcaggcagaacgtgggca

SEQ ID NO: 6805906 - DNA, 75 bp, Homo sapiens
atccttgggctaagcattaccttatattaaagttttgaatacattaatccaatggcacaatgtatggccaaggat

SEQ ID NO: 6805907 - DNA, 68 bp, Homo sapiens
gtttgcttgcttcagccctcatcttccccttggaagataggcgagccgaggcagcatccacagcaggc

SEQ ID NO: 6805908 - DNA, 74 bp, Homo sapiens
gtactcattgcagttaatgagatgtggaaagctttgtaatttgatttgctgggccatatgctgtaaagggatac

SEQ ID NO: 6805909 - DNA, 60 bp, Homo sapiens
cagtttgacggtatctgactccaaaaggttgcttatggtcacagtgtattgatcaggctg

SEQ ID NO: 6805910 - DNA, 82 bp, Homo sapiens
aaatgtttataaattctgcttttgtttgggggaaaagtccagttgaaagataaaagaggaaatttgttcaatgaaagcattt

SEQ ID NO: 6805911 - DNA, 56 bp, Homo sapiens
tacagaggtgtgtgtaggacagtctttaatttctaggaacatacaggccggctgta

SEQ ID NO: 6805912 - DNA, 88 bp, Homo sapiens
gggtgttgtcagctgcctcccgccttggcttcagtagctcacccagcttacaggggagctgccctgggctggagatgggcacgcaccc

SEQ ID NO: 6805913 - DNA, 62 bp, Homo sapiens
ggtcaaggcccaggctgccctgggcacacgcccctgtgcaggggcttgtctgggcctgggcc

SEQ ID NO: 6805914 - DNA, 83 bp, Homo sapiens
caatttggctgccttagctttgcaaatctaaaaccaactggtcacagaatttaagattcagtaaggcaaacccagttaagttg

SEQ ID NO: 6805915 - DNA, 64 bp, Homo sapiens
tttttgcttgcttcttgggagtggtaggaggggcatcgtgcttttgttttgaggcaggggagag

SEQ ID NO: 6805916 - DNA, 130 bp, Homo sapiens
tttagaatcacgtggggagcatttgaaaactactgatgcctgggccctaacccagattaattaaattagaacttctgagggtaggtcccaggcatagctggtcttttaaagctccccagcagatagtaag

SEQ ID NO: 6805917 - DNA, 56 bp, Homo sapiens
ttctcaaattggttttctatgtcagtaaacaaaacatgaagatgacaatttgagag

SEQ ID NO: 6805918 - DNA, 59 bp, Homo sapiens
caggcacacagcacatggcctgggatataaagataagtaagggtcaatctgtgtccttg

SEQ ID NO: 6805919 - DNA, 57 bp, Homo sapiens
ctttttgtgtatgctacagttgcacaatagttgtatgactatagcatattcagaaag

SEQ ID NO: 6805920 - DNA, 56 bp, Homo sapiens
ggtggctcatgcctgtaatcccagcactttgggaggctgaggtagggcagatcacc

SEQ ID NO: 6805921 - DNA, 56 bp, Homo sapiens
gcaggggccaagggtccagacctccctctaggcaggtccatttctaagcaccctgc

SEQ ID NO: 6805922 - DNA, 103 bp, Homo sapiens
gatgtcaggtcttctgtgtgcgggagagctgcactgggggtggaatgatgtgcacattgcttctacttgcccaggcaggcccagcacaggggcttggaacgtc

SEQ ID NO: 6805923 - DNA, 129 bp, Homo sapiens
gcctttggagtccatcagactccaagcattaggaagggccaagctcttctcccattggtagttctcacacacctgtgggtccagagaggggctacccgccatgatcctgggagctgtggtctaagggat

SEQ ID NO: 6805924 - DNA, 97 bp, Homo sapiens
tctggcatgtcatagggctcagggactaggtgctgcctgaaactcttgtggccgagtcaggtcccccattagctctgagttctggaaattgaccaga

SEQ ID NO: 6805925 - DNA, 104 bp, Homo sapiens
ttttactgaacagctatgcagttagcagtagctccccaaattcacacaaattgcctttggggaaagttaatgtgactggatggttttctctacgtttattaaga

SEQ ID NO: 6805926 - DNA, 65 bp, Homo sapiens
tccttttctcctttagcagatggagtactctcccaatcagatcatgcaagaataataggaaggga

SEQ ID NO: 6805927 - DNA, 83 bp, Homo sapiens
ctggtacacacgcacctctggcctggcacgggtcacggctgccatgtaacactgggctgggctccaggccagggtgaacccag

SEQ ID NO: 6805928 - DNA, 82 bp, Homo sapiens
gggatcacaagaaatgaggtagtattagaaggagagatgacaggttccctggaagggtactgatttaacttgggtgaatgcc

SEQ ID NO: 6805929 - DNA, 91 bp, Homo sapiens
actttgtaatacattttgaaattaggaagtgcgatgtctccagctaacacagctggagttctttttcaagatagattggggtattcagggt

SEQ ID NO: 6805930 - DNA, 81 bp, Homo sapiens
gtgataggggagaaggagtcaagaggaacttgtcatattatctgaagctgactagtcatttgcattccgtctccaaatcac

SEQ ID NO: 6805931 - DNA, 62 bp, Homo sapiens
tctcttgtggttttgtagttgaatgaattaattcatgtataacctgcagaatcactaaaaga

SEQ ID NO: 6805932 - DNA, 75 bp, Homo sapiens
catgtgttttctgtctcacactgtgccaaatcctttctacctgtggattcaggaaagccagtgtgctgacacatg

SEQ ID NO: 6805933 - DNA, 67 bp, Homo sapiens
gaagtccatgcttagaaagtgattgatacatgttggttcaggtaacagaattttcaagcttggtttc

SEQ ID NO: 6805934 - DNA, 71 bp, Homo sapiens
cttctcaaagcacctgggttatatcttagagaaattactcatatttaaggaaccacagcatgttagagaag

SEQ ID NO: 6805935 - DNA, 67 bp, Homo sapiens
cagcaaaatctgtcgtgttgatagttctaaatcagccaggctaggaatgtttacacgacagaaactg

SEQ ID NO: 6805936 - DNA, 60 bp, Homo sapiens
gggcgggatggcaggaggaggagggaaactgaccctacgcgcctctgcgctgtcctgctc

SEQ ID NO: 6805937 - DNA, 61 bp, Homo sapiens
ccagctaggcttgcactcttgtacttctgccatttccacaagaaggacatgcttgggctgg

SEQ ID NO: 6805938 - DNA, 76 bp, Homo sapiens
ggtaagtgctaaagactaagagaacaggatctggaatcagactgcctgggtataaatcctgcctcttgtatttatc

SEQ ID NO: 6805939 - DNA, 65 bp, Homo sapiens
gatctggcattgttgcaagcctggaatctggggtccccagcaggagactagcaacataccagatc

SEQ ID NO: 6805940 - DNA, 81 bp, Homo sapiens
catactggtgggacaggagggacaccttcctgctgagggcccagatctcagcacctctcttctcccttcctccaccatatg

SEQ ID NO: 6805941 - DNA, 55 bp, Homo sapiens
agggaagcaatgattattattcatttgtactataaatatggattgttgctgccct

SEQ ID NO: 6805942 - DNA, 61 bp, Homo sapiens
cggttcctcctgttagtgccatattccagcaaatgcaataggcagcttagcaggggctctg

SEQ ID NO: 6805943 - DNA, 60 bp, Homo sapiens
ccctgtcaaattggcattggattattcttatggctagaagagtctgtcaatttacagtgg

SEQ ID NO: 6805944 - DNA, 130 bp, Homo sapiens
aaaggaaaaactaaaaatttttgaatggcaaggagagaattactgggtgtcatatggctggtgtcatatggctgggtgctatccagtactttaatttgggttctttaagttcatagtagtctgcgccttt

SEQ ID NO: 6805945 - DNA, 64 bp, Homo sapiens
ggtcagtggccaggaagcagtcactttttgaagcgataactttaaattctggccttattcgacc

SEQ ID NO: 6805946 - DNA, 90 bp, Homo sapiens
ggcaggcttctacaatgagcatgcaggcttgaattctcttttgtataacccaagactaaagtcctgtgtgcttacacttgtgaattctcc

SEQ ID NO: 6805947 - DNA, 65 bp, Homo sapiens
ccgtcatggcacttctactctgtgttttccaggaagatagcacagaggtggaagtgtatatgtgg

SEQ ID NO: 6805948 - DNA, 102 bp, Homo sapiens
agatctgtctgaatatgcagcccatttgctttcctgttaacccaagaaccaagagtctcatgtgtacagtaaatgtaaatggattatattttggcagtggct

SEQ ID NO: 6805949 - DNA, 84 bp, Homo sapiens
tgtcagagatcaccaaggcattttcacagcattgaagatgatttgtttttccctggtgtggattgctttttggagatgatgaca

SEQ ID NO: 6805950 - DNA, 75 bp, Homo sapiens
tccatagttcacagccatgcagtggttgatgcagaccaccagggcttctgactccattgtgtctgtgtctgtgga

SEQ ID NO: 6805951 - DNA, 75 bp, Homo sapiens
ttgcttttcctatttgattctgtaaaataacaggaaggtttctattgtgctaccagaattacaaaagtaaggcag

SEQ ID NO: 6805952 - DNA, 75 bp, Homo sapiens
aatttgagttggcttcccatagcttgctagtaaaataatttgaacaatacagcgacacagggcaagcctcaaatt

SEQ ID NO: 6805953 - DNA, 56 bp, Homo sapiens
gtgctgattgggagctgggattcatgtttaattggatatttgtgccccatcagcat

SEQ ID NO: 6805954 - DNA, 70 bp, Homo sapiens
gtctgttgcattaatctgctcaggctgccatgacaaaaatctcacagactgggtggcttaaacaagagac

SEQ ID NO: 6805955 - DNA, 60 bp, Homo sapiens
ggaaggggggttgggcttgcaggaagctgctttaacgctgagggtctcatgtccccttcc

SEQ ID NO: 6805956 - DNA, 73 bp, Homo sapiens
taccctagtagagtgtgagaggctgtctggggcagacattttgtccatttcaaagccctcttgctttagggta

SEQ ID NO: 6805957 - DNA, 61 bp, Homo sapiens
ccaaccgtgttcgggaacacttgtcagaactacaattgacaagtgtttccaatatggctgg

SEQ ID NO: 6805958 - DNA, 61 bp, Homo sapiens
gcccttggggtgtctgtaataaaggctggatgagagaatttaaactaacaattgcaagggc

SEQ ID NO: 6805959 - DNA, 71 bp, Homo sapiens
tatattatgaaagactggcctggcatttttgttgttgttttgtgctatttgtgtcatcttttaataatgtg

SEQ ID NO: 6805960 - DNA, 72 bp, Homo sapiens
gtaggggtttggaaatcaaggggacaaattgtggggtgttaaaaaccacaaacttatttccaaacctatggc

SEQ ID NO: 6805961 - DNA, 80 bp, Homo sapiens
tcctctagaagcccctggaaactaacaacagagcagagccatctgccatgtttcttatttgcagtttcagggctttggga

SEQ ID NO: 6805962 - DNA, 73 bp, Homo sapiens
gttttccaagctgaaatggttttctcatgaggttagagattcagaggaacactgtttcatgcctggccaagac

SEQ ID NO: 6805963 - DNA, 130 bp, Homo sapiens
aatctgagtttttgtggaacaggattggggaactgggaagacaagaaagatagggagtttctgtttctttgttttgttttcatgttatttccagtctagaaattactgcttatcataagaactaaaatat

SEQ ID NO: 6805964 - DNA, 55 bp, Homo sapiens
ataaagattgaaagcctaggttaccaagttggttttagctttctagaatctttgt

SEQ ID NO: 6805965 - DNA, 63 bp, Homo sapiens
aagtttggttttttccctgaatctctgcatatgagcatttttctggagaaaggaccatagctt

SEQ ID NO: 6805966 - DNA, 58 bp, Homo sapiens
gtcttggagactacctgaacttgtagttgatgtcacaaatgagggtggtcttggagac

SEQ ID NO: 6805967 - DNA, 83 bp, Homo sapiens
gcagtttgcaaagtggtataagtctgaagatcagatgaaatagcactggtttaaaagacattatgcttaaaggctttgcctgc

SEQ ID NO: 6805968 - DNA, 72 bp, Homo sapiens
gaggcccagatgctgccaggcccctcagtttaccttgcgaagttacttacggatcagcagcatttggtcttc

SEQ ID NO: 6805969 - DNA, 77 bp, Homo sapiens
tcttctagatgagggtaagttaattatcacattgttagactggcaatacgtggtaggtatttaccttatctgaaaga

SEQ ID NO: 6805970 - DNA, 76 bp, Homo sapiens
ccgcactaggcatccagactgggcttgggagccgcgcaccctccctacccagatccaggatggctagaattaacgg

SEQ ID NO: 6805971 - DNA, 67 bp, Homo sapiens
gttgaaagcatagaattagagttaggctgcttgggtttgaaacctagttatatgactaacttttagc

SEQ ID NO: 6805972 - DNA, 56 bp, Homo sapiens
ttccagaaagttctggaactggacttaccatgcaggctccggaacctcctctggga

SEQ ID NO: 6805973 - DNA, 62 bp, Homo sapiens
agtgccatttttgctgggaatttacctggatacagatgggcctcctggaagaatgtggcatt

SEQ ID NO: 6805974 - DNA, 89 bp, Homo sapiens
tggggaaggctgggctggaggtcgcgcgggtgctgcagtgttgtgagctcacgctgcagtgttcagtgatctctccactgctttctgca

SEQ ID NO: 6805975 - DNA, 79 bp, Homo sapiens
gagtgagatgacaacaagtaagtttatatatattttgtgaaagcatgataatgtggatttattgtgatatattttgttc

SEQ ID NO: 6805976 - DNA, 57 bp, Homo sapiens
ggcgctcccgaggcggcctcttgtgcgatccagggcgcacaaggctgggagagcgcc

SEQ ID NO: 6805977 - DNA, 86 bp, Homo sapiens
ggacagtttgcggtatggcagctgtactctctttctctttttcttggttgctgtgaaggaagtcagctgccatgctgtgagcttcc

SEQ ID NO: 6805978 - DNA, 105 bp, Homo sapiens
gatgtgtctgggatttctgttagctagatctctcataaattccaagtcttagtttgggatggaaagaggtagaggatctggacttttcagagacttagtagcatc

SEQ ID NO: 6805979 - DNA, 66 bp, Homo sapiens
ggcaaagccctgcctggttcaagctagagagaaacagaaagagctgaattaaggaagggctgtgct

SEQ ID NO: 6805980 - DNA, 58 bp, Homo sapiens
gcctgcaccccagtttccttattgtctttctcctggcactaaggcagcagtgacaggc

SEQ ID NO: 6805981 - DNA, 56 bp, Homo sapiens
ggagtcctgaacagctgttgtgtgcccagtgccaggcaaatgctgtggagggctcc

SEQ ID NO: 6805982 - DNA, 60 bp, Homo sapiens
ttccaccatgtaacaagctctgtactgaactataaaaatacgggaatgaacatggtggag

SEQ ID NO: 6805983 - DNA, 74 bp, Homo sapiens
taccaatcagagatctgtctactatttaagactcagctatcttgctttttataatagttggactctcataggta

SEQ ID NO: 6805984 - DNA, 67 bp, Homo sapiens
cggaggcctggctgtcagtccccaactagtagggcctgtggggtaccctgggaccgccaggccaccg

SEQ ID NO: 6805985 - DNA, 63 bp, Homo sapiens
agcaggggcagcagcactgactggtccgctaattcctctcgaccttggctgctgcttcctgct

SEQ ID NO: 6805986 - DNA, 107 bp, Homo sapiens
tcttacagatggcggcttctcagcttcttcatcttacaccacagcaggtgtgtgtctccatggtgaagcagggtacagcacaaagccgcctcattcatgtctgcaga

SEQ ID NO: 6805987 - DNA, 69 bp, Homo sapiens
tgttgcccaggctggagtgcagtggtgctatctcggctcactgcaacctccgcctcccgggttcaagca

SEQ ID NO: 6805988 - DNA, 73 bp, Homo sapiens
gctctggctctggctactccaccctgttggccaaggggctgaagggcagagcactggcctgcaagggctgagc

SEQ ID NO: 6805989 - DNA, 80 bp, Homo sapiens
tggaagaagagctaaatctgtcagaatttctaagttctggactcctagcttgagaacaatgacatagtctcatgcttcca

SEQ ID NO: 6805990 - DNA, 72 bp, Homo sapiens
gttcttaggacagttgccatacccctttgctagggaatcttcccagcagccctatgtaattggactatttac

SEQ ID NO: 6805991 - DNA, 88 bp, Homo sapiens
gggaggcccagtgatggatcctgctggggtgtaggtgggaggcccctcctgtccatgccccaccaggacgctgcagccagggcctccc

SEQ ID NO: 6805992 - DNA, 80 bp, Homo sapiens
atcatttctttggagatatgtgaaaaaaacagcatcaatagtcgactctcttctttatgcatatcttcaatggcagtgat

SEQ ID NO: 6805993 - DNA, 68 bp, Homo sapiens
gagaagccacaggacagatttcttcactatctccttggttttgaggtctacagcctgtgacacttgtc

SEQ ID NO: 6805994 - DNA, 79 bp, Homo sapiens
ggatgacagcagttctctgtgcctcgctgggacagagtgtattctgaggtccagcgtctgcatggagatctgcctatcc

SEQ ID NO: 6805995 - DNA, 72 bp, Homo sapiens
agtagtctgctcagaattgcgctggtggagccagtgcatggctccacctacgttgtctgactctagactact

SEQ ID NO: 6805996 - DNA, 56 bp, Homo sapiens
tccattgatagctttctggaagcagccaatgagttgtttcaagtttgctcaaagga

SEQ ID NO: 6805997 - DNA, 57 bp, Homo sapiens
gaggcagtatagtcattaagtagcttcagatagacctcagtgacaggtgctgacctc

SEQ ID NO: 6805998 - DNA, 83 bp, Homo sapiens
gcacaagtccctgagttctctgagccttagccaatgggccagccaaccggaggcctataggcaagtgctgctcttgggtgtgc

SEQ ID NO: 6805999 - DNA, 82 bp, Homo sapiens
ggccttggagcagtggacccaggagagagggttgcatgggagagatcccagaggcagaatgctctgggtccactctgtggtc

SEQ ID NO: 6806000 - DNA, 78 bp, Homo sapiens
ggagacttttaactggggagctcaattatgtcaggctaacaaaacctgttcatacaagcagcctctgtagaggtctcc

SEQ ID NO: 6806001 - DNA, 107 bp, Homo sapiens
gccggggaccgccaagccggagccagtggagtggggcgaagtcggcgagttggaaacttcctgcaatcgtccactcctagcctttggcgttcggctggtcctctggc

SEQ ID NO: 6806002 - DNA, 121 bp, Homo sapiens
gaatcctcttgagggttttttaaagataccagtgcttggctccttccccagatattctgatttaattggtctggaatgggtttcaggcactggtttcctttaaaagctccttaggggattt

SEQ ID NO: 6806003 - DNA, 59 bp, Homo sapiens
tcactaaggtgattacacattgactacctgcctggcagtcagtcatggtaaccatttga

SEQ ID NO: 6806004 - DNA, 58 bp, Homo sapiens
aatgttccctagctataagccagggcaagaaatggcgcctctggagttggggaacatt

SEQ ID NO: 6806005 - DNA, 79 bp, Homo sapiens
ggtaaggacagcagctacttttccctcaagcatgtgataggtgccagcagggaggggaaagtggccaagctcttttgcc

SEQ ID NO: 6806006 - DNA, 60 bp, Homo sapiens
aactgttttcctgggttccatgagctgttctagcaaatgttcaaacctgaggagggagtt

SEQ ID NO: 6806007 - DNA, 63 bp, Homo sapiens
ggccctattcgcatgtcccccactatatagcaagctctgtggtgggacatctgaggagaggct

SEQ ID NO: 6806008 - DNA, 79 bp, Homo sapiens
aggaaatagttgatcaattttctttggctttcataatcttaaatttagatcaagtcagagaaatgacaatatatagcct

SEQ ID NO: 6806009 - DNA, 66 bp, Homo sapiens
cgtctagagcagagtctatttccacactccttggatctggggttggtcacttgacttgctttagtg

SEQ ID NO: 6806010 - DNA, 103 bp, Homo sapiens
gcggacaagaggtggggggacaagaggtggaatcagtgagtggaatttgtgtttcatcaattctacattggttcacattttagcgtccctgaagtcgaaatgc

SEQ ID NO: 6806011 - DNA, 85 bp, Homo sapiens
gcaaaattcagaaggtggaacataccgaaaatacttaaggatatactctaaaggcaaatgtgtgtttgtgctttttagattatgc

SEQ ID NO: 6806012 - DNA, 61 bp, Homo sapiens
catccctgcctgactctgacgtacaaaggtgtaattagaacagtgtggagcaggcaggatg

SEQ ID NO: 6806013 - DNA, 86 bp, Homo sapiens
caggaacttgggacatggtgttggtggctggagtgtctgtgactattagcacatataattacctaccagctggccgagggttcctg

SEQ ID NO: 6806014 - DNA, 64 bp, Homo sapiens
caccagctgagccctcagggcagagaagggggcatctatgcagagatctgggcgtcggctggtg

SEQ ID NO: 6806015 - DNA, 63 bp, Homo sapiens
atttcccagggttacctcgtgggctctgcctttgccctcagaaacggctgaccctggagaagt

SEQ ID NO: 6806016 - DNA, 65 bp, Homo sapiens
tctgagcactttagaatttagagttgcaattgaatgccagctgtggagatggggtgcatatcaga

SEQ ID NO: 6806017 - DNA, 67 bp, Homo sapiens
aggaagtctctcaaaactggaagggaaaggtgttttctccacatcaatccagttttggagacattct

SEQ ID NO: 6806018 - DNA, 63 bp, Homo sapiens
ttttggccttcttccccctgcactggttacacaggatcaggctaaggaccaggagggccaaga

SEQ ID NO: 6806019 - DNA, 74 bp, Homo sapiens
gtgctaaatcatgtgcagagatcaggagctatgaggagggagctctgagaaggaagctctgtgtacagaagcac

SEQ ID NO: 6806020 - DNA, 67 bp, Homo sapiens
gtggaatgaaaagtacttcagaatgactgaagcttacaatggctaaaggagttctaggccattccac

SEQ ID NO: 6806021 - DNA, 72 bp, Homo sapiens
aaacttttcttggggacctgccatgttggaatctccataaataagtcagatagggcagcctaagaaaggttt

SEQ ID NO: 6806022 - DNA, 65 bp, Homo sapiens
acaggcggtggctcctggctgagtgcaacattctccgaggtgctcaccaagcgccgccgctgtgt

SEQ ID NO: 6806023 - DNA, 76 bp, Homo sapiens
ttgagcctaaattagtgaactaaaaataaatttggtttcttagccatagaatttggtttattaaattgtaggccag

SEQ ID NO: 6806024 - DNA, 72 bp, Homo sapiens
ccatctagtggccaccatgccagctctcgggggactcgagggccccgggagggtggccaagcgagagattgg

SEQ ID NO: 6806025 - DNA, 59 bp, Homo sapiens
atcatcctgttaatgtccactctagaaatttactagaagtaaacagaaagcaagatgat

SEQ ID NO: 6806026 - DNA, 72 bp, Homo sapiens
tctaagtcatggccagagaaggcagggtcacatggcatacagtggccgccagagcctgtggctatgaaggga

SEQ ID NO: 6806027 - DNA, 90 bp, Homo sapiens
tctggttctaacttacaccaggaagtattcaaagggtccagcagatgtcagtatgaattcttgagtctctcctggttaagtattaacaga

SEQ ID NO: 6806028 - DNA, 61 bp, Homo sapiens
tacatgtacattgggcattaatttgctaggccagcactgctcaacagatatgtaacatgtg

SEQ ID NO: 6806029 - DNA, 67 bp, Homo sapiens
atgagcatgagcaagccagttccagagttagcgctggtaactgctctgctgtgtttgttcagcacat

SEQ ID NO: 6806030 - DNA, 84 bp, Homo sapiens
tgagtttggaaaattatcatctgaagattgctgttcaacttttggagagtgatattcagatgctttgaagacttccaatattca

SEQ ID NO: 6806031 - DNA, 60 bp, Homo sapiens
tttcagaaacgattatgaacacgattttaagaagtataaatgtcattattgtttctggag

SEQ ID NO: 6806032 - DNA, 63 bp, Homo sapiens
ccagtcaagcacacctggaaagaataaaatgcctttctgggctttacactgtgcttagaatgg

SEQ ID NO: 6806033 - DNA, 119 bp, Homo sapiens
cagaacagagctagtgattcgaatgctcttcaggtttctgctctggaaaactgacacccgctgttcctgactctaggtaaagcttgaagagctgtgcctcagccccctgcttacatttg

SEQ ID NO: 6806034 - DNA, 70 bp, Homo sapiens
tcttttgtcatcccttgtacatgcactaccaatgtttaccatctgtctcaggggcttaagtgacagaagg

SEQ ID NO: 6806035 - DNA, 57 bp, Homo sapiens
cggcagtgaccacctcaccggacccagagagtgggaaccagtaactggtcattgctg

SEQ ID NO: 6806036 - DNA, 61 bp, Homo sapiens
acaaaccggaaagtgtgaggacacgatcatgtcgtcatgtccctgtcctccttttctttgt

SEQ ID NO: 6806037 - DNA, 66 bp, Homo sapiens
gctgtgcacagagcaggggtctgtgtcagtcctgggttcaagcccttgctctgccccctgaccagc

SEQ ID NO: 6806038 - DNA, 116 bp, Homo sapiens
tttttggtttagaggcattttttctttatgacatgggaggcagtcataatgacatctaagagcttggagtcactgggctgcttcctataacatcaaggtttctacaggtttaaaag

SEQ ID NO: 6806039 - DNA, 56 bp, Homo sapiens
ttcatttattgtagtcttagtattcccatgggcagaactgagaccaataagtagaa

SEQ ID NO: 6806040 - DNA, 84 bp, Homo sapiens
tcctggatatcaaacaaacatttcagtgctcttcaatcttagatgtttgtgatttgatgtagctatttccttaacaagtcagga

SEQ ID NO: 6806041 - DNA, 62 bp, Homo sapiens
attcctgcagggaatcgaggcagaagcatggatgctttcttcatagaccttgtcttgggagt

SEQ ID NO: 6806042 - DNA, 72 bp, Homo sapiens
gctgaggtggcacagggttgttggtcatatgatttgctatctgatggcctgatgcacctgtcccaccacagc

SEQ ID NO: 6806043 - DNA, 62 bp, Homo sapiens
gggcgcgccccgagaggcgcccggctaccaccagctagctcagtgcttgggggtgacgcgcc

SEQ ID NO: 6806044 - DNA, 57 bp, Homo sapiens
gttctgtatcaggaacacattttccctcagatcaggaagcagacctgagcacagaac

SEQ ID NO: 6806045 - DNA, 61 bp, Homo sapiens
tggaagccaggggctgcttaggagatagtataaatgtctggatggtaagtggcttggccca

SEQ ID NO: 6806046 - DNA, 68 bp, Homo sapiens
gttcagttgggctcattacagcctgctgggcccagaaagttccaggggttggatttggcctagagagc

SEQ ID NO: 6806047 - DNA, 55 bp, Homo sapiens
tcctggaggagatccaatctgagcttagcttagcctgtgtggacattttctagga

SEQ ID NO: 6806048 - DNA, 67 bp, Homo sapiens
tttgcacccactctgggcccttctccaccagcgttcactgggggcttgtggtaaagaatggggcaga

SEQ ID NO: 6806049 - DNA, 66 bp, Homo sapiens
aggcacgttttatgacagaagaagccttaagacaccgtggcttcaggagggtgtgggacagtgcct

SEQ ID NO: 6806050 - DNA, 60 bp, Homo sapiens
tccctctcgtggcagaagcctgacctgaacatctggccccatctgcccacaagaaaggga

SEQ ID NO: 6806051 - DNA, 76 bp, Homo sapiens
ggttcatgcgatggttggagggatggtaaaagcagttagctcttgtcagctgcttccctctgctagtgcttgagct

SEQ ID NO: 6806052 - DNA, 68 bp, Homo sapiens
gccatgcagcccttttttttactccggacagctcatgtactgaagcgtcatgaaagaaaggctgtggt

SEQ ID NO: 6806053 - DNA, 130 bp, Homo sapiens
gaaagggatgggatttctatgctcaggataatggagaataggggccactggtgaggcttcacttccttccatgcttggccagggccctgctcaatttctccacgccttgccaagtcagtcctaggacttc

SEQ ID NO: 6806054 - DNA, 70 bp, Homo sapiens
gaggtctgtaagtagtttatcacaataaataattctgacaaatgtcgctgtttctgtggtgtatagcctc

SEQ ID NO: 6806055 - DNA, 72 bp, Homo sapiens
tggagtgtgtataggacactctgagctgttcagtccaattagagggcaggagtgtcctactgatacaaccca

SEQ ID NO: 6806056 - DNA, 55 bp, Homo sapiens
ggaaggcagtgaaggggctgatcaagactggcaagactccaaaacactgtcttct

SEQ ID NO: 6806057 - DNA, 70 bp, Homo sapiens
ctcagtattcaaagaacctttagcattggttgtctaaacaacatcccatgctaaggtttttggaatggag

SEQ ID NO: 6806058 - DNA, 76 bp, Homo sapiens
ttggaagagaatggcaaagaaagtgagaaatctaaatcacattaaaattctactttctctgtcattaaaagcccag

SEQ ID NO: 6806059 - DNA, 66 bp, Homo sapiens
atgtgtacatacatattcatacaggtggtacaatctatgtctccacttgcatgtgtatgtatatat

SEQ ID NO: 6806060 - DNA, 65 bp, Homo sapiens
gctggcaacaagaaaggcagagggccttaaacgtggaaaggcctttaaagaaagtcttgtccagt

SEQ ID NO: 6806061 - DNA, 84 bp, Homo sapiens
gggaatgaagaagcctgtggtttttgtcctaatttgtttggtttggggctggaccctaagcttgggaaccacggtaatcagccc

SEQ ID NO: 6806062 - DNA, 97 bp, Homo sapiens
ggatgagtttgagcaacatacatggttctcagcccttgccctaccttttgtttctctggtgtattggtggaggcccatgtcatgtgtgaactgattc

SEQ ID NO: 6806063 - DNA, 115 bp, Homo sapiens
ggaaatattctctgtgctcagcaataagccaggttagacatctctcattagacccagggattaatttggatctcttgttgctaatccaaacccaatagaactaagactgtttacc

SEQ ID NO: 6806064 - DNA, 106 bp, Homo sapiens
gtaaaaactatctatatagtttctgaccacagacaacctgctacaaaccttagaaatgagttggcaggttggcctttggttcacaaactcgatgattcaattttat

SEQ ID NO: 6806065 - DNA, 65 bp, Homo sapiens
gaccctcgctgtcttttccacaccgcaaagcagccatggtttgggcctgggctggacagcctgtc

SEQ ID NO: 6806066 - DNA, 58 bp, Homo sapiens
aagtactggtcctagcagactgaggagagcaccaagcagtccgctgagatcggagctt

SEQ ID NO: 6806067 - DNA, 88 bp, Homo sapiens
gcagccctacttgctctaccttcagcccccaaagcctcattcctgttcaggggttaggagaggggctgggtggtgcagggcgggtggt

SEQ ID NO: 6806068 - DNA, 80 bp, Homo sapiens
ggaggttgcgtcaatttaccagacgaacatgcttgccaatatacctttggcaaatattatctttgctggtcggaatgtcc

SEQ ID NO: 6806069 - DNA, 79 bp, Homo sapiens
ccacttgccccaggagctgctcagagccagtcccaagggacccccagggagactgcagctgggagggctgggtgagtgg

SEQ ID NO: 6806070 - DNA, 129 bp, Homo sapiens
aaccttaatttatatagtctagctttgtattttcgaggcattatgccatcgttaaattgctaatacttaccacattgtttaaagcaggcatcattcctcatgtgcgacgcagagacccagagatgggtt

SEQ ID NO: 6806071 - DNA, 62 bp, Homo sapiens
cccattacttctgatgtattctactggtcaatgagccacagagtccgcatttgaggcgaggg

SEQ ID NO: 6806072 - DNA, 87 bp, Homo sapiens
gacaaatagtcctcatgatagactttttgagctgaataacttggctgaggttatgcttttagaatttagcatgaggagagttaattc

SEQ ID NO: 6806073 - DNA, 56 bp, Homo sapiens
ggtgcaggtggatggcgagccctgcaagcttgcagcctcacgcatccgcattgccc

SEQ ID NO: 6806074 - DNA, 55 bp, Homo sapiens
gtttccaggctatgatatagagaggggaaaacctctctgtctgagcctggcagac

SEQ ID NO: 6806075 - DNA, 61 bp, Homo sapiens
ggagtggctgtttctgcccccatttctcaaccatccctgtggagggtcctgagccacctcc

SEQ ID NO: 6806076 - DNA, 77 bp, Homo sapiens
tggaggaattatgctaaatgaatcaagtcagttacagaaagataatactggaggattccacttacatgaggtctcta

SEQ ID NO: 6806077 - DNA, 58 bp, Homo sapiens
atctgaagtggagaaaaatatattttaacacttaatgcatttttctgtccactcagat

SEQ ID NO: 6806078 - DNA, 56 bp, Homo sapiens
tacttagagcgataatttatacatatatatatgtatggcttacagtgctttaggta

SEQ ID NO: 6806079 - DNA, 76 bp, Homo sapiens
acagatgcattgcatcgagtagcttctctggtcactggtgaccacgcatcaacggagctggttatgtaacatctgt

SEQ ID NO: 6806080 - DNA, 78 bp, Homo sapiens
cacatgcacataaattctgatcaagttccttctgagcaatcagacaactcaggacacacagagaaacatgtgcatttg

SEQ ID NO: 6806081 - DNA, 58 bp, Homo sapiens
ctctttctttctctcatgtgcatacactcatgatatgcatgtaagggagacacctgag

SEQ ID NO: 6806082 - DNA, 55 bp, Homo sapiens
agagcccgtgtcctgcagaaagacagctgtttctctgtccacaagcacaggctct

SEQ ID NO: 6806083 - DNA, 79 bp, Homo sapiens
cgtggtggtgactgtactcggggaaatggggtgtttgcaatggacacatccagtcactgtgggtgcaatcaccaccatg

SEQ ID NO: 6806084 - DNA, 76 bp, Homo sapiens
gcctccagccagtgtgaccgaggaggacagtatgagatggcagggccctgttttcagctaagtcacacgctgaggt

SEQ ID NO: 6806085 - DNA, 71 bp, Homo sapiens
ctttggtaatgtaatttttcaatggatgatctttttcaaaggaagttcaatcagatgaaaaagcaccaaag

SEQ ID NO: 6806086 - DNA, 64 bp, Homo sapiens
ctgaatcatttatttttgacagcagagccataggccatgcttcacatgtgtagataaaattcag

SEQ ID NO: 6806087 - DNA, 63 bp, Homo sapiens
tcctgagaggtgtgaggtgcagggatacccacctctgccttgacggccgcgcaccccttagga

SEQ ID NO: 6806088 - DNA, 97 bp, Homo sapiens
acctaaactattcaggattttccattgatcttgtgatagttcaactttttctaggtgtgtatcttcacgagatggatggacatccaaataataaggt

SEQ ID NO: 6806089 - DNA, 83 bp, Homo sapiens
agggcaggatgcaacgccgggtaaggtcattctgcacatgttaattgttgatgtagaactctttcctgcgtgggtagggccct

SEQ ID NO: 6806090 - DNA, 129 bp, Homo sapiens
tgctgtggccaaagacttccctctgctcctgggatcctgtgttgctactggaggaaacaggggtaccaaccattccgaggtggccacactgggtcactgccttagcagagggcacactgagccacatca

SEQ ID NO: 6806091 - DNA, 74 bp, Homo sapiens
cacctgctccccaggggccttgtgaatttggagggttctctgctaagctcacatggctctaggaggtgctggtg

SEQ ID NO: 6806092 - DNA, 58 bp, Homo sapiens
gctcattaggggactggcaacaacaaaattaacattgagtgctaagtcctttagaggc

SEQ ID NO: 6806093 - DNA, 88 bp, Homo sapiens
ctgtccttttctctggactatctcttcaggattgtttgtatagtgaacagctttgggaggtagtgtccccctctagacaaaagcacag

SEQ ID NO: 6806094 - DNA, 57 bp, Homo sapiens
cctggaacatagtgttaggtcgaactgttattattctgctggtaactatgtttcagg

SEQ ID NO: 6806095 - DNA, 89 bp, Homo sapiens
tggagttacatagaatgagttttcagcctctcatcatgaaaattcacaaagggtgatggtgggtctgatctcatatatatgaatctcta

SEQ ID NO: 6806096 - DNA, 60 bp, Homo sapiens
tttagagagaattttcaaagtgctcctttgatgatggagtttgtgatagttcattttaag

SEQ ID NO: 6806097 - DNA, 61 bp, Homo sapiens
cggcttcttttaaggttgctgaagcaaacactttgcttaatatttgaacctagagaagttg

SEQ ID NO: 6806098 - DNA, 86 bp, Homo sapiens
gccccctctccttggtcctcctgatatctgtgatctcatgaatgggatgatgaagcagactcaggtggtgcaaggaaggcggtggc

SEQ ID NO: 6806099 - DNA, 57 bp, Homo sapiens
cctctctagctctctctgcttcagaattcccagggaagcaactctgactagatgagg

SEQ ID NO: 6806100 - DNA, 130 bp, Homo sapiens
atgaaatattattgtgatgttcaataatagtaccatgatgttcaacaagtacatatttaacgaataactgcacttgttgaatgccatgacagttgtgggctataattaaatgagtctcaaaatattttgt

SEQ ID NO: 6806101 - DNA, 56 bp, Homo sapiens
tccgccaggactgagggcccatgtgctctctggagcctcccctcactcctgccggg

SEQ ID NO: 6806102 - DNA, 77 bp, Homo sapiens
ttagagatgctaaaggggtaggcctcctgcaccttgtcagagccaaaggcagaaggcctacctcttgcaagagctaa

SEQ ID NO: 6806103 - DNA, 99 bp, Homo sapiens
ttgtgtacgtgtgtttgtgcatgtgcacacagtgtcatgcaaccttatgtgtgtgtgtgtttgtatgtgtgtgtacgtatgtatagagattggatacga

SEQ ID NO: 6806104 - DNA, 70 bp, Homo sapiens
tgcaggagctatttgtcacaactggtgttttctgaagacttggcatgtggcaagtaagtcctttcctgca

SEQ ID NO: 6806105 - DNA, 61 bp, Homo sapiens
ggtgttactgagaggcatatgttattataccccatactgcaaaactactcagtaatctgcc

SEQ ID NO: 6806106 - DNA, 90 bp, Homo sapiens
gtgaaattgtttagcagagttgcaacgccaagcttgagcttttggtgtagctgaagtgattgagtgttagcagtctgtaacccggttcac

SEQ ID NO: 6806107 - DNA, 90 bp, Homo sapiens
tgatgatgatgtctgaagctgttggctgtggaatttctttttaggagagtagctataatttaggccagaagcgaaagactattgcaatta

SEQ ID NO: 6806108 - DNA, 83 bp, Homo sapiens
tgcctttgaagcaggagctcttaaggatgtgattaacttttcttaacacagctttgtgttgctccacttgttataaagaggta

SEQ ID NO: 6806109 - DNA, 57 bp, Homo sapiens
ctgagatggtagatggatgttaaggtgaatgtttcttaatgtcttgagacatttcag

SEQ ID NO: 6806110 - DNA, 94 bp, Homo sapiens
agtcaagcacttaaagcatttcaggcactgttcccagttatccttatttttcagatgaggaaacagaggcttggaaaggctaagtgacttgact

SEQ ID NO: 6806111 - DNA, 58 bp, Homo sapiens
ggtgctggacacgtggcactccttgttctcctgcaggaagctcacgtagtcctgcact

SEQ ID NO: 6806112 - DNA, 65 bp, Homo sapiens
ttccagtctggctcagcacaaaggggctgatgatcacttctggtgtcaaggccaggcatctggaa

SEQ ID NO: 6806113 - DNA, 88 bp, Homo sapiens
ctgaaatcctggtctctgtgtctgagagagcccttggggttcacccggacccatcctgggctgttgtcgggcacaagcaggaaagtag

SEQ ID NO: 6806114 - DNA, 111 bp, Homo sapiens
ggtccctgaagtcttattgattggtgcaggtcactgatttttttaatgaactcctgttcaatacagaatatgagtggccatctattgattcaagttcaatttcaagggatc

SEQ ID NO: 6806115 - DNA, 63 bp, Homo sapiens
ggatttcttttggaagttaatcaaagaattcagctgccactttaaaagttccacaagagatct

SEQ ID NO: 6806116 - DNA, 74 bp, Homo sapiens
ttctctagaggagggatgtggttgttgggtgatgctctcagagcacaagaataaccatatttaatctcagtgga

SEQ ID NO: 6806117 - DNA, 66 bp, Homo sapiens
gacggggctgcttcacctttttacggaggcagaaagtaagtcttgtaaggtactgagctccccatc

SEQ ID NO: 6806118 - DNA, 60 bp, Homo sapiens
cacattgaacttgtctggtgggcagcctcaacaattccatccaccaacataggaaatgtg

SEQ ID NO: 6806119 - DNA, 83 bp, Homo sapiens
gggcctgcagctgctgccgggaggccttcatgctggctgcaaagcgcaggagccgcgtggcaccctcctggaggagctgcccc

SEQ ID NO: 6806120 - DNA, 77 bp, Homo sapiens
ttgcttgaacccgggaggtggaggttgcagtgagccaagattgcgccactgtactccagctctgggtgacagagcaa

SEQ ID NO: 6806121 - DNA, 76 bp, Homo sapiens
gggagccgctttttcacagcttttgggtcttttaaaatgagaggcacatggagggtggaagaatttggtggtcccc

SEQ ID NO: 6806122 - DNA, 68 bp, Homo sapiens
gtctttcataattcagcacattgaaccaattactttgccaattggctcacctctgaagtgtgaaagtc

SEQ ID NO: 6806123 - DNA, 73 bp, Homo sapiens
tttttactagacaatatttgaaagtagtggtgcacattgtaaacattgctctgtgtcaaataatgggtggaag

SEQ ID NO: 6806124 - DNA, 88 bp, Homo sapiens
ctttaagctgtggcttggcatggggcaagggtaggtctagcctatggcctgcaaatcctggagccatggtaacaaagctggtttgaag

SEQ ID NO: 6806125 - DNA, 58 bp, Homo sapiens
gacttaggccagttggtggccctggacacatttgctccttaaggctgaggcctgggtc

SEQ ID NO: 6806126 - DNA, 65 bp, Homo sapiens
ttatatgcaagcacatagaatacttgcacatttgagtaagtttttagatttgcgtttgcatgcaa

SEQ ID NO: 6806127 - DNA, 60 bp, Homo sapiens
gtctgaaatggaggtgggaacttttccaatatgaacgattattcccactgacattctgat

SEQ ID NO: 6806128 - DNA, 75 bp, Homo sapiens
ggatcttaggagtgttagctaggaatggaaatttgtgttcttttttgttatcatttcagccatttttaaatgtcc

SEQ ID NO: 6806129 - DNA, 71 bp, Homo sapiens
aagacaaggctggagtttaggcagaggtgttgtacaatcacatgatgtgctttgactcacggcttagtttt

SEQ ID NO: 6806130 - DNA, 63 bp, Homo sapiens
atgagttcaggcctgccttgcttacgagactattatgtcctcaaggcaggaagcctgtcttat

SEQ ID NO: 6806131 - DNA, 64 bp, Homo sapiens
ggtcagctttctatgttgctaaacaacaggggattctgggttcagtaacgttgaaaggcaggcc

SEQ ID NO: 6806132 - DNA, 61 bp, Homo sapiens
tgcgtctgtcttcttccccttcctggcaataatagggtgtgtacaagacaagacaaatgca

SEQ ID NO: 6806133 - DNA, 67 bp, Homo sapiens
ggctgaccctgccatgagtgacagggactttcttctccttgactgccttcaggctgggacatcagtc

SEQ ID NO: 6806134 - DNA, 128 bp, Homo sapiens
ctgctggggcacactaaggcctttcttcctctttccctggatgtcttggcttgctctctgtgactcagggaaggacagagaggctaggccaggggacagaggctgcaggggcctgtccagataggcag

SEQ ID NO: 6806135 - DNA, 78 bp, Homo sapiens
gaggctctatttggggtagaagatggataaaacctgcaagtaagcagaaatcctttgaactactccatccagagcctc

SEQ ID NO: 6806136 - DNA, 64 bp, Homo sapiens
ccttatgggaacattttttaaggcagaaaaagaaagtttttttgtcctgatgttctttaatagg

SEQ ID NO: 6806137 - DNA, 72 bp, Homo sapiens
tctgctgacctttctctgacactacttactatattttagtgtcggaatcaattgaacggtgggttctaaaga

SEQ ID NO: 6806138 - DNA, 69 bp, Homo sapiens
tgccactgcttggccctgagggcagcccaggaccgccaggaatctgccaacccagggaaccagcaggca

SEQ ID NO: 6806139 - DNA, 64 bp, Homo sapiens
tcttccaggagtctggtattagtcctgccatctgggtgttaggggaaagcagaatcctggagga

SEQ ID NO: 6806140 - DNA, 87 bp, Homo sapiens
gaaactacaatacccatgaggccactgggcaaagataggcctggttaaggactcagccgcccgttgccttctgggagttgtagtttt

SEQ ID NO: 6806141 - DNA, 65 bp, Homo sapiens
cacatctttttatctgtttggaacattgggggcttctttggtgatggtgggggaggagagatgtg

SEQ ID NO: 6806142 - DNA, 68 bp, Homo sapiens
gaattcatttgccatcagtgtaatgtgtactattttccaaaccattttgcatttgaggcaatgatctc

SEQ ID NO: 6806143 - DNA, 89 bp, Homo sapiens
ctacgaccttttccaactatggacagcaattgcctagcaagatgcaggtcaatgctaaagtcagtagttaggaagagggtactctgtag

SEQ ID NO: 6806144 - DNA, 55 bp, Homo sapiens
ttcttattactaccaagggaagcagagcagcgctgcttcactaggagaaagagaa

SEQ ID NO: 6806145 - DNA, 63 bp, Homo sapiens
gaggccaagttggagaccaggtttagaagagaaaaactttcacttgactcctaatttgtactc

SEQ ID NO: 6806146 - DNA, 68 bp, Homo sapiens
tgttgaacagtcaccctgggagtttggtgagcagctctcgctccatgctttcagggtcactgtcaaca

SEQ ID NO: 6806147 - DNA, 100 bp, Homo sapiens
gaggcaggagaatcgcttgaacccgggaggccggaggctgcagtgagccaagatcgcgccactgcactccagcctgggcgacagagcgagactccgtctc

SEQ ID NO: 6806148 - DNA, 72 bp, Homo sapiens
tgacttctaatgattttctgataaagaactggtttttcacgttgtggaaatttagtgatcagaaagaggtca

SEQ ID NO: 6806149 - DNA, 55 bp, Homo sapiens
agagtacattcagagctacctacgaaataggtgtgaaatatgcttgaagtgcttt

SEQ ID NO: 6806150 - DNA, 71 bp, Homo sapiens
ctcctcccaaactatgggtgcatagggtgggtgttcagtttaaggaggctcactaggcatcctgggaggag

SEQ ID NO: 6806151 - DNA, 57 bp, Homo sapiens
ggaactcagacttgctttttatggaattaatcttaaattcctcagagttttggttcc

SEQ ID NO: 6806152 - DNA, 57 bp, Homo sapiens
ggaacagccagctcagtttcagcagtggaaagcaggcaatggagtttatgttgttct

SEQ ID NO: 6806153 - DNA, 76 bp, Homo sapiens
ttcagtctaagttagggcccgaggcaggatgtgggatctgctgcctgggtctggctcagtcctagctgtagaggaa

SEQ ID NO: 6806154 - DNA, 67 bp, Homo sapiens
agcctagaccacctccacattttgcagggagcaaatctccttgcaagggcagggaggtggccaggct

SEQ ID NO: 6806155 - DNA, 69 bp, Homo sapiens
aggctcagtctgttcatgcactggtgtgtattaattcagtccattcatagtcatgagctgactgtgcct

SEQ ID NO: 6806156 - DNA, 71 bp, Homo sapiens
gcagatttttagagtgttaccagtatacccccttcataccatggcggtccagctgttgatattctaggtgc

SEQ ID NO: 6806157 - DNA, 61 bp, Homo sapiens
ctctctgctttactcatagggtttcagttgtttgacctatttctcagaatagagctgagag

SEQ ID NO: 6806158 - DNA, 82 bp, Homo sapiens
caggtggtcaattggagtcacaggagaagaatgggcacgaggtacaggcctgttttcctcaatggcttgctgggctcagctg

SEQ ID NO: 6806159 - DNA, 123 bp, Homo sapiens
tataacgaggtgaccagttgtcccactttgcctgggactgcagatccccagagcatgaaacttaccattttgaaatcaggaaagttccaggcagttgaagatgggttggtcaccttcgctgta

SEQ ID NO: 6806160 - DNA, 78 bp, Homo sapiens
ggaagtgacgtttgagctgaaatgttaataattacaataaaaataatgattaaaatttaacttagttaacgtgcttcc

SEQ ID NO: 6806161 - DNA, 55 bp, Homo sapiens
tctccgaagtcaacattctgaagatgacttcggagaatgaagatgacttcggaga

SEQ ID NO: 6806162 - DNA, 81 bp, Homo sapiens
tatgaatactttttggagaatgtctctgttgctggtctcaggcccagggcagttttacttctctcttaggattggttcgta

SEQ ID NO: 6806163 - DNA, 100 bp, Homo sapiens
ggtcttcctgaaaccagcgggcttcctgaggaatgtgaagagaaccaggtcacctgggatttcttccttcctcagaaggtctccccaagtcaacatcgcc

SEQ ID NO: 6806164 - DNA, 69 bp, Homo sapiens
atgttaaccttcctgaggaaagtctaagatatggtcatcacacttatttggatcttatgaaggtggcat

SEQ ID NO: 6806165 - DNA, 79 bp, Homo sapiens
ggaacccactcactgtccaacaggctttactacctgagaacatgaagcaggagagaagggcaggggcgaggtgggggcc

SEQ ID NO: 6806166 - DNA, 58 bp, Homo sapiens
tcgattccatctgtgttgtttattttgagctggatttactgcacactatgtgaattga

SEQ ID NO: 6806167 - DNA, 59 bp, Homo sapiens
aagcaaagctaccaattattgagtgctatgtgccaagcatgatgtgaaatgctttgctt

SEQ ID NO: 6806168 - DNA, 55 bp, Homo sapiens
gtctcagcgaaaggagtgtggctttcaataaagagatcacataatttcctgtgac

SEQ ID NO: 6806169 - DNA, 62 bp, Homo sapiens
gcagccctgcagctccacaccgcctcttgctagttgcctgctggagtggctgcaggctctgc

SEQ ID NO: 6806170 - DNA, 72 bp, Homo sapiens
ggacattatactaagtgaagtaagccaggcacaagaagacaaatattctgtgattccacttatatgaggtcc

SEQ ID NO: 6806171 - DNA, 75 bp, Homo sapiens
taggagtgagttttggataaaaatgtttaagtgtcctggtgacctttcagtttttgtttccaaagccatagacta

SEQ ID NO: 6806172 - DNA, 55 bp, Homo sapiens
gaagtgacagaagaatcaagagcaaaccagagctcttgagtctaatctgaacttt

SEQ ID NO: 6806173 - DNA, 118 bp, Homo sapiens
aggcaggctcttaccaggactcatgagaaagccaagccaagcaccactggcactcgagggtccttccttgtccctttgggtgattggcacggttgtccactgagcccagagcctcact

SEQ ID NO: 6806174 - DNA, 60 bp, Homo sapiens
ctcacttatgtgccttgagcaggaagtgccacagtggccttattatggcatgtaagtggg

SEQ ID NO: 6806175 - DNA, 57 bp, Homo sapiens
agagtttatggattagagtttgattcttttatgaggctcagcatctgattcatatct

SEQ ID NO: 6806176 - DNA, 100 bp, Homo sapiens
tttactcccaatagctttatcactccttcaactttttacttgccctggtttacccagtcaagatagaaattttgaagcttagggttgttccaattgtaaa

SEQ ID NO: 6806177 - DNA, 99 bp, Homo sapiens
gaagattcaaggtgtaataaatgaacaaagcaggttgccagacaacattatatttgtaacagatgctatgtattatgtatgccacacttgtgtatcttc

SEQ ID NO: 6806178 - DNA, 70 bp, Homo sapiens
tctgggaaagcagggagtatggtgggactttgaatccaaagtccctgtactttccactgccctacctaga

SEQ ID NO: 6806179 - DNA, 59 bp, Homo sapiens
tttgacaaccaggcaggtaagatcggaggaggtaaagaatctgcttaggtttgttcaga

SEQ ID NO: 6806180 - DNA, 56 bp, Homo sapiens
gcccttgcccatggctcttcctccattctaccccagaaagcagccctggcaagagc

SEQ ID NO: 6806181 - DNA, 61 bp, Homo sapiens
atgctccaccttttgcaggaactgtcatcaagttaaaagctgctgtgaaatgtggcagtat

SEQ ID NO: 6806182 - DNA, 68 bp, Homo sapiens
gtgtcattaaccaccatgcaaattaattaatattacatattatggactttgtaggtgacttgatgaat

SEQ ID NO: 6806183 - DNA, 58 bp, Homo sapiens
ctgtatgtgttttgtatgagtgtgatttacatgtgtgctcatacacatgagcatgcag

SEQ ID NO: 6806184 - DNA, 55 bp, Homo sapiens
gaggaaggcagccacgtcaggctggctggccagctccttgcaggttgccttggtc

SEQ ID NO: 6806185 - DNA, 85 bp, Homo sapiens
ttcacaaaactcaggtcagccttggttcatggtagaggttgggtgttgatttctaattgtggccgaggtagatttggttagtgga

SEQ ID NO: 6806186 - DNA, 72 bp, Homo sapiens
agcagaaagcccggtcccaggtgccccggtgacgcccctgcttgtgtctggctccaggaccgggcacatgct

SEQ ID NO: 6806187 - DNA, 64 bp, Homo sapiens
acctgtcatgtagagtttcagctttcttaccctgggtacagagtctcaaacctacaaagtgggt

SEQ ID NO: 6806188 - DNA, 69 bp, Homo sapiens
ggggagcagcttgcatgctcagggatgccaagaactgttggaaactcagacatcatccgagcactcccc

SEQ ID NO: 6806189 - DNA, 99 bp, Homo sapiens
tctgaaccctggagaggctgacaccgaggtgtcttgaaggaagcaggcacactctcatgcttccccacctagggtttcgcctttcttctaatatttagg

SEQ ID NO: 6806190 - DNA, 57 bp, Homo sapiens
gtggtgaggccggaagaaagggggcaatttcttttgttcccttcaggccctcaacat

SEQ ID NO: 6806191 - DNA, 55 bp, Homo sapiens
tcaggtttaagctactggaatcattcctacatgattactggcagcagaaacctga

SEQ ID NO: 6806192 - DNA, 99 bp, Homo sapiens
gaggcagaggaatcacttgaacctgggaggcgggggttgcagtgagccgagatcgcgccattgcactccggcctgggtgacagagtgagactctgtctc

SEQ ID NO: 6806193 - DNA, 65 bp, Homo sapiens
gcacagaaacctgtctggagtgggaggtaaagtctgctgttccaaagaagaggttttaaaggtgt

SEQ ID NO: 6806194 - DNA, 86 bp, Homo sapiens
gggcgccgtgcgtcctgggcgcgtcccctgaggcggaggacggtcgtccggcgggaggacgcgtccagggggagcgccgcaggtcc

SEQ ID NO: 6806195 - DNA, 76 bp, Homo sapiens
agtggtcacagttcataacggacatgtagtgtaaaacatgaacagggtcattttatgatctgtgaacttcaccact

SEQ ID NO: 6806196 - DNA, 84 bp, Homo sapiens
ctgccaagttttctcagcaagacccccaccgtgtacagaataactgtcagataaatgggtggtttctgctggagtccttggcgg

SEQ ID NO: 6806197 - DNA, 78 bp, Homo sapiens
ttggtcaaatgtcatctggtgtttctgtaagagtgtttttgggtaagacttacatttaaatcagtggcctttgagtaa

SEQ ID NO: 6806198 - DNA, 97 bp, Homo sapiens
tatttaatgtatgtgtaaagcatggtgattgtttcttctttggacagtgatgttctaaagacaaatgacattacggctttgcaagctgcagaaagta

SEQ ID NO: 6806199 - DNA, 55 bp, Homo sapiens
agcttgcagaaaatatgatgtgtctaatctgaagaataacaaggctctgcaagct

SEQ ID NO: 6806200 - DNA, 84 bp, Homo sapiens
gctgtgctacagcccccgtttttaggaaattggtgcttggcaaacgatgaaaagtttcacagaatatgaaggttatggcacagt

SEQ ID NO: 6806201 - DNA, 103 bp, Homo sapiens
acaagtcttaaatcaggttgtggtttgatttgatccggagagatgagaaattcaactcttgtgaaagggttactgtcaggccacaaaaagctgtaggatttgt

SEQ ID NO: 6806202 - DNA, 78 bp, Homo sapiens
ctgcagcatatcactgatgactatatatgactagtgctgacatcagtgagcgtttatttagcatctactatgtgtcag

SEQ ID NO: 6806203 - DNA, 60 bp, Homo sapiens
ccaagttcctgctggatgcctccacctagtcctcccacaggcgttcagactcaactgtgg

SEQ ID NO: 6806204 - DNA, 74 bp, Homo sapiens
tacatgtctggggctggctggggttggctgacctagtctggccttgcctcaatagctccacctcaaaacgtgtg

SEQ ID NO: 6806205 - DNA, 97 bp, Homo sapiens
ttttaagtatttggttggttcaaaagtaattgtggtttttgctattgaatgtaatggcaaaagctgcaattccttttgcaccaacctattagtaaaa

SEQ ID NO: 6806206 - DNA, 82 bp, Homo sapiens
gattaccgtaatggtcagcaaagtcagtgcagtaatcagaatagtctgagctgcagagatctttgatattggctaggtgatc

SEQ ID NO: 6806207 - DNA, 71 bp, Homo sapiens
gcttttgaaaatgtgattttcccagtagaattcctaattttaaaaaatggaaaagtacaatatccaagagc

SEQ ID NO: 6806208 - DNA, 66 bp, Homo sapiens
gagggtatcctatagtccttagaggggccttagagactctttcttattggataaaaggaaaccttt

SEQ ID NO: 6806209 - DNA, 60 bp, Homo sapiens
gacagcagcataatacatgaactcatacattttcatatgttcagtatgcgtcatgctgtt

SEQ ID NO: 6806210 - DNA, 56 bp, Homo sapiens
gaactacaggtgcagcaagtgagtaaacagtaccagctgctccttggctgtggttc

SEQ ID NO: 6806211 - DNA, 73 bp, Homo sapiens
cccatatctcataatgtgactgtatttgaagatatgatctttaaggaggtaattataatgagttacagtgagg

SEQ ID NO: 6806212 - DNA, 56 bp, Homo sapiens
gcagttgcaggatttgtgttgtttaaagcacacacacaaacacagcttgtatctgc

SEQ ID NO: 6806213 - DNA, 80 bp, Homo sapiens
gccaggaaggagttctttgaggaggtatggcttaagagctgtaagatgagctgtgcagagcggggaagagcacccctggc

SEQ ID NO: 6806214 - DNA, 55 bp, Homo sapiens
agagatgccacctttttgctgtgtcctcacatggtggaaggggcaaggcagctct

SEQ ID NO: 6806215 - DNA, 55 bp, Homo sapiens
aggtagggggtttgggaactgcagtcccattctggttttaggaactcccttgcct

SEQ ID NO: 6806216 - DNA, 97 bp, Homo sapiens
cttcagacctggccttggggcttgggagggctcatggctcactcgtggtccaagaccgccatgggcgcacaggcctggagcgcagtaggctatgaag

SEQ ID NO: 6806217 - DNA, 73 bp, Homo sapiens
gtaataaatgctgttactgttggcccagggtgaggtagggactcacctgtgcccaggtaatatgatccattgc

SEQ ID NO: 6806218 - DNA, 67 bp, Homo sapiens
ggcgggtgggtggtccgcagacatatggcacgaattcagcacatgttctgaggtccaccgactttcc

SEQ ID NO: 6806219 - DNA, 57 bp, Homo sapiens
gccttcattgccttccctttcaaagcatggcttgcctttggactgaggtagtcaggc

SEQ ID NO: 6806220 - DNA, 106 bp, Homo sapiens
tcctctattcacatccatcagggagaggagtaggctgatggtgccagctaaggacctcggcactcctagacctattcctgaaccattaatggctctgaatttggga

SEQ ID NO: 6806221 - DNA, 59 bp, Homo sapiens
tataggttgaacaatttgtagattatggattttctataatttatagtgatcaatttata

SEQ ID NO: 6806222 - DNA, 77 bp, Homo sapiens
aagcagatttttggttgatattttgtgaatcattttgctttcagtaatatgtttataagatatcttcctttctggtt

SEQ ID NO: 6806223 - DNA, 121 bp, Homo sapiens
cctgttactagagattagtttgcattttctagattttatgtaagtggaatgatgccatgtgcatttttttgtgtctggcatttttcactctgcatggttatcttggtgtttagccacgtgg

SEQ ID NO: 6806224 - DNA, 63 bp, Homo sapiens
ggtgcatccctggtgatccaaggtaagtgttttactgcttcatatagggatgtaataattacc

SEQ ID NO: 6806225 - DNA, 100 bp, Homo sapiens
gaaactgcagtgggctcaggctgtggctttgaccgcatgtcataaccatttaaactgtggttagttgttcaaagctcaaagcttctccaagctgggtttc

SEQ ID NO: 6806226 - DNA, 66 bp, Homo sapiens
agcctttgcaaagtgtacctagagcatttactaatataggccaaatgctagaacattttaaaggtt

SEQ ID NO: 6806227 - DNA, 65 bp, Homo sapiens
tggtcaggtacctctggctgtccctctcaccttcttgtgggttaccaggcagaggatgctgacca

SEQ ID NO: 6806228 - DNA, 67 bp, Homo sapiens
gcagaaagcacttgaaatctggcagtgttattgccaagaaacattgtggtctctaagtgcttggtgc

SEQ ID NO: 6806229 - DNA, 81 bp, Homo sapiens
ggggacaggacagtttgctttgccctgactggttctctttctagttagcaaaacctaactttttgtttataatgatacccc

SEQ ID NO: 6806230 - DNA, 72 bp, Homo sapiens
aagatttttcttcagcagcccagaaatcttttctctctgacaggttggaagcactgaagagacaaccatctt

SEQ ID NO: 6806231 - DNA, 88 bp, Homo sapiens
tgttttctgagatgtaaaatcagttgtatgtgtgcatgtaaatatatatgtactatgcagtcaactgtttttacattatcttttagca

SEQ ID NO: 6806232 - DNA, 70 bp, Homo sapiens
gtgttttgcaagaggaattctagaagcaatctctttaatgaatgctatttggcacttttgacctgggcac

SEQ ID NO: 6806233 - DNA, 83 bp, Homo sapiens
tgcagagtcaaggagacaatttctaagatgcttccttggggaaaactgaagcaaaaaacagaagttgtggatcctgagctgca

SEQ ID NO: 6806234 - DNA, 56 bp, Homo sapiens
caggagccacattccaccttgaccttatattgtcaagggtgagaccatggcccctg

SEQ ID NO: 6806235 - DNA, 58 bp, Homo sapiens
ggccagtgggagcttcatcaagcagttcctgggaacttcttgcacagtcccactagcc

SEQ ID NO: 6806236 - DNA, 74 bp, Homo sapiens
gtgccccaagagggttgcccgcttcagagggaggacacgaagcccccagctccctcgagcagcgacccctccac

SEQ ID NO: 6806237 - DNA, 90 bp, Homo sapiens
ccgggtcgggagcccctcgtggccaggcgtccgcgcggctcaagaccgaggtccgccacgctgggccgctcgtgggcggctctcacccgg

SEQ ID NO: 6806238 - DNA, 59 bp, Homo sapiens
catgggtagtaacagagggatatgctgtttgttcagcatatcagatgactttgctggtg

SEQ ID NO: 6806239 - DNA, 79 bp, Homo sapiens
gcagaaacagagtcaaataattttctcaatagtgactactttaatggtcacagaggaacaaagttatttggaagtctgc

SEQ ID NO: 6806240 - DNA, 65 bp, Homo sapiens
tcgtgaaaggcatgtgcaactacaaatacttcatagctgtttgggttgctcattctacatcacga

SEQ ID NO: 6806241 - DNA, 66 bp, Homo sapiens
tgcaccattttgtcaggctactggaacccatttttctccaactcaagcagaggcagaatgtatgca

SEQ ID NO: 6806242 - DNA, 102 bp, Homo sapiens
gcatttcttagagtacctcgagtaaactttcgaaacacgtatttcaaaacccttatgtgtttaacatctggtttatacaatccaggaactcctaaaaaatgt

SEQ ID NO: 6806243 - DNA, 74 bp, Homo sapiens
tgtattttcatgctgtgggaattctcggaagttggctgaattgagacttaggaatatccacagcaggttttaca

SEQ ID NO: 6806244 - DNA, 57 bp, Homo sapiens
agtctccagaaatatagcagtgaatgaagcagtcaaaaatccttgctgtctggagct

SEQ ID NO: 6806245 - DNA, 56 bp, Homo sapiens
cccaggctggagtgcagtggtgcgatctccgctcactgcaagctctgccttccggg

SEQ ID NO: 6806246 - DNA, 59 bp, Homo sapiens
tggctttaggagctatatacctcaaaactttggctttaggaggtatatacctaaaacca

SEQ ID NO: 6806247 - DNA, 69 bp, Homo sapiens
tcatatgctatgctgaagaaatagttcatacatacaaaaaacaactagcagtcagcggttggcaattga

SEQ ID NO: 6806248 - DNA, 129 bp, Homo sapiens
ctatcttctacacctgctccttcattttcctttctctggagggctgagagagatttactggtcaaaaggaagagctcctcacttcgggttcaggaatcttactgaaggaaatgaaatggtcacagaaag

SEQ ID NO: 6806249 - DNA, 113 bp, Homo sapiens
ggcccaatccacttcttggtcacactgatagtggttaggaatacaggccctggggtcaaactggttgggtctgaattccagcccctctgtgtaccagcttagtgaccatggcc

SEQ ID NO: 6806250 - DNA, 100 bp, Homo sapiens
tgagccctagatgcacaaaaatacatgtgtgtgtgtgtgtgatatgtcattttttatctcactgcaaatattatgtatataaatgttttctttttactca

SEQ ID NO: 6806251 - DNA, 57 bp, Homo sapiens
agaggccccagaagaaaccaaacatgctgacacttcagtcttggccttctagcctct

SEQ ID NO: 6806252 - DNA, 69 bp, Homo sapiens
gtaatttgagcaatctaatagtttagcgtgtttctgtaccaggctgtctgttgtattattcaatattat

SEQ ID NO: 6806253 - DNA, 88 bp, Homo sapiens
ttctaaatgataatctgatttacatatacaaaagatttgcctatgctatctgggttgtgatgtaaaatatttagttgtacatctagaa

SEQ ID NO: 6806254 - DNA, 56 bp, Homo sapiens
cactgggaatatcaaccattgagactttctcctttctttgtggataatctccagtg

SEQ ID NO: 6806255 - DNA, 65 bp, Homo sapiens
gggctggtgtggctgccagccaagaggcttggggcaggcctggggcatgcagctgatacctgccc

SEQ ID NO: 6806256 - DNA, 56 bp, Homo sapiens
ggcgaggtgtctgccatcaagctggcttctgccctgaatggcagcagcagctctcc

SEQ ID NO: 6806257 - DNA, 75 bp, Homo sapiens
aggtaggttcgtctggtttgggttgctatggctgatagactccaccaggcagcaccaaagccggtaaactaacct

SEQ ID NO: 6806258 - DNA, 64 bp, Homo sapiens
gcagcctccccaggtggggcaacacaccagctcctcaaagctgctgtggggctcggcctgctgc

SEQ ID NO: 6806259 - DNA, 109 bp, Homo sapiens
atgtgaaagcacaccacttaaatgttttcttgatagacaaggaacaagcatgtagttttttttaattgaaaagatctgttccatgactgtatagaattcattttcacat

SEQ ID NO: 6806260 - DNA, 58 bp, Homo sapiens
ttcttaaagaggcaaaacacagggatgactgacctcctctaccgtgtttctttgggag

SEQ ID NO: 6806261 - DNA, 68 bp, Homo sapiens
tatactgtccctctgcactccaccccgcatacaccattatttgtcttgaagtgacctggggcagtgta

SEQ ID NO: 6806262 - DNA, 83 bp, Homo sapiens
tccacacttagaagcagaaatctcctctcacgctaggaactcctgatgtgtacagcaggatttctcaaccttcacactgtgga

SEQ ID NO: 6806263 - DNA, 60 bp, Homo sapiens
tgcatccctaggggcagagtccctgcccagatgagcagtgctggctgtcccagggaagca

SEQ ID NO: 6806264 - DNA, 112 bp, Homo sapiens
ttgaggtctggatcaggtatctgagtgtctcttgagctcagttctgatgtctctgacatcaagtggttctccaggttgcactcacaactgatgcttaataaaagaatattaa

SEQ ID NO: 6806265 - DNA, 61 bp, Homo sapiens
aggtcaaatgtcctgcccaaggtcacatacaatataaattgtagggtttggatttgaacct

SEQ ID NO: 6806266 - DNA, 70 bp, Homo sapiens
gctcacctgtaatctcagctaatcaagaagttcaggcagaataatcacttgaaactgggaagcagggggt

SEQ ID NO: 6806267 - DNA, 77 bp, Homo sapiens
acctttaaggagctactcaccgtcagactcacccaagtatagggttggcccctgagagcgagtacctccttaaatgt

SEQ ID NO: 6806268 - DNA, 60 bp, Homo sapiens
ggaatgagtatttctctatgctagctctcagcatggatagatgaatgcttaaagatttcc

SEQ ID NO: 6806269 - DNA, 100 bp, Homo sapiens
ttctcattttccataagcatcgagaacactgtgacaattcctgtcaaacgttagaatcttcaggaagtccagtttcatttgaggtcagtaaagatgggaa

SEQ ID NO: 6806270 - DNA, 74 bp, Homo sapiens
ttctcctattttatagtcctagtagttatgaatcttgaaaagttaagcctgagtgcttaggactgtttagagaa

SEQ ID NO: 6806271 - DNA, 87 bp, Homo sapiens
gaggctggtctgaggctccaaggaggtgctctcagatgacccttgaattccgttctaagcacacctcctagagcagactcttgcctt

SEQ ID NO: 6806272 - DNA, 80 bp, Homo sapiens
acagatgaattttggggggcacacaattcagcccataacaaatactgaaggcttctcagtggctcccttgaattgtctgt

SEQ ID NO: 6806273 - DNA, 90 bp, Homo sapiens
gccccaggccagagcgtgtagcatgcgccaccaccagccccgggggcttctcaatgctggtcgctgctgtatatgagcccatctgccggc

SEQ ID NO: 6806274 - DNA, 69 bp, Homo sapiens
caccacacccagccatgttcagttctctagagtatatacctagaaatggaattgctgggtcatatggtg

SEQ ID NO: 6806275 - DNA, 63 bp, Homo sapiens
tgcagaggtgttgctgagataaaagagcctaatggtgggtattcatttccagcagtctctgta

SEQ ID NO: 6806276 - DNA, 62 bp, Homo sapiens
gcaacagttgagtcagcagagctcagggcccctgacgaaccctgggagccgactgactgtgc

SEQ ID NO: 6806277 - DNA, 69 bp, Homo sapiens
tccatgctgaggcctgtggaagccttaaagaatatgtttattatggcttgtgcaggatctagcagtgga

SEQ ID NO: 6806278 - DNA, 62 bp, Homo sapiens
ggctccttcactcctccacccccgggggggatactccttgggcctggccctgtggaggagct

SEQ ID NO: 6806279 - DNA, 72 bp, Homo sapiens
tgtggaatatttctaaaggcctgaccaccagcacatctgtcctcttgctggcttttagatcagtagaccaca

SEQ ID NO: 6806280 - DNA, 55 bp, Homo sapiens
gttcttttccctctgcgcagccttggctcccttaatgcacagggtgggaagcaac

SEQ ID NO: 6806281 - DNA, 55 bp, Homo sapiens
gtcctggggctcactttgtacttcttttcagtgaagacaggaaaagctccaggcc

SEQ ID NO: 6806282 - DNA, 78 bp, Homo sapiens
aagaaaaggcagcatcccaggccacattctgggaggtgcagtattccctctctggctggggtgcggagcctggttctt

SEQ ID NO: 6806283 - DNA, 71 bp, Homo sapiens
agttcccgaggtgcattcattcatgctcattatgttgtaaacaagcgtagatgaaaggcacttaccaaact

SEQ ID NO: 6806284 - DNA, 67 bp, Homo sapiens
catgtgttgggactgtggtcaaggacaaagggctcatcccctctgttcctgcatagtacctcacatg

SEQ ID NO: 6806285 - DNA, 64 bp, Homo sapiens
ctgggcccccggcgctggagctctgtatctcagggactgagaataacagcctgtgttcccccag

SEQ ID NO: 6806286 - DNA, 64 bp, Homo sapiens
tgcagagtagctataccattttctactcccatcaggaatatatgagtggtctagtttctctgca

SEQ ID NO: 6806287 - DNA, 62 bp, Homo sapiens
cagggtgcgccactcagatgtacctctcccttgccatgggctccactgagtgtgtgctcctg

SEQ ID NO: 6806288 - DNA, 61 bp, Homo sapiens
agcattccacactgaagtctgcttttcttgaagcaaaaattctagtgtccttggacttgct

SEQ ID NO: 6806289 - DNA, 57 bp, Homo sapiens
tgcatcacttagctgcacaactgtggctctctctcttcactggcagataatgatgca

SEQ ID NO: 6806290 - DNA, 123 bp, Homo sapiens
ttggatggatgtttcaatgaggacaacagtagtttgaatgcagtatgcatttttcacataacatggaaagtagtgccattttgctctttgtcttgcagttggaatatgagataacccatgcag

SEQ ID NO: 6806291 - DNA, 67 bp, Homo sapiens
tcattagcagccttatcattagagtgtttggtaaactgatctaaagattaagagctggttttagtga

SEQ ID NO: 6806292 - DNA, 66 bp, Homo sapiens
gtctcacagcctctggaggtagtgtgatctctgcgatctcagctgacccctacaggttgtgttagc

SEQ ID NO: 6806293 - DNA, 76 bp, Homo sapiens
atggcaagtggctgttctcattggcctggcttccccttgagactggggatgaggaaaatgaaacagcaactgtcat

SEQ ID NO: 6806294 - DNA, 55 bp, Homo sapiens
cagggctcatctgtgtgaccagtagaatactgtggaagaaacaatgtgagacctg

SEQ ID NO: 6806295 - DNA, 65 bp, Homo sapiens
ggtcggcaaagtcaaataaatttactgtctggccctttacagaaaaagtgttttgacttctgacc

SEQ ID NO: 6806296 - DNA, 71 bp, Homo sapiens
aaaagttagctggatgtggctgttgccaaggaatgtcttttattagcaacaagtgactatctataactttt

SEQ ID NO: 6806297 - DNA, 69 bp, Homo sapiens
aaaatcacattgaaaatgttgcaggctgtattcatcaaagcatagccagagatattttcagttgatttt

SEQ ID NO: 6806298 - DNA, 59 bp, Homo sapiens
gtcaggcctggagaaaggaatgacatcttgatgaaactcagctttctcagaggcctaac

SEQ ID NO: 6806299 - DNA, 83 bp, Homo sapiens
cttgggcacagcaagttacagtgcttggcaataagtgccctaggtactgaaatgaaactgcacctgtggcttgagtgttcagg

SEQ ID NO: 6806300 - DNA, 80 bp, Homo sapiens
cagatatctaaacaagggattataattgatggtgacaagtaactcagatttgtcttttgtatgctttgtttggccatttg

SEQ ID NO: 6806301 - DNA, 79 bp, Homo sapiens
gcatagtgttggagagccatgctcaaggccacacgctgttctaaggcccaaagccagtgtgctctcccagtgtttttgc

SEQ ID NO: 6806302 - DNA, 65 bp, Homo sapiens
gtgtcccagcagcacattggctccaggagaagttgctcttgtctgctctgcctgctgctgggtgc

SEQ ID NO: 6806303 - DNA, 60 bp, Homo sapiens
gcttccgacagagatcacattgaaagggtctgtctcctgtgtgtgacctcctgtggatgc

SEQ ID NO: 6806304 - DNA, 77 bp, Homo sapiens
atgatctgtctgcctttctgctgctgcttttccaacaccctcctcacctggaagctgggcagttaaggcacagtcat

SEQ ID NO: 6806305 - DNA, 72 bp, Homo sapiens
gtcaaaggtgatgtagaagtttcaaacctgtgtgctggggggaatgggtttggcaatatctgaattataggc

SEQ ID NO: 6806306 - DNA, 59 bp, Homo sapiens
agagggggtgttccagaagcatcctctcctccagcgatgtggatctgggctcctcctct

SEQ ID NO: 6806307 - DNA, 75 bp, Homo sapiens
tgatgaggaagtcaggggatctagacttgaataaactccattaattcaagtctctcttcaaacgtcacctcttca

SEQ ID NO: 6806308 - DNA, 66 bp, Homo sapiens
tcttctttacttcatttccagtgaggacatacttaagtctgttccttaggaaaatgatgaggggga

SEQ ID NO: 6806309 - DNA, 63 bp, Homo sapiens
ttcttgcattttggagaatgctgaattaaaattgtaggtcagtcttctaaagggatgcaagga

SEQ ID NO: 6806310 - DNA, 65 bp, Homo sapiens
gtctgtgtcctccctgtcccccagagcagacaccctctctgtgtctggaccggggaggagcagac

SEQ ID NO: 6806311 - DNA, 96 bp, Homo sapiens
aggggctacttctgtgtcatgtttctgagtctggttagagtggtgattaatcacctggctctggggcggacagctggcatttgaatcctggctcct

SEQ ID NO: 6806312 - DNA, 81 bp, Homo sapiens
gggaatgaagaagtgagtaaaattagatttgagtgatttctaaattcaattgcatctagattaactggctgtctttctccc

SEQ ID NO: 6806313 - DNA, 92 bp, Homo sapiens
ggcctggatcctatgaatggctcatggtgagtgaggcgcaagctcctttgctgcattccacaccactctgcctgatgttacatggatctgcc

SEQ ID NO: 6806314 - DNA, 59 bp, Homo sapiens
ccctacgtgatagctattaccatctttatttcacaagtaaggaagctgagatgtagagg

SEQ ID NO: 6806315 - DNA, 129 bp, Homo sapiens
ttctttctaatgggagccaccacattgcgttcctttaattacacagtgtcatgtcgtgttcccctgtgaaatgacacggaggaacatgaggtgacctgggataactgtgatgaattgcatcccgaagag

SEQ ID NO: 6806316 - DNA, 62 bp, Homo sapiens
tcagatttcctgttgaagaagttgataaaaacatttcatttttctaaacaaagggagtttgg

SEQ ID NO: 6806317 - DNA, 59 bp, Homo sapiens
tggtaaggcccagctggagtcctttaatcacaggattcaagaggggatgggccttagca

SEQ ID NO: 6806318 - DNA, 130 bp, Homo sapiens
ttctttaatgttcccgtctttctcatttccctaaataaactgaagcctttactggaaggtcaagtaaatgttactgtgaatcactactagtagaggctccagaaaagggaatcctggttgctctcaaata

SEQ ID NO: 6806319 - DNA, 56 bp, Homo sapiens
tgacatttcctagtgctttgtgagcaatccaaatttcacttaaaagagaggtgtca

SEQ ID NO: 6806320 - DNA, 64 bp, Homo sapiens
ggccagctggagttccgggtgggcatgggcttggcgggcctgcactcggagcagccggccggcc

SEQ ID NO: 6806321 - DNA, 61 bp, Homo sapiens
aggaggccaagggcaaagcggagagtgccggagagccctcattcctgttccctcgccacct

SEQ ID NO: 6806322 - DNA, 59 bp, Homo sapiens
tggggtgaagggaagcgtaaaatgcgaccaaggaattacatgctataatttcaccctca

SEQ ID NO: 6806323 - DNA, 58 bp, Homo sapiens
caggtcccagtgttagggtgacaactgcaaaaatttggttatcattctcttgggcctg

SEQ ID NO: 6806324 - DNA, 56 bp, Homo sapiens
ccacagtaactgttttgtaccgaggccagctgtactcgggagcaggaaagctgtgg

SEQ ID NO: 6806325 - DNA, 56 bp, Homo sapiens
gtgtgtgtgaacatgtgtgtgtgcgtgtgtgtgtgcacgtgtgtgtgcacgcgcgc

SEQ ID NO: 6806326 - DNA, 72 bp, Homo sapiens
cctgatcaaaacattactccaccaatcccaccaggtcttccagggctgtggggagaaatgtctttgttccgg

SEQ ID NO: 6806327 - DNA, 63 bp, Homo sapiens
ttgagtgtggtatgctctgaggctgaatcacataggatgcagctttcacaggattacacttaa

SEQ ID NO: 6806328 - DNA, 56 bp, Homo sapiens
atggtgatgtgactctacgttatgattaatggggctgttggaatcattgtcaccat

SEQ ID NO: 6806329 - DNA, 65 bp, Homo sapiens
agcttcccacactctagtttccaccttagaattggcttccatggaaactagagtgtggcaaagct

SEQ ID NO: 6806330 - DNA, 68 bp, Homo sapiens
tggacctgattgcttttgagctagaattttgccctaggcagtgttcttgtttctaagcaaatgcgcca

SEQ ID NO: 6806331 - DNA, 76 bp, Homo sapiens
tgtcatgtaatgctgggagctgggctaggggctttacatccgttattctaacgcctcaccccagcactacgtgata

SEQ ID NO: 6806332 - DNA, 87 bp, Homo sapiens
tttctgtggtcaccttcatgacctatcaccagccaggggtctgcaaatggatgggctggagatatgtctggaacattatcgtggagg

SEQ ID NO: 6806333 - DNA, 60 bp, Homo sapiens
ttttccagcataggtacatataataattcctttgaatcatatgctctttatgctggaaga

SEQ ID NO: 6806334 - DNA, 55 bp, Homo sapiens
tcctgcctcttttcttattccagatttctcactttctggggaattagctgtagga

SEQ ID NO: 6806335 - DNA, 61 bp, Homo sapiens
ggtgatcaggctaactgtattctacagatcctatctctttaaacttcagtttctgatcatc

SEQ ID NO: 6806336 - DNA, 72 bp, Homo sapiens
tgaacatgataattgttaacaaagtactttgacattatatgtaattgtgcattggtgataattacgtattca

SEQ ID NO: 6806337 - DNA, 64 bp, Homo sapiens
tctgtgaatggtggccacgcgtttggatgttacagagcaagcacgttcttcattacttcacaga

SEQ ID NO: 6806338 - DNA, 63 bp, Homo sapiens
gcttctttccttgggctggaaccattcaactgcacagataaatgtttactcaaggaagaatgc

SEQ ID NO: 6806339 - DNA, 106 bp, Homo sapiens
cacccggcccggcttggggccagcaccctgccctcgggccctcccatagctgagactggtggctgtggctgtggctctgggcctgctccccaggccaccctgggtg

SEQ ID NO: 6806340 - DNA, 74 bp, Homo sapiens
gttctctctcaattggggtttctaagctggaagctcaaatatcttgagcttaaataggagccccaggggagagc

SEQ ID NO: 6806341 - DNA, 56 bp, Homo sapiens
taggctttggtttcatttctcccacaggaaagggaaggactgaaaacacaaacctg

SEQ ID NO: 6806342 - DNA, 69 bp, Homo sapiens
tgtacagcctggtcagcggcatcttctgggatccacagaggatcctgaccactaggaccaggctggaca

SEQ ID NO: 6806343 - DNA, 96 bp, Homo sapiens
ggagcttgtcgtgtacttcctggtcctgttggggtgttgcagtcttgccagtaccaatggcccacacaggctcataggccaggacgaccttgctcc

SEQ ID NO: 6806344 - DNA, 102 bp, Homo sapiens
ccttcaggaacagagtggctctggacctcagctacagactgcagctaattcataaatgtcaacagtcaagaggaggggaaccagaacattttgtcttgaggg

SEQ ID NO: 6806345 - DNA, 90 bp, Homo sapiens
gccgtaactgtcacagactgggtggctcaagcagcagaactttaatttttcactgtgctggaggccagaagtctgagatcaagatgtggc

SEQ ID NO: 6806346 - DNA, 130 bp, Homo sapiens
ggcatttatgtctgggatgcaaactgagtatgcccctggttgtctgttatctcttttaataatctttttgcaggaggaggctggagtacacccagggggtgggcaagtgggcagataccagattagatct

SEQ ID NO: 6806347 - DNA, 76 bp, Homo sapiens
acaagtaaacttcctgaaggatatttggctacagaagctcagaaagctatgagctgaatgtctggatactacttgt

SEQ ID NO: 6806348 - DNA, 64 bp, Homo sapiens
ggaggtgcttcctttgggctctgggtatattaaagaaaatgaatagaatggaaggaatatctcc

SEQ ID NO: 6806349 - DNA, 92 bp, Homo sapiens
aatatctagagagattgggagtgggaggctgagtctggaggtgagatatctgtatccaatcagagaagtttcctatgccttcctgtaatgtt

SEQ ID NO: 6806350 - DNA, 74 bp, Homo sapiens
gcttcctgctgtattacttttacaaactgcttctcacaggctaggcagagacagaggcaatatagcttacaagt

SEQ ID NO: 6806351 - DNA, 78 bp, Homo sapiens
gggtaggggcagctcgctttcctgagaaaggagaaggaggtccccttcttctcctaaggagagtcctgcccagcgccc

SEQ ID NO: 6806352 - DNA, 86 bp, Homo sapiens
tataaatttattgtattaaaagtttaaatattggtgtgtgggcatcctacatgatatatgggaaatgcttggatcagtaatttata

SEQ ID NO: 6806353 - DNA, 85 bp, Homo sapiens
agggggaaatttctctagaggtgggactcaggaattttgaaatctcccttcacaaagtctcatctttaaatgaaaatttcctctt

SEQ ID NO: 6806354 - DNA, 83 bp, Homo sapiens
ttgtgtggtttatgcttcttgtatataaaaatcatttgcccttgtggccaaatgaagttatgcaaaaacaaagtattatgcaa

SEQ ID NO: 6806355 - DNA, 58 bp, Homo sapiens
gagaggatccacaaaccaggaagtctaccttcctatgggagtgttgggatctctgctc

SEQ ID NO: 6806356 - DNA, 75 bp, Homo sapiens
gaacctgggtctctggcgccatctgtgcaaacggctgctcctttcccacatgtcctggcgctgagccctggcttc

SEQ ID NO: 6806357 - DNA, 69 bp, Homo sapiens
gcacagggtttctcaacctcaacactatttggaccagataattctttgttgtgggaggctgtcctgtgc

SEQ ID NO: 6806358 - DNA, 84 bp, Homo sapiens
gggaaggactaccctctctgtggcaagcatgctgctcagctgccccaggggccaggcagcagctttgtccaggagagtgtgccc

SEQ ID NO: 6806359 - DNA, 59 bp, Homo sapiens
aaccctgccagaattgagcttgaattccaagatcaacaagatcaagtgctggcagtgtt

SEQ ID NO: 6806360 - DNA, 82 bp, Homo sapiens
accacgcagacagatttctttatgaagtacagaaaggcatgaaataacgagatttttgtctctgaagtagatctctgtgggt

SEQ ID NO: 6806361 - DNA, 64 bp, Homo sapiens
acgagcctggctccctctgcagctcctctggggtgtcctggacggtggctgggggcaaggccgt

SEQ ID NO: 6806362 - DNA, 78 bp, Homo sapiens
cactccatcccttcaccacagcagtaaatatccctttgcctagaacacctgctgctgctggtggtggatgaaagggtg

SEQ ID NO: 6806363 - DNA, 60 bp, Homo sapiens
gctccaagctcccaggatacagactaatccatttggtgaggctcctgggaacttgctagc

SEQ ID NO: 6806364 - DNA, 88 bp, Homo sapiens
tggaagtctggttttgaagttggtgtggaaagtagctgctgtatgattcggaggcccattttatatccagccacttcctggacatcta

SEQ ID NO: 6806365 - DNA, 70 bp, Homo sapiens
gagttaaatagtagtcgccttttgtaagcaactctaacagaggtttacatttgggattaatagtaaactc

SEQ ID NO: 6806366 - DNA, 65 bp, Homo sapiens
cgggaaacttgaggaataagaagacgtgtacttcgtgttcttgtcacagcacctcagtctcactg

SEQ ID NO: 6806367 - DNA, 62 bp, Homo sapiens
gaggtggggagggattctggagggtctgctgttagcttttggttcttcagtcttcccacctc

SEQ ID NO: 6806368 - DNA, 77 bp, Homo sapiens
tgcaggcacccagggctgtgcctgcccatcagccccgatagcagcaattacacagtccgtgggtgtgatgagctgca

SEQ ID NO: 6806369 - DNA, 76 bp, Homo sapiens
ctagactgaattttaaaggtttgcaaatcatacatctaagaattagaagtagtaaatcataaaatttgagctctgg

SEQ ID NO: 6806370 - DNA, 65 bp, Homo sapiens
tcttatgagttggctttcttatggagctcttgtttgtggagctgccattttccatctcatgcaga

SEQ ID NO: 6806371 - DNA, 67 bp, Homo sapiens
atcaatacttgtgagtttccaacaatggatttggtagtggccattgtaaaagtattctaagattgat

SEQ ID NO: 6806372 - DNA, 74 bp, Homo sapiens
aagtcaatgtgctttgcttttagagtaagtttcaggccattgcttgaagcaatgatagcagaatgaattgattt

SEQ ID NO: 6806373 - DNA, 73 bp, Homo sapiens
cggtgtcctggagtgtcagaaacagtgtcctggctgggtgcaggacctgtaatcccagcactttgggaggctg

SEQ ID NO: 6806374 - DNA, 82 bp, Homo sapiens
cctacctttaattttaggaatatattgtaggagtctctcaaacagaaaacataatttgcattatatttatagaagaaggagg

SEQ ID NO: 6806375 - DNA, 79 bp, Homo sapiens
agggagtaatgtttcctggaatttttgacttttcagataaataagcttagaatgtgttaggaaagctatttgactctct

SEQ ID NO: 6806376 - DNA, 83 bp, Homo sapiens
gcatttaaaaatgtcctcaaaactgattgcagcatgacatccctcagattttgtattcagttttagtttagttactttgaagc

SEQ ID NO: 6806377 - DNA, 58 bp, Homo sapiens
gaaaacttggatctctagaatggttcatttcagagcttttccagatagccaagttttt

SEQ ID NO: 6806378 - DNA, 71 bp, Homo sapiens
gggccaccttgactgtgaaggccgtggcagaagccctgttcaccagggctgggcaggtctgcacagggccc

SEQ ID NO: 6806379 - DNA, 55 bp, Homo sapiens
ggagctttgagttgagctggctccatgtgagtgacggaaactcggctctggttcc

SEQ ID NO: 6806380 - DNA, 61 bp, Homo sapiens
ccactgctcctgaccaaggtcactcccagccccctctgaagtgaccgcaggcagggagtgg

SEQ ID NO: 6806381 - DNA, 55 bp, Homo sapiens
tctaggaatgttcttagggatttgatacagacaaacccctgagaacatttctaga

SEQ ID NO: 6806382 - DNA, 55 bp, Homo sapiens
gggctccgcccttggctgagctggagggcttggggtcaggaccaagggtgggtcc

SEQ ID NO: 6806383 - DNA, 65 bp, Homo sapiens
gccttgattttctcatctctgagagatgaacacaagagtttgtatttcattgaatgagataaggt

SEQ ID NO: 6806384 - DNA, 55 bp, Homo sapiens
acagtgctcatttccctggctctgaacccaaaaaagagggagggtgagtaactgt

SEQ ID NO: 6806385 - DNA, 75 bp, Homo sapiens
ggccccaggtgtgtacagaacagcacccacctgcccacgaggtcaccctgtgccctgttgcacacttgaggggcc

SEQ ID NO: 6806386 - DNA, 129 bp, Homo sapiens
tggcttagaagatggagaaaggggaaaataagccaagggctgtaggagctggaatgggcataaaaatagattgtttgctagagcctgcagaaggaacttggccctgctgacaaccttgattttaggcca

SEQ ID NO: 6806387 - DNA, 81 bp, Homo sapiens
ggagggaacagcctgagcaaaggcccagagggaggaacttgcaccttcataagagactcttggggctccctgctgccctct

SEQ ID NO: 6806388 - DNA, 80 bp, Homo sapiens
tgtttacatggaggttttcagcagccttagcaggcatgatgtttggatcctggaaatcatctattttttatgtgtaaata

SEQ ID NO: 6806389 - DNA, 68 bp, Homo sapiens
gtgtcccctgagacgtgagagccaggcagaagctgggtgaccttttcctgcctcacctcagaagtcac

SEQ ID NO: 6806390 - DNA, 73 bp, Homo sapiens
cccagcgcccaggggcagggctctctggcctggcttgtgctggttcccagagtccctgctgtcaggtgctggg

SEQ ID NO: 6806391 - DNA, 73 bp, Homo sapiens
taatcttcctaggctccagaactgtgaaaaatgaatttctattgtttataaattaggcgcctcaggtattttg

SEQ ID NO: 6806392 - DNA, 98 bp, Homo sapiens
accatacgaatgttcccatttcttgcatccttgctgactctttctttctgtgttgtagtcatcctggtgggtgtgaagtgggggtacttcattgtggt

SEQ ID NO: 6806393 - DNA, 85 bp, Homo sapiens
ccaatattcttctgaagaatttagtgaccattgccagaaaagccagtctctggcaattcctgagctctgagaaacaaatatgtgg

SEQ ID NO: 6806394 - DNA, 64 bp, Homo sapiens
ttttccttgttgaaaatgtctgcagtaaacaaatattgcctgacagtttacaactccaggaaaa

SEQ ID NO: 6806395 - DNA, 67 bp, Homo sapiens
gctggacgggctctgcttgcctgctgtgcacctgaggagtagggtttccaggttagagaggttctgc

SEQ ID NO: 6806396 - DNA, 59 bp, Homo sapiens
ttacagaaaagggctttaagagcctatgttcctttggctttaagagctcttcactgtga

SEQ ID NO: 6806397 - DNA, 82 bp, Homo sapiens
gtcttagcatcctgcagctcttacggagggcggggcagtctctggactcctgccttcggaggaactgctataagcgcaaggc

SEQ ID NO: 6806398 - DNA, 61 bp, Homo sapiens
tagagtttgtagttctacatggctccatatacatggagatttttagaattacagatattta

SEQ ID NO: 6806399 - DNA, 63 bp, Homo sapiens
gtgcgaggtcttgttgtcgccacgctcgatggtgagcggcgtggcattgacgctgacctgcac

SEQ ID NO: 6806400 - DNA, 70 bp, Homo sapiens
gtcacatggccacatctagctgcaagggaagctgggaagcgtaatcttgtattcagagtggacatgagac

SEQ ID NO: 6806401 - DNA, 55 bp, Homo sapiens
ggagctcggtcccctcctccaagccagacctttgcagaggtggcatctgggctct

SEQ ID NO: 6806402 - DNA, 70 bp, Homo sapiens
tggctgaaacattctgcatctcgtactttgataaatttacctgtatatcaggcagaatgttctctggtca

SEQ ID NO: 6806403 - DNA, 55 bp, Homo sapiens
ccttcgaccccagaccaatggctgtatttgtaagacagctgtctgaggtctgagg

SEQ ID NO: 6806404 - DNA, 64 bp, Homo sapiens
tccagtcaagcttgagaatttcagcagctcttgcttttggtgtagattttcattttgactgaga

SEQ ID NO: 6806405 - DNA, 65 bp, Homo sapiens
ggctgcctcaaagctcaagctccagtagcagcattcccactggggcttggaaagcagaggcagtt

SEQ ID NO: 6806406 - DNA, 74 bp, Homo sapiens
tgtctgcagatgctagcacttctgaggcacagaaaatgaatggttttaaatgtgatcctggtatgcacttgaca

SEQ ID NO: 6806407 - DNA, 57 bp, Homo sapiens
gggtgccccatagcctgctgccctcaaggagtatgggctgcagggcccagggcaccc

SEQ ID NO: 6806408 - DNA, 72 bp, Homo sapiens
tgtagaaggcggaaggtatcaaaaatgaaactgttgtttccattatttttccatgatacttatctgtttgca

SEQ ID NO: 6806409 - DNA, 80 bp, Homo sapiens
agcatccctcagacagaggcctggtgctgtgtccacacaacctctcccctgtggcacctcctggcttccctgaggaggct

SEQ ID NO: 6806410 - DNA, 60 bp, Homo sapiens
tcagagtatcccagggccagcaagatggggctgtcaggaggcccaccctggctagtctga

SEQ ID NO: 6806411 - DNA, 70 bp, Homo sapiens
cagtgttagcaggggtagatagagtgtgttagaatagcaatggcttctctgtgagctcctgcaaatgttg

SEQ ID NO: 6806412 - DNA, 58 bp, Homo sapiens
gtaatgctacaggagtctacattcctactcccgatgtagattttacttctgtcattac

SEQ ID NO: 6806413 - DNA, 91 bp, Homo sapiens
aaaggagtgaagaaaacagtcattgtattgaggatacttaaggttggagaactttcttcttaatactggctgctaggggctttatttcttt

SEQ ID NO: 6806414 - DNA, 59 bp, Homo sapiens
cggacaggctcctggagctcctccattaactaggagcaaaatgattccagagctttccg

SEQ ID NO: 6806415 - DNA, 85 bp, Homo sapiens
tgtcccaaggtatcttagggagctctggcagaaggaataagatggtatttctagtaaaggcctttaggaaatattttaggtgata

SEQ ID NO: 6806416 - DNA, 73 bp, Homo sapiens
ctgcccaagaaactcactttggttgaacttttaaaaaattgttccaggcatgtctgagtccttctctgggcag

SEQ ID NO: 6806417 - DNA, 100 bp, Homo sapiens
ctgtttatatataccatatatgattgcctctttcatacgctgtctacttcaaactttgatagactgataagcatcatatttggaatgtcatggttcacag

SEQ ID NO: 6806418 - DNA, 74 bp, Homo sapiens
ccctgtgcttttcttgcgtttctgagagtgggcctggcctctcctcctcccactcttgaatcaagagctcaggg

SEQ ID NO: 6806419 - DNA, 84 bp, Homo sapiens
gcgccagaacagatttttattcatttggaggtcgtgaataaaacagttttagactttggagcagaaagaaattggttagggggc

SEQ ID NO: 6806420 - DNA, 69 bp, Homo sapiens
attaaattctctgtggtatgtcatagcaagtggcaattgtatttgttagatactacagcaggatcagat

SEQ ID NO: 6806421 - DNA, 82 bp, Homo sapiens
agcatcttaaatgttttgcattagttttctagaacagactcttagaagttctagaaataagttgaagaccattttgatgact

SEQ ID NO: 6806422 - DNA, 83 bp, Homo sapiens
gcaggtgttgtgctatccgcagtggctgtttctggaaggcaggagcctgccttcacttctgcaccacttagcacagtgcctgc

SEQ ID NO: 6806423 - DNA, 130 bp, Homo sapiens
gcatccagtgaaatttgaatgtaaaataaatggtgaatgatatttcagaaaaaatgtgtcctaagtattgcatgggacttatactaaagtattatttgttgtttatctgaattgaaatttcactgggtgt

SEQ ID NO: 6806424 - DNA, 71 bp, Homo sapiens
tgatctcagctcactctgcttcctgggtgcgggcgattctcctgcctcagcctcccgagtagctgggatta

SEQ ID NO: 6806425 - DNA, 84 bp, Homo sapiens
tctgtcatgtcactgcaaattgcaatgttttaattcttcttgatttagtggcaggagttaaaatatgtaatgtacatagaagga

SEQ ID NO: 6806426 - DNA, 65 bp, Homo sapiens
cttgggcagggtattgtagaagacattatactacattatattatacaatagtccctgtccgcaag

SEQ ID NO: 6806427 - DNA, 58 bp, Homo sapiens
ccattcacctcttcacgtgctcggtgcctctactcagctcctggccagcggtggatgg

SEQ ID NO: 6806428 - DNA, 61 bp, Homo sapiens
gcagtgtggcgtggggacctaaagcatcatttatctggtctacaaaatgccagccatgggc

SEQ ID NO: 6806429 - DNA, 96 bp, Homo sapiens
ggttgctttctctgtgtcctatgctttctgaatgcttgggctcaccacaattctaaaatagggacccaggaaaacatggtgcagagaaggtcagcc

SEQ ID NO: 6806430 - DNA, 55 bp, Homo sapiens
cacatgccagggtagcattgtgacatgtgactgtccagactgccctgcacatgtg

SEQ ID NO: 6806431 - DNA, 109 bp, Homo sapiens
gcatatgagtctcctggacattttgttaaaaatgcagattcctattctacagctctaggacaggcctgagattttgcatttttcacaagttcctaggtgatggtgatgc

SEQ ID NO: 6806432 - DNA, 79 bp, Homo sapiens
gttatataggaagatcagagtaagctttttagaaaagactgacctgcctcttgaaagttatctagattctgaatatagc

SEQ ID NO: 6806433 - DNA, 55 bp, Homo sapiens
cctcattcattgcaagcacacgcaatgaatgttgtagtggaacaggtggatgagg

SEQ ID NO: 6806434 - DNA, 60 bp, Homo sapiens
gaagaatcaagcagtaatttgtgttccagataaagagcaaactgattgtgcctggtcttc

SEQ ID NO: 6806435 - DNA, 73 bp, Homo sapiens
gatgatctgtgacaatgggtcttgaaggctcctgttttccacagaggctctccaggtctcatgcactggtctc

SEQ ID NO: 6806436 - DNA, 63 bp, Homo sapiens
tctaagggaaatctttcaacacttcattgttaaggatgatgtttgctgaaggtttttggtaga

SEQ ID NO: 6806437 - DNA, 72 bp, Homo sapiens
gtctagggcaggcttgagagatcagatggcgtgaaaggcttgtgatctgttcgtctcaggctccccctaaac

SEQ ID NO: 6806438 - DNA, 55 bp, Homo sapiens
agctgctcttgggtgacttcaaactatgaaatttgcatgtagcccatgagtaact

SEQ ID NO: 6806439 - DNA, 92 bp, Homo sapiens
ccttttccccagagcccctggaggtcagaggcctgggaaggcggtggcctagggttgcaggcctcagacttagccatgctctgggtttctgg

SEQ ID NO: 6806440 - DNA, 82 bp, Homo sapiens
ttgttaggagcactcggcacttcggggaggaagaacgttcctaaaagatggaagcgcttccaccgaaggcagctctcggcaa

SEQ ID NO: 6806441 - DNA, 67 bp, Homo sapiens
atagttaccatttaaggaaaatgtatcacagtcctggtactgtgccaagtcctgaatgtgtttctat

SEQ ID NO: 6806442 - DNA, 56 bp, Homo sapiens
cagcttttggcaggatgaccagaccatgtactacttttggaagcctgcagaagttg

SEQ ID NO: 6806443 - DNA, 72 bp, Homo sapiens
ttctttaactggtttcacgtcagctttttcctctgatttgagaggtggagttaagtgtgaactgcttaagaa

SEQ ID NO: 6806444 - DNA, 61 bp, Homo sapiens
cagtgggaacctgcctgcacagtgtggttgaagctgcttggctgggtcagcaggtcctctg

SEQ ID NO: 6806445 - DNA, 67 bp, Homo sapiens
taggctggaacttaggcagaggcagtctagagaaaaaattccttcttctttctgaaatctcagtctg

SEQ ID NO: 6806446 - DNA, 77 bp, Homo sapiens
gagtacaaccaatttcttgttaattctcaggcctgtctcggggcctgagaattagtaagaaatttatcttgatcctc

SEQ ID NO: 6806447 - DNA, 65 bp, Homo sapiens
gtctggaagtgtcttgttaagtgggaaagtaagtcaaccaaatagaaacaaggggcttgccagac

SEQ ID NO: 6806448 - DNA, 56 bp, Homo sapiens
atggggagagaaaggagactgttacttttattttcatgtcctttgctctcccacat

SEQ ID NO: 6806449 - DNA, 67 bp, Homo sapiens
gtgccacatggtccatgtatcaaggggccagcaccagtctctggtttcagatacaggatatgggcac

SEQ ID NO: 6806450 - DNA, 130 bp, Homo sapiens
ccttcaaggtctaacttccaagattctgtgagtacgattctagggagcctctgcctcagacttctaagtagttcttcaggctgtgctctagaagttactggaatgaaagaaaaattgtagtgtttgaagg

SEQ ID NO: 6806451 - DNA, 61 bp, Homo sapiens
cacccgaaagctggtcctaattgagccattttctgaatgctagccttggaccggctgggtg

SEQ ID NO: 6806452 - DNA, 55 bp, Homo sapiens
gagtggctgggtgtttgaatccttgcttctagtggcagagactgaccggctattc

SEQ ID NO: 6806453 - DNA, 66 bp, Homo sapiens
aacagaggccttcctctcaagcacatggaacggggtccatttgtggacttggaggagagcaaggtt

SEQ ID NO: 6806454 - DNA, 60 bp, Homo sapiens
tcccaggaattgaagccagtgtttttcaaagaggattccacacaggcattattcctgcga

SEQ ID NO: 6806455 - DNA, 55 bp, Homo sapiens
ggcctgattcatgccatgcagtgggtacacgtccacagcctgtcatctcatggtc

SEQ ID NO: 6806456 - DNA, 79 bp, Homo sapiens
ggatgaatcagacccagcaggtcccactgagggcccccgttgaagatcagaggggtctggcagggcctgtgggacatcc

SEQ ID NO: 6806457 - DNA, 87 bp, Homo sapiens
cattggtgttggagataatcaataagttataatgagttcattcattcatttaataatttttgagtagcccaaagctaacactgactg

SEQ ID NO: 6806458 - DNA, 102 bp, Homo sapiens
aggcccagccttctcacccacccagccccacacggtctagctctgcctgaagtaggtgcttggctcgtgcacacagatggacgggtggatgcggctgggcct

SEQ ID NO: 6806459 - DNA, 102 bp, Homo sapiens
tttagaagctattaaggaagacagaagcctacagcttcatagacatttggtatgaggttttgtttcattttgtttcatttttaatacaatactacttctaaa

SEQ ID NO: 6806460 - DNA, 84 bp, Homo sapiens
gttgggaaatatgggggggcgtgcagaggagctgggaagccatggtgctgggtcactgattccccattttatataatctcccac

SEQ ID NO: 6806461 - DNA, 93 bp, Homo sapiens
ggccaggatggtctcaatctcttgacctcgtgatccgcccgctttggcctcccaaagtgctgggattacaggtgtgagccattgtgcctggcc

SEQ ID NO: 6806462 - DNA, 130 bp, Homo sapiens
agcctggtgccctttccatgttacctatttgcctcccagtattgttggagcatttaatagcagacgcttttcccatagctggttgattctagggcagataagtaataacccagcagggcccaccaggcat

SEQ ID NO: 6806463 - DNA, 87 bp, Homo sapiens
gatttcaaaatgactgccatctctatctttattgaaatcttccattattgtgggaagacaggtaaatagagatgctggtcagaaatc

SEQ ID NO: 6806464 - DNA, 116 bp, Homo sapiens
atgtgaatagtaagaaaagatcactttaaggggaattttgttttatcttcattgtaagttgatgttttttaaatgcagcagtttctgttctaaagctgattactactgtgccacat

SEQ ID NO: 6806465 - DNA, 59 bp, Homo sapiens
gtttatggtgactctaattactcagcctaactgaccctttggagtagcactatgtaaac

SEQ ID NO: 6806466 - DNA, 66 bp, Homo sapiens
caggaccagctggtcagttgaagattatagcaataatcctccagcagatgattagaccctggactg

SEQ ID NO: 6806467 - DNA, 65 bp, Homo sapiens
tctgtttatagacctgggcctgttttgaaaagtagataatcaaaatgatcccatttagaaacaga

SEQ ID NO: 6806468 - DNA, 81 bp, Homo sapiens
gcttactttgggtatatgtgagatgttgtataagatatatttattccaacattcttatcactataagcctctagtcttagc

SEQ ID NO: 6806469 - DNA, 68 bp, Homo sapiens
caaaacattcagagagctcacttgacccaaccgagggttttacttggtgagcctttctagtagtcttg

SEQ ID NO: 6806470 - DNA, 81 bp, Homo sapiens
ttacttcaggccatctgggcgtataggtgcaagtcacaggagatgcgatggcttggcttgggctcagaggcctgacagtga

SEQ ID NO: 6806471 - DNA, 55 bp, Homo sapiens
gggtggggcagtgtggcccgtcctctggggccctggcctgagcacctgtccacct

SEQ ID NO: 6806472 - DNA, 88 bp, Homo sapiens
ggagtttcgctctgtcaccgaggctggagtgcagtggcgggatctctagtcactgcaagctctgccttccgggttcaagcgattctcc

SEQ ID NO: 6806473 - DNA, 102 bp, Homo sapiens
tagtactgatttatttacatctttactggatttagaggctaacaccaattggtaaagttctatttgaatttaggtattttggagtaagtattattattatta

SEQ ID NO: 6806474 - DNA, 60 bp, Homo sapiens
gatttcttcaggagcagaggagctatttctcatttagacaaatgttccaaggaaggaatc

SEQ ID NO: 6806475 - DNA, 86 bp, Homo sapiens
gggaggttgggagagagggggcgggcgactcctcgccgcgcgggttcctggctggagcgccctcctctgcgtcctcccaaccttcc

SEQ ID NO: 6806476 - DNA, 91 bp, Homo sapiens
gtgtgtgtgtgtgtgtgtgcatgcacacacacgtagagaaaagaacattctttctctgtgtgtgtgtgtgtgtatatatatacacacacac

SEQ ID NO: 6806477 - DNA, 71 bp, Homo sapiens
ggacagcaggtcacagctgattggccaggactctccataggttatggccagtcttagctgtgcctgcatcc

SEQ ID NO: 6806478 - DNA, 69 bp, Homo sapiens
caggttttcgaggtgtgtgtgcatgtgtatacgtgcacatgctacacagagctcctcgacaagcacctg

SEQ ID NO: 6806479 - DNA, 87 bp, Homo sapiens
tttgggggttttggtctgggagggttcacagttagtttctcatggaaacagaccagtagggctcatcccagtgctggggccgtcaga

SEQ ID NO: 6806480 - DNA, 67 bp, Homo sapiens
gtcagagtgtggcaagcattaggtctctgctccacctcagtgccaattctgccatggggactctggc

SEQ ID NO: 6806481 - DNA, 60 bp, Homo sapiens
ctcagggacagtatcatttaggagaatatgtttttattgccctaaattgcttcacctgag

SEQ ID NO: 6806482 - DNA, 77 bp, Homo sapiens
ttacactgacaccaagtaatgtatgaaggtcccagttgtttcacattctcaccagtacttggtattgtcagttgtaa

SEQ ID NO: 6806483 - DNA, 76 bp, Homo sapiens
aaaaggatggagcagctcatggcattttctgcatgttgacctttccaacacagtgtcatcagtttctcaacctttt

SEQ ID NO: 6806484 - DNA, 56 bp, Homo sapiens
acgggcatttgggcgattcctaacatgtgctgtaacaaataatgccagatgtctgt

SEQ ID NO: 6806485 - DNA, 81 bp, Homo sapiens
tgtagcgttgagaaagttatatcatctcattgacgaggaaaccagtgtccagaaaggtaatatgacatcctcaaggcagca

SEQ ID NO: 6806486 - DNA, 63 bp, Homo sapiens
cagaccctgcattttccagggtttccataatggctggaaataaaaatggcagcagggaatctg

SEQ ID NO: 6806487 - DNA, 58 bp, Homo sapiens
ccccttcagagtagccacattagaaaggttaatgcattcatagtgagcttagaagggg

SEQ ID NO: 6806488 - DNA, 55 bp, Homo sapiens
cggagatatttaaggttctctccatgtaaggacattagaatctaaattatttctg

SEQ ID NO: 6806489 - DNA, 90 bp, Homo sapiens
gattattcaaggtttacattctgaaataaatggtttgtgtgaagttgggaactagcagaattattagagtgaacaatgctttgaatcctc

SEQ ID NO: 6806490 - DNA, 58 bp, Homo sapiens
tgtggagctgtgtggccttgggcaagtgacttaactgctctgagtctcagctaccaca

SEQ ID NO: 6806491 - DNA, 130 bp, Homo sapiens
gttagtgacttttttaagagcacattaaatgcagaggtaatatagaataatgggaagttctggattgacagatagacatatattctgattccatctgtgtcattaattgctgttgggaatgtcacttaac

SEQ ID NO: 6806492 - DNA, 77 bp, Homo sapiens
gaaaagggggacatgtaaacatttacagtattatctcctgattaaatgctgttctttatgttatttttatctttttc

SEQ ID NO: 6806493 - DNA, 126 bp, Homo sapiens
tgagatcagactcctgcccaaagagagatgtccaagaggtctgagcaatctcaagcctgtatctaaggctaaactgtgatcttcagtccatcaaagtctctttttctgctagtctttcccatctca

SEQ ID NO: 6806494 - DNA, 60 bp, Homo sapiens
tgggaacatggaaattctgctctgtttcagccaaaacagaaaaacaggattgtgttccta

SEQ ID NO: 6806495 - DNA, 84 bp, Homo sapiens
caaaatcaagactgtcccaggaagtgagtgtcagtcaaaggttttgaaatccctcaaatagttacttctgctgtcttggttttg

SEQ ID NO: 6806496 - DNA, 113 bp, Homo sapiens
gtctcctggtgtgtaagtctctctcctggttcccagcaggagtgtaggaatgagtgcttgtcctggactctgggctgggaactagcacctagtggggactggactaggatgac

SEQ ID NO: 6806497 - DNA, 60 bp, Homo sapiens
gacgtggctctgtcaggttgcgcctgcaagaggctgaccaaggcctgtgcagagcccgtc

SEQ ID NO: 6806498 - DNA, 70 bp, Homo sapiens
aggtggtacaagaggcttaatgttggcaaacatgcagctgattgctaacgctcaccctttgccaccacct

SEQ ID NO: 6806499 - DNA, 55 bp, Homo sapiens
tactcaatctaggtggcttacctacttcctgtttgtaaggcatcaagtttgggta

SEQ ID NO: 6806500 - DNA, 66 bp, Homo sapiens
aatacagatgttggccaagtcactggttaatgaacattattattcattttggctcacattagtatt

SEQ ID NO: 6806501 - DNA, 55 bp, Homo sapiens
tagtgtcatcgttgcagctgagtccttaaattctcctagtggaaggaagacacta

SEQ ID NO: 6806502 - DNA, 97 bp, Homo sapiens
ggttactagagcctggttattggagcctggttactagagcctggttattggagcctggttactagagcctggttattggagcctcgttactggagcc

SEQ ID NO: 6806503 - DNA, 75 bp, Homo sapiens
cccaaaagatgattccagaacaatgtggacgtatagcgacagagatatacacatgttattgtggaagctgctggg

SEQ ID NO: 6806504 - DNA, 74 bp, Homo sapiens
gttgtcagggagagcctgtctgacgtgaggcctggaaagccccgctccaggtcagcatgctcctctctgttgat

SEQ ID NO: 6806505 - DNA, 78 bp, Homo sapiens
ttatcttcctcgccttgagacagtggggtgttgccggacgttttcttgcggtgtgggtgtgtttcgtgggggagataa

SEQ ID NO: 6806506 - DNA, 73 bp, Homo sapiens
tggagcaaggagggcaaacgtaaggttgaataacgaagagtttatagctttgggaatgctctcctgggatcca

SEQ ID NO: 6806507 - DNA, 81 bp, Homo sapiens
tgtaaatgcgaattgatgtcaactcaggagaattgaaactcacatcttctgaactttgacaagtcaattgtgcagaaaaca

SEQ ID NO: 6806508 - DNA, 55 bp, Homo sapiens
tgctttcagtctcggcctcactcagctcctctgtggggccctgggattcagagca

SEQ ID NO: 6806509 - DNA, 107 bp, Homo sapiens
ttatttgtaaaatgggagtgatacctgctttaactgcctcagaggctcagggtcggggggaggctcagagaggcagtggaagtcaggaatatttattttgcacataa

SEQ ID NO: 6806510 - DNA, 91 bp, Homo sapiens
tctttggggtattgataatgtattcttcaaccttgctaaactcactagttctagcagcatttttgtagagtatattgaattttctcaagga

SEQ ID NO: 6806511 - DNA, 67 bp, Homo sapiens
agttatggacattttgtgagaaagttgaagcatctgttctttcctctttttctgatgttccatgatt

SEQ ID NO: 6806512 - DNA, 73 bp, Homo sapiens
ggcggcggcggcagctcgagggccacccgtgcaaatcgcgttgggcgcggggccctgagcggtcgccgcagcc

SEQ ID NO: 6806513 - DNA, 70 bp, Homo sapiens
gacagaaagcaatgtctctgcctggttttaccatctgtcaaaatctcagagtcattgttccttccatgtc

SEQ ID NO: 6806514 - DNA, 97 bp, Homo sapiens
gtccggcaggtaccggtccttccagtggtcgaggaagaccatgtccagtgtgtccacatcatacttcttcttcagctgggggatgatgtcctgggac

SEQ ID NO: 6806515 - DNA, 59 bp, Homo sapiens
catttgtagggagaagccttgttgaacgctagcaggtgcgttacttcactctccagatg

SEQ ID NO: 6806516 - DNA, 78 bp, Homo sapiens
tgctattgtgaataatgctgcaataaacatatgtgtgcatgtgtctttatagcagcatgatttatagtcctttgggta

SEQ ID NO: 6806517 - DNA, 62 bp, Homo sapiens
agcatttctactgtgtcagaaattctcaaactttagagtgtaactgaaacacagagagggct

SEQ ID NO: 6806518 - DNA, 59 bp, Homo sapiens
ttatttcctaaatctctttgttgggttaagtccattctgatataagagaagtggaatga

SEQ ID NO: 6806519 - DNA, 56 bp, Homo sapiens
tcagcatggagacaaagtgggcatggtatgcctgcacgcacttgctctccagcgga

SEQ ID NO: 6806520 - DNA, 81 bp, Homo sapiens
agaactcaggtcatcttaactcccagtcaagagctcagtctgcaaagactaagtcatcgcaggagtttggtgctgatttct

SEQ ID NO: 6806521 - DNA, 60 bp, Homo sapiens
tccaaaacagctagcagtttggttcttgaaagatccctgaattgtatgcagttacttgga

SEQ ID NO: 6806522 - DNA, 58 bp, Homo sapiens
gaagccaggggcctgacaggcacctatgccctggaagcctgattcacctctggacttt

SEQ ID NO: 6806523 - DNA, 58 bp, Homo sapiens
ggtttgggaggtttgatttggacacaatctgagaggagccaggacagacttcaaagcc

SEQ ID NO: 6806524 - DNA, 84 bp, Homo sapiens
ggcagtgagtcttcacataggcagtgttcaagttgtggtcttaactcttagaatgtgaactttgtcatgtaaccactctaggcc

SEQ ID NO: 6806525 - DNA, 57 bp, Homo sapiens
aaaatatggtaattgctagtaacggtctcttagattattactgtagtactacatttt

SEQ ID NO: 6806526 - DNA, 116 bp, Homo sapiens
ggttatgggggagcggggaggtgtatctttccacatcttcagtagtgtcatcttgaggtagggaaggaagtggtggtggtagttggggagatggatatctctgcaatcctaagact

SEQ ID NO: 6806527 - DNA, 108 bp, Homo sapiens
gttctagtcccaccaggtggcgcccgcgttcggcattctgagaacgtttggtgtcttctggactccagaatctggacggtccgaccgcctcgtgcttggtgggtttac

SEQ ID NO: 6806528 - DNA, 64 bp, Homo sapiens
caattagttcagagacctttcattccctgctcagaggaatgaaacacttctgattctcaagttg

SEQ ID NO: 6806529 - DNA, 84 bp, Homo sapiens
gagcaagcaggagagccagcaggcttccctcggctagccccccgcctgggtggcctggaagcccagctgtctcctgtccatctc

SEQ ID NO: 6806530 - DNA, 67 bp, Homo sapiens
cttttcgtggctggataatattctgttgtgtggatatacagcattttgtttattgagtcatgagggg

SEQ ID NO: 6806531 - DNA, 75 bp, Homo sapiens
ggcacactggtttgggaccattatcaacttctatattttgtgtctggaggggatgttatggtcttcatgtgtgcc

SEQ ID NO: 6806532 - DNA, 62 bp, Homo sapiens
cacatttccttcctggggagggaagtataagttttccccatccatccatggatggaaatgtg

SEQ ID NO: 6806533 - DNA, 91 bp, Homo sapiens
atgggtggaaggaagagagtgtttgtttccgtggctgtctccctgcaagggggcccagaggaggcaaagctctgttagttgtcccatccat

SEQ ID NO: 6806534 - DNA, 55 bp, Homo sapiens
agacgggaacagaggaggcaaagcccaacccagccctgtctcctccccgccgtct

SEQ ID NO: 6806535 - DNA, 68 bp, Homo sapiens
taaagccctcctgagaattttcagttggatataaacactattcaattgtattggtccaggaatcttta

SEQ ID NO: 6806536 - DNA, 76 bp, Homo sapiens
ggtgctgagattgtagtggaacactcatcagtggggtcagggctcctgctgagatggccactgggtctcatgctct

SEQ ID NO: 6806537 - DNA, 85 bp, Homo sapiens
gttttagattggggtggtgagggcgcaggggcccggtaggattctctaacagggcagcagccactcatttagcaacaggagaggc

SEQ ID NO: 6806538 - DNA, 59 bp, Homo sapiens
ggtttctgtggttctgagatgattgctaatgagaataagccagatacaccactgaaacc

SEQ ID NO: 6806539 - DNA, 58 bp, Homo sapiens
aatcaataaatgcaatcaatttttatgggccattggtgaaggtgagcatttgctgatt

SEQ ID NO: 6806540 - DNA, 76 bp, Homo sapiens
tatcatggcctaggtttttccaaaaagccagactctgggaagaacctggagtggaggaaaaaaccaggcagaggta

SEQ ID NO: 6806541 - DNA, 103 bp, Homo sapiens
gagctgaggatctggacagtccaaaaagtgcagcccaagagactctgttgacctcaatcacagatttttctccagggctttgtgtttttgtcctctttggctt

SEQ ID NO: 6806542 - DNA, 73 bp, Homo sapiens
gttgcctgagtcaggacaaggtggtctccagagaaacttcaacttttggggtaccacaatctggaatggtagc

SEQ ID NO: 6806543 - DNA, 61 bp, Homo sapiens
tctgtttcttggctagcctcttagcattgaacatgaaagaggctgaatgagaaagtacaga

SEQ ID NO: 6806544 - DNA, 63 bp, Homo sapiens
gtgtgggcagccctctccccagctcggtgcacaccaggctctgtgaagggtgttgctcaccgc

SEQ ID NO: 6806545 - DNA, 64 bp, Homo sapiens
ttgagttgcttctaagacaatctgttagagatgctcatcaggcaggtaggatggaagggctcaa

SEQ ID NO: 6806546 - DNA, 66 bp, Homo sapiens
ggatgaagcacagaatggttaacatgtcgttatgctgtcagttgacaaatttttgctgctatattc

SEQ ID NO: 6806547 - DNA, 69 bp, Homo sapiens
tagtgacctttgaacagcccagggatgcttcacagtgtcttattcttgatgcttgtttaaaggtttcta

SEQ ID NO: 6806548 - DNA, 59 bp, Homo sapiens
ctgcttcctccctgtaaaggcaggtggtgggggagccgttctgtgcagtggaggggcag

SEQ ID NO: 6806549 - DNA, 74 bp, Homo sapiens
cttctcactggaaaccctacaagggtgggaacgtgccttatttgcctgtatcctcagggtctagcagagagaag

SEQ ID NO: 6806550 - DNA, 72 bp, Homo sapiens
cgggggcggcgtcggactggagccgagcggcagcgcgagctgcccagggcgctgtcgtgagctcgcccgccg

SEQ ID NO: 6806551 - DNA, 81 bp, Homo sapiens
gcctgtcagcctttttaatatttatataattttctttgaaagagcttagtgaagttatttcctggtgttggaggctggggc

SEQ ID NO: 6806552 - DNA, 84 bp, Homo sapiens
tccctattttaatatatcttatgtttaaattccaatgatcatatattagggctgtttaaaagtgaggtgcattcataccaggga

SEQ ID NO: 6806553 - DNA, 74 bp, Homo sapiens
cacacagagtccttactgaggtagaccagctgacagaataaacgccatagggatgcttgtaagaactcagtgtg

SEQ ID NO: 6806554 - DNA, 70 bp, Homo sapiens
gttatgttgatctctgggtcctgttggcctcccttctgaggctacaagctccatgagagcagcctttgac

SEQ ID NO: 6806555 - DNA, 76 bp, Homo sapiens
aggttacaggctagctggttcttctgctcggtgtctcaccaggctgaaatctagggaccagctagggctgtgacct

SEQ ID NO: 6806556 - DNA, 62 bp, Homo sapiens
ttcccaggccttcctcaagcacctataaatatacatacacagtgcagggcctaaaaagggaa

SEQ ID NO: 6806557 - DNA, 63 bp, Homo sapiens
ccatttgaagacttagaagaggacaaaggagatagaagcgtccctaagggagtttgcaggtgg

SEQ ID NO: 6806558 - DNA, 65 bp, Homo sapiens
agtgaccgaggcacttggcaacactccttcctccagcatcactgtcactagtgccttctgtcatt

SEQ ID NO: 6806559 - DNA, 56 bp, Homo sapiens
gctctggcccctatggcggtggaggcaatactttgcaaaaccaaggtggctatggc

SEQ ID NO: 6806560 - DNA, 129 bp, Homo sapiens
aatgaggttagaaacgtggtctagaataagatcatctagggccttggaggccatgatgaggatgtggattttatgctaaattgaaaggccctggatggttttgagaagggacatgatctagtttgcatt

SEQ ID NO: 6806561 - DNA, 78 bp, Homo sapiens
gtgtgtatgtgtgtacaaatttcatgtaaagcctcatatttagaggtctatttttacagagaatgtacataaagctac

SEQ ID NO: 6806562 - DNA, 99 bp, Homo sapiens
ctaaattaattgaagcctgtgactcttaaatatactgttgaatgatgccattggattgtaatataacagtttgaatataggtgccagtgctatgtttag

SEQ ID NO: 6806563 - DNA, 79 bp, Homo sapiens
ggaaatagagaaatcttgctccacacccgtccttcattcatatcgcatgactcaaggagcaagagatttccctacctcc

SEQ ID NO: 6806564 - DNA, 73 bp, Homo sapiens
cattcagagtgcttgcatatttattgtctcattgacttctcacaagggactggaaggcaagtatttctgtgtg

SEQ ID NO: 6806565 - DNA, 84 bp, Homo sapiens
ggctattttcacttcttttgtggatcttctgttgcttcgggccatctggatgtatacgtgcaggtcacaggggatatgatggct

SEQ ID NO: 6806566 - DNA, 67 bp, Homo sapiens
tgaacaagcatcaggaaaaattgtgaaagggtttgaaataggcctaaaacattcctgggtgtcttca

SEQ ID NO: 6806567 - DNA, 101 bp, Homo sapiens
gaggaaaacatgttttccctccatttccttcacatgaggatttccttgagtttaaaatcctgtgttgatagagatggtttatttagaagagcgttggcctc

SEQ ID NO: 6806568 - DNA, 56 bp, Homo sapiens
gctcacttaatttcatgctacaattcttggaagaaaagtggcatagttgattgggc

SEQ ID NO: 6806569 - DNA, 129 bp, Homo sapiens
cccggtaattagtgtaaaccctttgtctgcctttgatacccacagcttctccccgctgcggcttcctccgcctggagcgcgggcggggagggcctgtggggagggcggccagacccctgatccccgcgg

SEQ ID NO: 6806570 - DNA, 94 bp, Homo sapiens
ggtgaaaggcagcgagcatggctggaggccgggcttccttagagatggtcggctgagcaggcttggtccccagcctccccttcctgaaatagct

SEQ ID NO: 6806571 - DNA, 89 bp, Homo sapiens
ggcttgacagcaggctggtggctgcttgcaggggatcttctgggggtctccagttacagcagccaggacccagtgtgcgacttcaggcc

SEQ ID NO: 6806572 - DNA, 69 bp, Homo sapiens
tatttgagagtgtgaatggtataagttgagggtatgaatgttggaaatgaacatattcacctctaaata

SEQ ID NO: 6806573 - DNA, 57 bp, Homo sapiens
aggtgctcagaaacgaggtgcagcccaaaaagatggcccctcctttcctgagcagct

SEQ ID NO: 6806574 - DNA, 64 bp, Homo sapiens
attgagttccaaaatcgccagtggaaaagccataaatgccaatggtaatttgagtggacttagt

SEQ ID NO: 6806575 - DNA, 55 bp, Homo sapiens
acagaattctctctgcagaggcagctacggctgttttgtggaagtaggttcttgt

SEQ ID NO: 6806576 - DNA, 61 bp, Homo sapiens
gtgagactgggggcttggccttttctccagcaaggacaaaaaccattgtcttcagtctcac

SEQ ID NO: 6806577 - DNA, 56 bp, Homo sapiens
gatagcatataagttataaaactgggacaaacacttagtttttcagatatgttgtc

SEQ ID NO: 6806578 - DNA, 64 bp, Homo sapiens
gctgaatccttgttccaaactccagtccccaggaaagccaaggatgtggggttgagggaccagc

SEQ ID NO: 6806579 - DNA, 111 bp, Homo sapiens
tgtaagtataaagtagaacaagagatcagagccagagatgataactaggtccaggtgggggcatagttatcttcccaagctctgatctcttcttccactttatgctttaca

SEQ ID NO: 6806580 - DNA, 123 bp, Homo sapiens
agcgtaggataaaattatactgctgtaggtactttggaatgacagatatcaataacaatttagataatgaagtgtattccagctttatttcaattttctccagctgtaaaattcttgtatgct

SEQ ID NO: 6806581 - DNA, 72 bp, Homo sapiens
gggcccaggccttatctccaccctgcagatagacatctctgctgggctagaagctgaggcccaccatggtcc

SEQ ID NO: 6806582 - DNA, 71 bp, Homo sapiens
aagcctaaagctgttttctgccacccaagggatatttttttctcttcactgtgcttcaagcagctgggttt

SEQ ID NO: 6806583 - DNA, 116 bp, Homo sapiens
gagcaattgtttttgtcaccccttttcttcctggcatgccttgaacatagtggacagtaataattattgttaccatttgtgaaggcttactatgtgccaggaaatgcagtatgctc

SEQ ID NO: 6806584 - DNA, 61 bp, Homo sapiens
gagagagatcttttctgtgtttatggatacttgagcaaaaatacagaaggcagactctctc

SEQ ID NO: 6806585 - DNA, 130 bp, Homo sapiens
tgactcagttgtttatcaaagttaggactgaaattagaagtgagcctaagagatgcaacatggaaaatttaaagcatctaatgggtaaatatttttatttccatttttctgatgaaaaattcgaagttca

SEQ ID NO: 6806586 - DNA, 55 bp, Homo sapiens
agagtgcatttttagagcttttagcaaaaatgtgaaaagttcatgtttgcacttt

SEQ ID NO: 6806587 - DNA, 62 bp, Homo sapiens
ctcctctggcttcctggaggcattggggattgacaggcttatctgggacagggcctgaggag

SEQ ID NO: 6806588 - DNA, 77 bp, Homo sapiens
cccgggagtgcctgggggaggtgcaaggccacctgctgagcatgggttctggagggcctcccttggtgtctcccggg

SEQ ID NO: 6806589 - DNA, 129 bp, Homo sapiens
gaaacatcagcatcacctgagaactttatattagagatgcagattctctgccctactccatctgctgaatcaggaactctggggttggggcccagcagtctgcgttttcacaggaaccctgggtgattc

SEQ ID NO: 6806590 - DNA, 65 bp, Homo sapiens
ggccatgcattcctcctctgccttataaatcttgatgtgccaggtacgggagggattgcttagtt

SEQ ID NO: 6806591 - DNA, 117 bp, Homo sapiens
tgagtgtgattatttaatagtttactgtcttgcacagtgcaagtagtgactgagtgtgattatttaatagtttactgtcttgcacagtgcacttcactgctctaagtaacagactca

SEQ ID NO: 6806592 - DNA, 57 bp, Homo sapiens
gtcctgtccctgggtccctggctttgccctgtgcttgtcaggagcctaggacatgat

SEQ ID NO: 6806593 - DNA, 64 bp, Homo sapiens
cttccctctccaggagccctgagctctggttcaggtagtttaactgttccactggagagagaag

SEQ ID NO: 6806594 - DNA, 78 bp, Homo sapiens
gttaatgagtgagtccaaggttcatggcacagatggtgccttcacgctcttgtcagaagcctcgaaatatgtattaat

SEQ ID NO: 6806595 - DNA, 66 bp, Homo sapiens
accgaggggtctctctgacagatctggagcccccatgaggtccagaatgttctagagccacccggt

SEQ ID NO: 6806596 - DNA, 57 bp, Homo sapiens
gggctgaaaggccgcctcagatgctcctgcacatagcggaaggtggctgaacagttt

SEQ ID NO: 6806597 - DNA, 75 bp, Homo sapiens
tgggggttccgctgtacttcccgtatcaccctccaaaccccacatgacacagggcatgcagcagaacccaaccca

SEQ ID NO: 6806598 - DNA, 65 bp, Homo sapiens
acaagtgcatggaatcagctgtgggtattattgcaaagacggaaatctgattctatttgctctgt

SEQ ID NO: 6806599 - DNA, 61 bp, Homo sapiens
acgtctcccgcccaacaagcaaggctcgtgtgatttctgcctcatctgggactgggagtgt

SEQ ID NO: 6806600 - DNA, 56 bp, Homo sapiens
aggagggctgcttgctgtgtggtgtcagagactgaacaggataggacagtgttcct

SEQ ID NO: 6806601 - DNA, 87 bp, Homo sapiens
atgttggtggcttgccttcttttcctatagaaagaggaagacagagctcttactagggggaggcagagatggcacagcaagagacat

SEQ ID NO: 6806602 - DNA, 69 bp, Homo sapiens
gcatttataaaagatttttctcaggagacggctaataaattagggctcactgagatgaatattaaatgt

SEQ ID NO: 6806603 - DNA, 102 bp, Homo sapiens
tgctatgtgcctaaaaggacatgcaccttatttaaatgatgttttaataaaaataaggcattactgaaggttcatggtccttttttttaaaaggtacataca

SEQ ID NO: 6806604 - DNA, 71 bp, Homo sapiens
gaggtgggaggatcacctgaggtcaggagttcaagaccagcctggccaagatggtgaaacccccccatctc

SEQ ID NO: 6806605 - DNA, 117 bp, Homo sapiens
ttcatttaacatccattcaaagtctgactgtatgttttccagttctttagttcacatcaagcctccaaccaaaggagaaaacatacaggacttcgaaaaaagggatgaagaaatgga

SEQ ID NO: 6806606 - DNA, 71 bp, Homo sapiens
cttgtctcaatcaaagcactgggctttgtagtcgctttccagagccgaggccaatgtgttttatgaaaaag

SEQ ID NO: 6806607 - DNA, 89 bp, Homo sapiens
cacccgacagcttgttagcaatgcagaatcttgggtctcttccctgacctcctgaaccagaatctgcattttaacaagatatccaggtg

SEQ ID NO: 6806608 - DNA, 58 bp, Homo sapiens
cttgcaaaactgaaaggtctgtctgggctcagctgataagatgttttggtttgataag

SEQ ID NO: 6806609 - DNA, 130 bp, Homo sapiens
cagatgaccctcaggcctcgggtggccactttctgggggagccctccatcccttgcggcagcttttccgagagtcggagtggaggcgcggggctggagggctctccggagccgcccaccagggtcctctg

SEQ ID NO: 6806610 - DNA, 64 bp, Homo sapiens
tggttctttgattttaagggagtcattcagtccatctagactgaatttggaactcagagaatta

SEQ ID NO: 6806611 - DNA, 95 bp, Homo sapiens
tcataaataaaatatatgcctagaaattatgtaagacatcagtatattacaggttatcttgtctttgattgataggctatgtaatttgcttgtgg

SEQ ID NO: 6806612 - DNA, 57 bp, Homo sapiens
agccacacttgccaggggaagggacttgtcccaaaagaccctggaggagtgttggct

SEQ ID NO: 6806613 - DNA, 85 bp, Homo sapiens
gcaactgcatctgcaatctctagcagcagcccttccttacgagactgtgtagggcatttgtgggtgttgttattgttgttgttgc

SEQ ID NO: 6806614 - DNA, 62 bp, Homo sapiens
gggaggtcaaaggagtttctgcttctcaccacagatgtagtcagaaacttgctttgccttct

SEQ ID NO: 6806615 - DNA, 75 bp, Homo sapiens
tctctttttagcttttattgaacagaatgtaaattcatacttttaaatattttgttcataatggcaaagagaaga

SEQ ID NO: 6806616 - DNA, 72 bp, Homo sapiens
gtgacccacagcccacccataccaggcccccagctctggccagtgggcctccggggtgagctgtggggtcat

SEQ ID NO: 6806617 - DNA, 113 bp, Homo sapiens
agcaaacaccagctcctatgggccagccctgtgcttggctaagctggggaggcctggggaggaatccaggcctggacgggtggcctgggtggccataaggactagtgtgtgct

SEQ ID NO: 6806618 - DNA, 88 bp, Homo sapiens
tcaggaggtgggcagatgataaatgcatgtgctttgtctgccatctcaaagcttcagttttctattgttaattgttaccaccttctga

SEQ ID NO: 6806619 - DNA, 79 bp, Homo sapiens
ctggctagtcaagatcaatcaatactccttagacagcaccaatttgaggttctgacaagtgttattttttgaaggccag

SEQ ID NO: 6806620 - DNA, 65 bp, Homo sapiens
tggaggttggttacctggattaaatatgttaatggatgtagagctcctaaatgtagccaacccca

SEQ ID NO: 6806621 - DNA, 55 bp, Homo sapiens
ggctgtgtccccacctgagcagtcccaaccacaggctccaggtggagagacaccc

SEQ ID NO: 6806622 - DNA, 77 bp, Homo sapiens
aacactggacactttagagcccagtctttgtgtgaagaaaatgaaattttcacccaggtgtggttaagtgcagtgtt

SEQ ID NO: 6806623 - DNA, 81 bp, Homo sapiens
tccttttgctcctctttctctttcttgtcagtcacattttgcgtattgttctgctgacaatgagaaagagcaaaagaaggg

SEQ ID NO: 6806624 - DNA, 75 bp, Homo sapiens
caggcttggccagacagagaggctttgttaggggaaagagaagctagttgagctttagtgtcaggtagggacctg

SEQ ID NO: 6806625 - DNA, 113 bp, Homo sapiens
tgcaggacacttcgggatgtgggtcacattttgtcctggaatcagtacttaccagcttagtctgaggccttgggacagaagtgctgctcataaaagtaaattgtgtttctgca

SEQ ID NO: 6806626 - DNA, 69 bp, Homo sapiens
ctggtggccatccttggccctggccaggagcaggccacagaactgccggtgggccaggaaggccgccag

SEQ ID NO: 6806627 - DNA, 75 bp, Homo sapiens
ggctttattccaggccttgttgggacctttgtgctctggtgagagcaattcccacatatgcaatcctgaataacc

SEQ ID NO: 6806628 - DNA, 88 bp, Homo sapiens
cagtggtgttcttgtcagtgttaatcagtggtacctgaagagaggttttctgggtttctgtttctttaatgaggacgaaacacacctg

SEQ ID NO: 6806629 - DNA, 93 bp, Homo sapiens
ttcttttttgtggtctccagatacttagccatcattgattgctataatccttattaagtatttgaagatgttgagtaccatccactgaaggag

SEQ ID NO: 6806630 - DNA, 55 bp, Homo sapiens
ccttgcagttgttactgtagcctctctgagcctcagtttcctcaactgcaaaagg

SEQ ID NO: 6806631 - DNA, 80 bp, Homo sapiens
ttgcttgtaagtttggtttcagaggtcagttatgtgccactgatgctgacttgttcttgagccagtaccttgctggacag

SEQ ID NO: 6806632 - DNA, 61 bp, Homo sapiens
tagcattcacccacatacccagggcctatggagaaccaggttgggatgagtgggtgagcta

SEQ ID NO: 6806633 - DNA, 72 bp, Homo sapiens
ggcattcctgcagagagtaactgaaatatagacagtaactctatgcctttcatgtgactcctgttgatagcc

SEQ ID NO: 6806634 - DNA, 69 bp, Homo sapiens
atctataaaattagtcaaaacactgagtgttacaaaaatagttcagtgttttaactgtcttttaggggt

SEQ ID NO: 6806635 - DNA, 57 bp, Homo sapiens
ctggcttgcagctcatcataaagtaaaatgtggtaccaaatggtgaaggcaatccag

SEQ ID NO: 6806636 - DNA, 95 bp, Homo sapiens
ccacattatgtcctacctcctctggtttatatcatttttgttcctttactgttgttttgttatggactctggaggagatagagataataaaatgg

SEQ ID NO: 6806637 - DNA, 77 bp, Homo sapiens
tttaaaaaagtgttgggaagaaagtgcagtgactctattctgattttcactgcatattctcctttattttgtttgag

SEQ ID NO: 6806638 - DNA, 71 bp, Homo sapiens
agcctggatgaacagcaggtcctggcatgggtgctgcacacccgagctctgacccctgctgctcccttgtt

SEQ ID NO: 6806639 - DNA, 82 bp, Homo sapiens
taatggaataatccttgggaagagaggaatatgaatcttgtgctgatgaaaataatttctcactttctattgtttatcatta

SEQ ID NO: 6806640 - DNA, 60 bp, Homo sapiens
caggtgtcaaaatactaagtggctataagcacacgcaggagagtattttgtaaaaccctg

SEQ ID NO: 6806641 - DNA, 83 bp, Homo sapiens
ccagcaacacagatagtccatctgtttactataaagatttgccaaaaaggtttggagttcatgggtgtgtatgtgtgtgttgg

SEQ ID NO: 6806642 - DNA, 56 bp, Homo sapiens
gtcccaggtgcccagtgggcagccagaagcagcccacactcctgcacacctgggac

SEQ ID NO: 6806643 - DNA, 127 bp, Homo sapiens
atatttgggaataaattccagatcattgctgctgttgcagctgctgttcctcatggtagacaaatctttccaaggcagagggagggcagctgagggtagcacctctggtaagaaagttttaaaatgt

SEQ ID NO: 6806644 - DNA, 58 bp, Homo sapiens
ctggcaggagcattcacagaggagtatcaaattcttttcctgggatgtctcctcccag

SEQ ID NO: 6806645 - DNA, 68 bp, Homo sapiens
cctgctgctctccctttctataaggcaagtgtgagaacaggcttgcaggcaggggatgagcagcctgg

SEQ ID NO: 6806646 - DNA, 92 bp, Homo sapiens
aagaacatgaaagttattactgatgatgtcccgcaatctgatcaaacacttaagggacagccgtcacgttatgattttaccgcactgttctt

SEQ ID NO: 6806647 - DNA, 71 bp, Homo sapiens
ccacatcagaaatgtttactcagtgactgttccttgatctgctgctgactctaacatgacatctgaagtgg

SEQ ID NO: 6806648 - DNA, 93 bp, Homo sapiens
gtttcagaaagtctggaaatgcccccatctcagtcgtgctaagggcttgtgcacttagcccaatgctgaatggacagggtggctgcctggaac

SEQ ID NO: 6806649 - DNA, 113 bp, Homo sapiens
ccatgcagtcattctcaaaagggacaatctggcagctctcctcggcggactcatcctgtgcatggtcctccagggtggcggctgccacttcttggttggttttcttctcgtgg

SEQ ID NO: 6806650 - DNA, 71 bp, Homo sapiens
aggtaatatatttgcattttaaacaggcaccttatcctagaggactgcctgatgcaggagtatcagagcct

SEQ ID NO: 6806651 - DNA, 76 bp, Homo sapiens
ttctgttcacccaagggcttgtgatttcacgctcatgtggaaacatgaggtaagcactgggcccaagtggacagga

SEQ ID NO: 6806652 - DNA, 91 bp, Homo sapiens
tattttctttattgattgaggagtgctatcttctttttaggtaatgctgaacctataagatgagatcagctttctgttttaaagattgata

SEQ ID NO: 6806653 - DNA, 65 bp, Homo sapiens
tcatactgtgaattttccaatattccgttaggaaagctccctggaatttcagaagagcagcatga

SEQ ID NO: 6806654 - DNA, 77 bp, Homo sapiens
gttagaaagttattgccacagacacgtgagtcctaaatgcaattgtgcttacgttcaatgtcagtcaactttctgac

SEQ ID NO: 6806655 - DNA, 76 bp, Homo sapiens
ttttgttttataggtcctgtgagattcatgctcaaagaggttctgttttgatgtgtttccaggatttgtttcaaga

SEQ ID NO: 6806656 - DNA, 58 bp, Homo sapiens
agacaggcttggaaaaaacctccccttcccaccactggcagagcccaagcagctgtct

SEQ ID NO: 6806657 - DNA, 65 bp, Homo sapiens
ttgcatgtgtaatttttctaaaggttcccatattcctctaccctctagaatggttacagcagcaa

SEQ ID NO: 6806658 - DNA, 77 bp, Homo sapiens
tgggcaccttgggtttgtgccatggtccaggggcagtctggactttcctggccagaggacaaagctggattggccta

SEQ ID NO: 6806659 - DNA, 61 bp, Homo sapiens
ttgtagcctttctgtctcactttctgtcattttgtgggatttggggcggaagggaagataa

SEQ ID NO: 6806660 - DNA, 59 bp, Homo sapiens
ctgccctatgggcgtctgttgtctggatctgctcacgagcagcagagacccatggggag

SEQ ID NO: 6806661 - DNA, 115 bp, Homo sapiens
ctaattctaacttcattttgctttccagtggttttctgcttagcattttagctgttttctctgagaagcttaagaatagggaaaatgtctagagggggaaaccactgagaattgg

SEQ ID NO: 6806662 - DNA, 67 bp, Homo sapiens
cattattggtacaccgtagtcattttctacttttcaatgactttgaaaatgatcttgtacagtagtg

SEQ ID NO: 6806663 - DNA, 61 bp, Homo sapiens
ctgaaatctcagctcatgcaattccagagagaatctctagttcaacgagttggggttgcag

SEQ ID NO: 6806664 - DNA, 92 bp, Homo sapiens
gcttggcttgcaaggggttaacagtattgctcatgaacttggcctgtctgtctggctcgtgatgaatggtgagacccgctgacaagttcagc

SEQ ID NO: 6806665 - DNA, 58 bp, Homo sapiens
tgcaaatgggtgagggttaggattatttattcaatgatttcattttttcctatttgta

SEQ ID NO: 6806666 - DNA, 60 bp, Homo sapiens
cagggttgggctccaaggatggaatggcaagctggcatcccaccgatggtcccaacactg

SEQ ID NO: 6806667 - DNA, 83 bp, Homo sapiens
tattaggttggtgcaaaagtaattgcagttttgccatttaaaagtaatggcaaaactgcaattacttttgcaccaacctaata

SEQ ID NO: 6806668 - DNA, 69 bp, Homo sapiens
aagcaaacatcccagaggttcaagttaactgaggccgactcctggctaggacctctgcggagcatgctt

SEQ ID NO: 6806669 - DNA, 71 bp, Homo sapiens
tgtcatggcttgtctatgagtgctctggtcatctcgccagaccatgagctcaccacaggcagaacctggca

SEQ ID NO: 6806670 - DNA, 63 bp, Homo sapiens
aagatcactgagcttcagtgctggcctagaaataagctgggaaagctctctcctcaggacctt

SEQ ID NO: 6806671 - DNA, 77 bp, Homo sapiens
gacctcaggatgtactacagaaggcaatcatctataggcattcttgcatttggagccatctggtatttcctgacttc

SEQ ID NO: 6806672 - DNA, 56 bp, Homo sapiens
gtccttccccagccagctctgggccatctccttggcccggagtgttggagggaggc

SEQ ID NO: 6806673 - DNA, 82 bp, Homo sapiens
tttgacatacatattaaatcaagaatatcagcttgtcagcttgttaatgaatgagaagttttgttgaatgtgtgaagtcaga

SEQ ID NO: 6806674 - DNA, 60 bp, Homo sapiens
gcagcagctctgaatgggcccctgaggctgcacaggggcctttgtcactggggcgcatgc

SEQ ID NO: 6806675 - DNA, 57 bp, Homo sapiens
gctcaattcaacacatgcacattgccacttgggtaaatacatgcagtgaattgcagt

SEQ ID NO: 6806676 - DNA, 71 bp, Homo sapiens
ggaattcttcagaatatctggcactgaaacatattggcttcaattaaaaggctatgatttctgtgaattcc

SEQ ID NO: 6806677 - DNA, 82 bp, Homo sapiens
gggatgaacagacagacactcggtgaatttttctagcgtagcaattacatatgatctattcaactgggctgtttaccatctc

SEQ ID NO: 6806678 - DNA, 82 bp, Homo sapiens
tttgaaagactaaatacaaatctctacttgtaagagctaataagtggctttcttatttagaagatttgtgtgttattttgaa

SEQ ID NO: 6806679 - DNA, 104 bp, Homo sapiens
tgaggcggagtctcgctctgttgttgcctaggctggagtgtagtggtaccatctcggctcactgcaacctccgcctcccgggctcaagcaattctcctgcctca

SEQ ID NO: 6806680 - DNA, 76 bp, Homo sapiens
tcatcctggatgcaccgggcacaggtcacacacatgaagcaggaggggtggaaggcctggcccagggccctgatga

SEQ ID NO: 6806681 - DNA, 73 bp, Homo sapiens
gacaaaggataaatgatctagattttcttccagaaggaggtttggttccatttgctgctttcttttctttgtt

SEQ ID NO: 6806682 - DNA, 60 bp, Homo sapiens
agtcaatttcagatcaaaattccttctacctacaagggtctgaggtttctgaagtgggct

SEQ ID NO: 6806683 - DNA, 81 bp, Homo sapiens
tggttaacctttctgtaatagagatggcagctgaagtgttgagcaaaccaacctctagtatctgtcgtactccagtgacca

SEQ ID NO: 6806684 - DNA, 88 bp, Homo sapiens
cattgtccaccaattagcccaaggctgactcaacagggggcccccgtgctgggggcctccattcagacagcctgtggctggggctttg

SEQ ID NO: 6806685 - DNA, 70 bp, Homo sapiens
ggctgtgtgatgtgtcatctgagagagtgggtaacccctattcccagcacatggccatttatttagagcc

SEQ ID NO: 6806686 - DNA, 75 bp, Homo sapiens
tggcatatgaacactttggaatagagataggcattccaggtgggagtctgtgtcacaggctaaagtgtgatacca

SEQ ID NO: 6806687 - DNA, 89 bp, Homo sapiens
gcagactggaattggctgcaggccaccaagttgcaggttctgacagctccactgtcactgggaggcatctggagctgattccaagctgc

SEQ ID NO: 6806688 - DNA, 68 bp, Homo sapiens
ctaaatataccagttgcctgcatccattatatgatgttgaaataggtgcctgttcttggcatatttgg

SEQ ID NO: 6806689 - DNA, 58 bp, Homo sapiens
agttttacagacaatttcagaggcttcatgaagtccctgaaacatctctgtggatcct

SEQ ID NO: 6806690 - DNA, 58 bp, Homo sapiens
atggctgtggtatcagacgcagctgggacctgatccagttctgccactgtccagctat

SEQ ID NO: 6806691 - DNA, 62 bp, Homo sapiens
acataccttctcttggagaactcacttaagctgttaagtgagttctccaagagaaggtaagt

SEQ ID NO: 6806692 - DNA, 83 bp, Homo sapiens
caggaatattacttttacccagtgtggtttatagcatacatttgtactgaagcatatagggatgttaatgtgatcttttcctg

SEQ ID NO: 6806693 - DNA, 74 bp, Homo sapiens
gattgaaatataatctctggttcttgtatgtgagatattcccacactgctgaagttactagagactatgcaatc

SEQ ID NO: 6806694 - DNA, 58 bp, Homo sapiens
ctggggtgaaaaagccaggacatgtagttgccatatttacatgccctgttgacttcag

SEQ ID NO: 6806695 - DNA, 80 bp, Homo sapiens
tcaataccagtgatttgcccaacaccttcagtgaagcctctgctctctgagggtctaaggagtcactcgctggtatttga

SEQ ID NO: 6806696 - DNA, 66 bp, Homo sapiens
cttggtagcacggggaagaggtacaaggaagaggtacaaggaatgtaccctttgccggatgccaag

SEQ ID NO: 6806697 - DNA, 106 bp, Homo sapiens
ggcatccctttttgtgtttagcaaaagagctcataacttaatggattcatcagcctgcgttaagtccacaggagttgtgttcactctctaacatccaagaggagcc

SEQ ID NO: 6806698 - DNA, 78 bp, Homo sapiens
caggtcacacaagaagttaatgggcaaagtcaagaacctacatattatggccatttcttaaactcttccctgggcctg

SEQ ID NO: 6806699 - DNA, 77 bp, Homo sapiens
atttatatactgccaggccacagctaaagaggattctttacagaatcaaatttcttgtggttgttccgtatacaagt

SEQ ID NO: 6806700 - DNA, 83 bp, Homo sapiens
tggggagctctccccccactgggccccaccctgaggggagccgggggtggtggccagcagtgggcagggggcagtgcccacca

SEQ ID NO: 6806701 - DNA, 111 bp, Homo sapiens
ggctcaaaacactacactgaatcttatggttagctaaaacagtttggacataggctctatgctcatgcttcttgtatttggctgacttagagaatgtgagtgtttactgct

SEQ ID NO: 6806702 - DNA, 55 bp, Homo sapiens
agatcattgcaatgggtgaaattaagttaaatgtatttcactaattgtaagattt

SEQ ID NO: 6806703 - DNA, 60 bp, Homo sapiens
aggtgcggagggagcagtcggctgtgggcgctcggaccacaggctgcccgctccccacct

SEQ ID NO: 6806704 - DNA, 95 bp, Homo sapiens
tatgttatatatatgtacagtttggtaaaatcatagtggtaactgagaggttgtgtctattgttatatttactgagcatatacatgcatcacata

SEQ ID NO: 6806705 - DNA, 76 bp, Homo sapiens
tgtgcctaagttaaggatcttgagatgatgagataattcttgattatcatctgagtgggtcctaaatgttattaca

SEQ ID NO: 6806706 - DNA, 64 bp, Homo sapiens
tgtcctctttgcatgcattttcccttacatttagatgtgaggaaagaaatagcaaggattgaca

SEQ ID NO: 6806707 - DNA, 61 bp, Homo sapiens
ggtgctgatgagttaggagaggtcatcaaaggtgatatttggccaaacccattatagtact

SEQ ID NO: 6806708 - DNA, 69 bp, Homo sapiens
cagctgcatggagggtgcccaggaggggacggtggctgcacctcaatccagctcccttcaatggcactg

SEQ ID NO: 6806709 - DNA, 71 bp, Homo sapiens
gctgtgaaatgttaacaatagagtttcttcaggatcaaattctgtgtagtcactattttaacatctatagc

SEQ ID NO: 6806710 - DNA, 117 bp, Homo sapiens
cctggcataattcctgatacagactggaatcctaaataaattaagaaaggattggtggcatgtcaaattcctttaacttgattattttcatcatcatgtcaggatgtcaatctcagg

SEQ ID NO: 6806711 - DNA, 88 bp, Homo sapiens
aacctgaacattcttgataaattgaggttttgaggcagaaactccatcgtcactaccttaatgtatgcacctaaggaaactcagagtt

SEQ ID NO: 6806712 - DNA, 64 bp, Homo sapiens
tagcttctaatacttaccaattgcattttaatatcacttgtttctggtagtctaggggaggctg

SEQ ID NO: 6806713 - DNA, 58 bp, Homo sapiens
cacatatccatctttgaaactttaagtttagataatgcagctcaaagatgggtaaatg

SEQ ID NO: 6806714 - DNA, 76 bp, Homo sapiens
gtgcaaatggtttggactattcaatagcccaaatggtcaaatggttttgggctattgaatagcccaaatcattcac

SEQ ID NO: 6806715 - DNA, 61 bp, Homo sapiens
gtcatagtgaattagtgtcccatgttatgtaacacagcttgtaactcctatttactatgac

SEQ ID NO: 6806716 - DNA, 75 bp, Homo sapiens
aagaagcctgtttagactcaaaattgaaaggcaaagagttggcatttttaataggtctagacacagttatttctt

SEQ ID NO: 6806717 - DNA, 76 bp, Homo sapiens
gggccattcctccttcccattcctgggggagacactggagcagcccccatgggtgtagggaggtggattggacacc

SEQ ID NO: 6806718 - DNA, 91 bp, Homo sapiens
ttctttaaaagcaccttccagatttgcacggcggagggaaatttcatctgggcagttctgtgcaggatctgggaggggtgctaatggggag

SEQ ID NO: 6806719 - DNA, 65 bp, Homo sapiens
gtggtggaaaatatttcttgtccatcttcgtgcctcccataatgtgactttgtgtcttccatcac

SEQ ID NO: 6806720 - DNA, 84 bp, Homo sapiens
gggagcaaaacagcatttctattaagtatgtaaacaagccagcaggatgcctaggcttgttatctgcgtgaagaaaatgcttcc

SEQ ID NO: 6806721 - DNA, 62 bp, Homo sapiens
gtctgacacagtgattagtaaattaattcaacaaattattgagcatctactgtgttccagac

SEQ ID NO: 6806722 - DNA, 68 bp, Homo sapiens
ggggttgggtgtgggccctgatgtcagcatgttggggaatctgtctggcatagttgctccctgactct

SEQ ID NO: 6806723 - DNA, 70 bp, Homo sapiens
tctttacaggaaaaggtggctgtggccattaccaagttattaaaaccacagagatcttgacttgtatgga

SEQ ID NO: 6806724 - DNA, 111 bp, Homo sapiens
gcactggggagagcacatcagcaaaggggaaccggaggcctcgaggagcatgcaggccaaggctccgcttcttagtccatccctcctttgactctgatttcatcaccttgc

SEQ ID NO: 6806725 - DNA, 91 bp, Homo sapiens
ccagtgggtaggggctcctctctgagagtagagaccaccagaccacaagtctacttccaggggtggggctcaggtcagctgctagcactgg

SEQ ID NO: 6806726 - DNA, 88 bp, Homo sapiens
gtgtcagctaccagatgcttcctctacggcctctgagatgcactcatgtgacttcagagcttggagggaggattcctggttctgaggc

SEQ ID NO: 6806727 - DNA, 61 bp, Homo sapiens
ggttggttgttcttgttttgcctcctacatcctaaacttggagctgaacaagtcagcaacc

SEQ ID NO: 6806728 - DNA, 102 bp, Homo sapiens
ccacacccttgctgtcatgggattcaggccaggcctggacagcctgagacacctctgtccttactgcttctggcttagtcctcatcccagagaaggctgtgg

SEQ ID NO: 6806729 - DNA, 59 bp, Homo sapiens
tggtttgtatatgtttgtgagatctagcttctgaggaatctcatacatagtaggaacca

SEQ ID NO: 6806730 - DNA, 99 bp, Homo sapiens
ttgtcttctgctgcccacaaatctaacctccctaattaggaaccgtattatttatgtatgtatcctgaggatggttgaagtgcatggcaggcagtacaa

SEQ ID NO: 6806731 - DNA, 79 bp, Homo sapiens
gccatggaggctgtgctcagagctccagctctcctcgtctggtagaggtggggggagcttgggagctgccaacagtggc

SEQ ID NO: 6806732 - DNA, 93 bp, Homo sapiens
gatgtgcacggaggcccctccctgccctgggcagaagtgggcgcaggtgttcacaactgcctccggggcactgattggcccccctgtaccatc

SEQ ID NO: 6806733 - DNA, 59 bp, Homo sapiens
gcacttggaggtgcccacacagaatataatatctcgtgacaggatgtctctccacgtgc

SEQ ID NO: 6806734 - DNA, 76 bp, Homo sapiens
cttgatttcagtggtgatgctgtccatgtccagggagcggctgttgtccatggacagcaccacagatgtgttcgag

SEQ ID NO: 6806735 - DNA, 104 bp, Homo sapiens
acactggatttaaactgcctgtgaagctcttttcaccattaaagtgtaggaaaatagactttttaggggaaagagagatgttcattggagtttgggttttttgt

SEQ ID NO: 6806736 - DNA, 63 bp, Homo sapiens
agatgtgatagcatgccagtgaaagacctggacctggtagctataagcatgctgattacattt

SEQ ID NO: 6806737 - DNA, 86 bp, Homo sapiens
gcattgtttatgatcatgtttgtaggtcctgcttgccaaccagattttaatctcttgtaagaggatctcaaactctaaaacagtgt

SEQ ID NO: 6806738 - DNA, 73 bp, Homo sapiens
tgagaaagaaggactctgcattttcctggctctctcctctacttgcttaggcatccagggttcttccgccttg

SEQ ID NO: 6806739 - DNA, 68 bp, Homo sapiens
gctcgaagtcagtttaaggcagagtattgctatctcttgcatctcaagattctgctttctgatagagc

SEQ ID NO: 6806740 - DNA, 76 bp, Homo sapiens
ccctactatcaaggtttcatggaaaatctaggcaaggcagaacttcctcagaaggacaagagacaaagaagtgggg

SEQ ID NO: 6806741 - DNA, 102 bp, Homo sapiens
aagcctgagttttttttaactgtggcttcaccccagttgtctctggggtcctctaacctggagataacaataaagaagcacaaggttggagagaatttactt

SEQ ID NO: 6806742 - DNA, 74 bp, Homo sapiens
cagcttgcaagactctgccttgcctacagagggtgctcaatgcctgtctgttagagaggtagttcttgattctg

SEQ ID NO: 6806743 - DNA, 99 bp, Homo sapiens
tcccagataataagctgtcttcctccagagcttcatcctgccccgctgggagttgactggggccaagatcaggggatttggcaggcaggcagcctggga

SEQ ID NO: 6806744 - DNA, 57 bp, Homo sapiens
tagcttcttatttcctagttttctttgcaaataagaaaactgaggagatgaggacta

SEQ ID NO: 6806745 - DNA, 57 bp, Homo sapiens
ttcaactgtgtctatgctgcctgctgtctgctgcgggaagtgtcagaattcattgaa

SEQ ID NO: 6806746 - DNA, 67 bp, Homo sapiens
gtagtggcagagccaggtttctgattcatatttttctgattccagagcctaagatctgatcctctgc

SEQ ID NO: 6806747 - DNA, 63 bp, Homo sapiens
ttctgtctatcccttccttcctttgcaaaatctttgcagggagaaacatgggatagtgcagga

SEQ ID NO: 6806748 - DNA, 76 bp, Homo sapiens
agtgcccactgcagggtgcttagggggtttggcaggcaatgggatgctctccttctcctctgcaatgactggcact

SEQ ID NO: 6806749 - DNA, 57 bp, Homo sapiens
aactgtgctgtggggagatagtaaaaatggatgtaggtcatctttccatagcatgtt

SEQ ID NO: 6806750 - DNA, 60 bp, Homo sapiens
gtctcagtgccttacagggaatggtagaaactggaaaatctacaagtaaagtattgggac

SEQ ID NO: 6806751 - DNA, 62 bp, Homo sapiens
tgcacttccaaataccatcacattgtgtgtaagggcttcagcatgtgaatttgggggtgaca

SEQ ID NO: 6806752 - DNA, 101 bp, Homo sapiens
tgaggtgggaggatcacttcaccctgggaggtggaggttgcaatgagccaagattgtgccattgcacttccggctgggtgacagagcaagattccatctca

SEQ ID NO: 6806753 - DNA, 63 bp, Homo sapiens
tttaggtcatctgatgtaacattacagaccagaccttggataatactgcttcagaggcttaga

SEQ ID NO: 6806754 - DNA, 61 bp, Homo sapiens
ccgcagaggcagaccctccagggcggtgcagcacctccacggcgtcgtctaccatctgtgg

SEQ ID NO: 6806755 - DNA, 74 bp, Homo sapiens
gaagtaggctaggctgaaggttttggagtctacaaatcctgatctctgagttcaaatcccagctctaccacttc

SEQ ID NO: 6806756 - DNA, 56 bp, Homo sapiens
ggacttctattaatacctctactctagcaaccagctaagtgggtaatagaggctcc

SEQ ID NO: 6806757 - DNA, 69 bp, Homo sapiens
gcctggggataggagattgggagtgtttctgtccgaggaacactttttcctcctgtctggttattaggt

SEQ ID NO: 6806758 - DNA, 69 bp, Homo sapiens
cgcaagccagggaagaggcctacctctgtctcagacttggcggccaaggaaggcttcctggaagaggtg

SEQ ID NO: 6806759 - DNA, 92 bp, Homo sapiens
cagagtgagccagggtccagtggcaggcggtgaggtcagggaaggcccggagggcctcatgggccatggagaggactttggctttttctctg

SEQ ID NO: 6806760 - DNA, 78 bp, Homo sapiens
taacggtaacgaacaaaaacaagccccattctctctaatccctgtgagaacaggccttgtttttgttcattactgtta

SEQ ID NO: 6806761 - DNA, 66 bp, Homo sapiens
caggcagcagctcagccgggcactgcagagagagagtctgggcagcatccagcagagctgcaactg

SEQ ID NO: 6806762 - DNA, 62 bp, Homo sapiens
gtgatgtcacagaataagtgatatcacaggataagtggcatcacaggataaggtggcatcac

SEQ ID NO: 6806763 - DNA, 85 bp, Homo sapiens
ctcatgtgtttatttagtacatataatctgccctggttccaagacattcctacagaagatatgtagtacttagtgcatacatgag

SEQ ID NO: 6806764 - DNA, 55 bp, Homo sapiens
tcccacaacctttctgtaaatcactttaatgtgatgttctagaaaatttatggga

SEQ ID NO: 6806765 - DNA, 61 bp, Homo sapiens
gtttaagtccgaaggctggagtggactgatgttgtagttcaagacaggcctctgactcagc

SEQ ID NO: 6806766 - DNA, 73 bp, Homo sapiens
taacaaatttacgttccttaactgttaagtgggccatacttcttgtctaataaagttaggaatttaagtgtta

SEQ ID NO: 6806767 - DNA, 59 bp, Homo sapiens
cagagaggagtgggattgggggggtctcactgtcccggagcctgcactcctaacctctg

SEQ ID NO: 6806768 - DNA, 80 bp, Homo sapiens
tcttaaattcatgtgtttgttgtcaagggcaacaattgggtgtttgggagcactgaacaacaaatagtgaatgaatgaga

SEQ ID NO: 6806769 - DNA, 110 bp, Homo sapiens
taactaagaacttgcttctgcaaagtctggcatgctaatacagcctgtcagccagggaacccagtgaagctgtgcttagcaaccagtccctttgctatctattttggtta

SEQ ID NO: 6806770 - DNA, 56 bp, Homo sapiens
cccctcgaggccttaaaaagctggtaaccaaagagcagctgaagatctggatgggg

SEQ ID NO: 6806771 - DNA, 64 bp, Homo sapiens
catggccctcttctggagcaatgggttcatgaggtttactcttaattatctagaaagggctatg

SEQ ID NO: 6806772 - DNA, 71 bp, Homo sapiens
gcttctgcttcccgcagtggcactctcatcacatatattggtaagtatagaggtgccaaggagaagcaggc

SEQ ID NO: 6806773 - DNA, 64 bp, Homo sapiens
gttgaacccaggagacaggttgcagtgagccaagatcgtgccactgcactccagcctgggcaac

SEQ ID NO: 6806774 - DNA, 96 bp, Homo sapiens
ttcatttcttgatgcaaccttccttagtgttagattctgtgctgtagttggattggaaagtcatgatccactaggggagataagcatttatgtgaa

SEQ ID NO: 6806775 - DNA, 125 bp, Homo sapiens
tggaacatgcagtgttcttttttccttggcttgggttctagagaatgttgtttcctcatttggtaattggagagttaatagggttctttgtgatgctaccgtggaagagagactgttttattcca

SEQ ID NO: 6806776 - DNA, 68 bp, Homo sapiens
tctcactattaattcatctgtttggatggatatgttcacgcatggaaccaagatgaataataatgagg

SEQ ID NO: 6806777 - DNA, 106 bp, Homo sapiens
cttttgctctgaaagaataaagtctttttccatcatttttactcagaaagaaatataaattgaggaaggctgaggctggagaattactttaggccaggagttcaag

SEQ ID NO: 6806778 - DNA, 84 bp, Homo sapiens
gtggggtagtaataagcactttgcatatttgttgtaaggattaaataaaatcatgtgtaaaaagtgcttaatatggtgcttggc

SEQ ID NO: 6806779 - DNA, 77 bp, Homo sapiens
atctgaaagttgtattgacaagaaagcgtcttctttttcagccagtttggctgaattttttgtctttgtaactagat

SEQ ID NO: 6806780 - DNA, 70 bp, Homo sapiens
gtgaggtttgtagttgctttacatctttgggtttgcagttccagaatagaaggcagctgtcattccctac

SEQ ID NO: 6806781 - DNA, 56 bp, Homo sapiens
tttctacagaagatacactgctgttttcatgttacggagtgaattttccctggaaa

SEQ ID NO: 6806782 - DNA, 55 bp, Homo sapiens
tataaagagtctcaaagaagttggctggataaagcctgctgtggaagtctttata

SEQ ID NO: 6806783 - DNA, 77 bp, Homo sapiens
tacagagggcaaggagaagggtaatcaacacagaagactgaaattatcctttccttgcattacttttccctcttgtg

SEQ ID NO: 6806784 - DNA, 56 bp, Homo sapiens
aaggatactaagagaaaggagaggtaaaaactcctacatcagctctcagtagcctt

SEQ ID NO: 6806785 - DNA, 67 bp, Homo sapiens
tgcaatgatgcgtttttatttgtgtgagcgttccttttgaatacattgctagaaatgtatttttgca

SEQ ID NO: 6806786 - DNA, 88 bp, Homo sapiens
caggcctgggtttcctcatctgtaaagtaggaatattgataataatatctacttcatagagtttcatgagaatacatgtaaaggcctg

SEQ ID NO: 6806787 - DNA, 130 bp, Homo sapiens
attcccctgtatcagtgagaatggattttaaaagttcaagacttgtgtggatattatctcactgtcttccttcgggcagatgaagtattacagacatttctttgaatcttgtctattggaattagggagt

SEQ ID NO: 6806788 - DNA, 85 bp, Homo sapiens
ataatggtttcatcctctgaatgtacttcataatcttttttcttgcttaaaaggaatgtgacattttggggtgaatagccattgt

SEQ ID NO: 6806789 - DNA, 71 bp, Homo sapiens
cagatgaattttcagaggacataatttggctcataacacagtcacatacattgcctttggaagttcaagtg

SEQ ID NO: 6806790 - DNA, 73 bp, Homo sapiens
cgctttgaacttggaaccgaggacctttattgtggatccagtaaattaagtttctcgtcaagaacttgaagcg

SEQ ID NO: 6806791 - DNA, 85 bp, Homo sapiens
atcaccgcaccaatcctagaacttagttattatcaccctccttttgtatgtgtggaaactaagactagagagactttgtattgat

SEQ ID NO: 6806792 - DNA, 67 bp, Homo sapiens
agccacttggggtggggagaggcaagtaggcaggtgtctgtccctctcacacctcaccagagtggct

SEQ ID NO: 6806793 - DNA, 55 bp, Homo sapiens
gttggccattaattggaggacacagataattgatctcctagatttctggtcatac

SEQ ID NO: 6806794 - DNA, 55 bp, Homo sapiens
atgtcagtggtagacccagaggttgagaaaaggcttccagaagactcattgacat

SEQ ID NO: 6806795 - DNA, 58 bp, Homo sapiens
ccaaagtgctaggattacaggcatgagccactgcatccagccatcccaagcattttgg

SEQ ID NO: 6806796 - DNA, 129 bp, Homo sapiens
ctctccttaattaattgtaactatagtgtcttatgtggaaaatgcacttaaaaccctcttttctccaaacaaaatggtgttaaaactgcaaatcctactgaaacatgttacagaaaattggcagtaggg

SEQ ID NO: 6806797 - DNA, 90 bp, Homo sapiens
ggtcagcactggaagtcctgatttgtgttttgaaaactcaaatctattgagcaagataagaggggatgcagagaggcttatgtgtagatc

SEQ ID NO: 6806798 - DNA, 98 bp, Homo sapiens
ctccaccactggggaaggagtcggtgccctcggccaccttcctggaggcaagctgctgcccaggagggagaggcgaggccactgtccccaggaaggag

SEQ ID NO: 6806799 - DNA, 70 bp, Homo sapiens
ggcaccagtccgtggccagactcaagagggcaaacgctccactccttgcgatcaactaggattctctgcc

SEQ ID NO: 6806800 - DNA, 79 bp, Homo sapiens
accggctgtctcagctagaggtgaaacatgccaataagatacaatgtaggcaatgggtggccctagaatgactgctggt

SEQ ID NO: 6806801 - DNA, 57 bp, Homo sapiens
gcaggtacaggggctgccatggggtttttatatacctgtgcagtccaatgtgctagc

SEQ ID NO: 6806802 - DNA, 78 bp, Homo sapiens
ttgtctaaaggatctagatggaattgtatatagtatgtacctatctaatagaatttttatttagagttttatagacag

SEQ ID NO: 6806803 - DNA, 77 bp, Homo sapiens
ctgaagaatcaggcgtcaggaaagatagcaaagaggaaagctctaggcatctcatctactgagtttggatgattcag

SEQ ID NO: 6806804 - DNA, 59 bp, Homo sapiens
gagctgggaggactgggaacttgggaagccagggtgaattttctcattcctttccactt

SEQ ID NO: 6806805 - DNA, 59 bp, Homo sapiens
gggctctgcgggcccggactccgctcggtggcagcggaggcccggctcctccagggccc

SEQ ID NO: 6806806 - DNA, 82 bp, Homo sapiens
agcttcctttattttaagacttaatttctggtgatgtcatgattcaaggcatcagaaatagtctttaaaatgaaaagaagct

SEQ ID NO: 6806807 - DNA, 74 bp, Homo sapiens
gtaagcattacaactttagcaaaggtgcattgctttgctttgtttcctttgtatacagttcttgtgatacttac

SEQ ID NO: 6806808 - DNA, 62 bp, Homo sapiens
gttgtgaatagtgccgcaataaacacatgtgcatgtgtctttatagcagcatgatttataat

SEQ ID NO: 6806809 - DNA, 74 bp, Homo sapiens
gagcccagtatgtttgaaatgtaataaaggctaaacagacagctgttatgtattgcacaaactttctgtggctt

SEQ ID NO: 6806810 - DNA, 66 bp, Homo sapiens
attttccagcctttctagaactcgaggttatatataaccctactgacttttgagaagctggaagat

SEQ ID NO: 6806811 - DNA, 74 bp, Homo sapiens
ctgagtgggcatgaaatggccaaccttcggccacccacagctcctaggtgcctggcgccgttttatgcatgcag

SEQ ID NO: 6806812 - DNA, 71 bp, Homo sapiens
tattacagcttgctagtgtgggcttccaaaataactgcatttaaggaagaattgcaatggcacaagtaatg

SEQ ID NO: 6806813 - DNA, 113 bp, Homo sapiens
actctgggggtgggggcgcgggggtacccagcagcaggccaggccctccaagggactggagggactagttggatgcttctgtgtcaccttgcaccccagaattcctccagggt

SEQ ID NO: 6806814 - DNA, 83 bp, Homo sapiens
ttcaggtcaagatgaaatatcttgaagaaattcttttctacagagatgaatccctaagatttttataaaaacagggatctgaa

SEQ ID NO: 6806815 - DNA, 84 bp, Homo sapiens
tgcatagtgagagcagagctttttggactcagacctaaattcaaatcctaggtcttgtatttacttgctctgtgacttaatgca

SEQ ID NO: 6806816 - DNA, 72 bp, Homo sapiens
ctttactttcttctactacttggagaaagaacaaggaaacttgttgatcaccttagctagaggaagagaaag

SEQ ID NO: 6806817 - DNA, 84 bp, Homo sapiens
gttcctctgtttggaagcttttctctgtattacctgttataaacaaatgggtcatctggagaacggtcctttgcagcgtggaac

SEQ ID NO: 6806818 - DNA, 57 bp, Homo sapiens
ggctgtagtcagtgacatggtaaaaagcacgaggctgctgtggtaatgactatatct

SEQ ID NO: 6806819 - DNA, 99 bp, Homo sapiens
gggcatcagggaattcctggcttcccggctgggggaaggggacctcaagagaggaggctgtaaggtcctctgtgcctgctggcgccaggccctgatccc

SEQ ID NO: 6806820 - DNA, 60 bp, Homo sapiens
tattgcatcagtaatttagtgtgtgtgtgtgtgagcactcagaccaaatgtgatgttgtg

SEQ ID NO: 6806821 - DNA, 65 bp, Homo sapiens
ttgatgatttggggctttttgggatttctaggactgagcccaagaatatttcccaagtttctcag

SEQ ID NO: 6806822 - DNA, 75 bp, Homo sapiens
ccactggatgaggaatgatagtaaaagagaatggtaatctcagcaatttttgagtatcatcatttcgtccactgg

SEQ ID NO: 6806823 - DNA, 82 bp, Homo sapiens
ggcattgtctttaaaaatatacaaccaaaacagaaaaatctaagccgtggtgcctggggatgtgtatttggaagacaaaact

SEQ ID NO: 6806824 - DNA, 74 bp, Homo sapiens
ggccactcgcgggctcccagctccgggtgcagtgcccgccccttgcacccctgggccccgcccgcccttgcgcc

SEQ ID NO: 6806825 - DNA, 55 bp, Homo sapiens
gcttctcatcaggcctgcattttacccctgggaaactgaggcttgatgaggcggt

SEQ ID NO: 6806826 - DNA, 75 bp, Homo sapiens
ctggtaaggagcagacctaggatttgaatttggccaatatggcttcagaacctgcaagtctaacctctgaattag

SEQ ID NO: 6806827 - DNA, 60 bp, Homo sapiens
tactggctatgtcccaaatgctacgtcagtagcagagctgcaatatagaccccaaaagta

SEQ ID NO: 6806828 - DNA, 80 bp, Homo sapiens
aaagaatttgcttcaaggcttattccagttgttgacaaaccttagtttgttgaagctgtaggtctgaggtcctgtttttt

SEQ ID NO: 6806829 - DNA, 72 bp, Homo sapiens
gtgttaacacggactagctgaacaaccttgggcaaattacttctctccgagcatcagtgtccctgttaatat

SEQ ID NO: 6806830 - DNA, 67 bp, Homo sapiens
ctggtatcggatttcactccttcctgccttcattcaacaagtagctcctgagtgatgaccgtgccag

SEQ ID NO: 6806831 - DNA, 67 bp, Homo sapiens
cagatttctttagcaagctaaggagagggaaaaaaaatcactttgagcattgcaaaaagaaagcctg

SEQ ID NO: 6806832 - DNA, 66 bp, Homo sapiens
gaagatgagggttatgttagtaggtttgtttgtacagatccattttggtgtcaactcccagtcttt

SEQ ID NO: 6806833 - DNA, 75 bp, Homo sapiens
cacgagataggatggcgagaaagtgagagagagagttcttcactctttagaggtacatctcttctcctgcttgtg

SEQ ID NO: 6806834 - DNA, 65 bp, Homo sapiens
ggtggcggcctccccgggactgtgcactcttgcaggcggccgtatttcctggggatgtggtcacc

SEQ ID NO: 6806835 - DNA, 70 bp, Homo sapiens
gctacatgatgtgtcagtcagctattgctgcttaacaaacaatttcaaagctcactggcatataagaagc

SEQ ID NO: 6806836 - DNA, 80 bp, Homo sapiens
tagttaaaaattttaaattagtttcctggtcacactgggcacattttaagtgctcaaaagacacaggaggctagtgacta

SEQ ID NO: 6806837 - DNA, 73 bp, Homo sapiens
gcatatatgtgtgtgtgtgtgtgtgtgtgcacacttatatttttaatgcatacatcatgctccatatatttgc

SEQ ID NO: 6806838 - DNA, 78 bp, Homo sapiens
gggagttggagtggcagtagatgagctggttgttgactgtgggcagccggtcatcgatgaccacgtccacccattccc

SEQ ID NO: 6806839 - DNA, 62 bp, Homo sapiens
tagtgactaatgaacatataatggtcgtagctttctttacaactatgtcatttaagtcactg

SEQ ID NO: 6806840 - DNA, 77 bp, Homo sapiens
gcttatagatggcggagttggcattatggccagggtctgctttacccccaagtcttgtcccagctctgccactcagc

SEQ ID NO: 6806841 - DNA, 80 bp, Homo sapiens
cctacagggcctaataacattcctcaaagttttcaggagttgtgagttttggaatgatgacatgaatgtggctttgtagg

SEQ ID NO: 6806842 - DNA, 97 bp, Homo sapiens
atgaggaaaagagaaaggacttgggaaagaagtttcaccgatactggtttatggttcttgagacattgttttccaagttgtttatatacagtttcat

SEQ ID NO: 6806843 - DNA, 73 bp, Homo sapiens
ttgtgttttccttgattagtacatgaaggaacagctctgttttgaatgccctgcgtgactggaggttacacag

SEQ ID NO: 6806844 - DNA, 69 bp, Homo sapiens
gcaggcgggctgccagatccttggaatcttctggaatgagagaggttgagctgcagcccaaaggcctgt

SEQ ID NO: 6806845 - DNA, 66 bp, Homo sapiens
tacggccaaagctctggggatagctttttcccgctctttgagaggaggccgatttcagaggtcgta

SEQ ID NO: 6806846 - DNA, 55 bp, Homo sapiens
gcccttctggtataaaaaccgagccaagactcagttatcaaatactatgaagggt

SEQ ID NO: 6806847 - DNA, 56 bp, Homo sapiens
tcccgggagcttcctgctgcgcacgcggcgcgcaccaggagaaaagctttgcggga

SEQ ID NO: 6806848 - DNA, 71 bp, Homo sapiens
ttcttgtatcataattgctccagtgatatattgccaatatatcacttttgaagagaattgacatgcaagga

SEQ ID NO: 6806849 - DNA, 78 bp, Homo sapiens
tcaactctttcttcatacaatttcagacatctctctatggataagaagatgtcagaacaggtatgaagttagggagga

SEQ ID NO: 6806850 - DNA, 56 bp, Homo sapiens
cccagggtggagtacagtggtacagtaatagctcactgtaacctcaaactcctggg

SEQ ID NO: 6806851 - DNA, 60 bp, Homo sapiens
gccccctactgttctgtgcttcagcacagcctggtttgtcaagaggcacatagttggggc

SEQ ID NO: 6806852 - DNA, 64 bp, Homo sapiens
ttggcacttaggtacaagggaatgagactggactcattcaggtatagtatctcagtttgcacaa

SEQ ID NO: 6806853 - DNA, 124 bp, Homo sapiens
ggctggctgtcacatccccactggacaaatgaattacatgtaagatcaaagccagtgaggagtgaggttattggcctgcattggctttggtgtgtgtgtgtgtctgtgtgtgtgtctgtgtgtc

SEQ ID NO: 6806854 - DNA, 80 bp, Homo sapiens
ggggcgtttaccaattcccacagctggtataaataccctccctggtgcttagcaaaggctgctgggagtggggttgcccc

SEQ ID NO: 6806855 - DNA, 87 bp, Homo sapiens
caattttgcatcattcaatgtaagcatatataccattctattatattctagatgtctatgtgaaactacagtgagggtgtgaatttg

SEQ ID NO: 6806856 - DNA, 61 bp, Homo sapiens
tgggctcagccttcatgtggccaatgaaaattgacattttccatatcccaaggttagccta

SEQ ID NO: 6806857 - DNA, 80 bp, Homo sapiens
tttgtcttaagttgcagaatacatttgggattactttgatcacatcacagagatgccatttgtatgcacttttaaacagg

SEQ ID NO: 6806858 - DNA, 63 bp, Homo sapiens
gagcagcacttgaggcatgtcaccagggctagggcaccaatgtggtggttggagtagctgctt

SEQ ID NO: 6806859 - DNA, 61 bp, Homo sapiens
ctcaccatctggttatggaaggcaaatgacaactagtcatgaacttcctagccagactgag

SEQ ID NO: 6806860 - DNA, 60 bp, Homo sapiens
ttataacttgtatatgttattcagagttcagtcacactggatatacatagcaggaaatga

SEQ ID NO: 6806861 - DNA, 56 bp, Homo sapiens
ttttatctacctatgctcatttcctatgattttggggtgaggtgggtgagatagga

SEQ ID NO: 6806862 - DNA, 73 bp, Homo sapiens
gtcattacatatgaactttataacttggagacacaggcccagtaacagaaattaaggttcatatgttcttggc

SEQ ID NO: 6806863 - DNA, 70 bp, Homo sapiens
cttgtgtgttaattttccctttctctgtagaatccagaatggatataagggatgtgaaagaacacaggag

SEQ ID NO: 6806864 - DNA, 104 bp, Homo sapiens
gcccgcccggaccgggccgacggggcgggcggcggggtggagcggccgggccgcgtcgctcacttacctcgcgccggccccgcagggacaaggacggcgagggc

SEQ ID NO: 6806865 - DNA, 69 bp, Homo sapiens
acagtacttaacttataggagagaaacagtgttttaccataaaatgtgcttctgttgtaagtttgctgt

SEQ ID NO: 6806866 - DNA, 71 bp, Homo sapiens
tttctgggcaaatgaatttccctgcaaatgaagtgaattattatatatgtaaaaagatcatttctcagaga

SEQ ID NO: 6806867 - DNA, 61 bp, Homo sapiens
gattcttaagcccagctgtggacctactaattacaatgtctgggggtgaggcctaggaatc

SEQ ID NO: 6806868 - DNA, 77 bp, Homo sapiens
atcatttatgtgtgctttttccatgcatttcaatttaataatttgatatgtaagtttaagcacaacaagaaagtgat

SEQ ID NO: 6806869 - DNA, 89 bp, Homo sapiens
atttggttttggagctgtaaggatttgacagctatgtgactcacagaaatatttaacaggagttgtaaatacagtactgaaactcagat

SEQ ID NO: 6806870 - DNA, 82 bp, Homo sapiens
agcccctgccccattcctgccatctgagggtccagcctggaagccaaggtctgtctttggattgttgcggggggtaggggtt

SEQ ID NO: 6806871 - DNA, 59 bp, Homo sapiens
actttgtaaacatctcaaggtcaaagaccatgtggatacctctggatgtatgcagtagt

SEQ ID NO: 6806872 - DNA, 56 bp, Homo sapiens
gagagctgggttcaagtagctgacaaaatgcagaatgagatttgtaactagctctt

SEQ ID NO: 6806873 - DNA, 65 bp, Homo sapiens
actgtctttcatctttcatgcagggtaaaagaagacaccttggctacagcaagaggaaagaaggt

SEQ ID NO: 6806874 - DNA, 121 bp, Homo sapiens
gcaggggacgctgagaagggctggactgtggttcttgttcatctggcaggcatagccaggcggctcctggggtgggtggactgagattggtccagggtgcccctgtcttagtgtgacctgc

SEQ ID NO: 6806875 - DNA, 82 bp, Homo sapiens
gatccttgtgaggactcaggaccacttgtggccttgtgtgaaggccatcagtggtaactgaatggttctaagcacaattatc

SEQ ID NO: 6806876 - DNA, 77 bp, Homo sapiens
cccaatagctccaatgaggcaaaggtggaggtggggtgttggtttccactggcccacctcctcagtggtcctctggg

SEQ ID NO: 6806877 - DNA, 121 bp, Homo sapiens
gagggcacatgtataattgattattagctaaaggctatttttagatgtttgcctattaccactgaatgcacagatatttttaaacatttgagaagccgtgcatatatatatatatgctttt

SEQ ID NO: 6806878 - DNA, 126 bp, Homo sapiens
gcggcagcggtgtctggctctcgcgctttctccagctgcagttcgttccagctctcccgacttcgcgctcggcgccggagttggtgggctgcagctgcagaccccgcgacgcttcgcccgtgccgc

SEQ ID NO: 6806879 - DNA, 62 bp, Homo sapiens
gccagctttggtgttcattaaacatggtcttgctgcatcaactccagggctccaagctgagt

SEQ ID NO: 6806880 - DNA, 85 bp, Homo sapiens
ggaagcctttccaggtcctttgcaactgggtgcccagcactgcctgtggcacagggggctgaggactagtgtggaattagcatcc

SEQ ID NO: 6806881 - DNA, 66 bp, Homo sapiens
catttactgttgaatccctagcacctgtggtaatgtagggatcctagtaggttcagcacgtatttg

SEQ ID NO: 6806882 - DNA, 61 bp, Homo sapiens
tcttctctgcagcttaggcccagttctttagtatgaggactgggtctatctccagagaaga

SEQ ID NO: 6806883 - DNA, 92 bp, Homo sapiens
aggtcacacagctagtcagaggcagggccaaggttcaaacagattggctagactcatgagccctggcttctaactactatgctatgctacct

SEQ ID NO: 6806884 - DNA, 70 bp, Homo sapiens
ggacctctggcattcttgtttctggaaatattgactgttttttacacaggagcaagagagccatctgtct

SEQ ID NO: 6806885 - DNA, 77 bp, Homo sapiens
aatgaatgacagttggttggacccaagtaaggagttgttagtaagttcctttctggtatttaaccaaagcatttgtt

SEQ ID NO: 6806886 - DNA, 56 bp, Homo sapiens
ggtagatctgaatctcatccgaggagtggaggttcctcaagaatgatggatctgcc

SEQ ID NO: 6806887 - DNA, 72 bp, Homo sapiens
acattttggcaggaagattttcattcaatcacaataaatactgaaaatgagtgccccctcctaccaaaatgt

SEQ ID NO: 6806888 - DNA, 63 bp, Homo sapiens
gccctggcctcctggaacaggcagctctttttcacccccctgcttgctcctggtccccagggc

SEQ ID NO: 6806889 - DNA, 84 bp, Homo sapiens
aggcgtggacaaagttaaaggaagttccagggagggggtttgattttctggtccctgggacggccttttggagagtcctgcact

SEQ ID NO: 6806890 - DNA, 68 bp, Homo sapiens
gaggtagctcagggtcatcttgcatgggaaaggagcttgccaagagggttgccctgagcgtgttcctc

SEQ ID NO: 6806891 - DNA, 65 bp, Homo sapiens
gtcgattctcaggcttgtgcacctgtactgagctccaggtgaacagcagcttcctgggaattgat

SEQ ID NO: 6806892 - DNA, 69 bp, Homo sapiens
ctgctaaacgagtcccggtcccaaaagtcagcttgtctccgctgcttttcttctcacggctgtcagcag

SEQ ID NO: 6806893 - DNA, 98 bp, Homo sapiens
acccaaatctcatcttgaattgtaactcccacaattcctataattcccatatgtcatgggaggaactggtgggaggtgattgaatcatggggatgggt

SEQ ID NO: 6806894 - DNA, 83 bp, Homo sapiens
ggctggagtgcagtgagttatgatcatgccactgcagtgcagtggtgccatcatagctcactgcagcctcaaactcctaagct

SEQ ID NO: 6806895 - DNA, 58 bp, Homo sapiens
ggcgcttggtgcagctcctcttcagggtcctcctacctgaaggagaggaccgagtgct

SEQ ID NO: 6806896 - DNA, 82 bp, Homo sapiens
tccccctaaagcagtgggcaccttgagggcagaaccttgccgcgggcatctctggcccctggggtccgagcactgagcggga

SEQ ID NO: 6806897 - DNA, 59 bp, Homo sapiens
gacccatagttataaggcaacactgttcatgaacatgttttgtgccttgactaggagtc

SEQ ID NO: 6806898 - DNA, 79 bp, Homo sapiens
ggggtgcagccaagcctcccacgagctcaccagcatctcgggttgaggagcaggatgggaggctgggctccgccatccc

SEQ ID NO: 6806899 - DNA, 92 bp, Homo sapiens
cagaaagacctatactgatatactgatagctgcacttctagctatggaaagccaaggggtgtagttcttatggactagataaaggtttcatg

SEQ ID NO: 6806900 - DNA, 56 bp, Homo sapiens
agtgagggtggccttgtgtggactgttctaactttgcagttggctaaactctcact

SEQ ID NO: 6806901 - DNA, 62 bp, Homo sapiens
gccatcaatacagtgctaataaatgctcaataatttcttcttattgtacttctgttgatggt

SEQ ID NO: 6806902 - DNA, 55 bp, Homo sapiens
gtgttggccaccttatggctattggattaggtctggctcataggaaggccattgc

SEQ ID NO: 6806903 - DNA, 62 bp, Homo sapiens
gtgtctgtgggccacatgaacacttgattaggagttcaggtcatcattaaagtcacagagac

SEQ ID NO: 6806904 - DNA, 71 bp, Homo sapiens
tcattgtgcagctgccgatcagatagggtcagtaggtctctagtctataattggcactcgtaaattagtga

SEQ ID NO: 6806905 - DNA, 92 bp, Homo sapiens
aagcacccgggggtgggtgctccccctggagggttcacccgcagtcagcctgctctgttctcccgcaggggcagccctcatcccggctgttt

SEQ ID NO: 6806906 - DNA, 65 bp, Homo sapiens
gcagcgcgctgtcagactggctcgcaggcggcgcggccggcggacccgttcgagacagcgcgggc

SEQ ID NO: 6806907 - DNA, 92 bp, Homo sapiens
gactcctagaccatcttgccacttggtcctcactccctgtgcctttcccagccagaggccagcagacgtgggactgaaggcaggaaggagtt

SEQ ID NO: 6806908 - DNA, 61 bp, Homo sapiens
gtggcggcatggaggcagcagctggaggctgctgctttagttcaacatgccaaagtgccat

SEQ ID NO: 6806909 - DNA, 73 bp, Homo sapiens
aatggcaaacagctagaattctactggctgaaatactttttagcttaaggtttcagtttttgttgttgttgtt

SEQ ID NO: 6806910 - DNA, 78 bp, Homo sapiens
ggtccagtcaactaaagacagaagcctctagaaatgaaattcttcagaggaagtcagtctttatctgcaaactggatt

SEQ ID NO: 6806911 - DNA, 82 bp, Homo sapiens
tgctacatcaagtggccatccctcaggtaggcaggttcccttagccgccagccagagaggcatggttaggttctgataagca

SEQ ID NO: 6806912 - DNA, 55 bp, Homo sapiens
agtgtttggggtgattgtaacctcattatttttgacactagctgccccgaatgct

SEQ ID NO: 6806913 - DNA, 63 bp, Homo sapiens
gacagtgctctaggtgattccaaaatgcagacaaagtaagacccactggttagagccactgtt

SEQ ID NO: 6806914 - DNA, 96 bp, Homo sapiens
tgggggggtggcacagccctgccctggaggtctgtgtggggccgggggacacagccttgccctgagtggtacctgtgggtaatagggcccccttca

SEQ ID NO: 6806915 - DNA, 90 bp, Homo sapiens
agtagaggtgagcatgtactaattgttcacacttgtttataaaagcatatatactgtgaatttttagtacgtttaatgttgacttcaact

SEQ ID NO: 6806916 - DNA, 82 bp, Homo sapiens
gtgaaatttaggcccagaaatgttagaaggtgttgtaaattctgtgactacactccaattttctaggttgctgacctttcac

SEQ ID NO: 6806917 - DNA, 91 bp, Homo sapiens
agctccctgcttggccctgctgtatcatctgcttctttggggggtagtaaagatggtgcagtgggctggaatatcagctggaagtagagct

SEQ ID NO: 6806918 - DNA, 64 bp, Homo sapiens
gtaatctcagctacttgggaggctgaggcagaagaattgcttgaacccaggaagcggaggttgc

SEQ ID NO: 6806919 - DNA, 64 bp, Homo sapiens
gtaattccagctacctgggaggctgaggcagaagaatcgcttgaacccaggaagcggaggttgc

SEQ ID NO: 6806920 - DNA, 56 bp, Homo sapiens
ccactaggaagggatcagcctcagcctcacatcactgggcctgtccctcttggagg

SEQ ID NO: 6806921 - DNA, 106 bp, Homo sapiens
cagaatcacctggaagtcttgttcaaacagagctctgctctcagattcaaaacgtctgtgtggagcctgggaatttagagttcggacaagttcccaggtgttactg

SEQ ID NO: 6806922 - DNA, 64 bp, Homo sapiens
gggacagaaggaagtgagcacacggcacacccgctgttggattggttgctatttctcccgtccc

SEQ ID NO: 6806923 - DNA, 67 bp, Homo sapiens
tatgattaggcatatggcacatgatagaaaatcagtagttttttatctagattgttatgctttcata

SEQ ID NO: 6806924 - DNA, 62 bp, Homo sapiens
ctggtctaattggtttgaataaataaagaaccggaatctttctcatccaaactagttgccag

SEQ ID NO: 6806925 - DNA, 81 bp, Homo sapiens
ggccccaaccaacactcaggttttggctttgtgtactgaacccagtcaggtacattggccaaggcttggctttgaacggcc

SEQ ID NO: 6806926 - DNA, 58 bp, Homo sapiens
ctcccagggccatcgagtcacttcaatgagtgtgtctgcctgtaaggcccgatgggag

SEQ ID NO: 6806927 - DNA, 120 bp, Homo sapiens
tcacccccaccccctgcctctccttttgctttatattcaagagaggagcagtcccaccttgatgcttctcatctaagttatatcagtacaggtgacagaggtcaggggtggtgggggtga

SEQ ID NO: 6806928 - DNA, 66 bp, Homo sapiens
ggattgccatctggttgatttcattccggttagtttggccaaataccattaaccagaaaacaatcc

SEQ ID NO: 6806929 - DNA, 59 bp, Homo sapiens
cctctgctgagaaaagactgagggaagcaaccttccttcaggcctcattctcatacagg

SEQ ID NO: 6806930 - DNA, 63 bp, Homo sapiens
tggtctaggaggttacctatgctctgggttagatagaagagggcatggcaggtcactggggca

SEQ ID NO: 6806931 - DNA, 100 bp, Homo sapiens
gcacagcgtccgtggagggaaaggccttttccccacttcttaaccttcactgagagggtggttggggtctgtttcactccatgtgtcctagatcctgtgc

SEQ ID NO: 6806932 - DNA, 74 bp, Homo sapiens
cttaaagtgtcctagctaggaggcaggaagacggacaaaatgaccagtagtctcctggccctaggactttagag

SEQ ID NO: 6806933 - DNA, 109 bp, Homo sapiens
tggctttttgtgaaactgtgccttttgttttctgtaggcctttcctgtgcttcagctccctggaaactggcactgcagaaggaggcaagggtgttaaaacgaggaggca

SEQ ID NO: 6806934 - DNA, 76 bp, Homo sapiens
ttggccataggtattctcttgttagtggtttggaacagcatttttcagagtctatgcaacagaattctgtggtcag

SEQ ID NO: 6806935 - DNA, 59 bp, Homo sapiens
gccaccatgccagactcatttttgtatttatagtagagacagggttttgccatgttggc

SEQ ID NO: 6806936 - DNA, 98 bp, Homo sapiens
taggtcggaaactggatgcagtttttctgctaactggaaaatcccctggcaaggattccaggcaaagcagagaagagtatgttgatgtttcaggcgta

SEQ ID NO: 6806937 - DNA, 59 bp, Homo sapiens
cagttcactcacttaacaagtgtttactgacagcttatatgtgcaggagagtgaggctg

SEQ ID NO: 6806938 - DNA, 80 bp, Homo sapiens
aggggaaaagtaagctggggcaagacaacgtttctcatccctgattgaaatgttcctatttaccccctaacttatacctt

SEQ ID NO: 6806939 - DNA, 70 bp, Homo sapiens
ggaatattgatgacacatgttagtttttagtgggaaaaaagccaacagagctaatttgatgcattgatcc

SEQ ID NO: 6806940 - DNA, 70 bp, Homo sapiens
tggcagatggagataaatggaacttactttttccacctggtgccagtcccgcttactctctatgctgcca

SEQ ID NO: 6806941 - DNA, 56 bp, Homo sapiens
cttagtttttgccctggagtttagagagagaattcaaattccctggcaaaagcaag

SEQ ID NO: 6806942 - DNA, 76 bp, Homo sapiens
ctgtgcctccttcctcctcctcacagtcacctgcagctgcccgacttcaggttctgagagcaggagaggtctgcag

SEQ ID NO: 6806943 - DNA, 64 bp, Homo sapiens
tgcggtggcttgatcaagatagtcaaacatctgagtttctgtctgccccagcaagtcacatgca

SEQ ID NO: 6806944 - DNA, 89 bp, Homo sapiens
gtcttgttagaacccaggcgtggttgaggcgagcatagcacagagctggctgagtttcatgcatcatgcactgaaggggtttcagagac

SEQ ID NO: 6806945 - DNA, 116 bp, Homo sapiens
cctgtggaagttaggcatgagttctgctctgaggagccagtgtgtctgtgttggtagctggcagtcactggtgacttctgagctggatggtaacgtaattagaatgacttcatagg

SEQ ID NO: 6806946 - DNA, 129 bp, Homo sapiens
ttgcttgggtttccttgtaaacaggggcaaaatgtgtaagacgtcttatggggcttagcactgtagctaagacataaataggctttttaaagattgtttcctctgtacaaaattcagtgactcaaatag

SEQ ID NO: 6806947 - DNA, 115 bp, Homo sapiens
gacttgcttggagccacactgtaagttagtgatagctgctgagattgggatatagactttagaatttccagtccagagtatatccgctttacttgtagaagtggcttttatggtc

SEQ ID NO: 6806948 - DNA, 56 bp, Homo sapiens
ccagtggcagatcaccaactggaggcaggaagaaactcttagggagctgtaactgg

SEQ ID NO: 6806949 - DNA, 85 bp, Homo sapiens
cttcccccaaggccactccagagactggtctctcatatctcaaacccgagaggggctctttactgtgagggtggtctgagggagg

SEQ ID NO: 6806950 - DNA, 81 bp, Homo sapiens
caaggatggtttcttcagtctttgtgaaaaatagtatttcagtcttctctatattcagaaaactgagcgatgacatccttg

SEQ ID NO: 6806951 - DNA, 87 bp, Homo sapiens
ctgtcttcccccactcagtatgagctccgtgagaacaggggccaaacctgtttttggtcaacagtacatgcggtgcatggaaggcag

SEQ ID NO: 6806952 - DNA, 100 bp, Homo sapiens
ttggggagggatacttaaagactccaggatgcagaggtttttaatacatttgtagtatttcacagactgcaaagtgcctttgcatctgtgacttctccaa

SEQ ID NO: 6806953 - DNA, 129 bp, Homo sapiens
tcttgggaaggatgaaatgctgcagttttcattgaactggaaccttttattcagtctggatacccgggctgccgtaagtcaggattaccgcttgtttactactgctttctcagtttcgctttcccagga

SEQ ID NO: 6806954 - DNA, 105 bp, Homo sapiens
ggcagaagcctgtttaccacgtgcattgattacttttgcagccacactctctaatgtgcttaggtggccagtgattaatgacgcttggacagcagcctggttgct

SEQ ID NO: 6806955 - DNA, 99 bp, Homo sapiens
tcactgaaaaattaagagcaccttagaaatcgaactcaggttagaatcatttaagcaatctgacactttgatttgatttttgacttggaatttgagtga

SEQ ID NO: 6806956 - DNA, 66 bp, Homo sapiens
tttgtgacttgcttctcagaatacaacaaaggtaatggaatatcacttctgagattaggttacaaa

SEQ ID NO: 6806957 - DNA, 67 bp, Homo sapiens
cattgatttccattttcaactcctgccctagatctgagtgtctgcagggtgaagatggcagtttatg

SEQ ID NO: 6806958 - DNA, 59 bp, Homo sapiens
aaatataggcagctccttgttacaagtaaaatttagctgagaggcaggtgctaatattt

SEQ ID NO: 6806959 - DNA, 56 bp, Homo sapiens
agatggctgtcttctccctgtgttctcacctggcacagaggatgaggcagctctct

SEQ ID NO: 6806960 - DNA, 66 bp, Homo sapiens
tcttattactcagcatcatctttctgcacaagctgaagctgcagtgtttggatgctgagtctgaga

SEQ ID NO: 6806961 - DNA, 63 bp, Homo sapiens
tgactttctccagaaaaccaaggaacagtccagacacggcatctaaggtggtttggagggtca

SEQ ID NO: 6806962 - DNA, 62 bp, Homo sapiens
cccctgtctttgctgcctaactcagggaaaggccatgaggatgggcagctggggagaggagg

SEQ ID NO: 6806963 - DNA, 65 bp, Homo sapiens
cactgcccaccaagtggctggtatgggcacttacattgccgccctcatggtcactgtggatagtg

SEQ ID NO: 6806964 - DNA, 56 bp, Homo sapiens
tgagggctgtgagggcccaggtatggtgggcaccttccctgggtctgcagcattca

SEQ ID NO: 6806965 - DNA, 58 bp, Homo sapiens
gaaatagatactagagatagaactggactaaaacctaggttttctgaatgtctatttc

SEQ ID NO: 6806966 - DNA, 55 bp, Homo sapiens
tccttggcacactcggatctgattcattccagggtcagcaccacagtgcccagga

SEQ ID NO: 6806967 - DNA, 62 bp, Homo sapiens
atgaagaggcctttggagtagagaagaccttctccattccttcatcaaaaggccttctgaat

SEQ ID NO: 6806968 - DNA, 66 bp, Homo sapiens
ggcgaagggggtgcatttgtgaatgaaccagaattctggttcaaggaaacagctgaccccattgct

SEQ ID NO: 6806969 - DNA, 56 bp, Homo sapiens
attgtgtaaaatcttccagttttgtaatgtcagcaagatgtttagatttatacaat

SEQ ID NO: 6806970 - DNA, 121 bp, Homo sapiens
ctggataatcagaacctgtaaacatttccaagaaatgttcggaagtacttctggaggagtagatctcctgcagcaatgtagtttgggacatgctttattatgtttacaggttacagaacag

SEQ ID NO: 6806971 - DNA, 60 bp, Homo sapiens
agccaaagtggtatatagggaacttctgtggacccagaatctctacactttcactaggct

SEQ ID NO: 6806972 - DNA, 56 bp, Homo sapiens
tttctgggttctcactctctgataggcagatcagaaatgtacacgacacccagaga

SEQ ID NO: 6806973 - DNA, 58 bp, Homo sapiens
gattattctcaccatttctcccttccatttgttaggtcattggaaaggtagagtaatc

SEQ ID NO: 6806974 - DNA, 75 bp, Homo sapiens
acttaacattcaaaaggaggcatgggcaattcctttcaccatctttctttgcccccttttcttgttacactgggt

SEQ ID NO: 6806975 - DNA, 77 bp, Homo sapiens
tgaaggatctaaatggttacaatgctttgcttttgaaaacattgagtgcatcgtggccattttaaaagattgcttca

SEQ ID NO: 6806976 - DNA, 58 bp, Homo sapiens
gacaagactggtttatttaagggcttagttctcctttggaaatggagctaatcttgtc

SEQ ID NO: 6806977 - DNA, 117 bp, Homo sapiens
ttcaggttttttgtgtgtgtgtctgccattgaggagtataaaacttttttcaaagtcgtttacatttggctttggcaagggttttaattgttcattggagagtatctgtaacctgaa

SEQ ID NO: 6806978 - DNA, 76 bp, Homo sapiens
aacctttcctatgaggcacttcattagctggctccattttctgggtgttatgaagatgcctggtacatggaaggtt

SEQ ID NO: 6806979 - DNA, 64 bp, Homo sapiens
ctcaggatgcaggtcacaggactcatgccactcacagtatccgccactgttgcctgcttccgag

SEQ ID NO: 6806980 - DNA, 77 bp, Homo sapiens
gcccttgcatcagggagagcccagccttgagtgaaactgcctgggagacaggctgggcgcttcctgcggcagtcggc

SEQ ID NO: 6806981 - DNA, 91 bp, Homo sapiens
tctaagttattgtcacaccttgtaaagcatctctgtcatataactgattgtatcagttgtgcattacgattgtgatgatactctacttaga

SEQ ID NO: 6806982 - DNA, 113 bp, Homo sapiens
gtcctgagagtccaggcctcctctctctgactggaaagcctgtcctcagagtccagacctcctctctctgactggaaagactgtcctgagagtccaggcctcctctctctgac

SEQ ID NO: 6806983 - DNA, 111 bp, Homo sapiens
gccattctcactctggtgatactattagttaactttcaggtgcatgtttgcattctagtgcaaatatgctgacagttggatataattggaattttcagaagagactgtggc

SEQ ID NO: 6806984 - DNA, 76 bp, Homo sapiens
tcccagtcgttgggccgtcttcactggtgcttcctgaacaatctctacgctgcacttgaggacgactcagctggga

SEQ ID NO: 6806985 - DNA, 68 bp, Homo sapiens
gcctggctccaggtcatgcactcacctctaacataagagatgcttgagatgcggcctggagtgaaggt

SEQ ID NO: 6806986 - DNA, 103 bp, Homo sapiens
ggtgttaaatgtaatgcagtggaccaagagttcaagagtgaaccactttaatcctgcttccagagatggtgtgctctgtaaccttgggcaatatatttaaccc

SEQ ID NO: 6806987 - DNA, 82 bp, Homo sapiens
agggtctctgtcacccaggctggagtgcagtggtgtgatggtgcaatcacagctcactgtagcctcgacctcaagtgatcct

SEQ ID NO: 6806988 - DNA, 77 bp, Homo sapiens
gaatcttctctcctcttctcactgcgccacctctgatctccagcgcagcagcgtggggacaggagctcagatgattc

SEQ ID NO: 6806989 - DNA, 65 bp, Homo sapiens
gggatggggggaagcgtccatgcgccatggtgggcgcccaccgctctggttgttcccctcatctc

SEQ ID NO: 6806990 - DNA, 60 bp, Homo sapiens
cagatttactccctgcttccgcccagtggcaataattgggtactgcagagggtgagtctg

SEQ ID NO: 6806991 - DNA, 66 bp, Homo sapiens
gggggcgccctctctgcttcactgttccctctggcctcccatagtggggcctgggagggttcccct

SEQ ID NO: 6806992 - DNA, 86 bp, Homo sapiens
tctgaaatgcttctgtttatccctttggtcagcacctcctgccaggaccatgctggagctgctaagaaggaagacaggtgcacaga

SEQ ID NO: 6806993 - DNA, 73 bp, Homo sapiens
gcagcagaagtccgtgtccccaggcagtagcaggcctagagcttcacagtgccagggggcaggctgtcgttgc

SEQ ID NO: 6806994 - DNA, 70 bp, Homo sapiens
tgagaagagctggatggaatctgggatgagtaacatgagtatccgtaggaagaccaccagtggctactca

SEQ ID NO: 6806995 - DNA, 84 bp, Homo sapiens
gagtatttggatataatgtgggaagagcagtggcagcagttggatctgatttgctacctcttcctaatcgtatactagaaactt

SEQ ID NO: 6806996 - DNA, 61 bp, Homo sapiens
tctttgctaattagaattgaaccagcaacatcatttgcacaatcacttctgttagcatgga

SEQ ID NO: 6806997 - DNA, 115 bp, Homo sapiens
gtgatgggaacttctatacagacagccagcctttctattggtttctcttcttctcgtggtagttttgggaggagccatagatagtgctgctgatatgtgcttcctcttccccaac

SEQ ID NO: 6806998 - DNA, 73 bp, Homo sapiens
actttaattaagagatgcttttctaaataattagtatatatttttgtttggttgtagcatttctttttgaagt

SEQ ID NO: 6806999 - DNA, 90 bp, Homo sapiens
cttcctggaattggagctcttacaagaaggaaaagggagcacttttgataacaagtttccctttttcttgtgaggcagttttcctggaag

SEQ ID NO: 6807000 - DNA, 84 bp, Homo sapiens
gatggtggcagcagaacatgaaacccattgcggggtccttctaagcactgggttccatgtgactgcgcggttcataagcccatc

SEQ ID NO: 6807001 - DNA, 67 bp, Homo sapiens
gagtctctctcaatacaaggttgaatcttgtaggaactatattgcccttgcccattgagagtctttc

SEQ ID NO: 6807002 - DNA, 67 bp, Homo sapiens
gcttcactgcttatgtctccttttcagtgaaaatggattgaatgggaaaacgaaataggcatgaagc

SEQ ID NO: 6807003 - DNA, 83 bp, Homo sapiens
ggatcgacccccacacaccaccgtcccagcctcctgccccacagaaatgcaggagctactcaggttgggttggggccacgacc

SEQ ID NO: 6807004 - DNA, 58 bp, Homo sapiens
ggagatgccttgtttcaggaacccattcagccaagttgtcctggcaagccgtacctcc

SEQ ID NO: 6807005 - DNA, 64 bp, Homo sapiens
gcagctcgcacattagtcactccctgtcacccacctacacggcaggaggctgctgtgctggtgc

SEQ ID NO: 6807006 - DNA, 66 bp, Homo sapiens
ataaaacttggcctttataacactctgacactctcagagcatgcaggacataaaggcaagtattat

SEQ ID NO: 6807007 - DNA, 96 bp, Homo sapiens
ctgggtgttgggtgatgatttaatgccatgctaagggcttggtgcctgacactgagctaatagctataggcaatttaagagaaacttaagactcag

SEQ ID NO: 6807008 - DNA, 74 bp, Homo sapiens
agaatgtctaatgaattgtctagaaattgaaatacgcaccttttatgaatagggacatttcataagaccattct

SEQ ID NO: 6807009 - DNA, 80 bp, Homo sapiens
acatttatttcttattcttgtcttattgtgctacctaggactcccagtacatgtagaataggagtgatgagagaggatgt

SEQ ID NO: 6807010 - DNA, 60 bp, Homo sapiens
cagcaggctctgagtggctgccagcccagcctgctggctgcctccaaagcaggcctgctg

SEQ ID NO: 6807011 - DNA, 58 bp, Homo sapiens
agtttaactggccatgccctcaattttcagtatagaagcatggttcacagttagtact

SEQ ID NO: 6807012 - DNA, 65 bp, Homo sapiens
ggttggcacaaaagtaattgccattccttttaatggcaaacaccccaattgcttttgtaccaacc

SEQ ID NO: 6807013 - DNA, 92 bp, Homo sapiens
tgttccatccgtgcaagtgttttatgaaaatttagctgaagcattttaaaaaaatgttttggccagattctttttagaataaagttgggaca

SEQ ID NO: 6807014 - DNA, 67 bp, Homo sapiens
cctgaatacatttgaaagttcttctgacactactgatccggtgtgtttactgctttgtgtacttagg

SEQ ID NO: 6807015 - DNA, 61 bp, Homo sapiens
gtgcctgcctgtactagagacccagacgtttatgctcttggggaggcaggcaggcaggcat

SEQ ID NO: 6807016 - DNA, 110 bp, Homo sapiens
gaaggtttctgaagatgatatttaatttagcaaggttcccttacccttaggaggacatgggttggaaggtcttaagaactgctacattcatctccgaggctgaaaccttt

SEQ ID NO: 6807017 - DNA, 83 bp, Homo sapiens
ctagtactttgagtggcaattgacaacaaaggagtgtaagatcagaagtttccttccaaagttaaatgtcaccctgaagctag

SEQ ID NO: 6807018 - DNA, 58 bp, Homo sapiens
aatgtggtgcaagtccaggcaaggtgctcagaaatgctctcctggaatgcaccccatt

SEQ ID NO: 6807019 - DNA, 92 bp, Homo sapiens
agtgttctgagaagtttcaagcaggatcaaagcaaaagttgattatacttttagctaaagaacttgctgaaccttgagggctcagtgacatt

SEQ ID NO: 6807020 - DNA, 71 bp, Homo sapiens
ggccgcggattggcctgccccgagatcctggccactgattggtcgcccggacggggcggggccacgtggcc

SEQ ID NO: 6807021 - DNA, 85 bp, Homo sapiens
ttgaatgaaccatggggctcttctggttgtcacattttaagaatctagaaatggaagcatatggaaagctattaggttggtgcaa

SEQ ID NO: 6807022 - DNA, 93 bp, Homo sapiens
tagatcaaaggttgatagagcactaagtagtgtattccagggcatctcctagtgcaggttctatatatttaatgttatataaagtttgatcta

SEQ ID NO: 6807023 - DNA, 75 bp, Homo sapiens
gattgaggaaacattgagctctggagtggaaaaggttgcagacttttagactcccaagtcgttgtagtctcaatc

SEQ ID NO: 6807024 - DNA, 124 bp, Homo sapiens
gcatgcttccaaaacgcatcaatggcagctcttttgtgtatatactttcttcctgggtagatagaatttaactgcctcaaggtatgtggtagaatagtagccattcagtttttggttaatatgc

SEQ ID NO: 6807025 - DNA, 57 bp, Homo sapiens
gctctgtgttccctccaggctcctggttgtgaggaacaggagtggatggggcggggc

SEQ ID NO: 6807026 - DNA, 56 bp, Homo sapiens
tgaaggaagaataggcagtgttgtgacgccattaacttgctctgattttcctgtca

SEQ ID NO: 6807027 - DNA, 81 bp, Homo sapiens
taaagtatttcttctgagcccaaggagttgggtgatttttagccacctgacaaccctcttctcggtggagaacatactttg

SEQ ID NO: 6807028 - DNA, 57 bp, Homo sapiens
ctaccatctctgcagattgtacagaattatctgtggcaggatgcggaagatgcagag

SEQ ID NO: 6807029 - DNA, 75 bp, Homo sapiens
agaaaagccgtgttaatcatttttgattttgcctttatgagggtaaaatcatgacagattgacatggacaattct

SEQ ID NO: 6807030 - DNA, 58 bp, Homo sapiens
ggagctcagagcctatagttggtcacttggaggtgactccagaggctgctgaggctcc

SEQ ID NO: 6807031 - DNA, 124 bp, Homo sapiens
ctggggaatttccttgcccagagggaggagctggggccaagctcaccttctgatggagtatgtgggtttctcgtcccagaaggaggagcttttcccaagcccagctttccagggcctttcccag

SEQ ID NO: 6807032 - DNA, 58 bp, Homo sapiens
gacagcagtccttggcttcatccgagtctctggcctggggctctcagggtcatgcttc

SEQ ID NO: 6807033 - DNA, 82 bp, Homo sapiens
gtctgctccctgaatttggtgcctgggaaatctctggagactttagggagaacagttgcagcagacaaggggccaggaggac

SEQ ID NO: 6807034 - DNA, 55 bp, Homo sapiens
gcattggcctgaaactggttcagcatctctgctgccacattttcaggactaaagc

SEQ ID NO: 6807035 - DNA, 95 bp, Homo sapiens
gagcaacttgaccaagatggcccagttagttccagctgcagccaagacaatttggcagctgttggaccttgaccctccttgccttcttcaagctc

SEQ ID NO: 6807036 - DNA, 128 bp, Homo sapiens
atgccttaggcccacccctggcctccctggaggggagcaacatagtcactctctagttacagagtacttggtgtagataatgatgctctccaccctgggccaaagtggccatgcatgggccaagacat

SEQ ID NO: 6807037 - DNA, 63 bp, Homo sapiens
cagatgtttgtctatatgctttcttgtttattaacaactgggagtaaattagacaaagcagtg

SEQ ID NO: 6807038 - DNA, 63 bp, Homo sapiens
ggccataacatgcagaaatcttagctacttaacatcatttttaagagctcttttgttatggtc

SEQ ID NO: 6807039 - DNA, 88 bp, Homo sapiens
cccagcctcgcccagccagagtggcgaccccctcagctgcagccctggggctgtgggggtgtcgcttcctgggagcggaccggctggg

SEQ ID NO: 6807040 - DNA, 99 bp, Homo sapiens
acagacacaccctaaaactctccagtctttccactgtagttatgatgaagttaaaactccttaatttctccagacagctgtgcaaaatctggtgtctgt

SEQ ID NO: 6807041 - DNA, 108 bp, Homo sapiens
ggaggaaagatgccaggggtaaagtgggaaaatgggaacctgaagccaggaggtcaagccaagccaacaggtgttctgtttttcagtgagtatatcctgtctttcccc

SEQ ID NO: 6807042 - DNA, 65 bp, Homo sapiens
gacttatccagggagggtcctgtggcttcatgtttatggagttgctaggtctctgcctcatggtc

SEQ ID NO: 6807043 - DNA, 98 bp, Homo sapiens
gggcagggctgtgttcccctctggaggctgcaggggagaatccctttccttgcctttcccagcttctagaggctgcctgcattccttggctcctggcc

SEQ ID NO: 6807044 - DNA, 56 bp, Homo sapiens
aggctggcggtgactgctctgatcactacgtgctgtgaagggcacggtgccagcct

SEQ ID NO: 6807045 - DNA, 84 bp, Homo sapiens
ccagattgacatccctggggactgctgtttcctgttggtgcctgtgcaaatgaaggcagcaagcagaagttctatgttttctgg

SEQ ID NO: 6807046 - DNA, 78 bp, Homo sapiens
tgtgcttccaatgggctggcagcctgaacagcatcagcatcatgctgtacattctgcacaggcccagctgtgggcgca

SEQ ID NO: 6807047 - DNA, 65 bp, Homo sapiens
cactgaccatggccaattggcaccaagctatttacaaccttaatgccagtctgcattggttcctg

SEQ ID NO: 6807048 - DNA, 83 bp, Homo sapiens
ggagcaccaacataatagcatttctaatttgtaccataattgcatgcagagatgaaatgttgttgtctatcatatgctgcttc

SEQ ID NO: 6807049 - DNA, 66 bp, Homo sapiens
tcctgtggctctgtggaaccttagacctcttctagctcagagagttgcaaacagatacctacaggg

SEQ ID NO: 6807050 - DNA, 60 bp, Homo sapiens
ccccctttgactgatgaagcaactccaggagggtcagcatgttcttaggtcacagggtgg

SEQ ID NO: 6807051 - DNA, 78 bp, Homo sapiens
ggtgctatcaggtgatagaatcagataaaaggatttcctataaggcattctgctggtaactctataaaaggtggcatt

SEQ ID NO: 6807052 - DNA, 110 bp, Homo sapiens
gggatgcctccgcacaagggcagcagcggcccaggcctacccctggaactcgggctgaggtttctgaaggctgggcaccgttttgatcccgtgtgggcgcaggcactccc

SEQ ID NO: 6807053 - DNA, 78 bp, Homo sapiens
gtatctctcaccagagtgaggcttgtgggcttcatgcatagcgatggatacagaagccttggctgttggtgaagacac

SEQ ID NO: 6807054 - DNA, 73 bp, Homo sapiens
tacttcagttacatgaaggtattctggcatagcaataaaacaaccggaaagtcctttgagtgtgtttgaagta

SEQ ID NO: 6807055 - DNA, 72 bp, Homo sapiens
ttatgcagatggcatgaggaggaattgtcagcggttgtcactgaggaactgctctctcaccatctgacatag

SEQ ID NO: 6807056 - DNA, 59 bp, Homo sapiens
ggcttggagtcatactgagaatccagttctgccatttacgagcagtatgaccttaagcc

SEQ ID NO: 6807057 - DNA, 113 bp, Homo sapiens
gagggaaaacagagggaatgtgcccacatggtgccatggccattcaccaatcctatggttgggggttggtatacgtgcataccatattgggcctgtttatacatgtggccctc

SEQ ID NO: 6807058 - DNA, 72 bp, Homo sapiens
tggtcccaggagaataggtgcaaaatgtttcttctacattttcagccatttagcagtctttctttgggacta

SEQ ID NO: 6807059 - DNA, 55 bp, Homo sapiens
gagctgcatgcaactcgaaaatcgttttaaggtttaaaagttgtaatgtaggctt

SEQ ID NO: 6807060 - DNA, 67 bp, Homo sapiens
cttgcaatctgagtcactgcattttaactgtttattaagtggtgacagtgacagctagatagtttag

SEQ ID NO: 6807061 - DNA, 76 bp, Homo sapiens
gaattattgattttgcagtttgttcagctctttcttgttgttaggatagagtggcgaatttcagcttcttacattc

SEQ ID NO: 6807062 - DNA, 58 bp, Homo sapiens
ggtcctgagtacctatgtttattgcatcaataaatgaataagaaggcattacgggact

SEQ ID NO: 6807063 - DNA, 93 bp, Homo sapiens
ggccgggcatggtgccttacgcctgtaatcccagcactttggaaggccgaggtgggcggatcacgaggttaggagattgagaccatcctggcc

SEQ ID NO: 6807064 - DNA, 68 bp, Homo sapiens
acctacagcatggggatcactgtaggcaactagaaatggaggtgtcttgtggtacccatggctaccgt

SEQ ID NO: 6807065 - DNA, 72 bp, Homo sapiens
ggcacctgtaatcccagctactagggaggctgagaatcgcttgaacccgggaggtggaggttgcagtgagcc

SEQ ID NO: 6807066 - DNA, 80 bp, Homo sapiens
ggcgcgcggaggctgcgggaggcggctgctactggcggcccaagcagcttcccgagcttctgaccttaacctctcgcgcc

SEQ ID NO: 6807067 - DNA, 74 bp, Homo sapiens
gagtgtatgtgagcgtcagggtgtgcgagagagagaaccaagtcttcagctggccaagaggctcattagcattc

SEQ ID NO: 6807068 - DNA, 129 bp, Homo sapiens
attggatgattgggtatttgtttctaaatgcagttggcagtcattgtagaactgatttgaattacattgttttaaaaggtactcaggctgctgtactgtgaatggcatttggtagagcctcatccatat

SEQ ID NO: 6807069 - DNA, 55 bp, Homo sapiens
gttattaacatgcatttagcatttgggaattctgtgcttaatacatgtcaataac

SEQ ID NO: 6807070 - DNA, 78 bp, Homo sapiens
ctcagaagtgagacccaagaggagccaacgtctgtgttttgcacaagatacagaatggttgtttgtccacattttggg

SEQ ID NO: 6807071 - DNA, 69 bp, Homo sapiens
tgttctaggtatgtggcatacttgtttaccctcgatgaattgttctaggcatgtggcatacctatggca

SEQ ID NO: 6807072 - DNA, 56 bp, Homo sapiens
attaggatttggtatggtcataaggatagagcccttatgaaaggactaatgctgat

SEQ ID NO: 6807073 - DNA, 78 bp, Homo sapiens
ctttgctattgtgaatagtgccgcaataaacatacgtgtgcatgtgtctttatagcagcatgatttataatgctttgg

SEQ ID NO: 6807074 - DNA, 57 bp, Homo sapiens
agacctgagtgcaggagccaggctgtggagcgtgtgtgtgggcctgcatctgggtct

SEQ ID NO: 6807075 - DNA, 69 bp, Homo sapiens
gctggccctggactcagaggtgctggtggggtcccatccatgggtgaagcccttgagtcctccatcagc

SEQ ID NO: 6807076 - DNA, 56 bp, Homo sapiens
cccggagcctgggactgggggtcatgctgctgcgtccccttccacacagctctagg

SEQ ID NO: 6807077 - DNA, 83 bp, Homo sapiens
ttaaaagtttatcagacaaactgtgagattgttcttgtcagagagaattgagaataagattactggttgtctgagatggttga

SEQ ID NO: 6807078 - DNA, 62 bp, Homo sapiens
gcaatgctggaacttgacaatttaggataagtcaaaatccttagagacaagaccagtttggc

SEQ ID NO: 6807079 - DNA, 59 bp, Homo sapiens
gatagggtctttacagaggtgcttatgttaaaataaggccattatggtgggcccgaatc

SEQ ID NO: 6807080 - DNA, 72 bp, Homo sapiens
gtcagccagtcccctcggacagccagaggccatgaagtcaaggggctctggtcagtgaggggccttgcttac

SEQ ID NO: 6807081 - DNA, 61 bp, Homo sapiens
gatgcagcacttgccttacgagctgttctttcttgctcattgagggctttgtgtgctgctc

SEQ ID NO: 6807082 - DNA, 63 bp, Homo sapiens
tcttggcattcttaatttcatctattcccatacttacaataggtggccaccagaatgttaagg

SEQ ID NO: 6807083 - DNA, 58 bp, Homo sapiens
cgcagtcaaatttgaaaactttgaggatgcagcactggaagaaaatggtttggctgtg

SEQ ID NO: 6807084 - DNA, 76 bp, Homo sapiens
gccaaggatggaatggcttttcctgactgggagtgtcctcatcacagacttttgctcaggcatcattcttcctggc

SEQ ID NO: 6807085 - DNA, 77 bp, Homo sapiens
ctccacctcctacctacacacatatcctcttgagttttcctgcttaatttttctcatagtgtgtggtataggtagag

SEQ ID NO: 6807086 - DNA, 69 bp, Homo sapiens
ctactgcatctgtgcctaacatagtgcctgacacttaccaggtgttcatgtaagtatagaaagcagtgg

SEQ ID NO: 6807087 - DNA, 130 bp, Homo sapiens
ggggagactcgctaatatttttggggtgttctcagattctgggcccagcttgtctgcgtgagtctaggcaccaatgagttaggagggtcaggctggggctcagaattcacccctttgagtcctgttctgc

SEQ ID NO: 6807088 - DNA, 83 bp, Homo sapiens
gagactggtcacggcggtgcaggctcaccctggagctgagtgatggtcttcagctcctgggtctgctcttccacatctgtctc

SEQ ID NO: 6807089 - DNA, 65 bp, Homo sapiens
gttgctcgcgctgttccagcagctggcgccgcgtgtggtgcagcagctgggtccggcggagcagc

SEQ ID NO: 6807090 - DNA, 60 bp, Homo sapiens
tctgtctcctcagatgactccaaatactaattctatatcaggattcaatctgggaacaga

SEQ ID NO: 6807091 - DNA, 57 bp, Homo sapiens
agatggagatgttttgaagttgcttataaatatgcaggtaaaggaacatttctgttt

SEQ ID NO: 6807092 - DNA, 72 bp, Homo sapiens
acaacatttaagtctctgactcacacaatgtagctgttaattacatttctgtcttagggactgtttcgttgt

SEQ ID NO: 6807093 - DNA, 78 bp, Homo sapiens
gcgggagctgcacacgccccggaaacctgggacagaaactgagtccctctccttcctggtggtggtgacagcacctgc

SEQ ID NO: 6807094 - DNA, 58 bp, Homo sapiens
ggccagttgtgctttaaaccctctactcctaagaaagaggcacagcacttggctggcc

SEQ ID NO: 6807095 - DNA, 64 bp, Homo sapiens
taggctacagaactgcaggaggaaaagcaatactagcttgctacctagaacattctgtcccctg

SEQ ID NO: 6807096 - DNA, 73 bp, Homo sapiens
gaggaatgggtgtctcgtgattagctgaaagtctacatcaccacacagtccccgcacagtgcagccatttctc

SEQ ID NO: 6807097 - DNA, 75 bp, Homo sapiens
gaccatccattcaatgagcccaagaacgtgaaagtaaatctttattcacaaaagcttttgaatttggggatggtt

SEQ ID NO: 6807098 - DNA, 65 bp, Homo sapiens
tgtgtgtgcagctgttactagagagattgatttgggacttggtctcagtgccgattgcatacaca

SEQ ID NO: 6807099 - DNA, 79 bp, Homo sapiens
cacaggactagatgataaaatgttgtaatgggaagctaattgtttcattggctttatacgtttgtcttttatttctgtg

SEQ ID NO: 6807100 - DNA, 114 bp, Homo sapiens
tctcgcaaaaactttaaaaaaattggcattacccagcatggcagagagtgtggaaagacaggtgcccccatacactaacagtgggtgagtcaataactatggtcctttgtaggg

SEQ ID NO: 6807101 - DNA, 67 bp, Homo sapiens
agaaatgtttatggctgcctattataagtcaggctctgtgctaggttatgggcacccaaaaatgact

SEQ ID NO: 6807102 - DNA, 73 bp, Homo sapiens
aagcttcaggcccacccatgtccaactgccatctacacactgccagcagctgtgcagagggagcctgaggctt

SEQ ID NO: 6807103 - DNA, 70 bp, Homo sapiens
tttcagggatatgttaagcatttgagctaaaaattatacctttggttgaaacataaaatatttcctgaaa

SEQ ID NO: 6807104 - DNA, 65 bp, Homo sapiens
tgtgtccagtgtcagctctggtgtgcttattaagggataaatgacccatgctgacctcacacaca

SEQ ID NO: 6807105 - DNA, 56 bp, Homo sapiens
tcctgggggctccaacaggttgtgggtattctcatcctgctgatggccctccagga

SEQ ID NO: 6807106 - DNA, 78 bp, Homo sapiens
tgtggtatcatggcaagaatattggaccagaagtcaggaaagactgtgttacgaagttgttgtgaatgtgatattata

SEQ ID NO: 6807107 - DNA, 103 bp, Homo sapiens
gttggtcaggctggtcttgaactcctgaccttgtgatccacccgctttggcatccccaaagtgctgggattacaggtgtgagcagccaccatgcccagccaac

SEQ ID NO: 6807108 - DNA, 63 bp, Homo sapiens
tttggagggtcagagcaagactggggtcaatgatggccccaggcctttggtctggcaactaga

SEQ ID NO: 6807109 - DNA, 92 bp, Homo sapiens
tggaagtgacttttgagcaaatcagattgtaattactaacttggtaatcaattgatcattgttcagggagattagtgtaagatgtccttcca

SEQ ID NO: 6807110 - DNA, 83 bp, Homo sapiens
gtgattagcttttttagttgttgttatgtcattactacttacggtatcagacaaagtaagggctaatgagcaaaaatagtcac

SEQ ID NO: 6807111 - DNA, 61 bp, Homo sapiens
gggctgctatggaggaagaaacaccttaagatgaggttgtttaataattctatgatagtcc

SEQ ID NO: 6807112 - DNA, 64 bp, Homo sapiens
acttttggttctgtaactgtgattctttactgcagtcttctacagcttttacagaattaatggt

SEQ ID NO: 6807113 - DNA, 61 bp, Homo sapiens
tgccttattttctgctagagatgtcacagactagctttagttctagaaagtgaaacaggta

SEQ ID NO: 6807114 - DNA, 68 bp, Homo sapiens
cagtggctgctgggggaacagttaaaattactacagtgtgattactgtggatgccagcagcatgactg

SEQ ID NO: 6807115 - DNA, 69 bp, Homo sapiens
tttcatattatcttttctacagccagctgtaaacatatataggaaagctggctagaagatagaatgaaa

SEQ ID NO: 6807116 - DNA, 107 bp, Homo sapiens
gtggaagctaaagagaggttgtctgtggcaaatgcactgtctccccaagggagactttggaaaggtgcttttgtctgtttttagactagcctctctccccgccccac

SEQ ID NO: 6807117 - DNA, 75 bp, Homo sapiens
gcaggaagtcttcccagttctgcttgagggggcccttccaaagtactcccagagggcctgttctagaactcctgt

SEQ ID NO: 6807118 - DNA, 57 bp, Homo sapiens
atcaagcctaggcctactctggtttgcctggggcagaaagtcatggccaggtttgat

SEQ ID NO: 6807119 - DNA, 72 bp, Homo sapiens
ctgggtgctcccaaacctgacaggctccaggagaaacacagacccctgggcatgtcgcctgggcagcccgag

SEQ ID NO: 6807120 - DNA, 73 bp, Homo sapiens
atgagagcaacaccttcacttgaaaactggtaagagtttggtgatagtgtgttgggggaggtattgttttcat

SEQ ID NO: 6807121 - DNA, 64 bp, Homo sapiens
ttctcaattccacttcattgacatcaagttagtagcttgaaatcagccatggtgagagtgagag

SEQ ID NO: 6807122 - DNA, 106 bp, Homo sapiens
tccttatgcacggaaaagtttgagaaccattaatatgggctattgatcaataaatcataaattgtcagagaattgtttaatggaattctcattttgtaggtaagga

SEQ ID NO: 6807123 - DNA, 68 bp, Homo sapiens
ttagtatatactgatgagtccttcgttactgttaccaagtgcataactggtatatcagtgtacactaa

SEQ ID NO: 6807124 - DNA, 76 bp, Homo sapiens
aagttctaaaccatttttgacagaaggcctaaataatgatttttatgtcttcaggtcagaaattctaggggagctt

SEQ ID NO: 6807125 - DNA, 69 bp, Homo sapiens
cttagtcaagtcattctatttctctatgttttgattggaagcagagagaaacagaatgatttgactaag

SEQ ID NO: 6807126 - DNA, 69 bp, Homo sapiens
tacacattatattaagagatgtatgaagagaaaactgtttattttcaccttctctggatattttgtgtg

SEQ ID NO: 6807127 - DNA, 62 bp, Homo sapiens
gattgtgcagatagtaattaggaaagctggtattaaaactaggtcctatctgtcccacagtt

SEQ ID NO: 6807128 - DNA, 73 bp, Homo sapiens
gctaaaaggtagaagtgatggaacttggagagtaaggaaaagtaagtttctaatctgggcttctgcagttagc

SEQ ID NO: 6807129 - DNA, 68 bp, Homo sapiens
ggccaggcatgcagctggtgtttagtctgcagtggacttatcttcacatgcatctgtcatgtttggcc

SEQ ID NO: 6807130 - DNA, 87 bp, Homo sapiens
gctgctagtgtctctaaagtggtttcttatcccctgcagcatctgccaaggttctgtttggctgaggatctatgaggcatctgaagc

SEQ ID NO: 6807131 - DNA, 66 bp, Homo sapiens
atgggagatgctcattctatgttttttaatctgaacaagttgaaacaaagaaaggagtgtcctcat

SEQ ID NO: 6807132 - DNA, 55 bp, Homo sapiens
gtctgtccatcagcaaaggcttgggaaaagcacccaggtatgtcccaggatagat

SEQ ID NO: 6807133 - DNA, 91 bp, Homo sapiens
ccattcggcaggcagtggaagctgtctgaggcttcagggccccctcctcactaggggctataattcatgcagtttcttatctgccagatgg

SEQ ID NO: 6807134 - DNA, 76 bp, Homo sapiens
caggggctttctccctcacaaagcattctcttcatggaaggatgatgaagtaaatcttatgtcagggagccacctg

SEQ ID NO: 6807135 - DNA, 117 bp, Homo sapiens
aggaacagggccaacaggaattagggtattttattgtgtgcatctggaagttggagaggccatcaggtgtttaaggatagtgatgtctgtctgtttctgacttttggccctgttact

SEQ ID NO: 6807136 - DNA, 66 bp, Homo sapiens
ccaaaaggtgatacagaataacgctgccattgacaaagtatgtgtgcatattctgccacctcgtgg

SEQ ID NO: 6807137 - DNA, 63 bp, Homo sapiens
ttctgtcacagtgctggtatcagaacccagatcccctgactccttgtccagtactgtttagag

SEQ ID NO: 6807138 - DNA, 63 bp, Homo sapiens
gactgctactagctgtatgcatttgtgtgtattgctgtgagtgcatgtccagtagtttatgtc

SEQ ID NO: 6807139 - DNA, 63 bp, Homo sapiens
ctggttgatgtcctcagtgccaggggtttgcttttaaagctccaaactcaagacattaataag

SEQ ID NO: 6807140 - DNA, 68 bp, Homo sapiens
ctggggagtctgatctggtagccctgaggttgcttcctgctcagatgcttagagattagactgcctgg

SEQ ID NO: 6807141 - DNA, 65 bp, Homo sapiens
tctgttatagacagcaatgtgtgtgtttttctcaacttaagtgagccaataccatgctgttcaga

SEQ ID NO: 6807142 - DNA, 73 bp, Homo sapiens
tctggctcctgcagccgtcctgtttgtctacacccttcaccccagtggggaaattgtggctgacagtgtcaga

SEQ ID NO: 6807143 - DNA, 129 bp, Homo sapiens
tacatgattatgtgcatttgctaaaatccctagacctacacatggaagttgcagttttcgtaggtcgaaaacagtccaagagctgcaatttcatgtggtgtaacctatgcatatcacatgaaggtgata

SEQ ID NO: 6807144 - DNA, 55 bp, Homo sapiens
ggtacctttgccacctcgcagggaatggcgtgtccctgtcttggactgaggcacc

SEQ ID NO: 6807145 - DNA, 108 bp, Homo sapiens
gaaaagaaactcccagttaattcagagttgcttatgtcaggtgagaggggtagacaccaattctctctcacctggcataagcaattcacaattaactgagttcttttt

SEQ ID NO: 6807146 - DNA, 57 bp, Homo sapiens
gtagtggccagaccatgggtcaggtctgtccggtttggatccagctctgccacttac

SEQ ID NO: 6807147 - DNA, 57 bp, Homo sapiens
ggaataattgtcaactatgctacacagaagtttagaaatgaaggagataattgttcc

SEQ ID NO: 6807148 - DNA, 57 bp, Homo sapiens
gcagctgtagactgggctggattcttttggaggtttcctaggcccagcctgagctgt

SEQ ID NO: 6807149 - DNA, 69 bp, Homo sapiens
tcttccattttcccaccatctcctgcaatacctcctcttcccttaggctttcctgggcagatgagaaga

SEQ ID NO: 6807150 - DNA, 77 bp, Homo sapiens
tcatttgtttacatactctctgtgactgctttccacactgctctaggcaagttgaaacagagtagttgaaacagaga

SEQ ID NO: 6807151 - DNA, 75 bp, Homo sapiens
gggaaacctgtctcctcttcatatacctgttcctttcaaggaaggctataaaaatggggatgagagaggataacc

SEQ ID NO: 6807152 - DNA, 115 bp, Homo sapiens
gtggtgcatgatttgagtttttgtgtgttttaagtatggagccatttgttatgcacagtttttaagagagacaatatggcttatttatagagcaaaaaacggagatttgaaccac

SEQ ID NO: 6807153 - DNA, 67 bp, Homo sapiens
gagggatgcagaaacagaggccctatgtaacagattaacacagcccctctcatagtctgtatccttt

SEQ ID NO: 6807154 - DNA, 68 bp, Homo sapiens
ccacttcccagtctgtcacctgggcctgaagagacattttaaagccctctgatcacactggctggtgg

SEQ ID NO: 6807155 - DNA, 80 bp, Homo sapiens
gaccacaaagtatcaactcccacactgtgccaatactgtggtaaacactatgacagtggggatcaggtattttatgtgtt

SEQ ID NO: 6807156 - DNA, 84 bp, Homo sapiens
gaaagtggagtttgggtacagcctcatcacgggagctgctctgcgttctcgggtcatgcaggctggcatctaatgccaactttc

SEQ ID NO: 6807157 - DNA, 78 bp, Homo sapiens
tgtcttttagatcactaaactgaagcatgaaaaggtgaaatagtacctaaggtcagatttcaagtttatctcagagca

SEQ ID NO: 6807158 - DNA, 94 bp, Homo sapiens
gaaaaaagaatgacctcttccagtttacatatcaggcgttaagattgaatgccctgtggttcatgtgagactctggaagagtttactaatgttc

SEQ ID NO: 6807159 - DNA, 68 bp, Homo sapiens
taagaagacttgcttcaagggctctcttctaccatgaattagctgggtggccttaggcaagtcactta

SEQ ID NO: 6807160 - DNA, 67 bp, Homo sapiens
gacaaccagcttcccggcaggcacgtcctgtctcagacacgggaccctcaccggggtgctatgtgtc

SEQ ID NO: 6807161 - DNA, 87 bp, Homo sapiens
gtgtgtgtgtgtgtgtgtgtgtgtgtgtgcatgcatgtgtgcctgcatttatgtgtgcatgtatacattaagtcacattttttatat

SEQ ID NO: 6807162 - DNA, 83 bp, Homo sapiens
ccatgttaacaggcacgagcaatggccgaggagggaccgccctccctccactcctagctcagtgcactttccagttaccatgg

SEQ ID NO: 6807163 - DNA, 75 bp, Homo sapiens
atgctgtccctgtgtccccaaggttcagcccacagtttccgcagctctgatttcaaggggaagcaaagacgatat

SEQ ID NO: 6807164 - DNA, 57 bp, Homo sapiens
tgttacaaagcgctttacctctgaagcatgtctcaggggcagctgtgctttgtgcca

SEQ ID NO: 6807165 - DNA, 69 bp, Homo sapiens
tgtgccgatcaggagtttctattgttccaaaattaaacagaaattttggcttgaaacttactgggcgca

SEQ ID NO: 6807166 - DNA, 62 bp, Homo sapiens
gactcagatttcactttctctggaggtctttgattctgccccagacatattgacatttgatc

SEQ ID NO: 6807167 - DNA, 55 bp, Homo sapiens
attactcttctagaggtcctagaaggaagattttctctcctctagtcagggtggt

SEQ ID NO: 6807168 - DNA, 64 bp, Homo sapiens
acctccaggagaataatggcagattataggctcatctccgtggctgccttttctctctgagggt

SEQ ID NO: 6807169 - DNA, 98 bp, Homo sapiens
ctcaatggtataggctggctccaccccaggaggatgagaagcaggcagaggacctcaaggaacgtcccctgggagtggaggaaggacttatccttggg

SEQ ID NO: 6807170 - DNA, 96 bp, Homo sapiens
tcctctgcagttgttacaaaggtcataaaagtgtgctaggtgtttatccaggaagaaaatatatttttattcttttttaataacaggagcagggga

SEQ ID NO: 6807171 - DNA, 78 bp, Homo sapiens
aggctggaaataaaagtaggaatgaaacgcatggaagtacccagtgtccatgcacctcacctctactttatccagctt

SEQ ID NO: 6807172 - DNA, 81 bp, Homo sapiens
atggaagtcactcatgtgggaaacagaaaatccatctttcaattgtcccagaaggttctttctcaacatgaatgtttctat

SEQ ID NO: 6807173 - DNA, 58 bp, Homo sapiens
agggtttgtgaagacttggccagctctccgttgacaatggccaaggaatagaagctct

SEQ ID NO: 6807174 - DNA, 61 bp, Homo sapiens
gtccttggcttcttgttgactgttgtccaggggttgctgtcagcagtaagaggccaattgc

SEQ ID NO: 6807175 - DNA, 81 bp, Homo sapiens
ccgtaaagaggagctggtggcagagacatcaggtgtttgctcagtgacacagtgacatcacggccacctcttatttcatgg

SEQ ID NO: 6807176 - DNA, 72 bp, Homo sapiens
tcaggatgggtctgagggccttaccactcctgtacccaccaacccaggactggtacttcaagaccccactgg

SEQ ID NO: 6807177 - DNA, 112 bp, Homo sapiens
tgtttattaagcataatttgatctaggctttgtgcaggatacagggatataaaaatgaacaaggtatgtacttctcctcatagacctacagatatagataactaaataaata

SEQ ID NO: 6807178 - DNA, 105 bp, Homo sapiens
ttcctattttaaatggttcctactttgattgcaagcatttattataattatcaagagattagtctgctgtgatagaatccttgtaatggaaccatttaaaaggaa

SEQ ID NO: 6807179 - DNA, 74 bp, Homo sapiens
accgggtttggagaggaaacacagagcagtgtctatttagatcttcagcgaggtttcctttctttctccacggt

SEQ ID NO: 6807180 - DNA, 78 bp, Homo sapiens
ttggcaagtctgtttgtcgttctgaataacctgagtcctccaacattggccttattcagattggctacaggatgccaa

SEQ ID NO: 6807181 - DNA, 77 bp, Homo sapiens
tgaagtgtgattaatcaccatggatgtatgattgagtcaattgactgttactttttcatgatgattaatcagctaca

SEQ ID NO: 6807182 - DNA, 86 bp, Homo sapiens
tgaagactgttggtcaaggcagaatggatgccaagggacattccagttcttcttctggcattttctcctttgagtttttgtcttca

SEQ ID NO: 6807183 - DNA, 65 bp, Homo sapiens
ctctttgtagcctttgcatattcaacagaatgaacctgcccagggtctacaaaaatatttgagag

SEQ ID NO: 6807184 - DNA, 81 bp, Homo sapiens
gtgtggggccaagggtcaagggccctcggatgatgatggtgctcgtgtttccctctcctcctcggctccctaagtcccagc

SEQ ID NO: 6807185 - DNA, 75 bp, Homo sapiens
ttcctgcattatagagccaaaaatatgttgagatgtattttgagatacatgttgtattctttggctggtcaggaa

SEQ ID NO: 6807186 - DNA, 59 bp, Homo sapiens
agtctgagcctgggcgtttctctagtgtgacaccactgaggattagcccaggctagatt

SEQ ID NO: 6807187 - DNA, 80 bp, Homo sapiens
gatttacgtgaaagtggattaaaaggcctttcaaaagaatgggtttgaaaaacctcagtccgctttaatacacgtacatt

SEQ ID NO: 6807188 - DNA, 89 bp, Homo sapiens
gtgtaacattttttagtctgtaaacttgtcattgtaatggtatctgtcacagaagcttgttgagaggttaagttagtaaatgttagcgc

SEQ ID NO: 6807189 - DNA, 84 bp, Homo sapiens
atgcctgcctgaccagccagcttccaccttctttcagagaacaagctctttggaagcaatgtaagtcgcatggcattcaggcat

SEQ ID NO: 6807190 - DNA, 56 bp, Homo sapiens
ggtatggcagttttcaagagttctgtggtgctgccagggttgagaattgttgagct

SEQ ID NO: 6807191 - DNA, 69 bp, Homo sapiens
tgctagaatttgcagaagcataaataactgcttgggctgctgctccgaagtgcttcctcgcaagttgca

SEQ ID NO: 6807192 - DNA, 122 bp, Homo sapiens
tatattgaagtcctaacaaccattacctcagaatgtgaccttatttcaaaataatgtatttgcaaatgtaataagttaagatgaggtcatattggtataaggtggggccctaattcaatatg

SEQ ID NO: 6807193 - DNA, 86 bp, Homo sapiens
ttctttatatattgaaccgcacagctgcaaggagttgcacaaatgttaccaactcatttgtcatgcaaacagtgcttcagaaagaa

SEQ ID NO: 6807194 - DNA, 58 bp, Homo sapiens
agacctcacaagataaaccgacaggactccattatttctttttctgtcttggaggtct

SEQ ID NO: 6807195 - DNA, 110 bp, Homo sapiens
ggggagctcaagggccttactcttaggtttctaattgccccttgtaaactgggtcctgcggtgaaagggagcaaatggacagacggtaggaaaggcagtttggaatccct

SEQ ID NO: 6807196 - DNA, 77 bp, Homo sapiens
gggtcaggtgttttattggcagcatgagctcctgggatgttcattcacctcattttcattgccagtcacgctgaccc

SEQ ID NO: 6807197 - DNA, 76 bp, Homo sapiens
gtctcccaaaatatacttccccattatgggggcatttcaaaatctccctgtgggtaatgtgtaactaagtggggat

SEQ ID NO: 6807198 - DNA, 60 bp, Homo sapiens
atcagggcaggatgctgtgattattcttattgcaaggaaatatgagcagcttgtcttgat

SEQ ID NO: 6807199 - DNA, 94 bp, Homo sapiens
tcagtgtataatcaaggctttggacatagcaaaagaaagtcatatatatcttttgatctaggatttgttagagtagtttagatttatatgctga

SEQ ID NO: 6807200 - DNA, 90 bp, Homo sapiens
gcctgagagtcagatagtctatgccagttctttctgagccagcaggctgcagggaaagggcactgggcttagaatcaaagacacttaggt

SEQ ID NO: 6807201 - DNA, 73 bp, Homo sapiens
tccctgttgggtttccctcaaaccccaagaacaagcacaggctgatggccttgatggggtgatccagcaccga

SEQ ID NO: 6807202 - DNA, 88 bp, Homo sapiens
tgctaatcaaataaagaaatcaggttgaaaactagtggataccttgctgggtccagtaaattacttgatgtcattatcttttgaagta

SEQ ID NO: 6807203 - DNA, 107 bp, Homo sapiens
tgctacgagggcttcagctgcttgaacaaggataaatttgagaaaataaataaatgttgttcaggtcagtttcaatgaagccatttttcttctattattccatggca

SEQ ID NO: 6807204 - DNA, 95 bp, Homo sapiens
gagccagtgaaattatagtcaaactgcatgaagctgattttagaaccacattttcttaaaatggaggttatgtaggttacatgttttactggctc

SEQ ID NO: 6807205 - DNA, 55 bp, Homo sapiens
tgctccaggagcaacctttgagaactgccatcctagatgctgtgctccaggagca

SEQ ID NO: 6807206 - DNA, 61 bp, Homo sapiens
gttgcttggtttgtaggtatactgtcaggttagattacaatttgcttgcacatcaagctac

SEQ ID NO: 6807207 - DNA, 56 bp, Homo sapiens
attccagttcacatcgatctcccagtgctggcgggctccaacggtgagcatggaat

SEQ ID NO: 6807208 - DNA, 58 bp, Homo sapiens
acccaaaaggcgaaggttgcagtgagctgagatcatgccactgcacttcagcctgggt

SEQ ID NO: 6807209 - DNA, 58 bp, Homo sapiens
caggcatagaagggcaagaataagacaaaaagtgtcatctccagcccctctgtgtgtg

SEQ ID NO: 6807210 - DNA, 67 bp, Homo sapiens
tcatgtgacaggcactgttctgagtgttaaggatgcagcagagaaaagacagtccctgtctacatga

SEQ ID NO: 6807211 - DNA, 69 bp, Homo sapiens
gggagccctgctgcgcagcacgcatgccttccctgttcagaacgccgttttgcatcagcgggagcgccc

SEQ ID NO: 6807212 - DNA, 77 bp, Homo sapiens
tgggtggactgctgtggagtatgtagggttactggaagacctagtagaccaagtatgctctcatagcacccaatcca

SEQ ID NO: 6807213 - DNA, 109 bp, Homo sapiens
gagggcaattaggagttaaaatctagccttttcattgttcctcgagcattgtccaagctcagagctgggtatgtctggaggaaggggcaaaaggtgtcctttgccagtc

SEQ ID NO: 6807214 - DNA, 69 bp, Homo sapiens
gtgcagccaccatgggttctcacctttatctttacagcaaagcagaaagtggccctggtgtggctgcac

SEQ ID NO: 6807215 - DNA, 82 bp, Homo sapiens
ctgattagaagaatacttgatgttcatgataattgtggtgcaagacagttttaagtatgtttttagtatttttatagttcag

SEQ ID NO: 6807216 - DNA, 129 bp, Homo sapiens
gctcagcctggtaggtagaaacagcccagagatgtagagtgatggcaggcaggtgagtagagccctgtaagcgcagattctggaaccagcctgcctggggtcacatcctggctccaccgtaggatgggt

SEQ ID NO: 6807217 - DNA, 105 bp, Homo sapiens
gcccctctggtggtcccccgctgagtctttggtaaagtctgctgcatctgccaattcttttgtgagcagatttgttctaggggtgtgggggactaagaaaggggt

SEQ ID NO: 6807218 - DNA, 86 bp, Homo sapiens
ctacttcattctgttcccacagtcactgggagaagttggagtaaggacttctgaaacccccagtgtgggtcctgaagaatgtgtag

SEQ ID NO: 6807219 - DNA, 83 bp, Homo sapiens
gcaaggctgcctctcctccagaggctgtggggaaaaggtctgtttcctagtctttttatagcttctggaggtctgtcacttgc

SEQ ID NO: 6807220 - DNA, 57 bp, Homo sapiens
acaggtgaggatctgagcctcacaaggacttccctaagaggcattgtgctcatctgt

SEQ ID NO: 6807221 - DNA, 121 bp, Homo sapiens
gggctctgtcccgagcaacttttcccccaataatgcatgcagagcttccagtggcctgggcagctctccggtggcagccactggggccctgtcacacggggagtgctttcagcatgagccc

SEQ ID NO: 6807222 - DNA, 88 bp, Homo sapiens
ttgattggtagcgtgaagctgcaataattgttttgaaatggattcaaatacaattaatgcagtttatacccatggaactaccaaacaa

SEQ ID NO: 6807223 - DNA, 68 bp, Homo sapiens
ctcaagcctgggtggtcttgcttcccaggataggatctctgtttctggggaacccccgggttcttgag

SEQ ID NO: 6807224 - DNA, 72 bp, Homo sapiens
ctcttcacacatcctgaccaagttcagggcagtgaaggcactgccctcatcgtttccagaatgtggatggag

SEQ ID NO: 6807225 - DNA, 114 bp, Homo sapiens
ttgagtttcccccattgacttaacccttcagctgctgctatgggtctgtgcccagccaggtgggaccagatgaagagttggaggggctctgggtctaggctagggatgtctcag

SEQ ID NO: 6807226 - DNA, 72 bp, Homo sapiens
tgatttgatctcattcagcaatgttctttgaaatacagtcagaatgctccagagctgaaagagatcatctca

SEQ ID NO: 6807227 - DNA, 79 bp, Homo sapiens
ttgtcagaaggaaggcttcctgatgccaaccactttgaaatgtaacatggtttataagagccaggagccccttctacaa

SEQ ID NO: 6807228 - DNA, 71 bp, Homo sapiens
ggtgtggactttgtcctgtagttacagtggagccctgggggctttctgaaacaggacagaggatcagaacc

SEQ ID NO: 6807229 - DNA, 83 bp, Homo sapiens
tagaggaatttatggcagccaagggtttatggttttgatatgggtttattaagcacaatttaggactgaaatagtctcctctg

SEQ ID NO: 6807230 - DNA, 77 bp, Homo sapiens
tgaaattgcaaaattgattgtggtgatggttgcacaactttgtgactatactaaaaacaatcgatttgtatatttta

SEQ ID NO: 6807231 - DNA, 74 bp, Homo sapiens
attaaatggataattcttgttgattttgagctggcaatctcaggcttctaaatcacaaggaaactccatttgat

SEQ ID NO: 6807232 - DNA, 64 bp, Homo sapiens
tgtatctttcattggcagagcctgttttgttttaaaatctgttctgcagtgaatttaatttaca

SEQ ID NO: 6807233 - DNA, 113 bp, Homo sapiens
ccacctggaaacttgttagaaatggaaattcccaggccccaccccagagctactgaatcagaaactctgaggtcagggcccggcaatttgtattttcacaagctctccagggg

SEQ ID NO: 6807234 - DNA, 73 bp, Homo sapiens
gagaggcattattgagggagcagctgaaatttatattcccgatcagtggcagcattcacaagtgatgtctctc

SEQ ID NO: 6807235 - DNA, 61 bp, Homo sapiens
gggaggtcctaaaggggaccaggtctttagaggcccaaagcctacccttaggagtcctctc

SEQ ID NO: 6807236 - DNA, 74 bp, Homo sapiens
cagccgttggtctcttgcagggcaggctactccactcatgctctggggagaggctgatcctgcagagaatgctg

SEQ ID NO: 6807237 - DNA, 119 bp, Homo sapiens
gctggaatgcaagtggtgccatcatagctcactgcagcctcgaactcctgggctcaagggatcctcctgcctcagccttctgggtgactaggagtacaggtgcacccatcatccccagc

SEQ ID NO: 6807238 - DNA, 56 bp, Homo sapiens
ggccttggttttaccaggtgttcattactaaatgtgatataaagtaaaataaggcc

SEQ ID NO: 6807239 - DNA, 87 bp, Homo sapiens
atttttcttttaggcttttctatgtatttcagatttaccacaatgaatgtgtgtttgtttagtgcagagagaaaaataaggaaaaat

SEQ ID NO: 6807240 - DNA, 60 bp, Homo sapiens
tcaggctgcagctgtcagcagcaggaacttctgctgctttcatttgagacggagcactga

SEQ ID NO: 6807241 - DNA, 66 bp, Homo sapiens
ggatcatgcatgtgacatgatcctggaactgcatttagtctaggctcttctcacatatatcagtcc

SEQ ID NO: 6807242 - DNA, 68 bp, Homo sapiens
ctcattcattcccgcagccaccactcagcgcgtcccatgtgccaggggctgatggtggggatgaagag

SEQ ID NO: 6807243 - DNA, 114 bp, Homo sapiens
gggtaacatgagttttcactctctctttctcagttttattaaaattaaatggcaatgaaggtttgtgcaggaatattgatgaacttagagagataagtttaccttaagttaccc

SEQ ID NO: 6807244 - DNA, 56 bp, Homo sapiens
gccatgaaggatgttgtttcagatgccaagtggacaatgagactgtgtcctttggc

SEQ ID NO: 6807245 - DNA, 106 bp, Homo sapiens
gcctggaagtcttgttgaaatacagattggtgtgccacaactagtttctgattcagcaggtctggggtggggcccaagaattggtatttctaacaagtactcaggt

SEQ ID NO: 6807246 - DNA, 60 bp, Homo sapiens
gccatgaggaactgtaagacaattaaacctcttttgtctataaattatgcagtctcaggc

SEQ ID NO: 6807247 - DNA, 65 bp, Homo sapiens
agccaaagtcactaagtgaaccactgggtgacaagttgcccaggcccagttggtgatttatggct

SEQ ID NO: 6807248 - DNA, 81 bp, Homo sapiens
ctgtctgcactgcttagttggtaaatgtgtctgtagcatgactatcatcacaactgccatctgagcagcagagccagatgg

SEQ ID NO: 6807249 - DNA, 67 bp, Homo sapiens
agaaaccgtggtctcctctcctcgatcccgttcacagccattgatctccagaggagtcatggtctct

SEQ ID NO: 6807250 - DNA, 77 bp, Homo sapiens
gggagccctggggagaatcagagaatgctgagggttggaaaagaccttagacatcagtgcttctcagcgggggtccc

SEQ ID NO: 6807251 - DNA, 62 bp, Homo sapiens
tctggcattacatgtgcaaaagagaggagtagcttctcatgtggtacagtggtaagctatga

SEQ ID NO: 6807252 - DNA, 58 bp, Homo sapiens
gtcattgtttcaaatctttctctccctgtagcagtgagagcctggtctgagataggac

SEQ ID NO: 6807253 - DNA, 63 bp, Homo sapiens
tatttttccatctttgtaactctagtaacatattgctaacagagggtgcaacatggggatcta

SEQ ID NO: 6807254 - DNA, 70 bp, Homo sapiens
gttgataggcaattgcaagggaatttatggtattctaacacctgtattcccataggcaatgcgtgataac

SEQ ID NO: 6807255 - DNA, 113 bp, Homo sapiens
ggaaaagtacaggcagactataagaagcttccacggatgtgtctaactttgcaaatgaacaaaaatctaatgtagacatatcctggaaacttctagtttgcctgcacttttcc

SEQ ID NO: 6807256 - DNA, 69 bp, Homo sapiens
gtgaataccagctagatatctctgctctcgcttccaacaggcaaagcagaacattatctaggtctttac

SEQ ID NO: 6807257 - DNA, 76 bp, Homo sapiens
gacgcttccaaaacctgctctgtaaggtcagaaaaggaatttgtcacttgaccctcacagggcagtcaggaatgtc

SEQ ID NO: 6807258 - DNA, 129 bp, Homo sapiens
tggggaccgaggaaggagccaggcagattttgttagccatgttgaagatttagaactcaagcaaacttatccaaaacttagaaatatggcagaaaggaagactgcagtttctttccacgtcggcttaga

SEQ ID NO: 6807259 - DNA, 72 bp, Homo sapiens
gcctcaagacagggagcagaggtgagaagttcattgcatactgttttcttagctccctgctttccacggggc

SEQ ID NO: 6807260 - DNA, 63 bp, Homo sapiens
tcacaattgtttttaggatcaagcctagagataaagagccatggtctctgaaaataatgttga

SEQ ID NO: 6807261 - DNA, 78 bp, Homo sapiens
ggggccagcagggtgcttccgtggagctgtctttgtttatgtcttcagcaagcggcctgtgaaagcccctccagtccc

SEQ ID NO: 6807262 - DNA, 130 bp, Homo sapiens
ctttccaaagcattttgaaaaatgtgttagtgtgtattaatgtttgtatatgttagttaactttacaattaatttatttgtaatataagcattaatagttgtgcttatgtgtccattgtgcaaaatttgg

SEQ ID NO: 6807263 - DNA, 78 bp, Homo sapiens
acgcggagcgcactgtgggcctgtcgtgggtggggccagcagcacatgcatgcctggctcacagagcagcctttgggt

SEQ ID NO: 6807264 - DNA, 106 bp, Homo sapiens
gaagagacagttcaaggactacaaatgatggtagtccttgaatttcaagtccttgggagttcaaggcctatcctcatttgtagttcttcacactgtaccactcttt

SEQ ID NO: 6807265 - DNA, 83 bp, Homo sapiens
cctttatttatcagccaagctgtgagagagtagtcatcagagtactggtccaacaaggttggcaattaatgatgcaataaagg

SEQ ID NO: 6807266 - DNA, 55 bp, Homo sapiens
tctgtgatgaggcttatttttagttactaacaatttttgaagcctaaattacaga

SEQ ID NO: 6807267 - DNA, 97 bp, Homo sapiens
tctgcattttgtagcttagcacacacaggcaggtgcttagcttaacaaaaatttatcaagcacatgcttttactgttttaagcaaacattttataga

SEQ ID NO: 6807268 - DNA, 81 bp, Homo sapiens
tctgattatttaggaggtctgtggtggagcctagaatctacttattcaattggtgctcccaagattgttctaagaatcaga

SEQ ID NO: 6807269 - DNA, 58 bp, Homo sapiens
tgagctgagatcgtgccattgcacttcagcctgggtgacaaagcgagactccagctca

SEQ ID NO: 6807270 - DNA, 64 bp, Homo sapiens
gtgaacatttgtgggggaacaggatacttacacagtctcaaagtagctcccacagattatttat

SEQ ID NO: 6807271 - DNA, 123 bp, Homo sapiens
ggccgggggtggcgcccgcgccccgcgccctcgtgccggcctttgttgtggagggtcccggggtgtgcggccaacatggcggaggtcagctgagtgcgggcagctgccgggccctgccctccc

SEQ ID NO: 6807272 - DNA, 72 bp, Homo sapiens
tggaatacagtgtttatgtacagattgtttcgtctttagactttaaatatccagtcaaaacactgttttcca

SEQ ID NO: 6807273 - DNA, 58 bp, Homo sapiens
ccagcactctgtcccagcttccacttcaaaaagcttttcggggaggcacgcaggctgg

SEQ ID NO: 6807274 - DNA, 78 bp, Homo sapiens
gagagcttagcagaaatgtagaatgtcgggctccatctcggacctactgaatcaaaatctgcattttagcaagatctc

SEQ ID NO: 6807275 - DNA, 65 bp, Homo sapiens
tcatcacaaatgtaataatgtctaccaggaagaaagtgggaaatggtagcagcaatttgggatga

SEQ ID NO: 6807276 - DNA, 55 bp, Homo sapiens
ggcccaaatctccacttgttgccatctcctaccagcagttggtggggaaagggcc

SEQ ID NO: 6807277 - DNA, 80 bp, Homo sapiens
tttactgtgtttgtacagatgaccttttgtttagattgaattgtctccccagaagtaagattactgtgagacatggtgaa

SEQ ID NO: 6807278 - DNA, 57 bp, Homo sapiens
gtgagccaggctgcagttggctggctgtggagcccactggctggagtgctggtccat

SEQ ID NO: 6807279 - DNA, 86 bp, Homo sapiens
tttggtatttaaaaggtagattttccttctatggttacgtgtttgatggttaatcatagaggaaaatccacgttttcagtatcaaa

SEQ ID NO: 6807280 - DNA, 70 bp, Homo sapiens
tgtgagagatgaggaggccagtaagagcctgatgctatccaggactcttccttccttcctccaactcacg

SEQ ID NO: 6807281 - DNA, 75 bp, Homo sapiens
gaaatcatcggtgatatcctcacaaagaagcttttgttgtttactctgtgtcagaagatatcatggcatggtttc

SEQ ID NO: 6807282 - DNA, 63 bp, Homo sapiens
gccatgcctggctaatttttttctgttttacagacggagtcttgctatgttgcccaggctggt

SEQ ID NO: 6807283 - DNA, 69 bp, Homo sapiens
aagcaataagccagatttggatcatgaaccacagtttaccaagtcctggtctaactggtctccttgctt

SEQ ID NO: 6807284 - DNA, 73 bp, Homo sapiens
gagagccatttcataagttggtgttgactttctcacaaaactgacaaaagttggacgatttgtgaaggctttc

SEQ ID NO: 6807285 - DNA, 66 bp, Homo sapiens
gattctgagccacagagctatttctctacttcctctagaggctgagatgtgggtttgttcagtgtc

SEQ ID NO: 6807286 - DNA, 73 bp, Homo sapiens
agaagctaaataatgctgtggtctaatggggagtcacatttcctggtttccgccacagtctttttttgctttt

SEQ ID NO: 6807287 - DNA, 62 bp, Homo sapiens
aggctagatagagggtcatcttagtattaattttaaaaaaagatacctgcatatttatgcct

SEQ ID NO: 6807288 - DNA, 55 bp, Homo sapiens
gaggaaggaagtcgaggagccaggcaggccaggtcttacctcagcttctttcctc

SEQ ID NO: 6807289 - DNA, 84 bp, Homo sapiens
ggaagcatagccaagggagtatgaagatgtgcataagacttttgtctgatacacactgctatccttttttgtgctaatgaattc

SEQ ID NO: 6807290 - DNA, 73 bp, Homo sapiens
ctccaaggaaaagtccaggggctggaggcggcgacccgtctgtggcagtccagaccctggactcgattcggag

SEQ ID NO: 6807291 - DNA, 66 bp, Homo sapiens
ttttgagttcttgactggggtgcttcttttctctataagattgtttaacagcagagacattcaaaa

SEQ ID NO: 6807292 - DNA, 57 bp, Homo sapiens
ccttcagcgtcccctttacccgttactcatagaatgtagcggagccacgactggagg

SEQ ID NO: 6807293 - DNA, 71 bp, Homo sapiens
tctgctttgaccttcttgatgctaaactttccttttcggatacatgtagtagagagggaaattagggcaga

SEQ ID NO: 6807294 - DNA, 68 bp, Homo sapiens
gggggcctgtgctgagaacctggctggctgaaggagaggaaccaccgaggctgagcatgaaggccgcc

SEQ ID NO: 6807295 - DNA, 64 bp, Homo sapiens
tcttaatgaatgtgtgctaacgttccttctggcataggaatgtgtagtaaatacacttcaaggg

SEQ ID NO: 6807296 - DNA, 67 bp, Homo sapiens
tttaggagagagatgccgccttgctccttgaacaggaggagcaaggcggcatctctctgatactaaa

SEQ ID NO: 6807297 - DNA, 90 bp, Homo sapiens
ttgttcgatacaaggagctttgaaagtttccggttcttagtacatatggaacacttagatttttaaggtttttttaattgttttagacaa

SEQ ID NO: 6807298 - DNA, 79 bp, Homo sapiens
ggggctaggtattgcttaggttcgtgaatgctgttcttacagacacagatggtacctgagcccctcagacacctgccct

SEQ ID NO: 6807299 - DNA, 93 bp, Homo sapiens
cttggattaggccgtggaggtaggtgacagaaggtgccagaatgccaggaggttttgacattatcctgttactggatgccctggcggtccagg

SEQ ID NO: 6807300 - DNA, 78 bp, Homo sapiens
gggagtttgttagaagagcagaatcttgagccctacctcagacctaccgaatcagaatctgcattttaacaagctccc

SEQ ID NO: 6807301 - DNA, 87 bp, Homo sapiens
gtgtgaaattgctgggctaagggaaggcttttgacatttcctagttgagttttagggaaccttctcaagtcttccttcagattacac

SEQ ID NO: 6807302 - DNA, 72 bp, Homo sapiens
taatagtattgagaggtggggcctttaagaggtgattaagtcatgaaggctccaccctcatggatgcgatta

SEQ ID NO: 6807303 - DNA, 73 bp, Homo sapiens
agcgttaagggttcactgtaggaaatttagaaacctctattcccactacccagagtgaatctcttaagatgct

SEQ ID NO: 6807304 - DNA, 67 bp, Homo sapiens
tctcacagctctccgctccttctcagacacgcagtaatctgagtctcaagcaccgaaagctgtcagg

SEQ ID NO: 6807305 - DNA, 56 bp, Homo sapiens
ctctctctatttctattggctctttttctgtggagaacagtgactaatatagagag

SEQ ID NO: 6807306 - DNA, 77 bp, Homo sapiens
ttttgttgatatacagtatgtactgtggtttataatttttaaggcatgtgaactgggacatattggatattacagaa

SEQ ID NO: 6807307 - DNA, 60 bp, Homo sapiens
ttccaagtgtcagatcagatttttagactgaagtttctaaagtctgcacagataccggaa

SEQ ID NO: 6807308 - DNA, 62 bp, Homo sapiens
tcagctatgttttggaacagggagctgctaaaaagactttgcttcctttgaatatcagttga

SEQ ID NO: 6807309 - DNA, 75 bp, Homo sapiens
gtaatttgatgtggccccacttagctgtgcttgcttttgttgagtacagttttggtgtcatatccatgaaattat

SEQ ID NO: 6807310 - DNA, 63 bp, Homo sapiens
attgagagacaccttgacctttttacacatctgtcctagacaatgtcaaggtgatcatccagt

SEQ ID NO: 6807311 - DNA, 66 bp, Homo sapiens
gcaatttagttaatgtgcactccttgtaggccctggttttggcccgagtgtatttgggtagagtgt

SEQ ID NO: 6807312 - DNA, 58 bp, Homo sapiens
tgtctgtccaggagattcagtctaggataacactgaggcatttccacaggacagctcg

SEQ ID NO: 6807313 - DNA, 130 bp, Homo sapiens
atctggcagtagggtcaggtgtctaaggcacaacatttaaggaggcactgactcacaatgtcttattctcagtgcactcgctctcagtgcctccttaaattttgcctcctaaaagccctgcttgcctcat

SEQ ID NO: 6807314 - DNA, 71 bp, Homo sapiens
gcgatgggatggggaaggtcggaggaaatggctgtctgtgtaaaccctctgcctgcccaccgacccatggc

SEQ ID NO: 6807315 - DNA, 102 bp, Homo sapiens
acttagctatgcaatttgttacttcttggggaaagttttgcattacataaatttgtgtttcagaaccttctttcattctgggtgcaagctgaatagccaagt

SEQ ID NO: 6807316 - DNA, 60 bp, Homo sapiens
cctggccacctctgccctaccgagtgggaccattcaccgggcaggagaggggtggcctgg

SEQ ID NO: 6807317 - DNA, 69 bp, Homo sapiens
ccaaatggtaacactcaatttacaaactctggatatttgattcggagtctatccttgaatgtactgtgg

SEQ ID NO: 6807318 - DNA, 107 bp, Homo sapiens
gtagaaaatgttaataatgctgattaaactttaatgcgttttgtgtctgtagccactacattgtgaatagaatagcatagaaaattgaggagctattatttttgtat

SEQ ID NO: 6807319 - DNA, 112 bp, Homo sapiens
gaaggggagggaaggaagagattgagtattagtgttatgttatctgctaggagctatgctagccagatgctgtcacacacactgttactgaatcccaacttctcttctgttc

SEQ ID NO: 6807320 - DNA, 55 bp, Homo sapiens
gtaaagtgcttcctaacccagagctgaatgtatttgactctggaaagcattttat

SEQ ID NO: 6807321 - DNA, 75 bp, Homo sapiens
ccatctcgttggctggaacatttgcttttggagcccaaagctgccatgcaagaagtccaaccatcccgaggttgg

SEQ ID NO: 6807322 - DNA, 75 bp, Homo sapiens
gctattcaccattttatgtttatggagtgctgaacttacacagctttttataaaatatgaaataaaggcttatgc

SEQ ID NO: 6807323 - DNA, 95 bp, Homo sapiens
gatagaatagaattaggtattcagcgcatgctcagtaaatacctgtggaatagatcaatccacagagtggcatgaatgaagccttctgtctcatc

SEQ ID NO: 6807324 - DNA, 123 bp, Homo sapiens
ttgccaagtgtctgttggagcaggataatattgtctctttcaataacttgtttttattctctctttagaaacagttctttggatggaagaataaagttatcaatagttttagctgcttggtgg

SEQ ID NO: 6807325 - DNA, 55 bp, Homo sapiens
tctggctgtgtaaggtagcaccatgtgaattccaggtctcctaccctcagctaga

SEQ ID NO: 6807326 - DNA, 90 bp, Homo sapiens
attttgttaggacacattgcaggaaagttcattattctaggccttcaacagaataatcttagcaacctccagtgtgatagagaacagagt

SEQ ID NO: 6807327 - DNA, 59 bp, Homo sapiens
tgaactgggacgtgcagtaagtgatgtaaaatacatgctaattgcaaagtcttggttca

SEQ ID NO: 6807328 - DNA, 70 bp, Homo sapiens
agaaatttcatgtcttcttgaactttgagagagacgtccattttggcagaggaagaaggcacatatttct

SEQ ID NO: 6807329 - DNA, 57 bp, Homo sapiens
gtccctggagcagggtacaggggtcaacacactgccttctgttttttgtaccagggc

SEQ ID NO: 6807330 - DNA, 130 bp, Homo sapiens
ttatcatgctcatggcatcacctgggacctgatttcttcaccagtgtcttattgaccatctttctaaaggagggtctaagggagaactgatgaaataagtcataaattccaagtgtgttatacatgctaa

SEQ ID NO: 6807331 - DNA, 92 bp, Homo sapiens
agaatctgctacattaataacttcatgtaacatttaacatgtaattaaacaacatattatggatttactgagttattgagttaggagatttt

SEQ ID NO: 6807332 - DNA, 66 bp, Homo sapiens
gtagcttctgttcatcttccaggcacagtgctaggtgctgggatgctaagatgagcaaaagaaaac

SEQ ID NO: 6807333 - DNA, 71 bp, Homo sapiens
gccaggcactgtgttaggcactgtgtatccaacaggacataacagtgaataagacatgtgctttccctggc

SEQ ID NO: 6807334 - DNA, 91 bp, Homo sapiens
caaaaacaaaagcttcagttctggggcaatgagaaaattaatcaaacatctgcttctttgaccccgcatggattgggagttaagtgctttg

SEQ ID NO: 6807335 - DNA, 61 bp, Homo sapiens
gatgttgtctgagtgctgggtggtctgtccctgtgctgtgccctgtgctcatgggaacatc

SEQ ID NO: 6807336 - DNA, 57 bp, Homo sapiens
gggaacagggcaggcctttggagcatctgtgctggacagtgaggccctcctgttccc

SEQ ID NO: 6807337 - DNA, 57 bp, Homo sapiens
acaggcattgcaagcagcagttcactaaccaaaacaaattgcagcctgtagtcttgt

SEQ ID NO: 6807338 - DNA, 57 bp, Homo sapiens
ccatcaggtaatttgcacctagttgaattctctcaataactgctaaattccctgtgg

SEQ ID NO: 6807339 - DNA, 66 bp, Homo sapiens
gcaagctcctgcacttgtcgctgaagagcaagggctcaggtgggcgttccggtgcgggaaccttgc

SEQ ID NO: 6807340 - DNA, 61 bp, Homo sapiens
tgcccatttgctctgtgtcagtggcacaaaagtgccactgggcatgcagatgtcccaggca

SEQ ID NO: 6807341 - DNA, 119 bp, Homo sapiens
agtatcccctcactctacagaccctatgcctcttccagctgctagctagatgcaacatgacatcgttttgtttctggaaaaggcgagaattgctgggaagcattgtctggggccgtact

SEQ ID NO: 6807342 - DNA, 55 bp, Homo sapiens
agaagagtgggctggcacaaggcagcagctacgctctgctcagaccaactcttct

SEQ ID NO: 6807343 - DNA, 77 bp, Homo sapiens
ggagggactcactcaaggtcacacagatagcaacaagaggcagagctaggtctggaaccaagacgtgtagctcctcc

SEQ ID NO: 6807344 - DNA, 58 bp, Homo sapiens
gagaggggtttgggtaggtaagaaattcatttcttacagagtttacagagcccatctt

SEQ ID NO: 6807345 - DNA, 92 bp, Homo sapiens
ccaccaaccttcataggatcgatgctgtgattgtagaaatattgtacatcaatgtcataatcaagtgtgggggggtattaaggtcaaggtgg

SEQ ID NO: 6807346 - DNA, 99 bp, Homo sapiens
tcacatctcagttagctatttttaggatcaaatgaaatattttgatttgctgaaatcaagcttaatgtttatgatctgtgaggcactaactaaatgtga

SEQ ID NO: 6807347 - DNA, 73 bp, Homo sapiens
gctccagatgaaggcagccgtgtgactgcatgtgtactgcagcacgtgaagcaggaaggctgcccagtggagc

SEQ ID NO: 6807348 - DNA, 109 bp, Homo sapiens
tttttctatgatccccagtctcccataattttccatggtttgctaactgtatgcctctaaacaggtggaaactagtgccatgcgaggggtgggagaggaggaagaaaag

SEQ ID NO: 6807349 - DNA, 80 bp, Homo sapiens
gtcccccactctgggaacgcagagcttcattaggctgtgagctccttcaccagacctaggctctgtgagagcaggggggc

SEQ ID NO: 6807350 - DNA, 56 bp, Homo sapiens
gcttagctctccttcgcatgggtgtctcaatgccagggtgtcaggagagctacagt

SEQ ID NO: 6807351 - DNA, 60 bp, Homo sapiens
gttcggtgggcttttaagtggcatttgttaactgacatgcaactaaagggtgccacgagc

SEQ ID NO: 6807352 - DNA, 84 bp, Homo sapiens
ggatgttttaagttggaattatgagagtaggaggaactggatacccaacatttagagactctcacagtctttgacttggcattt

SEQ ID NO: 6807353 - DNA, 55 bp, Homo sapiens
gcccattgtttttgttcatcagcgctgccaccaagtgtggaggaatcacaatggc

SEQ ID NO: 6807354 - DNA, 87 bp, Homo sapiens
cccaactttgattacctatcacaggaaaatctgcccacacaagactggtaagtcgatggggtgatatttcttgaggaatctttgagg

SEQ ID NO: 6807355 - DNA, 74 bp, Homo sapiens
agtgtacagtgttctcttcctgtatagcacttgtattttcaagagctagggtcattgagagaacacttctcact

SEQ ID NO: 6807356 - DNA, 62 bp, Homo sapiens
ataagctgtgtaagttgcttggttctagctatagacgagtgattccacacttgcacgcttat

SEQ ID NO: 6807357 - DNA, 88 bp, Homo sapiens
gcctgatttgggcccctgttgtggctttgtctaattatagaaatggatccttagagtcctcagcgttttgtgggaccccaaaccaagc

SEQ ID NO: 6807358 - DNA, 61 bp, Homo sapiens
gcttcacaaggctgagttgtacttgctaaatgagggcaaatgacagactcaccttggcagc

SEQ ID NO: 6807359 - DNA, 129 bp, Homo sapiens
gctcggtcatcagaggacgcagtgacacctggtccctggcgaggtcccgctctccccttggcagaatggtgagggctagggactcctcctcagggtgcttttgttttgttttttttggagacaagagtc

SEQ ID NO: 6807360 - DNA, 95 bp, Homo sapiens
cccctcactcccggaaacgacgttcagtccctggatttagagttcttttgctcaaattggattttaaactgttggttttctgtttgtttaagggg

SEQ ID NO: 6807361 - DNA, 72 bp, Homo sapiens
atgttccacttcattagaatagttatgggctttcacagtttaaaaatagtcttggctttagtgagggaacat

SEQ ID NO: 6807362 - DNA, 108 bp, Homo sapiens
ctagatgttggaaattaattatctctgaaagggttatcattgtggacacttgcttaatttgtaaaatatttgctactcttgattgatttagtctttttctgactttag

SEQ ID NO: 6807363 - DNA, 61 bp, Homo sapiens
gtatgaggagccacgcagttcttaggcgttacgataagaaacaaccactgctctccttaac

SEQ ID NO: 6807364 - DNA, 79 bp, Homo sapiens
taaaggtgcctgtaagttgtatgggctctagaatcaaactcgggttcttatttcagctctgccatttactagccctttg

SEQ ID NO: 6807365 - DNA, 63 bp, Homo sapiens
ggctctgcctgcctgagtgtccaacagcgtgttgatacaactctcttcatggtggcctgagct

SEQ ID NO: 6807366 - DNA, 62 bp, Homo sapiens
ttgagtttcttaaaagaggagttagaagttgaagatatttctaatgccttaaagaaattgag

SEQ ID NO: 6807367 - DNA, 74 bp, Homo sapiens
ccatctgcacctgccagagatttcacactgctatgttgcaaatagggcttgaaatttctggctgtgtcaggagg

SEQ ID NO: 6807368 - DNA, 63 bp, Homo sapiens
cagggtgcagtgtcgctgctagccactggtggatcaagggcagaaatgacagtaagcaccctg

SEQ ID NO: 6807369 - DNA, 66 bp, Homo sapiens
ttcttctgactgaggttattgcaataaaatatttactattataagcaatagcattcaaatgaagga

SEQ ID NO: 6807370 - DNA, 63 bp, Homo sapiens
tttaaggttgaaatagatgcgtcagagatttttttaagagcatctctgaaactgtgccttgaa

SEQ ID NO: 6807371 - DNA, 59 bp, Homo sapiens
tagggctgtcagactgaggaggcccaaaagcttttgaggtttcctccagataagccctg

SEQ ID NO: 6807372 - DNA, 99 bp, Homo sapiens
agggatgtagattttaagaagaacaaagagaccatgagccaaacttgagtgcccttcctccaggtgtttttttgtcatcttaatcaaactaaggttcct

SEQ ID NO: 6807373 - DNA, 63 bp, Homo sapiens
ttgtacagtttaagtgggtgaattatatgatatgtgaatgatagctcactaaaactgttacag

SEQ ID NO: 6807374 - DNA, 57 bp, Homo sapiens
agtgcatgctctgtagaaagcagggttaaataccatgggctacagaagcatgctgct

SEQ ID NO: 6807375 - DNA, 63 bp, Homo sapiens
gtaatagcagctgaaagggatctctacagattattactgtcatcttttcgcagctgcagttgc

SEQ ID NO: 6807376 - DNA, 66 bp, Homo sapiens
gcatgtgactatatagagcataaagtccattggtgtaaactttctgcaaaataaatagtgacgtgc

SEQ ID NO: 6807377 - DNA, 65 bp, Homo sapiens
ccaaactttgtgcaacatcagggaatgtatattgaagaagattcctgcaaatgtaatgagtttgg

SEQ ID NO: 6807378 - DNA, 70 bp, Homo sapiens
ccgggctccgggcgtgcgcacgaggagcaggtgcccgggcgagtctcgagctgcacgcccccgagctcgg

SEQ ID NO: 6807379 - DNA, 79 bp, Homo sapiens
tgagggtcatctcaggtgtgcttgattctgttgctccttcagctattaaggcacttgagcatgatgccatatttcctca

SEQ ID NO: 6807380 - DNA, 64 bp, Homo sapiens
gtcgataagatggaagaatggcagctgtgctggagcagacagtggtgttttccattgcataggc

SEQ ID NO: 6807381 - DNA, 58 bp, Homo sapiens
ggcctctgcaggcctcgacaaggcctggcctcctgcctcccgaaggcctgcacaggcc

SEQ ID NO: 6807382 - DNA, 57 bp, Homo sapiens
ttcaatgcaagggaggtctgaagaagtgatcacaatttcttcaggctcttgcatgaa

SEQ ID NO: 6807383 - DNA, 129 bp, Homo sapiens
ttggaaactcagtcccgtgagtaggacgtccacctcattggtggtgtttaaatattaagtgtcaaatgctagagacagtacaaaacccaccagagggggccttcctaacacgttggcataaggatccaa

SEQ ID NO: 6807384 - DNA, 104 bp, Homo sapiens
gctgagaaagggcgggcagctgagcaggcagccaagccagccggagcattgtgtgtgatctgcaggctgaggctggctcaactgccttggagctctttgacagc

SEQ ID NO: 6807385 - DNA, 75 bp, Homo sapiens
ggaagcagagcagatggtcttcataagttttaagcaaaggtgctaagaaaacacaaagtttacttttctacttcc

SEQ ID NO: 6807386 - DNA, 77 bp, Homo sapiens
aagatggtactcacagcctcaggcaagctgccatgagattgtcattccttggcactggtgcctgtggcgagcatctt

SEQ ID NO: 6807387 - DNA, 59 bp, Homo sapiens
aaggagctgcaagtgttgagagctgtaaaatctgacagcaatcaaaattaaagctactt

SEQ ID NO: 6807388 - DNA, 70 bp, Homo sapiens
cataagaactatctgggtgttaaaagggcaagttcttcaggcccttttaacacccaggtagttctgattg

SEQ ID NO: 6807389 - DNA, 88 bp, Homo sapiens
gaatgagcagctcagtatactgacctgagtaactccagatgaggtgttacttagtgttcttgtattgactattcctatatgttcattc

SEQ ID NO: 6807390 - DNA, 62 bp, Homo sapiens
agttggtgctttagctgagttggtcaaataccaatattatgactttaggtaaagaaccaact

SEQ ID NO: 6807391 - DNA, 69 bp, Homo sapiens
gcacctccccacatggtagtgagtatcctgtcctaaaagcaactcaaaaaagccatttggtgggtgtgt

SEQ ID NO: 6807392 - DNA, 106 bp, Homo sapiens
agtgcagtggtggatcacaactcactgtaacctcaaactcttgggcttaaggaatcctccctcctcagcctccgaaagtgctgggattacatgtgccaccctgcct

SEQ ID NO: 6807393 - DNA, 117 bp, Homo sapiens
gctcggcctgtgccgggctgggtacttgcacacgtgtatgtacatgcatgtgtccctgtctgaggggtcatgtatatgcatgtgtgtgtgcctgggcatgtgtagcaggggccgggc

SEQ ID NO: 6807394 - DNA, 83 bp, Homo sapiens
attgccacctaaggtgggaggcattgcagcttcctggtgctggaagcactgaagattgccctgtctcctgtgttgcctgtaat

SEQ ID NO: 6807395 - DNA, 87 bp, Homo sapiens
cacatgcactgtggggtgtggatgtgtctctgagatgtccatgaatgagcctctgggcacacaccatgcccacagattgatgcagtg

SEQ ID NO: 6807396 - DNA, 75 bp, Homo sapiens
ctcctgggtgttttcaatgttggcactgcacacggagttggcctggctgttttcaatgttgatggcaccagtgag

SEQ ID NO: 6807397 - DNA, 55 bp, Homo sapiens
gttatctgagagtctgagttacaaggtaactcagaaaccagctctctcaattaat

SEQ ID NO: 6807398 - DNA, 70 bp, Homo sapiens
gtatctttcccaccaatcacaatgctgcagtcttagtgtatgcagtctctatggtaactgggaaacatgc

SEQ ID NO: 6807399 - DNA, 74 bp, Homo sapiens
agggaactgctgatagtgttgtaaattattataatcctgtagaaaggaatatggcaatatgtatcaagatctct

SEQ ID NO: 6807400 - DNA, 59 bp, Homo sapiens
tggagaatggttctggcccagatgccaatagcatccctgtgggtcctgcacattctcca

SEQ ID NO: 6807401 - DNA, 60 bp, Homo sapiens
ctgtctgtggtctcagtaggcctctttcagcccagcggcctccatgccaccatcagacag

SEQ ID NO: 6807402 - DNA, 94 bp, Homo sapiens
gtctatttagtgccaggcactgtgctagatccttggggtagagtcataaaacaatctgagataaggaaacagtacagtgtggaatttgatacac

SEQ ID NO: 6807403 - DNA, 55 bp, Homo sapiens
atacaggagagatggtccattcgagaaaggactctaatctttgtcttttgtgtat

SEQ ID NO: 6807404 - DNA, 71 bp, Homo sapiens
tagtggtatgctgaagccagctcgcatagaacagtgatagctgattgcagcctcttgtttcagccccacta

SEQ ID NO: 6807405 - DNA, 72 bp, Homo sapiens
tctattttgtatacccataactttctctctgggatggatacatattagagaaaagatggatgtgagactgga

SEQ ID NO: 6807406 - DNA, 69 bp, Homo sapiens
ccatcgtggaactatggacctagagttggcaatggagaaaatagctacctagaaatacgttttacatgg

SEQ ID NO: 6807407 - DNA, 70 bp, Homo sapiens
gccctggggtgatctctggctttccgatctttgaagcccataaaaagaggtccctccggttatctttggc

SEQ ID NO: 6807408 - DNA, 56 bp, Homo sapiens
tgcctttggaaggcagagctctgtgaactatgtatattttcttctttccaaaagca

SEQ ID NO: 6807409 - DNA, 81 bp, Homo sapiens
tgctctgtttcctttctggtgagcatacaggcaggtttacttgttaatatactacgcaccaaacaaaggaggatctgagta

SEQ ID NO: 6807410 - DNA, 64 bp, Homo sapiens
gatatgaagtggcattgtgaagggagattttactcttttctcttttctgaaggcaacatctatc

SEQ ID NO: 6807411 - DNA, 64 bp, Homo sapiens
ggtagtgggtaatcaacagatatctgctagtagcttgtgattattctgttattattacattgcc

SEQ ID NO: 6807412 - DNA, 57 bp, Homo sapiens
gctcagaggttgttcttgggtttctttcagctaatagcttcagaatggcctctgagc

SEQ ID NO: 6807413 - DNA, 56 bp, Homo sapiens
tcctgacttaactactctctggagctactgcctactagagaagaggttaagcatga

SEQ ID NO: 6807414 - DNA, 72 bp, Homo sapiens
tcctaaaatctagaagtttaaaaggataatctttgtttatttgtttagaattttctgggtcagaaattagga

SEQ ID NO: 6807415 - DNA, 74 bp, Homo sapiens
aaggcaccagtagatttggtaaactaggaagcggtgagggcccacttcctggtttatagactgatggctgtctt

SEQ ID NO: 6807416 - DNA, 59 bp, Homo sapiens
gctgggcagcccctacagagagcgctccaaataccaagccaagtagggtcctccccagc

SEQ ID NO: 6807417 - DNA, 76 bp, Homo sapiens
actgctgcaacggtttcttgatgttttacaggcagccactgtaaggccaccgttatagaaccaccgtttcctaagt

SEQ ID NO: 6807418 - DNA, 62 bp, Homo sapiens
tagaaagtaaatcagttttatttactagatttcccctgggaagaaaactgtatttctttcta

SEQ ID NO: 6807419 - DNA, 56 bp, Homo sapiens
ccacaggaattagcagcctaaaacagcctatatgtattagctcatgatttcggtgg

SEQ ID NO: 6807420 - DNA, 67 bp, Homo sapiens
ttaagttctggggtaatgagaattgcctggctaatggctagtgaatgcttataacgttagaatgtga

SEQ ID NO: 6807421 - DNA, 66 bp, Homo sapiens
gggaggataagaaataaaagcctctgaactgaaaagtcgctcagggctgtggttccttttctactt

SEQ ID NO: 6807422 - DNA, 57 bp, Homo sapiens
ccttcctttctccctacaccaaggcacaatcaagggtgaatggggcaggaaggatgg

SEQ ID NO: 6807423 - DNA, 75 bp, Homo sapiens
aggtttctctgaggcaccaaatggaggggtccagctagcagctggctcctggtctggagcttcaaggagaggtct

SEQ ID NO: 6807424 - DNA, 83 bp, Homo sapiens
accagaagtggaaaagtgatgcaattcaggttcatcggaatgcaggatcttgggaatttgacattgacacacctatgtcaggt

SEQ ID NO: 6807425 - DNA, 68 bp, Homo sapiens
agtttgaaagcttaacagtacaaatgttctctccatggtactgttacatagcttttcttaaccagact

SEQ ID NO: 6807426 - DNA, 62 bp, Homo sapiens
cagttttatacactgcagctcctggctttaccattcatccagcagctcaggatatagacttg

SEQ ID NO: 6807427 - DNA, 71 bp, Homo sapiens
gctctgttttttcatgagtagttatctgttttcatgacaggtggtcactaactgccaagagagaatccagc

SEQ ID NO: 6807428 - DNA, 79 bp, Homo sapiens
tttcagtaaaaataggtcttgatgtgataagaggaaaatgccaaaacagtccattccttttcacttcaagctgctgaaa

SEQ ID NO: 6807429 - DNA, 68 bp, Homo sapiens
ttgttgtaaatggaaatccaagtcaccgtagttttagcagatggtgggttattttccttacatagcaa

SEQ ID NO: 6807430 - DNA, 68 bp, Homo sapiens
gttttgttagtgtctgttgcttttgttcagattaagctctgaaacaaaattaagattctcgtcaaggc

SEQ ID NO: 6807431 - DNA, 92 bp, Homo sapiens
aatttggtttggttatccagtacacaatttccagtatgcaaatgcctcacatctgtgtatttgttttgctgcagacataaccaggaagagtt

SEQ ID NO: 6807432 - DNA, 75 bp, Homo sapiens
tcagttcagtcctggcttaaattaggtaccaacattgagtgctggtagatacaactagtcaggatatgagactga

SEQ ID NO: 6807433 - DNA, 67 bp, Homo sapiens
gacaattgcttttgccgaataactgcttctgacccagaagtccttgcctatttgcagcagagttgtt

SEQ ID NO: 6807434 - DNA, 56 bp, Homo sapiens
gcatggtttaggaactaaggattatttcagtaataatcctatttctgaaaacctgc

SEQ ID NO: 6807435 - DNA, 80 bp, Homo sapiens
taaatattcagattctgaggacctactgaagagttattatgtcagaataatcttgagcaaggcctcagaatctatgttta

SEQ ID NO: 6807436 - DNA, 57 bp, Homo sapiens
tggagccaggctggccctgccactcatgcactgtgtggccttgggcaaattgtttca

SEQ ID NO: 6807437 - DNA, 77 bp, Homo sapiens
tgctctccaggctggcccagtgacccacagtggcatggtgcattgtctctactgtggggctggccaccaagagggta

SEQ ID NO: 6807438 - DNA, 81 bp, Homo sapiens
tggcttcttaaaactgctgggcatatatttctaggctttaatccaggcctactgaatcagaatgtccagtagtggaggcta

SEQ ID NO: 6807439 - DNA, 85 bp, Homo sapiens
gcaggtgttggagagcagtgtgtgttgcctggggactgtgtggactggtatcacccagacagcttgcactgactccagaccctgc

SEQ ID NO: 6807440 - DNA, 63 bp, Homo sapiens
tttaagtaaagattccctgttctcttcaatttatttgaaggtattggggaatatttgactaaa

SEQ ID NO: 6807441 - DNA, 60 bp, Homo sapiens
gcagggcacacaagaatgataaagatgtctaaaaaggatgttattttaagtgagctttgc

SEQ ID NO: 6807442 - DNA, 61 bp, Homo sapiens
gctcttcctgttggcctgctttttgatcatcttgctgtcagaggagaccaaggggaatagc

SEQ ID NO: 6807443 - DNA, 59 bp, Homo sapiens
ctttgtgagcttctggttcaacactcgttttacaagcaaagaaatggaggctcagagag

SEQ ID NO: 6807444 - DNA, 77 bp, Homo sapiens
gtgttctgttgtctcagaaaaaggagaaactggtagttagctaaccactatctctctttactgtgataattttgcac

SEQ ID NO: 6807445 - DNA, 72 bp, Homo sapiens
tctgtgttgattctcaaagaaaactgtgattatgattttttaaaataacagaaacttgagcatcaattcaga

SEQ ID NO: 6807446 - DNA, 81 bp, Homo sapiens
gctgttatttatgctgctccattcttgtcactttttaatttgacactgaactttgagtgggcgctgcaaaattctgacagc

SEQ ID NO: 6807447 - DNA, 95 bp, Homo sapiens
gcttcctcccatgcgctctgtaaagggccctgatccaggcctgtactatgggtatagaacctcatcatgcccacagtggccatggctgaggaagc

SEQ ID NO: 6807448 - DNA, 79 bp, Homo sapiens
gttcttttgtttggtctttcataggttgactaaatggcaattatgctatccattttcctatgacacttcttaaaggaat

SEQ ID NO: 6807449 - DNA, 68 bp, Homo sapiens
ttccatggtgacaaacagtagctgtgatgtctgttcacctttttgcagccattgttttctacctggag

SEQ ID NO: 6807450 - DNA, 65 bp, Homo sapiens
gcacagcccccagtctgaacagcagctgccttctcctttgggcagtttgctctgggggactgagc

SEQ ID NO: 6807451 - DNA, 69 bp, Homo sapiens
agcaaggccgccctttttgtgaagacaaacgtgcacgaacacaaaaggtccaaaaaggagcgtccttct

SEQ ID NO: 6807452 - DNA, 94 bp, Homo sapiens
tctgcctgacctagaggatgttcggcgattgggggtggagataagatcccccgctctggcagatgccgaattctcatctttgtggtttgggaga

SEQ ID NO: 6807453 - DNA, 79 bp, Homo sapiens
tgggtctcgtgggcttgggacagcaacggttctgtttagtcagctggtgcaggtggttggcccagccgatgagaactca

SEQ ID NO: 6807454 - DNA, 73 bp, Homo sapiens
tttcatgtttgagactaatttttcccattgtaggtgaatattatttaaggagcagttatttttagacatgaaa

SEQ ID NO: 6807455 - DNA, 64 bp, Homo sapiens
gcctcctttctctgcagcttggcattcacccccaggggcttccagctgcaggagaaacagaggc

SEQ ID NO: 6807456 - DNA, 65 bp, Homo sapiens
taaatgtcaatgtgatttataagatgtgtgagaaagtaattacaacagaggttaattgacattta

SEQ ID NO: 6807457 - DNA, 71 bp, Homo sapiens
agtccttcatttcctgatctctaagttccttttctaccctactattttatgagtacaaggaaggatggact

SEQ ID NO: 6807458 - DNA, 59 bp, Homo sapiens
gccaggaactggcagtgtcgtttacatgaatgtgttattcagaagagctgcctcttggt

SEQ ID NO: 6807459 - DNA, 58 bp, Homo sapiens
catgcagtctggagccttctgtacaacgtatttcacaggagcactttgtgtctgcatg

SEQ ID NO: 6807460 - DNA, 84 bp, Homo sapiens
tggaagcaagtaactaaaggccaaagttttcaggctaaaaaacaacattgagatgagaactttggctttatttacttgcaacca

SEQ ID NO: 6807461 - DNA, 100 bp, Homo sapiens
ttattgtaattttaaaccattttcagtttcagatgctttagaaatagaccagttgtttttgtggtatattgcaacaacgggaagattatattaccaataa

SEQ ID NO: 6807462 - DNA, 71 bp, Homo sapiens
tgccaagtagcctgcagtgactggaatgcaagatgcatggggaaaaaaatggttattgctgaggttatgca

SEQ ID NO: 6807463 - DNA, 71 bp, Homo sapiens
tgtgtcaaggcatcagcccagcctgccttccttgtcttggcccttggtgctgctgctgtgtctctggcaca

SEQ ID NO: 6807464 - DNA, 57 bp, Homo sapiens
gggctggaccgctcgcctccctccagtcccgacacccagggagacgaagtggctccc

SEQ ID NO: 6807465 - DNA, 62 bp, Homo sapiens
ggcaaggtgtgcagtagcaggaggcctgggaagggcccaggtccagactgtgtaccctagcc

SEQ ID NO: 6807466 - DNA, 81 bp, Homo sapiens
caggtcctcgtcgttgaggagatgcgactcgcggggctggaagcagttctgacacttgctcttgttgaagatgttggcctg

SEQ ID NO: 6807467 - DNA, 66 bp, Homo sapiens
tgggaggcctaggaaggggatgtaactttggataaggcagctttccttatcctagggcaaagccca

SEQ ID NO: 6807468 - DNA, 77 bp, Homo sapiens
ttctgaagttactccagagagagatgaagtgcttttcatgctgaagactttcatctcttctgggcagttttcttgaa

SEQ ID NO: 6807469 - DNA, 76 bp, Homo sapiens
ttgctctgtcacccaggctggagtgcagtggcctggtatcggctcagtgcaacttttgcctcccgggttcaagcga

SEQ ID NO: 6807470 - DNA, 58 bp, Homo sapiens
aagcagaaacttggatatgtatattgcaagccaatctatagtttctgagtttcttctt

SEQ ID NO: 6807471 - DNA, 65 bp, Homo sapiens
acccatgtttatttgtgtggtttctatctctccctttacactgtgaaatctatggagatatgggt

SEQ ID NO: 6807472 - DNA, 86 bp, Homo sapiens
gctgccttcccatctccgtgttggctcttggagggaagccgaggcgggaatccaccatgatttagcactggcttgggtctggcagt

SEQ ID NO: 6807473 - DNA, 81 bp, Homo sapiens
ttgttctttgcaaatatacacaatccctctgcattttgagaaaggatgcatctgtagtgttatatgattagtgtcggacag

SEQ ID NO: 6807474 - DNA, 55 bp, Homo sapiens
cagagtttgctggaggcgggaaagtaggccgcggtttccaccccagccagctctg

SEQ ID NO: 6807475 - DNA, 59 bp, Homo sapiens
tggcatctcacatatgacatcgccaatggtgtgtttgcaaccccttgtgagaatgtcca

SEQ ID NO: 6807476 - DNA, 58 bp, Homo sapiens
gggacctggcagggcaggggtttgtgcctccaatgagcacaagctccccctgcccccc

SEQ ID NO: 6807477 - DNA, 79 bp, Homo sapiens
ggtaattatatgtgaagtgggttattttggtttttgtttatttaatgaatagaataacgtagttacacttagtaatact

SEQ ID NO: 6807478 - DNA, 112 bp, Homo sapiens
catggtcatccagatgcaggctcttccctggggcactatagcagagagggctctcttccagtctattgcagatggatgccctcgtgagctgagttttgatgaacatcccatg

SEQ ID NO: 6807479 - DNA, 73 bp, Homo sapiens
tctggctcacttcaggcttcacgcagttcaagcctgagagctgttagagaaagtgaggcctaactgggctaga

SEQ ID NO: 6807480 - DNA, 59 bp, Homo sapiens
agagaatgattaatgtaagcccttctgtaactagccagaggcttaaggaattcttttct

SEQ ID NO: 6807481 - DNA, 130 bp, Homo sapiens
caattgcctagcattgaatctgatatacaaacttccttggatacaagtaactttataccttggcctgagaacgctgaatcaggcaaaatgaaagtttttgatgcaggaaagatttatacttatgtaattg

SEQ ID NO: 6807482 - DNA, 69 bp, Homo sapiens
gtgacaatgtctctgctgtggttagctttggtgccttctccaaggtaaattcagcagtgacattaacac

SEQ ID NO: 6807483 - DNA, 55 bp, Homo sapiens
atccttggatgtgtctttttgtgatacatatttctttagggtacatatcaaggat

SEQ ID NO: 6807484 - DNA, 104 bp, Homo sapiens
aatattctttctgttacagtaaaccacagacccagactagagagatcaattaggaattatttattcacaaatctcagtctttttggttactcaaaagtagtatt

SEQ ID NO: 6807485 - DNA, 56 bp, Homo sapiens
tgatttctgcaggatggaccctgctcactcgacagaatctacaccctcagaaatta

SEQ ID NO: 6807486 - DNA, 81 bp, Homo sapiens
ggagggtctttacagagaactcatagaaagaaagagtgctgcgatattccttcttccctttctgcaggttcttttttctcc

SEQ ID NO: 6807487 - DNA, 71 bp, Homo sapiens
ctgccgtcacctcttccccctgtccacagagccgggagccaggctctccatagaggcaggagggactgcag

SEQ ID NO: 6807488 - DNA, 83 bp, Homo sapiens
cctcttttgccccaagttgtacagattgtattagagaatagactatttctgatgttcatttcttttgtacaactcaacagagg

SEQ ID NO: 6807489 - DNA, 62 bp, Homo sapiens
aacatgatgtattttcttgtctgtgggttgttggcttccaaagtcatggaaaacatcatgtt

SEQ ID NO: 6807490 - DNA, 68 bp, Homo sapiens
acctttgctgatttgtttctattccatttgtccatggcattgtgggaaaagagatagatggccttggt

SEQ ID NO: 6807491 - DNA, 82 bp, Homo sapiens
gagacagattcatgaagcggagcatttgaacttgaactttacaccagtgatttaaaacagtgttttgcttagaatttggatt

SEQ ID NO: 6807492 - DNA, 68 bp, Homo sapiens
ttttaacacattttaagccattttaacatctcttgagagaaggtaggggctgtggaatgtgtataaag

SEQ ID NO: 6807493 - DNA, 60 bp, Homo sapiens
tttggccttggtcacagttcccaacattgaataacaactcaatgtatatgtgaccccaaa

SEQ ID NO: 6807494 - DNA, 60 bp, Homo sapiens
ttcatttattcagcaggtatttactgagcaccttctaagtgccaagcctgttgaaatgaa

SEQ ID NO: 6807495 - DNA, 81 bp, Homo sapiens
gcagaggtagatgtttgactttgtgttttgtgtaaaaattctttctgggttaacagagaacatagaagtagctacctaggt

SEQ ID NO: 6807496 - DNA, 55 bp, Homo sapiens
ggtgtctgtggcctcagcagctgtcagagaggagctcagagaatcagcagacacc

SEQ ID NO: 6807497 - DNA, 65 bp, Homo sapiens
ccatttatagatgtatttggctgtcagttacctttgactgtagaagcaccttacagctataatgg

SEQ ID NO: 6807498 - DNA, 64 bp, Homo sapiens
accagatttgagcgtcttaaacctactcagtagtaggtttctactccagttacaaccatctggt

SEQ ID NO: 6807499 - DNA, 56 bp, Homo sapiens
gagcagctcaggcacttagccaccaactctggtcccttttgtgtagagggctgctc

SEQ ID NO: 6807500 - DNA, 91 bp, Homo sapiens
tggtagcaaaagtaaaagaacagcataagtatttatttcagccatcagcactgatttgcaatgatttgtgcttttggtattcttgcttcca

SEQ ID NO: 6807501 - DNA, 87 bp, Homo sapiens
attattagtttgaactataaaaagttgtgacgttgtagatcaaatgcagtctaatattgacaatttcttatagttcaattcagtagt

SEQ ID NO: 6807502 - DNA, 66 bp, Homo sapiens
gcggggacctgcttttcccagggctctccagggagtccctgcacagccctcaagagcctgccctgc

SEQ ID NO: 6807503 - DNA, 59 bp, Homo sapiens
tccagaaacttttccagtctcagggattcctctggtcgtagagactgttgagttgtggg

SEQ ID NO: 6807504 - DNA, 55 bp, Homo sapiens
cccaggctcccaggtgggacaactttgtgttgtcgtttgggctcaaagctatggg

SEQ ID NO: 6807505 - DNA, 87 bp, Homo sapiens
tcagctgcctggttgggaagcagtatgtctgtgctcaagagagtgagctcttaaggccaattacatatgttcacattccaggcctga

SEQ ID NO: 6807506 - DNA, 57 bp, Homo sapiens
tctagggaacatgggtcaagctttctcagtggtcctgcttgagcctgtctcccttga

SEQ ID NO: 6807507 - DNA, 67 bp, Homo sapiens
tacatgaagacatctggaatcctgagtagttggcaagattgaatcaggagtactggtgtctacagta

SEQ ID NO: 6807508 - DNA, 55 bp, Homo sapiens
ctgtctcaagactgcaggcactgaaacgtgaccccggtgtctcaggctgaaacag

SEQ ID NO: 6807509 - DNA, 57 bp, Homo sapiens
tttgactcccaaactgtgattttttcagtattagacaagatcacttgggatgttaaa

SEQ ID NO: 6807510 - DNA, 70 bp, Homo sapiens
tatcaagttttcttagttgactgtttggctggttgtctccgctggttgtagttgggtagaggacgtggtg

SEQ ID NO: 6807511 - DNA, 67 bp, Homo sapiens
tgaatggcttatgggtcctccctcttccctgggcttgcactgaagaggggtggtctgtgaggattta

SEQ ID NO: 6807512 - DNA, 58 bp, Homo sapiens
gacacaggaaaagctccagccccccagggggtgtggtgaaggctggggccctgctgtc

SEQ ID NO: 6807513 - DNA, 86 bp, Homo sapiens
gagaattgcttgaacccgggaggcggaggttgcagtgagccgagatcgtgccattgcactccagcctaggcgacagagcgagactc

SEQ ID NO: 6807514 - DNA, 91 bp, Homo sapiens
ccctattctttctttacatagatggggtgtcatgtcaggaaaagtgatatttctcacatgagtcactatcttaatgtggacatgattaggg

SEQ ID NO: 6807515 - DNA, 83 bp, Homo sapiens
gcaaggggttcctgaggggtgatttgggacaggacatctaaagccaggtgtacgctcacgtcctcagtcccccaggctcctgc

SEQ ID NO: 6807516 - DNA, 104 bp, Homo sapiens
tggcctgcctggtttccaggcccaaccctggggcagctgctagggatagggctgcctgcccttagtgaggctccttcaggctgccctggaaggcagattcccca

SEQ ID NO: 6807517 - DNA, 130 bp, Homo sapiens
gcttccttttaactcccttgaagactgaatgtttcttataagaatgctgttaggggatttgggaaaaggtcttaaatctcactgggtatattggagtgatgagatttcaaagggaaaatgagaagtgggc

SEQ ID NO: 6807518 - DNA, 55 bp, Homo sapiens
ccagcctggctgacgtaactcagggcatctctgaggcactgtcagctgaggcagg

SEQ ID NO: 6807519 - DNA, 64 bp, Homo sapiens
ttcttgttttgtgctgctcaaagaagggattcctcagtgatcggtgagcaccaagaatcaagaa

SEQ ID NO: 6807520 - DNA, 96 bp, Homo sapiens
ttcatataaagctttatttgtcattcacggctggttggcaaaactgactttgcttttgaaaatgacaggtggtactctggtgagctctgtatagag

SEQ ID NO: 6807521 - DNA, 100 bp, Homo sapiens
ccactcctcgtagcccttctcagcctgctccaagtgctgccagccattgttgatgtcctggggcagggcaggagcaggcagggctatcacaaggaagtgg

SEQ ID NO: 6807522 - DNA, 98 bp, Homo sapiens
cttactgcttgctgatatttatgtaaaaagcccagccgctgagagggccacgatattgccaatttcagctctactttttgcatttagtaagataaaag

SEQ ID NO: 6807523 - DNA, 55 bp, Homo sapiens
tgagaatgggagagaacacaaagtccctttattcaggggagtggattccatctca

SEQ ID NO: 6807524 - DNA, 81 bp, Homo sapiens
aagtgagatattttgtaagagcatatgtaaaggtactagctcagtgccacacattataggcacttgtcatgtagttcactt

SEQ ID NO: 6807525 - DNA, 63 bp, Homo sapiens
attcagaaagttgtcatatttgaattgttttccttttcagaggagggatgtgcaatactgaat

SEQ ID NO: 6807526 - DNA, 61 bp, Homo sapiens
aggtgtgtctttggcgatgtctggacagctctgtccattagagatgctaaaggacatccct

SEQ ID NO: 6807527 - DNA, 72 bp, Homo sapiens
ttctgcacatgcacggcaccatcttctgtgagcacccatgggaggtcatgcctgatgactacttctgcagag

SEQ ID NO: 6807528 - DNA, 67 bp, Homo sapiens
gtgtccctggctgccagcatttgggggatggtgctaggactctcccattcagcttgcagtcattcat

SEQ ID NO: 6807529 - DNA, 60 bp, Homo sapiens
tcttaaggcaggtaggtgcctgtagctttcactacgctgtatctactggtgtctttcaga

SEQ ID NO: 6807530 - DNA, 74 bp, Homo sapiens
cctcagctgagttttatagttttgatgggaatagactcaaaatgcattttctcagaatataaaattctctcagg

SEQ ID NO: 6807531 - DNA, 76 bp, Homo sapiens
gctgacagtctcggtggggtagggactctttgaggtgcatatactgtctcatgacacccttcctcctgaggctagc

SEQ ID NO: 6807532 - DNA, 74 bp, Homo sapiens
tgttttcttttatctttattttgatatgatttcaaacttatagaaagattggaagaataggatagaagaacaca

SEQ ID NO: 6807533 - DNA, 128 bp, Homo sapiens
aaatggcattatatataaaagaaaagattggttctactacatacatcaggcttattaagtcacactagacaactgaggttgcctaagacgtcattgtcctggacttgcaagggcctccaactccagtt

SEQ ID NO: 6807534 - DNA, 63 bp, Homo sapiens
gctgaaacaggtgtgagaacatgccttgtggaaacaggtgtgagaacacgccttgtggtcagc

SEQ ID NO: 6807535 - DNA, 81 bp, Homo sapiens
cttttctgtcttggaatgaatcttttgtctcgtgaataagcaactctgggctcctatgagatgagaggccacatagaagag

SEQ ID NO: 6807536 - DNA, 58 bp, Homo sapiens
gtgtgcctgtatcatggtaaccactccataaatgtggcttttattatggaaggtacac

SEQ ID NO: 6807537 - DNA, 65 bp, Homo sapiens
gagtgtgtaggagaggcacctgtcacctgtgcagtgaggtagctgtcatctttcctgccatgctc

SEQ ID NO: 6807538 - DNA, 55 bp, Homo sapiens
ttgcagtccaagagtctcctggtgctcttgtactgtgtgctcttgacgactgtga

SEQ ID NO: 6807539 - DNA, 86 bp, Homo sapiens
tctcttggccattattccattcagttcaacaagtatttactggaccaccttgtatgtgttcagactgtagtaatgggccttggaga

SEQ ID NO: 6807540 - DNA, 58 bp, Homo sapiens
cccagctggaggggcgcatggaggggcgtcctgttctttctgccttcccctagctggg

SEQ ID NO: 6807541 - DNA, 56 bp, Homo sapiens
agccacatactgtaacttctggggcgtcctggttcagaagcctggggaatgtggct

SEQ ID NO: 6807542 - DNA, 61 bp, Homo sapiens
ggtcatcacttttggtgcctggcctcaattcttatttggcttagcttcattattggtggcc

SEQ ID NO: 6807543 - DNA, 70 bp, Homo sapiens
ttacttagtatatttttggctacatatttaggcagtggcttaagtagcctacaagtatatttataggtga

SEQ ID NO: 6807544 - DNA, 63 bp, Homo sapiens
agtaggcagagtgttataaatctttcattatccagtaatgggaaggttagcagtttgtcaact

SEQ ID NO: 6807545 - DNA, 76 bp, Homo sapiens
gcataggctgagaatcaggattcaagatcagctgtaaaccccagactggtaaccagttctgatcccatgttgatgt

SEQ ID NO: 6807546 - DNA, 97 bp, Homo sapiens
aagtttaattttgctataagacgccagttttcgagtctattttattcggtgcttccagataacaagatttgtaaaattgtaaagtaagttatttctt

SEQ ID NO: 6807547 - DNA, 72 bp, Homo sapiens
tcttgcagtggtgagccagtctctttatccaccaagcctgacccagcaggcaggagaggcccagtaccaaga

SEQ ID NO: 6807548 - DNA, 68 bp, Homo sapiens
tgcaggaccaggtttcattcaagaggcagtaagcaattttcctgcagctttggaaacctgtttccgta

SEQ ID NO: 6807549 - DNA, 130 bp, Homo sapiens
tcacctgtaagatgggcgtgcacttacctattttgcggggttacatgactaagcacttgagtccactgctctcagctcatccccatgtaatcccacaaggtaggtatgtgcacaccagtcttacaggtga

SEQ ID NO: 6807550 - DNA, 56 bp, Homo sapiens
gggctggtgggcggggctgaaggagcgcgccccgcctcctctccgcccaccagccc

SEQ ID NO: 6807551 - DNA, 84 bp, Homo sapiens
gggcctagctactattctaagctcagaatcccaaacctaataaggctgcgggtctgtcctaaggagctttagtaacttctgccc

SEQ ID NO: 6807552 - DNA, 58 bp, Homo sapiens
gtgcctcattgttctcatctgcagcatgaggctcagctttagagaagacaatgggcat

SEQ ID NO: 6807553 - DNA, 89 bp, Homo sapiens
ggtgtatgtgactctcagtgcagcttgacagagaaagtgattcagtgttcctggtttctgtttgaggctgtcacaagtcacaacaaacc

SEQ ID NO: 6807554 - DNA, 90 bp, Homo sapiens
ctgggcagggtggggtgcatggacgtgacttggccaagtggtcctttcccagctgccactcccccttcctgccaccctgcctttgcccag

SEQ ID NO: 6807555 - DNA, 83 bp, Homo sapiens
gcgtccttggaggagccctgccgtgggagtctggggttagatgctgcttccggaactctacttgggactcctctgggaggcgt

SEQ ID NO: 6807556 - DNA, 58 bp, Homo sapiens
tttgcattgcctctgacttatgagcttactatcctagaaatcagcaggcatatgtaga

SEQ ID NO: 6807557 - DNA, 63 bp, Homo sapiens
tttggagcctcacctttagtcccaccctggccagccaaaccagggtcagcctggggctccagg

SEQ ID NO: 6807558 - DNA, 64 bp, Homo sapiens
aatttctgcagctaagggggttaaggaaccagcggtgcctgcccactatgttgtcatggggatt

SEQ ID NO: 6807559 - DNA, 69 bp, Homo sapiens
agaagacctgcagtttctctacctttgggtacaagaaccaaggaggaggcttggctggaggactcttct

SEQ ID NO: 6807560 - DNA, 63 bp, Homo sapiens
gaaaagcaggctcagagcagattagcaaagacattgtttgttaagctgtggagtctgaacttc

SEQ ID NO: 6807561 - DNA, 85 bp, Homo sapiens
tcttcttgcttgtttatacatcaattgacacacaagagctgttctttcttctggtcctctctgtgatgctatagactagggaagg

SEQ ID NO: 6807562 - DNA, 83 bp, Homo sapiens
gaattcaggattctctcccatttaccactagggaaaaccctactgctaaggaccgtaaatgtcggaggatccccctgagtctc

SEQ ID NO: 6807563 - DNA, 115 bp, Homo sapiens
gctgggcagttcttctggtcttggctgggttccctcctatgcccactgaaagctgagtgggagctctcgctgggtatatgagggagcgactggctgtcagctggaacatcttggc

SEQ ID NO: 6807564 - DNA, 81 bp, Homo sapiens
gctgaggcctaacgtaagccagtgtcttcctgttaatcgtccaagtaggtgagctgcacacctggctatcttgacctcggc

SEQ ID NO: 6807565 - DNA, 58 bp, Homo sapiens
ggatgtagccattcttgtgacaaatcaaaaacagactcagaggaataatgctgcattt

SEQ ID NO: 6807566 - DNA, 69 bp, Homo sapiens
ctagctcacagggcctcagtgccaatcggagttccctgctctggacgtgttggtgaggacctgttgcag

SEQ ID NO: 6807567 - DNA, 80 bp, Homo sapiens
agcagagtgtggaaatcatatgtagtcattttataaagcacaagtattgacaaagggtcatatgagtttcagatgttgct

SEQ ID NO: 6807568 - DNA, 76 bp, Homo sapiens
gagtaccagcaggacccaggaatcctgcagttctgggatctgtccctatagggtagttgtgggcttgctgtgtctc

SEQ ID NO: 6807569 - DNA, 76 bp, Homo sapiens
tatagcagcactcaggagatgataactaccattgctttggtaatgatgtttcctatcttccaagggttttgtgatg

SEQ ID NO: 6807570 - DNA, 77 bp, Homo sapiens
gaggtttacagccagtgactggacaagcttatctaggtcttcagtgtagctgtctccctcacatggctgtgaaggtc

SEQ ID NO: 6807571 - DNA, 96 bp, Homo sapiens
acttgagtacttacagcatatcagcatcaaaacacaggctgtttccatgtcataaaaatgatttgtgcttttgagctgagatgagtgaagtcaagt

SEQ ID NO: 6807572 - DNA, 57 bp, Homo sapiens
gaataggctgatctagcagcacagcacacagtgcatggtgctcctttcgaccttttc

SEQ ID NO: 6807573 - DNA, 76 bp, Homo sapiens
gaaagtggtatacaattcttaggaactccttacattgcaaagtactttgggtttcaaagagttgtaaattactgtc

SEQ ID NO: 6807574 - DNA, 81 bp, Homo sapiens
tgatcacagtgtagaccttttaaatgaactgtttagttcactttttcagtgttttgttgaggagttttacatctgtgttta

SEQ ID NO: 6807575 - DNA, 91 bp, Homo sapiens
attgacggatatgttttgattgaaggattagtttactcattcattcatttgttcagataattcaattcaattctaaatatattgactcaat

SEQ ID NO: 6807576 - DNA, 94 bp, Homo sapiens
ggggaggggtgaggggggcgtttgttcttcaggagccccttctccactggcagccctggctcctgaggaccaggcacagtcttcacctctcttc

SEQ ID NO: 6807577 - DNA, 63 bp, Homo sapiens
ttgggaagaagggggagaagggtggtaaccaggggcaaccctcctttctctccctcatcccga

SEQ ID NO: 6807578 - DNA, 79 bp, Homo sapiens
ttaaaggttctaggcaccttaattaagaaattgccctgaataatggagtgcttttggaatttggtgtccattcctttaa

SEQ ID NO: 6807579 - DNA, 73 bp, Homo sapiens
gtggagaagctcacagtaggacaccagcagccacggccaacagaagggctgccaatccagctgtgggagccac

SEQ ID NO: 6807580 - DNA, 80 bp, Homo sapiens
gagagacctagaattgatgcttatggtcagggtttgtttcagttctaatgttccatgattcagtaccaatttattctttc

SEQ ID NO: 6807581 - DNA, 115 bp, Homo sapiens
gctcactaacgcaacttgttttaaatacagaagtttgaatttaagcactgatgttaagtttgagatcaaactttgtgcttgacttctagctatatggcttaagacgttagtaagt

SEQ ID NO: 6807582 - DNA, 110 bp, Homo sapiens
catctttatccttgaccacaggtcttgatactgatcctgaatgtgtgtgtttaccacatgtcctgtaaggcacatattgcagatcttggacctctttggtggatagagtg

SEQ ID NO: 6807583 - DNA, 65 bp, Homo sapiens
ctaatcacctcatccctcagcgctagacaaatactggaatcttcacgttggtgtgagctgattag

SEQ ID NO: 6807584 - DNA, 60 bp, Homo sapiens
gggccttcctccctcaggctcctctcacccctcggggctgccctcaggggaggatggcct

SEQ ID NO: 6807585 - DNA, 56 bp, Homo sapiens
tgctccttttctacaatattcccactgggccttctaagatattgggagcaggggca

SEQ ID NO: 6807586 - DNA, 86 bp, Homo sapiens
gcaggcctttatccctgcctcaacaaacagaatggtacaaaagtgatgctctgtgacttctgaggctaggttagaaaaggccatgc

SEQ ID NO: 6807587 - DNA, 85 bp, Homo sapiens
cattgaccctcatgactatgatttcatttctgaatatgtctttcaagataattcagggccagaatccccagacatgaacaaaatg

SEQ ID NO: 6807588 - DNA, 63 bp, Homo sapiens
gatgaccgtggtagccaagtaagtgtccatcagcagaatacaaggcaaatccatgatgtcatt

SEQ ID NO: 6807589 - DNA, 66 bp, Homo sapiens
cctcctccaacatcttgattcactaccattcttaccttcttttaggtgacaaagagtaagaggagg

SEQ ID NO: 6807590 - DNA, 70 bp, Homo sapiens
tttcaaacggctcacagataaagacagggctgtccactcgcagtcccttgaacgctggggctggaaggaa

SEQ ID NO: 6807591 - DNA, 107 bp, Homo sapiens
aggaaaggcatgatgagtgggggaaggattggggaaggagggttgtacaaaaggatcagaaatattttcccccttccacagtgcttcctaaaaattctgcctttcct

SEQ ID NO: 6807592 - DNA, 57 bp, Homo sapiens
gtgctccatggcctgtgtccatcatggggatcattgccctggcacttcctggagcac

SEQ ID NO: 6807593 - DNA, 82 bp, Homo sapiens
agttctaaactgagttttctgaaccccactccagatatactgaatcaatgctttgggggcagaggattcaggaatgaggact

SEQ ID NO: 6807594 - DNA, 67 bp, Homo sapiens
tttgatgttcactacttgaaagaattacagatgtaaaatatttgtatatttaggtggtggagttgga

SEQ ID NO: 6807595 - DNA, 65 bp, Homo sapiens
gagcacacactttgaaattaggagaacctgtgtctgaatcctgatttttgccatttgtgtgactt

SEQ ID NO: 6807596 - DNA, 73 bp, Homo sapiens
gggctaggggctcagggcagtatggctgagagctggtcccccttggaggtcaactgttctgtggacctagcct

SEQ ID NO: 6807597 - DNA, 58 bp, Homo sapiens
ggagagggctggaaacttcctgggcccatcaggccccaagacagttcaagtgctctcc

SEQ ID NO: 6807598 - DNA, 101 bp, Homo sapiens
tgagatggagtctcgtcctgttgcccaggctggagtgcagtggcacgatctcagctcactgcaatatctgcatcctgggttcaagcgattctcctgcctca

SEQ ID NO: 6807599 - DNA, 61 bp, Homo sapiens
tatgttaagtgggataatcaaatatttttatttctgtgtctggtttatttcactcagcata

SEQ ID NO: 6807600 - DNA, 67 bp, Homo sapiens
acacgtaaatctctcagtggccagagagccactgagtggctctctgaccactgagggatttacatgt

SEQ ID NO: 6807601 - DNA, 56 bp, Homo sapiens
gctcttggccgctagttgctgctagacacagtgcagtgcaggagcctggccagagc

SEQ ID NO: 6807602 - DNA, 60 bp, Homo sapiens
catttaagtagaattcctgggggtcatccactggtaacccccaggagtcctatttaaatg

SEQ ID NO: 6807603 - DNA, 113 bp, Homo sapiens
gaggagcgggggggcggcctgagagcccagggtcagggtgtggggccacttcagccactcccctgccagtggccttgggcactgaccttgggcaggccttcctccctatcctc

SEQ ID NO: 6807604 - DNA, 58 bp, Homo sapiens
cagcatcttctccaaagctgccttagagaattttcttggtgattttagagaattgctg

SEQ ID NO: 6807605 - DNA, 71 bp, Homo sapiens
cactggcaggagttgggattttgaagacttttactgtctcatttctgatcaaattctactctcctgcagtg

SEQ ID NO: 6807606 - DNA, 105 bp, Homo sapiens
cattgaacctgcatctgagactgtgggtcttgaaataaaaatcctgtttatggagaaatgttcaagatggttatttcatcacctataaactattaggggtttatg

SEQ ID NO: 6807607 - DNA, 80 bp, Homo sapiens
gtagtgtgaccatcctggtaatgaatcatggcagcctttcacttcagccaagatctcagtgactatgggtgtcaggctat

SEQ ID NO: 6807608 - DNA, 111 bp, Homo sapiens
ggctccaagacagcttcaggaggagtggctccttacaagttccatgaggtcaatgggatattgttctgggagtccttactgaaggctctacctagagttgtactttcagcc

SEQ ID NO: 6807609 - DNA, 56 bp, Homo sapiens
aggttgaccgagcaagtggccaccttattggctctcaagcacttgctggtctacct

SEQ ID NO: 6807610 - DNA, 61 bp, Homo sapiens
tcctcttcccaccttctcctctgttaacttattttctttacagcaggccttggggagagga

SEQ ID NO: 6807611 - DNA, 79 bp, Homo sapiens
gtctttcttctttttaaaaaccaaaggaatggagaacttggtaagtaccaccaactaatcctttgaaaagaagaccgat

SEQ ID NO: 6807612 - DNA, 77 bp, Homo sapiens
gtcagaaatgagcttattcataaaagtgcagtatggtgaagtcaatctgtaattttatgtataagctagtctctgat

SEQ ID NO: 6807613 - DNA, 55 bp, Homo sapiens
tggaaaggcactatgcaaaattggactcagcatcactgtagctagtgtctatcca

SEQ ID NO: 6807614 - DNA, 55 bp, Homo sapiens
ataaactcatgctgaaaacccaggagagtaccctgggtttttagcatgagtttgt

SEQ ID NO: 6807615 - DNA, 63 bp, Homo sapiens
tgcataggtgccaagtgggcttctgcagtgtcccaaaactcagtgtcaacagggaacctagca

SEQ ID NO: 6807616 - DNA, 91 bp, Homo sapiens
tctgcatccattaacactatctgtcataattaaaggtgaaataaagacattcccaggtaaatgaaagatgtgtgaatttgttgctagcaga

SEQ ID NO: 6807617 - DNA, 70 bp, Homo sapiens
aagtgaaattacagccttgggtagcttcttacttgggaggctaggaacagcccggccctgtgcatcactt

SEQ ID NO: 6807618 - DNA, 124 bp, Homo sapiens
tgaagacaagcaaagtatgagaaagacctcttggttcacattagatttccttcttccctgaagggcaatctgatagaacctttagaattgaaggggaagcatttcattcataaattgtgcttca

SEQ ID NO: 6807619 - DNA, 62 bp, Homo sapiens
tattagggagcagttgagtcatgggtatcagaatgagcccaagcaaaatggttcctgtaata

SEQ ID NO: 6807620 - DNA, 60 bp, Homo sapiens
cctgagaattactctgatgagtaattactgcccccttactccattcagaaattacttagg

SEQ ID NO: 6807621 - DNA, 77 bp, Homo sapiens
aatcaggtagcacatgattttgatatgtcccattactggtgatatttaattttgattaagatggtgtctgccaggtt

SEQ ID NO: 6807622 - DNA, 67 bp, Homo sapiens
ttctttggctgtcctcttggctggtggtaatgaggaaccctggatagaataaagggcaggcgaaggg

SEQ ID NO: 6807623 - DNA, 84 bp, Homo sapiens
ggtccttgaagagaatcagaaggttgatgactgagcagcctctgcaaaatacattaatttctatttttaccttcagatgggacc

SEQ ID NO: 6807624 - DNA, 85 bp, Homo sapiens
gtgtgtattgtataaacaagatgaatgaaattaatttatttcttgtcttcattcttgtctttgtatagtgtagctactttcacac

SEQ ID NO: 6807625 - DNA, 78 bp, Homo sapiens
gtgtgtagtttgggacactcttggcgatcaaggacagatacatccttatcacaatggagtgtcacagccactccacgc

SEQ ID NO: 6807626 - DNA, 92 bp, Homo sapiens
gatggctcagcgtaggaaggtgagcgtggtcttctgtgggtgcacagcagaaagataggtcaccccaggaggtccgggctcccctccccatc

SEQ ID NO: 6807627 - DNA, 76 bp, Homo sapiens
gagcttctcaagatttgtattgggcctctgtagaatctgacttctgtagtggctcaatacaaatctgtggatactc

SEQ ID NO: 6807628 - DNA, 83 bp, Homo sapiens
aacagagatttgtccagatgcacagataataattacctggaatgtgattcaaaactaggattgtctgaatccaaagctctgtt

SEQ ID NO: 6807629 - DNA, 63 bp, Homo sapiens
aggcactagtttattacagttccactgtgttacagcagtgttatcagatgactagtaagacct

SEQ ID NO: 6807630 - DNA, 84 bp, Homo sapiens
tcagtctctttcatttgtccagatcaatgcccacatgcccaatttaggtcaaggcatcaggcagaggaaaggactggagactga

SEQ ID NO: 6807631 - DNA, 70 bp, Homo sapiens
ccgtgggaaatacgagtttattcatttaacaaatagttaagtatttaatgctgtatttcaggcatcacgg

SEQ ID NO: 6807632 - DNA, 62 bp, Homo sapiens
ggatgttcttccttgtctatttttcatggccatacctgaagaggttgttgaggaatatgtcc

SEQ ID NO: 6807633 - DNA, 86 bp, Homo sapiens
cggtgaaatgagaccagagtgggcttcctgagaagtgtctttgaatacttgagaatcttgatgtctacccctggttctcttccccg

SEQ ID NO: 6807634 - DNA, 130 bp, Homo sapiens
gatatgtggcagttcttaatcataatagcttaggttataacctccagcaggtgtttaaaagaattttctttctgcttaaatagctggaggctacaatctaaggtgttattattaagaactgccacatatc

SEQ ID NO: 6807635 - DNA, 76 bp, Homo sapiens
tttttctagggccatctggactctctgagttgctgccaataggacagcagggaaagtccagaccagtccaggttaa

SEQ ID NO: 6807636 - DNA, 61 bp, Homo sapiens
cttgcaggcccagccttacaagcacaagttgagtgctcagcctgtaactgggactgcacag

SEQ ID NO: 6807637 - DNA, 72 bp, Homo sapiens
catccattgtctagaaaaatgtgaaagaatttgagaaatggcaaatttacacttggtttactagagaggatg

SEQ ID NO: 6807638 - DNA, 63 bp, Homo sapiens
aaacccagagactagaaagaccagggtgtgttgtggaaggagcttactgtgtctgatgggttt

SEQ ID NO: 6807639 - DNA, 86 bp, Homo sapiens
acctggtgagcagctcctatgtgaggttgctaagagatgaggatccatcactgagttccacacctaggaagtctcttaaattaggt

SEQ ID NO: 6807640 - DNA, 72 bp, Homo sapiens
ctgaatcagggttttctacctctgtgataggtaactagattgctagaaacacagggagggaaactctttcag

SEQ ID NO: 6807641 - DNA, 66 bp, Homo sapiens
ggaagctcagcagctgatggggaagtgatttataatcctaaacacagttctttcactgttggttct

SEQ ID NO: 6807642 - DNA, 77 bp, Homo sapiens
gtgcatggtaaccaggatgtctatgcattcatgcattccttcactgcatgtaactagcactttcttgtgccatgcat

SEQ ID NO: 6807643 - DNA, 103 bp, Homo sapiens
gtatagtatagctgggtttgtgggcagcactatgacatttaattctttaaaaatgactaaatgagtaaaacagtggtgttgcatagctttccatgatacatgc

SEQ ID NO: 6807644 - DNA, 72 bp, Homo sapiens
gaatctgtcttttatcagcttagtttatagggcactagtcaataacctaggagggtagaggtaaaaaggttt

SEQ ID NO: 6807645 - DNA, 129 bp, Homo sapiens
taactgggatgggtgttggagtatgggggatagcataggaaagtactgggaaccgtcaatcagtcgcggtggccttgagagatcaaaaggtgctgaaagccccctgcccgcaaaacacacctctagtta

SEQ ID NO: 6807646 - DNA, 60 bp, Homo sapiens
cttcttctctgtctcctttttcttccctttggaataaatgcacagaggccagagaggagg

SEQ ID NO: 6807647 - DNA, 96 bp, Homo sapiens
tgggaattttcagcataagtgccaagaatagttttacttttctatgtggtcaaagggacccatgcaactgtgattattctcttttgcttggaccta

SEQ ID NO: 6807648 - DNA, 59 bp, Homo sapiens
ggagcaaagagcacaagcacaaagaagaagccttctctgagcccctgcctctttcctcc

SEQ ID NO: 6807649 - DNA, 85 bp, Homo sapiens
ctgcccactttagagagcagtctggaagaaacagcgacgtcagctcagctcaacaatgtgtttccttcaggctctcttggggcag

SEQ ID NO: 6807650 - DNA, 89 bp, Homo sapiens
atctgtgaaccaggtcagctggcatctataccagagtccttccggcctacatgtggtcacttgtttggagccagctgtaattcacaggt

SEQ ID NO: 6807651 - DNA, 74 bp, Homo sapiens
gagttttgctctccttgtcagtaaaatgactgcaaccccagttattcaatggcttataaggattccatgagctc

SEQ ID NO: 6807652 - DNA, 84 bp, Homo sapiens
ggtgagcaatttcagccaggctcagaggctaggatgggtgaatggcagcctctccagagcctggcagaatgagggtgccccact

SEQ ID NO: 6807653 - DNA, 100 bp, Homo sapiens
tgattcgaatatctggcgtgtttcacaaggaaagaacctcctgctgtatttttaaacgtgtgtggaaagttttccatggtaaacggaaatcagagaatca

SEQ ID NO: 6807654 - DNA, 121 bp, Homo sapiens
gcacctgccccttgaattgttggataattgaatagaagctgataaactacttccctataagccaaaggaggggggtagcaagtggcctctgttgaagctcccaatacagagggggaggagt

SEQ ID NO: 6807655 - DNA, 62 bp, Homo sapiens
cctgaagtcctcttagcttctcagaaaacagatgcagaggctacagatacagaggctacagg

SEQ ID NO: 6807656 - DNA, 57 bp, Homo sapiens
gccaggtgcctccagtcacagtgcagactcaacccctgcttggtgcttgcccttggc

SEQ ID NO: 6807657 - DNA, 66 bp, Homo sapiens
tgtacacccattaaacaattagaggctaatacaaagtagtaatcagttgctaaatggtgtagtgca

SEQ ID NO: 6807658 - DNA, 65 bp, Homo sapiens
gggtggcaatcgttgactatagggaatagagggagaaaatccttaatgtttaatgttgtccaccc

SEQ ID NO: 6807659 - DNA, 99 bp, Homo sapiens
cagatatggcaagacttcacaacttgaagctgatttaagggtcttatagcctgttaaaccactttgttgcaagtaaagtcttttaaaaaccataatctg

SEQ ID NO: 6807660 - DNA, 96 bp, Homo sapiens
gaacttgttcgaaacagattgtggtctccaccccagagagtttctgagtcagtaggtctggggtggagcctgagaatttgcatttctgacaggttc

SEQ ID NO: 6807661 - DNA, 76 bp, Homo sapiens
gtatttattttcacagaatatcaccaaataagcatgaagcaaacagtctggatgaaatttaggtgcagataaatat

SEQ ID NO: 6807662 - DNA, 67 bp, Homo sapiens
taacatcaaagttggtatatttgcatctctgtataaagagagtttgcaaataggaatttaggtgtta

SEQ ID NO: 6807663 - DNA, 109 bp, Homo sapiens
tctccgcgccatggcagtgatggagatgggtccctggccgccctcggggcacaggtggcccgcagggcccggcgggctcagcagagcacgggcacgccgtccgtggaga

SEQ ID NO: 6807664 - DNA, 60 bp, Homo sapiens
ttgtccaggctcagcacttgctactggcttcccagagcagagtggctgtagcttgctcaa

SEQ ID NO: 6807665 - DNA, 100 bp, Homo sapiens
cctgcctctgccaggtgggctctgagagtgggtgattctgaacttccaagggccagggacacagcatcgtctcgctgtcagagctgctcagagagggagg

SEQ ID NO: 6807666 - DNA, 92 bp, Homo sapiens
tttggggagggcagctgaaatcactaacgccagcctggctctaaccagcctgtgcagttttaagtggtctaatcagccctgcttttcacaaa

SEQ ID NO: 6807667 - DNA, 65 bp, Homo sapiens
cttttggaggtttaagtcgggtggtgggaagagatacatttccattcctgatatggccacaagag

SEQ ID NO: 6807668 - DNA, 61 bp, Homo sapiens
agtgctcaatggggtgccttttttacagtcaaactgtcaggatggtcctttatgagaagct

SEQ ID NO: 6807669 - DNA, 60 bp, Homo sapiens
gcaatttctcccagggactggatgatgcaggcttccttcaccaggttcccatgggtgtgc

SEQ ID NO: 6807670 - DNA, 67 bp, Homo sapiens
tttggatttcattttaatttcactgggaagccattggagggcttgatgaaagaaggtgcagtctgaa

SEQ ID NO: 6807671 - DNA, 83 bp, Homo sapiens
gctgaaaggaatccatggtgcagggcacatgaggacccccaggtaagcctgtcctgatggcactagctcgtggctctttcagc

SEQ ID NO: 6807672 - DNA, 78 bp, Homo sapiens
gaatggttatcttgggcattggcttatattttggcctccgatatgggaagaaaactagtaatgcttctagaactattt

SEQ ID NO: 6807673 - DNA, 90 bp, Homo sapiens
gaaatttctagcgggcttattcctgggttccagcccagatctatggaattcagagtctctggggctggagccagggaacccgcatttttc

SEQ ID NO: 6807674 - DNA, 56 bp, Homo sapiens
cagagctggggactgttggatgggaagatgcccagccgcggtggtcccaggctctg

SEQ ID NO: 6807675 - DNA, 124 bp, Homo sapiens
ttgtggatgttactgcacatttttattattaacactagtttatctgcataaatgtttatatgcatgttttttgacagtttatgtaaaattagtaatgaatgatggcaatggctttaacctataa

SEQ ID NO: 6807676 - DNA, 64 bp, Homo sapiens
aagaggcagaaatatcgctgaatggtgaaaaacagctcccccatattcagcagtgtctgctctt

SEQ ID NO: 6807677 - DNA, 63 bp, Homo sapiens
cgcacccgccacctgcccgcggactgcggcgcagcggtcccaggaagtgcggcggcggcggcg

SEQ ID NO: 6807678 - DNA, 61 bp, Homo sapiens
atgtggctcacatagctggaaataattattttgtgttcaaatccagggctagggagctcat

SEQ ID NO: 6807679 - DNA, 59 bp, Homo sapiens
cttgcagtgtggccttgaagagatgcttgaatctctctgaacttaacgtccgcagcaag

SEQ ID NO: 6807680 - DNA, 62 bp, Homo sapiens
gtgacgtttaatagtgacatgggtgcattcccacacacacccattccacccagaaatgtcat

SEQ ID NO: 6807681 - DNA, 70 bp, Homo sapiens
gggagctctttcagttgactcctagatccctttgacatacccccatcattaggagcaggagagagttctc

SEQ ID NO: 6807682 - DNA, 58 bp, Homo sapiens
ctggggactttttggaataagggagaagttggttaccttttaacaaggatttccctag

SEQ ID NO: 6807683 - DNA, 63 bp, Homo sapiens
ccaactgcacacttagcatctgggagtgagcgcctccatcctgggtggtgagcgtgaagctgg

SEQ ID NO: 6807684 - DNA, 81 bp, Homo sapiens
ggttttcttagcatagctgtttgaagtatttttctatttcatagctagaagtggagtactcaagacagcactgggaaaagt

SEQ ID NO: 6807685 - DNA, 77 bp, Homo sapiens
cccagcaacctcattactaatgtctgcactttatggatgaggccgaggttacacagatggttagtagaggagttggg

SEQ ID NO: 6807686 - DNA, 59 bp, Homo sapiens
ccttgggtctaggccagggagtattcaaggatgttctccaggtatgcctgaattcaagg

SEQ ID NO: 6807687 - DNA, 55 bp, Homo sapiens
cactgcagtggtcagagcagaggtggtgagagcttgggctagagacttagcagtg

SEQ ID NO: 6807688 - DNA, 72 bp, Homo sapiens
gcatatggcagggactggggttcttgcttggaactaggacccaagcacagttcctggtatcccataaaaggc

SEQ ID NO: 6807689 - DNA, 57 bp, Homo sapiens
ttctgtcatcagattgttccaggagcagtgatgctcttaattaagctgagatctgag

SEQ ID NO: 6807690 - DNA, 100 bp, Homo sapiens
agcaatttggtgtgcaggactgctggaataaatgtgaattagagctttgcgatgtgagtaacactgtgtctttttacatttatccccgccatcatgtgct

SEQ ID NO: 6807691 - DNA, 108 bp, Homo sapiens
gccccacatctctgacatttcaaggtccttgcaattttcatctttctttgtttaacttcgtaaggcatgggtagaagagaagccagtgacttagtcttaaaatggtgc

SEQ ID NO: 6807692 - DNA, 73 bp, Homo sapiens
aagacagacagagctggagcttgaatggagagcattgcttggtatgcataggactcctggcttgcatagtctt

SEQ ID NO: 6807693 - DNA, 102 bp, Homo sapiens
attaatagtatctgtcagaaattagaagtcatgctcccatcttgctcagccatgagttttcaaaaagcaaaatgggacatgggattttgacatactattagt

SEQ ID NO: 6807694 - DNA, 61 bp, Homo sapiens
gcatttgaaatcctctgtgacgatctgctgtcatgcatggtaagcatagcgtttcagatgc

SEQ ID NO: 6807695 - DNA, 59 bp, Homo sapiens
gacgtctgtttccgattctcttgggtttgtcccaggagtgagctttggggtcagatgtc

SEQ ID NO: 6807696 - DNA, 81 bp, Homo sapiens
gaggttgagaagaaaattgagggtatttgagctggaaaaaatgtaatcaagctgatgctttaagattaatctggcaacctt

SEQ ID NO: 6807697 - DNA, 60 bp, Homo sapiens
tcattcagataggtcttataggtgattttttattcctttgcttataacctgttttgatgg

SEQ ID NO: 6807698 - DNA, 90 bp, Homo sapiens
gtgggtgacagaaagattgaaatcactggaagctttcagccatgaaggagttgtacattgtgaacattcaaatcaagatctttcatccac

SEQ ID NO: 6807699 - DNA, 73 bp, Homo sapiens
atttgctctgttatgcataagcatcagtgtataaataaatatgactggagatgcagtgtaaacagtggcaaat

SEQ ID NO: 6807700 - DNA, 70 bp, Homo sapiens
gtgatgaggggctcagaggtcagtagccaatcacagaagcgggcagtctgaccttccgtgcccctctcat

SEQ ID NO: 6807701 - DNA, 69 bp, Homo sapiens
gattattccaggcacagaaggagggttgattctgccattttcttgctgttttcttgtcctggtataatt

SEQ ID NO: 6807702 - DNA, 73 bp, Homo sapiens
cagagttggtcctttatcctttaggcatcagggaaccatctatatgtgcaagagtgaagaggccagagttctg

SEQ ID NO: 6807703 - DNA, 68 bp, Homo sapiens
gaggtcaaggctgcagtgagctgtgatcgcgccaatgcactccagcctcagtgacagagcaagacctt

SEQ ID NO: 6807704 - DNA, 68 bp, Homo sapiens
gatacctagattgggctccagttaaaacggttgatcccattatttgttttagcccagtttaaggtgtc

SEQ ID NO: 6807705 - DNA, 61 bp, Homo sapiens
ctagagagtggaaagcaagctgagttggtcacatcaaattcaattgtcctccaactcctgg

SEQ ID NO: 6807706 - DNA, 92 bp, Homo sapiens
tccctacctggcggcatcaaagagagaggactgttatgacctcctgcgggtcctgacagggaaaggtcctcttttgggggcaactgtgggga

SEQ ID NO: 6807707 - DNA, 66 bp, Homo sapiens
gaatacttgaagaggactttgcagctgtctggagttctctgtatagctctttcctttccagtattc

SEQ ID NO: 6807708 - DNA, 61 bp, Homo sapiens
gtcatcattaccaggcagtattagagacctgactccatccaatgctgcccagtaagatggc

SEQ ID NO: 6807709 - DNA, 69 bp, Homo sapiens
aaagcagtctgttttaacctgaaataattctgttgatatttgaatcactttcagtgggacatttgcttt

SEQ ID NO: 6807710 - DNA, 85 bp, Homo sapiens
tactgtcacgctgcagttgactccctgtttgcagtcagaccagtatgtcagcgtatacagaaagtcaaaagctagctagatagtg

SEQ ID NO: 6807711 - DNA, 66 bp, Homo sapiens
gtggttatcagagctattttgggaagtggcttgtttccagcctcctggccttgctcctgatgccac

SEQ ID NO: 6807712 - DNA, 74 bp, Homo sapiens
ttgatttttgccctctcaagttgagtcagattggaggtcaccatctgaagcacagcaggaagggtcagaatgga

SEQ ID NO: 6807713 - DNA, 101 bp, Homo sapiens
aggaataaatatctaacataagttgaatctgttaaattgggatgatgattaaagatatcggttttataaagagagtcagttggccttagatatgttatcct

SEQ ID NO: 6807714 - DNA, 102 bp, Homo sapiens
ctcatggaatctgggaagtgtcctaaaggttattgcactggagttggacgtggaagcatgggaaaattttgtataaggacaagggacattccaggtagggag

SEQ ID NO: 6807715 - DNA, 61 bp, Homo sapiens
gaaaggctaaaattataagggttagagcaagtattagctataccccttgattttagatttt

SEQ ID NO: 6807716 - DNA, 82 bp, Homo sapiens
ggctccaggcccagccctaaggcccagctggctactggaagaccaggggccagcagggaagccttgggcttggacaggtgcc

SEQ ID NO: 6807717 - DNA, 55 bp, Homo sapiens
tttagtgtagcctaagcagaattagctgtgagtcaccttctgttgctgcgctgaa

SEQ ID NO: 6807718 - DNA, 57 bp, Homo sapiens
gtctcctcaagttccgtggcagactagtaagactgagtttgacaccttgggagagac

SEQ ID NO: 6807719 - DNA, 80 bp, Homo sapiens
agcaaagttagcttcagcttaatctcttagcaaattaatgaaggttttttcctttaagagattctaaagctactggtgtt

SEQ ID NO: 6807720 - DNA, 60 bp, Homo sapiens
ggcaggcactgtgctaggcgctgagcaaacaatgctaatgagatccacacagtgcctgct

SEQ ID NO: 6807721 - DNA, 55 bp, Homo sapiens
cacagtgctttatgagagatctagggaaatccacttctatttgtaaagggctgtg

SEQ ID NO: 6807722 - DNA, 57 bp, Homo sapiens
agccccaggcccggacgcctctaggatcggacccgcgcgccccggatgcttggggct

SEQ ID NO: 6807723 - DNA, 58 bp, Homo sapiens
ttttcttcctggattttggcattatatttaatggtgaaaaattaaaacaggaagaaga

SEQ ID NO: 6807724 - DNA, 59 bp, Homo sapiens
tgaccttggctccaatcccagctctgcaatttactcgcagtttgatttggaccaagtta

SEQ ID NO: 6807725 - DNA, 65 bp, Homo sapiens
gatgctcaaaaaatagttgtggaatttgaattctcccagttcacaaaatggtttgttgatgtatc

SEQ ID NO: 6807726 - DNA, 55 bp, Homo sapiens
gactgtggatagaacactgcagctagtcctgcagatgctctcctcatccccagtc

SEQ ID NO: 6807727 - DNA, 55 bp, Homo sapiens
taaggagggagagaggggaatgaacacccatatctcactctctttccactctttg

SEQ ID NO: 6807728 - DNA, 69 bp, Homo sapiens
tccctatgttattggtagaggcaagcggaaggtgagtgctttgccaagatcagccagctaacatgggga

SEQ ID NO: 6807729 - DNA, 81 bp, Homo sapiens
cattatgtacattcatgtcccacttctagcagtgtggtgctgctgagaaatgcagacatgctggaggaaatgagcaggatg

SEQ ID NO: 6807730 - DNA, 64 bp, Homo sapiens
aagctcttgaatgggatcaaggccttcttagggcccaaagataacccctcccacttcagggctt

SEQ ID NO: 6807731 - DNA, 56 bp, Homo sapiens
ggatgctccttggtgatagaatatttccttgtagatgtctgtctcctggagggtcc

SEQ ID NO: 6807732 - DNA, 60 bp, Homo sapiens
cagctgacctggctaagggagctcaggccctgccatctcccctgttacactaggtcactg

SEQ ID NO: 6807733 - DNA, 57 bp, Homo sapiens
acaagtgacaaggcaatagatgctgttatcacatgccatgagttccctttcacttgt

SEQ ID NO: 6807734 - DNA, 101 bp, Homo sapiens
ggcatttcctggggaattaatagccagctggggttaacagtccttggttcgactttaggccatcaactcttcttgctgctcattaattcccagaaagtgcc

SEQ ID NO: 6807735 - DNA, 57 bp, Homo sapiens
ggcggatcacctgaggccaggagttcaagaccagcctggccaagatggtgaaacccc

SEQ ID NO: 6807736 - DNA, 55 bp, Homo sapiens
agcagcccctcggcgggtgcgcccggcaaaacccaccagcccgccgggggctact

SEQ ID NO: 6807737 - DNA, 76 bp, Homo sapiens
ggatctgcatacctccatgtgcccctggaagagcagaactgtttgccaaatatctaatacaggaggcctgcaatct

SEQ ID NO: 6807738 - DNA, 72 bp, Homo sapiens
taaaaggagttgttctgtgcaccagaatgatatttcttaaagaaactctcattttagtgcactgacctttta

SEQ ID NO: 6807739 - DNA, 78 bp, Homo sapiens
gtttttctatccaattctaatattgtgttttcagattataaggctgagactatggtgtgcagaaattggttggtgaac

SEQ ID NO: 6807740 - DNA, 76 bp, Homo sapiens
gttcctagcagctgcctgggcttgtacacctcatactctacgtggaaggtcctcgacgcccagcagttatgagaat

SEQ ID NO: 6807741 - DNA, 56 bp, Homo sapiens
ctggtagggaatccatagggcctattttgggtaggctggaagtaaaaacttactag

SEQ ID NO: 6807742 - DNA, 59 bp, Homo sapiens
ggctcctctggatcctgcaggaatctggtgctaaaggtagcaggatcacagggagagcc

SEQ ID NO: 6807743 - DNA, 74 bp, Homo sapiens
gctagaccgttgtgggatatttttcagtgtaaaaactagcattgtgcaatgttttacaatttatgttcattagc

SEQ ID NO: 6807744 - DNA, 76 bp, Homo sapiens
aatgtagttgccagatcttccacatggctgtatcaatgggcttgactctggagccttagatttgggcaagaacatt

SEQ ID NO: 6807745 - DNA, 91 bp, Homo sapiens
gcaagcatgccctggcaaacttgagcacacagtgtgcctgtgtagatgtgtgtgtctgcaaaggtttgtgtgtgtgtgagggtgtatttgt

SEQ ID NO: 6807746 - DNA, 57 bp, Homo sapiens
tatccaccagattcttagcagcataactgatgaagttgcaaaggtatttagggggta

SEQ ID NO: 6807747 - DNA, 62 bp, Homo sapiens
cagatgtgtgtgtgtgtgtgtgtgtgtgtagttgtatgtgtatgcacacatgtatgcatgtg

SEQ ID NO: 6807748 - DNA, 79 bp, Homo sapiens
gctcttcatctggctgccaccatcctcccccctcgaaggctcccagggtaaggggagagtgacggcagtggagaggggc

SEQ ID NO: 6807749 - DNA, 58 bp, Homo sapiens
caccctggtctttgcaaagccaatccagcatggattgcatatgcagcacatcaggctg

SEQ ID NO: 6807750 - DNA, 108 bp, Homo sapiens
tcctgacacagagtaatttgtcaggacctgccctggcttgagaaaggtgaagaagctgcctcactgctctgaaagtacagggtaggtacactgtgagctgtggaaggg

SEQ ID NO: 6807751 - DNA, 57 bp, Homo sapiens
aaatacagtggcagcagataatggcagtatctctgtaactgctggtaaactgtattt

SEQ ID NO: 6807752 - DNA, 81 bp, Homo sapiens
tgcaacactgccaagtctaaatgtcacttcttggtccacatcttaattgccccatctggagcatttgacctggttgtttca

SEQ ID NO: 6807753 - DNA, 62 bp, Homo sapiens
gtgtgcgcgtgcacgcatacttgcacacgtgtgtgtatgcaagtgtgtgtgcatgtgcgtgt

SEQ ID NO: 6807754 - DNA, 93 bp, Homo sapiens
ctcatcactgcattggagttctcatctctttgactcttaaaatagatgaatatttttttccatttatctttaaagacatgtgaacttgatgag

SEQ ID NO: 6807755 - DNA, 57 bp, Homo sapiens
ctgagtgatagcgatggggaaccattgaaggatttccatcacaagctaatcaattag

SEQ ID NO: 6807756 - DNA, 66 bp, Homo sapiens
gggctatagttctcactcagaatttgaattttgactttagacattaagtgttgaggagaatggcct

SEQ ID NO: 6807757 - DNA, 69 bp, Homo sapiens
ggcactgtgggggagccagtcccatacatatgtattaaaggatttggattccttactcccaccagtgct

SEQ ID NO: 6807758 - DNA, 56 bp, Homo sapiens
tctgggcaacaacttgcaaatggtttaatgttttccaaatgcagggctgctgcgga

SEQ ID NO: 6807759 - DNA, 55 bp, Homo sapiens
aagtttggaagccgtctgcaaatctcctggggttctcagaataaattcctaactt

SEQ ID NO: 6807760 - DNA, 93 bp, Homo sapiens
ttctcaaaattcagagagtgagtggaccctgcaaggaaggattcacctttttaaactcttggggtccctgcacagaccatttaatactgagga

SEQ ID NO: 6807761 - DNA, 58 bp, Homo sapiens
ctgttaagtgtagataatgtggaaattaaacatataatatatctggtgcacttagcag

SEQ ID NO: 6807762 - DNA, 59 bp, Homo sapiens
gttggactttttacatggtggcttaagactccaaaagccaatgcgtaaaaagatctaat

SEQ ID NO: 6807763 - DNA, 63 bp, Homo sapiens
aattagcacaggcaactccacatagtttgcaatcagagaattatattgtgccaagtgctaatt

SEQ ID NO: 6807764 - DNA, 63 bp, Homo sapiens
tggagagagtcgggatagtacaaagcgggttacccctagctcacaccttccctgctccctcta

SEQ ID NO: 6807765 - DNA, 77 bp, Homo sapiens
gttgtttattatttcttccagtgcttcctaaacttttccactgaagtactgacagagaagaatgaaagctacacaac

SEQ ID NO: 6807766 - DNA, 58 bp, Homo sapiens
atggggtcctgttttcttggtggagaaacattggattctggacagataggagccccat

SEQ ID NO: 6807767 - DNA, 78 bp, Homo sapiens
tttctatttggattgggttggaaatagtgtggcaatatgaaaatgagcatgttatgtatctgcccagctggagagaaa

SEQ ID NO: 6807768 - DNA, 56 bp, Homo sapiens
gtgctggctgccaggaggctgctgtggaaataactgtaggcctgagaagtcagcat

SEQ ID NO: 6807769 - DNA, 70 bp, Homo sapiens
gctggttgcatttctccaccttaactgtgcctgacaggcagcagagcatggtgggaagggcctgcacagt

SEQ ID NO: 6807770 - DNA, 58 bp, Homo sapiens
cctgcacccaggccgcacctctgtgtatcagccggtccatgtgtgggtgggtgtctgg

SEQ ID NO: 6807771 - DNA, 99 bp, Homo sapiens
gtttatagttttcagaatttttgctcagttttggaatagtaccgattaccaaaggtaaacctgacccttaatgagcaagtaaatttgtaggctgtatac

SEQ ID NO: 6807772 - DNA, 74 bp, Homo sapiens
ttacatgattgcctccaggctgaatatctagaataatattaggggtctgatagcctggaagagttaacatgtag

SEQ ID NO: 6807773 - DNA, 98 bp, Homo sapiens
tcactgtccagttactttttccaacatgccagacattagtttgtaggatccctacgctagagtgcaggcatagttgtcaaagtgtaggaatcagttga

SEQ ID NO: 6807774 - DNA, 57 bp, Homo sapiens
gctttggagttaggactcggccaaaaaagcagaattttcctggaattaacccagagc

SEQ ID NO: 6807775 - DNA, 90 bp, Homo sapiens
ctgccagtgatgttctagagccaggagggggagcagcctggttctgcttcctgcttgctctccggactctaattaatttccttctggtag

SEQ ID NO: 6807776 - DNA, 72 bp, Homo sapiens
caatgaataagtatatgggaaatagaaggaaggggtcaggtccaacttttgatgaacctatataatttgttg

SEQ ID NO: 6807777 - DNA, 58 bp, Homo sapiens
tcctcctgtctaccagttcctgtttcaggaacttgggatgaccttgtgaagggtagga

SEQ ID NO: 6807778 - DNA, 86 bp, Homo sapiens
taacatgatcctacatgaatgtttcaatattgtaatcctgtaagttacttttacattgacagttctgaaattcatgttgagtgtta

SEQ ID NO: 6807779 - DNA, 55 bp, Homo sapiens
tggagatgaggacatggacgtctttgagaaaggccttattcctcctacatctcca

SEQ ID NO: 6807780 - DNA, 74 bp, Homo sapiens
gcaggctgtgtgacactggccatctgggtttcttcccctgactcccaaagcccaggtccagttcactgcactgt

SEQ ID NO: 6807781 - DNA, 78 bp, Homo sapiens
gacaagtgaatcatgtctcagagtgttctagtctccaacataattaatagccaggagattttgtacatagaatttgtc

SEQ ID NO: 6807782 - DNA, 73 bp, Homo sapiens
ggaatgtgctgcttctccaaagtaggacttatgaaaaaatgagggtcccagcataggggaagcatcaatgtcc

SEQ ID NO: 6807783 - DNA, 58 bp, Homo sapiens
agcaggagaacactgtggctctcggatccaggagaggcaggccacgagggctcctgct

SEQ ID NO: 6807784 - DNA, 63 bp, Homo sapiens
gggggaaaagcacctagcatagtgcttagcacatctcaagcactgaactggtgctggtccctc

SEQ ID NO: 6807785 - DNA, 58 bp, Homo sapiens
gcccagctggatccctgcagaacttagaccttaccaaaggtgaaggggaccagctagc

SEQ ID NO: 6807786 - DNA, 86 bp, Homo sapiens
agcgataacttgtgcattgcagcagtgctttggactctcctctaacctccaaacataaaaagatagctgctgcaatggcagtcgct

SEQ ID NO: 6807787 - DNA, 55 bp, Homo sapiens
gcatgcagagtccctctgcattagaactcaagaagtgcttgttaattctgcatgc

SEQ ID NO: 6807788 - DNA, 78 bp, Homo sapiens
tagattagccttagtgagaaggagcccatgctagtaagactatgcatatcctccatctctgctgtcatggttggtctg

SEQ ID NO: 6807789 - DNA, 62 bp, Homo sapiens
gctgactcagcagctgatgatccttgggatgggctaggatatgaagctagtgttgggttagc

SEQ ID NO: 6807790 - DNA, 62 bp, Homo sapiens
tgtccagcatttaggcttgctgatatgtccttgaccttctcattgattctgaatcctggaca

SEQ ID NO: 6807791 - DNA, 57 bp, Homo sapiens
gcctacatatctaagacaagccagatgagattggtggacattctggatgtgctaggt

SEQ ID NO: 6807792 - DNA, 72 bp, Homo sapiens
gcagacagctgcctctgtgtagatcttgaaaggaactgcagggcaatctacgcagaagcatctccctactgc

SEQ ID NO: 6807793 - DNA, 84 bp, Homo sapiens
tcttaatagatattcctaaggccaaaagtatcactgagaagttggagccaaaatctcagggcttttcttttgaattctataaga

SEQ ID NO: 6807794 - DNA, 84 bp, Homo sapiens
gggtggaggagatgacgtgtggaagtccttggagtgagctgccacgttagcaccaaatcaccagcacgatcattccttccattt

SEQ ID NO: 6807795 - DNA, 93 bp, Homo sapiens
tgtataagaagttaatttgcaagcgacttgactagcatgagaatttttgactctttcagcaaacacgatgcttgtttatgtacttttttgaca

SEQ ID NO: 6807796 - DNA, 78 bp, Homo sapiens
ccccttactggaacaccatttcctctctgctcctctcccatagggagcacatgagctgatggtgggctggtgaggagg

SEQ ID NO: 6807797 - DNA, 58 bp, Homo sapiens
ccaacttcacgttcagtccagttgcttttcaggcaatctcttgggaggaatgaattgg

SEQ ID NO: 6807798 - DNA, 82 bp, Homo sapiens
cactcccccactgtccccggagctggcaaataaacaaatccacaaacaaattatccgtgtgctccggagaggcggcggcgtg

SEQ ID NO: 6807799 - DNA, 129 bp, Homo sapiens
ttatttagagatcaaactggcagaatgtcagtgggaatctgtcgcgtgtttggttttctgaagcacagaaagcttatgaatgggcaagatgctgaattccgctgtgatgcccgaaactttctaaaaata

SEQ ID NO: 6807800 - DNA, 101 bp, Homo sapiens
gagttgtggcttttgcgaatgaggaactggagctttcattttagataatttgaattaaatttaaattggacggcgcaggtctggaggagcccctgcaactc

SEQ ID NO: 6807801 - DNA, 84 bp, Homo sapiens
gcaggttttactaaagtgtcagctaaaacagttggtcccaggaccagtgttagagactgatacaggcaagaagggagagcaagc

SEQ ID NO: 6807802 - DNA, 79 bp, Homo sapiens
tgcagtaaaaaaggatatgtgcagctagttttccacttttaaaaccaaaccacagatgacacatttcctttccactgca

SEQ ID NO: 6807803 - DNA, 63 bp, Homo sapiens
gtctaaggcagtgagaagaaacaggtgcagttgcaatttgttctcttttccttgctccatgac

SEQ ID NO: 6807804 - DNA, 71 bp, Homo sapiens
cctggaacccaggcctggaagcctgtgagcattgtgtcatgtggtgggcagagcctgggcctgggtcgggg

SEQ ID NO: 6807805 - DNA, 117 bp, Homo sapiens
gagcatgggtatcatcactgttgaattgtgaggtagcctttggagggccctggtacaagctcccagtggtgcctggctctatcagtggtggacattacagatgaatgccctgggctc

SEQ ID NO: 6807806 - DNA, 56 bp, Homo sapiens
ccaggggaggcagcgataaacctggataatttgggccaggcctcttcctcccctgg

SEQ ID NO: 6807807 - DNA, 85 bp, Homo sapiens
gttctgccaacccctcccaaagataatagatttttgatagctttacttcccaagacaataatttttgggcagggcacagcagaac

SEQ ID NO: 6807808 - DNA, 56 bp, Homo sapiens
cctgagatcagtgcatttggtgaactgtatgttgtgttccagattggtgtctcagg

SEQ ID NO: 6807809 - DNA, 80 bp, Homo sapiens
cttcaggttgcgccctttaccacaaggacagaacttaggtcaagttacctctctgtgagagagaaaaggcaaacttggag

SEQ ID NO: 6807810 - DNA, 68 bp, Homo sapiens
ggggttccagggaatgatatttttgccttttatgtccccaagtgtagaaagtgcatctctgttgcccc

SEQ ID NO: 6807811 - DNA, 62 bp, Homo sapiens
tcagtggagtatggatgaagtcagtgccagaacaaaatcattttgtatttatattccattga

SEQ ID NO: 6807812 - DNA, 57 bp, Homo sapiens
tttggcatttaataggtgatcaggatctattaattctctttttcctttaatgccaag

SEQ ID NO: 6807813 - DNA, 70 bp, Homo sapiens
ataggaactatttctgccaaagtggggaccttgtccatagcaacgtccctgtcctgcagaaagtttgcat

SEQ ID NO: 6807814 - DNA, 76 bp, Homo sapiens
ttgcttgaattcgggaggcggagcttgcagtgagctgagatcgcgccactgtactccagccttggcgacagagcga

SEQ ID NO: 6807815 - DNA, 72 bp, Homo sapiens
cgcttctccagccaccaccactgaaaggttatagaatattctatttcaggacacctttaaaaacgagaagcg

SEQ ID NO: 6807816 - DNA, 58 bp, Homo sapiens
agaatcccaattctggctgatttagcaccaaggaagctttctccagctttgggctttt

SEQ ID NO: 6807817 - DNA, 118 bp, Homo sapiens
ttgatttgtggctgagcatggagatgatggtagtcggagtggagaaggtcacagaattgataccaaatttctggatcatccactttgtgtacatattacctagaaaagtgacaagcag

SEQ ID NO: 6807818 - DNA, 66 bp, Homo sapiens
ttgctgtaatgtgggaagccagagggtgccgtgttttatcagcctggctcatcctggttgcagtgg

SEQ ID NO: 6807819 - DNA, 97 bp, Homo sapiens
catgaaagatgctcatctatcctaattgttaggtgtctgatgtgcttgaatggtccacatcagacaattaattattaatttttggtcattttatatg

SEQ ID NO: 6807820 - DNA, 59 bp, Homo sapiens
tggtgttacaaggctttgagtgcgcttccagaaatagcacatgcacagccatagcgcta

SEQ ID NO: 6807821 - DNA, 78 bp, Homo sapiens
gatgggctaggtcagcacaggtgctcaggccaggacagatacttcgtccctggccacccagccttggccatggtcctc

SEQ ID NO: 6807822 - DNA, 59 bp, Homo sapiens
gaggccaggactctgaacagggctcaggaaaggccacagggccctgagagcttgggttc

SEQ ID NO: 6807823 - DNA, 78 bp, Homo sapiens
ggaattagaggataaggatttaagtttgcattactcagtatatgagtgtgtgaccttttaatttaatttccctgatcc

SEQ ID NO: 6807824 - DNA, 61 bp, Homo sapiens
ggaggcaaagcactttgcttggaaatatttttcacatgacatacaaggtgcttcgacctcc

SEQ ID NO: 6807825 - DNA, 78 bp, Homo sapiens
ttttagaggtgacatcaagtaacatttcaatgatttaaaggaggaaatctttgaagaggacttgaagtgcctttaaaa

SEQ ID NO: 6807826 - DNA, 76 bp, Homo sapiens
tttccctttaagcaaaagggagaccaaaggcttttgagcaataaagagacccagtcacacttgtgctttggggaaa

SEQ ID NO: 6807827 - DNA, 72 bp, Homo sapiens
ctgagaggaattggttcaaggtttatctggagctttaaagtctaaacctcaaatcagtgtcaattacctcag

SEQ ID NO: 6807828 - DNA, 62 bp, Homo sapiens
gtgtctgtgtcacttgattcttcctggttgagttatcaacactcagagcagcggcatcacac

SEQ ID NO: 6807829 - DNA, 81 bp, Homo sapiens
aggtgggaggggaatgaaatgaaacagaacatatcagaatgcattacatgtggtaagggtattatttcatccattttatct

SEQ ID NO: 6807830 - DNA, 79 bp, Homo sapiens
gcagctggccatgggcattctcttaggtgatgagcccctgacccataggccctctcattccagaggcattggccatctc

SEQ ID NO: 6807831 - DNA, 60 bp, Homo sapiens
gactcagtggttgagagcctgggcctcctagccagaggacctggctttgaatcttgactc

SEQ ID NO: 6807832 - DNA, 60 bp, Homo sapiens
gcttgagtcccatgatgatagccacagtccttgctgaaggatatcgatggtggctcttgc

SEQ ID NO: 6807833 - DNA, 99 bp, Homo sapiens
gaggtgggaggatggcttgagcccaggagttggaggctgcagtgagccatggtagtgtcactgcactccagcctgggcaatagagtgagaccctgtctc

SEQ ID NO: 6807834 - DNA, 86 bp, Homo sapiens
ggaggaggctgcaaggggatggctttgtggctgactctgtccagcgtttcccatggggcgtcccagctcatctttgcagttttgcc

SEQ ID NO: 6807835 - DNA, 56 bp, Homo sapiens
aaagagaacttttacccaagaaaatggtaatgacttttgggccttgagtcctcttt

SEQ ID NO: 6807836 - DNA, 58 bp, Homo sapiens
ctacttctaagtacatggtgataaagtatgatggattgcttaggtgcttaagaagtag

SEQ ID NO: 6807837 - DNA, 55 bp, Homo sapiens
gtatcacatatttactgagtagcctgcctggacctatacagtaattaagtggtat

SEQ ID NO: 6807838 - DNA, 92 bp, Homo sapiens
aagtcagcaaacaagcgagtaatggaatcaggatatgaacccaggtatcctgaggtcctggccatacctggtttccatcatgttcctgactt

SEQ ID NO: 6807839 - DNA, 100 bp, Homo sapiens
atgtttgaaggaatcaaaattggaagatgatgagaagaaagtagaagacatttctatgaatcaattttaacatccttgttgattctgtgttttcaaacat

SEQ ID NO: 6807840 - DNA, 68 bp, Homo sapiens
gcctgcagcccttggtattttccgatcccagctgctctgtgagggtggaaagtatttggggaccaggc

SEQ ID NO: 6807841 - DNA, 111 bp, Homo sapiens
gagtcacctcacccttgagggcagagagttctccacctctctttgacatggtataaaagccccaacttccctgagaggtggtgaggacttgtctttaatgtgaacaggctt

SEQ ID NO: 6807842 - DNA, 86 bp, Homo sapiens
gccatgtgcctttctgtagctcacactatgtgcttggtgtgtagccaagtacaagggtgtcagtttaatctgggtctgcaagtggt

SEQ ID NO: 6807843 - DNA, 60 bp, Homo sapiens
tgcaggctgaagttgcctattttaatatatgactcttcatttattcattttcagccagca

SEQ ID NO: 6807844 - DNA, 74 bp, Homo sapiens
gacctaaggaaaaggatatatatgtgctctaggagtgaattctggtgagaacgtttgtattctttcctttcctc

SEQ ID NO: 6807845 - DNA, 59 bp, Homo sapiens
ccatggagtgactgccttttcatcaggtatccatccctggcagaaagagttacacctgg

SEQ ID NO: 6807846 - DNA, 60 bp, Homo sapiens
gaatacacgaatagagcatggtgatagtatggtcattgctatgtctgaatgtgtgtgttc

SEQ ID NO: 6807847 - DNA, 90 bp, Homo sapiens
atttctttttctttgtatttttgttgattactgtgttgctgacattagttatggaagcactttaagcaacagatcaacagaaaaaggagt

SEQ ID NO: 6807848 - DNA, 86 bp, Homo sapiens
tttttcacatgcatttacatggagctatctaacccgcctgctgggaagttgggacgctaacatgagaatcttgcattgctgggaaa

SEQ ID NO: 6807849 - DNA, 68 bp, Homo sapiens
ttgccatagtgaaatgcaaagcctttctgtatcaacgaagtctaaagcaaggtgtatcaccatggcaa

SEQ ID NO: 6807850 - DNA, 71 bp, Homo sapiens
tccggcagaaagtcctgatgcatgctgtagggaatgtctgaacagagaactgcagggatctttctgcctga

SEQ ID NO: 6807851 - DNA, 59 bp, Homo sapiens
ggtatttaacaaaaatatcaggcatcacatgtattgtgggcttgtctattgtcaatgcc

SEQ ID NO: 6807852 - DNA, 60 bp, Homo sapiens
ccgatttcctttaggactgcccagcctcagacagctggtcctggaaggtcctgagggtgg

SEQ ID NO: 6807853 - DNA, 59 bp, Homo sapiens
gccactagggggccatttagttttctgcaacaggagaacactaatggtttcttaatggc

SEQ ID NO: 6807854 - DNA, 60 bp, Homo sapiens
gtggtcagtgcctcctgtgttggccgcaatgctgtgctcctcacagctggcgctgaccgc

SEQ ID NO: 6807855 - DNA, 66 bp, Homo sapiens
gtgaaagcactgaacaaagtaacaaaagtgctgagaagttgtgctttgtgacagattagttttcat

SEQ ID NO: 6807856 - DNA, 77 bp, Homo sapiens
ccttgacatctcttttgtctgaattggggttcattctatagattggcatagggttgggcttcagatgagggtcaagg

SEQ ID NO: 6807857 - DNA, 76 bp, Homo sapiens
tggctaacaatagatggtatgctattccatagactcctgctatcagagtctgcattcacagcaattatctttacca

SEQ ID NO: 6807858 - DNA, 63 bp, Homo sapiens
aaagcttgtcagtgcaattttacctgggtgacatcacccgcgtgaaatgctgctgccggcttt

SEQ ID NO: 6807859 - DNA, 74 bp, Homo sapiens
tgtcaacttccagcagactcttctcctggggcttaatatctatagcagtcccactttggattctgctggagata

SEQ ID NO: 6807860 - DNA, 55 bp, Homo sapiens
tagcactacttaggtacagccaaggcccagagcagactgtccttgagtagagttg

SEQ ID NO: 6807861 - DNA, 77 bp, Homo sapiens
atgaatcgctttggtcgtcatgggccattatcgtaaccagatggcatggccttattatggcacccgaagacattcat

SEQ ID NO: 6807862 - DNA, 102 bp, Homo sapiens
gatgtagaaatgtagaaacctaagggcatattaaagtgacaacatcttaaaagttttaaggctgtccaaaattttgacaattgccaggtttacattttcatt

SEQ ID NO: 6807863 - DNA, 130 bp, Homo sapiens
aggatcccttgagggaagggcaagtgcaccaggcccagcatctccatggctttggagtatcacgcaggacccagcagccagaatgaggagcttgctgtttaaaatgcagattcacctctgaagggattct

SEQ ID NO: 6807864 - DNA, 58 bp, Homo sapiens
tccctgcaggcatgtactctgagcccctgaggcagtttagggacagctctgtaggtga

SEQ ID NO: 6807865 - DNA, 63 bp, Homo sapiens
ggcagcaacgaggcttgataccatctagtatgacactagttccaccatcaacctcttcctgcc

SEQ ID NO: 6807866 - DNA, 60 bp, Homo sapiens
gacgcagagcagaagccgccagctgcccgaggacgctgaactggcttctgttttcatgtt

SEQ ID NO: 6807867 - DNA, 66 bp, Homo sapiens
agggccgtgtctggctggctggctggctggctggctggctggctggctggctggctgaccggcctt

SEQ ID NO: 6807868 - DNA, 96 bp, Homo sapiens
gttttataaggaagagatgacccagcaggtgtagggctcatggcaagtgctgtcagaatggtgggctcctgcctgtcccctcatgtccctgtaagc

SEQ ID NO: 6807869 - DNA, 64 bp, Homo sapiens
tggtgctctgcctatgccagcttggcacccgaagatgtgtgagtggacgtgaggctgagtatta

SEQ ID NO: 6807870 - DNA, 59 bp, Homo sapiens
gggtaattcagaggctgcctggaagacaaaggatgactagcaggtggtaatctgagcct

SEQ ID NO: 6807871 - DNA, 63 bp, Homo sapiens
cctcatatttgagttggaatcctggagatcatttagtccagttctatcattttagagatgagg

SEQ ID NO: 6807872 - DNA, 75 bp, Homo sapiens
ggattctcagaggtgaagaccagaagccatgagtggaaaaaccccacacagcagctggcagcttcttctctggcc

SEQ ID NO: 6807873 - DNA, 66 bp, Homo sapiens
aggagacttgattcattttgtgtctggaacagtcagtgcaatgttacaaactgaaatgagtttcct

SEQ ID NO: 6807874 - DNA, 101 bp, Homo sapiens
tgagacggagtctcacacggtcaccgaggctggagtgcagtggcgcgatctcggctcactgcaagctccacctcccgggttcacgcgattctcccacctca

SEQ ID NO: 6807875 - DNA, 61 bp, Homo sapiens
cagcagctcctctgcggctatgcattcgccattcttccctgtgtcagccgtggtgctgttg

SEQ ID NO: 6807876 - DNA, 86 bp, Homo sapiens
gccttagtgttgggagggaccctgatgactgaggagcctggtagctccaggtcgcccacactttcaggtctcttgcaccagaaggt

SEQ ID NO: 6807877 - DNA, 68 bp, Homo sapiens
gttaggagtcttgttagtaagtgacaaaaatccaactcaaattggcttacactaaacaagtttcctgc

SEQ ID NO: 6807878 - DNA, 55 bp, Homo sapiens
cattcccttggggagttcatgcttttccagtttactttatcctcccaggggaatg

SEQ ID NO: 6807879 - DNA, 55 bp, Homo sapiens
ttgcctgctgttttccttgtatttgtagcacctacagcaaggacaacataggtgg

SEQ ID NO: 6807880 - DNA, 76 bp, Homo sapiens
gggctgagaaggggcaatgtccaagtcagttgtgctcccacctaccttaggcagatgctcagtaccttttcagccc

SEQ ID NO: 6807881 - DNA, 106 bp, Homo sapiens
cagtgcatatttcctatttgaaaagcccaaatctgtagcatcttaaatgtagtctgcatcagacttcctttaagtggcacttggatttcagagagggtttgcattg

SEQ ID NO: 6807882 - DNA, 60 bp, Homo sapiens
gctaagaggagcctccttctgaaaataggttggaatgctggaaatgtggctgcttttagc

SEQ ID NO: 6807883 - DNA, 129 bp, Homo sapiens
agagggaattgaacaggcaaaggcctattttaggaggctctgtgactaaagaggattatacccatcttcttcaaggatctggagcgtattctgatttaatggtggcctgataagccaaagatctcctct

SEQ ID NO: 6807884 - DNA, 61 bp, Homo sapiens
tgcatgctcaagttagttgtgagatgtggctctcagcattttatactaaaatgaagtatca

SEQ ID NO: 6807885 - DNA, 83 bp, Homo sapiens
gcaggaaagtttttatttccccaagaccctggaggtgtcggggcctcagaggttctgtgtgggaagagagaggacttttctgc

SEQ ID NO: 6807886 - DNA, 72 bp, Homo sapiens
ttgtggtgttctaattcttttattcaaattaaaatggggatttgtttagtgaacaagttaagaacactatgg

SEQ ID NO: 6807887 - DNA, 69 bp, Homo sapiens
tgccatcccttctctggccagcagagggaagcagatgcccagactgtgacctccaggaaggggtgtgcg

SEQ ID NO: 6807888 - DNA, 79 bp, Homo sapiens
atcctgacttactttgtttgcacttcacctgtagcgacagcatcagtgaggtggagaacagggatagagtcctagagat

SEQ ID NO: 6807889 - DNA, 69 bp, Homo sapiens
cctacaatttaatttctgaagccagaaatataaatggatttttataatggcttctgagtattaggtggg

SEQ ID NO: 6807890 - DNA, 86 bp, Homo sapiens
gttgtacccacatgcaagtcttaatagtttagggttaataaaatgtttctaaaaaaatgagttgagattctgatacatgctacaac

SEQ ID NO: 6807891 - DNA, 57 bp, Homo sapiens
ctaggcagctttgggtgtgaaggagcccatcttacttgcagggtcccagaggcctgg

SEQ ID NO: 6807892 - DNA, 70 bp, Homo sapiens
gctgggaaggaccctctggggtctcagtgccctcccctggcatttgaggccagtctgggtccttcaaggc

SEQ ID NO: 6807893 - DNA, 56 bp, Homo sapiens
ctggcctggtgtctgcgaggcctgtcgaaaggggataggtccattcatcaagccag

SEQ ID NO: 6807894 - DNA, 65 bp, Homo sapiens
gaggcccaggctctgttccccgaggagccaggtcagcctgccctggggagccgagtctgtctttc

SEQ ID NO: 6807895 - DNA, 75 bp, Homo sapiens
ctggggtctatcaactgcatgagctgtcagtggaggccacggcggcctctccgttgctgacctcttgttccccag

SEQ ID NO: 6807896 - DNA, 72 bp, Homo sapiens
ggaggaatctacttacactgctgtgtggccagaaggaaaggaaagctctatacagctgttggtgtttcctct

SEQ ID NO: 6807897 - DNA, 75 bp, Homo sapiens
gaaaacagctctatatgccattaaaatatgtatgtgtttataaatgttaacagaggtcattttggggtggttttc

SEQ ID NO: 6807898 - DNA, 71 bp, Homo sapiens
gaatcagcagaggttttgctccatgatccctagtctgggtcataaaagcccgtggagcctctgcttgattc

SEQ ID NO: 6807899 - DNA, 81 bp, Homo sapiens
gccttagaaatgcttatacctaatgatcttgtgatgcacatggtttttagagaatataggttattagtttcttgtcttggt

SEQ ID NO: 6807900 - DNA, 60 bp, Homo sapiens
cccttccccttataagtctggcttctacttgagtttggagtgaataagtagggggaaagg

SEQ ID NO: 6807901 - DNA, 56 bp, Homo sapiens
ggctggagggagagtgaagagggaagagaatacagtccttgctattttcctcagct

SEQ ID NO: 6807902 - DNA, 81 bp, Homo sapiens
cctcggcagcctggcccagcaggaagacattgaagctcaccaggaggtggcagggagtgtccctgggggaagctgctgagg

SEQ ID NO: 6807903 - DNA, 62 bp, Homo sapiens
aggattagatgactaatgagctgtgacatcctctgtgacacagacattgtacatcttgtttt

SEQ ID NO: 6807904 - DNA, 78 bp, Homo sapiens
cggcccatttgcgttctaatttcaggcgttcctcaatcctctgtggaaccaggaagggcgcaaattataaagggactg

SEQ ID NO: 6807905 - DNA, 65 bp, Homo sapiens
tctcactcctggtttgtgtcctggctccactagacagagtgagctcccagaagccagagtcgggg

SEQ ID NO: 6807906 - DNA, 81 bp, Homo sapiens
cataatggacagtgctccacattgcactattcgggggtggaaggagtctggaatagtgcaatggggagtaaagtttatatg

SEQ ID NO: 6807907 - DNA, 106 bp, Homo sapiens
ggatagagagcttttgtcctgattgctgaaacttcccattaattgtccaaaaatactctgccggtgggttagattccgcgaagcaggacaagtagaggttttctcc

SEQ ID NO: 6807908 - DNA, 79 bp, Homo sapiens
gcttagggtttttgttcattagtacagttgtaaaactttcatttgctacgtgaactcagaacagttctaaatttcaagc

SEQ ID NO: 6807909 - DNA, 57 bp, Homo sapiens
tttgagcaagttccattaagctgtgattttcagagtatagtggctccttgcatcaga

SEQ ID NO: 6807910 - DNA, 88 bp, Homo sapiens
aataactcatctgcctgctgattagtattgtctgagggaaacaaggcactccgagaacaggatactcagttagggggctatggttatt

SEQ ID NO: 6807911 - DNA, 108 bp, Homo sapiens
aggtttatgtccgagactaaactgtgcatgaaccgaaacaaaaagcaagttcataccgctgcattctgttctcttgttctgacggttaattcactggacatcaaattt

SEQ ID NO: 6807912 - DNA, 82 bp, Homo sapiens
tgactgaacaactcaaaccgcgagagggtaacaggaataaatcctagtgtctgctgccaccttgtggtgagaagttccatca

SEQ ID NO: 6807913 - DNA, 77 bp, Homo sapiens
acacacaagtatctgcatgattttgagaaactaaaactctttaagttctctttttgcatcaggtcttaaatgtgtgt

SEQ ID NO: 6807914 - DNA, 69 bp, Homo sapiens
gctgaaataccagtggccataaaggaaggcagtggaaacaggctttgctttactcccactgtgttctgc

SEQ ID NO: 6807915 - DNA, 56 bp, Homo sapiens
caaatagacttcaatctcttgaattagatatgtacaagatattgagtgtcagtttg

SEQ ID NO: 6807916 - DNA, 78 bp, Homo sapiens
ccctactctggacagggacacagccagtgaggtggatgacctggagcctgacagcgtgtccctggccctggaaatggg

SEQ ID NO: 6807917 - DNA, 55 bp, Homo sapiens
aaattgtccttttaagaaacaggttataaagatagctggcttaggtggacagttt

SEQ ID NO: 6807918 - DNA, 82 bp, Homo sapiens
aaagacatattacatgccattttgaaatcagggattatatttaaattgttccttgatatgaggtcagcgtgtcttcattttt

SEQ ID NO: 6807919 - DNA, 83 bp, Homo sapiens
aataggtagtcatatagagggagaaatcagaaaggcaaatcttttcgtctgtctccttgcttttccctgtagtcctatctatt

SEQ ID NO: 6807920 - DNA, 65 bp, Homo sapiens
tggggggataggagggagcactatatggggagcatcagcctgagctctgctcttgcctcccctca

SEQ ID NO: 6807921 - DNA, 60 bp, Homo sapiens
ccttagattttcaatgtgaactagggacaactctagttttgtcttgaaaataacctgagg

SEQ ID NO: 6807922 - DNA, 70 bp, Homo sapiens
gcctggcctaagcccaggaatgcacttcagctcctggttgagcaatgtcactgaggcttgggagtcgggt

SEQ ID NO: 6807923 - DNA, 55 bp, Homo sapiens
gcatggtggtagtgaaaagaataacgagtgtatttttcttcactttgccccatgt

SEQ ID NO: 6807924 - DNA, 68 bp, Homo sapiens
tactaaatgagctgttaggatagtttgtgatggaaactgatcatacataaataagagtttagttagta

SEQ ID NO: 6807925 - DNA, 90 bp, Homo sapiens
tccactgttgaaagctgtacaatgttacctatttatttgcagacatcctttggaaacaaataggtagatttgcaacaaataaagagtgga

SEQ ID NO: 6807926 - DNA, 70 bp, Homo sapiens
cacatgacacccaggcatagcaccgcagacctctggggagctgcttcttgctgtgggttcttggaatgtg

SEQ ID NO: 6807927 - DNA, 64 bp, Homo sapiens
gtattttaggaagagttgagtaaatttaaggatgtacttaatttgctcattttcctactagtgt

SEQ ID NO: 6807928 - DNA, 59 bp, Homo sapiens
aaggcagtcctcctaggttatggaatttccccactttctcatctttggcaggactcctt

SEQ ID NO: 6807929 - DNA, 55 bp, Homo sapiens
gtcccagggcaaggctgtttctggacaataaagcatagccttcaggccctgaggc

SEQ ID NO: 6807930 - DNA, 57 bp, Homo sapiens
agcttagtcactcttaaatttattagaatcatactatgacttgaggctgactgagct

SEQ ID NO: 6807931 - DNA, 58 bp, Homo sapiens
gagagggcaggccatcacccgaggtcacacagaaaacccacagtggcagccccttctc

SEQ ID NO: 6807932 - DNA, 59 bp, Homo sapiens
gaagccaagtcctcgagtttcaggtagacttcagttgatttctgcgaggtctttgcttt

SEQ ID NO: 6807933 - DNA, 73 bp, Homo sapiens
gatgaataagggatggaggactgtatatatgtgcatccaatcttgtgccatgtttccattttcttgtatcatt

SEQ ID NO: 6807934 - DNA, 59 bp, Homo sapiens
ctgaggcagaagaaaactaaaagattctgaaggattgaaagagttttctgctgcagtag

SEQ ID NO: 6807935 - DNA, 107 bp, Homo sapiens
gtcaaccccatttctccagagcaggatgtactattcctttataaattgctttgaaacgtctttataaaggtttgtgcatatttgtctgcttggggagcttcagtgac

SEQ ID NO: 6807936 - DNA, 64 bp, Homo sapiens
ggtaggagagggccatggaaggagagggcacccctgccagccttgcccatggctccctcctgcc

SEQ ID NO: 6807937 - DNA, 71 bp, Homo sapiens
gagtcttggctctttcctcacacaggaagatgccttttccatgtggcaataggagacagctaccagtcctc

SEQ ID NO: 6807938 - DNA, 69 bp, Homo sapiens
ggggtaggatgcgtgctgactttctgctttcacagggagagggtcagtagtgatgcgtgaacttacctc

SEQ ID NO: 6807939 - DNA, 88 bp, Homo sapiens
ggagaattacttgaacccaggaggcagaggttgcagtgagccaagattgtgccactgcactctagcctaggcgacagagtgagactcc

SEQ ID NO: 6807940 - DNA, 58 bp, Homo sapiens
cacacatttcagatgctacaatgccgtaaacaggcacagtgatcatagtgggtgtgtg

SEQ ID NO: 6807941 - DNA, 58 bp, Homo sapiens
cctatgtctcatgggataagacaactcttgttaatcatgagttcccactgagactggg

SEQ ID NO: 6807942 - DNA, 69 bp, Homo sapiens
tttgctgactgagcctctgggaatggagccttctcctgaggaaataccacaacatggctcagaggcgga

SEQ ID NO: 6807943 - DNA, 59 bp, Homo sapiens
caggtccacagcccatcactgccataataggtgaccatagaagagagggctgtgatctg

SEQ ID NO: 6807944 - DNA, 72 bp, Homo sapiens
aagacgacacctgctccctcagttccagcagcccctaacactgcgctgacatttaggtagtagcagcgtttt

SEQ ID NO: 6807945 - DNA, 97 bp, Homo sapiens
gggaggaaggaagacccaaagcatgaacttgagcccagatcccttgaggccagatctggagtttcagttttctggaaatgggagctgccttactcct

SEQ ID NO: 6807946 - DNA, 59 bp, Homo sapiens
agtgcctgggacatgctgtggactcttgtgaatgagtttgtgagcattcccagagccct

SEQ ID NO: 6807947 - DNA, 58 bp, Homo sapiens
ttcctggtcccgttcttcactgtttaaaccgcaggattcctagaacacgaccgtggaa

SEQ ID NO: 6807948 - DNA, 80 bp, Homo sapiens
gaaatgcattaggctctggaaataattgctcaataatttaaacatagtcttcattatttaggggcctgccagtgtgtttc

SEQ ID NO: 6807949 - DNA, 55 bp, Homo sapiens
tttctgaactctaagggctttgcaatgaaaacagttgatagagctggttcaggag

SEQ ID NO: 6807950 - DNA, 68 bp, Homo sapiens
tccctggacgggaacattgttggtgggaacagccccagccagcaagctcccagttctcaaaaaaggga

SEQ ID NO: 6807951 - DNA, 84 bp, Homo sapiens
tgcaccttatgttttacacagtactgctttgggatgtgcaaatacagtgttactcccacacagactgtaagtatcatgagggca

SEQ ID NO: 6807952 - DNA, 73 bp, Homo sapiens
gtagcacatataggaggctcatgttacaggaaaacccttagagactttgcctacatgcgcttcctccggctat

SEQ ID NO: 6807953 - DNA, 57 bp, Homo sapiens
ctgacctcgtgatctgcccgcttcggtctcccaaagtgctgggattacaggggtgag

SEQ ID NO: 6807954 - DNA, 120 bp, Homo sapiens
gatatgtgtgtgtgtgtgtgtgtgtgtgcgcgcgcacatctgtgtatgtgtgtattcacactggtgtgcatacacacataggtatgggcatatatacacaggcacacacacacacatatc

SEQ ID NO: 6807955 - DNA, 67 bp, Homo sapiens
tgcctctcttctgctgtatgtggaaggaaacctatttcacataccacagagtgtgccctgagaatca

SEQ ID NO: 6807956 - DNA, 100 bp, Homo sapiens
ggatttctggtgcttttgcttactaagagaccgatattcttaagttgttttcttgttttaacagccttgagaaatgtttggttttggccagcagaattct

SEQ ID NO: 6807957 - DNA, 129 bp, Homo sapiens
gaaaagacgagagctgtataaagtaagaatggcctgagagaactgaccaagagcaggctcattttcttttctgctcgttggttccttttctttcatcaccgatcttgatccatcccctcctcccttttc

SEQ ID NO: 6807958 - DNA, 57 bp, Homo sapiens
aggaacctagaaattacctaacctatttcccaaatagggctgtaccatcaggttcct

SEQ ID NO: 6807959 - DNA, 60 bp, Homo sapiens
catacaaatgtgtccaggctctcaactgaggcctcgaagaataggagacatctttgtatg

SEQ ID NO: 6807960 - DNA, 70 bp, Homo sapiens
gggtggacttctgtttttctctccttgttttaaatctggggctgcctgtgagtcagaaacgaagccaccc

SEQ ID NO: 6807961 - DNA, 97 bp, Homo sapiens
tggaaggggcttaggtctctgaagtattatatgaaaatattccaccaaccaggaataattacattatactgttagaggataagcaaccaacttacca

SEQ ID NO: 6807962 - DNA, 107 bp, Homo sapiens
cataatcccaaggtctggcatactgtagtaaagcggaaagggtgatagggaagatgtcttgctgtactgacttgcttagctggtactagcttaggcactgggatatg

SEQ ID NO: 6807963 - DNA, 60 bp, Homo sapiens
cttggtgccaattctgtgccaggcactatgctgcatgcttgacacagttttctcattaag

SEQ ID NO: 6807964 - DNA, 66 bp, Homo sapiens
gttatccaaaggtgacacagaatacccataatgatgactgggcatgcgttttacctttgggcagac

SEQ ID NO: 6807965 - DNA, 69 bp, Homo sapiens
ttgtgtgtgtgtataatgtatgtgtgtgtatatatatatacacatatatttgcatatacacacatacaa

SEQ ID NO: 6807966 - DNA, 67 bp, Homo sapiens
tcttgcatttaagtagatgttacacacttagtgaaatgtgcatctgctaaaatttccggaggcaaga

SEQ ID NO: 6807967 - DNA, 75 bp, Homo sapiens
gtatcttattagagtatggaaggaacatttgcaagttgatgactgtgtcaatgctgccaaatcttctagaggtac

SEQ ID NO: 6807968 - DNA, 58 bp, Homo sapiens
caaagtgcctgtaccactttgctgaccaaccagcaatgtaagagttccagttactttg

SEQ ID NO: 6807969 - DNA, 73 bp, Homo sapiens
catttcacagctgacactttgacctagagtagccccgtcactcatagctgggaggtgtttgagttgtgatttg

SEQ ID NO: 6807970 - DNA, 58 bp, Homo sapiens
ggccaatgtcatttcactgggcttactcctaaggtaagccatcatcatggctttggcc

SEQ ID NO: 6807971 - DNA, 80 bp, Homo sapiens
catttaaacatggtacacaatgcatatttttccagatgatattctctgactagaagttgtgttgagtaaattagtaagtg

SEQ ID NO: 6807972 - DNA, 61 bp, Homo sapiens
attccttggcattctggacttgcctgatcttcagcagagcaggttccagcagccagagaat

SEQ ID NO: 6807973 - DNA, 64 bp, Homo sapiens
atctacagcagtgccaggtagccttaagtaaaaaaggaacatattttaggcacagttgcaggat

SEQ ID NO: 6807974 - DNA, 75 bp, Homo sapiens
ctcttatctcaagaacttgttcatgcagaggagctcttttgaaggttctttccccatggagttcggagttgaggg

SEQ ID NO: 6807975 - DNA, 79 bp, Homo sapiens
tagcgttaattgctgaaatgaaaggatatgggtctgtgtaattgaaacatttgcttttatttgcagtaatcatttgcta

SEQ ID NO: 6807976 - DNA, 60 bp, Homo sapiens
taccttgtggttttctgcatgcaggtttaagcctgcatttacacttctaaccacaaggtg

SEQ ID NO: 6807977 - DNA, 80 bp, Homo sapiens
ctgatgctgatattgatgtttcccgttaagagaaaaatcccgttttttaggctgacacaggaaataccactcagcactgg

SEQ ID NO: 6807978 - DNA, 83 bp, Homo sapiens
cctggtgattctgataggcccagcccgagtcagccttcagctgtgtggtctgtggtgactggggtgtgggtacagacgccagg

SEQ ID NO: 6807979 - DNA, 66 bp, Homo sapiens
gtgtctcttggctctatcacttattagttgtgtttgtgactttaagttccatgagagcagagacac

SEQ ID NO: 6807980 - DNA, 88 bp, Homo sapiens
attgcgatatatccttatgttgctttaactggaggaactaaaataactgtggctctgatagttacagcaggcaggatatataggcaat

SEQ ID NO: 6807981 - DNA, 81 bp, Homo sapiens
aatataatcatagaataagcccctttttttagtgtttagtcttctgaagaatttcctagggacttgtgtcctatgtatgtt

SEQ ID NO: 6807982 - DNA, 75 bp, Homo sapiens
tctgggactacagttagtgcctggctactttaaaaaaatgttctgtagaggtgtgctctcactctgtctcccagg

SEQ ID NO: 6807983 - DNA, 122 bp, Homo sapiens
gggacattcttccacaaagacttagctttttcctccgttcatacctctgctcccattacccacttcccttatgacatggcatgataggaggtgcagaatggaaagagctgatggagattccc

SEQ ID NO: 6807984 - DNA, 55 bp, Homo sapiens
attggcaaactctggcctgtgtgccaaatctggcccactacttgtttttgtcaat

SEQ ID NO: 6807985 - DNA, 76 bp, Homo sapiens
tactttaaatgggaaaaattgcagcctgttatgaatggcaccgaacagtgctgattattttacctttgacaaagtg

SEQ ID NO: 6807986 - DNA, 68 bp, Homo sapiens
tgaaatgttaatcacacaaaggctcccaaagcaatttcgctctggactcctcatggttatgcattaca

SEQ ID NO: 6807987 - DNA, 70 bp, Homo sapiens
atgtctgagacaaatgatttgctaaaaatttgccatagcaatggcatatagaaacatatgtttgagacat

SEQ ID NO: 6807988 - DNA, 91 bp, Homo sapiens
gagaaactttttcaaactttgggcctaagtactgttgatttgaggaacggatgaataattttagctcagagttgtgaagacagccattctc

SEQ ID NO: 6807989 - DNA, 67 bp, Homo sapiens
gaaattagccatgatgagtatatttgcaccatggaaattagcaaatgctacaaatcggggctttttc

SEQ ID NO: 6807990 - DNA, 61 bp, Homo sapiens
ctctggtgtctcccctaagctaccacttactgtgtgttgaccagctgggggacgcgtagag

SEQ ID NO: 6807991 - DNA, 68 bp, Homo sapiens
gctcttccatattactcagggtaaggacctaagtggtaatgccaatacctcgaagataactggagagc

SEQ ID NO: 6807992 - DNA, 61 bp, Homo sapiens
ttgtggttgttgacaagctcggtcatggtaacattggctcaggcttgaaaatagatttcaa

SEQ ID NO: 6807993 - DNA, 59 bp, Homo sapiens
ttgtcaagagtagtttgaatagtgcctaccttcagagcatcttttctatgccttggcaa

SEQ ID NO: 6807994 - DNA, 68 bp, Homo sapiens
ctggctctgttgtaaagaaattttgggctcacatcccaggattgattccactgcaacaggattgtcag

SEQ ID NO: 6807995 - DNA, 56 bp, Homo sapiens
tgcaggctcttggtgacgtgggtgtccaggctgcgcgccaggttccagggcttgca

SEQ ID NO: 6807996 - DNA, 97 bp, Homo sapiens
ggggaaattgtctgaattgcttcatggagatggacgaatggctttaggacttttgctttctcctgggctccaggaagcatttaggaatcacattccc

SEQ ID NO: 6807997 - DNA, 96 bp, Homo sapiens
ccctttctttacctatacagcactctggggagcatgagagatattcttaggccattttttattccagatggtgctgcggtattgaaaacttaaggg

SEQ ID NO: 6807998 - DNA, 62 bp, Homo sapiens
agggctgtggaaatgaaataggtctgggtgacacctgaggtcatgcatttccaacaagtcct

SEQ ID NO: 6807999 - DNA, 80 bp, Homo sapiens
gctgtccctgtggcctctgtggctgtggacctggtctgtgtcttaagagaccaggctgcagcagcagtggcccaggcagt

SEQ ID NO: 6808000 - DNA, 61 bp, Homo sapiens
gtatggaaatcatctgagtaataatctggaattcacaggttccaaatgatggttttcatac

SEQ ID NO: 6808001 - DNA, 74 bp, Homo sapiens
ttatctttttctactctaacatttgttagatgttcactcaggtgaagtcagcagtttgttggggtgatgggtag

SEQ ID NO: 6808002 - DNA, 84 bp, Homo sapiens
ggatcaaagtcagaaattaaattgagttataggaaataagttatgtttcttgtacactggaatttatggttgtaaaatttgtcc

SEQ ID NO: 6808003 - DNA, 72 bp, Homo sapiens
tctttgtcgcattacatagtaatctgagatgcactggatgtgctccagggaacagaatgtacttggcagaga

SEQ ID NO: 6808004 - DNA, 56 bp, Homo sapiens
gggaccttgcctgctcaagcctccattgccctggcccgagcatggcacaggctccc

SEQ ID NO: 6808005 - DNA, 55 bp, Homo sapiens
gctgtttccagacaatgtcttttttggatcagccagaagagacctgggagccagc

SEQ ID NO: 6808006 - DNA, 74 bp, Homo sapiens
acctctctctgcctcagtgatttctttagtgttactcaaaatatacatagagcaaggagtggcaggatagaggt

SEQ ID NO: 6808007 - DNA, 66 bp, Homo sapiens
tcagccttgtggccctgctccagatatttcctcttgaggccaatcacagggaccacaaaaagctga

SEQ ID NO: 6808008 - DNA, 57 bp, Homo sapiens
cctggaaaatgccactttcacaagtgtaaacgcttaactggaaactgggtttctagg

SEQ ID NO: 6808009 - DNA, 68 bp, Homo sapiens
tacagtttataggacatctgataggaaaaataacagcttttattcctgtacattagctgtgaattgtg

SEQ ID NO: 6808010 - DNA, 58 bp, Homo sapiens
ccagaagcacctccttttgtgcctcatttaaagagtctgaaaggcaaatggcttctgg

SEQ ID NO: 6808011 - DNA, 58 bp, Homo sapiens
tggcacagcctttaaagtaccagaacaactgatggtgtttttttcctttgctgggcca

SEQ ID NO: 6808012 - DNA, 95 bp, Homo sapiens
ccagctcctggccctggacctttgagggggaattggtacagcctgagtggaagacagacttggcctgaaggttcagcaggaaagccaggtgctgg

SEQ ID NO: 6808013 - DNA, 61 bp, Homo sapiens
cctgcctttcctgccccatctgcccagtctgccttgcagatgagggctggaggtgagcagg

SEQ ID NO: 6808014 - DNA, 77 bp, Homo sapiens
ctgcctttccacaatttggggtgcccactgtatgcttcaggtactgtgctgggatcccaaagatgaatgaaacacag

SEQ ID NO: 6808015 - DNA, 59 bp, Homo sapiens
actctccctgctatccacttccctccaccatccctgggaaaaggacatgttggagtagt

SEQ ID NO: 6808016 - DNA, 79 bp, Homo sapiens
gaatcctagctcaactgatttactggaattcttgctgaaagcaggctagagtgatcagatatcaggtgtggggggattc

SEQ ID NO: 6808017 - DNA, 66 bp, Homo sapiens
gcacttcagtcgggttgaagagagcaggagttggctgtccgtggctagatctgcccactgaagttc

SEQ ID NO: 6808018 - DNA, 113 bp, Homo sapiens
aaatatatatataatttttagtttatcaaatcctcacctcatcatgaaattttacttcattgttaatattcatgcttggtgtggggattatgaattaatgtaagtaagtattt

SEQ ID NO: 6808019 - DNA, 64 bp, Homo sapiens
ttatagatgtgtctagtttgagcacctaaaggttgataactcaggaaaggcagagtgtctgtaa

SEQ ID NO: 6808020 - DNA, 124 bp, Homo sapiens
gtggctccatctggatgcaaaagaaaggatgggttgggggagggagtgagcagccctgggaaatgtccctggctcagcagctctttctcagcaacaattctgcagtgtagaacaggaagcatgc

SEQ ID NO: 6808021 - DNA, 73 bp, Homo sapiens
tgtgtgccgagaccccatgaatgtagctttaatgattgatcagggctccaggggctgggtgactcatagcaca

SEQ ID NO: 6808022 - DNA, 56 bp, Homo sapiens
ttccccttcttcttgtcttcacccaggggctctgggacctgcagaggaaaggggag

SEQ ID NO: 6808023 - DNA, 55 bp, Homo sapiens
ggacagagcgtggggcaggggacccacatgcttggcctccagtcccagctctgcc

SEQ ID NO: 6808024 - DNA, 63 bp, Homo sapiens
cttccccttgataagcagggttgtcagtgcgtcactgaggccagcacatgctcatcagggaag

SEQ ID NO: 6808025 - DNA, 75 bp, Homo sapiens
ggatgaggatataaggatgccaatgacatcttgcagtgtctaggtctaggttggcaattcctaataattacatcc

SEQ ID NO: 6808026 - DNA, 55 bp, Homo sapiens
gcatgagtaattcacaaaacagatgaattggatcctctcatttgtgaagctcagc

SEQ ID NO: 6808027 - DNA, 63 bp, Homo sapiens
gggaggagcttggagattcactcagattcacacctcccttgggcttcctcttcacttcctccc

SEQ ID NO: 6808028 - DNA, 130 bp, Homo sapiens
ctcctggcccggccttctgacagccagccccgctccttcaagtgcagtacctgagcaccggccgataatccacgccaaagagctgctgctgccgctggaggtggttgggagtgtcgatgggtaccaggcg

SEQ ID NO: 6808029 - DNA, 62 bp, Homo sapiens
tgttgtagcttgacagcagccatagacaatagccaatgaatgggcttagctgagttgcaata

SEQ ID NO: 6808030 - DNA, 61 bp, Homo sapiens
cgagcggtgcgcgctccgagtggccgggacgcgcgccagtcctgggagcttgcactgctcg

SEQ ID NO: 6808031 - DNA, 64 bp, Homo sapiens
catgggaagggaaggaaagaaccagcagtagacatccagtgacactgttggccttccacccatg

SEQ ID NO: 6808032 - DNA, 75 bp, Homo sapiens
gctcctggtatttcctggaccaactgagattgggtcaaatgaatatgatagggtatgtccaagaaacacaggagc

SEQ ID NO: 6808033 - DNA, 59 bp, Homo sapiens
tgggtgggcgctcgcggggtcccatctctaaggagtaggcccagagttaagcccaccca

SEQ ID NO: 6808034 - DNA, 91 bp, Homo sapiens
tctatatctttaattttattgctatctctatatccatttatctgtatatgcagaaagagtaagggatggtcagaggagaaaaaggaagaga

SEQ ID NO: 6808035 - DNA, 94 bp, Homo sapiens
ttgggaacgcagcagccaccagaccaccaagagcaactgtaggttgggcttggtggtgctggtttagtgttgtggctgatgaggtgtaacccag

SEQ ID NO: 6808036 - DNA, 70 bp, Homo sapiens
ggttgtgcttaagcaagctttcttagtaaatgatcctaagaaaagagaaagctcaagcttttgcattacc

SEQ ID NO: 6808037 - DNA, 86 bp, Homo sapiens
gtgattgcttaaaaagtaactgctgatgtatttgtaaattatttccaatttaattttgtgatggcagttactttctaagctggcat

SEQ ID NO: 6808038 - DNA, 130 bp, Homo sapiens
aaccttctgaaaatgaatgcctgggagctgtgcttgacagtgggaagcatgagaattccagaaagctttcatgtcatatttttttcctctcaaatattgtcagtatctccaggcttctgttctcaaggtt

SEQ ID NO: 6808039 - DNA, 57 bp, Homo sapiens
tctgtgacctgctgcattactcttctcaagggctgtcccagaggcaccaggtataga

SEQ ID NO: 6808040 - DNA, 58 bp, Homo sapiens
agaaaactttattgttaggggctaaatttgaatttagctaatacgatttaagtgttct

SEQ ID NO: 6808041 - DNA, 60 bp, Homo sapiens
tcctggtcagctttgaggttgtctgtatcagtgaaggaattcctctaagcccaccaagga

SEQ ID NO: 6808042 - DNA, 81 bp, Homo sapiens
ggagaagcgagccggtgtctccaatgcccccagtcagccatttggtcctggatgtcttggggactcctgcttgctgcctcc

SEQ ID NO: 6808043 - DNA, 129 bp, Homo sapiens
tagtataatggaatatatgaaattaaaaataactacactggacactgggctctgcatacagtaaatattcagccgttgtctgcagacttgcctaagtgtgtacgcagtagttattctaggcaggtgctg

SEQ ID NO: 6808044 - DNA, 59 bp, Homo sapiens
attgggcggtgtccagaggctccgagaagaaggccatcggcggttgggcagcgttgggt

SEQ ID NO: 6808045 - DNA, 126 bp, Homo sapiens
gggctggagcagatgattttagaagtctctttcagttctgatagtctctgattttgtggaatagtagatctcaacactggaagtacatcagagtcgtgtggaacttgtgaaaaactgttccagtct

SEQ ID NO: 6808046 - DNA, 67 bp, Homo sapiens
tgcttgtattgttatttgcagaggtggtacttcaagtccacccctgggaatgtcaatatcatgggca

SEQ ID NO: 6808047 - DNA, 92 bp, Homo sapiens
ttaagagttctcattgctgtgctcacagaacaatgtttagttctaactgtagttgggctgacaaccatctgacaagctaggaggatttttaa

SEQ ID NO: 6808048 - DNA, 65 bp, Homo sapiens
gggcacgatgtctaccagtctctgtatttcatggataacgacatctgtgtagggcatcttgaccc

SEQ ID NO: 6808049 - DNA, 62 bp, Homo sapiens
gggcctgccattgctgccccagccctgggctcagggagcaggtgcatagcagaggcagggcc

SEQ ID NO: 6808050 - DNA, 81 bp, Homo sapiens
ggaagtggagcaaatggatggaaagcaatttttggaagatgaatttccaaaagtattggccaccatttctgcacctcttct

SEQ ID NO: 6808051 - DNA, 85 bp, Homo sapiens
ttccaaacctgaaatatagatgtgaacagtgtgtaccagtttaacgctttcacttcatttgtgttttttaattaaggatttagaa

SEQ ID NO: 6808052 - DNA, 85 bp, Homo sapiens
tccattgtcagccatcaccttgcgcagcacggctttctacttaaagagtgtttattgtgtaggcgaagtgggcacagacaacgga

SEQ ID NO: 6808053 - DNA, 57 bp, Homo sapiens
tgtgctatttttgcatatgtgtgtgtatatccacgcacatgtacacatgtatgcaca

SEQ ID NO: 6808054 - DNA, 88 bp, Homo sapiens
agggctccaaggccatgttcttggccaccagatctcactgccccataaacagagcaggagaggtgaggccaggcaaggcctgggccct

SEQ ID NO: 6808055 - DNA, 104 bp, Homo sapiens
atttctccagccacctctctgtgaaaggagtattgattgagtgataaagcaaatccagttatatggctgtggtgatctcatttcacaaaagagtctggagaaat

SEQ ID NO: 6808056 - DNA, 107 bp, Homo sapiens
tttcccaagcattttctccttcatgttcctccctgtatgccctgtgcaatggtgtacagcctggcactaccctggggggaggagagttaatcaggctgacaaggaag

SEQ ID NO: 6808057 - DNA, 129 bp, Homo sapiens
gggagaagattctggaaggccccttggaggaggtggcatctgagtggggcagggaaaggaaaggtggtggttagggcagcgctttggagtccctgctttacccctcagccaaggccgtccaacagtctc

SEQ ID NO: 6808058 - DNA, 80 bp, Homo sapiens
taaatgtgtccctggtcatatcagaaagttttattatcacttcagggtagctctctgataaattgataaagacatattta

SEQ ID NO: 6808059 - DNA, 111 bp, Homo sapiens
gaaggtccaatgctgctgcacatctttgcaagtgattctgttttctcatgttacacacagtgagagagttagggatccttcagactcgtcagtcttgccaattggtctttc

SEQ ID NO: 6808060 - DNA, 84 bp, Homo sapiens
ttaaccttttgttttgttttccttgctcactttgtgcaatagtcactagagtcagttagcgaatacttaacaaatattggttga

SEQ ID NO: 6808061 - DNA, 78 bp, Homo sapiens
ttaccaaaatctactgtgtgctaggaactacaccaggcaccaaaatgcaatgttctctctggctgccagtactggtga

SEQ ID NO: 6808062 - DNA, 89 bp, Homo sapiens
gtttttatccaagtgttaaggcttaatgatcaatccctagggtactctcttaaacaatgatgttatggctcaaacatttggaccagaac

SEQ ID NO: 6808063 - DNA, 56 bp, Homo sapiens
cctggcccattgccttctctctctgcaacctcggagagacctaaaagtgggcgagg

SEQ ID NO: 6808064 - DNA, 102 bp, Homo sapiens
gtcaatcacctgaggacttattaaaatgcggatttggctacagtaggtctggagtggtacctgagcatctgcatttctaacaagctcccagaaggtgtggac

SEQ ID NO: 6808065 - DNA, 69 bp, Homo sapiens
ccaggcttggggatgccaacagaagacccgctcctccaggtctcctccctttcattcacctcggcctgg

SEQ ID NO: 6808066 - DNA, 58 bp, Homo sapiens
gggctcagtctggcgtggaatgatctgtgaccacaggctgtaccataatgactggctc

SEQ ID NO: 6808067 - DNA, 74 bp, Homo sapiens
gtcctgtgcacttgaaacacttaatccaacagtgtattatttatctctgtggagcagtgtgttcatacaggtac

SEQ ID NO: 6808068 - DNA, 95 bp, Homo sapiens
tgttgcttctggagcctagatttgttttgccatctcagttttcttaggtcccccttcctgtttaccactgaggggcagctgggccaggagcagca

SEQ ID NO: 6808069 - DNA, 65 bp, Homo sapiens
gctcttcctctttagtctgtgtggagaagctatgaatcattcatggtctcccagctgagaagggc

SEQ ID NO: 6808070 - DNA, 62 bp, Homo sapiens
tctgagccctgctgtttattgattttgacatgaatatgaataagtaagcaagggtctccaga

SEQ ID NO: 6808071 - DNA, 72 bp, Homo sapiens
caattagtcacaaagtcacaataattaacctacaattaggttaaatatagttgctttccagggaactagttg

SEQ ID NO: 6808072 - DNA, 76 bp, Homo sapiens
tcgcttgagcccaggaggttgaggctgcagtgagctacgatgatgccattgcactccggcctgggtgacagagcga

SEQ ID NO: 6808073 - DNA, 77 bp, Homo sapiens
gcagagctcagccttggcaggtggaggatggagcttagagccttcctccagtcttggtgaggttgagcccaatttgc

SEQ ID NO: 6808074 - DNA, 64 bp, Homo sapiens
ggatgggatgtttgagatttttggctttcatttcttccggaagttatttttcaagatcctttct

SEQ ID NO: 6808075 - DNA, 129 bp, Homo sapiens
ttaaagtaaatgtggcagaatgaaagttaagcatagaatctgttaggttaaggaatggcaaaaaccgcaattacttttgttccaacctaatagatgatgggtatagcattttttgaacaattcttttgg

SEQ ID NO: 6808076 - DNA, 62 bp, Homo sapiens
gggcccagtgggggttgtgtctctgggcagagagcttccccagtggctgtccccatgggccc

SEQ ID NO: 6808077 - DNA, 57 bp, Homo sapiens
agtcatagaaggtgacccaggtgcgtgtaactgcaccagtccattcccctcatgatt

SEQ ID NO: 6808078 - DNA, 122 bp, Homo sapiens
agccccccacttaaagtgaagaattgtgtttgtgtacatgctcagtttgtgtacatgtttgtatacatgttcgtgtacatgttcagtattatcagcctctgttatttctatgtgggggtgtt

SEQ ID NO: 6808079 - DNA, 59 bp, Homo sapiens
attgcagggaggcaggtagatggctttcggtaggggcccatgtatagcttcactgggat

SEQ ID NO: 6808080 - DNA, 70 bp, Homo sapiens
ggggcttccagcgcccgccggtggccgggacccactaaagcccccgcagccgaggagtgcggggagcccc

SEQ ID NO: 6808081 - DNA, 130 bp, Homo sapiens
gtgagttatgattgccaccactgcactccacctggtgacagagcaagatgctgtattgttgttgttgttttgagatggagtctcactcttgttgcccaggctggagtgcaatggcacaatctcggctcac

SEQ ID NO: 6808082 - DNA, 64 bp, Homo sapiens
cctccctccctgcagtactcttccactttcaaagcacaatggcaacactgcaggagaggtgagg

SEQ ID NO: 6808083 - DNA, 79 bp, Homo sapiens
gtttatatcctgaataaattagctgtcactcaacaacaaagtttagtgatatgtctggtttggttcagtgattttgggc

SEQ ID NO: 6808084 - DNA, 68 bp, Homo sapiens
gtgtgtggcattgtgaaaatatgagccaggtaaatgagtatttgaaatcatgagatagtgtcacagat

SEQ ID NO: 6808085 - DNA, 126 bp, Homo sapiens
ggcttcataggcacatgcgccagcccggccgaggcagaaccagctgggactttaagccgatgagctgttcgatgaggtatatggcctggtttcctgtgcaggcagggtggatgcagtccagaagcc

SEQ ID NO: 6808086 - DNA, 81 bp, Homo sapiens
tggcagcccctccagggagggtcctgaggccggcagtggtgaagcagcaggcaccgggttgctcccctccgaggggctcca

SEQ ID NO: 6808087 - DNA, 56 bp, Homo sapiens
gtgccaagaccatttaatggagaaagaataatcttttcaacaagtggtgttggaac

SEQ ID NO: 6808088 - DNA, 63 bp, Homo sapiens
gatacattttatctcctaacaggctcaaattcaatgaactacgaggagaattagaatgatatt

SEQ ID NO: 6808089 - DNA, 65 bp, Homo sapiens
ctgggtgacagagtgagatggtctcagagaaaaaagcacacaccagactctatcaactcacccag

SEQ ID NO: 6808090 - DNA, 76 bp, Homo sapiens
gaagttggacaaatccagatcccagtcgtagctgtgtcactgactagaatgtgatctgggtaacatttttaacttc

SEQ ID NO: 6808091 - DNA, 80 bp, Homo sapiens
tattaggttggtgcaaaagtaatttctgtttttgccattacaactgcataaactgcgattacttttgcaccaacctaata

SEQ ID NO: 6808092 - DNA, 78 bp, Homo sapiens
taggtatctgttcacttaagcttattgtgacaaataatttataaccaatttcacaattgtatcagaaaatagtacctg

SEQ ID NO: 6808093 - DNA, 75 bp, Homo sapiens
cttcacattgaatgggttttaatatttttaacacttctacaagtgtcatggtctgtaaggagccctggagtgaag

SEQ ID NO: 6808094 - DNA, 64 bp, Homo sapiens
tcttttcacaccagcatggtctcagtgtgatggggacgcacctcctgagaggctgtgtgatgga

SEQ ID NO: 6808095 - DNA, 70 bp, Homo sapiens
agtcattcagagatgcaggtagacataaaccaaatagtccttggctgactcttcctcatctgtgaatact

SEQ ID NO: 6808096 - DNA, 93 bp, Homo sapiens
gcaggcggcagggtctgcagggcaatgatcccgagaggagtgtggccaggaaccctctagggaacacctgccgtggttgtccctgctgcttgc

SEQ ID NO: 6808097 - DNA, 74 bp, Homo sapiens
cgtttgaaatattcagggcaatgaccctgcaaggccagtaagaactggcctgtgtcctccttgccctgcagacg

SEQ ID NO: 6808098 - DNA, 76 bp, Homo sapiens
taaatcaggcagttctacttggatgtctgcaagatttgggattttgccagatagatgaagtggagcaggaggttta

SEQ ID NO: 6808099 - DNA, 95 bp, Homo sapiens
gggcagagaaggaccggtaatgccagacaggggctttgcatgctttagttattaagattcaaaagcagataacctttgttggctatgccttgccc

SEQ ID NO: 6808100 - DNA, 68 bp, Homo sapiens
ccaaattaagagtaactctgtagacctttgatgctatccaaaaatctctttagagactcttggttagg

SEQ ID NO: 6808101 - DNA, 61 bp, Homo sapiens
tacatttgattctctcctccaacagtcacattggctcttggccctagatgattaagttgta

SEQ ID NO: 6808102 - DNA, 83 bp, Homo sapiens
caaaccctaggtctgctgactcctagtccagggctcgtgatggctggtgggccctgaacgaggggtctggaggcctgggtttg

SEQ ID NO: 6808103 - DNA, 73 bp, Homo sapiens
gtgtgactttggactagtgatttaataaccttgaacttcagcttctttccttaaacactagttcgagtagcat

SEQ ID NO: 6808104 - DNA, 65 bp, Homo sapiens
gccctgctctgcagcttggactccctctcaggacagtgacagtgagatgaggcagggccaggagc

SEQ ID NO: 6808105 - DNA, 74 bp, Homo sapiens
tgagtagagtaagtctttgttgtgggggcggtcgtgtgcattgtattaacagcagcatccccagcctctactca

SEQ ID NO: 6808106 - DNA, 58 bp, Homo sapiens
ggggtcacactgtggtgactggatctgccattcacttagtcacctgttgtgtgatgcc

SEQ ID NO: 6808107 - DNA, 60 bp, Homo sapiens
aaggccttttcagttcctccttcacatgcttgactggtgagaagaacgcagaaggctctt

SEQ ID NO: 6808108 - DNA, 79 bp, Homo sapiens
tctgaagggttccaacacttgacacttgaacaccaggaaaatcactgtgtttaactgggagtgtgggaaaggacgcaga

SEQ ID NO: 6808109 - DNA, 68 bp, Homo sapiens
ggccaactgtaggtggccggaggacagtcgagcagttccttctgtctgtcctgccatccacagcggcc

SEQ ID NO: 6808110 - DNA, 66 bp, Homo sapiens
ccagggcacgttgggacagtacttttttctgcttatatctaaggatttttacttcagctgttctgg

SEQ ID NO: 6808111 - DNA, 61 bp, Homo sapiens
gcccgggatgtggaggttgcagtgaggtgagatcatgccactgcactccatccagcctggc

SEQ ID NO: 6808112 - DNA, 89 bp, Homo sapiens
tgtctccttggattttgttttataaactagtgttgagggatttttataaacttccaaagcacaggtaatacagagtaacagtaagcaca

SEQ ID NO: 6808113 - DNA, 82 bp, Homo sapiens
tgttttcagatcagaagttcaaggtagtcattctccaggcagacatcttgcttccactactcttagatctgcaatgaagaca

SEQ ID NO: 6808114 - DNA, 78 bp, Homo sapiens
ggaggcaagaggagggtcaagtaccaggaagcaagctttaagagtttccctgtccaaagtcttcctatctatgcctcc

SEQ ID NO: 6808115 - DNA, 67 bp, Homo sapiens
actacgatatactgcaagtatggcttttatatgtgctgggaagtaatacctagaagtatatcttagt

SEQ ID NO: 6808116 - DNA, 62 bp, Homo sapiens
taaagtgcgacccagtccccagacctaccctagcgaaccctggggtcactgcatctatttta

SEQ ID NO: 6808117 - DNA, 93 bp, Homo sapiens
gtgttcccccagcaagggcaggcagtggaggtttgagtgagacttttgcactctctgcgctgccttgatccttggcttcactctagggaatgc

SEQ ID NO: 6808118 - DNA, 74 bp, Homo sapiens
tcaactcagtccatagcacaggggaagagagtttatgcaaggtttctgtagtgtggtatgtaggcaagagatga

SEQ ID NO: 6808119 - DNA, 100 bp, Homo sapiens
cccgcgccggtggagtagggggcaggagagacctgctgcctctggcgccaacctttccattcagtgcgtctttcctgcctagcccacgttcccgggccgg

SEQ ID NO: 6808120 - DNA, 58 bp, Homo sapiens
gtgttagtttgctaaggataatggcctccagctccattcatgtccctgcaaacaacat

SEQ ID NO: 6808121 - DNA, 79 bp, Homo sapiens
tctgacctgcaaattcagaagaactgccctggcaactgtcattccagggctttctgaagttgtaaacacacatggcaga

SEQ ID NO: 6808122 - DNA, 111 bp, Homo sapiens
ggatcttttttgaaggggtgaaggaatcaggaaacgttgataaaaggaagttcctataacctttgggaatgttacagttttaattctgattctcactttagattttgattc

SEQ ID NO: 6808123 - DNA, 66 bp, Homo sapiens
cttgcctgtttatctatcatgaactgtgaagatttttgtacatgtgatggagtatagacgtgcaag

SEQ ID NO: 6808124 - DNA, 103 bp, Homo sapiens
gacactgatgtggtctgtgtgttcgtatttatgtcgcagaagggaactgcttttctggaatttcttgtcacataagtcacatgcatacataccactctctgtc

SEQ ID NO: 6808125 - DNA, 76 bp, Homo sapiens
tgttttcaaagtgcagcttgtgatccctagagggtacagcaaagttcttataggagttggcagcatcaaaagaaca

SEQ ID NO: 6808126 - DNA, 56 bp, Homo sapiens
ctagggaccaagggctggggtcaggaagtggactggaagtatccccagcaccctag

SEQ ID NO: 6808127 - DNA, 78 bp, Homo sapiens
cccaaggtcctgggctagaaggaccaggatggggaagaagtggcctctgccattctggaccaagctgggtgccttggg

SEQ ID NO: 6808128 - DNA, 57 bp, Homo sapiens
gacctggcatcccttcccaccctttatcctgtgacacagatgtagggggatgttgtc

SEQ ID NO: 6808129 - DNA, 71 bp, Homo sapiens
ggggatgggacccactcttttttcacctccggtcgtacctactgggtgtgcccagatggtgtcccttccct

SEQ ID NO: 6808130 - DNA, 77 bp, Homo sapiens
ctgcccccgccctctgctgcttgccagtcattgcttattcctgggaaaagtgcgagtagattcggacgccggggcag

SEQ ID NO: 6808131 - DNA, 86 bp, Homo sapiens
ggggttggggctggcctgtgcatcgtggggtgtcacagcatccctgacctccatccactagatgccagtagcaccgccccctcccc

SEQ ID NO: 6808132 - DNA, 72 bp, Homo sapiens
ggaagtacacttgggttgattttcaatttattattgcagtgatttcagagaatgaacctaatcaactgatcc

SEQ ID NO: 6808133 - DNA, 96 bp, Homo sapiens
catcccacctggccagagatgtggcctgggctgagcctgggctgtgtctgctcacatgcacggctgcacagccaggccctggggccaggaaaggtg

SEQ ID NO: 6808134 - DNA, 64 bp, Homo sapiens
tggtgatatcatgggaaggtgtacttccggtgatgcctagaggtcacgtcctgtgatgtcatta

SEQ ID NO: 6808135 - DNA, 104 bp, Homo sapiens
tgtatctaagaagtgtgttgtgagcaaaaataacttagagtaggcaaaagtgttttgtaaattatactgcagactctacagttataagttgataaattgataca

SEQ ID NO: 6808136 - DNA, 74 bp, Homo sapiens
cctgtctgtgggattttgttacagcagctaagcaaactaatgtggttggcattgaggagcaaaatttagactgg

SEQ ID NO: 6808137 - DNA, 78 bp, Homo sapiens
cagggagatctgctaggaggctgttgcagcagtccaggtgagagcagctggtggctcaagccatcttagtagcccctg

SEQ ID NO: 6808138 - DNA, 109 bp, Homo sapiens
tagagacagggtctcactatgctgccgaaactcacctttatcatatttttgaaggatatttgtctttcacaatcaaatggtgaaatgagagcacaaagaccatgtccta

SEQ ID NO: 6808139 - DNA, 129 bp, Homo sapiens
aagtgccaggggttcaagtcacccagcctggaggcaggaatcctgggttctatttttggcttcacagctaatccgctgtgtgacagtcgttaggagctcattctcccctctgggtctccctgagccctt

SEQ ID NO: 6808140 - DNA, 84 bp, Homo sapiens
ggtccctgttgccctgcccagcttcccgagtgcacatacgtgtggattacaggtgggctggggacccaggggacggctgggatt

SEQ ID NO: 6808141 - DNA, 58 bp, Homo sapiens
ccattggatgaactggcaagcccatggtcaaccggtagtgtggccagctctctactgg

SEQ ID NO: 6808142 - DNA, 58 bp, Homo sapiens
gagctttgtaaaaaacttgcacaccatggtctatgtggcaagtcactgtgtagagctc

SEQ ID NO: 6808143 - DNA, 55 bp, Homo sapiens
gggagccatgctggtcttcttttgtctgctcaaatgcaccagcaccttggctctt

SEQ ID NO: 6808144 - DNA, 77 bp, Homo sapiens
actttcagctctctatgcaacacccctatggatggacatccaatgttcaaagccaatggttgtggggacctggcagt

SEQ ID NO: 6808145 - DNA, 60 bp, Homo sapiens
gcagggaagggaaacagagaccagggaacccaggggacaggaatctctttccctttctgc

SEQ ID NO: 6808146 - DNA, 79 bp, Homo sapiens
ggcctctgctatcaccctacataagaaataattccaaaaggattatagatctaaatgtgaagggttgaaccagagagct

SEQ ID NO: 6808147 - DNA, 62 bp, Homo sapiens
gctcatctgggactgcagatcttctggcactggagcatctgtggtccatcagaagaatgggc

SEQ ID NO: 6808148 - DNA, 129 bp, Homo sapiens
ttatatatattatcaatagcttttattatagtgctgcaaaataaggtgtctgccccatagaggtattgaaaatctactcactgggcatctactttgtgccaggcactgggtactggggataaagagtga

SEQ ID NO: 6808149 - DNA, 93 bp, Homo sapiens
agctacagaatgtaatctgcaaatattagcattcgatatcagcactgtaatatgcttgatttgagtaatggtatatgcatactgctttcagct

SEQ ID NO: 6808150 - DNA, 62 bp, Homo sapiens
tgactcgtgactgtccctgcacatctggccttccatctgcaacagggacagtggcagattca

SEQ ID NO: 6808151 - DNA, 55 bp, Homo sapiens
gagatgctatggctattcccctgaagcagcagggtggagagagtgacagcatctt

SEQ ID NO: 6808152 - DNA, 112 bp, Homo sapiens
ctttttattttagtaaagttcttgaacaaaggtataagttaatatacagataaaaaataataggatgatgtctttatagctttgtgtacagcaggaaatattacttaaaaag

SEQ ID NO: 6808153 - DNA, 98 bp, Homo sapiens
tgaggcaggagaatcgcttgaactcaaggcggaggttgcagtgagctgagatcgcgccactgcactccagctgggtgacagagtgagattctgtctca

SEQ ID NO: 6808154 - DNA, 59 bp, Homo sapiens
gtttcctctcttgcagtccaggaggaccttcgaggcccctggctgtttgagcggggaat

SEQ ID NO: 6808155 - DNA, 60 bp, Homo sapiens
agggcccacagttcctatggccgttacctctctcagaagccaggcagagctgtgagttct

SEQ ID NO: 6808156 - DNA, 61 bp, Homo sapiens
tagaataggggtgacggtgccatagtctcagggacccaggtgcacccagcttcttgttcta

SEQ ID NO: 6808157 - DNA, 60 bp, Homo sapiens
aaaagtggtttatgatattccaagaatgaactcctattcttggtaatttttgaccctttt

SEQ ID NO: 6808158 - DNA, 79 bp, Homo sapiens
gctggaattatttactgataaggattcgttatttaataaaagaaatcaccaggattcctatcagtagtgtgttcacagt

SEQ ID NO: 6808159 - DNA, 56 bp, Homo sapiens
gtcacagatctcttgagtcaaggagatgggaacttaggctcatcttgtctgctgac

SEQ ID NO: 6808160 - DNA, 68 bp, Homo sapiens
tggagagataaagagaaacatgggactgaaggactgtcttgtaccttccagccccatctcatcgtcca

SEQ ID NO: 6808161 - DNA, 65 bp, Homo sapiens
tgaataattatgggagtcctaaaagcccacagttgggcggactagacggctgctatgattaagca

SEQ ID NO: 6808162 - DNA, 76 bp, Homo sapiens
ctgaggtaattttccagataatccccaccccaaatcgggtaatgcctggcctgattgatcaggacagttgcctcag

SEQ ID NO: 6808163 - DNA, 63 bp, Homo sapiens
ggggtttgcagcaatggagggcagtgcaaaaacaatgcctgtcacctctttggctgcagctcc

SEQ ID NO: 6808164 - DNA, 89 bp, Homo sapiens
ctcacacattggccacagcagatgcttcagatggattgtatcaaatggaagtaaggatcagggtatttcgctgggccgagattggtgag

SEQ ID NO: 6808165 - DNA, 57 bp, Homo sapiens
atcacaagtccaatacagagctttaaatataataaaggttgaaattggagcttggat

SEQ ID NO: 6808166 - DNA, 63 bp, Homo sapiens
gccagctgagcaaattccagctgcctgagggcagccttctggcaaagatttgcaacagttggc

SEQ ID NO: 6808167 - DNA, 55 bp, Homo sapiens
gtggctatcagcaatggcttctggaaggaggacagcacaggagttgaatgggcat

SEQ ID NO: 6808168 - DNA, 78 bp, Homo sapiens
cccaggaagtctggtggcctggggatttggtgggtctgctccttagcagtggcctggggctctgtgtgtgtatctggg

SEQ ID NO: 6808169 - DNA, 57 bp, Homo sapiens
atgcagggcagagtacgttagccagcatctctttggggctgaggtttcttcctatat

SEQ ID NO: 6808170 - DNA, 59 bp, Homo sapiens
gggaggagacagtaaaaagcacgcaaacacagtgtgttcagaatttgctgctttgaccc

SEQ ID NO: 6808171 - DNA, 78 bp, Homo sapiens
ccatccattatgtttcccaggctctgcatccaggctttatcacacagacaacttcctatgcagactaagcatggatgg

SEQ ID NO: 6808172 - DNA, 122 bp, Homo sapiens
ttttgaaacagcaaatggatttggtctgttctgaaaaaacaatctgtcctgtggcttgtttggaataacatctagagttgctatagaaggatggaggcagatgacccatgtctgatttggaa

SEQ ID NO: 6808173 - DNA, 57 bp, Homo sapiens
cacttacacttctgaaagcctaggtccaactatagggctgataccgggagagaagtg

SEQ ID NO: 6808174 - DNA, 76 bp, Homo sapiens
tttgctgagatagcttgtctgatttcatgtacatggagtgacaacttgcaagacgtgaaattgagacaacagcaaa

SEQ ID NO: 6808175 - DNA, 64 bp, Homo sapiens
gcttgctgtgccccctgcctgccccagtacgagcgggccctggacgtggcggcagagcccaagc

SEQ ID NO: 6808176 - DNA, 91 bp, Homo sapiens
cccaggctggagctctgtggcacgattgcactgcagcctcagattcccaggctcaagcaatcctcctgcctcagcctcccaagtagctggg

SEQ ID NO: 6808177 - DNA, 77 bp, Homo sapiens
gtttttccaaaacaatattctgtgaaagcttcagatttttcaaaatgctttcaatttagtgatgttgttggaaaaat

SEQ ID NO: 6808178 - DNA, 69 bp, Homo sapiens
aggtacgggtctgagagccatgccggccagtcagtcaacctccatttcatggtcacagaccacgtccct

SEQ ID NO: 6808179 - DNA, 78 bp, Homo sapiens
tggctaagaatcatagagccactgatagagcaatagcactgattattagttatcaaaggctatgtgatttttaggtca

SEQ ID NO: 6808180 - DNA, 58 bp, Homo sapiens
agatgctaagatcatagtttaaaatccatagctttgggctgcctctttcttagtgtct

SEQ ID NO: 6808181 - DNA, 56 bp, Homo sapiens
gggccaggtctgaagggagagtaggctaccccaggactctgctgcgggcttggcct

SEQ ID NO: 6808182 - DNA, 74 bp, Homo sapiens
agcccacactgggtctggccacaggaagtagagtaccctgccttttcttcctgaaagtcaggctgcaaagggtt

SEQ ID NO: 6808183 - DNA, 77 bp, Homo sapiens
ctcaccttagtgaggggcagctgagtgggcagggtgatgccttctttagccagcagcttcttctcatcctcggtgag

SEQ ID NO: 6808184 - DNA, 68 bp, Homo sapiens
cagggctgatgtggaatttgaatgagattattcatgtaaggcacccatgttcatacagacatgccttg

SEQ ID NO: 6808185 - DNA, 108 bp, Homo sapiens
gagtgatcctccatccagagcagtggagcagggctccccaggcccgaggtgagtgccacctgtgctgggtgtggcgtcttgagcgctgcatggttctgatcctgactc

SEQ ID NO: 6808186 - DNA, 80 bp, Homo sapiens
gatggtgtcatgaatatatgcatatgtcaaaacttatcaaattgtatactttaaacatgtgcagtataccttatgccatt

SEQ ID NO: 6808187 - DNA, 75 bp, Homo sapiens
gaggttgaaagaagagtgccagatggacctcttggtctttgtggtgggatcaggaaattggtacttttttccctc

SEQ ID NO: 6808188 - DNA, 58 bp, Homo sapiens
gcgttggggaccccgaagctggtggatcgctgcacggctgcgcggggtccgccagggc

SEQ ID NO: 6808189 - DNA, 77 bp, Homo sapiens
ccagggcctttgagagtgggcctaggggagggacctcaggctgctgaagtgcctcacctgggcctcctgccatctgg

SEQ ID NO: 6808190 - DNA, 79 bp, Homo sapiens
cactctgctgttgagagctggggcataaatgccacggcagttgctgggcatttatgccccagctcttaacagtggagtg

SEQ ID NO: 6808191 - DNA, 110 bp, Homo sapiens
ggcaggaattccgtttctagaagccatgcccagtccaaaagtaggttctatgactcccagttcgtagaggagggctaggggtacagaggtttaggaaatgtcttcaagtc

SEQ ID NO: 6808192 - DNA, 59 bp, Homo sapiens
cctttcaataacaaagctcattttgactcagcttggtcaagaagcaatttattggaagg

SEQ ID NO: 6808193 - DNA, 67 bp, Homo sapiens
ttctcaatgggagcaccaagtaggaagaaaaatgaaattggcttcttggactactcactagagagaa

SEQ ID NO: 6808194 - DNA, 77 bp, Homo sapiens
gctggcggatgtagaggaaggcgtgctggtaggccacacccggctccaaggccagcagctccctcagggtccgctgc

SEQ ID NO: 6808195 - DNA, 120 bp, Homo sapiens
tcgtatactgaagttctaagccccagtaccccagaatgtgaccttctttggaaatagggtcattgcagatatgattagttaagaggagatcatactggagtgggctttaatccaatatga

SEQ ID NO: 6808196 - DNA, 67 bp, Homo sapiens
cagtctgaggccgtctgggtctgcagctccatggcaacagggccgtggctgggatggcactcttctg

SEQ ID NO: 6808197 - DNA, 83 bp, Homo sapiens
tgctccccagcagcatccggcagcccgggcctggtgcaatcacatcaatgggccaccggctgccaagggttcctctgggggta

SEQ ID NO: 6808198 - DNA, 69 bp, Homo sapiens
aattttgtccagatactcatctctccaccacgtagccaactacaacaggagacaatgagtgacagagtt

SEQ ID NO: 6808199 - DNA, 79 bp, Homo sapiens
gaaagattgcttttagaagttatcaggattaaagttgcatacagtgctacaagtcattccaggtacttctaaatctttc

SEQ ID NO: 6808200 - DNA, 129 bp, Homo sapiens
aaagatcctgcctttgctctgcgcagtttcaaagtgttcactgtgaactcatattcagactctagcattttcttctgaatatcctcactggtgataaatctttggcctttgaaagtggatgtgattttt

SEQ ID NO: 6808201 - DNA, 70 bp, Homo sapiens
ttctggcaagattagattctaatgtggattaatatcctaaattgagagctctaattgaacactgtgggaa

SEQ ID NO: 6808202 - DNA, 76 bp, Homo sapiens
catccatgaagagctgagtctgcagtcgccatgggggtgaactaggaaactgcagtctcagttgagtcctgagatg

SEQ ID NO: 6808203 - DNA, 66 bp, Homo sapiens
ttggagatttgagtagaacttttgcataaagacttgatttattatgtaatttgtttgctcttccaa

SEQ ID NO: 6808204 - DNA, 130 bp, Homo sapiens
ctgcgttgttaggtgacttccatttgatcttatagaacccataaagtatagatctgtgggttggaatgatagccatagaactaaactctattttttgaaagcaaataagatgtacctaatatgtcttctg

SEQ ID NO: 6808205 - DNA, 77 bp, Homo sapiens
tgggggtagggataaacagagtagttgctactggcctctagtgggtggtggccagagatgctgttaaataccccaca

SEQ ID NO: 6808206 - DNA, 82 bp, Homo sapiens
ttccaatgacagagcttctttgcacactggatcttgtggactggatttctggaagattcccagagaagttccacattgagag

SEQ ID NO: 6808207 - DNA, 81 bp, Homo sapiens
gggatactcggtgaacaagacaaacttggccctgctgtctctgggcagcaaagtccagtctgtgtacaccaggtgtggccc

SEQ ID NO: 6808208 - DNA, 55 bp, Homo sapiens
agtggcagtgtgaggatcctgctttagaagactacagcgttttcaatgctccact

SEQ ID NO: 6808209 - DNA, 59 bp, Homo sapiens
atgcccgatacctagttaactctctacatgttattgttgttttgctggtatctggggat

SEQ ID NO: 6808210 - DNA, 85 bp, Homo sapiens
gggagtgtggattttatcagaagtatcttgggaaggcactggacaatttcaagcaagaaagatacatgacttgatttacatttcc

SEQ ID NO: 6808211 - DNA, 61 bp, Homo sapiens
ggcaatctggttcttcttaggcatcaacatcttgatggctgtagggtccggggccagggcc

SEQ ID NO: 6808212 - DNA, 82 bp, Homo sapiens
atgcattgaacaacaagactcagtgggtagttatgttgtcataaatgtactgcttcacccttgagtcttggttactcagcat

SEQ ID NO: 6808213 - DNA, 106 bp, Homo sapiens
ctcagtggtaaagaaaatgcatgggaacttttaaagaaattgcatgtaataactgaatattccacagtgcaacagcagttctctttatattcccaggctcattgag

SEQ ID NO: 6808214 - DNA, 56 bp, Homo sapiens
gctacaccggctgccactcgggcttattttcaaggccaagtggatgctggtttagc

SEQ ID NO: 6808215 - DNA, 123 bp, Homo sapiens
tctggttatttagttatttcatccaatgcattatactctactttgtactctgtatattctggtctaactccagattgtacacagtagagtataatgcgttggatgaaataactaaaatacaga

SEQ ID NO: 6808216 - DNA, 93 bp, Homo sapiens
gtacaagcttttgtgtggatgtacgttttcatttctcttgggtagacagatacctaggagagggaaaatctaggcactttgagtctactgtac

SEQ ID NO: 6808217 - DNA, 71 bp, Homo sapiens
agttttatgcagtgttctgatatgttatactcattttgcttctaaaaccttctagaatcctgtataagact

SEQ ID NO: 6808218 - DNA, 116 bp, Homo sapiens
atcagaatctgggccagagtgagacctttctagcctgccccagtgtcaccctgatccaagggccttcaggtgctgccaggctaggctctaggtgtctgattctcatgggatctggt

SEQ ID NO: 6808219 - DNA, 77 bp, Homo sapiens
gcgagcggtgggcgcgggcgcgcggcctcgggaggggcgcaattccaggccagcggcccgcgcgttctgctgcccgc

SEQ ID NO: 6808220 - DNA, 88 bp, Homo sapiens
tatttacatctgtccttttcttactgcttagccaccatgacacactcaaatggtcaggagcttggtagtgtgattagggatgtggata

SEQ ID NO: 6808221 - DNA, 58 bp, Homo sapiens
ctcacaggcgcagcaccaggtgaagggtggactctttctggatgttctagtctgagag

SEQ ID NO: 6808222 - DNA, 130 bp, Homo sapiens
ttcacctataatttatctgttgagtttgtttgttttaggtagactttgtaacataccagcactcgcattagtgagttatataaactttaaccaggatgtccaaaagcaattgaaatagttgtcagggaga

SEQ ID NO: 6808223 - DNA, 56 bp, Homo sapiens
ttaggtgtcttgtcactaccgttcactagctgtgtaatcttagaaaaggcacctaa

SEQ ID NO: 6808224 - DNA, 63 bp, Homo sapiens
gcatagcttctgggagcagaatggttgggtttaaattccagccctgctactcacaagctgtgt

SEQ ID NO: 6808225 - DNA, 98 bp, Homo sapiens
ctgtctaactagtcccagtgagatgagccacgtacctcaggtggaaatgtagaaatcacccgccttctgtgctaatctcactgggagctgcagaccag

SEQ ID NO: 6808226 - DNA, 64 bp, Homo sapiens
gaagtgtttatattatggaaatatacatgagataaaacatgatattttatggtatatgcatttc

SEQ ID NO: 6808227 - DNA, 62 bp, Homo sapiens
gtgtacgtctttcaaggtggcattagtatttctgaccagccaccaccaggagatcgttgaac

SEQ ID NO: 6808228 - DNA, 70 bp, Homo sapiens
aatccagagtttgctaatccagacttcacacaacctaccccggaagttgtagatgaagtaattcaggatt

SEQ ID NO: 6808229 - DNA, 56 bp, Homo sapiens
gtactaggttccatactcaaagattgtgattccactagtctgtgtgggaccagggc

SEQ ID NO: 6808230 - DNA, 56 bp, Homo sapiens
catgtgcagacggtgggctggactttatcctcaccatagcactcagtttgtacatg

SEQ ID NO: 6808231 - DNA, 74 bp, Homo sapiens
tgaggcctactccttgctgcgtctctgggtagatgttgcctgtgaatgcattaatgagtggtaaagaaacctca

SEQ ID NO: 6808232 - DNA, 92 bp, Homo sapiens
ggctgcatggaccagggctggagcacaggggctggatgaacttgcatctgtctgctgttagctgcattgcttctgggtgtgatgcttaggcc

SEQ ID NO: 6808233 - DNA, 64 bp, Homo sapiens
gtgtctcagctgggagctccattagatagtgaaattgtctcctgaggatcccagctgggagcac

SEQ ID NO: 6808234 - DNA, 57 bp, Homo sapiens
ggaagcctgggaaatgaccacaaggcctgtcatgccctgctatcattctaggcttcc

SEQ ID NO: 6808235 - DNA, 67 bp, Homo sapiens
acctgatacctatagtgatgctaggcttttctgactgaaggagcttcagcgtgtgctaagggcaggt

SEQ ID NO: 6808236 - DNA, 85 bp, Homo sapiens
tcatggtgtaaatgactaattataactagtttaatgctctctaggagatacttacagttttagagcagaacttgttaacaccaga

SEQ ID NO: 6808237 - DNA, 57 bp, Homo sapiens
ccagccctcactgaggcctctcccaaatctgaacgtggaggccccaaggtgggctgg

SEQ ID NO: 6808238 - DNA, 58 bp, Homo sapiens
tgggcaggtggcctgaggagaggggggacaggcctgctcctccaaaggtcccctccca

SEQ ID NO: 6808239 - DNA, 55 bp, Homo sapiens
gtctgtacccacgtcctgctagtttcctgctagcttgtgacagtggggtggggac

SEQ ID NO: 6808240 - DNA, 55 bp, Homo sapiens
tccatgaggattggaaatacgtctgctgtgttcattgcagtcccaaaccttagga

SEQ ID NO: 6808241 - DNA, 78 bp, Homo sapiens
cttggggggttctaagtgcaccctttccttaaggcaatacagaaggcacaggctaggggaacactagaatcttttaag

SEQ ID NO: 6808242 - DNA, 59 bp, Homo sapiens
tttgggcgttatctctcctgctacctagggagaggtcagcaaggctcttaatgcccaaa

SEQ ID NO: 6808243 - DNA, 80 bp, Homo sapiens
ctttttgggaaccctgtgcagagaagtgagcggcgttaccttacagctgccacacagctgtatgagggaagcccaggagg

SEQ ID NO: 6808244 - DNA, 88 bp, Homo sapiens
ggaggattgcttgaccccaggagttggaggttgcagtgaactatgataataccattgcactctagtctgggtgacagagcaagactct

SEQ ID NO: 6808245 - DNA, 77 bp, Homo sapiens
gggggtcccatgggccacagcaatacaatgtcacagaagaggcaaacttctgctgaacttgctgcccagagaccttc

SEQ ID NO: 6808246 - DNA, 57 bp, Homo sapiens
tagtatggttgagtgtaaaacacactgggtgtccagtgctcattcaagtccttattg

SEQ ID NO: 6808247 - DNA, 101 bp, Homo sapiens
cgtcggggtcgggaaggacccggggcggggcttccctctctgcctcagcttccccgagactgcagagagttgggctgcgccaggggctccccacctgggtg

SEQ ID NO: 6808248 - DNA, 58 bp, Homo sapiens
gctgggcaggcctcgtgagggccacggacatggagcttgtccctccgggcttcccagc

SEQ ID NO: 6808249 - DNA, 66 bp, Homo sapiens
taggatttgaaggaagccgggtatctcattatgtcaacagaggacttggcttctttcagagaccta

SEQ ID NO: 6808250 - DNA, 70 bp, Homo sapiens
gtggcggtgtcatttctacggttggcttttcttgctacaggttgggccaaggtggagaaggcactggtat

SEQ ID NO: 6808251 - DNA, 124 bp, Homo sapiens
actagaaagataacagagccactatcaaagagcctcaaacttcaatttcagtctcagagagttctcaacaggatgctctggctagaaattattagttctttgcaagggctcggagtccactagt

SEQ ID NO: 6808252 - DNA, 55 bp, Homo sapiens
gtgggagactatctcagggacccacacttcccagtggcaccctggccactcccac

SEQ ID NO: 6808253 - DNA, 60 bp, Homo sapiens
catgggctgggctgcagcaaaatgagggtgtactcagtgcactgaggcccatgtaccatg

SEQ ID NO: 6808254 - DNA, 57 bp, Homo sapiens
taggtacaatgtcttacagacccagtggatcttggtgtgactaaggcagtgtgaata

SEQ ID NO: 6808255 - DNA, 69 bp, Homo sapiens
ctgagaaggtgactttaaaacagtctgagtgtataaattgcaatcagactattaaagtctcttttaaag

SEQ ID NO: 6808256 - DNA, 75 bp, Homo sapiens
caggaccagaagcagttattttttgcacattataactggctaatgtcacaaaaatcagtaattgctgaaatcttg

SEQ ID NO: 6808257 - DNA, 55 bp, Homo sapiens
catacgccataggctcctcacttcaacagtgaagaaggtgatttctatggttatg

SEQ ID NO: 6808258 - DNA, 87 bp, Homo sapiens
tgccccctgctctggctggtcaaacggaaccaagtccgtcttcctgagaggtttggtccccttcaaccagctacagcagggctggca

SEQ ID NO: 6808259 - DNA, 64 bp, Homo sapiens
ctgggtataggaaacagttaagaatgtgtaggtatcagtgcaaactgtgtcttcctgtacctag

SEQ ID NO: 6808260 - DNA, 69 bp, Homo sapiens
agcaatgcaaacaagagctaggtctgaatgcattgtcgcatttccagaacatgtgtttgtttgtttgtt

SEQ ID NO: 6808261 - DNA, 55 bp, Homo sapiens
ggctcagagccctgcatgctccatctcccccagagaaaaggccaagggcctagct

SEQ ID NO: 6808262 - DNA, 114 bp, Homo sapiens
aggcagatctttctaagtttgtgtcatcagtggatgggtgaaggttctcagaattcatattctgagagctgccatctcatttgaatttgagaaagcaaactccaaaatctgctt

SEQ ID NO: 6808263 - DNA, 98 bp, Homo sapiens
catggggtttttggggcaccattctagtcaatctccaggatttcaacaaaaatctctgcagctaagaaattaattggaaatgggagccttaatccatg

SEQ ID NO: 6808264 - DNA, 80 bp, Homo sapiens
cagttttgaaagttattgaaccttatttagagtcaggtggtttttattgtagtatatgtggttcagtaatttggaagttg

SEQ ID NO: 6808265 - DNA, 61 bp, Homo sapiens
gagaggttcctccctgctttacggcctggctgtcagctttttagttcatgagggatttctc

SEQ ID NO: 6808266 - DNA, 75 bp, Homo sapiens
ggaggctgaggcaggaggattgcttgagcccaggagttcaaggctgaagtagctatgatcctgccagtgcactcc

SEQ ID NO: 6808267 - DNA, 74 bp, Homo sapiens
catggctgcagatagagccaagagggtggcctcgggtggctggtggcagtctcctggctgtgggggcagaagtg

SEQ ID NO: 6808268 - DNA, 80 bp, Homo sapiens
cttccaggaggcaatagtagagtccaggatttgagctctgtatccctaatggctcaccttctggatttcctcctgtgaag

SEQ ID NO: 6808269 - DNA, 68 bp, Homo sapiens
gagacgggtggatcacttgaggtcaggagtttgagaccagcctgaccaacatggtgaaaccttgtctc

SEQ ID NO: 6808270 - DNA, 72 bp, Homo sapiens
accatagactgtgaggcttacaaagaatcgacatctatttctcacagttctggagcctgggaagtctaaggt

SEQ ID NO: 6808271 - DNA, 128 bp, Homo sapiens
gctcattgttttgtttttgttatgtttatttttgtgttgatcttttctatttatggtagtggtatgtacctttgttttaatgtaaaagaataatatggtttaaagaaaaatattaaggaaataagagt

SEQ ID NO: 6808272 - DNA, 60 bp, Homo sapiens
gagcatgtgtgtgcacctctgtgcatgtttttgcgtgtgtattattgcatacacatattc

SEQ ID NO: 6808273 - DNA, 92 bp, Homo sapiens
ggtctattagaatgaacagatcagcctagtactcatttcaaatatgtaattgagtaataattgatcttggcttagaattttaatttgagacc

SEQ ID NO: 6808274 - DNA, 74 bp, Homo sapiens
ggttggtgcaaaagtagttgtggtttttgccattacttttatggcaagaactgcaattacttttgcaccaaacc

SEQ ID NO: 6808275 - DNA, 72 bp, Homo sapiens
tggcaaataagagctggagacagaaacagcccgtgatgctgtgccctgaaatttagcatttacatatttcca

SEQ ID NO: 6808276 - DNA, 69 bp, Homo sapiens
gggcagcctgctggctggtagagttccgtgtcttcccttctagctggagcctggcagctgcaaatgtcc

SEQ ID NO: 6808277 - DNA, 76 bp, Homo sapiens
tggattatctattcagtatttcatgactttcttcatctataattgaccaagaaagtgatgagctacagatggtcca

SEQ ID NO: 6808278 - DNA, 91 bp, Homo sapiens
agcatagtggtaacagaaagaaagtttgggaaatttttatctgatcagcttcccataccctgttcatctttgtgttatgcactgccaggct

SEQ ID NO: 6808279 - DNA, 59 bp, Homo sapiens
cctgtattttaattcgtgttttcttgggaggagagagggcatggagtgtaggtggaagg

SEQ ID NO: 6808280 - DNA, 87 bp, Homo sapiens
ccagtgatggctagatctgtgtggccagtgtgtctctgtggaagccagggtgaccaggccaacagctaagttaatgccaatctctgg

SEQ ID NO: 6808281 - DNA, 58 bp, Homo sapiens
cccagccctgacctattggaaaccaaagcagcaccagggatagtagtgaagggctggg

SEQ ID NO: 6808282 - DNA, 75 bp, Homo sapiens
cacctaactttccttaatacctggttaccactggttaccaattacagtgcaaataagctattatggaatagggtg

SEQ ID NO: 6808283 - DNA, 91 bp, Homo sapiens
tttgtgttttgatttttcatttgtccaaatactatgtagggatatgattttctaaagacaaatatagtgaccaggtggaacaagggacaaa

SEQ ID NO: 6808284 - DNA, 63 bp, Homo sapiens
gctgggatggaggggcacaatttcaaaggaacaaatgttgcctgaatgcttcgtcatcctggc

SEQ ID NO: 6808285 - DNA, 60 bp, Homo sapiens
attcctattgccagcatagtatgataggcattctaataatgctgcttggtgaataggaat

SEQ ID NO: 6808286 - DNA, 58 bp, Homo sapiens
ctactctgggcaccaaagagcagcttttagtagatagttgagttggagccgggagcag

SEQ ID NO: 6808287 - DNA, 63 bp, Homo sapiens
gatgaatgggtacacaggatgaggggcaaaagaatgttcactttctgtttttattcattcatt

SEQ ID NO: 6808288 - DNA, 78 bp, Homo sapiens
taaagtgcagactcccggaaacaacaacttatttatcaattaaaacagcagagttgggttccagagatctgcatttta

SEQ ID NO: 6808289 - DNA, 106 bp, Homo sapiens
tatggtggttaagaacttaggctttgtagttaggctataggaatttcaattttgacttcacaagtcattagctgcataaccttaggtaagttacttaactactata

SEQ ID NO: 6808290 - DNA, 101 bp, Homo sapiens
ctgaggtaggagaatcgcttgagcctgggaggcggaggttgcagtgagccaagattgcaccactgcattccagcctgggcgacagagagatcctgtctcag

SEQ ID NO: 6808291 - DNA, 58 bp, Homo sapiens
actttcatggtagttgtattcttggagaattcgctgtaaattaaaactacatgaaagt

SEQ ID NO: 6808292 - DNA, 55 bp, Homo sapiens
cagagtcagtaacatatatggtacaaacattcttatacatgtgtcactgattctg

SEQ ID NO: 6808293 - DNA, 93 bp, Homo sapiens
tccctgtcttggggcagagggcagtagcctcgtaccctgaggattcttgaaggtctggggtccgagcagctccatcagaagccccatcgggga

SEQ ID NO: 6808294 - DNA, 87 bp, Homo sapiens
tcttctatgcagcctcttattctccaggacttgtttacatggtgatggtggtaagggtctcagaagagtgaggggaagtgtacaaga

SEQ ID NO: 6808295 - DNA, 86 bp, Homo sapiens
ggtatcgaaatcgttttctcatgtccctcgaggggccctaagtcactctcaccaaagagctgcatgcggaaacctgttctgattcc

SEQ ID NO: 6808296 - DNA, 65 bp, Homo sapiens
ggccccgggaacataaagcagtgaggaagggaagccatttggcagctgcgttgtgtttctgagcc

SEQ ID NO: 6808297 - DNA, 60 bp, Homo sapiens
gcaaagggtggctgtgaagtgcttggcaccatgccaggcacacaatggcttcctgattgt

SEQ ID NO: 6808298 - DNA, 98 bp, Homo sapiens
acaatttgagcagttgtatatgctatgaaaagagtatagccactggataagtgttgtacttacattttaaagctaaccaaagttaggctcttgattgt

SEQ ID NO: 6808299 - DNA, 88 bp, Homo sapiens
cacctgacctcgagtctttcaaatggccattggcttaggttaccccaattagccagactcatttggaagtatccagaggagtcaggtg

SEQ ID NO: 6808300 - DNA, 73 bp, Homo sapiens
ttggactgttctgccaagatcaacgttgcctcacttctcactataaacttgaaaccttggcaaacaatgccaa

SEQ ID NO: 6808301 - DNA, 76 bp, Homo sapiens
ttctcctggtttaaaattactggttaaggttattttgcattcacaaatgttaaacagtatatctgagcaaggtgaa

SEQ ID NO: 6808302 - DNA, 88 bp, Homo sapiens
cttatccatttctcctttgggcatttgcttaatgccaggcatttgtgtcaggcactgtgcaagggtctcgaaatagaaggacaataag

SEQ ID NO: 6808303 - DNA, 55 bp, Homo sapiens
ccagctgcagaatgttggggaagagggtgcctgattctctggcttctgtagctgg

SEQ ID NO: 6808304 - DNA, 68 bp, Homo sapiens
gtggcagccatgagaatataacactcagatctccagatgtgtgaagttactacttcttatgctatcac

SEQ ID NO: 6808305 - DNA, 59 bp, Homo sapiens
gagtaagcctctgcctcacaggctatgtaagatgtagtgtgcatggtggaggcttgctc

SEQ ID NO: 6808306 - DNA, 77 bp, Homo sapiens
ccacgactcagcattctttccttcgcttgtttctatttctgtcaaggtgaggagaccttttgagtgtgagacgctgg

SEQ ID NO: 6808307 - DNA, 58 bp, Homo sapiens
gtacgcacatttgattgtgattgattggacaatcagttacatctgttatgtgtgttac

SEQ ID NO: 6808308 - DNA, 55 bp, Homo sapiens
tcctttggaactgactccgttaactctttgagggacagcagtaggttttagagga

SEQ ID NO: 6808309 - DNA, 65 bp, Homo sapiens
gtttggctggtttcaagaaggcatctctgaggaaatgacatttgaattgagaccggttaacaaac

SEQ ID NO: 6808310 - DNA, 122 bp, Homo sapiens
tataagtaactatattgatctcagtagtgctttggtatagaactattttgtggaaataagctgtcctgacttggtaagctgtccaaagcattactaagaggtgcattgctctgtaacttata

SEQ ID NO: 6808311 - DNA, 65 bp, Homo sapiens
agtttataggagggagaaatcaaaagtacaaccttactttttgctggtctcttccatcctctgct

SEQ ID NO: 6808312 - DNA, 64 bp, Homo sapiens
aggcttgcagaatgaatgcttcttcaggtcggagtgccttaataagcattcattcagcaagcct

SEQ ID NO: 6808313 - DNA, 63 bp, Homo sapiens
tcgtcgggggtcgggggtcgggggtcgggggttgggggctcctgtcccggggaccgccgagga

SEQ ID NO: 6808314 - DNA, 129 bp, Homo sapiens
aatttattttatttaacaatctaggaagttcacagccaccagcagttctagtgcaatttcaggtgtgattgggaattcgggaatctcagtggagctgttagtgtagcgaaccttgtaagtaaaatacat

SEQ ID NO: 6808315 - DNA, 60 bp, Homo sapiens
ccaagatgtgttcttcccagcctgagatatctcgtggatcagactgaccgaagcatctgg

SEQ ID NO: 6808316 - DNA, 72 bp, Homo sapiens
atgataccaagatatcaatgacatagtatcacccctcagtatagtgcagtgttcttgatcatctttgttcat

SEQ ID NO: 6808317 - DNA, 80 bp, Homo sapiens
tggcttagctacttgggttggcatcagctgggcagtttttctgctggtcttacctggagtcactcatgtagctgcagtca

SEQ ID NO: 6808318 - DNA, 74 bp, Homo sapiens
atgtacagcaaatatatgctctctaataggtatgtactcatacctggaaaagttatatgtgtgtgtctgtgtgt

SEQ ID NO: 6808319 - DNA, 60 bp, Homo sapiens
ttacattcagaaagatttgagtacattgtggacaaattcataagtcattctgcaatgtag

SEQ ID NO: 6808320 - DNA, 66 bp, Homo sapiens
ctgtggctctccattgacatggaatggagccttccttattttcatgtaattatggagagaatgcag

SEQ ID NO: 6808321 - DNA, 129 bp, Homo sapiens
tgaagtagcatagaaatgatgctgtgttctcaggacatcatatcaggaggcatgtaatagactattgtcccaggattgtgatgttaactttgatcacttggctaaggtggtatctcttagctgtctcta

SEQ ID NO: 6808322 - DNA, 78 bp, Homo sapiens
actgtttgcttctgccagaagttctgagagtatcctacacctggactacttttcatgttacttttggggcctgagagt

SEQ ID NO: 6808323 - DNA, 70 bp, Homo sapiens
gcttcaggtctgagtagagaaaaggcaaagcccaaatttggctacatttctttggcagacattatgaggt

SEQ ID NO: 6808324 - DNA, 75 bp, Homo sapiens
ctgcccaacatgccaatgcctgctagtccaaagccacttgagtcctgggagcagcattgccatgtgcaagagcag

SEQ ID NO: 6808325 - DNA, 64 bp, Homo sapiens
ctctccatgagcatttgaaatgtacagctacaagttgatagtgtatgatttcaaatggctagag

SEQ ID NO: 6808326 - DNA, 73 bp, Homo sapiens
ggtaggtaggagaggactgttctatttctttgtacctttgagacatggataacccagttcatttctccctgct

SEQ ID NO: 6808327 - DNA, 57 bp, Homo sapiens
tcttccccttcatggcagcagccaggccctccctgcacaggccttgaagggagagga

SEQ ID NO: 6808328 - DNA, 74 bp, Homo sapiens
atgaaggtcagtgtaagttatgtagatgtgcataagattttatacatttaaatatgccttatattttacttcat

SEQ ID NO: 6808329 - DNA, 57 bp, Homo sapiens
aaaggtagtacttctagaagggaggcgatcagagtccaattaggagatattactttt

SEQ ID NO: 6808330 - DNA, 80 bp, Homo sapiens
aagtatttcctcctagctttgttttgttttgttttgttttccttaagacatcttgccttgggaaagtgggaggagaactt

SEQ ID NO: 6808331 - DNA, 106 bp, Homo sapiens
tcttgttcttttgtgttagctgtacctgagaaaagccaatttttgatgttatgaataaatcaacagaaactcatgccatctcgttgtagctaacacaaatgcaaga

SEQ ID NO: 6808332 - DNA, 75 bp, Homo sapiens
ttcattcacttaacatttaccaaggatctaccataaatcagataatgttgaagattctggagagagagtgatgaa

SEQ ID NO: 6808333 - DNA, 69 bp, Homo sapiens
tgaggatgttgaggcagacgttgccctcgatttcaatgttggggtgatagaccattgtctcacacttca

SEQ ID NO: 6808334 - DNA, 72 bp, Homo sapiens
tgtctgggtcacccctcctggctgccctcttggagctgaataacagaaggggaggggttagtaacccggaca

SEQ ID NO: 6808335 - DNA, 71 bp, Homo sapiens
ggttttatttgcctgcagctctggttaaaaagaattaaaggggccccttcagggcttagggaaatagtgct

SEQ ID NO: 6808336 - DNA, 73 bp, Homo sapiens
tctatttagcagcaggactggcccacaggtgcttttacagcggctggcaagtgtctgctcatgaatgaatgga

SEQ ID NO: 6808337 - DNA, 90 bp, Homo sapiens
tgcgatgtggctctggattatgttcgactttagaaatagtgccagaactattctttgatttgtggacatggaccctgagactgcagagca

SEQ ID NO: 6808338 - DNA, 58 bp, Homo sapiens
cggttccaggaccctggcctctgagagaacctgtgctttccaggagaactgggagccg

SEQ ID NO: 6808339 - DNA, 80 bp, Homo sapiens
gagaatagttcccttagcgacctttcccttcaaatactttgcagccaggtagagaagtttggagtgaaggttttgttctt

SEQ ID NO: 6808340 - DNA, 72 bp, Homo sapiens
ctgaggacagcattcctagttccaaaaagccccaagggggcactgtttagacactagggatgcagtggtcag

SEQ ID NO: 6808341 - DNA, 71 bp, Homo sapiens
cccatcttcaagcttgtgtcggatctggttgagggatttaacctgaggagaacagtgcttggaaggaaggg

SEQ ID NO: 6808342 - DNA, 116 bp, Homo sapiens
ctgtgggatctaactggccagtggtggtggctgcagtgtccggtgcatttcaccaggagcatcctgcgagccctgggagctgcctggctgacggcattcccacagcgagcctacag

SEQ ID NO: 6808343 - DNA, 81 bp, Homo sapiens
tatcatgttaattacaagatgcatccatatttcagagttgttagaatgcagagatatgtgcgtcttagattgaatgtgata

SEQ ID NO: 6808344 - DNA, 130 bp, Homo sapiens
cccgtcctcacccccgggctcgtcccccagcctccgccggcccgcctgtgaatggtggatttaatgagcgtttgtgtggcgttggccggcggttctgaagatgcgctgacctggagggagggcgcgaaag

SEQ ID NO: 6808345 - DNA, 63 bp, Homo sapiens
caattagcatttcccatataaatttcatactataaaggaggttgtaatggataatgcaaattg

SEQ ID NO: 6808346 - DNA, 84 bp, Homo sapiens
ctatgtagagtgctttctgtttcctgtagtacttgacttggatgataccagagatagatgcaggaaacagaggctcaaatatgg

SEQ ID NO: 6808347 - DNA, 68 bp, Homo sapiens
gttctcatgtgtgtactattctatcattattgtataatggttttcaaaccagtgggcacacagagaac

SEQ ID NO: 6808348 - DNA, 92 bp, Homo sapiens
tctccagggctgccttttctattctggatctgtggcaggggcccagcctgcctcctggtgcaggcaggcatgtgactgaggcagcccgggga

SEQ ID NO: 6808349 - DNA, 55 bp, Homo sapiens
aatcacatgaaaactgtgtgtttaagtactagaatacaagtcaatccatgtgatt

SEQ ID NO: 6808350 - DNA, 86 bp, Homo sapiens
gggtaagtgggagtcaaatattccagcttctttgtccctgggttgaacaattcagaggtccctagcaggagtgaaccccattgccc

SEQ ID NO: 6808351 - DNA, 70 bp, Homo sapiens
agtcattaaatattcttccaaaacatcatttgggaaggctgcagagtgttttagaatatggtttgtgact

SEQ ID NO: 6808352 - DNA, 68 bp, Homo sapiens
agatggatgagtgttgacagccaagcctatgcccaatacaaaggctccttcacagcactcgcccatct

SEQ ID NO: 6808353 - DNA, 63 bp, Homo sapiens
gcagaaagtagagtgtagcagtttcgatgaatgagagacagccatgcacttctgctgttctgc

SEQ ID NO: 6808354 - DNA, 58 bp, Homo sapiens
aggagccgtacttcctgtgactttaagcaactgagagcaccaggaacagtgtggtcct

SEQ ID NO: 6808355 - DNA, 65 bp, Homo sapiens
tctccaaatagtgtcacattgtgaggaactggggttaggacttcaacacatgaacttttggaaga

SEQ ID NO: 6808356 - DNA, 75 bp, Homo sapiens
tctactttctgccttaaaagtacttttacttaaaacatccagttagaagggtattttttggcattgctagttagg

SEQ ID NO: 6808357 - DNA, 77 bp, Homo sapiens
gatggtctcgaactcttgaccttgtgatccacccaccttggcctcccaaagtgctgggattacaggcttgagccatc

SEQ ID NO: 6808358 - DNA, 73 bp, Homo sapiens
gccttgtggctcgtgagatgttagggaggccaaaagaaattgctagaaccagaactcatgagtgcctcaaggc

SEQ ID NO: 6808359 - DNA, 90 bp, Homo sapiens
gcttctcaaagggcctttcttttgaatctctgcagaatgaactgattcctcagcaggtcatgaaagaaaaccagctaatattgatgaagc

SEQ ID NO: 6808360 - DNA, 56 bp, Homo sapiens
gcactgcagtcctgatggagcggcttatggaagtttttctgggaggcactgctggc

SEQ ID NO: 6808361 - DNA, 69 bp, Homo sapiens
acttctttgcagctaggactgtgccaagcagaagctagatcatgtacagagtcctagctgcaaagaagt

SEQ ID NO: 6808362 - DNA, 64 bp, Homo sapiens
tctcatttagaaccccttccaacctgttcaaatataggtcccttagatgttctgaagactgaga

SEQ ID NO: 6808363 - DNA, 71 bp, Homo sapiens
ggtgtctctgaaaggtataaataagacttactcttttgctgtaagattccataccttttaggtcagactct

SEQ ID NO: 6808364 - DNA, 74 bp, Homo sapiens
gaacctgccagatcagaatagtgtattctgtgcacccaacagggtggaagacattattttgtttgtgttagttc

SEQ ID NO: 6808365 - DNA, 74 bp, Homo sapiens
gcctgcccccatggagtgcctgagggccagcaaacacctgtggcttcctaggagcccgtgctttgggcagtggc

SEQ ID NO: 6808366 - DNA, 129 bp, Homo sapiens
gtctcacacttgtcttttcaacgagttgtatatttatgtgtgaaaatgtatgctatttgttgccacctatcaaaggaatagactttgtataatttcccacattggacaatttaaaagtgtttgtgaagc

SEQ ID NO: 6808367 - DNA, 56 bp, Homo sapiens
atgcagtttatctccaaatcatgatttttccctttatgatttgatcatggctgcat

SEQ ID NO: 6808368 - DNA, 62 bp, Homo sapiens
gtgctgtaggcagttggtgagatatgatgtgcccttagtctccttaattggcttattggcat

SEQ ID NO: 6808369 - DNA, 55 bp, Homo sapiens
gcctgggatagaggcaatgcatggacccaacagcctgtgttcctctccccaaggc

SEQ ID NO: 6808370 - DNA, 88 bp, Homo sapiens
ggagaatcacttgaaccaaggaggctgaggttgcagtgagctgagatcatgccactgcactccagcctgggtgacagagtgagactcc

SEQ ID NO: 6808371 - DNA, 73 bp, Homo sapiens
atgatgtcagttctacaagtccagtttttgcaagggcaaattaactttgtttctcagctgtggagcctatcat

SEQ ID NO: 6808372 - DNA, 107 bp, Homo sapiens
aaatgtttactaaaatgtagcttctttgtttatcagacgaactgtggtaacagcagttatgaaacttatcacagttcatctgataaactacattttagtaaacattt

SEQ ID NO: 6808373 - DNA, 65 bp, Homo sapiens
gagagaatgtggtattttagtttaagttagaaagaaagcacttactttaggaaaccactttcctt

SEQ ID NO: 6808374 - DNA, 109 bp, Homo sapiens
gactgaattgtgcaaatgagtagcgatgcacattagaaaacaacattataaaatcaggtatgtgaaatcctgagatgtacttgctttatttattttaacaagggcagtt

SEQ ID NO: 6808375 - DNA, 58 bp, Homo sapiens
aacttgaagaggctttttggcaaagatttgaatatatgtcctttggccttttctggtt

SEQ ID NO: 6808376 - DNA, 102 bp, Homo sapiens
agacattgtgtgtgggccctcgttctggatttgtcctcactttctgcctgcagcagagatctgaaacaaattaggagctctctgagggcacaggcagtgtct

SEQ ID NO: 6808377 - DNA, 100 bp, Homo sapiens
ggagtgaggcgcaggctgtgggtgcaccagtggggcatccaccacggagaatgtgggtgctcccatgtgtgggtacagacgcctggagggtcctggctcc

SEQ ID NO: 6808378 - DNA, 68 bp, Homo sapiens
tcagctttggagagagttaaatatgttagtgaaatcagaacaaattttcaagttctccactgacctga

SEQ ID NO: 6808379 - DNA, 60 bp, Homo sapiens
tcacacttatcccactcagtcatggcaaagagaagacactactggcactggtaggtgtgg

SEQ ID NO: 6808380 - DNA, 61 bp, Homo sapiens
gttccaaggagagctcgacctcaaaggtgttagtgctttggggtcaaggctgccttggggt

SEQ ID NO: 6808381 - DNA, 93 bp, Homo sapiens
ctggtcatccacattatttttgtgcttttatgtttgcttcaaagaggaactttgaagcacagacctgggcatcagtgatgaacgaagggccgg

SEQ ID NO: 6808382 - DNA, 67 bp, Homo sapiens
gttaatattaggtacatgtctgaagtatctccaatcatggaaattctccagaccttgtgactatgac

SEQ ID NO: 6808383 - DNA, 66 bp, Homo sapiens
gcaggttggcgcccaggacgccgccgctgtactccccggcggccgcgtccagggccgccaggccgc

SEQ ID NO: 6808384 - DNA, 82 bp, Homo sapiens
gcttgaggccaaattgaagggcattagtcatcagtaatttgcagatgtttttaatgtttttcacccaagagaggtttcaggc

SEQ ID NO: 6808385 - DNA, 57 bp, Homo sapiens
gccatgaggcctctgaggcctaggctcagattgaatcatggcctttgaggcctaggc

SEQ ID NO: 6808386 - DNA, 57 bp, Homo sapiens
cctgcctggtgtaagtctaaggttgcaagaaaggtgaggagtctggcaccaggtagg

SEQ ID NO: 6808387 - DNA, 73 bp, Homo sapiens
atcactggctaatgactgagtttttagcagaggcatcctgtctttgttcaagcacaggtcttagtcttgtgat

SEQ ID NO: 6808388 - DNA, 60 bp, Homo sapiens
catctggtatgaggttttgcttttcacagaatggcaacatctaacctcatcacacaggtg

SEQ ID NO: 6808389 - DNA, 62 bp, Homo sapiens
tacatttgtgtgtatatccttccagaaatttttggcgcatttatatacacagtacatatgtg

SEQ ID NO: 6808390 - DNA, 64 bp, Homo sapiens
gaatgagctggctgacaaagcagggtgccagagttctccactggctccttgccaccagctctgc

SEQ ID NO: 6808391 - DNA, 91 bp, Homo sapiens
gagaatgtaagtttgacatttactattcctggttaaatctgttattctggctatgacttcatgaatagtcaagtgtgggaggtatattttc

SEQ ID NO: 6808392 - DNA, 92 bp, Homo sapiens
tcatttaattgtcacatccatcttatgagataggtgctattattattctcactaaagagggctgatcattggattgatgtgagcctagatga

SEQ ID NO: 6808393 - DNA, 68 bp, Homo sapiens
agtcctaatggagcctctgtttatctggatcctgagagtctatgtggagcagaggctgcctggtgact

SEQ ID NO: 6808394 - DNA, 56 bp, Homo sapiens
ctacccccagactcatcctccagtcgttggaactgggaaatgaagtctggtggtgg

SEQ ID NO: 6808395 - DNA, 61 bp, Homo sapiens
ggaaaaagggatgtctggctcagagggtacttctaacccctcgctctaggcagccctgtcc

SEQ ID NO: 6808396 - DNA, 57 bp, Homo sapiens
aacaggagtcattgtcattattgttacttattagtagtgtcatcctcagcttctgtt

SEQ ID NO: 6808397 - DNA, 130 bp, Homo sapiens
cctgaggcaagtgaggccctgcccctggggtggctgattttgtcctgggggtgggaggggctggaggggaatccagtccaacctgccccttgggccctatagcctcaaaggggtggggagagcagacagg

SEQ ID NO: 6808398 - DNA, 80 bp, Homo sapiens
ctcaacacacatggtagcaggtacaagtcaaaatcaattacaaatttgagtttgctgcactgtagtaaagataagttgag

SEQ ID NO: 6808399 - DNA, 67 bp, Homo sapiens
aatatgatccttaaccttcatgttacagtgagagataaattagcatcatgggaagtaggattatatt

SEQ ID NO: 6808400 - DNA, 113 bp, Homo sapiens
tgtgggaattagtaagcaaataagaaacgcctgtgaaattatcttagtaccaacctaaaaacaacatatatcacatcaggtgattcactcatattttacgtttacttttcaca

SEQ ID NO: 6808401 - DNA, 106 bp, Homo sapiens
attctgggtaaatgtaaagaaaggtctggagagtggccaactctggagacctgcttttgcaggctgagtttctcattctcgctcctgtcttatctttactatgaat

SEQ ID NO: 6808402 - DNA, 55 bp, Homo sapiens
gaggtggcagaggcctggacctgccgtcaaaggtgtgttgatgtttccccatctt

SEQ ID NO: 6808403 - DNA, 76 bp, Homo sapiens
taaagttagcagactatgtcatagtcaagagactttgctttatgaactagctgatttagtttgctcacaagctttg

SEQ ID NO: 6808404 - DNA, 57 bp, Homo sapiens
cactaggctggagacccgccaagaaattatgagacgtttcggtcccagatgcctgtg

SEQ ID NO: 6808405 - DNA, 90 bp, Homo sapiens
cacttcctttgtcagtcatgtctgcttttcttcaaatggagccttaagaggcccttatgcaaaggcagaaatagatttataaattaagtg

SEQ ID NO: 6808406 - DNA, 78 bp, Homo sapiens
gactgcaaggaggtggggtatcacttaatgtaataatccatcctataaaaacatttattgaccccctccttgtcattc

SEQ ID NO: 6808407 - DNA, 58 bp, Homo sapiens
agaatctggaagtgggcagtaggctattttatagaccattttctatcttccagattct

SEQ ID NO: 6808408 - DNA, 59 bp, Homo sapiens
gaaatttacaactttctcatgggaagaaagagaaaatcctatgagttaggggaaatttc

SEQ ID NO: 6808409 - DNA, 71 bp, Homo sapiens
gctgaagggtcaatttctaagggcagttttctccaacttaattctgtccacctttgataggctctctcagc

SEQ ID NO: 6808410 - DNA, 68 bp, Homo sapiens
cccatagtgcacactgctgctccaggaggaacttcctgagctggaagagcttgtgcttactctatggg

SEQ ID NO: 6808411 - DNA, 89 bp, Homo sapiens
ccatccataaccttgacactcataattttgaaacctatcgttcattacaagggttaaaatctaaaatgtgactgtgcaggttgagatgg

SEQ ID NO: 6808412 - DNA, 87 bp, Homo sapiens
cctggcaaggttggctttgtagctgtgaggggatgttcatgtgagggaaacatgaaagctcagtgcactgacagcccccatgccggg

SEQ ID NO: 6808413 - DNA, 69 bp, Homo sapiens
tgctaggagttattctaagattatgccttatttacttttaagccacatttcctaatatagcacctggta

SEQ ID NO: 6808414 - DNA, 68 bp, Homo sapiens
agagtttcttgtgagcactgacagttttctaagccagcaagcaacctcaatactcacaaagagatttt

SEQ ID NO: 6808415 - DNA, 68 bp, Homo sapiens
tagggagcatgccaggaacaaacagtggtgcccactcactgggcccatttcttgagttcagctctttg

SEQ ID NO: 6808416 - DNA, 74 bp, Homo sapiens
agtgcggttttggggtttacaagagctgatggatgtaaagtgcttagaagaatgcctaggacagagtacgcact

SEQ ID NO: 6808417 - DNA, 57 bp, Homo sapiens
tacattcctcagcaggccttttgttggttgcactaactgcaaggttgctgggaagta

SEQ ID NO: 6808418 - DNA, 66 bp, Homo sapiens
ctgggctagtatttcagcatgtggggcagggaaaccctggttcaatgcctagaacttagcatccag

SEQ ID NO: 6808419 - DNA, 91 bp, Homo sapiens
tagaacatgtgttccggtgtctgggacatgcccttactcctcttcagctagggctctgtgcaccccagcaccgtgaatgcacaggactttg

SEQ ID NO: 6808420 - DNA, 67 bp, Homo sapiens
ggaaagggcagaggccttggaggtaacctgaccattggaattaatgtccagcctttccctcacttcc

SEQ ID NO: 6808421 - DNA, 62 bp, Homo sapiens
cgtgtgtgtgtctgtgtgtgtgtgtgtacatgcgcacatacacatgaatatatttttatatg

SEQ ID NO: 6808422 - DNA, 63 bp, Homo sapiens
tgtggatgtgtacagatcagagggatgcaagttaatgcacctgccagattttactatcgtaca

SEQ ID NO: 6808423 - DNA, 60 bp, Homo sapiens
agtgtgacaaatctatggctcaaaaatgaaatagggagctagccaagagatttgttaact

SEQ ID NO: 6808424 - DNA, 63 bp, Homo sapiens
gcctctggctcaggtcagacagggagttaccaggaaccctttcctgctgcctgcgggcaaggc

SEQ ID NO: 6808425 - DNA, 100 bp, Homo sapiens
aagatgaaattactagaatgaggcttttgtgggaaattaaatatgtctggatttatcaggaagattagtttcctacctctttcaacagcaatttcttttt

SEQ ID NO: 6808426 - DNA, 89 bp, Homo sapiens
gagaggatgcaggtgacttttctgagacaatgctttgcagcttgtatgagattcttagagaagtctggtcctccctgccccagcctctc

SEQ ID NO: 6808427 - DNA, 55 bp, Homo sapiens
gccccatttccttcctggggcagggttagtcatccggccctgcaggaggtggggc

SEQ ID NO: 6808428 - DNA, 61 bp, Homo sapiens
agatggccaaataacagcttgcatgctgtgtcaggcatgcccctttgtagtgtggccttct

SEQ ID NO: 6808429 - DNA, 71 bp, Homo sapiens
ggccatttataaaaggagtatagtgtgacaagattaaagattacacaggctggctctttgagatacaggcc

SEQ ID NO: 6808430 - DNA, 73 bp, Homo sapiens
tggagttctgaaggcatttttgctgatttctgggttcccagacatctgcacggttgccgtttctagaagtcta

SEQ ID NO: 6808431 - DNA, 64 bp, Homo sapiens
gtgaagcctctgctgattagtatatgacagatataataccatagcctattagcttgggcatcat

SEQ ID NO: 6808432 - DNA, 57 bp, Homo sapiens
attggtacctattgactggctgcagtgccatgtaggccaggaaaaagggtggccaat

SEQ ID NO: 6808433 - DNA, 127 bp, Homo sapiens
attggtgcttcctggggtcacctcttgtttaaacttgggcatttaaacttggatattaaacagattctgagacagagatgtgtgtgcaagaggtttattgaggagtgatctcaggaatgacattagt

SEQ ID NO: 6808434 - DNA, 102 bp, Homo sapiens
aaatatgtgtacatttgcaataataggaagttatagctatgatcttaataagaacactttccagttaagcatgctgcaacttctgcagagatggccattttt

SEQ ID NO: 6808435 - DNA, 58 bp, Homo sapiens
ttagttatctctgctacagaaaatgtttgtggtaggttttcccagcagagatagctgg

SEQ ID NO: 6808436 - DNA, 60 bp, Homo sapiens
cagacactgcagcagtctcccagatctgccttctgggaacccgaattgcccggtagtctg

SEQ ID NO: 6808437 - DNA, 69 bp, Homo sapiens
ctctaggggctggtcagcgtctctagggaattatgggggaaatagatatgcaaacgacggcacctggag

SEQ ID NO: 6808438 - DNA, 71 bp, Homo sapiens
gaggggtgtgtgtgtgtgtgtgtgtgtgtgtgtgtgtatgtatatgtatatgtgtgcacgcacagcctctt

SEQ ID NO: 6808439 - DNA, 71 bp, Homo sapiens
tcagaacccccaggtgaattaggtcatctctgtcccctcccctgaagacctcgtgaactctgagggtatga

SEQ ID NO: 6808440 - DNA, 71 bp, Homo sapiens
tggcactttaatgatattcttaatttgagttggaagagttttccagagatccaaagaatatgaagatgcca

SEQ ID NO: 6808441 - DNA, 66 bp, Homo sapiens
ttgggtaaatcactcctaataatcagtcaatcagcttgtattgttatgccagtgatacatacctag

SEQ ID NO: 6808442 - DNA, 82 bp, Homo sapiens
gttctctattgtatcgcagcatcagggacagtgcctggcacttagtaggtaggccctgagtgctgttgtttgaatggagagc

SEQ ID NO: 6808443 - DNA, 74 bp, Homo sapiens
tgtgaataagtaggatgaataactgaaatggtgctgtttagtagttgccactatccattcatcctattctcata

SEQ ID NO: 6808444 - DNA, 57 bp, Homo sapiens
gtgtccttatcgcgaaagtgggacaacacccactttataaaattggtgtgaggaagc

SEQ ID NO: 6808445 - DNA, 64 bp, Homo sapiens
tcctattacagttggggtaatttagtttcaaggtttagaaatttgctttaactagtaaatgggg

SEQ ID NO: 6808446 - DNA, 117 bp, Homo sapiens
gttttgatatctttgtagtattgagggcagtgatgtcaaacagtgaataaagttatatatctatgtggtgatcttattttaacctcaatattattttagtgatttgtaagtcagaat

SEQ ID NO: 6808447 - DNA, 61 bp, Homo sapiens
ggatgaagatggagcaagtgcctgtacaacataggactaaaaagatgctctccctttatct

SEQ ID NO: 6808448 - DNA, 88 bp, Homo sapiens
gctcatctcaatagactaattttctttcacacataggatgatggataaacatatctgcctgtggtggaggaagtttcttgagatgagt

SEQ ID NO: 6808449 - DNA, 98 bp, Homo sapiens
tggcagagccaaaatattgtaacatatgttgaaccaggtgtgtaagttgaataccttttagacatgtagttgtcactgttaatataagtggcctgcta

SEQ ID NO: 6808450 - DNA, 66 bp, Homo sapiens
cagagtgattatggaggattgcatgcaggatacacacttcattaaatcctctaaaatctaactttg

SEQ ID NO: 6808451 - DNA, 76 bp, Homo sapiens
aaagctaatgagaacagtgctgataaatcatacccgtgggttgaactaaattagacattgtttacgtcaaagcttt

SEQ ID NO: 6808452 - DNA, 59 bp, Homo sapiens
gtgggaagaagcatgagacacagtggaatctggatttcctgtcaagtgcttgttcctgc

SEQ ID NO: 6808453 - DNA, 56 bp, Homo sapiens
ccaagatgggcaccccagcacctcctcctctgagaggagccactgccccagtttgg

SEQ ID NO: 6808454 - DNA, 57 bp, Homo sapiens
aacagaaatgagcgtgtctgggcctatacaaagaaccccagaagcactcttcatgtt

SEQ ID NO: 6808455 - DNA, 71 bp, Homo sapiens
ggtgaccatgacgtcagcctgcaggacaggtgagctggatccctggggactgaaggatgttgctggtcacc

SEQ ID NO: 6808456 - DNA, 104 bp, Homo sapiens
gtccctgccttcctgagtctcctcttttctccatcaccccctcggtgacttcccaaggatacctggcatggaggggctggcaggaaggaaaggagggcagtgac

SEQ ID NO: 6808457 - DNA, 119 bp, Homo sapiens
cttctgtgcccccaatccgcaatctccttccccagttccaggggcctgctgggattggctgcagtggaagaggctctttgagctgggagaagggtttatgcagaaagtggggctagaag

SEQ ID NO: 6808458 - DNA, 62 bp, Homo sapiens
gacagctcaaggcttggagtaagcttggctgtatccacagccttgtctccagcctaagtttc

SEQ ID NO: 6808459 - DNA, 109 bp, Homo sapiens
gatgacgctgatgctataaaaggcaatgtgaggggacagctgagttattgaagcaagcttttctgagttctgccctacacctgaatttagtggtttaagtagcgctgtc

SEQ ID NO: 6808460 - DNA, 64 bp, Homo sapiens
gggatggagtatttttatttgcttgatattttttccctaagaaaatagatttaacatccatccc

SEQ ID NO: 6808461 - DNA, 83 bp, Homo sapiens
actagttaggagttgggttaggtgtgaagtgtgttataattgttatttcactcagtataccataggtttcaaattcctctagt

SEQ ID NO: 6808462 - DNA, 67 bp, Homo sapiens
actagaagtttgggtccattaagaaaagcattttatcatttgttcactgatgtacctcaagcctagt

SEQ ID NO: 6808463 - DNA, 75 bp, Homo sapiens
tctgccttacctctggggcagtctgacactatggaatactctggtcaggctgaactgccacaaaggttgggtgga

SEQ ID NO: 6808464 - DNA, 69 bp, Homo sapiens
tgtcacctgcggagtgctgggagccatattgtactgaaagcttcaaggttcacagcttcttaggtcata

SEQ ID NO: 6808465 - DNA, 57 bp, Homo sapiens
ctcaagctctttaaacttatgtcatttatttggtatataggtagtgaggagtgtggg

SEQ ID NO: 6808466 - DNA, 63 bp, Homo sapiens
gaaattaaagcaggttatgaccatggcccgtgaggcatggttttatgactctgctgaaatctc

SEQ ID NO: 6808467 - DNA, 68 bp, Homo sapiens
ctgacatcccaactatgtccgagtaggccttccagtaatgttacttgaatgactagtgggatggttag

SEQ ID NO: 6808468 - DNA, 82 bp, Homo sapiens
tgaccctggctttgtatagttccctgaactgaaattgaccacattcatccgtcctttcagagctaactcggcaaggaagtca

SEQ ID NO: 6808469 - DNA, 70 bp, Homo sapiens
aagtctttgctattgtgaatagtgccacaataaacatatgtgtgcatgtgtctttatagtagcatgattt

SEQ ID NO: 6808470 - DNA, 107 bp, Homo sapiens
taaaaatgtctatgtagtatagaaacccagaaagatagtgtaactacttttatatcatacattatttttaaaagttcacacagatcttactttgtaatacatttttg

SEQ ID NO: 6808471 - DNA, 63 bp, Homo sapiens
gctgttgccattttatggttattaaggctgctagcctaggaactagtagatgtgtaaacatgc

SEQ ID NO: 6808472 - DNA, 130 bp, Homo sapiens
ttccgatgcactgcaattctttacagtgggtgcaacaaaggtctggaaacagcagggagaatcagggatatctcacctgcctccaggctctagatgtgaagacggcaggagagaaaagaaaaggaaggaa

SEQ ID NO: 6808473 - DNA, 84 bp, Homo sapiens
tttctctgaggtgcattctgaatctttgcagggtctatctgcctagcaggaatatgaggttaatatgagtgcatttgagaggaa

SEQ ID NO: 6808474 - DNA, 85 bp, Homo sapiens
tttctctcccctttgcagcacttttcagtttccagctttgtcattctgtggcctttgctgtgacaatgctgggaagggttagaaa

SEQ ID NO: 6808475 - DNA, 59 bp, Homo sapiens
tgtctctggcccatgagcagagtgggcttttaatccttagcctgagtgtttcagagaca

SEQ ID NO: 6808476 - DNA, 57 bp, Homo sapiens
tacattccccagcaggccttttgttggttgcactaactgcaaggttgctgggaagta

SEQ ID NO: 6808477 - DNA, 72 bp, Homo sapiens
gtttctgagggatgcagctgtgtgccagaggtaccgagaaatgccccatacacatgcatgtactccaggagc

SEQ ID NO: 6808478 - DNA, 71 bp, Homo sapiens
ggtgactccatgagtgagaagcgcacaaggcaagaagccttgctctgcatttgacatttagtggggtgact

SEQ ID NO: 6808479 - DNA, 93 bp, Homo sapiens
gtagtacttgcttcatagggctattctgagtaataatgggttgatttttctataatgcatttagaataattcatgacatttagtaagtattat

SEQ ID NO: 6808480 - DNA, 57 bp, Homo sapiens
tgcaggctagagtgaagacaaattacttgagaaaagtggtttgattcagtttatgca

SEQ ID NO: 6808481 - DNA, 61 bp, Homo sapiens
tgtggagccaagatcatgctctgctgatggaagcaagatgcatgatcctgagcaacccaca

SEQ ID NO: 6808482 - DNA, 90 bp, Homo sapiens
gcagcatgggtggtcctctgagcacgccaggcacgagtgtgcagggagctggtgcacatgcctctgtgtgcgggtgagcatctgtgttgt

SEQ ID NO: 6808483 - DNA, 62 bp, Homo sapiens
aggctcagatccttgtgtcctgccacaagaccaggttggggcgggaaggaggttctgaccct

SEQ ID NO: 6808484 - DNA, 58 bp, Homo sapiens
gcctgacagcactgcattattcttaagtgagttattacaaggatctgtgtaggcaggc

SEQ ID NO: 6808485 - DNA, 57 bp, Homo sapiens
gatgcaggatagcttcacccaggtagaagagaaaactggcatagtgagcttagcatc

SEQ ID NO: 6808486 - DNA, 69 bp, Homo sapiens
ctgggtttagggtctccccttgagaaaagcggttgggtggttggtgagggaagggggcttattccacag

SEQ ID NO: 6808487 - DNA, 98 bp, Homo sapiens
cagattaagaagactggaggggaaagttctgcacaagggaaaacaaaactaaggctaagttttctttctgtcattactttcctccctctcctttcctg

SEQ ID NO: 6808488 - DNA, 68 bp, Homo sapiens
tagtagttaagagaagagtatctagaacaaggatgcctaggttcagattctttctctttcacatacta

SEQ ID NO: 6808489 - DNA, 56 bp, Homo sapiens
ggcttcactcctcaagcctgggtgttagaggcaaccacaggtgggtcagtgaggcc

SEQ ID NO: 6808490 - DNA, 126 bp, Homo sapiens
ccctacagcttactggcacttggattttctttgaagatggcaaatttagaaacttattttctcatagttctggagtttgagcacttcaatatcaaggtgccagccaattcagaatctgctaaaggg

SEQ ID NO: 6808491 - DNA, 58 bp, Homo sapiens
tccccagtcgtgacaaccaaaaatatctccagatattgccaaatgtctgctggaagga

SEQ ID NO: 6808492 - DNA, 57 bp, Homo sapiens
tttatgacaagcattactgattttccatttctagaagtcagagaatgttttcatgga

SEQ ID NO: 6808493 - DNA, 93 bp, Homo sapiens
gctgttaagtattaaagattctgaaaggggtggggctggcgtcacgtttttcattgatccctgccccagctctgtcagtgtctagcacacagt

SEQ ID NO: 6808494 - DNA, 67 bp, Homo sapiens
gtgatgggagctcatagcaagacagtcagacccagcctgtctgagtgtatggaattagctcccttgc

SEQ ID NO: 6808495 - DNA, 64 bp, Homo sapiens
agcaaatcagttaagcttgaatgttggggaagtgatttctcttctcccaacttgactattttct

SEQ ID NO: 6808496 - DNA, 70 bp, Homo sapiens
tgggacattgcttgatgattcatagtaaggtcctttagacattaatgtgagttatctaagtacagtccta

SEQ ID NO: 6808497 - DNA, 70 bp, Homo sapiens
ggaggattggattgcgcagttttctccttgttgagaggaagctcttcctggagcgcccaccagctcctcc

SEQ ID NO: 6808498 - DNA, 57 bp, Homo sapiens
gcacagagaggctgtgagcgccagggctgggaatcaggagctcatgccctactgtgc

SEQ ID NO: 6808499 - DNA, 69 bp, Homo sapiens
cagttacatgggggttaggatgttgaactataatcataagtaaaacagtttcctgactcctatgagttg

SEQ ID NO: 6808500 - DNA, 62 bp, Homo sapiens
gtgcccaggtgtccctgagaagtctatctctgctgctactttctcagggccgcagagggtac

SEQ ID NO: 6808501 - DNA, 74 bp, Homo sapiens
gatagaagacgctgagagtggtggctcacagtaattctctcctccctgtcatgcacctctccatgtcccctttc

SEQ ID NO: 6808502 - DNA, 75 bp, Homo sapiens
ttggttaggttagacctattttctcagaatataccgctctgtaggattctgagttagagtcagccagaagaccaa

SEQ ID NO: 6808503 - DNA, 60 bp, Homo sapiens
cagtggaatacgagcagatgtcttgaatatgctgtgagcttggtcttttgtgttccagtg

SEQ ID NO: 6808504 - DNA, 77 bp, Homo sapiens
gatatgaatcagagaagccactggaggttgagatgtctctggaaagacatttaatgtcaactggtttgaagcatgtc

SEQ ID NO: 6808505 - DNA, 57 bp, Homo sapiens
gatttctgtggcttgtacatatgagggcttctctctttcctgtaaaacccagaggtc

SEQ ID NO: 6808506 - DNA, 70 bp, Homo sapiens
atataatgtaaaatgtgcttagacaaggctaaggtcacctagcctgtctgcgtcacgcttatttttatgt

SEQ ID NO: 6808507 - DNA, 104 bp, Homo sapiens
ttctgggagtacattttttaggggagagtaagaaagggcacagttgcttctcaggtagcgtgaggttgagagcccaggattctttcttccttaagaatccagaa

SEQ ID NO: 6808508 - DNA, 75 bp, Homo sapiens
aggcacgcggctttccagttctgggctggctgctgcagctcccctgcagacactggcctcctgaggctgctgttt

SEQ ID NO: 6808509 - DNA, 83 bp, Homo sapiens
cccaaattaattgtttaaaccatagagtcttaattattgttgagagtgactttcaagttaatgattctggtttggaatttggg

SEQ ID NO: 6808510 - DNA, 110 bp, Homo sapiens
agttatgcctcctttaaagcaagacagaccacgtgacagggccccaggatcgatttttatgcactaagggctctgcgcacggttctttttgcaaatgaactggtgtgtct

SEQ ID NO: 6808511 - DNA, 64 bp, Homo sapiens
agcaacaccatcttctgtggcttatgagcttttgacttgtcagcaacagtgggtgagtgttgct

SEQ ID NO: 6808512 - DNA, 75 bp, Homo sapiens
tattttctttccgtttaaaatgttttaacatgagtgattacatcagttctaacagtttagaacaaagggaaagtg

SEQ ID NO: 6808513 - DNA, 80 bp, Homo sapiens
gtttttgttaaggttgagctcacttttattatggaaacacaacctccagagtttatgaaagtgaagcttatgaaaaaaac

SEQ ID NO: 6808514 - DNA, 82 bp, Homo sapiens
tccttaggctgggaactctgcttgcagatgagaaataaacctacctctctccagggcatgagttccacagtgaaactgagga

SEQ ID NO: 6808515 - DNA, 58 bp, Homo sapiens
gaaggatcaggctgaacctggaacttttcctgtaagtgcatctttgcttggctccttc

SEQ ID NO: 6808516 - DNA, 62 bp, Homo sapiens
ccatctgtcaagatagactctgcattacagagaagatggtggtgaggtctgctgacagttgg

SEQ ID NO: 6808517 - DNA, 73 bp, Homo sapiens
gaaggatgtatagggccatgacaccactcctgatgatactacaatggtggacgcatgtcattatacatttgtc

SEQ ID NO: 6808518 - DNA, 81 bp, Homo sapiens
tcagttgtgtcaggggcccatactcaggaacctacagaaaaagatttacttcctgaggccaatgaccctgggcaggactga

SEQ ID NO: 6808519 - DNA, 64 bp, Homo sapiens
ttctttggtcatcatgggaagcaaggacttcctcagcccctgcccctctcctgtgatccaagaa

SEQ ID NO: 6808520 - DNA, 91 bp, Homo sapiens
gggcaaggctaaaggtctgggggtggttgggggcctggttccaggcccagctctgccatctacccactgtgtggctttaaagggcttgccc

SEQ ID NO: 6808521 - DNA, 63 bp, Homo sapiens
tgtgttgttttaagctgctgcatttgtagtactttgttgtagcagccatagggaagcaataca

SEQ ID NO: 6808522 - DNA, 80 bp, Homo sapiens
ggagcagaactactcttctccattcattttactctcacaagagcttcaagaggtaggatgggtggagatgatctacctcc

SEQ ID NO: 6808523 - DNA, 55 bp, Homo sapiens
ggctcagtggctaaacacccacttctctggggagggtgacatttcccaatgagcc

SEQ ID NO: 6808524 - DNA, 97 bp, Homo sapiens
gttgacaatgataatggctgtatttattgagcacttaattatgttccagactctgtgctatgtgttttacatgcattatctttgtaatcatcacaac

SEQ ID NO: 6808525 - DNA, 64 bp, Homo sapiens
ttgattctaggcttgaaacatgaagcagttttccggttttcttcacaaatggcctagagttcaa

SEQ ID NO: 6808526 - DNA, 55 bp, Homo sapiens
aggccatgggatttccaattggctgtcaaaaaggaaagttctgagtccctggcct

SEQ ID NO: 6808527 - DNA, 114 bp, Homo sapiens
gccaataggaccctccagatccctgcccagcaggctggacttcagtcccaaggtgataactagaacaagggggccgagcctagtctgtccagcagcgggtggaggagccgcggt

SEQ ID NO: 6808528 - DNA, 63 bp, Homo sapiens
catgcccttatgcttccctgaggatcttatctaaatgagatagccacagaggcatcttgcatg

SEQ ID NO: 6808529 - DNA, 87 bp, Homo sapiens
ctccatcttggagtgagtgctattgtaaccatcctttccagcctatttctggaaaatagcaatcagggactctctgtagggctggag

SEQ ID NO: 6808530 - DNA, 63 bp, Homo sapiens
agaaaatcatgttggcacaataaaaccactcttggtgtttgtttttccaatatgtatgcctct

SEQ ID NO: 6808531 - DNA, 60 bp, Homo sapiens
gaaggaacctgagggaccccaaactcagccactcttgtagtttccctctccggttctttt

SEQ ID NO: 6808532 - DNA, 77 bp, Homo sapiens
gaagtgcagaagggtagggcaagaggtgcccagcaaggctttgggcaagcacaaggccctgaccttcactgactctc

SEQ ID NO: 6808533 - DNA, 63 bp, Homo sapiens
gcacttcatgactttgtcaaattacttatcatattctgtagggtgacatagctcttggggtgc

SEQ ID NO: 6808534 - DNA, 87 bp, Homo sapiens
tttatgtcccaagggtgccagagtgccatcagtgccatctagtggcagtcatggtgaactgagggtacctggcccctatgatgtaaa

SEQ ID NO: 6808535 - DNA, 60 bp, Homo sapiens
gatgtgtcatttggtcatctgcttactggcattgggttagaagatgtctatttgactatc

SEQ ID NO: 6808536 - DNA, 77 bp, Homo sapiens
ctgagggattgactcatgggcttgaccctacagaaagttatgaactggtctgtgtgtttgccctgtcccttctttag

SEQ ID NO: 6808537 - DNA, 56 bp, Homo sapiens
ctctgaacaacttgtcattccaagaaacacttgtgaagaacagtttgttccttgag

SEQ ID NO: 6808538 - DNA, 127 bp, Homo sapiens
ggagccaccacagctcattcgtggaggtgtctaatcagctatgctaattgattgtcgtgtctgcaatatcagatgcatgcttaattagcacatgaactctcctgtcagatattcctggaggggctct

SEQ ID NO: 6808539 - DNA, 59 bp, Homo sapiens
gcttctggaagctgcttctgcctgcctctgtgttcatggcagtagcaataattagaagc

SEQ ID NO: 6808540 - DNA, 57 bp, Homo sapiens
gtgtctcatgtgaactctgcagaagaaaaagtttctgccagaactccattagaaaac

SEQ ID NO: 6808541 - DNA, 74 bp, Homo sapiens
gcactccccataagacatgtccaggctgtgagggggactcagactcgcccatgtttctttatgtcttggtttgc

SEQ ID NO: 6808542 - DNA, 70 bp, Homo sapiens
gcttaagcgagcacattgagtgaagaatagcatctagcagtttgctcattcaatgtgcattgccgatagc

SEQ ID NO: 6808543 - DNA, 65 bp, Homo sapiens
aatggtaaatgaaacagtctccagacttggatgacaccatcagaagtctggactgcttctccatt

SEQ ID NO: 6808544 - DNA, 87 bp, Homo sapiens
cagcgggctcagagtgtgccactgcctgaggaccctgaagagtgagtggtggcccgggcggtggctgcctgcaccctgtgctttctg

SEQ ID NO: 6808545 - DNA, 57 bp, Homo sapiens
tccactggtaatacctagatccctttttggcaaactatcaggtaatgcgcagctgga

SEQ ID NO: 6808546 - DNA, 73 bp, Homo sapiens
cgggaggtcacgactgggatgcctgtgctttagaatgtgtttacgggaagggaaaaccagcgtgacttcactg

SEQ ID NO: 6808547 - DNA, 65 bp, Homo sapiens
acctacaactttctgttaaatgttagtcattctgatgagtaaaaagttcagaatggttgttgggt

SEQ ID NO: 6808548 - DNA, 63 bp, Homo sapiens
agttaagggaatcctaggtaggctgtatgttttgcttccctttctggtgacttctctggtgct

SEQ ID NO: 6808549 - DNA, 59 bp, Homo sapiens
gctgggaatgtgagcattcattcagatccatccccatctctgagaaaaatattcccagc

SEQ ID NO: 6808550 - DNA, 64 bp, Homo sapiens
cccacagcttcacccattatccctgccttcaccctcaattcagggcaaatctgaagactctggg

SEQ ID NO: 6808551 - DNA, 63 bp, Homo sapiens
gctgaggcaggaggatcatggatgcagtaagccatgactgcaccactgcactccagcctgggt

SEQ ID NO: 6808552 - DNA, 84 bp, Homo sapiens
cctttcccagctctatgacattataaaggattattgtgaaaatgacagtagggtttgggagttactagtaaagctggctaaagg

SEQ ID NO: 6808553 - DNA, 56 bp, Homo sapiens
agctgtaatataagcaatgaaaagaccgttcttcacatgtgtcttgtgttactgct

SEQ ID NO: 6808554 - DNA, 62 bp, Homo sapiens
agccattttcgtgtttggcatcttcatgcaggcgtcaggaagctgaattacaaaaaggagct

SEQ ID NO: 6808555 - DNA, 56 bp, Homo sapiens
cccaagatctaggacagaaagactcatgcagtaactcctgccttacagatctgggg

SEQ ID NO: 6808556 - DNA, 65 bp, Homo sapiens
tttagtgctttgctattcatggagataggcctggatagtggctgaacagaaagcagggcagtaaa

SEQ ID NO: 6808557 - DNA, 69 bp, Homo sapiens
ccaatcccctctttgccagcatctctgcctggcctacctagctgagcaggccagcaatggaagggatgg

SEQ ID NO: 6808558 - DNA, 63 bp, Homo sapiens
aaagaacattcgcctcaaaccaggatatctcaacgattggcgtttgaaagtgggtgattcttt

SEQ ID NO: 6808559 - DNA, 87 bp, Homo sapiens
tcaatttaaactcttcatgtcttgcctgatatatcctaggtataagcctaagaaaattgccttaagtaagactgaacagtgccttgg

SEQ ID NO: 6808560 - DNA, 79 bp, Homo sapiens
cagggttgggattggaactggggcttttgcacgtgggaggcatgccctgtcccccacccatgccctgtcccccaccctg

SEQ ID NO: 6808561 - DNA, 63 bp, Homo sapiens
gaggacacctggcctggcaaggagtgagtgctggtttcagtcctgccttggtggggtggtctc

SEQ ID NO: 6808562 - DNA, 61 bp, Homo sapiens
tttctgctgtcactcatttgcttcagggctgacttgttttgaagccagtgggcagcagaga

SEQ ID NO: 6808563 - DNA, 63 bp, Homo sapiens
gctgttttggagaaccatgaaatatgggcttgtagcccatttacattgtactctgtgacatgt

SEQ ID NO: 6808564 - DNA, 56 bp, Homo sapiens
tttattaatctgtttatgctgtcaaggaggaaacttgaccagtgcagataagtgag

SEQ ID NO: 6808565 - DNA, 83 bp, Homo sapiens
acagtagtaggtcagtgatcattcagtctctgggacagtcaatggacagacgtttacagctctgagtgctaaactgctactgt

SEQ ID NO: 6808566 - DNA, 78 bp, Homo sapiens
ggctcagccctgtgaggccctgggtgctggacagaaagactcttgctcctccagccacctcagtgctctcagctggcc

SEQ ID NO: 6808567 - DNA, 92 bp, Homo sapiens
aggttggtgcaaaagtaattgcggtttttaccattatttaacttttgccattacactaatggcgaaaaccacaattacttttgcaccaatct

SEQ ID NO: 6808568 - DNA, 77 bp, Homo sapiens
cagaggaggatgggactaagtgtcctgttgggttccataactctccaggactttggcccaattacttaccgcctctg

SEQ ID NO: 6808569 - DNA, 74 bp, Homo sapiens
ggtatgtatttagggttttcaaaagagataataagcaattgctaataattatttgaagacattagagttggacc

SEQ ID NO: 6808570 - DNA, 73 bp, Homo sapiens
ctccagcctcagcggctggaattcgggtgccccccttcctcgggagctggagaaactgcagctgaggcgggag

SEQ ID NO: 6808571 - DNA, 55 bp, Homo sapiens
tcatgagatatttgccaagagaggtggatccactggtttataacatgtctcatga

SEQ ID NO: 6808572 - DNA, 78 bp, Homo sapiens
ggagactagcaggaaatttaagagtgtacaataaaagttaacttatttcatggtttaaaatttcttccagctgtctcc

SEQ ID NO: 6808573 - DNA, 73 bp, Homo sapiens
ctctggccctgctggagagccttggccaaggcccttccatctctgggtctgcctcttcctcccagggccaggg

SEQ ID NO: 6808574 - DNA, 85 bp, Homo sapiens
tatcctctgtcctaagacagcaggtaattagttaacataaggccttaaagatgtaagtaaatttctgttgtctggatacttgata

SEQ ID NO: 6808575 - DNA, 72 bp, Homo sapiens
tctcactagtaggcctctgatgaggttgagcatcctctggttggcttctccctcagagtcctggctatggga

SEQ ID NO: 6808576 - DNA, 106 bp, Homo sapiens
aactgtgccaaaaatagctttgaaatttccacttgaattcttagaaagggcccttttctctccatttccatctgaggaaaagaggaggtagcttattttcacagtt

SEQ ID NO: 6808577 - DNA, 77 bp, Homo sapiens
cgtgctagatggtagtgtggctgattgacatggtcagctggaggagaatgattgtgtgttagccatcaatggacatg

SEQ ID NO: 6808578 - DNA, 66 bp, Homo sapiens
gatgctgtatgccaggctccagcttgcacacagcccccagtgcaggcagcttggttgcagaccatc

SEQ ID NO: 6808579 - DNA, 61 bp, Homo sapiens
agaaaggatatggcaggatctgttgttcatttgtgtttattagaatgctattgtcttttct

SEQ ID NO: 6808580 - DNA, 58 bp, Homo sapiens
ttctcattagtcatttaccatgtagggcgaataggaggcccacagatgctgataagaa

SEQ ID NO: 6808581 - DNA, 70 bp, Homo sapiens
tcctgcaggccaagccctcgcagagagggcctggggtgagagcaggcatctccgtgcagcttggccagga

SEQ ID NO: 6808582 - DNA, 63 bp, Homo sapiens
aagtacagaaggagcgaacaattggtgcttagcaggagccctaccttcctcctctctgtagtt

SEQ ID NO: 6808583 - DNA, 60 bp, Homo sapiens
ggtcccaaactcctgacctcaggtgatccactcgcctgggcctctcaaagtgctgggatt

SEQ ID NO: 6808584 - DNA, 72 bp, Homo sapiens
gacatttttgagactacaatttttaatgagatgcacattccttttctcatgtaagccttgtctcagggggtc

SEQ ID NO: 6808585 - DNA, 90 bp, Homo sapiens
gtgtcctattctgctactgaatgatgatctagcaagggggaaaaattgcttctgaaatgcaggtcttcataagacaaaggaagaggatgc

SEQ ID NO: 6808586 - DNA, 61 bp, Homo sapiens
tctaaacagtactggacaaggagtcaggggatctgggttctgataccagcactgtgacaga

SEQ ID NO: 6808587 - DNA, 103 bp, Homo sapiens
ttgggttaggctgggagtgggacagggcaggaaaggttcagtgattgaaaattgctttttagttccctgaaacttttggccactaactttgagcatatcccag

SEQ ID NO: 6808588 - DNA, 66 bp, Homo sapiens
tctggaaacagatcataactaagccaatcacggaaacctcatccgcttatgagtgatttgttcaga

SEQ ID NO: 6808589 - DNA, 55 bp, Homo sapiens
cagtgcttggtccatgtctgtctttccgtttagactgagaacttgccaaggactg

SEQ ID NO: 6808590 - DNA, 59 bp, Homo sapiens
aaacacactgacctcctttgtggttgttgaggatgatcacagttgaggtctggttgttt

SEQ ID NO: 6808591 - DNA, 86 bp, Homo sapiens
ctcctcccataacctttgggtttgctcctgggaaagcagaaaagacacagtcccatctccaaggagcagatccagaggacgaggag

SEQ ID NO: 6808592 - DNA, 81 bp, Homo sapiens
ttgccagtagattgaagagtgcttgccttctcatcataaaacttatgatacagagaaagcatcttttccaagacttggcaa

SEQ ID NO: 6808593 - DNA, 57 bp, Homo sapiens
tatcagtttattctataaatagtgaaccatcactttattattaggagtaaagtggta

SEQ ID NO: 6808594 - DNA, 56 bp, Homo sapiens
ctgcagttggctgagaccccccagggttatttctcctggtctcagtgcagctgcag

SEQ ID NO: 6808595 - DNA, 99 bp, Homo sapiens
gaggccctttgcggactggctggccgcgctcttcgcacggggcgcttttgcgtggggtcgcgcaggagccgcggagggccggatcgctgagggagcgtc

SEQ ID NO: 6808596 - DNA, 60 bp, Homo sapiens
ccatggtctctgtgaagcctgtatcgtgtttatcattctatagttcacatagacccttgg

SEQ ID NO: 6808597 - DNA, 60 bp, Homo sapiens
ggtcatgttggctgaggctgtatttgtttttgacatgtagaggtcatggccagtatgatc

SEQ ID NO: 6808598 - DNA, 67 bp, Homo sapiens
agtagtttacaacatgccaactgggctttatttgtagcctatatcacagcattgtgtgtgaaaagct

SEQ ID NO: 6808599 - DNA, 86 bp, Homo sapiens
taagcaattctggattgttgaaggctggcaatatatttgttacaacatgtaatgagtgcaaaagttacaaaccaaggattgtctta

SEQ ID NO: 6808600 - DNA, 72 bp, Homo sapiens
tggcattgtattcagttacaggtcttctttgtagactttaaaaacacaagcttgccaagtgaatacaagcca

SEQ ID NO: 6808601 - DNA, 58 bp, Homo sapiens
tgctgttttcccatagctggtcattctctgtttggctgaatgctaaaggaaaacagta

SEQ ID NO: 6808602 - DNA, 79 bp, Homo sapiens
tgtgtgacccgtgctgtgtgatccatgctggccatgtgacccatgctggccgtgtgacccatgctggccgtgtgaccca

SEQ ID NO: 6808603 - DNA, 97 bp, Homo sapiens
gcttttcactttatggtatattttgctctatggtggggagatggttctgggctcatgttgacgccagagagaaacagaatgtgctgaaagtaagagt

SEQ ID NO: 6808604 - DNA, 58 bp, Homo sapiens
gcaggcttccagccaggtagcccaggaggctgggctgcaggggttgagagctccttgc

SEQ ID NO: 6808605 - DNA, 130 bp, Homo sapiens
gagagacgagagacagaggtgggtccaggtgatattcaagaccgcggcccagttgttccaggtgtgaggctctggcctttctggcactgggctgtgtgagcccactgacccccttgctcctcaggctgtc

SEQ ID NO: 6808606 - DNA, 65 bp, Homo sapiens
ggttggaacaaagaacatggtaggataacaaaatattttttgtagcctctgtagttcatccagcc

SEQ ID NO: 6808607 - DNA, 58 bp, Homo sapiens
gcccttagtcagcactttcacttcagtcactgtgattgcaaagttctgactgtagagc

SEQ ID NO: 6808608 - DNA, 89 bp, Homo sapiens
agttataatatatcttctcaaagtatttgtttaaatatggtaagaaattttcacaaggaggaggtgctagagaagatgttgttctggct

SEQ ID NO: 6808609 - DNA, 77 bp, Homo sapiens
tcccagagggattgctatatttagggaaagtctttcttaactagtgaaagactggaaggtgaggctgtttactggga

SEQ ID NO: 6808610 - DNA, 63 bp, Homo sapiens
gttttgagtagtttaaagcttgctgtagcttgtatgctgaagaatgtttaggctacttaaaat

SEQ ID NO: 6808611 - DNA, 80 bp, Homo sapiens
acattttcttggtgaagaaactggtgcattggtttacattctagtgcaagctccataatcttcaacagactccaaaatgt

SEQ ID NO: 6808612 - DNA, 104 bp, Homo sapiens
aagtcaattggttctgttttatttgactttgcaaaataatgctgatttgagaaaagtcatcacaattgcctaaagttctgtgaaataatgatgtggtgtggctt

SEQ ID NO: 6808613 - DNA, 85 bp, Homo sapiens
cttgggaaatcagctcaagaaaatgctgatactctggctactggtacagctgtgagtaataaagtcattttttctctgacccagg

SEQ ID NO: 6808614 - DNA, 57 bp, Homo sapiens
tttttttctcttggcttaggtttcatatccatccttgaatgtgcccaggggaaagaa

SEQ ID NO: 6808615 - DNA, 120 bp, Homo sapiens
tccagagcctgtggagctcactttagcaggcacacaataaatgtttgctgatgagtcattcatttattcatctaataaacatttactgaggcctactaatgtgccaggctgggctctgga

SEQ ID NO: 6808616 - DNA, 57 bp, Homo sapiens
ggctgcattgctataaaatacaatccattcctttttgttaacaatagcaatgtagtt

SEQ ID NO: 6808617 - DNA, 79 bp, Homo sapiens
tagaaacagacgtgaacccacagggtcattttagggtatggctttcctaatgtcagtgacctggtttaatattattcta

SEQ ID NO: 6808618 - DNA, 69 bp, Homo sapiens
gcagctgatggaagtcctattggcagacagccttctctcatcagccccttcaggacttgcctcagttgc

SEQ ID NO: 6808619 - DNA, 88 bp, Homo sapiens
agagattagaaggcaattttcacataaaagctccaaagaaacatgttgttattctgtggaagttatttgattgttcctcatagtcttt

SEQ ID NO: 6808620 - DNA, 81 bp, Homo sapiens
ggtactgatctagatgctcaggatgcaggaataaaccaaaagagacaaaggtttctgctgtcctttatatagattacagcc

SEQ ID NO: 6808621 - DNA, 79 bp, Homo sapiens
ttatttttgacagcataatcctacacccatgggagctgagctttacaggtgttaaagaggatttgttgtaagaaaatga

SEQ ID NO: 6808622 - DNA, 55 bp, Homo sapiens
agcccagcaggacagagtggtttggaatgcagcattcagtgtgttctgtttggct

SEQ ID NO: 6808623 - DNA, 57 bp, Homo sapiens
gccagctgaatttccaactgtttcaagtttttgaaacaggagggttttcagatgtgc

SEQ ID NO: 6808624 - DNA, 60 bp, Homo sapiens
gttggaaggtgaggtaaggtcttgtaggtccctgcaaggacactgtcttttacttgaaat

SEQ ID NO: 6808625 - DNA, 95 bp, Homo sapiens
gcatccatgtgggctgtgcatgcatgtgcatatgtgcatggatatggatgttcatgttcatatgtgtatatcagtggctgcccacgcttgaatgc

SEQ ID NO: 6808626 - DNA, 63 bp, Homo sapiens
ggcctgatttgaactctgggacttgtagagcaatggttataggaactggttctagattcagcc

SEQ ID NO: 6808627 - DNA, 117 bp, Homo sapiens
taaaataataatatctatttttttcaatattatgaagattgtgcttggcctgtaataggtgctcaatgattggtggctattagtacaattatttttattattgtcattattgtttta

SEQ ID NO: 6808628 - DNA, 57 bp, Homo sapiens
ttctgccctggctcctcccacgctggggatctcagcacatggatggagttaggagaa

SEQ ID NO: 6808629 - DNA, 68 bp, Homo sapiens
ctggggtgggtctggaaggagagcttcctgcagtgaagaactccgatgcttccagggccacctgccag

SEQ ID NO: 6808630 - DNA, 64 bp, Homo sapiens
ggaaaggctgagacagcacaggtcccaaagcccagaggctgggcgtgcattactcagcaaatcc

SEQ ID NO: 6808631 - DNA, 68 bp, Homo sapiens
gctttgggtgggtgagcgtggagcggcatatgggtgatgttctgcaagccctgccacctgccctaagc

SEQ ID NO: 6808632 - DNA, 55 bp, Homo sapiens
gtttcctgtctgctttactatagcaggtgttctaggtaagaaagggcaagggaac

SEQ ID NO: 6808633 - DNA, 85 bp, Homo sapiens
tcaaagtgcaagcccagctgaaagcatttttttagtaattgtgacggaatgagtgtgaagttagctcagtgtgtgtgcactttga

SEQ ID NO: 6808634 - DNA, 62 bp, Homo sapiens
gcagcaaaattgaagtcaatgtccaatactgaggttggtggactgattttcattttaaatgt

SEQ ID NO: 6808635 - DNA, 68 bp, Homo sapiens
tcagcctaagtcagtactctgccatgccgttagtaagatggccctggaaagagcttgagttattctga

SEQ ID NO: 6808636 - DNA, 75 bp, Homo sapiens
gcacattcatccatagcttgatctgttcccttggagcaaggaaggggaactgaggaacgaactgggaaaatgtgc

SEQ ID NO: 6808637 - DNA, 66 bp, Homo sapiens
agattttttccgtttggtgttccgctagtctttgaaccctggtggcatggaccttggaagaattct

SEQ ID NO: 6808638 - DNA, 56 bp, Homo sapiens
gattatgactgtcctagaaaaatcttgtacagatggcataggtatagtacatagtc

SEQ ID NO: 6808639 - DNA, 65 bp, Homo sapiens
cacccagagcctgagagggatagtaaaacaatcactactttatgtaaacctgtaagttctgggtg

SEQ ID NO: 6808640 - DNA, 60 bp, Homo sapiens
gaggaagaatcagggtggtgaggcaattagtaggtgttctacaatcctgacatctttctc

SEQ ID NO: 6808641 - DNA, 60 bp, Homo sapiens
ggatcacctgtgtatctctgtatgtgcacactgctgcagggcacacgcacgggtgtgtct

SEQ ID NO: 6808642 - DNA, 57 bp, Homo sapiens
atcattgaatttggttcaatatgcagaaatttgtgtaaatgagcctagattcaagat

SEQ ID NO: 6808643 - DNA, 56 bp, Homo sapiens
gagggaaggtcacccttgtagcccctgtcacctgctaccttgggaggcattccctt

SEQ ID NO: 6808644 - DNA, 115 bp, Homo sapiens
agggctttgtgaaatcaggtattgctggctgcagtagcaagagactcctaatcctcactgcaggactgcctctaaaatctgctcacgtctgtgtctgcctggttttcactcacct

SEQ ID NO: 6808645 - DNA, 110 bp, Homo sapiens
tgtgggcgtgtgcaaggaatctgtgaaccgacaggggaagattgtgctttcttcagaacacggcttcttgactgtgggttgcagagaaggaaaggtctttgctgccagca

SEQ ID NO: 6808646 - DNA, 59 bp, Homo sapiens
tcttggtgcctcagaccttgtgatccattggcacagcagcggtgtgcaggccccgatga

SEQ ID NO: 6808647 - DNA, 129 bp, Homo sapiens
ccactttagccattcaggccatgctgcctgtattgtgtattcagcagttcctattagatgtcttcacagtgagtgattctgtagggcttgctgacacccgcttcatgcatggcctgctgtgctgggtgg

SEQ ID NO: 6808648 - DNA, 58 bp, Homo sapiens
tagatgtggtggtttctgttgaataacccttatggtggtcaattttctacaacatttg

SEQ ID NO: 6808649 - DNA, 84 bp, Homo sapiens
agggacttcatctttctgagcctcagttccctcatctgtgaaatggggttaatcagaaggctgacaagatatgggttagtccct

SEQ ID NO: 6808650 - DNA, 67 bp, Homo sapiens
caagtctgcctgctgcccatcggctcttcaactcacagctgagttaataggtaacccagcagacttg

SEQ ID NO: 6808651 - DNA, 102 bp, Homo sapiens
agtggttatttgaagcatcgtgtgctcagtggagcctgagactagcctctgatgtgaatattctgaggaatcttgacacatttgacagtcaggtagctcact

SEQ ID NO: 6808652 - DNA, 112 bp, Homo sapiens
tcccttggagctgcattctctagtccaaaaacaggcttagggcttgggcccggagctcaggcctgggatccaggggctgagatgatggggctggtgggtgctatcaggggga

SEQ ID NO: 6808653 - DNA, 63 bp, Homo sapiens
atatgaaaatgttttagctgtaggatgtactcttaaggttcccaaagcaagcagttttcatgt

SEQ ID NO: 6808654 - DNA, 99 bp, Homo sapiens
gagaatactgactctaaatctttatacattttgctgggacttattacttccaacactcttaggaagtcacagaagcttgaagattttcccggtgttttc

SEQ ID NO: 6808655 - DNA, 62 bp, Homo sapiens
tcttattttaaagtgaagggtcttgtcattttagtgtaagagccattcaagttaatcttaga

SEQ ID NO: 6808656 - DNA, 56 bp, Homo sapiens
tagagcagggctggtcctcaatagcctgggcatgaggagccaggaaacctgctctg

SEQ ID NO: 6808657 - DNA, 61 bp, Homo sapiens
atcactgtggaaaactgtatggcagttcctcaaaaactgaaacatacaattaccataggat

SEQ ID NO: 6808658 - DNA, 75 bp, Homo sapiens
tcattgggatatacaatggctgaatcatccagtgggaaaaatttcttccctggcttaaagccagttgtccagtga

SEQ ID NO: 6808659 - DNA, 64 bp, Homo sapiens
gaggagcaagaaatagtgcccattatcttctgtgataacacagcatctgattacttgttctctc

SEQ ID NO: 6808660 - DNA, 64 bp, Homo sapiens
ctgcctcctcacgtccacagtggtgtgcacccggaagcacaggcttgaggacgatgagcggcag

SEQ ID NO: 6808661 - DNA, 84 bp, Homo sapiens
accttgcacatgcatgtctatgggcaggtaactgtatgcaatatatagactaacatattcatgatatatgcatgaacaaaaggt

SEQ ID NO: 6808662 - DNA, 77 bp, Homo sapiens
cttggttagccagaaaaatcctcccttgtccttccctaagccagcatgggtgggattttccatcacttgcaaccaag

SEQ ID NO: 6808663 - DNA, 123 bp, Homo sapiens
tttattcattctacatttcagaactcttgtagtttatgtagatgtgtctgtatattattatacttttattttactttaaagcgagagaaaagactgatatgtgaaaggtttctattgaataag

SEQ ID NO: 6808664 - DNA, 55 bp, Homo sapiens
atgtagagcagtgttgtccaatagaactccctgaaatgataacactgttttatat

SEQ ID NO: 6808665 - DNA, 87 bp, Homo sapiens
tttcaggtatattttgtatatactcttatgctgtacccaaattaaaggtttaaaacagaagagtgtataattttaatatatgagaaa

SEQ ID NO: 6808666 - DNA, 59 bp, Homo sapiens
gggttgtgaccctcgggacagtttgcaatatctacagacatgcttgtttttcacaacct

SEQ ID NO: 6808667 - DNA, 58 bp, Homo sapiens
tttgctacattcttagttgggaaaatgaatccagcactattttccagaatgtagtaag

SEQ ID NO: 6808668 - DNA, 60 bp, Homo sapiens
ggtaggtctgggacttggctgggcaggggatagctggaacagccaagaacaggcagaacc

SEQ ID NO: 6808669 - DNA, 63 bp, Homo sapiens
caggccgagggaagcaggctgcaaaaacatcacaaccgggcaaagttctcttccttgggcctg

SEQ ID NO: 6808670 - DNA, 66 bp, Homo sapiens
agggtgcagaagggttgatacaacaggactggtcttgccttctcctcagcagcttttgcagtccct

SEQ ID NO: 6808671 - DNA, 86 bp, Homo sapiens
ttctagtcactgtccacttcatgtagtccatcaggttaatgcacttcggaaatgtgacttcctatactgaactggactgtctagga

SEQ ID NO: 6808672 - DNA, 55 bp, Homo sapiens
ctcaccttccccagaggggcttaccagagccaggaccctgtgttgggagtgtgag

SEQ ID NO: 6808673 - DNA, 68 bp, Homo sapiens
tcacatggacactggtggatatggaatggcttttttctgcgcaattcacatccgaccaggtcaagtga

SEQ ID NO: 6808674 - DNA, 56 bp, Homo sapiens
gttcatgctaccctttcctaatttgtggaggctaaacagaaggaatgtggcggaac

SEQ ID NO: 6808675 - DNA, 66 bp, Homo sapiens
cacgcactgtttaatttaggattaggtaactaaggaaatatctacctctaaagtacagtttgtgtg

SEQ ID NO: 6808676 - DNA, 100 bp, Homo sapiens
gatttggggtggagagttctgtaggtgtctattagatctggttggtgcagagctgagttcaattcctggatatccttgttaactttctgtctcattgatc

SEQ ID NO: 6808677 - DNA, 77 bp, Homo sapiens
gacacaggcctcatttgggggtctcctcaggcacttcccccttggctcctgaggccagaacccgaccctgctgtgtc

SEQ ID NO: 6808678 - DNA, 98 bp, Homo sapiens
cgctggctcggagctccttcaccaccacctgggcgggggtgtagtcggagaaaatctctcccaggatcacctggtcaaggggcacccaggagtcagcg

SEQ ID NO: 6808679 - DNA, 123 bp, Homo sapiens
taacagagaagacatcactgatgataccaacagagagaccagaaacaggccatctggaagatggagatagtgtgtttgtttgtttgtttgtttgtttgtttgtggtagagtctcactctgttg

SEQ ID NO: 6808680 - DNA, 93 bp, Homo sapiens
tttgctttgcctctgtacatggaacaagaactcagatttacttctttggtacatgaaggattagttccatgctgtcagtctaggagaagcaaa

SEQ ID NO: 6808681 - DNA, 68 bp, Homo sapiens
ctgaagcagggagcagtctttgcaccgatccacacaactcggtgtcagctcttagcattttgtgtcag

SEQ ID NO: 6808682 - DNA, 83 bp, Homo sapiens
gtctttctcagcctgttgttctcttgttagccctttgatgtttcaaagctgacgaggtcagcatcttccaggctgcaggaaac

SEQ ID NO: 6808683 - DNA, 68 bp, Homo sapiens
tgactaatccatggtgctttgtttaaacccagtttttactgggttaatagaatcattaactgaggtca

SEQ ID NO: 6808684 - DNA, 88 bp, Homo sapiens
ggtcagagatggaatctgtctgggtgcagcagtccgagcttgcacacaggagggacagctgctttcaggccacagcgccatcctgtct

SEQ ID NO: 6808685 - DNA, 97 bp, Homo sapiens
gatatgaggaaagcaagagaatctgctgtgaaaggtgaatatttcagaaatacttgtagtatgcatatttcaaagtaagttatgctgatatcatgtc

SEQ ID NO: 6808686 - DNA, 66 bp, Homo sapiens
cccacagccaggccacctggggcaggaactttccatggctctctgggaggtcctggctagaagggg

SEQ ID NO: 6808687 - DNA, 85 bp, Homo sapiens
gtggtagaaagattgaagggtcttatgtacccctattgggtgtggggtatataggaactctttaaaaaagagtttgatctaccat

SEQ ID NO: 6808688 - DNA, 129 bp, Homo sapiens
tatattcagtgaagagagaataataaaagtgcattgagatgtgggtgtcaggcagtgagctagaattacccattagctacatgatttgttcccacacatcagcttgtctgtgtgctcaatttgaatgtg

SEQ ID NO: 6808689 - DNA, 83 bp, Homo sapiens
tgtgcaaggataaataagacagctgtctttctgtttacaaaggatctttcaatggttctaggttagaaggacagattggcaca

SEQ ID NO: 6808690 - DNA, 84 bp, Homo sapiens
caggttctccatcacctgttacgagggaataataataatacctattccctgctttcttgtgaggggagatatggaaagcacctg

SEQ ID NO: 6808691 - DNA, 88 bp, Homo sapiens
cttggagaaggcatcccattggatcccctgctttggaatgggcatcacttcatgcagggcatagggtccagtttgaccttgagctaag

SEQ ID NO: 6808692 - DNA, 67 bp, Homo sapiens
tctcctggacagtttgtaaatatatatcaaaatgttaaatgtgcatgtgcgttgactgtccatggga

SEQ ID NO: 6808693 - DNA, 61 bp, Homo sapiens
ggctgccctcgtctactgcccatgctgtcctcacagacctttcagagaagaggtgttagtc

SEQ ID NO: 6808694 - DNA, 62 bp, Homo sapiens
cttttccagtaccttgggacccagcagccatgctgtgaaaaagcccaggctacatggagagg

SEQ ID NO: 6808695 - DNA, 107 bp, Homo sapiens
gggagaggcacccctcacctcagagggcagctggagacctcctgtgtgaggagggcttggcctccttcctggggtctctgctgctcaggcagggggctccctctccc

SEQ ID NO: 6808696 - DNA, 61 bp, Homo sapiens
tcaggatacctcagttttagctgtgtgcttttgtgtagtgaaatgcagtgaggtcttgtga

SEQ ID NO: 6808697 - DNA, 93 bp, Homo sapiens
gctgcatgggctaaacttagaggatataaaacaagcacagtcttaaacagggtgaagataagcatgttttctagagtttaaaatctgtgaagt

SEQ ID NO: 6808698 - DNA, 80 bp, Homo sapiens
tttgtaggtaatggatatgtttagtaccttgatgatggcaatggtatcacaggtgtatgaatatgtccaaatccatcaaa

SEQ ID NO: 6808699 - DNA, 88 bp, Homo sapiens
ctgtcaagcttccataagagttttttctctcctcattattgaaatatacgctcaagagtagaactagaattcttcaagggtttggtag

SEQ ID NO: 6808700 - DNA, 78 bp, Homo sapiens
tctgaccccagggaagggctacctgaggctgagggggtgttgaggggaggcctcatgtggcccctccctgcggacaga

SEQ ID NO: 6808701 - DNA, 74 bp, Homo sapiens
atggaagacttgggatgctcagggtcctgctagccttcaaactgcaggactctgagcatcccaagtcttaccat

SEQ ID NO: 6808702 - DNA, 61 bp, Homo sapiens
ctcaaacttgtttctattgattccagtgcttacaggtagagggacacagagacagagagag

SEQ ID NO: 6808703 - DNA, 93 bp, Homo sapiens
atgaaggattatttgtttcatacactgtcagatttcgattgctaatatttgtcctggtattcacatttatgacagtgaacgagaatcctttat

SEQ ID NO: 6808704 - DNA, 71 bp, Homo sapiens
gctcactagcagtcctgcctgtggttagcacttccgaaagcgagtgccagcttgtggtcagaggcttgagc

SEQ ID NO: 6808705 - DNA, 66 bp, Homo sapiens
tctcagcagggtggatttgggaagtggcctggaatatggcaggccttccctctcatcctgctggga

SEQ ID NO: 6808706 - DNA, 78 bp, Homo sapiens
gaacaatgccagctcatgtggtatttattaaacaagtattaatatttgagtgccttctctgggctaggtcatatgttc

SEQ ID NO: 6808707 - DNA, 88 bp, Homo sapiens
tgcaaaaatctgtctatggagaataaatatagggacattttgttttaaatgctctctgtcgttatgcttcattagcatatatgttgta

SEQ ID NO: 6808708 - DNA, 68 bp, Homo sapiens
gactgtgaggaggaggtctcctccgcagggggagtgtactccccggagcagtcctccccttcagggtt

SEQ ID NO: 6808709 - DNA, 64 bp, Homo sapiens
tcttaatgcactaaactgcctccttgttacacacaggttccagggctgtaaattagtgctgaga

SEQ ID NO: 6808710 - DNA, 113 bp, Homo sapiens
tcacctgggggtgctcgttaaaacagactgctgggctccatccccacagtttctcattgagtaggtctggggtggggccaggcaatttgcatttctaacacattcccgagtga

SEQ ID NO: 6808711 - DNA, 59 bp, Homo sapiens
gtctggcatatgcaaagtgcataaaaatccttagcaatttgttaaataatgtgtcagat

SEQ ID NO: 6808712 - DNA, 56 bp, Homo sapiens
ccaggctctgcgctggacatggggcagttgctcgtgtctttgtgttgagaggctgg

SEQ ID NO: 6808713 - DNA, 68 bp, Homo sapiens
ggggtgagttgagttagtggatttgtttcctcttaagaggctgccgaaactgatcttgttcttactcc

SEQ ID NO: 6808714 - DNA, 63 bp, Homo sapiens
ggtcgcctcaggatggaagcctacaggaagggaattcctgagctgacacttggggagtgggct

SEQ ID NO: 6808715 - DNA, 59 bp, Homo sapiens
gcaaggcagatgggcgtctataaattgagagtgatcaattcatagatagtttgcattgt

SEQ ID NO: 6808716 - DNA, 87 bp, Homo sapiens
ggctcattccactacatcatgctgtgccaggagatggaacacttttccctgttctccacaagctgatgctaggatcctgaatgagcc

SEQ ID NO: 6808717 - DNA, 92 bp, Homo sapiens
tggctaactgtaggtatagtgaaaacaggcacatagtaacatttgacaaatattttaaagcctacctgttttccacagacctcacctggcca

SEQ ID NO: 6808718 - DNA, 80 bp, Homo sapiens
caggctctgttcaatgcaatggcaatggaaggaatagtaaccttccatttagtgcacagtgtaatgaatcagaattcttg

SEQ ID NO: 6808719 - DNA, 98 bp, Homo sapiens
aaagtaatgatcaatttatgtataaatgattacagtatttgagatccaagatccttggaaaatctgatgttgcaatcaaaacataattgagctatttt

SEQ ID NO: 6808720 - DNA, 68 bp, Homo sapiens
gctaagcagctttctttcctgtgaagctgaaaaacgtgctgcttcaaacctacaagaggagctgcagc

SEQ ID NO: 6808721 - DNA, 61 bp, Homo sapiens
tctgcagttagatccagagatttcaatatctgaattattgttctaagggtttaattaaaga

SEQ ID NO: 6808722 - DNA, 75 bp, Homo sapiens
atttgtggaatttgaacttcataaagaaatgttatgattatagtcatcttcacattttaagaagttcttgcagat

SEQ ID NO: 6808723 - DNA, 67 bp, Homo sapiens
gtgagtcctatgggactgtctgtgtgagatggagaagacacacagagggtctgggcacaggacacac

SEQ ID NO: 6808724 - DNA, 68 bp, Homo sapiens
ctcagtttcctcagctgtgtcctggcgatgataatgcccatctcatggagtcatgtgggggatttgag

SEQ ID NO: 6808725 - DNA, 88 bp, Homo sapiens
ggggttggtgtcttaataaactgcttctctcagtctgtcacatttagttacggagctgtgcagtttagggggaaaaaaggctaattct

SEQ ID NO: 6808726 - DNA, 81 bp, Homo sapiens
gtaagtgacactggaggatactgtgttaaacatgttttacttgatctacctgctaaactggtatctcttcagtgtaattac

SEQ ID NO: 6808727 - DNA, 95 bp, Homo sapiens
atcaaagagaagtagtgagaaagagcaaggataagttgattaagatggcttatgagaactgcaacttgtttgattcttggacatttatttttgat

SEQ ID NO: 6808728 - DNA, 55 bp, Homo sapiens
agagggtggcacttgctgtagaatctggaagttctgtcttctgctgtcgtcctct

SEQ ID NO: 6808729 - DNA, 71 bp, Homo sapiens
ggactggattttgtttgactgatgtttgtttattcattcaacaaacatgtacctacaatcagaatccatct

SEQ ID NO: 6808730 - DNA, 56 bp, Homo sapiens
ctctccctatgcctcccaggagcatctgatgatggaactgctgggagaggggaggg

SEQ ID NO: 6808731 - DNA, 60 bp, Homo sapiens
gggcttgttaaaacacaaattcctgggctccacctccagagtttctgatttagtaggtct

SEQ ID NO: 6808732 - DNA, 69 bp, Homo sapiens
caggcaagcacactgattaactgaactgaatttactgcccaagtataatcagcagttaactcatgtctg

SEQ ID NO: 6808733 - DNA, 67 bp, Homo sapiens
ctctaagtgttcctttatctatctggccttattaattccagcctttatgaactgggggactttggag

SEQ ID NO: 6808734 - DNA, 57 bp, Homo sapiens
aaccttgtataaaactttgagacagttctgggaccatcacaaggtttatgaagggtt

SEQ ID NO: 6808735 - DNA, 74 bp, Homo sapiens
caagaaggctaatgataagagaggttctggccagtccctaaggactctgcctccacttgtctgtgattcccttg

SEQ ID NO: 6808736 - DNA, 94 bp, Homo sapiens
tgcaaatggtattttgctatttgtttctaaaagttgaaaatgaccttgcacgttaaaaatcatcagtttagaaaaaatatgaagtctgtttgca

SEQ ID NO: 6808737 - DNA, 91 bp, Homo sapiens
ccagtgtattttcagtacttacataaaaactgaatgtattttgtatgcagtacatatcggttgaatgcaagtattgatgaaggacagatgg

SEQ ID NO: 6808738 - DNA, 83 bp, Homo sapiens
gaactgaaaatagagactgggaggtgatattttgataaaaataaatattttaacattgccatggttaattttactttcagttt

SEQ ID NO: 6808739 - DNA, 64 bp, Homo sapiens
gttcaaggttttacagagtgtaaagtgaatttgaacaagatacctctttgtgaaattttagaac

SEQ ID NO: 6808740 - DNA, 61 bp, Homo sapiens
ttgtcatttgtagttaaaaatgtctccctcagatagggagtcagccaaattaaaatggcaa

SEQ ID NO: 6808741 - DNA, 85 bp, Homo sapiens
gcctcccaggaacatctaaagccagtttgtctctttaaagttgaggttaactttgatcatttggttaaggtgatttctgccaggt

SEQ ID NO: 6808742 - DNA, 62 bp, Homo sapiens
gggtggggtgaggcagccacatttaactccagctaagaagttagtggaaaattcccccgccc

SEQ ID NO: 6808743 - DNA, 63 bp, Homo sapiens
tggtatgcaatgttacagaatgtactgaattctaatatagactttctgtagcatctgtaatca

SEQ ID NO: 6808744 - DNA, 81 bp, Homo sapiens
tttgattccacagccgataccatgactactaagctatactgtctccctctgtggatcactgggcgtgctgtgtgaaacaaa

SEQ ID NO: 6808745 - DNA, 63 bp, Homo sapiens
gacacctgagaaaaatgagtcaggtacaacttcttcctgcctatttctcatagttcaggtctt

SEQ ID NO: 6808746 - DNA, 61 bp, Homo sapiens
tgagccacatctgctccagcagtggaccccacccactgcacaggtgagatgtggggcctca

SEQ ID NO: 6808747 - DNA, 63 bp, Homo sapiens
taaaatggtaactttcatttgcatttccaaaagaatttcattgcaaatgagttgcatattttg

SEQ ID NO: 6808748 - DNA, 69 bp, Homo sapiens
tttcctaggacaattatcaactaggctggccagcttgttcccttagccatagctttaatgtccaggaaa

SEQ ID NO: 6808749 - DNA, 76 bp, Homo sapiens
gttatccagtctgtgcagtaaagagggtgctggggcccagaccccagccctgaaccctgctgcatggactcctggc

SEQ ID NO: 6808750 - DNA, 77 bp, Homo sapiens
ttgtttccttaagcctgcctttttactttgtaaaagttcacctatgaggcaagttatcagggcagttagagaaacag

SEQ ID NO: 6808751 - DNA, 73 bp, Homo sapiens
gcctgactggccttgtcgtgagcttgtttatccactgcatctgtcaggaagcaattatgataaggccgctggc

SEQ ID NO: 6808752 - DNA, 67 bp, Homo sapiens
tgagcaggaagagagtgattccctcccatagaactgtattttgaagaaggagtagctctattgctta

SEQ ID NO: 6808753 - DNA, 64 bp, Homo sapiens
aggccagtttttggagggaaacatcaatactgttgccattcagttctctatgccatgctggcct

SEQ ID NO: 6808754 - DNA, 69 bp, Homo sapiens
gccctctgcctgtaactttctgaagcagtagtttttcacgtgtgcctgacagtgttacgggaggggagt

SEQ ID NO: 6808755 - DNA, 79 bp, Homo sapiens
gggctctcctgattcctggcccagtctgccttccctgatgtgtccactagcagggaagaagctggtagtaggtgagccc

SEQ ID NO: 6808756 - DNA, 78 bp, Homo sapiens
gttagggttctgttagaattttgaaaatagcaaatgtcttgctgtgtcagtgtccatttttgcatattttaccctaac

SEQ ID NO: 6808757 - DNA, 61 bp, Homo sapiens
cagggggcagggctgggcctcggggtcagccaactggagtctggcttggcgctgccctctg

SEQ ID NO: 6808758 - DNA, 81 bp, Homo sapiens
tgtgctgttatttctacttctgtctagttattacaacaaatcaggatgtattaatgtaaagaagatgtaggaaagagtata

SEQ ID NO: 6808759 - DNA, 70 bp, Homo sapiens
ttgtagcagatgggagatggagctgcctagatggggtgatttcagggatagcgcactcatatctgctcaa

SEQ ID NO: 6808760 - DNA, 96 bp, Homo sapiens
tattattgttagtgttattaaattagattatgtatgttagtattcaccctgatgcctggcacatggttaatcataattccagtcactaatagaata

SEQ ID NO: 6808761 - DNA, 69 bp, Homo sapiens
cttattagtcattagtcggcattacttatcactgttgattatagcaatgcttattgctgactatagaag

SEQ ID NO: 6808762 - DNA, 71 bp, Homo sapiens
tatacaatgagtacattctggggatctaatgtacagcatgttgactataattaatgatactacattgtata

SEQ ID NO: 6808763 - DNA, 57 bp, Homo sapiens
agtctgcctttccaatcccgtgagataaagctcatgctccatacttgggtggtgact

SEQ ID NO: 6808764 - DNA, 76 bp, Homo sapiens
gtatgtcctattggtagacatttctgttcctaatttttttccactgcacaaaaagctgccgatatggtctgcatat

SEQ ID NO: 6808765 - DNA, 70 bp, Homo sapiens
gtgacctgcaggcactggaggggctgtccttccctatcttatggacaagatctcttggcttgggggacac

SEQ ID NO: 6808766 - DNA, 100 bp, Homo sapiens
aggagaggatgtgacacaagagaaatgattcctgggcagatcgtgattcctggatgatccctatgggcttcatttcttgaattcacacagatacccttct

SEQ ID NO: 6808767 - DNA, 61 bp, Homo sapiens
tattggtggtgaggacatgccagtgagcttcctgttcagcttggtagatgcagcaccagta

SEQ ID NO: 6808768 - DNA, 83 bp, Homo sapiens
cttgaccccaggatttttggaaccagtaattaattaaattaactaatcaattaactaatttggtacaagagtctggaacagag

SEQ ID NO: 6808769 - DNA, 85 bp, Homo sapiens
agattaacaaaaatcggcttctgtccttatggagttcagactttcactgtgtgtacttgaaagggcaggtcctttgcattagtct

SEQ ID NO: 6808770 - DNA, 55 bp, Homo sapiens
gggaccctgtggaggtgagatgatgaaaacgaaatggtctctgctccagggtctc

SEQ ID NO: 6808771 - DNA, 93 bp, Homo sapiens
gacttgctttctagagccacatatttcccttcagggactagctacttgttcttctcagagaaatgtgtcaccatctttccagcagagccagtc

SEQ ID NO: 6808772 - DNA, 70 bp, Homo sapiens
gagtgacaggccttgtcaagaaaatgccacttctgaccaaaaaagatttggcaaactgcaagcttcattc

SEQ ID NO: 6808773 - DNA, 61 bp, Homo sapiens
ggaacctggaatctattacaaggtgctcccagctaagctctcagggtaacagccaggtgcc

SEQ ID NO: 6808774 - DNA, 77 bp, Homo sapiens
aggatgcttgaagtttaaggttagataagtatcaagaagctgaatgcttatctggaaactttgaactttcagtgcct

SEQ ID NO: 6808775 - DNA, 81 bp, Homo sapiens
gtttgctgactgaatacgcgaagaaggacctgatgggctcatatgcaccactgccatcacagtccccatcgtgatgcaagc

SEQ ID NO: 6808776 - DNA, 68 bp, Homo sapiens
tgtgaaacctgtaggcgagggatggacagttcacagagtgagctgcttctgccactgccaatatcata

SEQ ID NO: 6808777 - DNA, 83 bp, Homo sapiens
aaacgccaaaaagagaaaaagtactattttaacaaagtaggaccattcttttaaaatgttaattgagtattttttgagtgttt

SEQ ID NO: 6808778 - DNA, 71 bp, Homo sapiens
gatgcaagtgagttcagcattcactcgtttggtgcactcaagtgctgagagaatgcagaatttacagtgtc

SEQ ID NO: 6808779 - DNA, 58 bp, Homo sapiens
ggagagcgtgaacctgtccatagctcccctgggggaagtagggctcattatgatctcc

SEQ ID NO: 6808780 - DNA, 58 bp, Homo sapiens
cgcccctgggacagcacgatgggagcctcctcccaactccgtctgagtcacgggggtg

SEQ ID NO: 6808781 - DNA, 72 bp, Homo sapiens
atgagccatggggggctgacttgttaggccattgcctctgagtccttggagctcccctctgtacgtggccat

SEQ ID NO: 6808782 - DNA, 56 bp, Homo sapiens
tagctcctccccatccaggttcccctagtgttgggcagcaaaggaggtcaggacta

SEQ ID NO: 6808783 - DNA, 94 bp, Homo sapiens
atgagccttttggggaaggataaaaaccacttctaatctgacaagtataaggctgaagtagcattgatgatttttctcttccccaagtcctcat

SEQ ID NO: 6808784 - DNA, 91 bp, Homo sapiens
ttgaggaggtgagttctcagtttcatagctgagcaaactaaggtgagaaacactaaggctgctcattgctatggctgagtttctatcccag

SEQ ID NO: 6808785 - DNA, 70 bp, Homo sapiens
gttgaaagtctgtataaggagccatgagaaccccagattacctcctgaagatccattatagacactcaat

SEQ ID NO: 6808786 - DNA, 88 bp, Homo sapiens
gggtcccagacacaaagctggcctctcaggctttactgaaagataagtgctgataaggcctgcgggtcatcttcgtctacgcgggccc

SEQ ID NO: 6808787 - DNA, 59 bp, Homo sapiens
cctatgctggcctgggttgccttaggttagtacccccctatttatccagacagcacagg

SEQ ID NO: 6808788 - DNA, 63 bp, Homo sapiens
gggcaggggcagtggtggcattctggggacatgtctcttgcagtaccatctctgcctctgcct

SEQ ID NO: 6808789 - DNA, 72 bp, Homo sapiens
tctgaagtactaaacatcaccttctgcagttggcctctgtggttaagagagcggaagatgtttattaccaga

SEQ ID NO: 6808790 - DNA, 76 bp, Homo sapiens
tctatgtgtgtgtgtgatatacacatgtatatttctatatgtaatatgtatatgtgtatgtacatacatacattga

SEQ ID NO: 6808791 - DNA, 91 bp, Homo sapiens
gaatcacttataaaggccccagagttttgattttttgcattgctgatgcagagatttggctcttaaagctcttatcttttatacattgttc

SEQ ID NO: 6808792 - DNA, 74 bp, Homo sapiens
gtcagaagcaccatgggggaaggctggtccaggcttcagaatggaactcaggccaggtttctcccacagcagac

SEQ ID NO: 6808793 - DNA, 66 bp, Homo sapiens
gaaccttccacctctgagctcctcttctgcttccactgtagcgcaagacctctgaggtagaagttc

SEQ ID NO: 6808794 - DNA, 57 bp, Homo sapiens
gccttctgattgctggactgactctctcgccctctcttggtgcagccctcgggaggc

SEQ ID NO: 6808795 - DNA, 57 bp, Homo sapiens
ttagctaactcccagttcaatccacagcttgccacttgggatctggaagctagctga

SEQ ID NO: 6808796 - DNA, 89 bp, Homo sapiens
ttctacaattagcatctactagtagtatctttgaaacacaatgagatatgtttactcattgataaagtactgcttttgtaaaggtagga

SEQ ID NO: 6808797 - DNA, 130 bp, Homo sapiens
aaggacaccggccagttggcccccaggagcaggaggctggtcagcgtttgtcagagcagggctcatcactgataacaaaagtgctggccacgccagtgctggaggcaggctggggactgtgcttatcttt

SEQ ID NO: 6808798 - DNA, 56 bp, Homo sapiens
ggagatggcaagaagttattaggttctggtttgaagcttgaactgattctatttcc

SEQ ID NO: 6808799 - DNA, 60 bp, Homo sapiens
ggtgtctgattccaaggccacactcctcctattgcacaggtgtgctttcaaccagacact

SEQ ID NO: 6808800 - DNA, 72 bp, Homo sapiens
ttttacacaatcatggcatgtgatccgaaggcatgagatctgccttcgtacatgcaacatgcaatggtggaa

SEQ ID NO: 6808801 - DNA, 66 bp, Homo sapiens
ggctgggctcttggaccccaacgctggcccccagttcctgccagccaccttctccaaggcctagct

SEQ ID NO: 6808802 - DNA, 88 bp, Homo sapiens
ataaatgaaacatataatgatagatatagtttgcctcacactttctttatattggggaattgtacttttattacatgtagttatatgt

SEQ ID NO: 6808803 - DNA, 80 bp, Homo sapiens
tcctcttagcatagaagaaagctgggaaataaatattaagtaagaaactactaatacattctacagttttcaaaagaggg

SEQ ID NO: 6808804 - DNA, 129 bp, Homo sapiens
ggtgtttgccaggctttggcatgtgattttggggtgcagctaggaaggttcaaaagagttttgaggtgagcagaatctaagtcagcactcctgaggatcacgggccttggagagtccagggcaaactcc

SEQ ID NO: 6808805 - DNA, 63 bp, Homo sapiens
gtattagctaggttacctgggtcagaaccagaaagtaggctcccagcagtgacccagtgatac

SEQ ID NO: 6808806 - DNA, 63 bp, Homo sapiens
gggttgaattcctggttctgtgactaccttatgttgggtggacttagataaggcatttaatct

SEQ ID NO: 6808807 - DNA, 56 bp, Homo sapiens
cggccttgacccccggcgccggcgccgcagccgccgcgccgggcccgggttggccg

SEQ ID NO: 6808808 - DNA, 65 bp, Homo sapiens
acagagtccaggggcctggtgtgtgctgtgttttacagatgacacattaacctttgaaattctgt

SEQ ID NO: 6808809 - DNA, 82 bp, Homo sapiens
ggcattagattctcataggagtgtgaactgcacgtgagagggatctaggttacatgctccttatgagaatctaactaatgcc

SEQ ID NO: 6808810 - DNA, 87 bp, Homo sapiens
gctgcagagaagcctccactctggggtgggtgagatggtggaagcgcctccacccgcttccagcggtttggaagtatgtctagcggc

SEQ ID NO: 6808811 - DNA, 57 bp, Homo sapiens
caagaagccgagctacaggctctggctttggccatgtgcctgttcacaggcttcttg

SEQ ID NO: 6808812 - DNA, 77 bp, Homo sapiens
gattcatgggatgtaggtatacagagatttctggggctgttctgggctattggagatcttgtagacctaaactattc

SEQ ID NO: 6808813 - DNA, 80 bp, Homo sapiens
tggaatctggagatgggtctgtcaccagtggagagatgataagagccatatcctgggtggctttgacccactagaagcca

SEQ ID NO: 6808814 - DNA, 69 bp, Homo sapiens
gtgagagatgtcttggagcagctcccagtgatggctttataacagggctgcttggacaccttaaatcac

SEQ ID NO: 6808815 - DNA, 58 bp, Homo sapiens
catggccacagcgtggtccagggagacaaagagcccatgagccaggctgacggctgtg

SEQ ID NO: 6808816 - DNA, 101 bp, Homo sapiens
tcaagaataatagaaaatgactataaataggagattgtataatatagtataatagtcttttgagcagttacctattttgtagaaattttttaaggtcttgg

SEQ ID NO: 6808817 - DNA, 60 bp, Homo sapiens
gcgagggctgtgttgctctcctttgtgcaagctgcgtgagctttagagcatcagccctgc

SEQ ID NO: 6808818 - DNA, 75 bp, Homo sapiens
gcatatgatgtaaagttacttgagttttgagttaagaataaaataaattctcaagtaattggtataatgtaatgc

SEQ ID NO: 6808819 - DNA, 59 bp, Homo sapiens
gtgtagaagtttagaagtgacaggtttaaattaaaacctcttccttttagattttaaac

SEQ ID NO: 6808820 - DNA, 76 bp, Homo sapiens
gtattaattactgttgcctcctattgtcattttaatggcaccttatataaatagaggcagtgaagctagttgctac

SEQ ID NO: 6808821 - DNA, 55 bp, Homo sapiens
ttccaagcatggtctactgcggggcctgtgctctggcagtcccctgtgcctggaa

SEQ ID NO: 6808822 - DNA, 72 bp, Homo sapiens
taaaaattcatccatgaacaattccacatttcatcactgcccttggaactgacactgtgggtgtgattttta

SEQ ID NO: 6808823 - DNA, 98 bp, Homo sapiens
cccagtaatcattgtttcctttctggtttggtcatagctgggaagagccaaccaaccaaatatgaataaaccaaggacagatacaaccatttaagggg

SEQ ID NO: 6808824 - DNA, 78 bp, Homo sapiens
attaacttaaatacacctttttttgctgctattcgtaatggatacatcaaggatgatggtgtaagtataagccttaat

SEQ ID NO: 6808825 - DNA, 69 bp, Homo sapiens
ttataatagtaggtaagtaggctgctctgtttatggagtagccattcttttatttctttactttcttaa

SEQ ID NO: 6808826 - DNA, 57 bp, Homo sapiens
aaacacttgaaagtaatggttgtgctgcttcaggatagtacaacctcatcagggttt

SEQ ID NO: 6808827 - DNA, 66 bp, Homo sapiens
tcctttcaaagttctgagaagcagtttactctttcacactagagattgcttaaatagagctgggga

SEQ ID NO: 6808828 - DNA, 81 bp, Homo sapiens
ttttatgccattagttgtctggctttcatggctctgcaccacattacagtcagagcaggaaggccagcagtggagatagaa

SEQ ID NO: 6808829 - DNA, 69 bp, Homo sapiens
ctgtgtaaaggaggaaggggctggttaaacatgatatttgatctgcctcattcttgttcaacctaacag

SEQ ID NO: 6808830 - DNA, 56 bp, Homo sapiens
tccctgcacccttgctgggccctggatctcctagggaaacagccagatggaggaga

SEQ ID NO: 6808831 - DNA, 67 bp, Homo sapiens
ctttgtgtacatttcagtttccttaagacttaggaagtccaagagaatactggagagtaccttagag

SEQ ID NO: 6808832 - DNA, 86 bp, Homo sapiens
gtacctcagactcatcttccttctttgatgacaagggctctaaagtgagtcacctaaactgcagtctgaggaggagtcaagggtac

SEQ ID NO: 6808833 - DNA, 115 bp, Homo sapiens
ctttctttctcttttagttcttgactatttctatccttccaataatatctattgccaatacttaaaatacattcaaaggaaggatagataggaaggaaggaaggaaggaaggaag

SEQ ID NO: 6808834 - DNA, 63 bp, Homo sapiens
ctactgccagacacgttatgctcattatttaattttcataatgcatctgtgctctggtagtgg

SEQ ID NO: 6808835 - DNA, 84 bp, Homo sapiens
ccattgtttcttgcaggtcactcactgagcgtaggagcagacagagctgacttcaacttaggggcgacttcagtaagaaagtgg

SEQ ID NO: 6808836 - DNA, 67 bp, Homo sapiens
gatttcttctggtagcagtggtgggagtgtcacctgatagttgtaataacaataccaaaaggaaatc

SEQ ID NO: 6808837 - DNA, 88 bp, Homo sapiens
gaaatgatgtctctagtataatatagcaaaaggtaagcaatatgaaacctacatcttttggtagaatgatattggatgtgcaaatttc

SEQ ID NO: 6808838 - DNA, 66 bp, Homo sapiens
ccccagaatatttgtaattactgttgatgattcatttattagcatttcagtacacatgttgagggg

SEQ ID NO: 6808839 - DNA, 102 bp, Homo sapiens
gataattctgccagactgttggaaagaagggctgagcaaggtcataatgacattcactgtacttgtgtccctgctttccctagtctttttggtaggattatt

SEQ ID NO: 6808840 - DNA, 73 bp, Homo sapiens
tgtgcatggaggataataattgagaaagtgcataagatgaaataattgcttccttaggtcttcttggtgcaca

SEQ ID NO: 6808841 - DNA, 73 bp, Homo sapiens
atggatgggatattgcttgccacttctccccaaggaccagagagaggattaatgaggcagtattcacatttat

SEQ ID NO: 6808842 - DNA, 78 bp, Homo sapiens
agatgtaaattctcctggccaggatgacctaacaggatgacctgttctccctgatgcccaggaagaaatgacttgtct

SEQ ID NO: 6808843 - DNA, 61 bp, Homo sapiens
ggggtgctttggtcagcaatattgtggggagttactccagaccaccctggccatgcacccc

SEQ ID NO: 6808844 - DNA, 72 bp, Homo sapiens
caggtaggagcaggctggtgggtgtctgattttattgtagctaggctaattcattggcttgaactccacctg

SEQ ID NO: 6808845 - DNA, 58 bp, Homo sapiens
gaggcctcgggttttccacaggagtctttattacagtgtaaatccaagctcaggcctc

SEQ ID NO: 6808846 - DNA, 72 bp, Homo sapiens
ggcatacaggtaggggacatacatcctgccttcaaagcaggcattcgatgtctgattccctactctgatgtt

SEQ ID NO: 6808847 - DNA, 72 bp, Homo sapiens
ataagtaggaaaatttgaatatggactggttattggagggtacagggaaatattctcaattttcttgggtgt

SEQ ID NO: 6808848 - DNA, 77 bp, Homo sapiens
ccgccagccccttcagctcggcctaggcccacggtcagcccaggggagctgggggctgcagccgggtgggtgagtgg

SEQ ID NO: 6808849 - DNA, 79 bp, Homo sapiens
ctccggctaccactgcggtgtgtcatcctgtgaggactgcaaagccttcttcaagaggaccatccaggggagtatggag

SEQ ID NO: 6808850 - DNA, 92 bp, Homo sapiens
acaagagcatctcagctatcttttctatgtatgttatcatcccccaaatgccactgtgaggcatgcatgcaaggtggtgtatactgcattgt

SEQ ID NO: 6808851 - DNA, 58 bp, Homo sapiens
ttccttattccttgatataatgagttatctaattatggtgacatctgttgaggaggaa

SEQ ID NO: 6808852 - DNA, 70 bp, Homo sapiens
ttggtgaagggaatgttgtggttggtttaatcttctattcagaccactaaaactttctctgtgtcagcaa

SEQ ID NO: 6808853 - DNA, 64 bp, Homo sapiens
taaagttggacctgattttattgccagttttcattcgaatccactgggaaatcggacgatttta

SEQ ID NO: 6808854 - DNA, 85 bp, Homo sapiens
gctttgaactgctgaggtatactatgtgacggtgatgaatgaacacgtggaaagtcgacggcagtgtagcttagtggttgggagc

SEQ ID NO: 6808855 - DNA, 57 bp, Homo sapiens
ctgccatagcacccacttccaggtgttctgagtgagcacctgtggtgctgatgacag

SEQ ID NO: 6808856 - DNA, 63 bp, Homo sapiens
acactacagtagtgaaactcctacatgtggttgcacagggagtgcaattcatattgtagatgt

SEQ ID NO: 6808857 - DNA, 72 bp, Homo sapiens
gctacaagttcaaagctcctggtacagtaggtagattttcctatgagtcacttaggagttttgccctgtggt

SEQ ID NO: 6808858 - DNA, 65 bp, Homo sapiens
actggcagttttagaaattgatttgcaagtttggttaaagctcccattatcttctgaaacccagt

SEQ ID NO: 6808859 - DNA, 65 bp, Homo sapiens
aggaagtcaggaggtgaaggagaaccagtgctaccatctggcgtttacttccttcctgtcttttt

SEQ ID NO: 6808860 - DNA, 69 bp, Homo sapiens
tccctgccccaggcaacggagcccactgccagccatccaagctgttaggtgtttctgcctgaggaggga

SEQ ID NO: 6808861 - DNA, 98 bp, Homo sapiens
gtccatgcaccaattgaagtatctgcagcatctcaactcttcagtggttgagttacagagacacttgctgtgaggtcgcttccccttggctgtaagac

SEQ ID NO: 6808862 - DNA, 81 bp, Homo sapiens
tcatgggtctgctgggaaggtctgctcagttctgtggttgcaggtgtttacagctgagccctcatccctagtttccggtga

SEQ ID NO: 6808863 - DNA, 79 bp, Homo sapiens
gtccctaccagggctttgccaaagtccagctcttatatggaacctgagttactactggtgctgggcagggctcagggac

SEQ ID NO: 6808864 - DNA, 57 bp, Homo sapiens
aaataccacatgagaaacctagttaatgatgaagctaggaattttgcatgggaattt

SEQ ID NO: 6808865 - DNA, 117 bp, Homo sapiens
cgggacgtggccacaggtgggctccgggcgcgggaaggagcccgagaaggcggagcttgcaggggccctgaactcttgccctccaggtctcggcccagccccactgtggtccccctg

SEQ ID NO: 6808866 - DNA, 75 bp, Homo sapiens
ctccagtgccagctctagtgctggctactgtagtacatggcaggcagcagcacatggggctggcaacatgtggag

SEQ ID NO: 6808867 - DNA, 77 bp, Homo sapiens
ccagcaagcaggcatgggaggccatcctattggggaaagatgaggatgccatcagagtgtctgtgtacaagggctgg

SEQ ID NO: 6808868 - DNA, 59 bp, Homo sapiens
cataagaaatttaacagaacttcaccctgtgggaacaagttcttttagatgtcttcgtg

SEQ ID NO: 6808869 - DNA, 64 bp, Homo sapiens
tatgtagcagatatttgtgcacacgagtacatgcaagtatgagtgtgcatgtgtgtgttgcatg

SEQ ID NO: 6808870 - DNA, 65 bp, Homo sapiens
tttacaacataggccccaagaagaaggctttgttggacttgactctgtgcggtctgtgttatgaa

SEQ ID NO: 6808871 - DNA, 93 bp, Homo sapiens
gactaatatagacaatggtatattcaagggcacttaacttcaattggtcaagttaagtgtctctcgaattatgcttcttggactgcccatgtc

SEQ ID NO: 6808872 - DNA, 97 bp, Homo sapiens
gacagtagaaagaaccaactatgtgctccaagccacacaaatgcctaagaatttggcgtttgtttgcggcacatagtttgagtgcttctcagatgtt

SEQ ID NO: 6808873 - DNA, 79 bp, Homo sapiens
tggcaactgattccataggtgagagctaggatgcaagcccaggcagtttggctcacatctttggctacatccctggcca

SEQ ID NO: 6808874 - DNA, 73 bp, Homo sapiens
ggaatctttgaaggattttaagggggctgtgattatagttagatttgcattttaaaagcttttggagaattcc

SEQ ID NO: 6808875 - DNA, 64 bp, Homo sapiens
cttggcacatggcatccccctgcctatagcagcaagagccttccaggcagggggagcagccagg

SEQ ID NO: 6808876 - DNA, 62 bp, Homo sapiens
tctgctctgtggcttcagctaaaatgctgtcctcagctcctcctctgaactatggaagcagg

SEQ ID NO: 6808877 - DNA, 66 bp, Homo sapiens
gtgacggggctgagggccaattcctactgatagcgcttagtgggctgggggcacttgcaacgtcac

SEQ ID NO: 6808878 - DNA, 90 bp, Homo sapiens
ccacagggcagccctgggatggcttctgaatcagggcctgcccgcctcctgcaggtccctctcagtaagtcagaaggtacagctctgtgg

SEQ ID NO: 6808879 - DNA, 65 bp, Homo sapiens
gttgtacatatgaggataagttttagtgcagaaagtctcattgcattgcattccatgtgttcaat

SEQ ID NO: 6808880 - DNA, 59 bp, Homo sapiens
caggagaaagtccaaacttttctttgtaacatacaaggcctttcaggattttgctcctg

SEQ ID NO: 6808881 - DNA, 67 bp, Homo sapiens
tttttcattgcagcctctctcctctatctggccattaaatgatagcttctgagagcacagtgataaa

SEQ ID NO: 6808882 - DNA, 57 bp, Homo sapiens
catcagaggtggaactggggactcgaggctattgaaaccctctccctacctttgctg

SEQ ID NO: 6808883 - DNA, 83 bp, Homo sapiens
aattatacagtgctcttttttctcccacaagtattaataacaaggaaaatactgatacggaagaaaaaagtggctgtgctgtt

SEQ ID NO: 6808884 - DNA, 60 bp, Homo sapiens
ggcagccatgtgggcagcgagtcccagcagtccaccttcctgttctgtccagcatctgcc

SEQ ID NO: 6808885 - DNA, 70 bp, Homo sapiens
tataaacctaactgcctcatcaccagtgcacagcacagtgcctggggaaaagcaggcatttaaatttata

SEQ ID NO: 6808886 - DNA, 74 bp, Homo sapiens
atctccaggcttttctcatggagtcactgtaacagctttcccattgatctcctgtcttgagtctcctccgagat

SEQ ID NO: 6808887 - DNA, 61 bp, Homo sapiens
tgtacacaggtagataaagactaaaagtgaaaaaatgtttatctgctatctgctgtgctca

SEQ ID NO: 6808888 - DNA, 70 bp, Homo sapiens
ttttgtgttatgcattttaaagcattattttgaggagggtccacaggcttcaccaggtgcatgcatgaaa

SEQ ID NO: 6808889 - DNA, 73 bp, Homo sapiens
cagttgtatggctttaaattgaaggagtttggctttttatctaaattgcttcataataaaaccactgcttttg

SEQ ID NO: 6808890 - DNA, 56 bp, Homo sapiens
cttccttaacaagcatcatgtagctgcataaactacagcaatgggcagtgaggaag

SEQ ID NO: 6808891 - DNA, 62 bp, Homo sapiens
aggggagccatgtctccaggccatcagctcatgcaggttagggagtcaggtggctctttcct

SEQ ID NO: 6808892 - DNA, 79 bp, Homo sapiens
tcatgttttcaggaagtgctgcctggtgtctaacctgaaggcgtcctgctgcagtataagccattccttcctcccatga

SEQ ID NO: 6808893 - DNA, 68 bp, Homo sapiens
gcatcatgagtgtgtaagggatcaaagagttccttctgagctcttgaaaatttacacctgcatggtgc

SEQ ID NO: 6808894 - DNA, 59 bp, Homo sapiens
caggcatgagccaccgcaccgggcctaaaatttgttgctttggtcagtggttcagtttg

SEQ ID NO: 6808895 - DNA, 69 bp, Homo sapiens
acttgagcccaggttgaggctgcagtgagctacaatcgtgccactgcactccagcccgggtgatagagt

SEQ ID NO: 6808896 - DNA, 62 bp, Homo sapiens
gcaatgattttcatcagagaagtctacagtgatttgtataggctttatggtagaaagtttgc

SEQ ID NO: 6808897 - DNA, 120 bp, Homo sapiens
gtgattgtaacttgtggttgtaacctgtcgtgattgtaacttgtgattataatctgttgtgatagcaacatgttatgatggtaaattgtggtaaccctggttgtaacctgttgcaatggc

SEQ ID NO: 6808898 - DNA, 64 bp, Homo sapiens
tgggagaagggataccaacatattctgttcaataatgccaggaaataaaaagtatcttcttcca

SEQ ID NO: 6808899 - DNA, 88 bp, Homo sapiens
ggagatcaaagatgggcagagagaaaaatggtatgtgggtgaaggagagatttttgcataacatttgctgtctcctatgtttgtttct

SEQ ID NO: 6808900 - DNA, 62 bp, Homo sapiens
tccttcagcttatttcttaggaaattacctccagatctacccaagaaacaaaggctgcagga

SEQ ID NO: 6808901 - DNA, 78 bp, Homo sapiens
tgcaattatcgttctctttgtctttatggtttttatgctcaggataagaagctatacagcaggagaatggaaagagca

SEQ ID NO: 6808902 - DNA, 57 bp, Homo sapiens
atgtcatagaagcctgtgaacccagctttagttatgcactggaattttctgtgacat

SEQ ID NO: 6808903 - DNA, 62 bp, Homo sapiens
tttagaaatgttgaatacatcaggaatattttcatatttctgcatggtcaaggctttctgaa

SEQ ID NO: 6808904 - DNA, 88 bp, Homo sapiens
tcccagggcaggcatccatcccctcagagatcatctttaacctgccaggaatggcctgggttccatgatctccagggctgccctgaga

SEQ ID NO: 6808905 - DNA, 79 bp, Homo sapiens
atttcagggcatggtaagtgagtggtacactctttaagaaaaagttttcctctcatttatcaatactgtgccctataat

SEQ ID NO: 6808906 - DNA, 79 bp, Homo sapiens
tagcaagcctttactaatgtcttcttcagctgaataattgtttgttatctagttggaggagatgctaaagaaagtgtta

SEQ ID NO: 6808907 - DNA, 68 bp, Homo sapiens
gttatagcagcgactaatgaataagtacctactgtgtgtcaggcactggtctgagtgcttgttgtagc

SEQ ID NO: 6808908 - DNA, 130 bp, Homo sapiens
ggggagagggaagggagccacatccaggcgacggggctgctcgtcctcctgtgcgagagtggggagactcaggccagcccaagtgggcggcggccccggttgcttgatctaagctctgctcacactgccc

SEQ ID NO: 6808909 - DNA, 89 bp, Homo sapiens
ctgtgcgactttggaagagttgtttaacctctctgattttcagcatcttcagggataataataataataatacttcgtaaagttgttag

SEQ ID NO: 6808910 - DNA, 59 bp, Homo sapiens
gaagttttatgcacaaatatgttaagcccaaaaatgtatttgtagtagcatagaatttt

SEQ ID NO: 6808911 - DNA, 68 bp, Homo sapiens
ctgggtttcacatccctggagttacccagtggggaaagtttatcttaagggaggggatgtaagcctgg

SEQ ID NO: 6808912 - DNA, 79 bp, Homo sapiens
gcaggaaggcagccttttgagttgattctttaaaaatgggaagaatttcctttttaaaaagacaaattgcccagtctgc

SEQ ID NO: 6808913 - DNA, 61 bp, Homo sapiens
atgctagcaatttagtatctgttaggtgtaatatcctggcactatgcttacatgcttatat

SEQ ID NO: 6808914 - DNA, 62 bp, Homo sapiens
gaacaaagatcagaggatagctgagtctgaaagcagttagagaagcaagatgatctttgttc

SEQ ID NO: 6808915 - DNA, 56 bp, Homo sapiens
tcaagcatggtattctgttagctctgtgatttagatgtaaactttaccagctctga

SEQ ID NO: 6808916 - DNA, 55 bp, Homo sapiens
ggaggaggggtgctgcctctggactggctcagctcggctcagtgcctgctccttc

SEQ ID NO: 6808917 - DNA, 100 bp, Homo sapiens
tgaggcaggaggatcccttgagcctgtgaggttgaggctgtagtgagccgtgatggcatcactgcactccagcctgggtgacagagtgagacctgtctca

SEQ ID NO: 6808918 - DNA, 121 bp, Homo sapiens
tgaactcctgaagcatttgccttgctcattccttgttcacacacctgacatttctgaagcaccttctgagtggcaggcactgtgacggaaatagacaaagtctttgccctcatggagctca

SEQ ID NO: 6808919 - DNA, 65 bp, Homo sapiens
ggggcagctcctgtggaatccactcctaagtggcgctcactcggtggttccactggcagtgctcc

SEQ ID NO: 6808920 - DNA, 86 bp, Homo sapiens
tctgccatgctggaggagcgcttccggtagccggtgggcttcacaccagatagaccctgaatgctctcattttccaacatggcaga

SEQ ID NO: 6808921 - DNA, 62 bp, Homo sapiens
aagccaacatgattactataatgtaaaacatataaacatcatgaatagtagtatgtaggctt

SEQ ID NO: 6808922 - DNA, 93 bp, Homo sapiens
ctgtttgtctggagattaggagaggggaaggatggaggaagcctcagtggcttccaaggtcctctccacccactcccagttccagaaaggcag

SEQ ID NO: 6808923 - DNA, 77 bp, Homo sapiens
tctctcaattgctggctgccatcttgcccccatgaagggaggtcctgtctgagaatggagtaagtcagtctgagaga

SEQ ID NO: 6808924 - DNA, 61 bp, Homo sapiens
ggcgagcagcgctgtgtcaggtcaaagggagagagttttggggcctgtgaggccttttgcc

SEQ ID NO: 6808925 - DNA, 66 bp, Homo sapiens
gcatctggcatgtatcacatcaaggccagagcagtgtggcccagcagatggctatgtgctagaggc

SEQ ID NO: 6808926 - DNA, 58 bp, Homo sapiens
attcctagggaaccctgtgctgtgctaatgaaatgagcaatagggcaccctaaggagt

SEQ ID NO: 6808927 - DNA, 58 bp, Homo sapiens
gtgttagtttgctaaggataatggcctccaactccattcatgtccctgcaaacaacat

SEQ ID NO: 6808928 - DNA, 79 bp, Homo sapiens
ggatgttattttcccagtttatcatttccaagtcttccttgagtggccaggaatggagaggtggcctcgaataatgttc

SEQ ID NO: 6808929 - DNA, 82 bp, Homo sapiens
caggacatatttgttgggtcaagaagctatgcccttggaaggatcaaatcatgcaggctccttatcttacaactttgttttg

SEQ ID NO: 6808930 - DNA, 68 bp, Homo sapiens
ctgtagtcccagctactcaggaggctgaggcaggagaatcgcttgaatccgggaggtggaggctgcag

SEQ ID NO: 6808931 - DNA, 66 bp, Homo sapiens
acctctactgtaggtgggtcactagtacaggtggatcactagtacaggtggatcactagtataggt

SEQ ID NO: 6808932 - DNA, 98 bp, Homo sapiens
tttttatgatgtctcaaggtttctggtcaagggaagtaaatgtaggatagtatttttacaccaaaatgacacagagagaattgagcacaccagaaaga

SEQ ID NO: 6808933 - DNA, 60 bp, Homo sapiens
ctctagtcacctttggcacctgcaaaatagaagttttgctatagtggtctagggtgagag

SEQ ID NO: 6808934 - DNA, 58 bp, Homo sapiens
ggcgctgcaagctctggcttctgggaagttccccaaagcgcatagggggcagcaagct

SEQ ID NO: 6808935 - DNA, 98 bp, Homo sapiens
ggtagatgagggcttagctttctcctttcctgaagcaagcctattggagaagtgtggctggctcatgcaaagggtgatggaggggcaactgatctgct

SEQ ID NO: 6808936 - DNA, 96 bp, Homo sapiens
gggaggcagcggaaaaatgggagaaaaagaaggccatgtcttggtactttaaggatatttcctagaagttggacatgccatttctgctgacctccc

SEQ ID NO: 6808937 - DNA, 103 bp, Homo sapiens
gtgatggtagaggttttagatctaatgtcttactgtggaaccttttttgttatgctaggggtcagaggagaagttgggaaaattgcagacctactcacatcat

SEQ ID NO: 6808938 - DNA, 77 bp, Homo sapiens
ggagatagtggtggtcttaatctacccagagcagagttgctcactttaggaactgtaggcttaaagccattatttcc

SEQ ID NO: 6808939 - DNA, 60 bp, Homo sapiens
gttgcttccaggcttcctacctttgacatatttagttcaggtttaggaatttggaaaggc

SEQ ID NO: 6808940 - DNA, 67 bp, Homo sapiens
tagaaagctcttatgtaaacagaaattgcagtagctatctttctgtttagcataaagtggcttacta

SEQ ID NO: 6808941 - DNA, 65 bp, Homo sapiens
attcattagtgaaatgactgcataggtttctgaaaaaaaatgtgggcatttgactaaacttgaat

SEQ ID NO: 6808942 - DNA, 80 bp, Homo sapiens
ggatttttaagtggttttaatgttgtagatttatagtgaaaaaggctaggaatctcaagctgtaaatacctcccaagtcc

SEQ ID NO: 6808943 - DNA, 56 bp, Homo sapiens
taaatgattagtatgtgaggtggtgtctatgctaattatcttactttagtcatttg

SEQ ID NO: 6808944 - DNA, 72 bp, Homo sapiens
gagaatatcaggatgcaaagctgtgtttttctctgatgatgaataccttcttccagtgtcctagtatttctc

SEQ ID NO: 6808945 - DNA, 63 bp, Homo sapiens
tggcctcctcgctgcatcccattcctccacacacagaggagacatggaatagtgaggctgtca

SEQ ID NO: 6808946 - DNA, 67 bp, Homo sapiens
ttgaaaggtatcatgtccatacagtcctttgctgccctcatcagcatttgatacatgtacctctcgg

SEQ ID NO: 6808947 - DNA, 67 bp, Homo sapiens
accttatgaggtaggtattatacttacatacattttgtgggtgtagaaaacttgagctcagagaggt

SEQ ID NO: 6808948 - DNA, 73 bp, Homo sapiens
atggtaggccaaggtatacaatgactatgataatgaatgatataatagtcattgtataccttggcctatccat

SEQ ID NO: 6808949 - DNA, 58 bp, Homo sapiens
tccattcttttgctgtcttcctaattagtgcactaaggaagatgaacaacagaaagga

SEQ ID NO: 6808950 - DNA, 59 bp, Homo sapiens
gccttgccaaggggcagcagagcttgcgtggagccccctcctctctcctttggcagggt

SEQ ID NO: 6808951 - DNA, 96 bp, Homo sapiens
agggccctgtcctgcctactcctgttcccgccaggcactcgagcgagagctctgtggctgagcagcagagagctgggttggacttcaaggggctct

SEQ ID NO: 6808952 - DNA, 69 bp, Homo sapiens
ggccttgtggaaggtatgagcatccagctgtgacaatgatcactagagggtactcttaccccaagggcc

SEQ ID NO: 6808953 - DNA, 57 bp, Homo sapiens
ttatttggttgctgacttggaagagtacagaattttaagttttaagcaatctgataa

SEQ ID NO: 6808954 - DNA, 66 bp, Homo sapiens
agtgaccattttcagctagaggaattgagcatttcagcttagaagggtcagcttagaagggtcatt

SEQ ID NO: 6808955 - DNA, 78 bp, Homo sapiens
ggagactgggggcaaggtgcagcctttggaattagagactccatgcgatccttccactggctgccgccccctttctcc

SEQ ID NO: 6808956 - DNA, 59 bp, Homo sapiens
gaaatgtgttcgtgattatttgtccatttagggggacatctgtttaacgaaggcatttt

SEQ ID NO: 6808957 - DNA, 71 bp, Homo sapiens
tctctgtgggaagtttggagggaaaggttatccaaccttcaaaagccaatcccttgtccttccctacagga

SEQ ID NO: 6808958 - DNA, 57 bp, Homo sapiens
agacatgtcaccaattcttactgattctcattctcagtgggccaagtgtatgtgtct

SEQ ID NO: 6808959 - DNA, 79 bp, Homo sapiens
ctgtttccacaatgccaggggcatcactggtactgtattcttgggtaatggtgctccctggagttgtgcagtgggacag

SEQ ID NO: 6808960 - DNA, 64 bp, Homo sapiens
gcattctcagaaacttctttgtgatgtgtgcattcaactcacagagatgaacttttgatagtgc

SEQ ID NO: 6808961 - DNA, 72 bp, Homo sapiens
agtgttttctgttaggcatcattttaactgagactctttcttgaaaatttggtgttggcagaaaagaacact

SEQ ID NO: 6808962 - DNA, 88 bp, Homo sapiens
ccagcatgagctgaaactttagttctgcaacaagatctttcctttttgtgtagtcagtcaataaagagcttctactcatgaaatctgg

SEQ ID NO: 6808963 - DNA, 58 bp, Homo sapiens
catgaggaacatatcatttactggctgattataagttacaggatgatttttccttatg

SEQ ID NO: 6808964 - DNA, 59 bp, Homo sapiens
ctcattgcagctgcattactgtgggagctgtccctctagagacactgggctgcaatggg

SEQ ID NO: 6808965 - DNA, 66 bp, Homo sapiens
gggtggggctgattgtgtcctgctggtagtcatggcttatgaccagtttatagcgatctgtcaccc

SEQ ID NO: 6808966 - DNA, 67 bp, Homo sapiens
tcatccagaccatggtcatactcgagtcagcatgttgtgtcagttacctgacagtggttatgaatga

SEQ ID NO: 6808967 - DNA, 89 bp, Homo sapiens
taagaatcctacagatagtcggtgcatgtaccgccaaatatgcgtatttcctgcagtggtagaattccatataccctgtttgtatcttg

SEQ ID NO: 6808968 - DNA, 126 bp, Homo sapiens
ttttcttttcttctaacagaatacgggcagagagaaggtttatgtttcatctgataatcacagctattccggattcagaaatacaaaacacttacttttaacgtgggaaggagatttaaaagaaaa

SEQ ID NO: 6808969 - DNA, 79 bp, Homo sapiens
cctgggctctcctggaggacaacagggaaataaaaagggcctgcaagtcaaagagtgttctccagggtagagcctttgg

SEQ ID NO: 6808970 - DNA, 96 bp, Homo sapiens
gtctctctacccagcgacctcctgcctgagagtctgttggtcaatttagctgtaaccagggtcaaatgggcaggaagagtcatgtgggggagagat

SEQ ID NO: 6808971 - DNA, 72 bp, Homo sapiens
attagccccgaaatacctcggtgctgtggaaaacaaggcacctgtagttattttgtttgtttgtaggctaat

SEQ ID NO: 6808972 - DNA, 81 bp, Homo sapiens
gtctcaacagatttgagttttctatccttgtgtcatcaccgaagcacagaagcatgggtgtgaagcaggaaacttaaagac

SEQ ID NO: 6808973 - DNA, 95 bp, Homo sapiens
tcctgccccaggcagatgtctgtcaccccatgctgggatctgacacccttgctgggcagcgtcccacatgggcaccctcctctgcttgagccggg

SEQ ID NO: 6808974 - DNA, 94 bp, Homo sapiens
tcagtttctatttgcgaggactgtgtaggacatgcattccagaagggaaaatcaataacccctgtctctgccagctagcagaatttggaattga

SEQ ID NO: 6808975 - DNA, 75 bp, Homo sapiens
cctgggaagtcttgaagagcactgtaaatttgaaggtctttggaaaattttagtcttggaacaagacagtccagg

SEQ ID NO: 6808976 - DNA, 67 bp, Homo sapiens
gggctttttggtgttctgattctttcctcactagcagaggcagtgaatttaacactcagatttgctc

SEQ ID NO: 6808977 - DNA, 58 bp, Homo sapiens
caggaggacatactggctcacacataaaaagaaagttttggaacagatgatccttctg

SEQ ID NO: 6808978 - DNA, 79 bp, Homo sapiens
agtcccaggactgtccttggtatgaccaaggtttctgcaaggacggtgaggccttggaagccagggagccctaggggct

SEQ ID NO: 6808979 - DNA, 56 bp, Homo sapiens
ggaaatatttgatcaaatttaaggaggcatttctttaaccttggtcaagaatttcc

SEQ ID NO: 6808980 - DNA, 60 bp, Homo sapiens
gagtcccctctaacccaactttattatgtattaataataataaagctgctcagggggctc

SEQ ID NO: 6808981 - DNA, 73 bp, Homo sapiens
tgaagtgcaggctcagagccttattgatttcccataacaactgatggatctttagggctctatttttatttca

SEQ ID NO: 6808982 - DNA, 55 bp, Homo sapiens
aagctctgtctcttgggagttaggtaactgactgtcttcctggatctcatagctt

SEQ ID NO: 6808983 - DNA, 60 bp, Homo sapiens
agcaacagtgtatatcataggccctcaacaaacaatgcctgctgtttctttactgttgct

SEQ ID NO: 6808984 - DNA, 65 bp, Homo sapiens
gtctggaagcaggccagtatgagacaggagtccccagggactctgtagggacggttctcccagac

SEQ ID NO: 6808985 - DNA, 91 bp, Homo sapiens
tttgtacagtgaaaggagcttttcctttgaaaggtgagggcttccaacatgaagttaccttagcaggggtgaagattctacattggacaag

SEQ ID NO: 6808986 - DNA, 85 bp, Homo sapiens
gaattacacaatctgtttttccatttgaatgaaacatcatgaacattgcgattttgttaaatggtaaaactgtgttgtgtggttt

SEQ ID NO: 6808987 - DNA, 70 bp, Homo sapiens
ggaagtgtttgtgcagatggccacctgagtctgtcacctccaggcatagccaatgacaagtatcacttcc

SEQ ID NO: 6808988 - DNA, 127 bp, Homo sapiens
gggggaatcccgtgctgaatgcaggagtgccggggttcctgggttttctgccgattgttccaggttcaggagctgggagggagcagagaacccaaccgccaccctcccgtagtccacgggtgccccc

SEQ ID NO: 6808989 - DNA, 80 bp, Homo sapiens
aggggctaagaatcaagaaatagggatcaaaacaataccaggaatttgaaattccttgaaaatcttggtttagagtccct

SEQ ID NO: 6808990 - DNA, 62 bp, Homo sapiens
ttctctggtttgctgtttctgaaaggagttccctcaacagagtacaacagttaatgggggaa

SEQ ID NO: 6808991 - DNA, 58 bp, Homo sapiens
tggtgctgcaaagcctgtgcatctctaattatattttatgctaggctgtgcaatacca

SEQ ID NO: 6808992 - DNA, 92 bp, Homo sapiens
tctttcctaaaatattacagatagatgatcatttatgagagtacaggttacttcacaaagagatcatctaatgattggaataacaggaaaga

SEQ ID NO: 6808993 - DNA, 66 bp, Homo sapiens
tggaggcctcctcaaatttttaaattgtatcataattttatttaaaagttttgtgggaggttttca

SEQ ID NO: 6808994 - DNA, 92 bp, Homo sapiens
cctgatgagaagactgtttgtattcataaataatctgtagttgttttagtcttattttccagaagcaggtatttcatggagcaagcagcagg

SEQ ID NO: 6808995 - DNA, 82 bp, Homo sapiens
gagagggtctgattgcctgtgtctccctgtacctccactcccaggccgaactgggcagaggacagggaagatcagacccctc

SEQ ID NO: 6808996 - DNA, 61 bp, Homo sapiens
gagaggaaggatgcatatccaaagattttatgtttatcttgagggttctatcttgtttctc

SEQ ID NO: 6808997 - DNA, 73 bp, Homo sapiens
cacccatttttactagggtgtaagttctgtcttgagcatccttcctacccttaaggagcttgcactctgggtg

SEQ ID NO: 6808998 - DNA, 94 bp, Homo sapiens
cagaacagcaagagaggcagggcaaatagatggagaacaaccacaggcacatcaagttttccctgaagcctctccccacagcatttttgttctg

SEQ ID NO: 6808999 - DNA, 56 bp, Homo sapiens
gtcaagacttcaccgctctgtgcttcccttctggaagctggagggtaagtttagac

SEQ ID NO: 6809000 - DNA, 58 bp, Homo sapiens
gctcaggctggattgcagtggcacaatctccgctcactgcaacctcttcctcctgggc

SEQ ID NO: 6809001 - DNA, 72 bp, Homo sapiens
atttacccattttttttcatgagagacaggttatacatgtttgatctgtgataggaaaataaatggctaggt

SEQ ID NO: 6809002 - DNA, 59 bp, Homo sapiens
cccagaggctggcagccagctgataccggacagggttcacaggggccagcgctctgtgg

SEQ ID NO: 6809003 - DNA, 106 bp, Homo sapiens
ggtccttttggaaccattgcctttttggtgataatttgttactgttccaaacagtcattagaaacagtacaaatgcagccagagtagttgggagctaaatatgact

SEQ ID NO: 6809004 - DNA, 81 bp, Homo sapiens
ctgcccttttagaaaaggtttgccgacctctgctttagagggttatgaacagggaatggcacaatctgacgggaagtttag

SEQ ID NO: 6809005 - DNA, 57 bp, Homo sapiens
ctcttggtactctcttgaaggcctttctagcaagacaggtgtgagagatgctcgggg

SEQ ID NO: 6809006 - DNA, 92 bp, Homo sapiens
gaggaaggatctcttgaacccaggcttttgaggctgtagtgagctgtgatcgcaccatggtactccagcctgggtgacagagaccttgtctc

SEQ ID NO: 6809007 - DNA, 61 bp, Homo sapiens
tattcacagttaacaatgtgtacatctctgtggggggaataaaaattgtttactgtagata

SEQ ID NO: 6809008 - DNA, 58 bp, Homo sapiens
cctacccttctccccctctgcggcgtggtgcgcatgcgaggcgggaggaggccttagg

SEQ ID NO: 6809009 - DNA, 65 bp, Homo sapiens
tgatctgtggtcaagctgctgtgacttaactttctctgtttagatcagtggctgataacaaatta

SEQ ID NO: 6809010 - DNA, 59 bp, Homo sapiens
ggagtcagggaggaaggggtgcttggaggcagcccaagacaaacttccttcactgcacc

SEQ ID NO: 6809011 - DNA, 62 bp, Homo sapiens
cctggccctgaaggccttgagcattaggatgtgtgctgagccaaggtcgccccagggcaagg

SEQ ID NO: 6809012 - DNA, 55 bp, Homo sapiens
ggccttgtgtggctctcagctgcccctcctctgagcagctggagccaagagggcc

SEQ ID NO: 6809013 - DNA, 55 bp, Homo sapiens
gctggcaggagcctttccctttcccgggtttgggtacaaagaggctcctccttgc

SEQ ID NO: 6809014 - DNA, 64 bp, Homo sapiens
gatgtgctgcctctcacagaattaggcagcacatccctaagaactgctgagtaggtagcatttc

SEQ ID NO: 6809015 - DNA, 77 bp, Homo sapiens
gtgtagcttgctcattaaaatctgcttccttttacagaaatgttttttatgtaaagtagatggcaggtaaaaaacac

SEQ ID NO: 6809016 - DNA, 77 bp, Homo sapiens
cagcctctgcaactccgccttggtgcccccgcacgttccaggggcagccacactgatggattgctcagaacgggctg

SEQ ID NO: 6809017 - DNA, 60 bp, Homo sapiens
tactagactgaaccctctgctgcactgccacccttggcacaaacgagggctcagtgagta

SEQ ID NO: 6809018 - DNA, 98 bp, Homo sapiens
ggatagtatatgtgtttatcaccagtttgtcaatgacttaggcgttgtgtttctcaactctctgaagttggcagagcaggataggtacaatactatct

SEQ ID NO: 6809019 - DNA, 56 bp, Homo sapiens
tgggggtacccatttgtcgccagtgtcgggaaacacagtgtgttctgggacctcca

SEQ ID NO: 6809020 - DNA, 65 bp, Homo sapiens
gcaggatttcatacatctttactgaattgaaatatttattcataaggtgtagtgatatctgttgc

SEQ ID NO: 6809021 - DNA, 100 bp, Homo sapiens
atttttgtcttgttagaactaggatatgagtaagcctttgttgctatcactggatgataaaaagaaggttattcaaattcttccataaaatcacaggagt

SEQ ID NO: 6809022 - DNA, 66 bp, Homo sapiens
aatccttcagcaaccagaaaggctgggtcacttggccagggcttcagttagtggtgagctgggatt

SEQ ID NO: 6809023 - DNA, 62 bp, Homo sapiens
ctcccatattcgtatcttgaagtcctaaccctcagggcttcagaatgggactgtgtttggag

SEQ ID NO: 6809024 - DNA, 84 bp, Homo sapiens
ctcaccactgagcttggccaggaatgaatggggcagggcaaggacagtcccattcagagctatgggtgcagctcccagggtgag

SEQ ID NO: 6809025 - DNA, 58 bp, Homo sapiens
tgcaacctgaactttctgattctgccaggcccttttggaatcagcaaggtaggatgtg

SEQ ID NO: 6809026 - DNA, 59 bp, Homo sapiens
tagaagacccttgcatgaattaattcagaattatttctggaattgcaggctgtcttttg

SEQ ID NO: 6809027 - DNA, 104 bp, Homo sapiens
caggcttcctgctgcctagggatttctggagatactgctctccatattccccatggagttatggtctctgtattttcaggtctctcctggaagatggaaacctg

SEQ ID NO: 6809028 - DNA, 59 bp, Homo sapiens
gcgatggccagatgaaataatagagttaaatacatctatgttgttctctggtttaaagc

SEQ ID NO: 6809029 - DNA, 56 bp, Homo sapiens
gggccttagagatcttttgtttaccctcttttacacaaatggagaaactgaggccc

SEQ ID NO: 6809030 - DNA, 55 bp, Homo sapiens
ttgagatggagtctcgcactgttgcccgggctgtagtgcaatggcgccatctcga

SEQ ID NO: 6809031 - DNA, 82 bp, Homo sapiens
ttttttgttacctccccaactagaatgtaattccctgaggatggggacagaagtcacatctaattcggttaggttcaagaaa

SEQ ID NO: 6809032 - DNA, 88 bp, Homo sapiens
ttttgagtggcagcagggtatggtgggaagaatcagaggcatgaactcccctcctggtttgcccacaccagccacgggtcactcagga

SEQ ID NO: 6809033 - DNA, 79 bp, Homo sapiens
aggccaagagccctgctcatctggatcccgcactgaggctggctagaactcccgggcagtgggccgggctgttgggcct

SEQ ID NO: 6809034 - DNA, 62 bp, Homo sapiens
acatggctttctctaatgtggtattgcaaatatttgtcgtgcccagtaaatgaaagctttgt

SEQ ID NO: 6809035 - DNA, 59 bp, Homo sapiens
ggctaatggaggtgtctggcctggtagatagagtgcagggtgctgcgcctccactggcc

SEQ ID NO: 6809036 - DNA, 99 bp, Homo sapiens
gctaactgcactaaccaggagagctggctggttggggagaagacactaaccctgtgagtctgacctcagccagctaacctgccctggggtgccaccagc

SEQ ID NO: 6809037 - DNA, 116 bp, Homo sapiens
gttgattccacccaatgcacagacctatgtggaaaccttgaagccatagttttctctataactttaatgtgcttcattctacatgacattgaaggcctgtgtcaattatgaaaaac

SEQ ID NO: 6809038 - DNA, 75 bp, Homo sapiens
aatgcatatttcctagcttattgctacttagtactaaatttagaacctggagttaaggcctaagaaataggcatt

SEQ ID NO: 6809039 - DNA, 80 bp, Homo sapiens
gggggctgaaaactggggcctgaaaggttctcgcccagctctcctgggccggagcggacaggtcctagcagacagtcccc

SEQ ID NO: 6809040 - DNA, 79 bp, Homo sapiens
acatagataggggttcagagtcaggatctaagtcccaagagaacaggactagggctggtctttgaggtgctgataatgt

SEQ ID NO: 6809041 - DNA, 94 bp, Homo sapiens
aggtaatgctaaacaatgcctgtattaagatacgtagttgtaaatttcctggtttaaaagcatatgtcttatatatttaaattgttgcttatct

SEQ ID NO: 6809042 - DNA, 129 bp, Homo sapiens
attctatcaatacctttccatctggcagaggtctgtggtggtgtgggcaaggaaaagaaaattctattcatcttcttttcctgtccaggcaattattgaccttctttcagtccttctctttgatggtat

SEQ ID NO: 6809043 - DNA, 58 bp, Homo sapiens
tttcctaacacaatgcatgagatatacaaatagacatgtcatgttttgtgattggaaa

SEQ ID NO: 6809044 - DNA, 61 bp, Homo sapiens
ctggacctctcctccccaggcccacaccatgtaccaagtggggctgatggagacggaccag

SEQ ID NO: 6809045 - DNA, 73 bp, Homo sapiens
tggtgggagatcagataagcaagtatcgagagattgaaatttaatgattacaattgtcttagatttctcatca

SEQ ID NO: 6809046 - DNA, 56 bp, Homo sapiens
tccctgtctagtacaatgagggctaacacaccttcagagaagttgtaggctgggga

SEQ ID NO: 6809047 - DNA, 64 bp, Homo sapiens
gcttgctgtcaagcgtaggcttttattgctttgttttggtcagtgcatgcttgacttagcaagc

SEQ ID NO: 6809048 - DNA, 60 bp, Homo sapiens
gctggagctgcagcctgggccttggtttgatccttggccttggcctttggccagcacagc

SEQ ID NO: 6809049 - DNA, 60 bp, Homo sapiens
gtttgaaattcaacaacgctcaggtccgtaagaccctgggcttgacgttgtggaattaac

SEQ ID NO: 6809050 - DNA, 72 bp, Homo sapiens
tgtgtgtgtgtgtgtgtgtgtgtgtgtggtgtgtgtgtgtgtgttgtgtgcatgcaaacacgtaaacattca

SEQ ID NO: 6809051 - DNA, 65 bp, Homo sapiens
gttggcagaattcagttccttgtgattgtaggactgcagtgcctactttcttgctgtctgtcaat

SEQ ID NO: 6809052 - DNA, 65 bp, Homo sapiens
ggcattatctgtatccccatctagctaggtcatcaccatcttgttagtgtggatgagacagtgtt

SEQ ID NO: 6809053 - DNA, 63 bp, Homo sapiens
ggaggcattatgttaaaattttgtcttggaaaccaggtcaaagaacctagctatagtctttcc

SEQ ID NO: 6809054 - DNA, 88 bp, Homo sapiens
ccaccgtggaataacgtgcaacattgcttctgaacataggaaactcattttatggcaaaagaaatgtggcagttggcttttactctgg

SEQ ID NO: 6809055 - DNA, 58 bp, Homo sapiens
cctgctcaattccggcacgctggccctcgctcagacggcactgcgcctgattggtagg

SEQ ID NO: 6809056 - DNA, 68 bp, Homo sapiens
ggtgtctctgtggctggctccttccagcggttccaccctctgggcaggaggcgcagccacggatagcc

SEQ ID NO: 6809057 - DNA, 114 bp, Homo sapiens
gtaaaccaaaggtatcgaatttgtggcttttgctagctttgcagaaaagatttttttaaaatacatttcttgatagtgcaaaactagcaaaagccacaaatggaatgggtttgc

SEQ ID NO: 6809058 - DNA, 105 bp, Homo sapiens
gaaacgcctcactatgtcaaggagtcgtctcatggtggctgtcacatgaagcatgaaggagtgtgatggaggacccagcgtgggaggacagacagtgaagccgtc

SEQ ID NO: 6809059 - DNA, 66 bp, Homo sapiens
taagtcaggaggtctcctgacactttgccttttgataaggaacagtcaggggtactttttaactta

SEQ ID NO: 6809060 - DNA, 76 bp, Homo sapiens
gtatagcacttttgtagagctcagcattggctccattcccagcctgctgctagctgtattgcaagagccagcatgc

SEQ ID NO: 6809061 - DNA, 90 bp, Homo sapiens
ggaagcccgtggcgcttgcagccccatcagccttgtttcttcagtaatttcagcaaggtgagtcctcagctgacacggtatgggtatgcc

SEQ ID NO: 6809062 - DNA, 106 bp, Homo sapiens
attattgtatttatttttaggttgttaaattatttatgttaacagtcgagagacttctctgttttttaactaatgaatgttgacttctctaagtaaggttagtagt

SEQ ID NO: 6809063 - DNA, 70 bp, Homo sapiens
ggcaggaacacaggtggcccggcagggaaggctgctctggccctgccttgcctccccacccagtattgcc

SEQ ID NO: 6809064 - DNA, 128 bp, Homo sapiens
ctgactttgctgcatgggaaagggcagggataaggagcagggctgccccagtccagccggatccaggctctgatggacatggcagccctcactccttctcctccagccctgtggggtgcagctgttgg

SEQ ID NO: 6809065 - DNA, 95 bp, Homo sapiens
gcactctaagattttctactctgaggtttcctgaagaccttttatctattttacatatatagtctgggcttcagagttagagagttatggagtgt

SEQ ID NO: 6809066 - DNA, 58 bp, Homo sapiens
ggtatcaggacttcattccttttaatgtttagataatagaggaggtgattcttgagct

SEQ ID NO: 6809067 - DNA, 91 bp, Homo sapiens
agaaggagaagacttcaaatctcttgaaagcaatgggtttttccttcacctagggatattttgacttttaacagtgagtctatcttcttct

SEQ ID NO: 6809068 - DNA, 76 bp, Homo sapiens
gagctcaaattttccagtgagcaaatgtagaattttaattagcttcgagtccatttctctgctggaaatagatctc

SEQ ID NO: 6809069 - DNA, 69 bp, Homo sapiens
actgaactgatgccaagagtgctcccaggagacagaccttcaaaggcagcatcttgatattggtttggt

SEQ ID NO: 6809070 - DNA, 80 bp, Homo sapiens
cctttctgcaatggacagctctgagcagggcctgtgtacaaccctgcatttcaactgagctgcaccattgaatcaagagg

SEQ ID NO: 6809071 - DNA, 113 bp, Homo sapiens
gagcctgaatccccctcacctctagacggcactttccagtctatagagcaggttcccatacagctttgtaaggtaggtgtgatcaggcgctctcaaggtgaggaaacaggctc

SEQ ID NO: 6809072 - DNA, 83 bp, Homo sapiens
gctgtgttgcacagctccatgggactccattcacatcgaaagtgtatgcagtgtgtggcccttggagttgtgacctgtacagc

SEQ ID NO: 6809073 - DNA, 103 bp, Homo sapiens
cccgcgctgtcctggggagcggtttgctttcctaactcatcggatgtaccaccctggatacacacccttgataggactgcggtgctcggccgggcagcctggg

SEQ ID NO: 6809074 - DNA, 98 bp, Homo sapiens
gattctccagagatacattatctccaaatcaatcaatatgaaggctcactttgtctttaatgggatccatctggttaatgctgtgtttcttgagtttc

SEQ ID NO: 6809075 - DNA, 60 bp, Homo sapiens
agattggtgttgcagaaccatgaatgtttaacaatttgtcagttcagtatacactattct

SEQ ID NO: 6809076 - DNA, 85 bp, Homo sapiens
cacatctgcaacatgggaatatactagtcctctgcttccctccttgggttgcctgaggacagtgtgaccatggatgcgaagagtg

SEQ ID NO: 6809077 - DNA, 75 bp, Homo sapiens
tattttggctattctacgagtttggtaatttccttattatggaaaatagtgaacatcataggtaattctagagta

SEQ ID NO: 6809078 - DNA, 71 bp, Homo sapiens
agaaagatctgacttagacacagaataagctgcttgtgctgggtgtgtttgtgagctgggtgaggttttct

SEQ ID NO: 6809079 - DNA, 70 bp, Homo sapiens
caaaacaatgcacatactacaatctctgttaacttgggttatcagagattgtagtatgtgcattgttttg

SEQ ID NO: 6809080 - DNA, 63 bp, Homo sapiens
ttctcttgagctggtcatgtttctctcagaataatgttgtagtgtgtgcctagttttagagaa

SEQ ID NO: 6809081 - DNA, 82 bp, Homo sapiens
gagacagctctttttgtaaagggtcatttctgtccggcagctgagctctgggacagaaatgatgtttggcaataccagcctc

SEQ ID NO: 6809082 - DNA, 129 bp, Homo sapiens
cgtctcccaggctgtagctctcactgtctgtctgttcctgctggctcttctgggttctgtgtctggggcaagagaagagagaagggagggccagagagatgaaggggaggggagagtcacagagagggg

SEQ ID NO: 6809083 - DNA, 67 bp, Homo sapiens
gtcagggatgagaaagctctctaaggctcattttatttagtgcctgcagggttttgttattctctgc

SEQ ID NO: 6809084 - DNA, 58 bp, Homo sapiens
ggtgttggattctgagcatttaaagcattcgttttgaaaggcctgtttatccagcatc

SEQ ID NO: 6809085 - DNA, 89 bp, Homo sapiens
ctttcattccaatttgatgtaagccataaatgaaatgacttggctgattataagtcagttccccatgaacatttgtttacatctgaaag

SEQ ID NO: 6809086 - DNA, 83 bp, Homo sapiens
gcctcctgttaaccctgtagcagctgacctggctaagggagctcaggccctgccatctcccctgttacactaggtcactgagc

SEQ ID NO: 6809087 - DNA, 103 bp, Homo sapiens
gttgtaactccacttctgcctctttggtcaattgctgtggggaatttaaggaagaatctccttgcagggtttgataaagatgtgtaagttgataagttgcaat

SEQ ID NO: 6809088 - DNA, 58 bp, Homo sapiens
tcctgggggtttaatgagcaaccagataatctcctgctccagtgcctgccccacagga

SEQ ID NO: 6809089 - DNA, 61 bp, Homo sapiens
ctttgcatccagaaaagggttttgtacctgggtcagagatacttttctttggatgcataag

SEQ ID NO: 6809090 - DNA, 73 bp, Homo sapiens
gaaggctttcctcctggcttgcagacagatgctttcttgctgtgtcctcacatggtggggagagagagctgtc

SEQ ID NO: 6809091 - DNA, 63 bp, Homo sapiens
ggaatgggagctaagtcctggaggcacatgagggcctaagagattattgctcctgcaaatttc

SEQ ID NO: 6809092 - DNA, 90 bp, Homo sapiens
tctgacttggaagtccatttggagaagtcttcagcttgttcacacaataggcaagggtaaaggcattcaagatggaagttgaagtacaga

SEQ ID NO: 6809093 - DNA, 88 bp, Homo sapiens
tgattaaaatatgcattgcttgagggtaggaacctaccttaaggttctttttattcccctcaagcacttgctgcatggcctatgatca

SEQ ID NO: 6809094 - DNA, 78 bp, Homo sapiens
ggcggggctgccaggctctgcaggcacccagggtggggaggccacccttcctgccctacccgcagaatggtgctctcc

SEQ ID NO: 6809095 - DNA, 80 bp, Homo sapiens
gtgcccatttaaaatgtaggtttctgacccacccagtggcgtctgagtcagggtcctggaatctgcattttaacaagcac

SEQ ID NO: 6809096 - DNA, 59 bp, Homo sapiens
tccttgttctagtcagaaatttctaggtgcttacctaggccacagatgagacataagga

SEQ ID NO: 6809097 - DNA, 72 bp, Homo sapiens
gtggcactaaatacagcatttcagggaagcaaataaatatgctttataaagaaaacagctgtatttttccac

SEQ ID NO: 6809098 - DNA, 55 bp, Homo sapiens
tacgactgtacaaggcatattgaaaaccttcagtattagtgtctttgctgttgtg

SEQ ID NO: 6809099 - DNA, 62 bp, Homo sapiens
cagcattcatgcaaagccaattccagctacagactgcagcttggggttgtcttctgcagctg

SEQ ID NO: 6809100 - DNA, 93 bp, Homo sapiens
tgtgctttcattcagcaggatctgtttcttctagtgaagaattattcattcagattaattcaacttacaaaggagaagagttccagagacaca

SEQ ID NO: 6809101 - DNA, 61 bp, Homo sapiens
caccaggaagctgcaatttgaggagtggcaacactggattcaagatacggtttccaggctg

SEQ ID NO: 6809102 - DNA, 88 bp, Homo sapiens
tgcctagcgggtccttgggtcagtgagtgaggtgccgcgcgtaaaccccgcactctcctccctgcccacagggatcgcccgttgtgca

SEQ ID NO: 6809103 - DNA, 82 bp, Homo sapiens
gcaccgtctgtcccatcacagttttaccatttggtactctctggagcattgccatggcctagacctgtgattaaattggtgc

SEQ ID NO: 6809104 - DNA, 81 bp, Homo sapiens
ctatgacaaaacatatctacggatacgattaaaccacattttcaattgtatgatcgttgatgtgatgttgggtgtacatgg

SEQ ID NO: 6809105 - DNA, 80 bp, Homo sapiens
tccagtcacatcagaaagttgagtgctgatctgattatttcacttaattgcataaaattcaactctgtgacatccctgga

SEQ ID NO: 6809106 - DNA, 96 bp, Homo sapiens
gctgatgcaccaggctgagcctctcatctgcagttttctgtgactccatgttttgtgctgccaagggtgggggagcttgcctggcttgccaccagc

SEQ ID NO: 6809107 - DNA, 64 bp, Homo sapiens
cccaccccctgcagcatgacactgccatcctgctcatcaggtactgcagctgcaggagggtggg

SEQ ID NO: 6809108 - DNA, 72 bp, Homo sapiens
gagtatctggttccagagtatttcatttcagttttaaaaggactttacgaatgtctttctggaatactattc

SEQ ID NO: 6809109 - DNA, 64 bp, Homo sapiens
atggagcattcttttactttaggataactgactttgatgtcttccttgaaaagaatgtctccat

SEQ ID NO: 6809110 - DNA, 73 bp, Homo sapiens
acatttccagatatcaggcaatatggaagctacagagatgaagtctctgaagctcaattgagataggaaatgt

SEQ ID NO: 6809111 - DNA, 58 bp, Homo sapiens
agctgctagaaaattagagtatatcagtatatgagattgctgtaggtttcgtggcact

SEQ ID NO: 6809112 - DNA, 71 bp, Homo sapiens
agaactagtttgaaccaggctaatccagttccaattggttgaaactggattaactggctcaaatcaatttt

SEQ ID NO: 6809113 - DNA, 79 bp, Homo sapiens
gttcctatttttcttattttgccatgggccagtggaaaacttaccactagttctaggtatagtaagaaattcctgtgac

SEQ ID NO: 6809114 - DNA, 105 bp, Homo sapiens
agcagccagaagttcacacccagaagccctttgtttgttgtgttgttgctaacagagcctgaggtctaacaggggtttcccgggtgtgttgattagctttctgct

SEQ ID NO: 6809115 - DNA, 73 bp, Homo sapiens
taagtatacctgctttgataggttgtggagaagattcaatgagtaactctagaatgaattagcgcagggcttg

SEQ ID NO: 6809116 - DNA, 76 bp, Homo sapiens
tggctatttttaatggatttagcatcatttaattttgcctaaatgtaattgtacgatgttaaatcagtttcagtca

SEQ ID NO: 6809117 - DNA, 66 bp, Homo sapiens
ggtgtgacccggggacggagccagggaaggagactttggaaggtcgtccgtgtggtattttatact

SEQ ID NO: 6809118 - DNA, 59 bp, Homo sapiens
acagcgagaaggacaggtccagttctgcttgatgatgaagcctgtgtcttctctgctgt

SEQ ID NO: 6809119 - DNA, 60 bp, Homo sapiens
gcagaggacacaggagggcaagttgagctccctcatccctaaatccttcagtgcctctgc

SEQ ID NO: 6809120 - DNA, 66 bp, Homo sapiens
aatgtgggcatttaggatctttagttgaccaatccttcttgcttatctaacctagatgtctgtgtt

SEQ ID NO: 6809121 - DNA, 87 bp, Homo sapiens
ttaggcattccggacaagacaattcttcgttgtgtgtggagagggaggctgtcctgtgctttggaggatgttcggcagcatgtctgg

SEQ ID NO: 6809122 - DNA, 58 bp, Homo sapiens
ctggctttgctggactgggagtcccagggcagtgtgctcctccctcttgcaatgtcag

SEQ ID NO: 6809123 - DNA, 83 bp, Homo sapiens
ctgtccatctttctgtctgttatctcaccagtccccactactgggagaccccaatgtggcagattagaaggagcactggacgg

SEQ ID NO: 6809124 - DNA, 59 bp, Homo sapiens
gggaaggaaagttattagcagagatctcccagaagtcctctgtaactgtcccttttgcc

SEQ ID NO: 6809125 - DNA, 77 bp, Homo sapiens
gtggaagatggacatgtaaatggcaattatggtgcagagtgataaaccattattagccataatagtaagctttgcac

SEQ ID NO: 6809126 - DNA, 72 bp, Homo sapiens
ggaggcagtgaattcttcagtttctgggactcctggcaacacagggcctgtgagaatcaaggaaaagcttcc

SEQ ID NO: 6809127 - DNA, 61 bp, Homo sapiens
ctctttcctgtgaaatgccagaccatgaaagactgtttggctgtgatttgcacgagatgag

SEQ ID NO: 6809128 - DNA, 86 bp, Homo sapiens
ccaacaactagattaggaaggacttggattctggagccagacagcttcagcttaaatcccatctttgtctctttcacgttgtgtgg

SEQ ID NO: 6809129 - DNA, 107 bp, Homo sapiens
ccttcaatcagcgcagttccacccgtgtttactgagcctgtgccctcatcaggcctctgtggggtgctgggctcaggtgggggaggcagggaactgtgggatgaggg

SEQ ID NO: 6809130 - DNA, 71 bp, Homo sapiens
ccagtgacagccccaagatggccagcagggacttgaccctgagctcaggcccttggggaaaatgctgctgg

SEQ ID NO: 6809131 - DNA, 69 bp, Homo sapiens
ggaatacttcccagatctaattatcctttgagatataacctggatagcacctcctcagggaagtcttcc

SEQ ID NO: 6809132 - DNA, 56 bp, Homo sapiens
aagcagctgtgtgacataatctggtttgcatgttgggaaggtcacactggctgctt

SEQ ID NO: 6809133 - DNA, 84 bp, Homo sapiens
agttggttttagttttgaactcaggagtaactgatgtttgccatgtgctttctggaagttacctgattccaactggcgccagct

SEQ ID NO: 6809134 - DNA, 99 bp, Homo sapiens
gtttccagctctagtagtagtagtagtagcagtagtagcagtagcagtagcagcaacagcaactcctgcttctgagtatttactacaggcatgtgaagc

SEQ ID NO: 6809135 - DNA, 93 bp, Homo sapiens
tataaggtagtcttgatatttttgaaggctgaaagagtgaaaaaaacatatgccattagctagaaataagattaactcaagactgcacttgtg

SEQ ID NO: 6809136 - DNA, 59 bp, Homo sapiens
gaggacctggacacagagcggagaactggaccccactagacactcctttgtctgtcctt

SEQ ID NO: 6809137 - DNA, 64 bp, Homo sapiens
ggagttaaaaccttaaatttctctgtgatctgtgattaggcaaagaaagccaaggtctaactct

SEQ ID NO: 6809138 - DNA, 63 bp, Homo sapiens
gtatccatgcctatatgcatgcatgtctaaatattcatgcacatgcatttacagtgtggatac

SEQ ID NO: 6809139 - DNA, 86 bp, Homo sapiens
ggaagggacaggaaggaggcaggcaggtggcatcttgtgaacaccttctgggtgccctttgctctgttgagtacttccaactttct

SEQ ID NO: 6809140 - DNA, 77 bp, Homo sapiens
tcacctggattggggtctgacactgcttgtgttcagcagagggtgcagtggcagtgtgacgctgttctccgtggtga

SEQ ID NO: 6809141 - DNA, 73 bp, Homo sapiens
gcttcattatttatgtatgtggatgtgtttacacagtgattttcagaagcacacctattacataaatgggggc

SEQ ID NO: 6809142 - DNA, 130 bp, Homo sapiens
gaatttggtgagggagccagcagctctgatggctatgtcgttggtgtggaagttggtatcaatcacaagtcgactgtcatacacaagacatgcatcattgagggctttaaacgtttcataatccacattc

SEQ ID NO: 6809143 - DNA, 79 bp, Homo sapiens
gggggactgggtcagtttctgttctggttccaaaccctcccaggaaggccaggctctcagtgactgcccctcacccacc

SEQ ID NO: 6809144 - DNA, 103 bp, Homo sapiens
ggccagaaagaggaacctaaataacttgtgagagcagctgggcctgggactggcaggctgaaactcggggtctatgaagtgagttcccatgtctttactggcc

SEQ ID NO: 6809145 - DNA, 60 bp, Homo sapiens
ggcagttgcgtgcatcagtggttggttcctctcggttgcgtggacgtactgcagcttgct

SEQ ID NO: 6809146 - DNA, 60 bp, Homo sapiens
ggtgcctggggatcagcagaatgggactctgttctggctctctcatcacccaatggcatc

SEQ ID NO: 6809147 - DNA, 63 bp, Homo sapiens
cttacaatggaagaggcttaagatttatgtatttgaaacattgagttctacttccatttcaag

SEQ ID NO: 6809148 - DNA, 81 bp, Homo sapiens
cacttctttaaatttatagatttatttgcaaaaatggggtattttcaatatcccaagatacgctgtaagaagaaaaaagtg

SEQ ID NO: 6809149 - DNA, 61 bp, Homo sapiens
gaagacctgttagcattcagctgcattcctgtggattagaaagctccagtgctgacgcttc

SEQ ID NO: 6809150 - DNA, 56 bp, Homo sapiens
ggaggcatctctgtggctgtctccacggtgaagggggcatctccagggctgtctcc

SEQ ID NO: 6809151 - DNA, 63 bp, Homo sapiens
ggttctgaagtggtcccattccgggctgtgctgaccttttttccgggaccaaagatcagaact

SEQ ID NO: 6809152 - DNA, 100 bp, Homo sapiens
tgaggcaggagaattgcttgaacccaagaggtggaggttgcagtgagcctagattgctgccactgcactccagcctgggtgacagcagaactctgtctca

SEQ ID NO: 6809153 - DNA, 107 bp, Homo sapiens
atactttgtgttttcacgtcttcaattgcatttgatgggaccagacatgagcaccaaaccaaagcttaccaatcagatgcagatgagaaactggaactgagaagtat

SEQ ID NO: 6809154 - DNA, 114 bp, Homo sapiens
ggctgggcggatctttggaacttgactaggctcaggcctctatggtcagctgagggccaggaggtcgctctgctgaccttggtgggctccttgttggcgaacatctggccagcc

SEQ ID NO: 6809155 - DNA, 63 bp, Homo sapiens
ggagctgttatggcataagcatgtcttctgaccagacagctgtaaaaatcccaagacagcttt

SEQ ID NO: 6809156 - DNA, 107 bp, Homo sapiens
gccgccgagccccccatttccagggccagggacacgctgtcaggctccaggtcatccacctcactggctgtgtccctgtccagagtaggggaggacggcacggtggc

SEQ ID NO: 6809157 - DNA, 78 bp, Homo sapiens
ggtgtggggctggcctaggcaggctgagggctatttctcctactgtggcccaggggctcttggtgttggtcctgcaac

SEQ ID NO: 6809158 - DNA, 125 bp, Homo sapiens
agaaaatatcatgcgagtgtgaaacaagggagttgaaaggtgctttcactcatttcacattatgaattctatccagtgaaagcactcacttctgctcttttcttttaacatcatcttgactttct

SEQ ID NO: 6809159 - DNA, 93 bp, Homo sapiens
tacattcattttgtgtttgttttgtagaagtattatagaaggtgctttataaatattttctttaattctcacagcaatcataaaaggaaggta

SEQ ID NO: 6809160 - DNA, 104 bp, Homo sapiens
tgacaaattaacgacttgatcgtcctcgtctgtgaaattgggataagaacgcctagttcttaaggctgttgcagaaggaatgacatgtcgtgttatttccctca

SEQ ID NO: 6809161 - DNA, 63 bp, Homo sapiens
ttcccttgcgccagggcttcactggacccttataaactccgcctggcttccaaggtaggggag

SEQ ID NO: 6809162 - DNA, 75 bp, Homo sapiens
tggagtgatggtggagatgagtttggctatcttaggagatagtgcatacacagcttatttctttgccataatcca

SEQ ID NO: 6809163 - DNA, 76 bp, Homo sapiens
agcagagccctggcagcgtgagcagcatccacctgcagaggcacttgggagtgtatgctcgacctgcacctctgtt

SEQ ID NO: 6809164 - DNA, 87 bp, Homo sapiens
gaatggctgcaaaagggctgattagagtgttaatgaggaggccaaagagattacctgctgtgtggggctctaacagctcagctattc

SEQ ID NO: 6809165 - DNA, 81 bp, Homo sapiens
ctgaacgatctgtttctccaacattgtgagcattgactatccataaaaagctcatcatggtcagaaacaatgttcgttcag

SEQ ID NO: 6809166 - DNA, 58 bp, Homo sapiens
gctgggaggcagcacctttagcaacccttgaagtctgagaacactgtgctctcctagt

SEQ ID NO: 6809167 - DNA, 90 bp, Homo sapiens
tcctgaacttagtgggaatatctctagtacttcctcactcacactaaaactgcctttgtgacaaaagagatattatttaccaagttagga

SEQ ID NO: 6809168 - DNA, 62 bp, Homo sapiens
tcatagctctgtcacctggcaaagttaggaaactacagctttatcctgatcagggttattga

SEQ ID NO: 6809169 - DNA, 58 bp, Homo sapiens
ccctgagggcaaagagcagaggggtgctctctggtggcccagcagttctgccccaggg

SEQ ID NO: 6809170 - DNA, 85 bp, Homo sapiens
tgtgaaaacatgagatttgggaggggccaggggtagaatgatatggtttggctctgtccccacccaaatctcatcttgaattata

SEQ ID NO: 6809171 - DNA, 64 bp, Homo sapiens
gggactgtccggcagaaggtacacacgtcgtagggtgtgaggccttcagctcgggaaggctccc

SEQ ID NO: 6809172 - DNA, 80 bp, Homo sapiens
gaacactacaaacatggtggagccatgaaactggaactggtccaaagcatttggctcccaccatgcagctgtggttgctc

SEQ ID NO: 6809173 - DNA, 69 bp, Homo sapiens
caagaatagcagatatcccagctgatttctgtagcaggcagaagtgttcttcctatctgctgttctctg

SEQ ID NO: 6809174 - DNA, 56 bp, Homo sapiens
tctattttcttgccaaaactgctgcacaattggttgtagaggggtcagagaaggga

SEQ ID NO: 6809175 - DNA, 65 bp, Homo sapiens
ctgagtcacctctggatgtagcggaatgacacagcttcctcagactgcaaatgcaaggtgaccag

SEQ ID NO: 6809176 - DNA, 84 bp, Homo sapiens
ggaaacccaggcctgtcagagagctgccagtgaccctttacttttctgggacacatgtgtggccgctgtagacaatgggttttc

SEQ ID NO: 6809177 - DNA, 77 bp, Homo sapiens
cggccccaccgagggtgcagtcctgctagagaaatgcaagggaagcagggcagccatgagccttcaggaggaggccg

SEQ ID NO: 6809178 - DNA, 107 bp, Homo sapiens
ggcttctaccacgagaaaggcaaaatgtgaaaatgctggcaagagagtagctcgggagctacagctgccgtgtttttcatgttaaaaagccacttaatgtggaggtc

SEQ ID NO: 6809179 - DNA, 74 bp, Homo sapiens
acccctttggctggctggctgtgcaaaggcaggccccacaggggagtaatgtatttgtgacagccagttggggt

SEQ ID NO: 6809180 - DNA, 71 bp, Homo sapiens
tggctacaggagggtgtgttgggcgctgtcagtggggccagatcacgtccagctgctccctctggtggtca

SEQ ID NO: 6809181 - DNA, 81 bp, Homo sapiens
atatgttcacagtctaagattcaggtgaaaaggcaggatgccaaatcttgtgtacttgctgatcttatctgtgtagaatat

SEQ ID NO: 6809182 - DNA, 57 bp, Homo sapiens
ggtggaactccattatgttatctattgtggtagatagtattttggtggggttctact

SEQ ID NO: 6809183 - DNA, 55 bp, Homo sapiens
ctcttcagcaatgctttagtccagctttggctgcatattaaaattgcttggagag

SEQ ID NO: 6809184 - DNA, 55 bp, Homo sapiens
gttctgtagcagaaagcacatggtaaaatgtgcattcctttgtctgttaaagagc

SEQ ID NO: 6809185 - DNA, 74 bp, Homo sapiens
ctggaaaagttcctgtgatactcatattatgtcaaaggagttcatcatatttgaaattatcacaggaattacag

SEQ ID NO: 6809186 - DNA, 60 bp, Homo sapiens
ggagctctcttgtggtactcccatgttgtccagcactttcggagtcaccaagagagaccc

SEQ ID NO: 6809187 - DNA, 83 bp, Homo sapiens
ggtaataggcacagacttttgcttgcgttgaggaaatattctaagtttcacaatggggtgtggaagaatctgtgcgaatctcc

SEQ ID NO: 6809188 - DNA, 72 bp, Homo sapiens
tctgaggttatgcttgttgaggttccagtctatttttaaaactaaagaaatttcaaaatgcaaaacctgagg

SEQ ID NO: 6809189 - DNA, 57 bp, Homo sapiens
gggagggagagaggaaggactctgcgtgtccagtgtagaggccctgctcaccctccc

SEQ ID NO: 6809190 - DNA, 78 bp, Homo sapiens
tcttgggggaagttgtgtaacctctgggccctgcgacgccctttcctggagcctggagctggaacgaagccccttgga

SEQ ID NO: 6809191 - DNA, 59 bp, Homo sapiens
gtctggaggaggaagaaggcactcgctggcttttgtttgctttctgctcttgtccacac

SEQ ID NO: 6809192 - DNA, 69 bp, Homo sapiens
tatatgggctcctgggagatagaggtcataaatatataatttattgcaatgggatcaggggtaggtata

SEQ ID NO: 6809193 - DNA, 63 bp, Homo sapiens
gaatcttatccccagtccttaatcctaaacaggtttaacagttggatttggggaaaatggttc

SEQ ID NO: 6809194 - DNA, 82 bp, Homo sapiens
cccagccaccttctctgcaccaggccctgccttgagggacctggacccccaggtggcttctggccaggtgtgggtgggtggg

SEQ ID NO: 6809195 - DNA, 89 bp, Homo sapiens
tgctttttagggcgatctataccatttcttaggcatgttgtagatgggaatcatacatgtaactaagtaaaagatcgtattaactagca

SEQ ID NO: 6809196 - DNA, 91 bp, Homo sapiens
ttatttctcttctagacactgagcttccaagatggggactatgtcctatccacatattccagacaccaagcttagtgcctgattgaaataa

SEQ ID NO: 6809197 - DNA, 71 bp, Homo sapiens
gttgataataacccctgagtaccatatgtctactttgtgggcttagcactacaccaggtgttatggtcaat

SEQ ID NO: 6809198 - DNA, 56 bp, Homo sapiens
gtggcctagagaagccaaaagattggaccccccgatctagatcttctttaggccat

SEQ ID NO: 6809199 - DNA, 100 bp, Homo sapiens
cgggcggaggggacccggggcgagtcatcaagggcgcgtggttcggcgtgccaggcgcgctgctctgcctgctctcttggcttctgtctcccttcgaccg

SEQ ID NO: 6809200 - DNA, 84 bp, Homo sapiens
gtcatgcacttaaagcaattttcaaatgtactcaaagtctctaggcttcggtacccagggttgcttcaagtatttgttcatgac

SEQ ID NO: 6809201 - DNA, 72 bp, Homo sapiens
tccctgggtggggaaaggcagcagccatatctatagctcctgaccacacttttcccctgctagagccaggga

SEQ ID NO: 6809202 - DNA, 55 bp, Homo sapiens
gagtcagctgtgaagatggtggctgtaacggacagcttcttccaggcagtgactc

SEQ ID NO: 6809203 - DNA, 74 bp, Homo sapiens
cgtgatagggcaggtgtggtgaccagagatgggtgaccaggctcgcatgccctgcaccactgccgtgattcacg

SEQ ID NO: 6809204 - DNA, 74 bp, Homo sapiens
gccactctacgtttaataactttcaaatctctaggtgtaaatggggaaatggatgttgagttaaatgttcctgc

SEQ ID NO: 6809205 - DNA, 78 bp, Homo sapiens
gaaactcacattcttgggccccaccctcagaatttccgactcaatgggtctgggctggtgctcatgaatttgcatttc

SEQ ID NO: 6809206 - DNA, 67 bp, Homo sapiens
ggagccaggtttgaatctcagtcctcttacttcctggctgtgtgatcgaggtttgtcacttggtccc

SEQ ID NO: 6809207 - DNA, 93 bp, Homo sapiens
gaaatggaagctgctctcttaggagcaagagaagtggagggttcttctaatgtccctgctttcagtgtgctcctgagggctagtttctgtttc

SEQ ID NO: 6809208 - DNA, 61 bp, Homo sapiens
ctcctttcctagcagctggtcctgggaacagaaggctgtgacaaggctgcgggaaatggag

SEQ ID NO: 6809209 - DNA, 64 bp, Homo sapiens
ctctgtgtctttaaagatttcatttgttgttgaaaaaaatgagtgaattcagtttaaaacagag

SEQ ID NO: 6809210 - DNA, 62 bp, Homo sapiens
cactgattggctaagatttggtcacctgactgggatgccatcaaatgattggccattcagtg

SEQ ID NO: 6809211 - DNA, 55 bp, Homo sapiens
gtaatgataagcagccattcacacgtcctttgtgtcaaggctgttgcattaatgc

SEQ ID NO: 6809212 - DNA, 58 bp, Homo sapiens
atcttccatattagactatgtgggggcccacgtggccccccagagttgatataaagat

SEQ ID NO: 6809213 - DNA, 65 bp, Homo sapiens
gcctgccagtgtttgaggattgtaaaaatccacttgacatcatcttcattgacatctggacgggc

SEQ ID NO: 6809214 - DNA, 90 bp, Homo sapiens
gtgtgtgggagtgacagagcaggaactgaaaatgagacatccatggtatttgtcagtctcttctttgccggtcctgccctctcccaccat

SEQ ID NO: 6809215 - DNA, 100 bp, Homo sapiens
ccctgagttgcaatgacaggccctgggaaggggaagagaattcctctgtgggaactctctgtcttctagggataaaccgagtctgctgctggacacaggg

SEQ ID NO: 6809216 - DNA, 112 bp, Homo sapiens
gattacagtgtgtgtagctgaaggcattattccacagctcagaattttttttcatctggaaagtagtaatctcaattgtgaaatagtgccttcagctgtggacattataatc

SEQ ID NO: 6809217 - DNA, 89 bp, Homo sapiens
ggctcaggggctgtggttttgtagggggctcagagcgagggtcaggccaggccccagcctcagtcccctgaccgcctccctcttgggcc

SEQ ID NO: 6809218 - DNA, 86 bp, Homo sapiens
ggcatgtttacatacttcttggcctgattccaatacctgccagcagttttattgcaatttggctaaagaatacaatcaaactgacc

SEQ ID NO: 6809219 - DNA, 81 bp, Homo sapiens
ggatactactggaatcagacactagtggactagaattttggttctatcacttgctagctgtttgaacttggggaagtttct

SEQ ID NO: 6809220 - DNA, 74 bp, Homo sapiens
gagctgccgctgaccgggagactttgagcaccatgtttaatttatctgggcttcaatttccttagctatctctc

SEQ ID NO: 6809221 - DNA, 80 bp, Homo sapiens
caactcatttggacagatggtctgtattaaacagatgatgactatttggcatgtacagctattccatacaatttgagttg

SEQ ID NO: 6809222 - DNA, 59 bp, Homo sapiens
aagacatgcctctttatcttcctgtcctaaattagaagcaggatttgagaaggcgtctt

SEQ ID NO: 6809223 - DNA, 82 bp, Homo sapiens
gcctcaccatacccctcagaggtaccagcagcctctgggcagtgcccagttctccaaggtctgagcctctgctctgggaggc

SEQ ID NO: 6809224 - DNA, 79 bp, Homo sapiens
tccactacagatcttttactttaatttattggttacttcacagaattgccaactgcattacagtcccgtgtgtagtggg

SEQ ID NO: 6809225 - DNA, 81 bp, Homo sapiens
ctgaatagttaggcaagttatcttagggtacaaaggacttccaagtaatgactttgtaggtagcgaatcaataactattag

SEQ ID NO: 6809226 - DNA, 82 bp, Homo sapiens
caggtcctgtgactctccgcaccatgccgggtgggggaaccacatgttccctggctctggtgaggagaagttaggagacttg

SEQ ID NO: 6809227 - DNA, 93 bp, Homo sapiens
gcatttctacgtttatgagctggcattcttctgttaaactgctttcacttgtgaaacaggatgcagaggaggagacttattcaacagaattgt

SEQ ID NO: 6809228 - DNA, 78 bp, Homo sapiens
ccatctgtgggcttcaacacagtcagttcctggatcaacaaacatttattcagcacctgctgtgttccaggcatatgg

SEQ ID NO: 6809229 - DNA, 98 bp, Homo sapiens
ccctccccaggcctctccatgagctgtaaccaattagtttttggactccaaacagcagactttctacagctcacactggggggcataggggaaatggg

SEQ ID NO: 6809230 - DNA, 71 bp, Homo sapiens
ccaaaaagttggaaagcccattatttggacagcacagccaatgtgtgttgaaaggctattccaatgtaagg

SEQ ID NO: 6809231 - DNA, 80 bp, Homo sapiens
gtatggatgaatcatgacgtgttgctgagtgaaagaagccttccacaaacatacagtacatttcatatgattctacgtac

SEQ ID NO: 6809232 - DNA, 79 bp, Homo sapiens
ggcaggctccccaccgtgaggccaagcctcctctgccactgccagcatggcccaagggaggcttggccttgggcttgcc

SEQ ID NO: 6809233 - DNA, 85 bp, Homo sapiens
gtatttgatactgaaaaactggatgtccctgtatgattcgtcataaattaagcgaacacagcagggataaccactcttcaagtac

SEQ ID NO: 6809234 - DNA, 106 bp, Homo sapiens
gaaagtggggagagatatggttgggaaggtgaacatgatgcagattctaaaaggccaatggagcacgtagcgttagttgcctacccaacagtcacaaccccctttc

SEQ ID NO: 6809235 - DNA, 56 bp, Homo sapiens
atgctacttaaagtataggggaatttaaattattgcctttatgcaaggactggcat

SEQ ID NO: 6809236 - DNA, 66 bp, Homo sapiens
gggctgtgtcctcctgggtcattgccagcaaatcaatatttgactgtgccacccagggtggtgctc

SEQ ID NO: 6809237 - DNA, 58 bp, Homo sapiens
gtccttggcacccatgtgattctgacatccagaagggatatgagatggtgctagagac

SEQ ID NO: 6809238 - DNA, 59 bp, Homo sapiens
tttcccttgttccttcctctgaagacagtaggagctataaacaggaacagtttgggaga

SEQ ID NO: 6809239 - DNA, 57 bp, Homo sapiens
cgggaaagttccacagatggatgggggagatgattgcccaacagtgtgaacatcctg

SEQ ID NO: 6809240 - DNA, 62 bp, Homo sapiens
gttcccccttaaagtttatccagtgttgaaaaaatacacaatccttgaactttaggtggagc

SEQ ID NO: 6809241 - DNA, 61 bp, Homo sapiens
gttcagcaagtactcagtccacagcagtagctccaaatattggctgagtggatgcatgaat

SEQ ID NO: 6809242 - DNA, 111 bp, Homo sapiens
tgctggttcatacccttccctcctcagggctggttacatggatggctcccaacctaaacccccccatgccagctgctaggtcacagggatctctggagggtgtaacgggca

SEQ ID NO: 6809243 - DNA, 77 bp, Homo sapiens
aggtcaagtacaactcagaaaggtaagggctctgtttcttggccaggccagatcagactgaaaaatgtgcttgatct

SEQ ID NO: 6809244 - DNA, 62 bp, Homo sapiens
cttagtttctgttgcgttctgtagcttttttgtgaataaagtctgaatgaagcaaagctaag

SEQ ID NO: 6809245 - DNA, 70 bp, Homo sapiens
gggcagttttgcacagaggatgctagagactctgtcattggcaaagtgactccttggggcaagattggcc

SEQ ID NO: 6809246 - DNA, 74 bp, Homo sapiens
atttgtgggggcgagtggccagtctcttcatgtgtaaaatcagaacagtaacacctactctgtccccctcggat

SEQ ID NO: 6809247 - DNA, 65 bp, Homo sapiens
tgcaatagagtagtatctagatcattcataacagaaatagctgaatgatttgggtgcattcagca

SEQ ID NO: 6809248 - DNA, 63 bp, Homo sapiens
gtatgtatctttctaagggtgagagatccctaatttgttagttacatgcttagagatgcatgc

SEQ ID NO: 6809249 - DNA, 59 bp, Homo sapiens
gagaatgcagagttgctggtggcacattaaggtggtatgctgaagaactctttattttc

SEQ ID NO: 6809250 - DNA, 62 bp, Homo sapiens
agtatgatattcaacctttcattgatcaggctggatgttgtgaggtatattgaaatcatgct

SEQ ID NO: 6809251 - DNA, 59 bp, Homo sapiens
gttatgtacaatctatcacaagaagcatagctgtgcattcatgagctgattgtattaac

SEQ ID NO: 6809252 - DNA, 82 bp, Homo sapiens
ctatcagggcagtaaagatttcagaagcctgtgccatgtcagtgactgggaggcattttggaactttctggcagccctgtag

SEQ ID NO: 6809253 - DNA, 78 bp, Homo sapiens
gtaacctacttctttccagaatggcattatactaaagcgtgtaaaaccataaggctggaaggaaatttgagtggttat

SEQ ID NO: 6809254 - DNA, 117 bp, Homo sapiens
ctcagcctcctgcttgactttgatgttcagcagggcctggcactcctgggcctggagctgcccctctgcccaggtctatgccagctctgactccaggtgaagcaggatcccgttgag

SEQ ID NO: 6809255 - DNA, 58 bp, Homo sapiens
tttgaccctctaggagcggtggtctgatgtctcagcccattccttcctgggggttaaa

SEQ ID NO: 6809256 - DNA, 70 bp, Homo sapiens
gcagagggcccagcactgaactgaacctgaggagacttgcgtattcctcagtctccgtgctcacctttgt

SEQ ID NO: 6809257 - DNA, 111 bp, Homo sapiens
tcatttcttgcaaccatgactaaggtatcaagcacctgttgtgttacaatcctcccaattgctatttaaggaaggcacagcagttgaagcaagccatggtcagagagatga

SEQ ID NO: 6809258 - DNA, 84 bp, Homo sapiens
cagccgtgcaccctggaaacgaagcttaacttttctgagctactgccccagataaagaaagtttcgggtcgcggacgccggctg

SEQ ID NO: 6809259 - DNA, 80 bp, Homo sapiens
tacgtctgaaaataaagaatggatgagatcgtgagggtcccttgacgattaggcatttattctttatttgaaatgcagtg

SEQ ID NO: 6809260 - DNA, 75 bp, Homo sapiens
ggggaaaagtaattgatgcaatcgtatagttcaaatgcttaacaggatttaggatagtttaaattggttctcctc

SEQ ID NO: 6809261 - DNA, 63 bp, Homo sapiens
gaaggaaaacagatctgcctgatggctgtcattgaaaaatctcttaggtggtcattttccttc

SEQ ID NO: 6809262 - DNA, 83 bp, Homo sapiens
ggtgctgctgctttttagcatatggaataaggcttgttagttccatgtcagtccttattcctatattcctatgcatagcttcc

SEQ ID NO: 6809263 - DNA, 55 bp, Homo sapiens
aacagtcttcctacggccattatcatatgaagtgtggtggaaagtaaagagtgtt

SEQ ID NO: 6809264 - DNA, 65 bp, Homo sapiens
tgtcaattaaggagcaattgcaatgatgaaaagcataaggcaatggcattcttgacaagctgaca

SEQ ID NO: 6809265 - DNA, 85 bp, Homo sapiens
ggcttcaagcctctccagtgcctcccagtgcctttcgggtagaccccaggtcctccaggccactgcagaggctctgatctctgcc

SEQ ID NO: 6809266 - DNA, 55 bp, Homo sapiens
gcatcccattaccagcgcattgtgagcgaaatgacttgcatgtgtatgtgggagt

SEQ ID NO: 6809267 - DNA, 88 bp, Homo sapiens
gtgatgttttctgttccactggaatgccttgtttatgccctcctagttcccttcaaataaggctgaaagcagggagctataatatcat

SEQ ID NO: 6809268 - DNA, 66 bp, Homo sapiens
agttgcagcacttgccaaactaactcaggtcagatgcccaaaggaggggtggaggtggctgcagct

SEQ ID NO: 6809269 - DNA, 89 bp, Homo sapiens
ggagaatcgcttgaacccgcgaggtggaggttgcagtgagccaagattgtgccattgcactccagcttgggcaacaagagtgaaactcc

SEQ ID NO: 6809270 - DNA, 88 bp, Homo sapiens
tcatgcttcctgcagtctccgtgttgccaacacctcatcttgcttgatcttaaagcgccctgtgaggttggcagggaggggaagatga

SEQ ID NO: 6809271 - DNA, 96 bp, Homo sapiens
gctccttggaggtatgaggcctgaggcctgaagcctgaagtgaccagcaggtaactgggcaccacagcctgaggccaatcagccccaagcaagagc

SEQ ID NO: 6809272 - DNA, 69 bp, Homo sapiens
gccacacagcatattcattcagtgagactaggacgtctacattttctttccagctaatgagttgtgggt

SEQ ID NO: 6809273 - DNA, 84 bp, Homo sapiens
agaggtccagtcagtaacactattttcatatgtatctatctgtatgtatatatatatgaatataggtactgtatatgtgtatct

SEQ ID NO: 6809274 - DNA, 76 bp, Homo sapiens
gttctgtgcatagagtatataggcctttgtgtacacagagtacacagacatttgtatagctctgtgcagagtagac

SEQ ID NO: 6809275 - DNA, 66 bp, Homo sapiens
ctgcacggccttctcgatggcagcgggcgtggcgccctgcgagttgccatctgagaagagcagcag

SEQ ID NO: 6809276 - DNA, 67 bp, Homo sapiens
gcctcaaaatttggtttttctttctcatgatgacctaatctgtcaggaagctaccaattttgtaggc

SEQ ID NO: 6809277 - DNA, 105 bp, Homo sapiens
gataagaaaactgaggtgcagaagagattaagtgactgacctcttgcctagttggtagcaaagtcaggatttgaactcaggtctgtctgcttctgtttttctgtt

SEQ ID NO: 6809278 - DNA, 58 bp, Homo sapiens
gtgtgggaggaaggtgaacagactggttgatccctcatctcttctctctctctcatac

SEQ ID NO: 6809279 - DNA, 59 bp, Homo sapiens
aagctctgggaccacgtgactctgctggacacagcaggggaaggcagtggtccaggctt

SEQ ID NO: 6809280 - DNA, 58 bp, Homo sapiens
ctgtaggatcctggcccaaagctctgcatatcttggagagtctgaggaggaccaacag

SEQ ID NO: 6809281 - DNA, 69 bp, Homo sapiens
gagcaatagaaagaatactgctctgcacttggatgtcaaagatctgggtttgaattctttctctgcctc

SEQ ID NO: 6809282 - DNA, 60 bp, Homo sapiens
ggggccacacagggcagctccctctgagctttcgagatttggagggtgaccctgagcccc

SEQ ID NO: 6809283 - DNA, 76 bp, Homo sapiens
ttgtttgggaggaaagagaagtggtccagaactagagaaagaacattctgagactgtcacttttccttgtaggcag

SEQ ID NO: 6809284 - DNA, 127 bp, Homo sapiens
ggtacagggacccagtcatcattggaataaaccatctgctctgggccagctattaacctgcttcagtgttgccgttcccaggcagatggtacgttttagctggatgactgctttgtgtctctgggct

SEQ ID NO: 6809285 - DNA, 67 bp, Homo sapiens
ggcaggccttggaggttattaacactggcctactttcaaagtcctgagtcaaagccccagggtatcc

SEQ ID NO: 6809286 - DNA, 73 bp, Homo sapiens
tattgcatattattctagtggcttttatctcttacgaaacatactgtggtaaaatgactagtgatttgcaata

SEQ ID NO: 6809287 - DNA, 59 bp, Homo sapiens
tgcaaagcactggagatgccagagtgttggggaaatattttggggaatctaggctggca

SEQ ID NO: 6809288 - DNA, 95 bp, Homo sapiens
ctgctccaaaggggagctgcatttcagctgtgacctaaagatgtctccatccatgaagaggcttattgctgaggtgccctcttcccttggaccag

SEQ ID NO: 6809289 - DNA, 59 bp, Homo sapiens
ggaatccttgggtctgaacgtgaagagttagaaacacaacgttcatgactctggatttc

SEQ ID NO: 6809290 - DNA, 88 bp, Homo sapiens
gctatatagaagtaacatttatataactcactaggataaaattagtataaatctgaggctgattccagtgagttaagatgtatatggt

SEQ ID NO: 6809291 - DNA, 76 bp, Homo sapiens
gggctgtgagtatagaatgcttctttgccttgcatttgaaaggctgatttggttattctaccactatgtacaggcc

SEQ ID NO: 6809292 - DNA, 63 bp, Homo sapiens
cctgctagatgaatcatctacatcaaggatctaaaacggtcaggtggctggtgattcaacagg

SEQ ID NO: 6809293 - DNA, 64 bp, Homo sapiens
tgcgcattctgagggtgggaagggctaaatatttacattgcaagatcagaactcagaatgtgta

SEQ ID NO: 6809294 - DNA, 83 bp, Homo sapiens
ctgattcgtgaatcattcattgctcaattaagttcctttaaatttaattcagctgaagattttcttttaatagatggtgtcag

SEQ ID NO: 6809295 - DNA, 81 bp, Homo sapiens
aagttgcctagactcagacagaaaatgtgtcttccctatgttatgcaacagctgaattttctgctctggtcttaacaactt

SEQ ID NO: 6809296 - DNA, 96 bp, Homo sapiens
gtttatctcttgacttctggatggatgcttctttctagtttttgaatattataaagaaagctgctatgaacattctatttcaagtcttatataaac

SEQ ID NO: 6809297 - DNA, 58 bp, Homo sapiens
ccctgtatagatacaggtcatagggaaatagtctcgtgaggcctgtgagtgtctaggg

SEQ ID NO: 6809298 - DNA, 91 bp, Homo sapiens
cactttccgcccagaatcgtgccttagtcctaagtcctggtcacctcctactgctggatggtattggagtaggacttgcatgtggacagtg

SEQ ID NO: 6809299 - DNA, 63 bp, Homo sapiens
agaaacatcgcttagtcctcatttactcactgggaacctcggaggatttcagctgatgttttt

SEQ ID NO: 6809300 - DNA, 116 bp, Homo sapiens
ccacctgtcaggagcgagaggctgtcacacttcaggaaatacaagtgacatcattcaagtagtggggacatttgtttcctgaaggctgcattcatttcttagcccgagacaggtgg

SEQ ID NO: 6809301 - DNA, 59 bp, Homo sapiens
agggatctccttttgctttacagatgaactgtctgaattttgagccctgggagatctct

SEQ ID NO: 6809302 - DNA, 126 bp, Homo sapiens
cttgctctactcaagcccaaaaagagaggatctcctgaagccatgtaagatccatcatgtggaagtctgactactatgctgggaagacaaggtggagatgccctgaggctacatgaaaagaggaag

SEQ ID NO: 6809303 - DNA, 69 bp, Homo sapiens
atggtctaatagcattttagagcataataagaatgatagagttactgtctctggtttgcattggattat

SEQ ID NO: 6809304 - DNA, 93 bp, Homo sapiens
tggaggtgtccagggcagggatgttgcggcagcctggggctctgcaccctccacccttcaccgccacattctgcctcttggcctttacctcca

SEQ ID NO: 6809305 - DNA, 103 bp, Homo sapiens
gcagttttctagaaagtgagtcaagtatatctagtcattaggaatttatgtgtcctttgcgctttgttgaactaatatataaactcacttttagaaaggctgt

SEQ ID NO: 6809306 - DNA, 71 bp, Homo sapiens
ctgttggtgattgatcacaggtgaaggcctgttccaataaatgaggtctctcagccctgacattctaacag

SEQ ID NO: 6809307 - DNA, 83 bp, Homo sapiens
agaaaactgtgcaatcttggcagatgggtggggactgtgaggtggtgcctctgggcctcacctgctgctcagcgccactttct

SEQ ID NO: 6809308 - DNA, 63 bp, Homo sapiens
caaggccatgggtaaggcccaggtcaaatgtataacccttgcctgtctgtttgcccattcttg

SEQ ID NO: 6809309 - DNA, 58 bp, Homo sapiens
gcccaggaggcagaggttgtggtgagctgagatctcaccactgcactcctgcctgggc

SEQ ID NO: 6809310 - DNA, 74 bp, Homo sapiens
ccacccccagcaacagttgattagactagagatgggtatctcacccaaactgggccagtcagctgtagtggtgg

SEQ ID NO: 6809311 - DNA, 128 bp, Homo sapiens
gggagtgctgacatgtggaaatgcaacagtcatgaagctgcagtcgttaacgtaactgacaaaacctgtacagcattaacaggctgtttaattttatgccaagtccataatttttgcagcatgtaccc

SEQ ID NO: 6809312 - DNA, 82 bp, Homo sapiens
ctggggagcttgtcactgtgctggcaatgactcagggaacatttcctggaggaggtgggttgcaggagcaagaagccaccag

SEQ ID NO: 6809313 - DNA, 97 bp, Homo sapiens
ggctctagtctgagaaagggaggcaaagccagattttaggaagtaggatccttcctggggctaagtctggtgctgtcctcacccttcttcctctgcc

SEQ ID NO: 6809314 - DNA, 63 bp, Homo sapiens
gatgacctgggagactaaactggaattgactcatcagaagttttccattatctctcagccatc

SEQ ID NO: 6809315 - DNA, 82 bp, Homo sapiens
ctggaaatgagaaagaggcaaggaagaattctcccctagagccttttgtgggagaatggccttgcaaacaccttaatttcag

SEQ ID NO: 6809316 - DNA, 62 bp, Homo sapiens
ggctccagctgcccttaataggcattcactgaagatagtggaattctgggtagcctgggacc

SEQ ID NO: 6809317 - DNA, 71 bp, Homo sapiens
aagcacttcacccacattccatcactctgccacaccaggtagagagagagagagtgctgggcaaagggctt

SEQ ID NO: 6809318 - DNA, 63 bp, Homo sapiens
atgcatgtgtatgtcttattcaaagatgtgtgcaacagtaccattttaagtatatatgtgtgt

SEQ ID NO: 6809319 - DNA, 73 bp, Homo sapiens
cagtcaattttttgggtctttcaggctaaggcagattgtcttgtggtctgattccacctaactgaattgactg

SEQ ID NO: 6809320 - DNA, 87 bp, Homo sapiens
aggaaacttgagttctattctcacttttgccacaaaacagccataaagttgttacagggataaatgaggtaggagcaaaagtttttt

SEQ ID NO: 6809321 - DNA, 56 bp, Homo sapiens
gggaacagctgggatttagtttgccacatgcagacaccaagtctggcagctttccc

SEQ ID NO: 6809322 - DNA, 99 bp, Homo sapiens
ggggtgtttggaagatgaccctgtgagagttgagatattttgccatgatcccactggtggcagcacatcagaattctgcaggtcgctttgaggttcttt

SEQ ID NO: 6809323 - DNA, 68 bp, Homo sapiens
gtcaaagatttcttaggagttactgggagtctgttaaaggacttcctgggtgttgtaaggtcagggac

SEQ ID NO: 6809324 - DNA, 83 bp, Homo sapiens
ttttctttgcagatttcaaggtgatgacaaaagagacaacagtcttagcatttgttaatacccacttgacccacaaaagaaaa

SEQ ID NO: 6809325 - DNA, 120 bp, Homo sapiens
ctttcggtaaggtagactgcgtgttaacagttaggcacgggtacagcaacggagaacagctctaattttgcaattgcttgtcactgttcatactccatgtgaagttaatgctgctggagg

SEQ ID NO: 6809326 - DNA, 58 bp, Homo sapiens
ggggcttgttgcgctgaagatttacaatgtacttcttgcaggcggctcagcaaccccc

SEQ ID NO: 6809327 - DNA, 65 bp, Homo sapiens
tcacttgggctttccgagcacagccacttattttgtcaggcctgcaaggagagtccccagagtga

SEQ ID NO: 6809328 - DNA, 93 bp, Homo sapiens
gggagagggcagggcgtggatggagcttcaggctggccagagtggggtcctctgtcagcttcctcatctagccttcctgcagcaccctcttcc

SEQ ID NO: 6809329 - DNA, 58 bp, Homo sapiens
acctggtgtcactcaagcccggccgcccctcacagtggccatggcgtctgacccacgt

SEQ ID NO: 6809330 - DNA, 59 bp, Homo sapiens
taagcaggctgtggtatgttgggcaaagtacaaaatgcctctcagccacagtttcctta

SEQ ID NO: 6809331 - DNA, 79 bp, Homo sapiens
ttggacctcaattttaattttgttatagaactctgtgagaaaaagcttatagacacgttgtaacaaacactgtggccaa

SEQ ID NO: 6809332 - DNA, 70 bp, Homo sapiens
atcagggatctactttctgtcaatggattatatccagggataaaagtaaggttctcaaatatgacctgat

SEQ ID NO: 6809333 - DNA, 79 bp, Homo sapiens
ggctattttcattgattctaccagctactttgacagacacgttcaaaagtgatatgtggagccttcgagaggaaaagcc

SEQ ID NO: 6809334 - DNA, 61 bp, Homo sapiens
gcctcgctttcaccgggaaattatcgttgcttgtaaaacagaagaagccgggaaggcaggc

SEQ ID NO: 6809335 - DNA, 62 bp, Homo sapiens
gggctgttttgtttactttcacagccccctgattatgtaatgagagctaacagtgacagctc

SEQ ID NO: 6809336 - DNA, 104 bp, Homo sapiens
gtgcaaaggattatgatctgctagctgtggagcaattggtggtgtctgttctagactcaggcagaatgcaagctctttggtctccacatcattttcttttctac

SEQ ID NO: 6809337 - DNA, 72 bp, Homo sapiens
gccccagaacctgtgactgtgatcttatttgcaaataaggtctttgcagatataattaagttaagatgaggt

SEQ ID NO: 6809338 - DNA, 74 bp, Homo sapiens
cccagtgggagaaatttgttttgaatatttcagttgctgtgaatatgaaacattcatacaaataaatggctggg

SEQ ID NO: 6809339 - DNA, 129 bp, Homo sapiens
catttaagaaaagggggcttccatgtgggaagaagggcttgtgaacccagtgtggttgtgaattctgtaacggaagtcaccagctgggctttttctaggcaggagttatcttctttactggcaatcatg

SEQ ID NO: 6809340 - DNA, 75 bp, Homo sapiens
gcttgtacgtggattggggacaatgttttctagcctctccaagggctgagttcctgcctcactctattcgtaagc

SEQ ID NO: 6809341 - DNA, 81 bp, Homo sapiens
agtgaatgtgagggtggggaatagactgctatgggagggatggacctggtggcagtgagatttctcttctgggcagacact

SEQ ID NO: 6809342 - DNA, 56 bp, Homo sapiens
atgactggctttatcccccttgaaaccatgaacacttcaagggttgggtctgtcat

SEQ ID NO: 6809343 - DNA, 81 bp, Homo sapiens
ttagaggagcactttaaaacaggtcaagtgtaaccaagactaaattgaaaatgcattattcttttttggtaggccctctaa

SEQ ID NO: 6809344 - DNA, 60 bp, Homo sapiens
gggagcacagggacaatgccaggtgtcctggggacagtcggcagcatcccagtgacttcc

SEQ ID NO: 6809345 - DNA, 79 bp, Homo sapiens
atatttttgtgactaaatgctttgtgcatgcagccattgagtgaaagggtgtgtgtgtgtgtgtgtttagttgaaatat

SEQ ID NO: 6809346 - DNA, 62 bp, Homo sapiens
tacctaccatgagtcaggaactgtttccatacattataaaataacactgtgcgtggtaggtg

SEQ ID NO: 6809347 - DNA, 56 bp, Homo sapiens
agggctggggagacacaggtgggaagtgaaatcccagctccctgtttcctcactct

SEQ ID NO: 6809348 - DNA, 96 bp, Homo sapiens
gagattcatgagggaaatagcccaggctttgagattggaaaggtaacagggggctgcctttgcaacagaaagacctgactgattctagaatggctt

SEQ ID NO: 6809349 - DNA, 90 bp, Homo sapiens
gcaggttgacttgttccaggtgcttccaacaggtgatttctcagcgagcctgagccagtagtcagggacaaacaggaaggttaaccttgc

SEQ ID NO: 6809350 - DNA, 79 bp, Homo sapiens
attgtgatgataaaatgtctttgagtttttataagagatttcatatctcttagttggagattattttgtaatttacgat

SEQ ID NO: 6809351 - DNA, 62 bp, Homo sapiens
ccatgaagaataggagaaaagttctgtaaatgaggacagaaataactttttatgttttatgg

SEQ ID NO: 6809352 - DNA, 63 bp, Homo sapiens
gtacaaattaggaagctttgtgaaagtcataggcccagctaatcacaaagctgggatttgtac

SEQ ID NO: 6809353 - DNA, 80 bp, Homo sapiens
ctctttcattcattcagaagtgctttcacactctgttttcctatagaatgggaaagtatatttgtatatggttttgaggg

SEQ ID NO: 6809354 - DNA, 102 bp, Homo sapiens
ggaggcgctgagctgggagcagagggagcagggaggggactgctgagtagggctcctccccggcctccacttttctctctcctgtggctgcccacgcccacc

SEQ ID NO: 6809355 - DNA, 62 bp, Homo sapiens
ggctcctgagaatgggccatcagtggtgtgatcctcagcttccaatccctattctctgagcc

SEQ ID NO: 6809356 - DNA, 60 bp, Homo sapiens
gaaggaagcagccttccattgaagaaaatgatgctaatttaagagtaggctgattgcttc

SEQ ID NO: 6809357 - DNA, 117 bp, Homo sapiens
gctttaagataatatttttgatgaaatctccaatgtgttaatgagcaatgacctaaattttaggtccctggtaattgacacacatggggtttattttatgcaatagcacattgaggc

SEQ ID NO: 6809358 - DNA, 64 bp, Homo sapiens
cagactttgtgtgcatttctgtgcatacacatgaagattcaaatgtgtacaggagtgcagtctg

SEQ ID NO: 6809359 - DNA, 81 bp, Homo sapiens
tgtgtgataatgcaaggctttgtgaattttaaatgattctgcagatgaatttgagatacagtaaagccttcattagatata

SEQ ID NO: 6809360 - DNA, 59 bp, Homo sapiens
cactcagcccacccatgtttgtgtaaactgagttttgccggaacatagcagggctggtg

SEQ ID NO: 6809361 - DNA, 63 bp, Homo sapiens
gtagagatgagtttcaccatgttggtcaggctggtctcaaactcctgacctcaggtgatctgc

SEQ ID NO: 6809362 - DNA, 62 bp, Homo sapiens
ggtttttgtcgagttccttgacctggttcctgataacttggcagcggaccctggcccgaacc

SEQ ID NO: 6809363 - DNA, 91 bp, Homo sapiens
ctgtatgttcctctggtgtgctgcttcatttatatgctttcctattctttttatgagggctgtgaaggagcgggttagcatttgacaacag

SEQ ID NO: 6809364 - DNA, 78 bp, Homo sapiens
gcctcatttataaaaatctggcaaaaggctttgtagtgacaccttacttgcttggatttcaccagacttaaatgaggc

SEQ ID NO: 6809365 - DNA, 85 bp, Homo sapiens
atatcttttgggctatattgggctggaattgcttcagatttaaagttgttgagaagcttggctgcccattgttcaaataaggtat

SEQ ID NO: 6809366 - DNA, 68 bp, Homo sapiens
agcctccagagtccctgttctcggcctccacatatttggctttgcaggtggagaaaggactttgggct

SEQ ID NO: 6809367 - DNA, 77 bp, Homo sapiens
gatggggagactgagacccagtgggggcctgatctgtctaaagccacacacagacagccgctggtgtccgccccatc

SEQ ID NO: 6809368 - DNA, 56 bp, Homo sapiens
gatcccttctttttcagagaatatagcgtgatgagcaaatctgagaaaggagaatc

SEQ ID NO: 6809369 - DNA, 110 bp, Homo sapiens
aggaattgtttttcatgtatatcccgctgcattttacttacctgttagttgcctgtctctccaactaggctgtaaagagctaggaggaagaatgtgaattgcagcttcct

SEQ ID NO: 6809370 - DNA, 56 bp, Homo sapiens
ccaggctttaagaggtggaaactagtagtttccaccgtagactcttggaagtctgg

SEQ ID NO: 6809371 - DNA, 71 bp, Homo sapiens
gtctccctccatgcccactcccattacaggacaggagatggatttggattgtggggtgggcccaggaagac

SEQ ID NO: 6809372 - DNA, 63 bp, Homo sapiens
taagtgaattgtccgaggacacacagcaaataagacagcttgattcctctgaaggttctttta

SEQ ID NO: 6809373 - DNA, 79 bp, Homo sapiens
catcatactgtgacagagtacttaaactatcttaacttgggcagtttggaagtgcttgtgataggaaatatttgtgttg

SEQ ID NO: 6809374 - DNA, 83 bp, Homo sapiens
ttattgtgtggatgcatgagtgtgtgtgagcacttacatatctggatgtccagtttctacacacatacaagtacacagaatgg

SEQ ID NO: 6809375 - DNA, 84 bp, Homo sapiens
ggcattgttttattcctcaagattcctttcagaaggtgaaataagaaatattgactaaattggaaagaatggaatgttcaagcc

SEQ ID NO: 6809376 - DNA, 79 bp, Homo sapiens
agaccaaatgctctggagtacgtgaaatttgtctatcagcaaatcaacagactagttaacctttctccaggcagtgtct

SEQ ID NO: 6809377 - DNA, 80 bp, Homo sapiens
gaagtgaaattcagccacactacatcctcagaaggatcctttgtgaggatcttctttctctgtagaggttggaatccttt

SEQ ID NO: 6809378 - DNA, 55 bp, Homo sapiens
tctttaattcagcatgatgcggataaggctcaaaaacatcatgctgaattaaaga

SEQ ID NO: 6809379 - DNA, 58 bp, Homo sapiens
ctgcagatggtattgttctggttctcgagaaggaatccaagataaaggctgtctgggg

SEQ ID NO: 6809380 - DNA, 63 bp, Homo sapiens
cctgcctttctcagtaatcttttattactttgtgatcccgatgaaaatgatgggcagggcagg

SEQ ID NO: 6809381 - DNA, 70 bp, Homo sapiens
tgttttcagaaccattagttcattattgctttctttaaaagaaggcaactgtttgataatgttgaaaata

SEQ ID NO: 6809382 - DNA, 56 bp, Homo sapiens
caggggagtgagtccctctctgtgactcctcagagctggttgacagcattcctttg

SEQ ID NO: 6809383 - DNA, 70 bp, Homo sapiens
tggacagcatcccattcacagtcacccttctccatggagtggccattggaaggtgcactgtgacagtcca

SEQ ID NO: 6809384 - DNA, 72 bp, Homo sapiens
tgtttacataagccttaaatgtttctaatattcttacagggtgggcagaacatttgtaggcttaactgagca

SEQ ID NO: 6809385 - DNA, 60 bp, Homo sapiens
ggtttgtctgggccagggggcgaatgcttctggcagtggagcttccaggcccggaaaacc

SEQ ID NO: 6809386 - DNA, 57 bp, Homo sapiens
gagtctatctcactcccccaggtcctgagagtgcactggagggaaaggggtggattt

SEQ ID NO: 6809387 - DNA, 70 bp, Homo sapiens
gttttggacacagtttttctcacggtggtcgttccagttatacccactgtgactcggggctgttcagaat

SEQ ID NO: 6809388 - DNA, 88 bp, Homo sapiens
ttcttttgtatgttggactaggctcttaattttatatcttgttttgtctccttgaatgttatagcccacagtccaatcttcaagagaa

SEQ ID NO: 6809389 - DNA, 59 bp, Homo sapiens
aaggacacactgttctcacgtaaagccaaattgctgactttgagtgagtgtgtgtgctt

SEQ ID NO: 6809390 - DNA, 125 bp, Homo sapiens
cagtttacaagcatttcctgtatatttgcctgtcttcatcctcatcataaccctgtgaggataattttttcttattctcatttttatagatgagagaagaggagggagctaatgtttgttttctg

SEQ ID NO: 6809391 - DNA, 82 bp, Homo sapiens
atgtgattgactaaaatcccatcggagaggaggattgtgttgtagcatccccctcttggatggcggcaagatgaaattacat

SEQ ID NO: 6809392 - DNA, 58 bp, Homo sapiens
gggctctcaatgaagcatgaatccccctgtcctggggtgaggatgcagatgagggcct

SEQ ID NO: 6809393 - DNA, 117 bp, Homo sapiens
atttaactttttggtgactttgcttttcatttttgagcagttttataattaagagggacctaccacacttctaaagattctcagaaaaaggctataagatactgaaagagtttaaat

SEQ ID NO: 6809394 - DNA, 75 bp, Homo sapiens
gtttattatgcgcactctgctacaaaagttaggctagtctcctagactaaaagtatcagagggccagagatgaac

SEQ ID NO: 6809395 - DNA, 81 bp, Homo sapiens
agcagttgtgaagcttcctgggtcagcctggaggtatttcagatctgctactaggaagattccaggattttaacagctgct

SEQ ID NO: 6809396 - DNA, 75 bp, Homo sapiens
cagagaagtctgagtgagggtgtgagatatctttgcaaaattcatatctatatatttttattctatacatctttg

SEQ ID NO: 6809397 - DNA, 55 bp, Homo sapiens
ggtgcccgccggcaaccctcggacgcatgcgcggcccgggcaggtaggtggagcc

SEQ ID NO: 6809398 - DNA, 73 bp, Homo sapiens
gggagggcattttctgggttatcaggggttaaagggttgccagtcttgacagctgaggcccagagtacccccc

SEQ ID NO: 6809399 - DNA, 58 bp, Homo sapiens
ggactcccttgactaggtgtaaggatgtgctcttgagatgctgggaacaaggaagtcc

SEQ ID NO: 6809400 - DNA, 62 bp, Homo sapiens
gcgcgcgcgcccagggcctcatggcctatcgttgggctcgcagatcacctgggggcgtgtgc

SEQ ID NO: 6809401 - DNA, 113 bp, Homo sapiens
gcatattatgtataaactagcaactattttcaggtcacatttctcagtgcagagtgctacattttatttgcatcttagcaatgaccgagtatctcttgcacataattgaatgc

SEQ ID NO: 6809402 - DNA, 59 bp, Homo sapiens
ttacaagttcagattttctcatgaccattttctggaaagcagaaaatctgaaattgtaa

SEQ ID NO: 6809403 - DNA, 108 bp, Homo sapiens
ttctgggccccaaggcagagcatttcatgcagagctggggactggattggctccctctgagctacaccagcttgcctgggctctcaagcagctctgcctggccctgaa

SEQ ID NO: 6809404 - DNA, 55 bp, Homo sapiens
ttattttaccttcctctgagctgctaatcgcctgcctctgagctgggtgagataa

SEQ ID NO: 6809405 - DNA, 67 bp, Homo sapiens
ctcccaggttgattctttccctgacacaaaacaggcactatgggcaaagacacctgcagccttggag

SEQ ID NO: 6809406 - DNA, 59 bp, Homo sapiens
tggataaccttttgggattggcttttttcactcagcgtaattccctggaggttcatcta

SEQ ID NO: 6809407 - DNA, 62 bp, Homo sapiens
ggagtgtatttatttcatatacaacagaaaaatgactgtgtattatcaagtaaatacatgct

SEQ ID NO: 6809408 - DNA, 76 bp, Homo sapiens
ggaatcttcttaagtgagcttgaataatcttattcagtgagaagataagttcaactcatttagctgaagttattcc

SEQ ID NO: 6809409 - DNA, 129 bp, Homo sapiens
ggagcctgcaagccaccctgagggtgcagaaatctgaatgtctggggccatgtgcagagtgtggccaagtcgtagctgtggcttcagcattcagagcctctgcctctactggggattaatgcaggtttc

SEQ ID NO: 6809410 - DNA, 80 bp, Homo sapiens
gcaatagatacagatgatttttatgaaaacaatgcatttgcaaccatgttttcagaaagagttagatacatatctggtgc

SEQ ID NO: 6809411 - DNA, 58 bp, Homo sapiens
gtcttgatatctcatggtcttacttgcaaaggctacagtgttccatgactatttggat

SEQ ID NO: 6809412 - DNA, 80 bp, Homo sapiens
cttggctgtaattcctagtccttttccctccctggaaaggaaggaggccaagaagggagtgggaggggaagcagcctaag

SEQ ID NO: 6809413 - DNA, 111 bp, Homo sapiens
ttagccaagcaaggtggtgtatgtctgtagtcccagctacttgggggtctgagctggagcccaggaggttggggctacagtgagctgtgtttgcaccactgccctgggtga

SEQ ID NO: 6809414 - DNA, 117 bp, Homo sapiens
aagaaaagcagagagtgaattttcatggagttagactgcgttgagacgaatgaagctaaggctcaggtctctttcattacgtgtttgacttgtcctgattcaaaatctaaataactt

SEQ ID NO: 6809415 - DNA, 61 bp, Homo sapiens
tcctcttcaaaatagctctgaaaaatatgattggaatttctggagtctattttgaaaagga

SEQ ID NO: 6809416 - DNA, 74 bp, Homo sapiens
agagaatgctctgtctctgacagtggttgggatctcatcactggagatatccacacagggactgtattactact

SEQ ID NO: 6809417 - DNA, 85 bp, Homo sapiens
aggagctccctcagggaatgggcccagtcccttacaaatcaagcctgggcttggggttcagggactggctctctgagcaggcctt

SEQ ID NO: 6809418 - DNA, 75 bp, Homo sapiens
gcagatgtgatcaggaaattatttattaatattggctttaaaattttgtaatgaataaacttgagagtcatctgc

SEQ ID NO: 6809419 - DNA, 94 bp, Homo sapiens
actctgtgtttaacattttgaggaactgccagactgttttccaaagtggatgcatcacattacattcccatcagcaatgtattaacacaagggt

SEQ ID NO: 6809420 - DNA, 57 bp, Homo sapiens
aggcggctccgggagtgtgggcccccctgggacgtgtgcgtgtttccggggtctcct

SEQ ID NO: 6809421 - DNA, 77 bp, Homo sapiens
attagtctgagttaaatttcttgtggccaatcctggaggtttggctcattaaagatgataattaacccattgctaat

SEQ ID NO: 6809422 - DNA, 55 bp, Homo sapiens
ttgagatggagtctcactctgttgcctaggctagagtacagtggcgccatctcag

SEQ ID NO: 6809423 - DNA, 66 bp, Homo sapiens
ttgagaggtaattttgtgttaatgatttgctactcaattcagtcgccaaaataccttaattctcaa

SEQ ID NO: 6809424 - DNA, 59 bp, Homo sapiens
acctttatgaaacagctgtcgtaacaggaattctgagatgacagtgtggcatggaaggt

SEQ ID NO: 6809425 - DNA, 67 bp, Homo sapiens
gggaagggaatggggggaaacctggagtgaagaacatgaatccatctgtctttcccatccactaccc

SEQ ID NO: 6809426 - DNA, 78 bp, Homo sapiens
tgggcacggagaagccctggggtcagtgtcgtgcacggatggcggcagtgttgaacccaggaggctgaacccggccca

SEQ ID NO: 6809427 - DNA, 124 bp, Homo sapiens
tggatgattaggtgattcagatacatgaagctggatgccttcctcccaactttattataatgatccttggattgggtagaacgtatccaagacttctgctgtcaacacacaagtgaattatcca

SEQ ID NO: 6809428 - DNA, 57 bp, Homo sapiens
gatgagaaggctcagatccaaaggccaacatagttttctgtttcctgccttcccatt

SEQ ID NO: 6809429 - DNA, 67 bp, Homo sapiens
gcttcccccttgaccacctcctccccatcattggattgggatgaggatcaatcagggaggaaaatgc

SEQ ID NO: 6809430 - DNA, 91 bp, Homo sapiens
gctgtgtgacattgaacaagtttcctgacctgagcagcttccctttctggttgtgagaatgaagttaggtaatgtgtgtaatgtccacagc

SEQ ID NO: 6809431 - DNA, 73 bp, Homo sapiens
tgagaggaaatgtcacttgtccaatgttatgctattccctaaatagcagagcatgctaagtgactccatctta

SEQ ID NO: 6809432 - DNA, 59 bp, Homo sapiens
aaccacaatgtgaagaaggaggtgctcctgattgggcttcttttctcagctttgtggtt

SEQ ID NO: 6809433 - DNA, 59 bp, Homo sapiens
gtttcagcatctggcaagcaatccctctcagagccctgagctggcagatgtcttgagat

SEQ ID NO: 6809434 - DNA, 62 bp, Homo sapiens
ttgattctttgagaccgtgatactcttttcatgtcatagaaattggaggctcagagaatcag

SEQ ID NO: 6809435 - DNA, 61 bp, Homo sapiens
tctgatgttttatggaacaaaccaagataaactgcatgttgaaatccatgagacatgaaga

SEQ ID NO: 6809436 - DNA, 62 bp, Homo sapiens
gttctctgggtttgtgcctgctttgctgggtatggtctgcaatccaggaaaaaccagggagc

SEQ ID NO: 6809437 - DNA, 57 bp, Homo sapiens
gatataacgacttcccaggtctttacatgtctgagctgaaactggagtccttatatc

SEQ ID NO: 6809438 - DNA, 82 bp, Homo sapiens
ctgatccaggagcactgcagtttgagtctaccagcctcctctccttaggagtagggctgcctcaggcacctcctggcctcag

SEQ ID NO: 6809439 - DNA, 130 bp, Homo sapiens
gggacagcagaggctcaggggcagtgaaaagcagtgccggggctggagatgaaagagccaattctccattcttctgtgagtccccggagatgaacactgtgaacttgttcccagtctctgtgtctcgtgc

SEQ ID NO: 6809440 - DNA, 67 bp, Homo sapiens
ggcttcaagttttaatgttctggtgggagaaatgaaagtatcatttcccaacacattagaaaatgcc

SEQ ID NO: 6809441 - DNA, 90 bp, Homo sapiens
gttaaagggaaatccaaactctataaataagggctattagggcgttttaaatcttggtttgcaccaaagtggagtttctatctctttaat

SEQ ID NO: 6809442 - DNA, 73 bp, Homo sapiens
ttgtcagcaaagtgcttattgttttaaaccattgagttttggggtgatttgttatgcagcattgttgtggcaa

SEQ ID NO: 6809443 - DNA, 85 bp, Homo sapiens
ttgtagaagggatttgagatttttgcctattttacgtgctcaaaggtgggaaatattctaaaagtcttgtgaattttgtttacag

SEQ ID NO: 6809444 - DNA, 86 bp, Homo sapiens
gaagttatttgtgttatcaacatactggttcagaggtagattcaagactaccactataattagtttgttaagaaagacataatttc

SEQ ID NO: 6809445 - DNA, 56 bp, Homo sapiens
atgtgagcatcttggcagatatgaacacactgtgttcagattcagggtgtttacat

SEQ ID NO: 6809446 - DNA, 128 bp, Homo sapiens
aggacggtgaggaccctggagtgcaacatttaaggaggcactcgctctcagggtcctgtaagtgcagggtccgcacctgtgagtgagcgcctccttaaatcttgcaccaacagcctcaccctagtcct

SEQ ID NO: 6809447 - DNA, 77 bp, Homo sapiens
ggtggcagaagtgccctcgtgcccagggcctctcatatcactggaggacttggggtggagggtgctgggtgctcagc

SEQ ID NO: 6809448 - DNA, 126 bp, Homo sapiens
caaagttgtttgttctttttgtttgttattccttcgagtttatttttaatggttgttgattataagaacaatgaatttgaaagcatattaggactgaattaggatacaaacacatacacaactgtg

SEQ ID NO: 6809449 - DNA, 55 bp, Homo sapiens
gtcctcactggccgcacgctgagaacgagaagctcgggtgggcagcagcgggggc

SEQ ID NO: 6809450 - DNA, 57 bp, Homo sapiens
gtttcctggaaactgctccactcctccctttggaggcagcattttatggtaggaaac

SEQ ID NO: 6809451 - DNA, 80 bp, Homo sapiens
gggaggcagctttcccgggtccattgcgcagagggattaggccgtctgtgaaaatgcgaggatctggaatccccccttcc

SEQ ID NO: 6809452 - DNA, 69 bp, Homo sapiens
atttggatgaacaatggaaaaagtcattcattcatctggatggttccagcttccactgtttactcaaat

SEQ ID NO: 6809453 - DNA, 58 bp, Homo sapiens
gcatgtgggagggtcttcccacactgacacaccctcaagggtataccccctcatatgc

SEQ ID NO: 6809454 - DNA, 121 bp, Homo sapiens
ggagattcctgggccccaggtggcggggggaagggtccagcacctcggctccaggcatgtgtgccagaggaagccccagctgtgggatcccatccgttcctggagcccagaacacttctct

SEQ ID NO: 6809455 - DNA, 71 bp, Homo sapiens
gccctcttcagctgacagcaattcctagagagaactcagatgagtgctttcagctgctcgaggaggagggc

SEQ ID NO: 6809456 - DNA, 72 bp, Homo sapiens
gagttaataccaggaatttggcagcactgaagggtagcttttagtgtatgataaaaaattctttcaaagctt

SEQ ID NO: 6809457 - DNA, 59 bp, Homo sapiens
aggtagagcacctggctgcccaatggataacctcagttgctgcctggaggcctctacct

SEQ ID NO: 6809458 - DNA, 69 bp, Homo sapiens
gtgatgagcaagatggaaagagatgaggtgtgggccacgacagcatctgttctatccacgttgcttcac

SEQ ID NO: 6809459 - DNA, 83 bp, Homo sapiens
atttcagaggattgcctcctttttaaactctcaatcggcctgctcaaaggaccagaattcagaaagggcataaaatctggaat

SEQ ID NO: 6809460 - DNA, 74 bp, Homo sapiens
tgtaccatttggtcattaggtctccttcctacctggaaaacaaaatggcgaggatgaagtgccaaatggttaca

SEQ ID NO: 6809461 - DNA, 61 bp, Homo sapiens
tggagaacaaatatctggcttctgacagcctcaacaggagaattctgatgtatgttctgta

SEQ ID NO: 6809462 - DNA, 76 bp, Homo sapiens
gggatgtttttgagaaggaaacaatggcttttgagacaaaattcaagaagcagcaagcccttcaaagaagcatctt

SEQ ID NO: 6809463 - DNA, 77 bp, Homo sapiens
agataggtggacatagactgagtttagctgagtttggctctaaacttcaggctgttccagatctagtccacatgtct

SEQ ID NO: 6809464 - DNA, 86 bp, Homo sapiens
gtttcttttgctggctactcaaatttttagtaagaatttctccatatgaatgagagagttgctaccaagatgctagcaaaggagat

SEQ ID NO: 6809465 - DNA, 129 bp, Homo sapiens
ctcccaaagaacgttatcatcagtgactccaggaggtccttctcccaccttgttgagatgtagcttccctcaacaagatgggagaaggacctcctgttattcaaaggcaacatgactattctaagggag

SEQ ID NO: 6809466 - DNA, 87 bp, Homo sapiens
tggactagtgtggtagtaggaattcatatcaaaattagactttgtgactgaaagtgtaaacaaatgcattcttgctaagactagcca

SEQ ID NO: 6809467 - DNA, 129 bp, Homo sapiens
gggaggtcacctgggactggtagagggaacacaaagcttaaggtaggtacagaggccagcagtcacattagtgtttctcagctttctttgcgcattttgttctcccaaccttttactttcctgccttcc

SEQ ID NO: 6809468 - DNA, 88 bp, Homo sapiens
agctctgagatgcaagaccatgtaaataataataatcactattagggttgcatttattgactatttgctatgtgtcaggcactatgct

SEQ ID NO: 6809469 - DNA, 78 bp, Homo sapiens
gctgtttgatgcatctttggggcatccaggaaaataagtttcttattcctatctcagggtacccagatactagacagc

SEQ ID NO: 6809470 - DNA, 69 bp, Homo sapiens
ccatttctcagaaaagcaagctttctggttgattaggaacaggaaaacaaaatgcttttctggaacagg

SEQ ID NO: 6809471 - DNA, 56 bp, Homo sapiens
tcctggccaagtagatgtggcgcttcaatcatccaggcctgaatctgcagccagga

SEQ ID NO: 6809472 - DNA, 55 bp, Homo sapiens
tagagtgttgtaattgaaaaggatgattttctggtggttgaatttcagcactctg

SEQ ID NO: 6809473 - DNA, 67 bp, Homo sapiens
ggggcgtggctgctctcttccccagggttgggctcccggccgcggaggggcagctggctcgtgcccc

SEQ ID NO: 6809474 - DNA, 68 bp, Homo sapiens
gagcatattactatgtgcatatcagctccaacacaatggggcattatctgagcacgtaataggtgctc

SEQ ID NO: 6809475 - DNA, 130 bp, Homo sapiens
gggagagagcacagtgataaactgcccagatggtggggcagctgatctgaagcctccagtgatgcttcctcaagggctgagaattcagctttcctgatccctgttggtcggtaatcctttcctctgtacc

SEQ ID NO: 6809476 - DNA, 57 bp, Homo sapiens
agcaggtgccaggtgtacccgcctgtcttcagacactggttatgcctggtccatgct

SEQ ID NO: 6809477 - DNA, 70 bp, Homo sapiens
gtgagcttaatagtcatgctttctacccttcacaagcttacactggagaagaggcaggcattaagtacac

SEQ ID NO: 6809478 - DNA, 55 bp, Homo sapiens
ttcttagaagtttatggcacggaggcagtaaccctctgttgctcagtctatagaa

SEQ ID NO: 6809479 - DNA, 90 bp, Homo sapiens
ggggtgcacgcagcctcagggactccatgctgcagctcctccgcggaggaaccactgaacggggaatcctatgaaagctgctgtcccacc

SEQ ID NO: 6809480 - DNA, 57 bp, Homo sapiens
tcactgacctgaccacttaacctattgataagctggcaaggatggagcaggcggtga

SEQ ID NO: 6809481 - DNA, 72 bp, Homo sapiens
gaggagctggctgtcgggaggcagggatcagacccctcaagggcatccacaggcctccgaccctggctcctt

SEQ ID NO: 6809482 - DNA, 73 bp, Homo sapiens
agtcatgactgtgattgacaagtttcctaaaccacttcctcttcaggtaataatgtctctcggttttgtgact

SEQ ID NO: 6809483 - DNA, 91 bp, Homo sapiens
ggcctgggtgagttgggactgggacaggacagacatctcagcctcttggcagattcctggctcagctccttttgcacaacacactcagggc

SEQ ID NO: 6809484 - DNA, 78 bp, Homo sapiens
agagtgacaatgtctccattattataagcctgagactcaaagacatcctggagtgtgatatttgagtattgtcaatct

SEQ ID NO: 6809485 - DNA, 81 bp, Homo sapiens
caaaatgttgtctcaagggaggctggagtacatgattcttctgatgtggactgtgtttcccctcctggagaaggcaggctg

SEQ ID NO: 6809486 - DNA, 55 bp, Homo sapiens
cacttctcacaaagtgacattcttataagctgcaatgtccctctgatgggaagtg

SEQ ID NO: 6809487 - DNA, 78 bp, Homo sapiens
gggttgatttcttgttgccactgcctggcctgaagacagtgcttggctcagcggtggcagcagacgaagcagcagctc

SEQ ID NO: 6809488 - DNA, 90 bp, Homo sapiens
ggatatatgggttttggaagcagtctataaatcagctttgcttacagtaagcagccatggctgtagaactctacttaaaactcttactcc

SEQ ID NO: 6809489 - DNA, 62 bp, Homo sapiens
tttcacatgtgctgttgtcaatatctggatgttgaaacagatgcatgcatggcacagtgaaa

SEQ ID NO: 6809490 - DNA, 61 bp, Homo sapiens
tactgctgggctcctggtggctgctgtctgctctgcagcagaaagccctttccccacagta

SEQ ID NO: 6809491 - DNA, 76 bp, Homo sapiens
acaaatagaataaaaggaaatgtgcctgacactgcactaagtatgtgggtgtgtttgtatatttttctctgcatgt

SEQ ID NO: 6809492 - DNA, 89 bp, Homo sapiens
gtcgacagtgcatttccagtctgggcaggaatggccattggcaacaggtgtttctccactgggcgtttctgtccaatctcattcttgac

SEQ ID NO: 6809493 - DNA, 99 bp, Homo sapiens
gagaggttgagtaatttgcccacagccacacagcttaatgacagaatcagaatgaaggattcacatcaaggactgtctggctgcaaaatcccagccctt

SEQ ID NO: 6809494 - DNA, 75 bp, Homo sapiens
gaacaaattgagatgataaacacctgctgggtatgtatacacccttgtacacactgtttgatcatttctaagttc

SEQ ID NO: 6809495 - DNA, 57 bp, Homo sapiens
cagcatggacaggggtggcgttctctatggtgttgggaccccgcctttgccctgctg

SEQ ID NO: 6809496 - DNA, 57 bp, Homo sapiens
gcggtcagcgctgagccgagactgcgcccctccaggcgggctgagcgccttggctgc

SEQ ID NO: 6809497 - DNA, 73 bp, Homo sapiens
tgggcatctctgtggcagttctggttcatctcagatgttgactggtgaccaggctgcggctggctggtgccca

SEQ ID NO: 6809498 - DNA, 61 bp, Homo sapiens
gctgtcggcctttggcttctcctgtgttctagaaccaggagttttgaccaggggcggcggc

SEQ ID NO: 6809499 - DNA, 88 bp, Homo sapiens
ttctaagcgctaatggagatgctgaagtcacaccatcaccatacaaactagggtcaatctggacaacagtgttttcaagggttgagaa

SEQ ID NO: 6809500 - DNA, 96 bp, Homo sapiens
tctggctctctgggtttgtgggctgcagcggattggggattgcgaaaatgatgttcttcgcaggcgctgcagggcgcggagacaggagaggcctga

SEQ ID NO: 6809501 - DNA, 60 bp, Homo sapiens
gaggcagttgcagtaatccaggcaagacttgttgagggcctggattaaggcagtgacttc

SEQ ID NO: 6809502 - DNA, 64 bp, Homo sapiens
gcaagattccttgagcctagtttggctggctggcccatctctcaggcccaagtagagtctctgc

SEQ ID NO: 6809503 - DNA, 80 bp, Homo sapiens
atggatgggctgcctgagtacaagtcccagagctttcccttaatagctgtgagacttggggcaggttacttctcttccat

SEQ ID NO: 6809504 - DNA, 71 bp, Homo sapiens
atatgttctcattattttctctgcaatggatacttatctttgatttagaaggaaatgaagatgacacatat

SEQ ID NO: 6809505 - DNA, 83 bp, Homo sapiens
tccagtatccatgagggacttctgttggcttttaagccagagcgcttcgggccataggctaggtccctctgctggtctctgga

SEQ ID NO: 6809506 - DNA, 107 bp, Homo sapiens
cctgaccttctccctggtgcccctttagcccctgcagagacttctgcctttccctaggatacatggttgctgggggtggcagagctagaaccagggtggtgggaagg

SEQ ID NO: 6809507 - DNA, 63 bp, Homo sapiens
gaactaggagactcccagctagtcttggtagttcccaagaactgtgctccaggctccaacttc

SEQ ID NO: 6809508 - DNA, 81 bp, Homo sapiens
cctggaactcagggtggcagacaaaatgactgttgacattgtcacactgtcatgacgtttgtcaccccacctgtctccagg

SEQ ID NO: 6809509 - DNA, 75 bp, Homo sapiens
ggtgtcggctgtacaaaggcagggacttcatctatgtgattcactcctgtgcaggcctgcctcacagtcagcacc

SEQ ID NO: 6809510 - DNA, 103 bp, Homo sapiens
ttttcagtattcataatacatttctagagttcatcatggtaaaaacagatgagattttgggagattactctggtgtgctttagtctattgtgcatggtgaaaa

SEQ ID NO: 6809511 - DNA, 82 bp, Homo sapiens
tttgtcctttgttactctggggttgtggtgaaggagataacaaactctcttgtcactagtggaatctgggagcaaaggcaaa

SEQ ID NO: 6809512 - DNA, 75 bp, Homo sapiens
tgcatggcttggagcagcatttctcaaagggtggttcaaaactatttccttcaggtgctcttcgaggaccttgta

SEQ ID NO: 6809513 - DNA, 91 bp, Homo sapiens
gagtggagtgtctatattaggcagtggagaaataaacaggcctccttcaggtcgtcgtttagttgtcccttcttaaagaggttttccactt

SEQ ID NO: 6809514 - DNA, 76 bp, Homo sapiens
ggaaaggcttttgacggttgcctctcccatatccacactctcctgggacctagagagaggcaaccaaagtttatcc

SEQ ID NO: 6809515 - DNA, 84 bp, Homo sapiens
taagattatttagaatttagtgtaaagctactggaatgtaaattgctttcctttggcttagcactaggtatagatctgaactta

SEQ ID NO: 6809516 - DNA, 59 bp, Homo sapiens
ggattcttagggagcagacatctgggtttccctgctagctgtgactccctgggcaatcc

SEQ ID NO: 6809517 - DNA, 65 bp, Homo sapiens
gtttataagcctggttcataatttgctgatctgtcgtaggaagtaaatggcccagggttatcagc

SEQ ID NO: 6809518 - DNA, 62 bp, Homo sapiens
gttagtagtaaagcagggattcaaagccaagactaagcccaatccctgcatttactataaat

SEQ ID NO: 6809519 - DNA, 99 bp, Homo sapiens
agagggatgtgggaattagagaagttttacttaagaatccttgatgatgcagtaaaaattatattttttaagtatgaactcttgagtacacatcttttt

SEQ ID NO: 6809520 - DNA, 83 bp, Homo sapiens
gttattttgcagagtcaattttctgttacataatcacatagacttgtatctaatgcaacagaaaattgcctgggtggaataac

SEQ ID NO: 6809521 - DNA, 74 bp, Homo sapiens
catagcttccaccgccccatccttcttctaaatctttaattttgcaaagccatagggagtggtggtagcctgtg

SEQ ID NO: 6809522 - DNA, 60 bp, Homo sapiens
ttcctctctgaactgtgctcaccagtgtttgaatccatttaagtcagttctgaggaggaa

SEQ ID NO: 6809523 - DNA, 90 bp, Homo sapiens
taaattaacacttcaaaattatacatagatctgtgtgggcaaactacttacccagcagggtctctgtgtctataacgtagggttatttta

SEQ ID NO: 6809524 - DNA, 73 bp, Homo sapiens
cagcaatagatgtttttgcttaccagtccttgatttggtgacctagtcttggcagaacgcatttctattgctg

SEQ ID NO: 6809525 - DNA, 56 bp, Homo sapiens
actcttgcagataccttgaaggatggaggcatatctggggtaagttgagcaagagt

SEQ ID NO: 6809526 - DNA, 75 bp, Homo sapiens
ctgctatttcagtcacttcttctctgacccaaaaggtatagagtccacgcagagacatatgattgagacagacag

SEQ ID NO: 6809527 - DNA, 80 bp, Homo sapiens
tcaccctgtgggcctcaaatgtggagcactattctgatgtccaagtggaaagtgctgcgacatttgagcgtcaccggtga

SEQ ID NO: 6809528 - DNA, 82 bp, Homo sapiens
ttgtttcgaaatacatgaggaacaactatctgtgttaacatttttggcaatttcatggtattcctttatgtagaagaactaa

SEQ ID NO: 6809529 - DNA, 84 bp, Homo sapiens
atgtgcatgttattatgctgtggaaaatacaaagacaaattaattttgtctccaggctacttatacaagataacaaatgcacat

SEQ ID NO: 6809530 - DNA, 64 bp, Homo sapiens
agctaaagccatgcttagtgaaaaatgtatacttcaaatgcatattttataaagatggaaagct

SEQ ID NO: 6809531 - DNA, 67 bp, Homo sapiens
cagccttttccatgtattgttgtgctgtaagtgccatgcacatatttcctatatgtggaaagggttg

SEQ ID NO: 6809532 - DNA, 73 bp, Homo sapiens
tcacacaggctctctattgagtgcagtttggaagcggattttggctggaggactagaaagaggcttgttgtgg

SEQ ID NO: 6809533 - DNA, 91 bp, Homo sapiens
caggtttgtttcacttctaaggtgtctcattaatgtacttcatctgagaatttgttttaagagcgcactttataatcttgatgtttgcttg

SEQ ID NO: 6809534 - DNA, 58 bp, Homo sapiens
aggcacaaagacagaaaagcactgcccttttgcggggctttactaggtcgttgtgtct

SEQ ID NO: 6809535 - DNA, 103 bp, Homo sapiens
gcaccttgtggtgatgaagcagttctggatatggattttggtgacgtgtacacattctatgtgatcaaattgtgcagaattatacgtccacacacaggagtgc

SEQ ID NO: 6809536 - DNA, 55 bp, Homo sapiens
ggaaggggccttgagcaaactgagtttgtgatcatgtttaatcggctgcctttcc

SEQ ID NO: 6809537 - DNA, 82 bp, Homo sapiens
agtgaccattcatttagcctgtctgctgtcttaggatgggctcttcagcagtcaggcaaatgggaggagccatttgatcact

SEQ ID NO: 6809538 - DNA, 55 bp, Homo sapiens
aaggggctaggaattcaggagagctcagaagagatgacctggagtctaacccctt

SEQ ID NO: 6809539 - DNA, 91 bp, Homo sapiens
gatttaaaaaatatggagacatgaaaaataacaaaacacggttttatcgtatgaccatgtgtttgcattgttaattcagtcccgtaaaatc

SEQ ID NO: 6809540 - DNA, 82 bp, Homo sapiens
gggtcactcagcaggtatgtttgttcagcacataagactcctcagaaggcctgcaaagaacaaatataccctgaagtaatcc

SEQ ID NO: 6809541 - DNA, 57 bp, Homo sapiens
ccccatggcaactgctgggggtgagaggacgggtcccaaggcagggaggacatgggg

SEQ ID NO: 6809542 - DNA, 62 bp, Homo sapiens
gcaccagggtttttccagttgctcagtctttcaaacttggcaatcccttgaatcctaggagt

SEQ ID NO: 6809543 - DNA, 94 bp, Homo sapiens
ccagctaagtgaacggttagcttatgctaaaaacacgtgtgagtgtgatcatttgtgtgcaacgcatggagtcgaaccgctaccatttggtagg

SEQ ID NO: 6809544 - DNA, 56 bp, Homo sapiens
gattatcactgggtgtcttgagcagagctgcttgcttctgaatgctcacgataatc

SEQ ID NO: 6809545 - DNA, 60 bp, Homo sapiens
tgtgagtagtgctgcaatgaacatacgcgtgcatgtgtcttcatggcggaacaacttgta

SEQ ID NO: 6809546 - DNA, 98 bp, Homo sapiens
ggggtgccaggaatggggaggcgctgcgctggggccagaagcgcaatgggtcgtgccagtttctggaggcgggcgacctcgcctctgaccgcaacccc

SEQ ID NO: 6809547 - DNA, 64 bp, Homo sapiens
atttgcagagctctgaattttgacctctttgctgcaagcctgtgaattttcagaactctcagat

SEQ ID NO: 6809548 - DNA, 96 bp, Homo sapiens
ttcttctaaaggaaaaaaactctatggacatggattttgtcataaataataagggcatgtaaatccttctttaggccacatttccatttgggagaa

SEQ ID NO: 6809549 - DNA, 71 bp, Homo sapiens
gcatctggctttgcacacacaataacaaatgtattctcaatatacaatcgtgtgagcaaatgtctgtgtgt

SEQ ID NO: 6809550 - DNA, 77 bp, Homo sapiens
gctgggggctagttggtccagcattgcctcactcacatgtctggaaataggtgctggctggactgtgtgtctccagc

SEQ ID NO: 6809551 - DNA, 82 bp, Homo sapiens
gggctcaagggggctctggagaagaggagctggaagcctgggcctcccatgtacccacctccattctcatctgcctgggccc

SEQ ID NO: 6809552 - DNA, 60 bp, Homo sapiens
tggacttacagaatgttcttccaacagaaattatttgtcgggggaggatgctgttctcca

SEQ ID NO: 6809553 - DNA, 74 bp, Homo sapiens
tccttggaatgttctgagtgcagcttaataaacttaaaaagtaattttaaagctgagccctcagaagctcagga

SEQ ID NO: 6809554 - DNA, 64 bp, Homo sapiens
gaagtagcatgttgctgccagaatactagcatttcttttggcaaactgaagtacatgtcacttc

SEQ ID NO: 6809555 - DNA, 109 bp, Homo sapiens
ctgcctcattactcctaagactgcacagtacacaaaaggagttagtttgccacgtgccaaaacatggctgtgggtgctggctccaccctgcagagggaaactgaggcag

SEQ ID NO: 6809556 - DNA, 93 bp, Homo sapiens
tcattcccatgggggatgggcaagggacaggcctggctttcttgggaccttagacccaggccaggcatgtctgccctgcccttgagggtttgg

SEQ ID NO: 6809557 - DNA, 82 bp, Homo sapiens
gagggggtgcccacagcaggaagctggagggaaatctcactgttgtcccctggtctctctctatctcatcctctgccccctt

SEQ ID NO: 6809558 - DNA, 85 bp, Homo sapiens
ggcctacctccaggagcagggctggcgtgcaggctgaggccagaggaaggccaaggttagccagcccagctccaggggaaaggtt

SEQ ID NO: 6809559 - DNA, 56 bp, Homo sapiens
ggtcccaagtgctttcatctagagatgatattctccgggtggcagaacgtgggtcc

SEQ ID NO: 6809560 - DNA, 79 bp, Homo sapiens
tccaggctctcgatcaccgtggccactttgagggagcggtcgtgcacactcagcttggcctggacgtagcgggcctggg

SEQ ID NO: 6809561 - DNA, 59 bp, Homo sapiens
acaatgtgataatttaaagatatgggatctcccagttgttttggaggttttttcattgt

SEQ ID NO: 6809562 - DNA, 60 bp, Homo sapiens
tttccattttcagctggctgttgtggtacaagggcagccacagtgagaaataaatggaaa

SEQ ID NO: 6809563 - DNA, 107 bp, Homo sapiens
ggcctagggaagagctctgggacagccaggtatgggcgtgcgggtcctgggacgagtttcttccctcgcgtccagccggggcttggccccagcagcctccctctgcc

SEQ ID NO: 6809564 - DNA, 82 bp, Homo sapiens
gctgagaagactgcatagtcatttctatcagatgctgccaaatagcaaatacaatgagtggagactgtgtgtagagttcagc

SEQ ID NO: 6809565 - DNA, 64 bp, Homo sapiens
tggctttatccatcatcgccaacattttctcttttgcagctttgagggtgatggggataggtca

SEQ ID NO: 6809566 - DNA, 65 bp, Homo sapiens
tagttagggattttgaacttactgcttgctagagaagccggactggtaaggaaattcactaatta

SEQ ID NO: 6809567 - DNA, 68 bp, Homo sapiens
tttgggcatatagctgttcccttctctggttggaaactcgtcagtcaggtacagcgtatctgcccggg

SEQ ID NO: 6809568 - DNA, 75 bp, Homo sapiens
ataacttcagggctgtgacagaagggctggtgcctagaaaggtcccttcaggatctgttatgggatggaagttgt

SEQ ID NO: 6809569 - DNA, 61 bp, Homo sapiens
aggtaatagggttcagaattataggatggatgctagaaattattctgtctctctcttgcct

SEQ ID NO: 6809570 - DNA, 117 bp, Homo sapiens
ctaaacctggagtaaactacaaatgattccccagcagtggttctcaaactttagtgtacgtcagaatcacctggaggtttgttaaaccagattgctgggctgcacctccagagttag

SEQ ID NO: 6809571 - DNA, 69 bp, Homo sapiens
tatcatggacaccttccaggtcggtacaaaaggatcaatttttaaatggccacagggtgctccattgta

SEQ ID NO: 6809572 - DNA, 56 bp, Homo sapiens
agacccaggcttcatgtgaatctcagaagtgatttttatatgcgaagtctaggttt

SEQ ID NO: 6809573 - DNA, 62 bp, Homo sapiens
tatagcagatggcattgatggccccggctcttcccctcctcaggcccacatcctttgctatg

SEQ ID NO: 6809574 - DNA, 58 bp, Homo sapiens
tcaacctctgaaggcaggatggatctggagggataaacataacctgcccagaggatga

SEQ ID NO: 6809575 - DNA, 74 bp, Homo sapiens
ttgttttcggccacaatgagtcctttagtgccattgtggactcacaatgcacatggacatcaggctgtgaatga

SEQ ID NO: 6809576 - DNA, 113 bp, Homo sapiens
catacataaattatgatatatccatgcagtagacaagttctcagaaataaaaatgaatgaaccattgatacatgcaacaatgtggatgaatctcaacataattatgttcaatg

SEQ ID NO: 6809577 - DNA, 61 bp, Homo sapiens
gcttcaccctggaccagaaattgggccacctgccatcattttctgaccaggctgatttagc

SEQ ID NO: 6809578 - DNA, 71 bp, Homo sapiens
gacatttctcacagttctggaggttgggaggtccaagatcaagatcccagcagaatctgatgagggctgtc

SEQ ID NO: 6809579 - DNA, 56 bp, Homo sapiens
ggggtttcatcatgttggcagattggttttgaactactgacctcagatgatccgcc

SEQ ID NO: 6809580 - DNA, 56 bp, Homo sapiens
taggaggaaagccaggatttgaactcaattctgttgtagagtctgtgctcttccta

SEQ ID NO: 6809581 - DNA, 63 bp, Homo sapiens
atctgtaagagactattgagcatcttggccgcttccaaaatgacctcagagtttttgtcagat

SEQ ID NO: 6809582 - DNA, 85 bp, Homo sapiens
ggtcattctgcacttcctttgcttcccttccatgaccagctggaacccccatcccggagaggcagtatttggggtgacagatgcc

SEQ ID NO: 6809583 - DNA, 55 bp, Homo sapiens
ggtctgcagtgcacacatcctgcttttattacagggtgcatttcacttacagacc

SEQ ID NO: 6809584 - DNA, 55 bp, Homo sapiens
tctctaaacttatatgaactatagagctttgcagtggtttgtatagttttgggga

SEQ ID NO: 6809585 - DNA, 106 bp, Homo sapiens
ttcaagatcattattagagaaatccttagactctcaattgaagttactatctatgaaaagattctttcagagatgtctagcctattttctaatgaggaccttagaa

SEQ ID NO: 6809586 - DNA, 109 bp, Homo sapiens
ggatcaacaaaatgtgattattttgcaaaggtctaagaaatcagatgatgaggttttataatcccaacttctccatcctcttccctttgtggaatgttatgttcattcc

SEQ ID NO: 6809587 - DNA, 73 bp, Homo sapiens
cccagcccaaagggctctgagtgccggacactgagccgctgtcctggggacaagaggcccttgggaagaaggg

SEQ ID NO: 6809588 - DNA, 63 bp, Homo sapiens
tagagacatcccaagatgacacagtggacgaccaaatgctcaccactgttttctggggctcta

SEQ ID NO: 6809589 - DNA, 68 bp, Homo sapiens
caggtcctgagtggcagggtttgggctgacctgcaggctggtagctcatcatctgccttcagaacctg

SEQ ID NO: 6809590 - DNA, 114 bp, Homo sapiens
atccaggggagattttaagaaatctagaaaaatggctgtgcttcatactacagataaataatagttatcttgacaagttttggacagccactaggtgtcaagatctttaaggat

SEQ ID NO: 6809591 - DNA, 79 bp, Homo sapiens
gcccggagggtcagagttcaggtcgagggccccaagaacatgcccttactatgacctggacctcagccaagaccagggc

SEQ ID NO: 6809592 - DNA, 56 bp, Homo sapiens
ttgaaacaggcagcctaaattggccacacagggtaaattagtgctccttgtttcaa

SEQ ID NO: 6809593 - DNA, 69 bp, Homo sapiens
ctgggacatttaatctatgttttgttttgttttgttttacaattataagaataattaagttagtcctag

SEQ ID NO: 6809594 - DNA, 63 bp, Homo sapiens
ggttgaacatctctggcaccaaactcccttcttctctttcagtcacttggcagaggttcagcc

SEQ ID NO: 6809595 - DNA, 59 bp, Homo sapiens
gagcaaaggtgcagtttgaaatgactgatagaattcaggtttccaacaaacctctgctt

SEQ ID NO: 6809596 - DNA, 73 bp, Homo sapiens
tcttgtctctctttcctgagtttgggtggggcagggctgcccagacctctgagccatggaaggtgactcatga

SEQ ID NO: 6809597 - DNA, 73 bp, Homo sapiens
aggtgagaggttataaatcagggtcatttaagctctgttgtaccaacaaatgaacctgaaatctcagtcactt

SEQ ID NO: 6809598 - DNA, 65 bp, Homo sapiens
tgtcattcacttgcctatattctctggagaacctcaaaaatgagaatgaggcaaggaggaggata

SEQ ID NO: 6809599 - DNA, 66 bp, Homo sapiens
catctgtcttcatttatgcaattagcaatagaaatatggtgataaacagctgatgaagaccagttg

SEQ ID NO: 6809600 - DNA, 56 bp, Homo sapiens
gctcttctcagattgtacactctcagaacctgatggagaagtgacttggaaagagc

SEQ ID NO: 6809601 - DNA, 59 bp, Homo sapiens
gttactgtgtgtatatcctcatctgtaagaaattgagacataggattccacatagcaac

SEQ ID NO: 6809602 - DNA, 93 bp, Homo sapiens
gtcagtagaaatgttgctttcagagaagcagtttatcagtagctgttgtgaatgtgtacattgcttatttgatagtacattttcaaagttgac

SEQ ID NO: 6809603 - DNA, 118 bp, Homo sapiens
tcccagggggagagtgtatctgttggttggctggattctcatcagagccagagctctgccctccctctggctgtgtatgagagtttttgtttcctttgtaaactccctttcctgagga

SEQ ID NO: 6809604 - DNA, 116 bp, Homo sapiens
tcagtagctttatctctgggtatcatattggttaggaacacaggctcttgtcaggacatacctgggcttcaatcttggctctgccatttcctagctgcatgacctgagataactga

SEQ ID NO: 6809605 - DNA, 76 bp, Homo sapiens
tacagctagcccagcaggagagaacatttccctctggttcagggatgttcctttgtttcctgctctgtcagctgta

SEQ ID NO: 6809606 - DNA, 57 bp, Homo sapiens
ggcttcacagagcatctcggagcaacgcctaatgcagcctgggaaatctgggaagcc

SEQ ID NO: 6809607 - DNA, 77 bp, Homo sapiens
cttgacagagaatctgggtggcacatgtctgtgtccactacatcagcagtgtctacctcggtgaatctctgtagtag

SEQ ID NO: 6809608 - DNA, 75 bp, Homo sapiens
tctgtccttgttgagctagggaggaggcttgctcttcaggagagaagccaaactactgagcaagacaaggagaga

SEQ ID NO: 6809609 - DNA, 58 bp, Homo sapiens
cagtcactggttctataggcccctctgagcagaggtaggcatcccaggccagtgactg

SEQ ID NO: 6809610 - DNA, 59 bp, Homo sapiens
gtggctgtctgcagatgtgtctgttgctggatgtggacacaagggtaactgccagccat

SEQ ID NO: 6809611 - DNA, 65 bp, Homo sapiens
tccctctgggctggagcagggtccagctggcactgccccagagccctgctcctggctgggaggga

SEQ ID NO: 6809612 - DNA, 64 bp, Homo sapiens
agaggccctttctgaaactgcgcatttgaaatataagctctggcttccaaaggaatgggccttt

SEQ ID NO: 6809613 - DNA, 65 bp, Homo sapiens
ctggaatgtgctagggctgtggccacctgggcccctgctggagctgcagctgtggatgttctcag

SEQ ID NO: 6809614 - DNA, 61 bp, Homo sapiens
cctgcttggctgtcataaggtcctggggaactcccagtactgatccctggcagcccacagg

SEQ ID NO: 6809615 - DNA, 62 bp, Homo sapiens
aatttctgggattttttaaaaaagggatgccaatctctgagtgggaaggaatgtcagaagtt

SEQ ID NO: 6809616 - DNA, 78 bp, Homo sapiens
ggctggacatggggactgatgggccgggtgtgttcatggcgcccttgtggcactgccatcaggcctccgtgtccagcc

SEQ ID NO: 6809617 - DNA, 61 bp, Homo sapiens
ctgaggtgcttggatgtttgtagtaagagcttctaactctgctgctccacccggctctcag

SEQ ID NO: 6809618 - DNA, 67 bp, Homo sapiens
agtgtgctgacttctgtaatatttttgctgctcgaagaaaacaaagaatttcaaagtccagcacatt

SEQ ID NO: 6809619 - DNA, 86 bp, Homo sapiens
ttcagatagcacacatcacactaatttttcaagagtttttcattgtatttattgtatggaaaatattggtaggatgcttgtttgaa

SEQ ID NO: 6809620 - DNA, 86 bp, Homo sapiens
ttctgtaaagccatagccatgctgctatgcacagccatgcaatttgcacactgtgacaaaagcagcctgcctggggacagatagag

SEQ ID NO: 6809621 - DNA, 71 bp, Homo sapiens
tgcaggattgcctcaggctagctactgtcccttaactaaaggtcacagctttctcgtgaggactctctgta

SEQ ID NO: 6809622 - DNA, 66 bp, Homo sapiens
ggctgctcggagagagtgtgacggtggattccataaattaactgaaaatccctcttctccggagcc

SEQ ID NO: 6809623 - DNA, 83 bp, Homo sapiens
agctcaaacttgaagacatgtttttaatatgtaaatgtgtatgaatggatacatacaagatgtgtttaaaatctgtttgagct

SEQ ID NO: 6809624 - DNA, 59 bp, Homo sapiens
ggggccggtgctcaggttcccatgagtgcccggtggcaccaggcagctgagcaggccct

SEQ ID NO: 6809625 - DNA, 66 bp, Homo sapiens
tacagtcatccaggaaatgtatccaaatgcactacatggaaggcagccagcctggaagtgactcta

SEQ ID NO: 6809626 - DNA, 63 bp, Homo sapiens
tctgttttcttcctcctgcctcacctgggcaaatggtttaggcagtggaaggagaaagcaaga

SEQ ID NO: 6809627 - DNA, 61 bp, Homo sapiens
agagttgaaagtgccaagtcctagtggttttgagaagcctctggtctgctctttctgctct

SEQ ID NO: 6809628 - DNA, 70 bp, Homo sapiens
tgggatgaacctgtcagtgctgcaggctctgcggctcattagcagagagagcagcaggcagggcttccta

SEQ ID NO: 6809629 - DNA, 126 bp, Homo sapiens
ctttcagctgaactcctcttcttgtcttgatgagaatctctttgacaagcagatatgatttctgttatcaagagttctgcttggtcaggggctgtgttaactcatctccagataatcagtgtctag

SEQ ID NO: 6809630 - DNA, 89 bp, Homo sapiens
ctcggactctctcacagcttggcagaattagtggaacagcatgtgtcttttatctagaattttgccatatagctctggagttatctaag

SEQ ID NO: 6809631 - DNA, 130 bp, Homo sapiens
gtgaagagccacactgcgggtcattgtgtacctgagtagggagttcagaggctggtttgcaggctcctgccacaggcctgaccctgagcttcacaccttattgagttttcactaatgccgatggctgtcc

SEQ ID NO: 6809632 - DNA, 90 bp, Homo sapiens
gccacaagtaccagtgccaaggctcttggtctggaattctgaaaacatttacctctgaccctggcagcccactggccattgcttgtgtgc

SEQ ID NO: 6809633 - DNA, 84 bp, Homo sapiens
gtctcggtcagtcacttcagatccctctgccactgtagctcacatctgtcagggtttaggggaactgaggtagtttgaggggac

SEQ ID NO: 6809634 - DNA, 74 bp, Homo sapiens
agccaaggtgaaccagcagttgcctgaaaaagacctttccttgccttcttagttagtccctggtacctttggct

SEQ ID NO: 6809635 - DNA, 58 bp, Homo sapiens
gctctctggaagcgcagatctgttttaaaagtcctgagcaatttctcgcaccagacgc

SEQ ID NO: 6809636 - DNA, 113 bp, Homo sapiens
ttgcaattctactgtacccttcattattcacctacttttgccatgtgtgtaagggtataattttgcatgtacgtacagagagagtgagtgttaaagggatagagggacagtga

SEQ ID NO: 6809637 - DNA, 103 bp, Homo sapiens
gactatattgggggattagaggtgggttctgaagatgttgtggaatgctgtttccccatggtttccaggatagctttcaggaatccttttctgtagaatagtc

SEQ ID NO: 6809638 - DNA, 57 bp, Homo sapiens
gcaataggcagcaagaaattgtttgtgctacacatacaagttctcatgtgtatctgc

SEQ ID NO: 6809639 - DNA, 67 bp, Homo sapiens
tttcctagatgttagttagtcttgacaataaggcctatattcaagattgaactggcagataaggaaa

SEQ ID NO: 6809640 - DNA, 75 bp, Homo sapiens
agacttagacatgcgtaggaataaagaatctcaacttctacagaagcactgagagattctcctgttgtcaagtct

SEQ ID NO: 6809641 - DNA, 71 bp, Homo sapiens
caatgataatgtagaagcccggaggaaggagagccttacccagagcacttgagcttttgcattccttgttg

SEQ ID NO: 6809642 - DNA, 64 bp, Homo sapiens
gtgggattggggactccaaactcagggtcatcctgcctgccctgagccgctgctccaacctcac

SEQ ID NO: 6809643 - DNA, 58 bp, Homo sapiens
ttcatgttttgagccattctgagtgaaacaatacttgtgagaggcgttcgaagcagag

SEQ ID NO: 6809644 - DNA, 81 bp, Homo sapiens
gcttaagagagggtgaaggattggagggcatcttttattcatggtccagggtaccctgtatccatcccttattctataagc

SEQ ID NO: 6809645 - DNA, 80 bp, Homo sapiens
tcagctccttttattcaaatagttcacactcttgatgtaaccccaggagttgcaactcactgaacaaaatgattggctga

SEQ ID NO: 6809646 - DNA, 79 bp, Homo sapiens
cagaactcagggagctaaagagccctacccaaagttacacagtgtaatccatgtcttgtagttccttgctgtttctctg

SEQ ID NO: 6809647 - DNA, 87 bp, Homo sapiens
cagggattggtaggcttagtggtagagtcctctcaggtcaggaggctggagcacaaatgggaactactatatagcataccttctgtg

SEQ ID NO: 6809648 - DNA, 104 bp, Homo sapiens
gtagctggggagagtggggttcaagcagggcagggagcttagaatgaccctcagggtcctcagtgtaccattgctgaagttgacaactccctctttccacctgc

SEQ ID NO: 6809649 - DNA, 57 bp, Homo sapiens
ttccaggcttctctggggcgtcatctgcactcgcgctgcctccctggagcctgcgaa

SEQ ID NO: 6809650 - DNA, 69 bp, Homo sapiens
ggagctttacatgtgttttgtcatttcaataatataaggattatctgagatcagcagcatattagctcc

SEQ ID NO: 6809651 - DNA, 68 bp, Homo sapiens
ggagatgctttatctcctttgtcccttttcccacaaccacagagtgacgggagccatagggaatctcc

SEQ ID NO: 6809652 - DNA, 55 bp, Homo sapiens
gagtatgtgtttctgggtttagtcttcctagaggacaatctagaaatatgtgttc

SEQ ID NO: 6809653 - DNA, 88 bp, Homo sapiens
gctagaatttcctgagcccccaggatttcctgcaccgccagccgcctcttccccaggcacagggagctctgggggcacacggtctggc

SEQ ID NO: 6809654 - DNA, 76 bp, Homo sapiens
agtttacttttgattatgaggatcttatgtaataattatggatatatgacaggcatgagatcctaaaagtattact

SEQ ID NO: 6809655 - DNA, 67 bp, Homo sapiens
gtcttgcagagggcccttctgctgcagacccagagccttgcagtagcttcctgacctcttgcaagtc

SEQ ID NO: 6809656 - DNA, 106 bp, Homo sapiens
tggtttctataattgcaatttgagaataactgatttaaatgccatctcttctaatccaattcaaaatgagagcaatagtaaatcagtgttctccaagaagacacta

SEQ ID NO: 6809657 - DNA, 89 bp, Homo sapiens
tcacatggccatccctctctgcatgactgtgtctttctcctcttcttgtaagggcaccagtcatgttggagtagggtccaccctagtga

SEQ ID NO: 6809658 - DNA, 76 bp, Homo sapiens
ctcacctggagagcttgctaatacactggtccccatcctaatcccccaaggtaaaggcaaactctccaaggatggg

SEQ ID NO: 6809659 - DNA, 81 bp, Homo sapiens
cctgataagatccaagggctgctttttgtatatgcttcgaggatgagcccattctctgtacagaaggtaccgttcattagg

SEQ ID NO: 6809660 - DNA, 119 bp, Homo sapiens
tggacattttgggctggatgtttctttgttgtggggcggctgtcctggcattggaggatgttaggcagcatttctgcttatccaccagacacctgtagcaccacccctaagttgtgcca

SEQ ID NO: 6809661 - DNA, 73 bp, Homo sapiens
agttactcactgagggtttattttgatattaactacttattttccagtgtctaccaaccgtctagtagtaatt

SEQ ID NO: 6809662 - DNA, 128 bp, Homo sapiens
gtcctccaaggagctgaaagggaatggtgaagctgtttccagggctctcttcatgagacacttgctagaacaaagagggctcatttgaagctgggctctgggaaaatccctgcccacagactggtggc

SEQ ID NO: 6809663 - DNA, 71 bp, Homo sapiens
ttagggctggactgtttatgttaacatgataccacatatatgtacaatcagcagttcataaaatgccttag

SEQ ID NO: 6809664 - DNA, 65 bp, Homo sapiens
tctcagtatgcttgattggatttaaaaaccatgcctggggtttcatcatccaaagagttacggga

SEQ ID NO: 6809665 - DNA, 64 bp, Homo sapiens
gatcgggtgggttctgccatcaggaccagggagcccactgagtggcctggagccccgcctggtc

SEQ ID NO: 6809666 - DNA, 60 bp, Homo sapiens
tcttgagtcagcaaggaaaatgtgtcacgttgttggtgagacaagatttgtaggcagaga

SEQ ID NO: 6809667 - DNA, 56 bp, Homo sapiens
catttgacttgctttcccagctaccatctgctgggaaaggtgcggcaggtagagtg

SEQ ID NO: 6809668 - DNA, 64 bp, Homo sapiens
gggaagaattgagagttagagataaaggaattttctattctctgatctttaattcagatatccc

SEQ ID NO: 6809669 - DNA, 88 bp, Homo sapiens
gtgcactggctggcaagttactggcaagggctgcagttttggctgatagcagttgttttcagtgagtggttattactgcagggtgtac

SEQ ID NO: 6809670 - DNA, 77 bp, Homo sapiens
gcaatctcagcctatgatgctgttattatctatacttttaagaatatatttagcagtgttaaacttgctgaagttgc

SEQ ID NO: 6809671 - DNA, 97 bp, Homo sapiens
gggtggttcacagaggtgaaccaagtaaacaatatgtgattcagttatcaaacaagtatctgaccaaaggtggtttatttggttcaccgaatttccc

SEQ ID NO: 6809672 - DNA, 72 bp, Homo sapiens
tgcctaccagtgttctcccttctgtgtcccagtactcaattttgttgctggagtgagggccttggtggtgta

SEQ ID NO: 6809673 - DNA, 61 bp, Homo sapiens
tcctttctgggcctcagtgactcctctgcaaaggggcgagaaagtcacagcccaggaggga

SEQ ID NO: 6809674 - DNA, 80 bp, Homo sapiens
gcccaatctcatggaagttcattctcctggtgctggagctgcacacacatgaagttgctgagctaccatgagaagggagc

SEQ ID NO: 6809675 - DNA, 65 bp, Homo sapiens
tagtgtattaatattggttcattagctgtaacacatgtacatagcaatgtaagatgttaacacta

SEQ ID NO: 6809676 - DNA, 66 bp, Homo sapiens
ggctgaggtgggtggatcacctgaggtcaggaccagcttggccaacatcgtgataaccccctctcc

SEQ ID NO: 6809677 - DNA, 62 bp, Homo sapiens
ttccttcagctgttttgagtttaattggggtcttctgtataaaccatggacagctttgggaa

SEQ ID NO: 6809678 - DNA, 83 bp, Homo sapiens
tagcttctactcctctctctcttggccacttgctctgggcaaagccagcagccaagccatgaggactacatggagaagaactg

SEQ ID NO: 6809679 - DNA, 95 bp, Homo sapiens
gctggaattcaaagcaagccttagaggctaagcactggcatttctgtacccatcttgggggagagctggtagctggctccagggaagcatccagc

SEQ ID NO: 6809680 - DNA, 65 bp, Homo sapiens
gtcagtagttgaatattagaggagctaatgatttaagtttagttcttactgttttcagcgtggac

SEQ ID NO: 6809681 - DNA, 60 bp, Homo sapiens
tcccccgagttcctatgcccggcctgcttttggccgtggccttgatggctccggttggga

SEQ ID NO: 6809682 - DNA, 57 bp, Homo sapiens
gagtgcctggggcatctcctgcacggaatggcacccgcaccaggtgcccctggcctc

SEQ ID NO: 6809683 - DNA, 73 bp, Homo sapiens
ccagatgccagagccccaggacagctctagttgccccagcggctacagtggcactgggctttcctggcactgg

SEQ ID NO: 6809684 - DNA, 61 bp, Homo sapiens
gcccagcactaaaagctttgctggtttttctatccccacagcagaggttctctggctgggc

SEQ ID NO: 6809685 - DNA, 94 bp, Homo sapiens
tagagtctttgtaaagcagcagtggttttatcattttgtcacctgaggcactgccacaaaaaaatgagggaaatcctgtccttagcttcctcta

SEQ ID NO: 6809686 - DNA, 61 bp, Homo sapiens
cctgggtctctgtccttgctctaccaatgacaggaagaaatagacatggtagtgattcagg

SEQ ID NO: 6809687 - DNA, 73 bp, Homo sapiens
atttttttgatccagttgaaagtgatgaagacatagcaagtgatcatgatgatgagctgggttcaaacaagat

SEQ ID NO: 6809688 - DNA, 61 bp, Homo sapiens
acaaactcagcatcagtgtccagaacaaccgaagtgttcggcatattaatggtgggtgtgt

SEQ ID NO: 6809689 - DNA, 70 bp, Homo sapiens
tccgcatcaggaggagatgaagaaaacctattgtattaagttgttttcttcacctttcctgggttgtgga

SEQ ID NO: 6809690 - DNA, 55 bp, Homo sapiens
agattttcaaggaaatcagaaccaaattaagagttcttaatttccttgtgagttt

SEQ ID NO: 6809691 - DNA, 66 bp, Homo sapiens
tactggcttgtgcatttcattcctcaggttgtttgggcttgataagtgtaaattacgtagccagtg

SEQ ID NO: 6809692 - DNA, 55 bp, Homo sapiens
ggcaggctttgagaaagagcatcagaagcctgacagttcttcttcagcctcagcc

SEQ ID NO: 6809693 - DNA, 57 bp, Homo sapiens
gtttccagcctcctgggtaaaggagcagtctcctcccttgcttgggactctggacgc

SEQ ID NO: 6809694 - DNA, 76 bp, Homo sapiens
tgcagaactcatggcatctacctgtgtactttgcgccacatcacagtaaagtgtaaaagcatgttagggagttgca

SEQ ID NO: 6809695 - DNA, 84 bp, Homo sapiens
ggtgatttacatttcatgccctttcaggaaggagtaaccattctaatacatccttctcaaagagtgcatgtttagtggaacatc

SEQ ID NO: 6809696 - DNA, 55 bp, Homo sapiens
gcggcaagggtagaggcatcagtagactggtgaggaggctttgcactcatgttgt

SEQ ID NO: 6809697 - DNA, 57 bp, Homo sapiens
gaggtgcccttgtgtattgctgccatccaccaaaacagtgatgcatgcaagcagctc

SEQ ID NO: 6809698 - DNA, 68 bp, Homo sapiens
ggctccctgtttcctgatgagcccagacttcgattccgtgtgggtttaagaggcagcatgtaagagtc

SEQ ID NO: 6809699 - DNA, 128 bp, Homo sapiens
tggctccaggtggtattccgtggcaccaggtggtattccgtggtgccaggtagtattccatggctccaggtggtattccgtggctccaggtggtattccgtggtgccaggtagtattccgtggtgcca

SEQ ID NO: 6809700 - DNA, 86 bp, Homo sapiens
aaggataaaactgtgttagtatactggtagtaaaatgtataattaataaagatgctgcagctatattttcccacagtgaaatcctt

SEQ ID NO: 6809701 - DNA, 55 bp, Homo sapiens
tgcagggaatccagtctagggtgaatgttacacagccttcagatcattctgtgca

SEQ ID NO: 6809702 - DNA, 56 bp, Homo sapiens
gagtggaggtgacttctgggctgaggcagttaagagcacacaggccacctccactt

SEQ ID NO: 6809703 - DNA, 110 bp, Homo sapiens
gttgcttaatcgtattccattgtatggagatgacacaatttatttatccgttttcctatggatggacatttgagttatttccagtttggggcttttacaaatagagcagc

SEQ ID NO: 6809704 - DNA, 70 bp, Homo sapiens
gcttacagtgtgtaggctattactttacagtgtatcgagagacattgtttcagctgtatgctatgtaagc

SEQ ID NO: 6809705 - DNA, 71 bp, Homo sapiens
ggtgatttagcaatcatgacaaattatcttcatctataaggtggagaattgttaggattcctttattcatc

SEQ ID NO: 6809706 - DNA, 91 bp, Homo sapiens
ccctttccccttttcttcccatcactagcatctgcaccactcaccagtgagggcagcgagccaggtaggtggccggaggagtggggagggg

SEQ ID NO: 6809707 - DNA, 56 bp, Homo sapiens
acaggattttgtagttttgttgccccttctatgagcaacaaactacaaaattatgt

SEQ ID NO: 6809708 - DNA, 82 bp, Homo sapiens
cacgtttagcctatcttattaaacactgcttatctactaaaggcagtcagcagcatgtttaatcaaagtcagggcagatgtg

SEQ ID NO: 6809709 - DNA, 78 bp, Homo sapiens
gatcctgaactaacacatggttctgtcaggaaggtcttcatctccctgaacactactatgatgctggagtttggggtt

SEQ ID NO: 6809710 - DNA, 66 bp, Homo sapiens
tgccttaaaaatgtgacagatgcagtacagtcattgtagattgcctccagatgatcatattttgca

SEQ ID NO: 6809711 - DNA, 59 bp, Homo sapiens
agtaacatttagcttctcactgaagagggtcccctttggaaggcttggctagatttact

SEQ ID NO: 6809712 - DNA, 62 bp, Homo sapiens
tactgtgtagtattgttgtgatgattaaatgcgtgaacacatctacagctgtctgcacagta

SEQ ID NO: 6809713 - DNA, 113 bp, Homo sapiens
cggaggctagaaatctaagatcaaaggtgacaggattggttgcttctgaggcctctctccttggcttgcaggtggccatcttcgttctgtgtcttcacaaggtcttccctctg

SEQ ID NO: 6809714 - DNA, 88 bp, Homo sapiens
aggtggtgctggaagtggactggagctgagagcatgggtaaagggaagtctttcctgcgctctcagttcacacaaccacttctctcct

SEQ ID NO: 6809715 - DNA, 68 bp, Homo sapiens
atacatgagaaggttttggcatatactgtggtacataataaatgttactttcctttcacatcatgtgt

SEQ ID NO: 6809716 - DNA, 71 bp, Homo sapiens
gcagctggctggatggtatggaggagctcaggcctttcatggcctctggtccctcatgctgtggcagctgc

SEQ ID NO: 6809717 - DNA, 66 bp, Homo sapiens
ttcatagacattttgcattcaagcactgcagtaaatttgggtgcatatttgtatgatgtttaggaa

SEQ ID NO: 6809718 - DNA, 55 bp, Homo sapiens
caagggacctgagatggtctctcttgaaatcaacagctatggtaggactcccttg

SEQ ID NO: 6809719 - DNA, 55 bp, Homo sapiens
gtaatcccagctgctcaggaggctgaggcaagagaacctgggaggcggaggttgc

SEQ ID NO: 6809720 - DNA, 67 bp, Homo sapiens
gaagcctccttggtctcagcaggccctgtgttgtacccaccaggcctctaggagattagggggcttc

SEQ ID NO: 6809721 - DNA, 70 bp, Homo sapiens
gaggcccagaatctggtggacgtgaagattccagttctatcttgtgggcagggacacatccccaggcctc

SEQ ID NO: 6809722 - DNA, 77 bp, Homo sapiens
gagagatgctgaggattaattacagccctaagatcagctacagttgcatgggcttaattcatcccataaatcttctt

SEQ ID NO: 6809723 - DNA, 64 bp, Homo sapiens
gtgaggtcatgcaaaattgaatcaggtatttggagttttgttcctgattctaccactgactcac

SEQ ID NO: 6809724 - DNA, 67 bp, Homo sapiens
gagtgatttccagagagacgtttccttagaggtccagatttatcagagagcatctccctgatcattc

SEQ ID NO: 6809725 - DNA, 62 bp, Homo sapiens
tgcaagagaaggtgaggaagccggtggagcaggatgaattctcgacttctcatttctctgca

SEQ ID NO: 6809726 - DNA, 62 bp, Homo sapiens
gggtcatcatactgaactgtatcagggaatgccattcagatcatagtctttgtgactggccc

SEQ ID NO: 6809727 - DNA, 55 bp, Homo sapiens
gtgtgccctggctccagcaccaatgggtagaagatgttaggtggccaggggatat

SEQ ID NO: 6809728 - DNA, 112 bp, Homo sapiens
acctttcccctttctgctctcagcctggcctggcactgggctcctggccaggtatcaccccctggcacagggcagggccaggtggggcagaggatagtaaggtggcaggggt

SEQ ID NO: 6809729 - DNA, 59 bp, Homo sapiens
ggcactgcccaccctcacagggtatgagtcagtagtcagccctgtgattggcaagtgtc

SEQ ID NO: 6809730 - DNA, 63 bp, Homo sapiens
ggtttcttctgcctttaccaaaagaaaacactaattatcctatttttggtctgggtggaaacc

SEQ ID NO: 6809731 - DNA, 58 bp, Homo sapiens
acactttgtcctttttcattgtatttagataattaatcaatgagacagagcagagtgt

SEQ ID NO: 6809732 - DNA, 78 bp, Homo sapiens
gaggggatgtcctgtgcattgttgagtgtttagcagcctccctggcctctacccactagatgccagcagcatcccttt

SEQ ID NO: 6809733 - DNA, 89 bp, Homo sapiens
ttacgttagaagccctgagtcatcattgcggaagttggcctaagcttttgaaatacagtggtgcactgagataactttccaattagtaa

SEQ ID NO: 6809734 - DNA, 59 bp, Homo sapiens
atattcataaaatcagttggaaattccctttagcaatgtccagctgtgattatgaatgt

SEQ ID NO: 6809735 - DNA, 66 bp, Homo sapiens
tgccctgggacatgcagcggagtgacgaccagtctagacacctccaggctgcaaggccacagggca

SEQ ID NO: 6809736 - DNA, 57 bp, Homo sapiens
ctgagcaggatattcacagcagacgctgctctctctgtgtgtgacaacctagttcag

SEQ ID NO: 6809737 - DNA, 100 bp, Homo sapiens
tcctcccttctcgccagggcgccttcggcctctctttgaggccttccccagggactcagagcctcgagggactgcgggctcccttgtgggtgggggagga

SEQ ID NO: 6809738 - DNA, 68 bp, Homo sapiens
gtctgcctgcttcttcatagtctatgtgctcgctcccagtggtttaaaagaatgagggagtagggagc

SEQ ID NO: 6809739 - DNA, 66 bp, Homo sapiens
cgtgccttgttaggtgataaagatacccttgctggaaagcagctttgtttactccctgcaagcacg

SEQ ID NO: 6809740 - DNA, 120 bp, Homo sapiens
ggcttgggtttggaagggctgggaggtctgtgacccctgccctgtgtttggggactaggtaggcaggcctgtgactgtaggaggagggggttcaggtcttggtcctgctgagcccgagtc

SEQ ID NO: 6809741 - DNA, 56 bp, Homo sapiens
ctggagttcagtggcgtgaacatgactcaccacagccttgacctcctggactccag

SEQ ID NO: 6809742 - DNA, 73 bp, Homo sapiens
ggatgtggaggcctaaggtacagtttgcatctggagtgagaggcatgggccagaaaaggcttcccaggcattt

SEQ ID NO: 6809743 - DNA, 84 bp, Homo sapiens
tctcttttattttatatagtttgatacttagcatgttacttcagaacaacatagctcttaagtctgtgatagaaaagaaagaga

SEQ ID NO: 6809744 - DNA, 125 bp, Homo sapiens
gtctttagctaaggcttagcagaaaagccttctcctatggggagaactttctgtgaggttccatatggtccctgctgactcttcctggagtgaagaaggcttttccaagccccttgatggaagac

SEQ ID NO: 6809745 - DNA, 98 bp, Homo sapiens
gtgaagaaggaactgttaactggcagctcgatgacttctgcattccttgtggtgaagccatgcaggattgttgggttctgtggcactttctcctttgc

SEQ ID NO: 6809746 - DNA, 57 bp, Homo sapiens
catttctccgccgagatcactgaggcagggagcaggtgagtcgggggcggagagatg

SEQ ID NO: 6809747 - DNA, 74 bp, Homo sapiens
ggtctactgctctccctcctccctgcccaggccaaccttagaaccagggcagggctgggtgggagacagagacc

SEQ ID NO: 6809748 - DNA, 76 bp, Homo sapiens
aaaagcttctaatatgttagggaaatattggaaattacttgtaatggcagttggtgttactctgataggtgctttt

SEQ ID NO: 6809749 - DNA, 93 bp, Homo sapiens
ggagggtgtgagttggttttagttcttgctcatggggtaggttccaggagtgaccgagccatgagcgagtaattacccaatagtcaactcttc

SEQ ID NO: 6809750 - DNA, 79 bp, Homo sapiens
tgtagcatcacaaggagaagtctgttgagattgctgcccctcacagcttcaacagtttgatttctgtcttttcactata

SEQ ID NO: 6809751 - DNA, 66 bp, Homo sapiens
gtgccagactttccttaggtatctcaagagctctgtttctaggaaactcaaagggaagtgggaaac

SEQ ID NO: 6809752 - DNA, 76 bp, Homo sapiens
ttcctaggactggaccagaaaggacatggctttgtaagagctttcctagcaatgtctttttggccatctgtgggaa

SEQ ID NO: 6809753 - DNA, 79 bp, Homo sapiens
agcttacttgagtaagttagtacctgctcagatttgtttaagaagatatggcatatcctcaatttgccaggcattggct

SEQ ID NO: 6809754 - DNA, 55 bp, Homo sapiens
aagatgctaattgtggaagttgcttttcatgcaaataaaacctagttggcatctt

SEQ ID NO: 6809755 - DNA, 101 bp, Homo sapiens
gatgctttggagtcttgtgtgtaccttgccaatgtatagagatagctgtgtgtgtctcaccacaccatgagcttcctatatagggtcacttctaattcatc

SEQ ID NO: 6809756 - DNA, 81 bp, Homo sapiens
ggtgctgaaccatttctgaatagtttgttccttggcttttaaattggtatctggacagaaattagcagtgagtttagtgtc

SEQ ID NO: 6809757 - DNA, 79 bp, Homo sapiens
tccttcactaggctgggggtcaatgacgaacagcaattccagttccctgccctcaaggagcccacagtctaatgagggg

SEQ ID NO: 6809758 - DNA, 69 bp, Homo sapiens
ggtgagtaatcgaggtctctgagtgcctggggttgaaggttgagggagttcaaagacttgatgctgacc

SEQ ID NO: 6809759 - DNA, 66 bp, Homo sapiens
ctagaaattgcaggtcgtgtggaagtgacgtttcgtgttcttttaatagagatcctgtgtttctgg

SEQ ID NO: 6809760 - DNA, 65 bp, Homo sapiens
cagtgtctgcctttctgtttggcttcagtccttaaagctgtcaacagaccagagaggcggagctg

SEQ ID NO: 6809761 - DNA, 80 bp, Homo sapiens
tggtacttaaatcttatgtgctgtgagatttttctcctccagggagtttagagataattggcacatggagaagattacca

SEQ ID NO: 6809762 - DNA, 57 bp, Homo sapiens
ctggtctagggtctaaacggccattcagtactttgaactttggctttcctgacacag

SEQ ID NO: 6809763 - DNA, 64 bp, Homo sapiens
ccaggtggcagggggctaaagggcacttcctgccagggaggctctcaccctctgaccagactgg

SEQ ID NO: 6809764 - DNA, 96 bp, Homo sapiens
ttgaaaaatcatactccattcacttatttttaaggatgtttgaataacttttaaggatgtttgaataacttggatatattgaatgtgctttttcaa

SEQ ID NO: 6809765 - DNA, 83 bp, Homo sapiens
gaagccatgactgtgtgcccagtcctggccagtaacatgaagaaaacaggtcctcaggtggggaggcatgcagttctgacttc

SEQ ID NO: 6809766 - DNA, 58 bp, Homo sapiens
gttagaggtgtcaggagcacaggtttcagagtcaggctgcttgtgttcataccttagc

SEQ ID NO: 6809767 - DNA, 71 bp, Homo sapiens
agctgtgaatcctaggccctgggtatttaatagagcatctcagttctgaggggccagggatctgggcagct

SEQ ID NO: 6809768 - DNA, 61 bp, Homo sapiens
agttgttaagaggatggactttggagacagacacttcagtttccacttacatttaatggct

SEQ ID NO: 6809769 - DNA, 66 bp, Homo sapiens
gtacacttgactcataggaaatttggtacaataggagttccattgctatgagcctcaagtgtctgc

SEQ ID NO: 6809770 - DNA, 55 bp, Homo sapiens
gccagggagtctgggccacagatcccaaaggctgatatgagcccttatctttggc

SEQ ID NO: 6809771 - DNA, 63 bp, Homo sapiens
tcccccctttggtattcgaatgcttttattttcttcacataaaatattcctagttagggggga

SEQ ID NO: 6809772 - DNA, 74 bp, Homo sapiens
ctgggtttgttagtggtaatagagctccaaactaggctttttcgctttattctggctgtatattattgacccag

SEQ ID NO: 6809773 - DNA, 72 bp, Homo sapiens
agtccgcagctgagcagaagccctcctggactctgagttatggagtctccaagcctctgtgagctggtgact

SEQ ID NO: 6809774 - DNA, 77 bp, Homo sapiens
gtgtgcactggctttctgttataaagacattgctaccaaggcatgttattaattcttagaatattgtcattgtacat

SEQ ID NO: 6809775 - DNA, 128 bp, Homo sapiens
attgaaaattcaaattagaaaacgaactcttggagatactagtaagatatttgacaggcgccgaatgctccatcaagctggctgttgctatttcaagggttatgatcattctgatgaagatatttaat

SEQ ID NO: 6809776 - DNA, 76 bp, Homo sapiens
gtctccctctaaagatgtttattgacatacatgatgatgaatatgttgactttatgaactcttctttttggggagc

SEQ ID NO: 6809777 - DNA, 65 bp, Homo sapiens
ggtttcatatgctggagggtcgtctagccgagaggttcaacatggctttattcacatatctgacc

SEQ ID NO: 6809778 - DNA, 89 bp, Homo sapiens
cacaaccaattgaatcaaagaaggagaggttcctggggctatttggctatagtgctttgtttcttttcagatctctcaatttataagtg

SEQ ID NO: 6809779 - DNA, 111 bp, Homo sapiens
ggctcagacacggtttgcattcacttggaagagataacattataagttcactgtctggcccagactgatgttaaccctctcttctctgtcacaatgtaggcctaatgggcc

SEQ ID NO: 6809780 - DNA, 83 bp, Homo sapiens
gtgaggctagaggcgggctgtctttccttttggcatttttgatggtctcagactaaaagaaggaagctaccttctggccttat

SEQ ID NO: 6809781 - DNA, 80 bp, Homo sapiens
aaagcttatttcctcagctttagactatgaatagaatagctttaatttatagttgataaaagcagaaggaagaaagtttt

SEQ ID NO: 6809782 - DNA, 112 bp, Homo sapiens
ctacctgaattccaagtggtgtcatgaacaagtacatacataatatagcagttaagtgcaaatttggaatctgtatgtatgtataaagttgctgttgacatggttctagtag

SEQ ID NO: 6809783 - DNA, 55 bp, Homo sapiens
cagaatcagtgacacatgtataagaatgtttgtaccatatatgttactgactctg

SEQ ID NO: 6809784 - DNA, 86 bp, Homo sapiens
cttacagctatttcacaactgttccttaggaattatttgatgctgaaaatatcaaataagaagggaatggttttaggctaaataag

SEQ ID NO: 6809785 - DNA, 73 bp, Homo sapiens
attcaatatctggttctgcaaatttgtccctaaagattttagggcttcattcaggcagaatttcatattgagt

SEQ ID NO: 6809786 - DNA, 129 bp, Homo sapiens
agcattagaggaatcaaacaaacaaggtctatatttttgcatagggtgttttacgttcaatactacaatatttatgtttggcactattcactccatgggaaaatataggctgtgtgtcttttatttgct

SEQ ID NO: 6809787 - DNA, 87 bp, Homo sapiens
atttatttttcaacaagggcttacatctgtttctaatttacacagattattgacacatctggatgtttggccttaggaattgtaagt

SEQ ID NO: 6809788 - DNA, 71 bp, Homo sapiens
gcgccaaagttggaattttaatgtatgttccagagcgtacagaatagtagcttaaagtcaaactgatgcgc

SEQ ID NO: 6809789 - DNA, 77 bp, Homo sapiens
tgtccagctttgtagaaaattctcttggatagccctggcctaagtgatgtctaagataactttcagctagtaaaaca

SEQ ID NO: 6809790 - DNA, 57 bp, Homo sapiens
agtgctgtggtagctatctccaagtctaattggtaacatcgcttaaatcatagcact

SEQ ID NO: 6809791 - DNA, 76 bp, Homo sapiens
cttgatgatgcaggttgggcaagtgtggggtggctctgcctccttctagctctgtgacctttggcaaatcatcaag

SEQ ID NO: 6809792 - DNA, 73 bp, Homo sapiens
tgaagtagccatgttgttaaaagacaagagatgaaacatgccccttttgtggttgattacattgttcatttca

SEQ ID NO: 6809793 - DNA, 73 bp, Homo sapiens
agcttgctgctgtctcctttctggtcttggatgggagaatgagagagaaggaccagagaaaacacagcaggct

SEQ ID NO: 6809794 - DNA, 65 bp, Homo sapiens
gtgtttaaccaccattctattctgccttgagagagaatgagaatgcaataaatggtggtcagcat

SEQ ID NO: 6809795 - DNA, 108 bp, Homo sapiens
agattaagccttctggagacctgatgtgagctttttaactttagatgttttttatatgcctaaggcccgtgagtttcatatctcggtttccacaaagagcttggatct

SEQ ID NO: 6809796 - DNA, 98 bp, Homo sapiens
cattgaggtagggaaaagattgaaagagaatttgtcaccttattgcaaagatgggcaagctttgtttcactttatctttttccatttgaccttgaatg

SEQ ID NO: 6809797 - DNA, 81 bp, Homo sapiens
ataagttttctttctttacagtacttgcttttaatgtgtcttctgcttagagctggtatttctgaaggaaagaaagtttat

SEQ ID NO: 6809798 - DNA, 77 bp, Homo sapiens
ggcttatacaagctggaagtgcatttctcactcatgtcaacagctgagctggtgtgccagttccagtttgtgaagtt

SEQ ID NO: 6809799 - DNA, 127 bp, Homo sapiens
actgaaaggcgtccaaatacccttacagttagattgtcgagtcgtggcttaggtgcttgctaacagccaggaattggacaacacatctaaaaggtgcttagggatgaggatgggcctgactttcagt

SEQ ID NO: 6809800 - DNA, 71 bp, Homo sapiens
tcctattttgtatattattttccctggagttgtatttgaaagaatataaaatatggaaggtatataatgga

SEQ ID NO: 6809801 - DNA, 56 bp, Homo sapiens
cctgtgaatcttgatgttatttctggatcattgcagatgccacattgagttatggg

SEQ ID NO: 6809802 - DNA, 118 bp, Homo sapiens
gaatgaatatataacagactttgcagctaaccaggatatcttgaggtcggaggctgctgttgtttctccaggctccctcaggatgcactgttgccagtcagcgttactcattttattc

SEQ ID NO: 6809803 - DNA, 60 bp, Homo sapiens
aggaggtctcactatgttgccctggctggtcttgaactcctgagctcaagtgatcctcct

SEQ ID NO: 6809804 - DNA, 78 bp, Homo sapiens
gtcaaattaggcaactgtttggttgaagtatgaacaagttaaaaatcatgtaaagactataaagttgttctgatttac

SEQ ID NO: 6809805 - DNA, 55 bp, Homo sapiens
ctttactgccatgcatttataacacttgtgtgtctgtctgtgtatgtgcagaaag

SEQ ID NO: 6809806 - DNA, 62 bp, Homo sapiens
tacctttatgggttttctgaattccagctcctacttgggctcagttagcacctatgtgggta

SEQ ID NO: 6809807 - DNA, 57 bp, Homo sapiens
gctccctgttctcagccatgatgtctggatctccaattcactttgaaggatgggagc

SEQ ID NO: 6809808 - DNA, 66 bp, Homo sapiens
ggtctgagcctgcaataagcacagccctaaattacacttgaggctgcttaacgtccaggcccagcc

SEQ ID NO: 6809809 - DNA, 67 bp, Homo sapiens
gaccagttgcttggagtatgagcttcctggagggcacctccagagaggtttctccatgctgatgatc

SEQ ID NO: 6809810 - DNA, 86 bp, Homo sapiens
ctggctgaaaatacttttttaagacctagtaccagacttctttagagaagtaattactagtttttaggaaaagtgactttgaatag

SEQ ID NO: 6809811 - DNA, 119 bp, Homo sapiens
gcagagatgataggggagcagaaagccaggcaggacatttttcttcctacaatgcctttcatagcaggttgtttgacatgagaagtgtcatgtcagtcattgtgtttacccatctctgt

SEQ ID NO: 6809812 - DNA, 72 bp, Homo sapiens
gccgagttctccttggctaggcagcggctgtcctggctgacagggcagcgccctcgtcatgagctacttggt

SEQ ID NO: 6809813 - DNA, 58 bp, Homo sapiens
ttatgaggcttacaggcaggccaggggctccagaaccctgccttgccaagcctcctaa

SEQ ID NO: 6809814 - DNA, 80 bp, Homo sapiens
ggttttacattttgtgaaatccaatcactgacacccagctgaattcctgctcttggatttcataagttatgtttatagcc

SEQ ID NO: 6809815 - DNA, 59 bp, Homo sapiens
gggtggattggaagttggctgagtcttaatcaaactacagcccagctgggatcacactc

SEQ ID NO: 6809816 - DNA, 76 bp, Homo sapiens
ccctctctgcctgactcaaggtgagaggtcagggattcagagactcttgggtcaatcttgggtgtaggtcagaggg

SEQ ID NO: 6809817 - DNA, 58 bp, Homo sapiens
agaatcacagggagttcctgctttggattgggccatccaggaaagcctgtgtgagtct

SEQ ID NO: 6809818 - DNA, 69 bp, Homo sapiens
ttttcttagctcttctaatggtaaagaggcagaagcctttgagaaagaaatttgaatgagtgaggaaag

SEQ ID NO: 6809819 - DNA, 87 bp, Homo sapiens
gatctgaaagtcataggtccatattattatttttaaacaaatcatactgattcatgtaacagttataacaatgtggccatgagggtc

SEQ ID NO: 6809820 - DNA, 72 bp, Homo sapiens
agatctcaataggttctccacaggttctccataggttgtccatagaacctccacaggacctccataggatct

SEQ ID NO: 6809821 - DNA, 60 bp, Homo sapiens
attattctttaagttgtgaatctaagacagatgactattttagcatatttaaggaatgat

SEQ ID NO: 6809822 - DNA, 78 bp, Homo sapiens
gggagagattttgagaagcatctggtccacttctccaccttcagaggagtctgggttgatatttctcaattttcttct

SEQ ID NO: 6809823 - DNA, 129 bp, Homo sapiens
taaaaagagtgaagagttgagaggctccatttggtttcagtttgtaccattgtttgaagtactcagttggttgaatactccaaataatggttcaaattcaaaccaaatggagcctctccactcttttta

SEQ ID NO: 6809824 - DNA, 61 bp, Homo sapiens
tgtgaatggcagggtctgtcttcagctcaagtttgatagaggaatctctgccatagccaca

SEQ ID NO: 6809825 - DNA, 71 bp, Homo sapiens
actctgatgcctgggcaaggatgactggaagacttagactacctccccatgctgcttggcaccctcagagt

SEQ ID NO: 6809826 - DNA, 71 bp, Homo sapiens
gtggtattcttgtggaattttctcacttgtctgccctttcaagacagtgattagttactataaatcttcac

SEQ ID NO: 6809827 - DNA, 60 bp, Homo sapiens
gccctgtcccttggcttctaggctctcaacctgtttagaaggcaagcttggtacaggagt

SEQ ID NO: 6809828 - DNA, 75 bp, Homo sapiens
ccaaatgtcctttatagcctctgtggcttctttctcaagcccaggatccagtccagggctgtgtgttacatttgg

SEQ ID NO: 6809829 - DNA, 61 bp, Homo sapiens
ccttagttaactagaacttcgatttgcccattccccaagtgcatacactagttaattgagg

SEQ ID NO: 6809830 - DNA, 55 bp, Homo sapiens
cacagcctaaactcagaactccaagggcagttggaggtcaggggagaggctgatg

SEQ ID NO: 6809831 - DNA, 70 bp, Homo sapiens
gctccctttctcaaggtcattgaaaatatacagtagtttcagacatcacatgggtttgggcaaagggggc

SEQ ID NO: 6809832 - DNA, 66 bp, Homo sapiens
ccccagaatttttgacctgggaggaatctttgctgagatgtggatcctagggtagaaacaggtagg

SEQ ID NO: 6809833 - DNA, 58 bp, Homo sapiens
cttccttaagatttcccaagtcatctttgcaaggtggctgaggcttttcttaaagaag

SEQ ID NO: 6809834 - DNA, 73 bp, Homo sapiens
caacacaaaacctaaacagactgtccaataactcctgctacctggatccttggaggtgtttggctttttgttg

SEQ ID NO: 6809835 - DNA, 59 bp, Homo sapiens
gggaaacttctgctaaaaccagagctgaccggcccgaaggttttgatcagaggtatccc

SEQ ID NO: 6809836 - DNA, 68 bp, Homo sapiens
gggcaatgtggcaaaaccctgtctggacaaaaaatacaaaaattagccaggggtggtgacatgtgcct

SEQ ID NO: 6809837 - DNA, 100 bp, Homo sapiens
tttggggaggaaaaagagaaagggaaagaagtcagccacagtgggagaaggggctccttttcttcatttcttgtcttcccctttctctccccaccctaag

SEQ ID NO: 6809838 - DNA, 64 bp, Homo sapiens
ggcccaggcctctgagcagcactcatgggtcactttactcattgtggatcacagagcctgggct

SEQ ID NO: 6809839 - DNA, 82 bp, Homo sapiens
actggctccaggtaaagctgccctcattcccagtgcatcaactgactgacatctggggcttgggcagctgcattaagccagt

SEQ ID NO: 6809840 - DNA, 77 bp, Homo sapiens
gtttggggaatattgtggggtgatttgccacgggggttgtgcctctgtctgcctgtgtccccacctcttccccaaac

SEQ ID NO: 6809841 - DNA, 87 bp, Homo sapiens
ccttggggaggtggagaaagccctgggagattttctgggtttgtttgaggacctgaatccccagggccttccggttgcttcccaagg

SEQ ID NO: 6809842 - DNA, 61 bp, Homo sapiens
agcagcaaggaacagaatggacatgcctattaagcctgccttctctgctcttatgcatgct

SEQ ID NO: 6809843 - DNA, 61 bp, Homo sapiens
agttgaccctgagttctggcagccagggtctgtgaacttggctcttggaaggggctcagct

SEQ ID NO: 6809844 - DNA, 85 bp, Homo sapiens
gcctaagctttgttaagattcagccaaattgttcatccattgcaggtgagagagtaaattggttcagttaccttagaactctggc

SEQ ID NO: 6809845 - DNA, 67 bp, Homo sapiens
aaagactgacagggggcagaggtggctgaacctttcggactacccactgcatgcttcctttgttttt

SEQ ID NO: 6809846 - DNA, 123 bp, Homo sapiens
tttatgaggggattttgtttctgcattgacctcttgtggtgctcctttcagagtatgaaaaatggcatcatctgattccagaaggggcatacaggacagtgttctcatcaaaaccattatagg

SEQ ID NO: 6809847 - DNA, 73 bp, Homo sapiens
gcctgcctgtgctagtgcagggaaatctttggaactctttcaaatgttccctgtactggccggacaaccaggc

SEQ ID NO: 6809848 - DNA, 60 bp, Homo sapiens
ctattctgtcagcatcatggttgtctttatacaggctaacaataggttttggcagaatag

SEQ ID NO: 6809849 - DNA, 87 bp, Homo sapiens
ggtggacctgacatgggccttgctgcactttggatttagacaaaccaaatccacagtgcagcaagggcccatgtcagctttgaaacc

SEQ ID NO: 6809850 - DNA, 70 bp, Homo sapiens
gaagcctgttcagatggcacattcagttgttcactacaccctactgaatcttcctctgaaattacgtttc

SEQ ID NO: 6809851 - DNA, 65 bp, Homo sapiens
gctctgggaaggatcgtagtgagatgcaggaattcacccacaaccactaccaaccttccaggggc

SEQ ID NO: 6809852 - DNA, 87 bp, Homo sapiens
cacccaggttgtggtactgcattacagcctccttaggaaacttacacacatcttcctgggctcctgtttatgctaccacagaaggtg

SEQ ID NO: 6809853 - DNA, 130 bp, Homo sapiens
tgggaatctggggtatataaattgttctcaagagggacttctattagagtgaggaatgtggagttaagtcctggctcttcagaggttcctatggtcttgagcaagttgtctaattcagtgttaattctta

SEQ ID NO: 6809854 - DNA, 63 bp, Homo sapiens
aggcataaccttttatctggatctcccactcttcctagccgattcagattaaatgttctgtct

SEQ ID NO: 6809855 - DNA, 56 bp, Homo sapiens
gggcctctgcctgaaagaacagatttaccgaatgtctggtctggccaataaggtcc

SEQ ID NO: 6809856 - DNA, 87 bp, Homo sapiens
tctcactgttctctctgctcacgccaccgttcatcagactctagtccatggtcagaactcagcgtgcttgtagatgagataatggga

SEQ ID NO: 6809857 - DNA, 71 bp, Homo sapiens
gaagggaaggaagtcattagtgcagactgagctgtggagttgggttcttgcaggatttccttccagccttt

SEQ ID NO: 6809858 - DNA, 74 bp, Homo sapiens
ggcttatttaattttcacagtgctgtgagataataatagctatcgtcagtcctgtgagatattattattaatcc

SEQ ID NO: 6809859 - DNA, 67 bp, Homo sapiens
gtcagcttttctccttagtgtccctgtatcccgtctggagcccagaggcaaggatgaagatgccaac

SEQ ID NO: 6809860 - DNA, 62 bp, Homo sapiens
tgaacctgggatttgggggctcttccggattacatccactcagcctgaatcccaccagttca

SEQ ID NO: 6809861 - DNA, 66 bp, Homo sapiens
tcagaagttagacttcaactaattcagcaaggccccatcatgtattagaaaaagtctgagttctga

SEQ ID NO: 6809862 - DNA, 55 bp, Homo sapiens
gagcgctgggctgagaagttaagcaaatgttgttttgtgctgccagctgggcttc

SEQ ID NO: 6809863 - DNA, 60 bp, Homo sapiens
actcagctggctgcatgatgccaaaatgactccttgctttggctaattcagtcagctggt

SEQ ID NO: 6809864 - DNA, 74 bp, Homo sapiens
cagttgtctgataaatgccatctttttgaatgctttccttgaaattcaagaaaggagtctatgtatcacagctg

SEQ ID NO: 6809865 - DNA, 61 bp, Homo sapiens
cagtatcattcttaggagaggcatctcaatgtttctgagccgctttctatgagatggactg

SEQ ID NO: 6809866 - DNA, 56 bp, Homo sapiens
gccttgcagagcataggagcccttggaacttgagagggatagaaatgctccagggt

SEQ ID NO: 6809867 - DNA, 72 bp, Homo sapiens
gagaaagggtaaagagaggaggaaagttaaagtgttcacatccgctagcctccattttattactaaagtctc

SEQ ID NO: 6809868 - DNA, 55 bp, Homo sapiens
ggtggctcacacctgttatcctaacactttgggaggccgaggcaggtggatcact

SEQ ID NO: 6809869 - DNA, 70 bp, Homo sapiens
tgaagattagatacctttgtgttgtagaatgttttaagcaatctgaactatagaaaagtattttccttca

SEQ ID NO: 6809870 - DNA, 72 bp, Homo sapiens
gcactaaacttttatgaagacaggcagtatattatcactgttgtatgctaaggccttaactcatggaggagc

SEQ ID NO: 6809871 - DNA, 75 bp, Homo sapiens
ccttgagtggttggatccatgtggattgatactttcagttgcgtagttagttcatagaatgtaacaggatcaggg

SEQ ID NO: 6809872 - DNA, 62 bp, Homo sapiens
ttgcagaatatattactgagcctcctgaagaataggaagttatcaaagatgtattctctcaa

SEQ ID NO: 6809873 - DNA, 58 bp, Homo sapiens
gggctggcgggaaaggcaattccagggccacttccccttttcctgcgccggccagccc

SEQ ID NO: 6809874 - DNA, 126 bp, Homo sapiens
ctgtgaagcaatctctcagtacttaaagtgggcttcattcttaagatgcctaaatgtaatattgggtcaaaacactggggaatgttggttaatatttattgagtgctcagaatgaatgtgttgtag

SEQ ID NO: 6809875 - DNA, 60 bp, Homo sapiens
gtgtgtgtgtgtgtgtgcatgtgtgtgagcgagagcaggcttgcacatgcacgcacgtgc

SEQ ID NO: 6809876 - DNA, 68 bp, Homo sapiens
tccagcagagggtcttggccatttacagctgaaggaatgtgctagtggcaatgctgccctcttttgga

SEQ ID NO: 6809877 - DNA, 73 bp, Homo sapiens
caactctctatagaaagcttgaagtgttgcgccacaaatatttccaggctgttttgtgaatgttcgagtgttg

SEQ ID NO: 6809878 - DNA, 81 bp, Homo sapiens
gttttaaaatgatgagccagcatatatatagttgaatacatgtaaaaatgagagttcagcataggctgctcttcaatgaac

SEQ ID NO: 6809879 - DNA, 56 bp, Homo sapiens
agttattcttagcctcggtatttctatcttatggcatcgcaggtctaagattagct

SEQ ID NO: 6809880 - DNA, 57 bp, Homo sapiens
ttctcagggtcttgtgcaaggggataccaaagtgccctcttgtgtagaacctgagaa

SEQ ID NO: 6809881 - DNA, 58 bp, Homo sapiens
agctgcccagtctcctcactctggaaagttactgatgaatgagaggcttaaggcagct

SEQ ID NO: 6809882 - DNA, 129 bp, Homo sapiens
gatgagacagtggcgtagcatgtttgtgttgtggcacagtgtaatgccatggcatagcatggtcgtggtggtgtggcatggcgtggcatcgtgtggcatagcatggttgtgttgtggcatagtgaggtc

SEQ ID NO: 6809883 - DNA, 71 bp, Homo sapiens
cttaaggcttcagcacaggtatatgtggggcttttggttattcagttacctgatttggagtttgccttaag

SEQ ID NO: 6809884 - DNA, 69 bp, Homo sapiens
tgtaagtggcaaagcaagattcagatgtaggttgatcccattctaaaacctttgctttttctacttgca

SEQ ID NO: 6809885 - DNA, 122 bp, Homo sapiens
gaactcctaacccacaagctctctcccctctaccttccctttcctgagccacggcccagtcagttaatctgggctctgaagggtgacaggtttggggataaaagacaaaaacccatggagtc

SEQ ID NO: 6809886 - DNA, 79 bp, Homo sapiens
acaatcggcagatattctagaacctagtagaatctcaggcctgataggatctgtcctggttctggaatgtttaagttgt

SEQ ID NO: 6809887 - DNA, 77 bp, Homo sapiens
gctccagggccctctctccaattttcacctcattctgggcctgagactgagatgagactggggagaggtctggtagc

SEQ ID NO: 6809888 - DNA, 56 bp, Homo sapiens
ctgtggagcagggcagggtcaccggccagactgagctgtcctcccctgctctacag

SEQ ID NO: 6809889 - DNA, 105 bp, Homo sapiens
atggttcttgggtgttgacactggatgcagaagcagaacttacacagtctgaacaaacgggtggttagaaaagattgtttcaagcctctgtgttcctaagatcat

SEQ ID NO: 6809890 - DNA, 58 bp, Homo sapiens
cttgtgttcttttcactggctgttcccaaactgtgggacagttttaaggagcacatgg

SEQ ID NO: 6809891 - DNA, 78 bp, Homo sapiens
gggaggaggggctgtatgatgggagctggaagtacagaagagacgcagccactgctagagatgcatccccttcctccc

SEQ ID NO: 6809892 - DNA, 56 bp, Homo sapiens
agtttatgtctttacttcagctaatgcagtatgtagaaaaaagtgaagacaagact

SEQ ID NO: 6809893 - DNA, 56 bp, Homo sapiens
aggcaaatctgagacatttaaacatatttcttaatttgaattacttaggtttgctt

SEQ ID NO: 6809894 - DNA, 64 bp, Homo sapiens
ggggctttggcaggtcctgcttatgataaaatgcaaaggctcttaaccctctgccacaagcctc

SEQ ID NO: 6809895 - DNA, 66 bp, Homo sapiens
gtaatcaggtacagggatgctgagtgatggggaatcaaaggcctctgtcctagtgcctaagtttac

SEQ ID NO: 6809896 - DNA, 63 bp, Homo sapiens
tgtgctctgaaagcccccagtagatacctgttctcccaggactggggactcattcagagcata

SEQ ID NO: 6809897 - DNA, 59 bp, Homo sapiens
gaagctaaagccctgtccttccgtgtccctgaatactggagaagcaggtgctttgggtc

SEQ ID NO: 6809898 - DNA, 63 bp, Homo sapiens
cgctcagcctctcatgttctcccccagctaaagtaagcagctggcccaggtgagaggttggtg

SEQ ID NO: 6809899 - DNA, 101 bp, Homo sapiens
gggcctgcgggagcctgctggtccccatgggcctggcaagcatctgccctggtagactgaagtgcccccaggccctgtggttagtggaagcctgctggccc

SEQ ID NO: 6809900 - DNA, 104 bp, Homo sapiens
gcctcagctcatgcccaaacccattctcctaggatcaggggtcctcttttagctccagagagcctctgtcatggagagaagcttgtttgttcactgtcttaggc

SEQ ID NO: 6809901 - DNA, 80 bp, Homo sapiens
ggatgtgacacattaaaacgtctacaatgttatcactacatcttgccaaatatactgagtgtgttaatgatgatacatcc

SEQ ID NO: 6809902 - DNA, 62 bp, Homo sapiens
tacagccatcatgtatgtatattttcctctaacctttttgcatgtatatttatatggctgta

SEQ ID NO: 6809903 - DNA, 70 bp, Homo sapiens
gctcccatggctggcaggcacagtatgcaagggaaacctttgttgctgctccaaccagtgttcattcagc

SEQ ID NO: 6809904 - DNA, 67 bp, Homo sapiens
ttttagtggtactcagggagggaacagcactaaatatacttgttcaatctgccatgtataactagaa

SEQ ID NO: 6809905 - DNA, 75 bp, Homo sapiens
gtagtaattagcacttgggagtatttatttatttattaaatatttattgattaaatactgcaggctaagcactat

SEQ ID NO: 6809906 - DNA, 67 bp, Homo sapiens
aggccgaggagcttttccaaggtgtgaggagattggtctcaaactttgtttgaaggctgttctgttt

SEQ ID NO: 6809907 - DNA, 82 bp, Homo sapiens
tagcttggttgcttaataaagttagatactgagaattgatgaaattttaaatccagcttctaatttagagttcccagagtta

SEQ ID NO: 6809908 - DNA, 63 bp, Homo sapiens
ctccccattcctctcggtggtggtgggggagccttttcaaccaagactgttaggagtggggag

SEQ ID NO: 6809909 - DNA, 73 bp, Homo sapiens
tgggcctgctggaaggaggcctggcagatgaagatgggcttcccatgttgcacggccttcacagagcgcaccg

SEQ ID NO: 6809910 - DNA, 56 bp, Homo sapiens
atagcaaccacctatgtgcacttaagtctgtaagttgctgacatcaggtctgctat

SEQ ID NO: 6809911 - DNA, 64 bp, Homo sapiens
gagcacttcagaattgggcaatttaaaacgatacatgggttttgcccatttcttaatgatgctt

SEQ ID NO: 6809912 - DNA, 69 bp, Homo sapiens
cccttgccgattgccacctctttaaacgctgttccttcacttagcaggtgggatcaagctggcaagagg

SEQ ID NO: 6809913 - DNA, 66 bp, Homo sapiens
cttacatgttgctaaatccaatggtcagttattaattcccatcttgacctatcagcagcatttgag

SEQ ID NO: 6809914 - DNA, 130 bp, Homo sapiens
agaggtggaggggtggagagagggggcttttgaacatcagccatttgaccttgggggccagagttcaaatcccccagaggtctgaaaaggttgaaaagatatcattatcccttctccctcccccgcgtct

SEQ ID NO: 6809915 - DNA, 55 bp, Homo sapiens
tcctcaagcattatatgtggagaaaaatgagatctactatgtagtgattgcagga

SEQ ID NO: 6809916 - DNA, 59 bp, Homo sapiens
gatgcaaactgtgacatagagttcaaggaaacttattgagatctatgcaggtttgcatt

SEQ ID NO: 6809917 - DNA, 67 bp, Homo sapiens
accttcctctaagacatttagctcagaataaagcacacattcatcttagctgtagtagagagagggt

SEQ ID NO: 6809918 - DNA, 62 bp, Homo sapiens
agccaagagttctttagcggtggaagaagatggggtcttacacgaatggaagggtcttggct

SEQ ID NO: 6809919 - DNA, 81 bp, Homo sapiens
gtatctcaccctgcatttgccgcccactttgttcccacgggaaacaggaaggtgagggtgccagtgcatgggtgtagatgc

SEQ ID NO: 6809920 - DNA, 63 bp, Homo sapiens
tacaggcctcaaatagggtgcctcctcccccaaatagggagacatctgaatttgaagccagta

SEQ ID NO: 6809921 - DNA, 56 bp, Homo sapiens
tgctggccatagaagccaaagagggatgcatctgtcatttctcttctgggttagca

SEQ ID NO: 6809922 - DNA, 73 bp, Homo sapiens
agaggtggctccaggagcaatgctctgaggttccatggaaggtgtgatcttgctgtgctcccagcccacctct

SEQ ID NO: 6809923 - DNA, 86 bp, Homo sapiens
ctgcttagtgccctaccataaatgcctcattttctctcactgaaatcccgatgtcagtgtttgagtttgcggcattgggcgggcag

SEQ ID NO: 6809924 - DNA, 121 bp, Homo sapiens
tctccctcatctgtgctgtctctgcttctccatcacaaccagtgcttcctgctggagctggatccctcagctccccagggaagggactggagtgaatcaggtgcacaggtcatgagggaga

SEQ ID NO: 6809925 - DNA, 107 bp, Homo sapiens
tggaattgctgagtcatgtggtaattgtgtgtgtaactttatgagaaattgtcaaactgtttttcacaggagttgtaccattttactttcctaccagcaatgttcca

SEQ ID NO: 6809926 - DNA, 66 bp, Homo sapiens
gctcacagttctatttttcatgccccatcacacttcgctacacggcaatgggaaaggaaatgtagc

SEQ ID NO: 6809927 - DNA, 70 bp, Homo sapiens
gtgggaggtacggctccttgagggctgcctgtgtaacagtccagccacaaaggcttgcctcggatgccac

SEQ ID NO: 6809928 - DNA, 77 bp, Homo sapiens
aaaggaaggagacagggttgaaccacgcactccagcctggttgcacagtgagaccctgtctctaaaaaaattctttt

SEQ ID NO: 6809929 - DNA, 72 bp, Homo sapiens
gtaatatggcagaaaagattctggatttagaatcagaacacttaaatctacatttcagttttgcccctttgc

SEQ ID NO: 6809930 - DNA, 60 bp, Homo sapiens
tttctcacattcagaacttttatagattttcttcagtatgaaatttctgatgtagagaga

SEQ ID NO: 6809931 - DNA, 77 bp, Homo sapiens
atgagctagtttgtcctaggttcagaatagagctatactgatttatggctctggattaatctaggaacattagccat

SEQ ID NO: 6809932 - DNA, 81 bp, Homo sapiens
catagccacagaaaataaagcacgattcatattcactaaccacttttgaaattgtgaattcattttctggcaagagctgtg

SEQ ID NO: 6809933 - DNA, 68 bp, Homo sapiens
gctgacatacctagtcacggggtggctgttgcgagagtaaatcacagtacatgattatgtaggtgagc

SEQ ID NO: 6809934 - DNA, 86 bp, Homo sapiens
atctgagctccatgttctattcattgctccacgaggtaacacatgattttctactgtactgggcactgaaaagaaggctgccaggt

SEQ ID NO: 6809935 - DNA, 71 bp, Homo sapiens
gagccggcggcagacggggattggcaggcgcccgagcccagggcccgggccatggctgccccacaggcctc

SEQ ID NO: 6809936 - DNA, 89 bp, Homo sapiens
agacattcctctgctttacagtcaccaaactttgctgcaagaaatgtatcagatttgtcaagtgacttcctgaagcaataggaaagtct

SEQ ID NO: 6809937 - DNA, 71 bp, Homo sapiens
ccgggtacctcagttggaaatgcagaaatcacccatcttctgcgttgctcacgctgggagctgtagactgg

SEQ ID NO: 6809938 - DNA, 63 bp, Homo sapiens
gtctttctatgcatagagcagagcttaccacgaaaggaattcatcctctatgctagcagagac

SEQ ID NO: 6809939 - DNA, 75 bp, Homo sapiens
gaggcattagcggcattctgcataggctatatttgttcagccacattgaataacttactctatgcttagtacctc

SEQ ID NO: 6809940 - DNA, 84 bp, Homo sapiens
atccttattctttttcaaggaaatgacatgctgccctcatttctaaatctagatgtcatctttttaaagaagagaccctgggat

SEQ ID NO: 6809941 - DNA, 77 bp, Homo sapiens
agtttaacgcattgatgagtacctaagttttacaattctagggaatgttacctgaggtgtgctttcaatgggtgatt

SEQ ID NO: 6809942 - DNA, 111 bp, Homo sapiens
gcaaatgttcagtgtaatggtttgaaacccagccgtgtagctgccgccgcccacacacagagctgccgtggcactgagcttcagcaggcaaaccatatcaccagcgtcggc

SEQ ID NO: 6809943 - DNA, 70 bp, Homo sapiens
atttattcatttaactacaagtgtcaaaccaatgaacaatggatagaaactttctgttagatgaatggat

SEQ ID NO: 6809944 - DNA, 58 bp, Homo sapiens
gggatcaagctgaacactgtcttcaaggatgaaatcatatccttgttgagctcgttcc

SEQ ID NO: 6809945 - DNA, 75 bp, Homo sapiens
ggacaagatgatacagcctagtttgagtcccatctgagacacggtagtgggattcaccatgggcttcagaagtcc

SEQ ID NO: 6809946 - DNA, 77 bp, Homo sapiens
aaagtgggttcatacttaacggtattgtcacatgtcacacacacacagatctatattttagagtggggttccacttt

SEQ ID NO: 6809947 - DNA, 89 bp, Homo sapiens
gaagatgagacctgaaagatgcatgctgaagctggctcagactgtctcaaaagagctaattgtgtgcacctcttctcaactccatcttc

SEQ ID NO: 6809948 - DNA, 80 bp, Homo sapiens
tctgtggccctaatgtgttggacagcttctactgtgaccttcctcagcttctcagactagcctgtaccgacacctacaga

SEQ ID NO: 6809949 - DNA, 63 bp, Homo sapiens
ggcatccttgacaatgagcctggtaggtctccaaccctacagagggtaattgatcaaggaccc

SEQ ID NO: 6809950 - DNA, 70 bp, Homo sapiens
ggctacaaatataaaacacagatactctctaaaggctcacaagggattgtgtgtgtgtgtgtgtttgtcc

SEQ ID NO: 6809951 - DNA, 65 bp, Homo sapiens
tgaagctggctgaagttcagctagacttagcagaagggggattggctgaggtccaggtagtttca

SEQ ID NO: 6809952 - DNA, 55 bp, Homo sapiens
gggaaacagattatgaacaaatacccaggaagggaaggacgtggtctgatttcct

SEQ ID NO: 6809953 - DNA, 70 bp, Homo sapiens
cttagtgccaaatattgctggtgtattatcattattggcttacaccattttctgcagtgtttcacttaag

SEQ ID NO: 6809954 - DNA, 65 bp, Homo sapiens
taaattcacccacgtcttagtctgtttgggctgctacaacagaataccacagactgggtaattta

SEQ ID NO: 6809955 - DNA, 101 bp, Homo sapiens
taggctgggtcagggtcccccaggagctggcatgtggagagctgacacttaaccagttctcactctttgtgcaggctcttggcaatgccccacccaccctg

SEQ ID NO: 6809956 - DNA, 77 bp, Homo sapiens
ttacatttttaatttcacagctcagtgaggtgggcaaaagcagtattaccaacctcatttaacagattaaaaagtga

SEQ ID NO: 6809957 - DNA, 72 bp, Homo sapiens
agcttgagtcctctttggagaagcacgtattattaataacaatggcttgtgtttgttcagggttttagagct

SEQ ID NO: 6809958 - DNA, 87 bp, Homo sapiens
tgaccaggagcctgactgtggtctgttctccaggtgggtctgatcattctacttgatcatagccacagttattctcatctgatgtca

SEQ ID NO: 6809959 - DNA, 55 bp, Homo sapiens
gctggatgaggctcatgcaccctgcgactgatgcacctggctgagtctcatttgc

SEQ ID NO: 6809960 - DNA, 67 bp, Homo sapiens
tgaaagccagggaaaggggaatccagtttaattcatatgcagaggattccctgaaattgtgctttca

SEQ ID NO: 6809961 - DNA, 62 bp, Homo sapiens
atttattccttttgtgttagctgctttgaacatgattagggaagtttgtgggaggaatatat

SEQ ID NO: 6809962 - DNA, 70 bp, Homo sapiens
gtggaccctgaagcaacagggagctggggcacttatacaccaactccatcagctgttggttgagggctgc

SEQ ID NO: 6809963 - DNA, 117 bp, Homo sapiens
gccgcggcccccagcttttacctctacgcgcgggccgggccgctgggcgctgccatcccaaaggctccggagcctgagcggcccagggccagggttgcgaagcggcggagtcgcggt

SEQ ID NO: 6809964 - DNA, 56 bp, Homo sapiens
ttgtgttctgcacacggtcctcaaacaccgtggtgaaggaactttgtagaatacaa

SEQ ID NO: 6809965 - DNA, 87 bp, Homo sapiens
tgcagctgtttggtgagatgcagaaccctcaggagcgcccaggcttgggcagcatcccctgcattctgttttcccaccaggctgaca

SEQ ID NO: 6809966 - DNA, 85 bp, Homo sapiens
gtaaaataagtttagtgtttattgaggatttactattactattgcatagtagaatagatggatactattgtaaactatgtattac

SEQ ID NO: 6809967 - DNA, 108 bp, Homo sapiens
tgtcttagttgccctttataatggaattgatttttttaactcacaggatcagatttctgtacatgagttctgtgtcctttaaaaaagacactttggggatgctgagca

SEQ ID NO: 6809968 - DNA, 59 bp, Homo sapiens
gtttaccagtgagtagatggaaattaaataattagcttgaagtcactccactggtaagc

SEQ ID NO: 6809969 - DNA, 72 bp, Homo sapiens
tgttttgcactaggctcattaagtccccagggctctagtccatatggcgatgaatgagtttcaggtaaaata

SEQ ID NO: 6809970 - DNA, 65 bp, Homo sapiens
gggatgccagaggttactttgccttggaactcttccacgccaaaatttgtagcttcttcagcccc

SEQ ID NO: 6809971 - DNA, 64 bp, Homo sapiens
cagttgtggccataggaggtcagatgagctgtagctcaggctggtggtcagatggctatgattg

SEQ ID NO: 6809972 - DNA, 61 bp, Homo sapiens
tcatctgtatctagacctaatgtggattatgagattaacagctttgggtctgatatcatga

SEQ ID NO: 6809973 - DNA, 100 bp, Homo sapiens
ataaattaggcttgttctaaatgtttgcctaattcttttagaatattagaatttaacttattagctgtatgttgggtaagcattgcaagagttaacttgt

SEQ ID NO: 6809974 - DNA, 76 bp, Homo sapiens
tgctgtcgttcatggattcagtctcaccctgggcatagcttgggacagggacatgaggccatagtgattgagagca

SEQ ID NO: 6809975 - DNA, 130 bp, Homo sapiens
gctcctcttccattggagacacccagggatgtttgacagcctttctgctgttgcttagcaacccctgctgcattgattatgcatgctaagaaatagcagctattgtcctttttccttctctagaaggagc

SEQ ID NO: 6809976 - DNA, 104 bp, Homo sapiens
tgtttacttcatactaaaacatttgctcttttctaaaacttttttagtataccattggctaccaggctatacaagtgtagaatagagaaaaggatgaaagaaca

SEQ ID NO: 6809977 - DNA, 78 bp, Homo sapiens
ctttggtaggggaggtcttttgattggctgagtggagtcatgacatttggccagatggaaatgatgttctcaccatag

SEQ ID NO: 6809978 - DNA, 67 bp, Homo sapiens
gggtgggatgggaggaaggaggcccttgaagacattttgcaagactaaaccttcccctcagctatcc

SEQ ID NO: 6809979 - DNA, 69 bp, Homo sapiens
gaaaagatccagctattggcaagaagtggtgtttggtgagggcatcatagaatcaaaggctggtatttc

SEQ ID NO: 6809980 - DNA, 76 bp, Homo sapiens
gcagtcagagggaacaggagttaaccatgggaagttgggatgctaacagccccaggctctccaccctctgtgctgc

SEQ ID NO: 6809981 - DNA, 112 bp, Homo sapiens
aagtacaaattgttttagacacggcaatttttgtacttatagtacttataatggcctaaaatacacattttagtgtatatgtgctgagaaacgtgtttttaaatgttgactt

SEQ ID NO: 6809982 - DNA, 77 bp, Homo sapiens
tctttccaaacctcaaataattaatttatacacatctcagaagaaggtgatgattatctgttttataggtgggaaga

SEQ ID NO: 6809983 - DNA, 83 bp, Homo sapiens
agcacttacagtgtgttggaggagactgtcattaaaccagtcattttgtaaacagtctttctacattctgtgcagtaagtgtt

SEQ ID NO: 6809984 - DNA, 75 bp, Homo sapiens
ccagataactttccatttccaaccaagcctattcttggtcatcttgagttagaagtgctttgggatggagtctgg

SEQ ID NO: 6809985 - DNA, 96 bp, Homo sapiens
gagggagtcttgctctgttgcccaggctggagtgcagtggcgcgatctcggctcactacaacctccgccttccaggttcaagcagttctctgcctc

SEQ ID NO: 6809986 - DNA, 56 bp, Homo sapiens
gggtaaggtcagccagaagttcctattgtttatgcttactgaggcctgccttgcct

SEQ ID NO: 6809987 - DNA, 63 bp, Homo sapiens
ttagtcctctgttatgtgctagtatgcctgttagggtacttgactgcaaacagcagagactga

SEQ ID NO: 6809988 - DNA, 86 bp, Homo sapiens
ttttgttttcatcttattctgttttcttattttgttttgttgtttgatcaagacagaagctaggctagacaagtgagtgaacaaga

SEQ ID NO: 6809989 - DNA, 69 bp, Homo sapiens
gggcaggagaggaggctacttcttaccctgggctactgaggaggcaagtaggaagtcttcctccctccc

SEQ ID NO: 6809990 - DNA, 98 bp, Homo sapiens
ggatttattaaagggtttgagaaaatatttaataggctaagatgttaccctgacaagcagagattaaatgtttttaatattgatcttttataaagtcc

SEQ ID NO: 6809991 - DNA, 59 bp, Homo sapiens
gactttataaatgagaggcggactgcatatcattccttttctgcttatattatgaagtc

SEQ ID NO: 6809992 - DNA, 78 bp, Homo sapiens
ttcctgaggcttccatttatactggtacatttgctaatcaattccagctagtagccaattaagtggcaagcctgggaa

SEQ ID NO: 6809993 - DNA, 84 bp, Homo sapiens
gattttatgttttaagtactgaattttgagcaaatgagagactgactgagaattcttggtggttagaatatctatatcaaaatc

SEQ ID NO: 6809994 - DNA, 83 bp, Homo sapiens
cttggtttcaacttgcagaaataactcatattgcaataagtttattgtaatctagtagttttctaagggtagaagaaactcgg

SEQ ID NO: 6809995 - DNA, 55 bp, Homo sapiens
ctgtgttttggggaagatggcaagataatgtctggcttccacacaagaagcacag

SEQ ID NO: 6809996 - DNA, 129 bp, Homo sapiens
ctaaaattctttattccatattatgtgtctgagggctgaaacataatccttctggaggcaaaattcaggacttgttatttttacgctgctaggtatttttaaacatataaaatggaaaggaatatttag

SEQ ID NO: 6809997 - DNA, 75 bp, Homo sapiens
tcattctctctcgggccttggagtcctccactggatgtcgaattcagccagcagcccaaggatgagagcaagtga

SEQ ID NO: 6809998 - DNA, 55 bp, Homo sapiens
tgcagaggtgctcagtggcagaaatgaaatcattccagggctcattccctctgca

SEQ ID NO: 6809999 - DNA, 66 bp, Homo sapiens
aaaagctaactgtgaaatctctggattttgttttagaaggaaatcacttttttcatagttgctttt

SEQ ID NO: 6810000 - DNA, 79 bp, Homo sapiens
tgcttgtgtgggatgcttaggatcttgcccttatggtataggcacaagaagggcaggctccaagcatcctatgaaccca

SEQ ID NO: 6810001 - DNA, 70 bp, Homo sapiens
ggccttggaaggacgggctgtatctggtatcagagtcaccaggatagatgatccccatccactccaggcc

SEQ ID NO: 6810002 - DNA, 88 bp, Homo sapiens
ggagaattgcttgaacctgggaggcaaaggttgcagtgagccgagatcatgccactgcactccagcccgggtgacacagtgagactcc

SEQ ID NO: 6810003 - DNA, 72 bp, Homo sapiens
tttgctgtgggtcctcctgtgtgcccggccctgtcctaagtgctgggaagatatgagtgaccaacagacaaa

SEQ ID NO: 6810004 - DNA, 56 bp, Homo sapiens
gagagagagagagagagaataaagtgtgatacacaggaatctgtttctcctttctt

SEQ ID NO: 6810005 - DNA, 76 bp, Homo sapiens
ttgcttgggcccaggagctggagggtgcagtgagatgtgatcacatcactgcactccagcctgggcaaccgagcaa

SEQ ID NO: 6810006 - DNA, 60 bp, Homo sapiens
atgaccagacaagggaggtggcctgtggaactgcatagacaaagctcattctttggtcat

SEQ ID NO: 6810007 - DNA, 114 bp, Homo sapiens
gctggagagaagtaggagaggttcagctccagctctatctcatttccccacgtctgagaggctggaagagaaaggagtggatcttgagttggcaactcccatttctccatcagc

SEQ ID NO: 6810008 - DNA, 62 bp, Homo sapiens
gtgctgtgagtaatgacctgtcttgctctgatccaatgagtagtacagtttactttcagcgc

SEQ ID NO: 6810009 - DNA, 67 bp, Homo sapiens
gtggctctgaggcatcatggagaacagttgaaaatcacattgtcagctcgaaatgcatcaaagctat

SEQ ID NO: 6810010 - DNA, 65 bp, Homo sapiens
caggctctaactctcgccttggacttcaattgttggaaaaaaggcaatgagggagatagagtgtg

SEQ ID NO: 6810011 - DNA, 82 bp, Homo sapiens
ttattaataatgctgatgttggcctctgggctttggcaaacacttttggtcaaagcatgaatcgactcggcaaccataatga

SEQ ID NO: 6810012 - DNA, 57 bp, Homo sapiens
gttttctgcctgaaggtgaccagtgatcttcagagacatttatctttggcaggaaac

SEQ ID NO: 6810013 - DNA, 57 bp, Homo sapiens
agggagcagcaggttctaggggaaccaaagggttcagagaagcaacctcctcttcct

SEQ ID NO: 6810014 - DNA, 97 bp, Homo sapiens
gtgtggccccccaggcagatgtgtgcagacagatattacttagctaccactctgctattagtgtacatctcacacgcatgcctgttctggctctcac

SEQ ID NO: 6810015 - DNA, 130 bp, Homo sapiens
ccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgg

SEQ ID NO: 6810016 - DNA, 58 bp, Homo sapiens
cttgcacagactcaccttaatttgacattgtcatattgattgtgagtctgtggccaag

SEQ ID NO: 6810017 - DNA, 123 bp, Homo sapiens
tgtgtgagactggatctgcatggatcctgggtggcagatgtttgcaccagctaccaggggtgggaggtgcagtgtgtaatccaggaactttataaaagggggatatccagtgatcctcatgta

SEQ ID NO: 6810018 - DNA, 64 bp, Homo sapiens
ctgtggatgtgttttagatgtcattttatacttaacggtgattgacaattcattatatctacag

SEQ ID NO: 6810019 - DNA, 94 bp, Homo sapiens
aatatgtgtgactaagggtgaaggtaaaggaaggaggcttttaaaattaattagatatgcctctgctttatttattgactttttcacatgtatt

SEQ ID NO: 6810020 - DNA, 110 bp, Homo sapiens
tgggtcatgtaattgtagcgaggtgacagagttttagatctcataagcaagtcatttaaattgtgtgagcctcagattcttcatctctaaaacagagaaaataataccta

SEQ ID NO: 6810021 - DNA, 90 bp, Homo sapiens
agtcagagttaacatgtggttctctagtagcagtttctttctaataaactttacttgaaagaacatgtgtgatagattttgctcatgatt

SEQ ID NO: 6810022 - DNA, 60 bp, Homo sapiens
gacattcctgaagaaggtatgttgcccagcatcgatgggaatagaagaatttaggaagtc

SEQ ID NO: 6810023 - DNA, 82 bp, Homo sapiens
gggtctaagtttatggatgagttcctgaggagtggagatctgcttccccactctgtcacctactcactgtatccaaggacct

SEQ ID NO: 6810024 - DNA, 58 bp, Homo sapiens
tagggggctttgctgcttgacacaggcgctccctaccatggcacccagagtccccctg

SEQ ID NO: 6810025 - DNA, 73 bp, Homo sapiens
gcagctgagtctgaggttctttgcagaattaaattcttgatttaaagattcaaaagccaagactttgagttgc

SEQ ID NO: 6810026 - DNA, 105 bp, Homo sapiens
agagaggtgctttcttcttctctcaccctgggtgagaggcaaacaggtgcttgcttgttctcttacccagggtctagaggaagcaatttatttatttatctgttt

SEQ ID NO: 6810027 - DNA, 81 bp, Homo sapiens
tgctgtttagagcaggcttgcagagaaggggctgagacttactagccccacctcccttcaggcctgcagaaatgaacagta

SEQ ID NO: 6810028 - DNA, 69 bp, Homo sapiens
gcacctgctatgtgctttgcactgtgctatgttgttacatgttatgtgcaagatacataagacatggtc

SEQ ID NO: 6810029 - DNA, 130 bp, Homo sapiens
gagggtaagagaaggcagataggtataggaagacaagaagagaaaggtactattccctccatccctgacataggggaaataatggggcatggagttaatctgtttcttctgcctgatgcaactttccctt

SEQ ID NO: 6810030 - DNA, 69 bp, Homo sapiens
ttctaaatgccatgggaattcagaggcgtggaagcggttaataacgaatgaattctggggtagttggga

SEQ ID NO: 6810031 - DNA, 60 bp, Homo sapiens
tgcctggaaagtacagtgtgtcacacagatgcctgttgacctggaaggtgcttcctggca

SEQ ID NO: 6810032 - DNA, 69 bp, Homo sapiens
agcatgatgaagtggaaatccacggattgaaggaattctcttttcttcctggattcctacttcagtgct

SEQ ID NO: 6810033 - DNA, 58 bp, Homo sapiens
ggagcatgtttgagaaatgcgctcttctgtttgagtctgctgtttctgagcttgcttt

SEQ ID NO: 6810034 - DNA, 130 bp, Homo sapiens
ttgaaatcgcctggggagcttttaaaaaattactgatgtccaggccccacccctagagagctcatttaattggtccagggtggagcttggacaccagtaatttttttaaaagctccccaggtgatcttaa

SEQ ID NO: 6810035 - DNA, 94 bp, Homo sapiens
tgcacaacttcaggggacatcatccatattgtaatagattgtgatggacatattctgagaggcacaatgtggatggtacccctggagttctgca

SEQ ID NO: 6810036 - DNA, 59 bp, Homo sapiens
gatgaaatgagatagataatcaggcaggtccgatccattgcctggtgcattcattcatt

SEQ ID NO: 6810037 - DNA, 64 bp, Homo sapiens
tttacaagaaatcatgatgctaaagcttgacactaaagcttgagtattgttatctctgagtaag

SEQ ID NO: 6810038 - DNA, 101 bp, Homo sapiens
ggtgtcagccagggctgtgatttcatctgaggccaggagccctcttccaagctcactggttgttggctgaattcaattcattgcagttttagggctgaccc

SEQ ID NO: 6810039 - DNA, 129 bp, Homo sapiens
ttgctcacctttcatgaagggctgatagtcaaacttgggtatggctgtgccagttgtttatggccagtggtctcctggttagtcagtacctgagtgtgatcagttgttacatgttttgtatatgagtgg

SEQ ID NO: 6810040 - DNA, 123 bp, Homo sapiens
ttccctggcctttgaagggaagatgttgcaatgtacaggcagttggagtgttttgcctaattcatcaaaacattcacatttgctagtaatacaatgcatctatgatgagaaggacttagggga

SEQ ID NO: 6810041 - DNA, 59 bp, Homo sapiens
caagaagaagcttccttaagtctagatgtcactggtggagtgaggcaagctttttcttg

SEQ ID NO: 6810042 - DNA, 63 bp, Homo sapiens
tcaggagactggcagtgcccactcctagggaggaaactgggttacagctagaagtacttttgg

SEQ ID NO: 6810043 - DNA, 111 bp, Homo sapiens
cctgccccgtcacctggtgcgcgtcttcccgcagcccagcagggcccggagcggcggggacggtgcctctgtcagcagggcctgtgggagggaggctgggggctgggtggg

SEQ ID NO: 6810044 - DNA, 77 bp, Homo sapiens
aggccgcgattagagtaatgccagggccgggacaatgtgttctgtgcccataatctggtatttacctggtgtgacct

SEQ ID NO: 6810045 - DNA, 72 bp, Homo sapiens
atattcctcattggtaatgttagtattgatcaccctgttagtatgttgtctgatgttaccattgcataatat

SEQ ID NO: 6810046 - DNA, 82 bp, Homo sapiens
cattcctctgactctcaaagaaattgcctgtcattgatcacattcttctttgtagcaaagtttttttgagagaagaggaatg

SEQ ID NO: 6810047 - DNA, 77 bp, Homo sapiens
ggcagaaatttctaagcagccacttccaagaagctttggaaagaaatatccagggaagtgctgtgtggaagtctgcc

SEQ ID NO: 6810048 - DNA, 94 bp, Homo sapiens
gcttgggtgtgggattggaagggatgccagctgctttggggggagcgggtgcttgcttctagcagagggcatctgctgttgttgccactgttgc

SEQ ID NO: 6810049 - DNA, 60 bp, Homo sapiens
ttctcttgatatttaaagctgagatccttaaaaatatatcagctgtgaatatcatgaggg

SEQ ID NO: 6810050 - DNA, 76 bp, Homo sapiens
gtggctgggtgggagcatggtcccagtgcccaggagaaagagctgagctggcaggaggggccctccccctggccac

SEQ ID NO: 6810051 - DNA, 55 bp, Homo sapiens
actgaacagaccattttgtccttcatttctgagaagtaaaatgtctgtggtcagt

SEQ ID NO: 6810052 - DNA, 68 bp, Homo sapiens
cttggtcttgtggcatctttccagacactgtcagggatggtaggccatggaaagattcaaagaccagg

SEQ ID NO: 6810053 - DNA, 69 bp, Homo sapiens
tcaagcccctcctggaggcggatgcccacctacgtttcagcgtgggaagccgaccccggggggacctga

SEQ ID NO: 6810054 - DNA, 130 bp, Homo sapiens
cagagtgaagggttccatgattctcttggtccttccctcagagttgcctggtgctttttgcagattcagccatgtcttcacaccgggcagcaggaaggagaaagagaaggggagtcgcacttaccacctg

SEQ ID NO: 6810055 - DNA, 84 bp, Homo sapiens
ccacttagaatactagtgaagtcatcgaaaaaagtgatgggcattaacattaactggtggctgcttatatggtagattaaatgg

SEQ ID NO: 6810056 - DNA, 104 bp, Homo sapiens
cgactgtgcctcttttggagggacttagaaagaaggccagctgtttcaaagactcagctgcccctcattttcaccacacgagccctcctaaacagagcacatcg

SEQ ID NO: 6810057 - DNA, 57 bp, Homo sapiens
ggacccaggatgctggaactcaggccttcggcctagaaagacagaggttttgtctcc

SEQ ID NO: 6810058 - DNA, 95 bp, Homo sapiens
aggcgggaggaaaaggcaggtgcaggtgggcgtggcgagaaggcgcaccttgtagtcttccccggcgtgcgcgccccgtgactccttccccgcct

SEQ ID NO: 6810059 - DNA, 124 bp, Homo sapiens
gtgggttttagcaaaggcttgtaaatcagatgggctgcgtgcagtgactgaagaagtctcctgcctggattcggatcctgccttcattacttgctcgtagcacaggctttccactgaagagcat

SEQ ID NO: 6810060 - DNA, 70 bp, Homo sapiens
agtagtgaaatttgtttagataggtcactcaagaaaaatggcaagattatgttctaaacaagtcagtgct

SEQ ID NO: 6810061 - DNA, 123 bp, Homo sapiens
gggttctagttttcagcagcatcttccgcctttggcaatggatggtcatctagtgcaatgtttggcacacagtaggtgccatgtatatgtcaaatggataactgagtgaaatagcatgaaccc

SEQ ID NO: 6810062 - DNA, 87 bp, Homo sapiens
gggccccggtctcaggtccaagatggccatccagacccagcagtcgaagtttgtgaactggcaggtggacggggagtatcggggctc

SEQ ID NO: 6810063 - DNA, 89 bp, Homo sapiens
gtcagcatggtcagactaggacactccggcatgtgattaaccatctacagttagggctggaagagttttagctggcatttgggcatgac

SEQ ID NO: 6810064 - DNA, 81 bp, Homo sapiens
cacatgtgtgtctgttaggcatgtgtgcgtgcatgtgtgcataggcatgtgtgggtgcatggatgcacgggtgcatatgtg

SEQ ID NO: 6810065 - DNA, 55 bp, Homo sapiens
cacactagcacttcagaggttccaaatgacctgggtcctttagtttgctgatgtg

SEQ ID NO: 6810066 - DNA, 126 bp, Homo sapiens
gattttggttctgttgtcaagtattctaggaatcctttctcatttcatttctgtgcaaaatggattgacatgagaaatgaagagagtcaaggttgccaagattcatttgtcagcatgcatcgagtc

SEQ ID NO: 6810067 - DNA, 59 bp, Homo sapiens
gcccagggcagggcaagagtgaattctttgctggattcttcatgcccaggccttggtgc

SEQ ID NO: 6810068 - DNA, 55 bp, Homo sapiens
tgtagggactgaggctggagaggccactgctgcactctcagccccatccactgca

SEQ ID NO: 6810069 - DNA, 120 bp, Homo sapiens
ctcctaggtacatttgtgtatctattcgtatttattagtaattaaacttctatgttggtctataagccataatgttgatgattgtctttgtaaatgaatgcatgcaaatacgcccaggag

SEQ ID NO: 6810070 - DNA, 77 bp, Homo sapiens
ggttcccatggctagtgtcgggaacgcaggcctgtccactccccaagccccttcctgtccgcaatggcctgggagcc

SEQ ID NO: 6810071 - DNA, 71 bp, Homo sapiens
cctcctgtagagccccagccctgcttctatagaggattcttggaaaggctgcattggggcggtgtgggagg

SEQ ID NO: 6810072 - DNA, 84 bp, Homo sapiens
agtaccccatggtttagtgtttctcagagtgaggttcagagacctcctgtctcagtcagaatcaccagactttggggccaagct

SEQ ID NO: 6810073 - DNA, 125 bp, Homo sapiens
cagggcagaagtacaggttctgtttgtacactcgccattgtccaagagctcattatccggagtgtgtgtgcttgaggagtggcgctggacttagagtggacagatgcatgtgacttgaagccctg

SEQ ID NO: 6810074 - DNA, 58 bp, Homo sapiens
tctagtcattcatgctatgattattgagctcctgctctgtgtcaggcatgaatctggg

SEQ ID NO: 6810075 - DNA, 130 bp, Homo sapiens
tcagagcaaaaaggtacaagctttacttgccaccagcagctgccagagtggaggccttatgtaattacttcggcttcagccttggcagcttttgttagcccaaagtggatttgctatatttgtgctttga

SEQ ID NO: 6810076 - DNA, 71 bp, Homo sapiens
agacaaatcagataaaaaattgaggcattaactggtagttaggtgtgtccagttttttctctgctgtgttt

SEQ ID NO: 6810077 - DNA, 82 bp, Homo sapiens
tctgttttgtgtccattctatttccaaagacaagcttaagggttaagctgtggtaaagggtagagggaatgccaaaagcaga

SEQ ID NO: 6810078 - DNA, 69 bp, Homo sapiens
tactgatctaaatggctgtgctaaaatgagtgtttcacgacactcattttataacactgtagtttagta

SEQ ID NO: 6810079 - DNA, 66 bp, Homo sapiens
atattgcatggctttgctggttaaacacctgataatcagtttgaaactgcagggctataaaaatat

SEQ ID NO: 6810080 - DNA, 55 bp, Homo sapiens
ctgagatggagccactgcactctagcgtgggtgatagagtgagactccatctcag

SEQ ID NO: 6810081 - DNA, 100 bp, Homo sapiens
acttctctcctcttgattttgccattaaaacatgttatctcctcataataaatcactggagaggttgttagaatagtggaggaaaacaagggagagtggt

SEQ ID NO: 6810082 - DNA, 98 bp, Homo sapiens
cacatcatattttttcaatctagtctactattaacaggcaattaggtttattccatgtctttgttattgtggacaggggtgaaatgaacatgcatgtg

SEQ ID NO: 6810083 - DNA, 55 bp, Homo sapiens
tcttggcaatgctttgttcacactccacttggaggaccaggacagtatgtcagga

SEQ ID NO: 6810084 - DNA, 60 bp, Homo sapiens
gcttaatgggctgtggatttaggaacttcatgtctcctgaagctcttaagacctttaagc

SEQ ID NO: 6810085 - DNA, 67 bp, Homo sapiens
catctcacagcaaactgctgaaagggaccaggcctcctatgtctgtgcagcagtatggtgtggcgtg

SEQ ID NO: 6810086 - DNA, 105 bp, Homo sapiens
tttcactgaagacagattcagcctaattcatgaatatattgaattagcatgactacatgctttattcaggtcactgaggagactgaatttatctgcttagtggga

SEQ ID NO: 6810087 - DNA, 66 bp, Homo sapiens
ttaggaagaatatatttagagcatggaagtctattaacttttcctcattttaaatgttctttttaa

SEQ ID NO: 6810088 - DNA, 124 bp, Homo sapiens
gttacagcgtatccaggtgagattatgactcaactatttagcacctccatctcaacatgtacttccccaacggtcatggcagaggaagagagggctggaaaattgagcactggcaatgacatat

SEQ ID NO: 6810089 - DNA, 85 bp, Homo sapiens
aacagtagggagaatatgtctatagtgccatggcaaactgtcttgaagacaggaccagcaggccaggggcactgctctctgtgtt

SEQ ID NO: 6810090 - DNA, 64 bp, Homo sapiens
ttccctttcacaatatctaatttgccaattatgaagagcacagtgatatccttgagaaagggaa

SEQ ID NO: 6810091 - DNA, 68 bp, Homo sapiens
gcaatcactgaagaatgggagaggaatgcagagaatgaaatttcctccctctttctgcccagggatgc

SEQ ID NO: 6810092 - DNA, 71 bp, Homo sapiens
cataatctttggtacagactttgttttctaagaaacttaggctaaaacagtttgtttcagaaatggttatg

SEQ ID NO: 6810093 - DNA, 66 bp, Homo sapiens
cttggctatttccggagtgtgttagccaatctaccctgtggttttctttctctggaattggtgaag

SEQ ID NO: 6810094 - DNA, 86 bp, Homo sapiens
ctgttagcttcaaacatttaggaggagggagggggaacgcccaataaagtaattctctcctatttcagagtgttcaaatatgacag

SEQ ID NO: 6810095 - DNA, 92 bp, Homo sapiens
agatgcgtaaaaccacattgtctgagaatcttgcatatcatcaatattcattggtgagagatgctttcttaacgctggtgttttatgcattt

SEQ ID NO: 6810096 - DNA, 55 bp, Homo sapiens
aaaagtctgctctcatttcagatggacaagtaaatcagaaagaaggtagattttt

SEQ ID NO: 6810097 - DNA, 66 bp, Homo sapiens
tctcacagaagagcattaagatgacatagtgccatacacaactcgcttattagctctttagtgaga

SEQ ID NO: 6810098 - DNA, 56 bp, Homo sapiens
aatcttcttttcaaaaggtggagcctaatctcactcctattgaatataggaagatt

SEQ ID NO: 6810099 - DNA, 68 bp, Homo sapiens
tgtgagtgtcgtgttgtactgacatgtagccctcagaggctgacatttcagcgtgcatgacatgtata

SEQ ID NO: 6810100 - DNA, 68 bp, Homo sapiens
acccctctggtgccattctgtggcctagacttgcttggctgggccaagaagttgtgtatgtgaggggt

SEQ ID NO: 6810101 - DNA, 60 bp, Homo sapiens
tggaccaattctcagttttcttacaagcttatactgagctgacaaaacaagaattgtcta

SEQ ID NO: 6810102 - DNA, 63 bp, Homo sapiens
ttttacctgaaccacacagtattgtgtcctagcatgctgatgtatatagtgattgaggtagaa

SEQ ID NO: 6810103 - DNA, 74 bp, Homo sapiens
tgaggcagcaatgaaaatttaagttgcagctattagttgattgctgtaactttttcattttcaaaccatgtaca

SEQ ID NO: 6810104 - DNA, 75 bp, Homo sapiens
aggaaggacataaggaattccctttctgacagaactcgttggttacttgttaggaatttctactattgccttcct

SEQ ID NO: 6810105 - DNA, 91 bp, Homo sapiens
cctgctcccgccccagcagcacactgtggtttgtacggcactgtggccacgtccaaaccacactgtggtgttagagcgagggtgggggagg

SEQ ID NO: 6810106 - DNA, 79 bp, Homo sapiens
ggcttagaggtccacttagtcccttaggagacagatggaagaataagttagtttgaatggactgagaatcttgagagct

SEQ ID NO: 6810107 - DNA, 60 bp, Homo sapiens
cattattgtcacctttatttggattgccctaaatgtggctagagtacaggtgcagaaatg

SEQ ID NO: 6810108 - DNA, 64 bp, Homo sapiens
ggccaccttcctgtggtctctgctgtggtgcaggcaggggccaccaccaaggaaggtgggatcc

SEQ ID NO: 6810109 - DNA, 60 bp, Homo sapiens
cttaagccactgagatttggggttaaattttatctatagcataaacctctgtggctttag

SEQ ID NO: 6810110 - DNA, 59 bp, Homo sapiens
ctggaaatcactactagtcaatacctagagcactatataggtatacagagtatttctag

SEQ ID NO: 6810111 - DNA, 61 bp, Homo sapiens
ctgcagagcctgctcacgtctctgtttctaagttcataacatgctgctctgggctttgcgg

SEQ ID NO: 6810112 - DNA, 84 bp, Homo sapiens
gagaaaaaatatcgatgagtcacagaaggttttgatgaaagcacagattttattccacttagtgactcatttgtgacttttctt

SEQ ID NO: 6810113 - DNA, 68 bp, Homo sapiens
gtctgcattctggatagctagtcaatgctcgaacattatggttgcctagtaaatcctgaatagcaggc

SEQ ID NO: 6810114 - DNA, 72 bp, Homo sapiens
gaatgactttcagcttctactgtggggggattattaggaagactgacagcatagaataagctgaagtcactc

SEQ ID NO: 6810115 - DNA, 130 bp, Homo sapiens
aaaactacagtctgcggagataaaagtagaattattacagcaggcatagagtagcactcagtaacatcaaatgcatgaatgcaaatcatgattgtaataatactttttacttttgtatcactgtaggatt

SEQ ID NO: 6810116 - DNA, 118 bp, Homo sapiens
agggaaaaatggaaccagccagaggccttggcatgaagtcagcagctgggaggaaggggcctccacaaagttgctgagtttctgaaatcccaggcactccatggtgcaatttttttct

SEQ ID NO: 6810117 - DNA, 71 bp, Homo sapiens
atgcagcactcatgcaagaagatagattaaatgcaatgttgcaggaataagctgactgttgcaggctgcat

SEQ ID NO: 6810118 - DNA, 65 bp, Homo sapiens
gaggaaaatatgctttaagttatagtgatacttcatgacaacccacagaagcatatttgttcttc

SEQ ID NO: 6810119 - DNA, 57 bp, Homo sapiens
ggcccagccttggggtttctttcctcacctctaacaagaaggccccgagtcagggcc

SEQ ID NO: 6810120 - DNA, 92 bp, Homo sapiens
ctattcagggattttacaatcattagcaattttcaataagtactggatgatgtgtcttttatctgacattgttagtgtattgcctggagtag

SEQ ID NO: 6810121 - DNA, 118 bp, Homo sapiens
aacctcaatgtggtaggaaagtttgggaagctggcctgaatgaatggcttttcttacttatttagttaagtcctcataggctaaggatttttccccttcctgccactccaaataggtt

SEQ ID NO: 6810122 - DNA, 56 bp, Homo sapiens
agagcagacagggcagagccagagagacactgtttgatggccacctctgctgttct

SEQ ID NO: 6810123 - DNA, 56 bp, Homo sapiens
tatcaatggtttatattcaagggaggaacaagttttttcttggagaactaatgata

SEQ ID NO: 6810124 - DNA, 56 bp, Homo sapiens
ggctggctggctggtagacaagaccccagttttcttccatctttcagtagttagcc

SEQ ID NO: 6810125 - DNA, 57 bp, Homo sapiens
gggccctgaggggccagtgaatgaggagctgaattcagctttgaggctctggggccc

SEQ ID NO: 6810126 - DNA, 66 bp, Homo sapiens
tttattctgctgtcttattgtaatcatcatcctatgttgattaagcaaagagcagtaaagggtaag

SEQ ID NO: 6810127 - DNA, 72 bp, Homo sapiens
ggccctaggaagcctgctgtgcacagcagtgattaggaagctgagttatgctggggcagaggcccgagggtc

SEQ ID NO: 6810128 - DNA, 109 bp, Homo sapiens
ttgtgactctgttggttttccagcaagtaatttgccctgacttaatgtttggtgtttctgcttcaggagtaaagaagacttgacctggcagattaatatttgatcacaa

SEQ ID NO: 6810129 - DNA, 58 bp, Homo sapiens
tggcctcggacaccctctgagggctttggcttttcggagccctgcgtgtctgggggca

SEQ ID NO: 6810130 - DNA, 130 bp, Homo sapiens
ggaatgcaaacactcaaaccatagcaaggatggagagagattcagggcagattgtgaagcaccttggaatgtggtctccagtgaatctcctcctggttccatgtgtgagtcctgggagcagtttgtttcc

SEQ ID NO: 6810131 - DNA, 87 bp, Homo sapiens
gttttcagcccaggagtttgaggctacagtgagctatgatcataccactgcacttcataccactgcacttcagcctgggcgacaagc

SEQ ID NO: 6810132 - DNA, 58 bp, Homo sapiens
gctccacagaggcaggggacccaaggctgagccggctgtgggctctgcttcctggagt

SEQ ID NO: 6810133 - DNA, 77 bp, Homo sapiens
gctgtgagttataaatgtccctgtcagagcccgggccgagaggccctgctgctggcagaggcgccagggcccacagc

SEQ ID NO: 6810134 - DNA, 118 bp, Homo sapiens
catatacccacctctctaaatgccacattcaacaaacttcaagtccagtgatactggcaggaagacagtctcttcttcagtacagcattgatttatgtggcagaaaggatgctatatg

SEQ ID NO: 6810135 - DNA, 130 bp, Homo sapiens
ttatgagcattagatgaaatcgtgggtgaaaggctcagtacagtgccaggtatacaagaagcattcagttaagtaatagctgttattgttataactgaggttttcacaagccgcacacttttgctcctga

SEQ ID NO: 6810136 - DNA, 63 bp, Homo sapiens
cacactgatagataaaactatattttcaggttttcctgaggtcatgtttttactaacagtttg

SEQ ID NO: 6810137 - DNA, 84 bp, Homo sapiens
ggaagacccgagtggtgaggtgtagggaaggtactcggagccagttctaaggccagagccctttccactgccctctgggcttcc

SEQ ID NO: 6810138 - DNA, 60 bp, Homo sapiens
tactttctgtccttctgttaaagcttaatgggaactgctgcaaaggaggatcagagagta

SEQ ID NO: 6810139 - DNA, 57 bp, Homo sapiens
gctcctagtgagatccgggggattagtttccaaatctggaatggtactcactggagt

SEQ ID NO: 6810140 - DNA, 62 bp, Homo sapiens
tcattgatttggatgatatttcatctctgaaggagttgactgggttattcagacgcatatga

SEQ ID NO: 6810141 - DNA, 129 bp, Homo sapiens
agaaaataactttctgttgtttaaaccactcagtcttaggtattttgttatgtcagcttgtcttagtcagttggggtgctataaaaatgatcttacactgggtggcttaaacaatacaaatgtatttct

SEQ ID NO: 6810142 - DNA, 78 bp, Homo sapiens
ccaactatgacccatatatacgtaatttgtttggctatgacccatatatacgtaatttgtttggctctcatagtatgg

SEQ ID NO: 6810143 - DNA, 55 bp, Homo sapiens
tcctggtggtgccagctgcaggctgtgtgcttgggcagctggcactacccttgga

SEQ ID NO: 6810144 - DNA, 61 bp, Homo sapiens
ggccgcctgggtccaccgctcgcgctcccaggggagtgggccggacagcccaggccccgcc

SEQ ID NO: 6810145 - DNA, 79 bp, Homo sapiens
ggagcccagggagggagtgcagggacagaccggggcactccaggccccatccactggccactgcacctcttcctttttc

SEQ ID NO: 6810146 - DNA, 76 bp, Homo sapiens
gagtgcttatacagtttgcctgaaatccatacattaacagcctttggatttccaaactcatagtatggtgtatctc

SEQ ID NO: 6810147 - DNA, 93 bp, Homo sapiens
ggctaggatggtcttcatctcttgaccttgtgatccacccgctttggactgccaaagtgctgggattacaggtgtgagccaccatgcctggcc

SEQ ID NO: 6810148 - DNA, 66 bp, Homo sapiens
tagggtggcctgtaaccagcttgggatgtgtctagtacatctgaaagggattgcagaatcaccctg

SEQ ID NO: 6810149 - DNA, 66 bp, Homo sapiens
caaaggatgggtttgagatgtttgggttggttgagtgggcatttagacaacaagccttctcctttg

SEQ ID NO: 6810150 - DNA, 67 bp, Homo sapiens
gcaaagacacagggacgtgctctgcctcatgcaaatgagctgttctaaaagcgtccctgtgtcctgc

SEQ ID NO: 6810151 - DNA, 65 bp, Homo sapiens
ggagccaaatgtgcagacattgttccaaaatgaatatttgcatgcatggatgcacgcttggatct

SEQ ID NO: 6810152 - DNA, 69 bp, Homo sapiens
atccctccgattccaaacctccctaaaatgattaaatacattttaatggcagggcagaatattagggat

SEQ ID NO: 6810153 - DNA, 82 bp, Homo sapiens
gctttggagtgtccatgtatcggttagctattgctgcgtatttgttgcacagcaatagctaactgatacatggacacaaagc

SEQ ID NO: 6810154 - DNA, 89 bp, Homo sapiens
tctttggaaagtttagcttcgtgcatctatagcacagccaagtggaattgtttgtagaaaattagatgcatggttttggaattcagggg

SEQ ID NO: 6810155 - DNA, 126 bp, Homo sapiens
ctgggtggctgttggtgctggctcagtggcttggggaggttggggctgggatgtatgtcattcctgggctttcccctctggttgtgagtggctgcagcagctccaggtatcacggctacatcccag

SEQ ID NO: 6810156 - DNA, 64 bp, Homo sapiens
atgccaagtgcagttggctgaaggaagagcagatccccttccatctcacctgcactctgcgcat

SEQ ID NO: 6810157 - DNA, 82 bp, Homo sapiens
ggaaataaattggccaatcctattgggtgggatttgtgttaatatgagccccaccagatggatgaagcagatttgtttatcc

SEQ ID NO: 6810158 - DNA, 55 bp, Homo sapiens
aatgctgttgagttgttcctgttttattcttcagtgaatgactgttttcagcatt

SEQ ID NO: 6810159 - DNA, 89 bp, Homo sapiens
actgtgttagtccgttttcacactgctataaagaataccacctgagactgggtaatttataaagaaaggaagtttaattgactcacagt

SEQ ID NO: 6810160 - DNA, 76 bp, Homo sapiens
gagcaagtatcagcacatctccaagaatttctgcagcagaaattcatggagacggtgccatcaagtgatttagctc

SEQ ID NO: 6810161 - DNA, 65 bp, Homo sapiens
ggcagttctggatgcattgtcacttggtgtccatccatgttttcactagcatccagtaacatgcc

SEQ ID NO: 6810162 - DNA, 66 bp, Homo sapiens
tgtgtatgtgtgtgtgtgtgtgtatatatatatatatatatgcacgcatacacacataaatacaca

SEQ ID NO: 6810163 - DNA, 104 bp, Homo sapiens
ttttgaccaatgggacattagcaagcttgataccaggagaggcacttgcaatggggattctcctttgcaaaactccttggagctgagctgcatgctatgcgaaa

SEQ ID NO: 6810164 - DNA, 55 bp, Homo sapiens
ggagcagctgtggggttgaccatggcagctgtcacagccccacgtgggctgctcc

SEQ ID NO: 6810165 - DNA, 59 bp, Homo sapiens
ataggcctgtttcttgtccagctctatgtagagaaggactacggaaaacagatgcttgt

SEQ ID NO: 6810166 - DNA, 56 bp, Homo sapiens
caggggctccccacagagggacctgaaggcggctctgtgctcgggggagctctctg

SEQ ID NO: 6810167 - DNA, 75 bp, Homo sapiens
cctcagatttactgcttgacacattggttgtgtcattctgcattgtgaaaggctgatggtgaagcagcaaacagg

SEQ ID NO: 6810168 - DNA, 63 bp, Homo sapiens
aagtggctgccccctcccgtggacacagcaggcctgctgacgtgttcaccagggcagcagctt

SEQ ID NO: 6810169 - DNA, 64 bp, Homo sapiens
gagtcttctacgctcacacaaagccttagtgtcagctaggagtgtgtgaatagctggaggattc

SEQ ID NO: 6810170 - DNA, 58 bp, Homo sapiens
ggcagtgctttcattaagctttgtgaattcccccataaagcaaagtcaagtgcactcc

SEQ ID NO: 6810171 - DNA, 66 bp, Homo sapiens
ttgattgttgtaacttaaagggatcaaggtcatctaatacaactccctacaaagtgcaggaatcag

SEQ ID NO: 6810172 - DNA, 59 bp, Homo sapiens
ttcctgtagcctgtccttacaggcctttgcttgtctaaggtgtttgatgggttgaggaa

SEQ ID NO: 6810173 - DNA, 86 bp, Homo sapiens
atattgaacacattttacagttgtctggctatattatataaatgtggtaagcaacttttgtagagatagtacgtgtgtgataatgt

SEQ ID NO: 6810174 - DNA, 78 bp, Homo sapiens
attgggcagagaggagagaagccagagctctgtggttctcacagaacctgcctttactctccttatcaacagtccagt

SEQ ID NO: 6810175 - DNA, 76 bp, Homo sapiens
tgtttccccttggtaactgttgggttggtttctgttcactggctctctacatttgccaggattctttggggaggca

SEQ ID NO: 6810176 - DNA, 62 bp, Homo sapiens
ttcaaggaaaccagcatttggtcagcaccttcaatgcaaatcattgctctaggttccttgga

SEQ ID NO: 6810177 - DNA, 64 bp, Homo sapiens
gtaatctcagctacttgggaggctgaggcaggagaattgcttgaacccaggaagcggaggttgc

SEQ ID NO: 6810178 - DNA, 61 bp, Homo sapiens
cccagggccccatttgcccatggcagcagcacagagcaggcagacagatgagggtgctggg

SEQ ID NO: 6810179 - DNA, 86 bp, Homo sapiens
gcttggattttcaaaggctgctttctacaccaagtatgtgcactgggagtcttttgtattttggctgtagagcagataatctcagc

SEQ ID NO: 6810180 - DNA, 73 bp, Homo sapiens
ctgtttcagtgaagtaatggtgagagatataggtattaggtgtccttactattacttacattttttgattcag

SEQ ID NO: 6810181 - DNA, 106 bp, Homo sapiens
tattgtatgtcacagaatttttcttaagtaataaatttatggcagcaaaattggaatagcctttgaagcacatttcttgagatgaacattaggttgatgtattata

SEQ ID NO: 6810182 - DNA, 69 bp, Homo sapiens
aagatgtatctttcctttaattctgattatagaatttgtaaattagtagaataaagagggatacatttt

SEQ ID NO: 6810183 - DNA, 79 bp, Homo sapiens
gatcaaatttcctgtaccattattcacatgatcttttccaaggaaaggagtgggaaaaggaaggagaaggaagagtgtc

SEQ ID NO: 6810184 - DNA, 68 bp, Homo sapiens
cagggatgttaaatttgaggcctgagctctttccatcatactgcgaagtctcaattgtggcatcactg

SEQ ID NO: 6810185 - DNA, 83 bp, Homo sapiens
gatagagaaagccaatggttttgcaggtttgtggagcaccagcaactgttcctcaaattagcagatcataggtggcttctatc

SEQ ID NO: 6810186 - DNA, 67 bp, Homo sapiens
catttcccccagcccacaagcatattaaaatgactgtttttaagcttttacgggttgaggtgatttg

SEQ ID NO: 6810187 - DNA, 73 bp, Homo sapiens
ggctgctttatggcacacaaatatcaaaatgagttttatacatttgaattagtgattccatgcaaatgcagtc

SEQ ID NO: 6810188 - DNA, 57 bp, Homo sapiens
ggaagacatctgcttgcaccagatctagcacatagtgggtgctctgcaaatgtctcc

SEQ ID NO: 6810189 - DNA, 79 bp, Homo sapiens
acttcttttaggattgttttccttcttcattgtgttacagctgcttcagtacaaaaggaagagggatcttagaggttgt

SEQ ID NO: 6810190 - DNA, 77 bp, Homo sapiens
atgacttagttgggtgactctggcttcaagtttcttatgaagttgtaattaagctgtcagccagggtctaaagtcat

SEQ ID NO: 6810191 - DNA, 94 bp, Homo sapiens
taggaaagggttcatgaagctccagccctagtacagctggcgtccatcctccgcctgtcgctgccaacagggctgggagatggccactctcctg

SEQ ID NO: 6810192 - DNA, 79 bp, Homo sapiens
gaggatggtagacatcgagatgagtgaggatcagagatgatactctctaggacattttctagatgttgattcttccctc

SEQ ID NO: 6810193 - DNA, 84 bp, Homo sapiens
gtccccaggtcctgctgctgcacatcctcattgcctaatgagtacctggtgaggaatgctgagcagaggaagcaagatgtggat

SEQ ID NO: 6810194 - DNA, 57 bp, Homo sapiens
ggagagtggagactgtccaacaaggaaatgagttcatccttcagttctgcactttct

SEQ ID NO: 6810195 - DNA, 68 bp, Homo sapiens
tccacgtggggcaggcgggtgtccagatcggcaatgcctgctgggaactgtactgccttgaacatgga

SEQ ID NO: 6810196 - DNA, 95 bp, Homo sapiens
ctttcccttggctgccctcaggtttgactctgcccagccgcttgtctgcgagaccccgggggacaagggttctgcagagcctgcagaagggaagg

SEQ ID NO: 6810197 - DNA, 85 bp, Homo sapiens
tgaaaggcttgcttttggctggcacactgggaccgttgttttcagccaacagatgaaacccagctagttggaagaggcccattca

SEQ ID NO: 6810198 - DNA, 127 bp, Homo sapiens
cttttaaaaaatgcagcttaacccgtatttgttataggtggttatgtcagcctagatgctgctctcatttgagttgggatttcttcttaaataataaatattacaacaaatgtattctgtatgaaag

SEQ ID NO: 6810199 - DNA, 98 bp, Homo sapiens
aggcaggagaattgctcgaacccggaaggtggaggttgcagtgagctgagatccggccactgcactccagcctgggggacaacagcaagactctgtct

SEQ ID NO: 6810200 - DNA, 57 bp, Homo sapiens
gaaagtgcctcagtcctcttatactctgttttcttgcaaaggtactgtgggactttc

SEQ ID NO: 6810201 - DNA, 79 bp, Homo sapiens
tatgaagaaatacccagcgttagtgagacagaaggcaaaaggcatgtttgtacacaacctgtggtagtatattttggta

SEQ ID NO: 6810202 - DNA, 73 bp, Homo sapiens
gttcctagtggataataaaacagatgctgagggtaaatgtcctccagcattcaagtaattcacttggatatgc

SEQ ID NO: 6810203 - DNA, 105 bp, Homo sapiens
gccagatgtaagcagtctattgggtaaggtatgggagaaggagcatggcgtggtggtgcatgcctgtaatcccaactacttgggaggctgagtgctgtctttggt

SEQ ID NO: 6810204 - DNA, 67 bp, Homo sapiens
gtccctctgggccatcaggtccaagccccttggtgcacagaaggggaaactgaggcccagagagggc

SEQ ID NO: 6810205 - DNA, 71 bp, Homo sapiens
ccaggcagtgacaagttacttggatggctaaatcagaactggtccaccaaacaaaattgtgcactgtgtgg

SEQ ID NO: 6810206 - DNA, 68 bp, Homo sapiens
tcacagttatgaggcctacgttctttgtctcgaaaatagggacaattaccctggcttgataaaagtga

SEQ ID NO: 6810207 - DNA, 63 bp, Homo sapiens
agtttttaaaatgttaggtgattcagatcttaattttctgactgaaattgcattttaaaaatt

SEQ ID NO: 6810208 - DNA, 67 bp, Homo sapiens
catgttttcatttaaataattgccttcagggacataatctgaagaagttaataatggtgagaaaatg

SEQ ID NO: 6810209 - DNA, 58 bp, Homo sapiens
ctttgcttttgtgctctagtggtgggtaatatgctgacaccacagctcagatgtagag

SEQ ID NO: 6810210 - DNA, 72 bp, Homo sapiens
tcactgaggccagcagaaagcttattttgactgtctatgaagcagttaattctgttttttctccttcagtga

SEQ ID NO: 6810211 - DNA, 59 bp, Homo sapiens
tcagcagggcctccttgtgcagaaagtaatttgtaccagcgtccctgaggccctgctga

SEQ ID NO: 6810212 - DNA, 62 bp, Homo sapiens
tgagacagcccttctgcacaggggaggataaaactcaagatgctttcttggagggcttctca

SEQ ID NO: 6810213 - DNA, 67 bp, Homo sapiens
gggtgtgtctctgtgtccagatttttccttttcttaggacacattcatactggattagggctcaccc

SEQ ID NO: 6810214 - DNA, 58 bp, Homo sapiens
tgactaagggtgtttataaggtcaattcacccgccttatggtgacattctcttagcca

SEQ ID NO: 6810215 - DNA, 57 bp, Homo sapiens
ggtgacacagggaccagagtctgaatccagcagcattcctgaggctccttatgcacc

SEQ ID NO: 6810216 - DNA, 56 bp, Homo sapiens
ctgctgtgtgaccatggacaggtaaagtcacatctctgactatcttcacagggcag

SEQ ID NO: 6810217 - DNA, 70 bp, Homo sapiens
ggtgtaggtgtggcccaggtgtctgcagctctgaaggtggaggtgcagcccaggtgtagctctttgaacc

SEQ ID NO: 6810218 - DNA, 62 bp, Homo sapiens
gcagccctcctcacatcagcgtcctgggagcctccgcccagggggccggcagaggaggctgt

SEQ ID NO: 6810219 - DNA, 65 bp, Homo sapiens
catggccattgcaacgtcaggaggagaggaaatacactctacctctttagcagcactgggacatg

SEQ ID NO: 6810220 - DNA, 77 bp, Homo sapiens
actctttactgtttggtgctctattgactaaatttttccaataaagtgatgataatgataccaaacatgtagatagt

SEQ ID NO: 6810221 - DNA, 69 bp, Homo sapiens
agcactgtccattcactcatattcaggcattgaagtgtatgcatgaaggtgattatgaatgtataggct

SEQ ID NO: 6810222 - DNA, 60 bp, Homo sapiens
tcataattgtatacatttatgggatacaatgtgatgttttgatatatgtatacaatgtgg

SEQ ID NO: 6810223 - DNA, 63 bp, Homo sapiens
gtgtctgtatatcacttttgtcctttctgtggaagaattagaacaacagtggtctacagaggc

SEQ ID NO: 6810224 - DNA, 61 bp, Homo sapiens
tgaaaacccttgaagagggcagctgatactcagattgttgccactggacccagggttatca

SEQ ID NO: 6810225 - DNA, 130 bp, Homo sapiens
ataacacacttagcaaactgatacagatgcactcagtcctgtgaagtgacctctgcagatctcaaggaagaggctgcagaggtcactttataggactgaacgcttctgcattcctttgctatggcactat

SEQ ID NO: 6810226 - DNA, 60 bp, Homo sapiens
gccagtggatgtctcatagtgtgatgagcctctgtcacctgttggatgtatactgtcagc

SEQ ID NO: 6810227 - DNA, 70 bp, Homo sapiens
ggtgctgatgttattgatgctgcagatttcatgaggtggagacactcactttagctcagtcgacagcccc

SEQ ID NO: 6810228 - DNA, 73 bp, Homo sapiens
cagcctgagaagttgattctaaaataggaggaaatgattcaattatttcctctcaagggattactcaatgttg

SEQ ID NO: 6810229 - DNA, 114 bp, Homo sapiens
ggtgtcacacagggtaatgctgctttattaactactcctttagccttttgggaagtagagagtgtaggagagaggttttaaatggggtcagaagagggcattaaaaatgacatt

SEQ ID NO: 6810230 - DNA, 80 bp, Homo sapiens
tgttaaagagctcttactctagtgtactagtgtgtctaagtttgtagctggtatcattccgaagtggagctctgaaagca

SEQ ID NO: 6810231 - DNA, 62 bp, Homo sapiens
ccaacttagtgagccactcttgcatcctatgtcagttggggtgtaagtttcatctgaattgg

SEQ ID NO: 6810232 - DNA, 68 bp, Homo sapiens
gttttttgatgtcagagggctcatttcctggaattcctagagacagaaatcttctgacttcaagaaac

SEQ ID NO: 6810233 - DNA, 101 bp, Homo sapiens
atttttatgacttctatttggtgttgtcataggaaactcagccagagcctaagtctggctttagctgcctagacagctatagcaaaagaagctgtagggat

SEQ ID NO: 6810234 - DNA, 57 bp, Homo sapiens
gggggcagaatgtactcttgtctgaattattagcatttggtgttggttctgccaccc

SEQ ID NO: 6810235 - DNA, 63 bp, Homo sapiens
ctgagttcaggctcttggccaggcattccagatcaatgcactggtcatgtcttctgatcttgg

SEQ ID NO: 6810236 - DNA, 58 bp, Homo sapiens
tttcaggaatgtgactattttttcagcaagctttctgtgctgtgtcacatttatgaaa

SEQ ID NO: 6810237 - DNA, 71 bp, Homo sapiens
attcctcagacatgttttaagacttatttatgaaggaggagagaggttttaagtaaatgtccaaatggaat

SEQ ID NO: 6810238 - DNA, 102 bp, Homo sapiens
gccttaaggccagttggcaattgcctcagagtcttcagtgaaacaggggccagggtaaatcttaactctctgaggacttggggttgcctgttgctttaaggt

SEQ ID NO: 6810239 - DNA, 58 bp, Homo sapiens
tgtacctggtttcttaaacccaaatgcctccaattctggagtttgaagatcaggttta

SEQ ID NO: 6810240 - DNA, 68 bp, Homo sapiens
ttcctgcccgggccagggcttatgtagtcagggattatgaagactgaatgttctgtgtcctggaggaa

SEQ ID NO: 6810241 - DNA, 89 bp, Homo sapiens
gacttgactggatcacagtctggattgtaatctaaaacattatacctagaaataatgacagccctctagtctgggaattcagtctagtc

SEQ ID NO: 6810242 - DNA, 96 bp, Homo sapiens
ttcagtagaagagtatggatagtctgatttgcagagcaggctccaaatttctgatgagccttttgaaatagaaatctgaaagcttttactactgaa

SEQ ID NO: 6810243 - DNA, 70 bp, Homo sapiens
ctgcctagccttcttcatgccatgatgcatacatacaaaattatacggactacatggagaggctatgcag

SEQ ID NO: 6810244 - DNA, 64 bp, Homo sapiens
agaggaggggcagggggtggccagacctcttgctttcactcttccacttcctgcccgctccttt

SEQ ID NO: 6810245 - DNA, 72 bp, Homo sapiens
ccagaatgggagaaagtaggcagccagaagagtttgaaatgttgatcatatggctcagctttccccatctgg

SEQ ID NO: 6810246 - DNA, 120 bp, Homo sapiens
gaggctccaaggggttaagcagcatgccccaggtcacacaacggaaatggaaccagggttctattgcatccccattgtgccccagggcccatgctgttaactgcctggctgtttggcctc

SEQ ID NO: 6810247 - DNA, 74 bp, Homo sapiens
gaagcatttatttagaagagttttaaagtacttaggcgcagtccaaagcactcaatttctaagctaaatgcttc

SEQ ID NO: 6810248 - DNA, 57 bp, Homo sapiens
tgactattgaatacgtgctttatgtaactgttgcagagtggcattgtttattagtta

SEQ ID NO: 6810249 - DNA, 60 bp, Homo sapiens
gctgccccccggactcggcggggctgcggggaggccgccgctgggatctaggggtgcagc

SEQ ID NO: 6810250 - DNA, 61 bp, Homo sapiens
atattatgatccagtaatggtatgacattcttttttatgactatagctcgggttataatgt

SEQ ID NO: 6810251 - DNA, 76 bp, Homo sapiens
ttgtgagatcgatctgtcctggcagttaacacgatgtgcaacagtgtgttagcatggaacagaacgcttttcacaa

SEQ ID NO: 6810252 - DNA, 55 bp, Homo sapiens
ggccaggtgacagaactcagagcctttggctgcttcaggagatgtcaccatggct

SEQ ID NO: 6810253 - DNA, 65 bp, Homo sapiens
ccagggagttcttgtgacctggctaaggttgtgcaactagcttgctccaggtacagaactccagg

SEQ ID NO: 6810254 - DNA, 84 bp, Homo sapiens
tcctaacttattccataggctcactgatagaattatataccattattagttgaattatcctatgaggaaagttgaactgtagga

SEQ ID NO: 6810255 - DNA, 88 bp, Homo sapiens
ggagagtccactgagataaatgcctccagtcactaaaaattcagtttggggtgacttttggcatttataatttccaaggaatttgtcc

SEQ ID NO: 6810256 - DNA, 119 bp, Homo sapiens
ttacatttctatgattattcatttcccctattctaacagtttgcagagagctggcaattggtaggcattgcacaaaaaattgttgaataaatgaactgagagatcgtacctatatgtaa

SEQ ID NO: 6810257 - DNA, 79 bp, Homo sapiens
actggtggatttagagaaggagtagaatgccgggagagtagaatttcacccagcagctgcttctgcttgtaatatgagt

SEQ ID NO: 6810258 - DNA, 68 bp, Homo sapiens
ggaatattgccagagggtctttaactaaatgtcaccttttaattaagaaggcaactggcaactatttc

SEQ ID NO: 6810259 - DNA, 61 bp, Homo sapiens
gtggcatttactctgactgaaatggagagctacttgaggttttggatcagaggagtggtat

SEQ ID NO: 6810260 - DNA, 82 bp, Homo sapiens
tattaagagactaatgaagtaagatattcaactaaagtgaattagcattgattcatgcaagttaaatacctgtctcttaatg

SEQ ID NO: 6810261 - DNA, 56 bp, Homo sapiens
tcagccactttgctctgctgtggaacagtgccacagcagcaggctgtgtggactga

SEQ ID NO: 6810262 - DNA, 74 bp, Homo sapiens
atgccttacagattgtaagttaataaatgctcaacagagattgcattgacttgatacgagcctctagtatgcat

SEQ ID NO: 6810263 - DNA, 96 bp, Homo sapiens
ttgaagttgctaaatgagttttgtgctttcaaagttaagtaaaagaaactttcttttactttgtgtcaagtcaagaaaactaataggtaatttcag

SEQ ID NO: 6810264 - DNA, 63 bp, Homo sapiens
gagcgcctcagcctagagccggacgctttggcttcttcgccatctggccctaggttgggcctc

SEQ ID NO: 6810265 - DNA, 57 bp, Homo sapiens
tctgcatctgtgttgagtgcccctccaactgtgagaggtggtggtgcagggtgcagg

SEQ ID NO: 6810266 - DNA, 88 bp, Homo sapiens
gttatttccatgggtttttcccactcccactgattttggtgtagtttctgatcaatcatgatggtgggagatgacccagtttcataac

SEQ ID NO: 6810267 - DNA, 59 bp, Homo sapiens
ggacaatgtttgctgctaaggtcagtacagtggactattttgtccttagtgcagggttc

SEQ ID NO: 6810268 - DNA, 130 bp, Homo sapiens
ggaagtgagcatcatgatagccgtttcctgccttgtttatggcgcactccgactctcccaccagcgccgaggtggaaagaggaagtgcccagcagggcgagggagacttggggctggctgtgttcctctc

SEQ ID NO: 6810269 - DNA, 110 bp, Homo sapiens
aaactggcccaaaagggtttaaaattgtcagaagttgatcttgatcagttcaaatattttttgacaaagaaaatcagttctggtcagttcaaatctattttgaccagttt

SEQ ID NO: 6810270 - DNA, 63 bp, Homo sapiens
gggggaggagttcagaccagatgccaggcactgtgcctgcattttctcaatgaaccctctttc

SEQ ID NO: 6810271 - DNA, 57 bp, Homo sapiens
catttctcactttctgttcatctggaatatcttctgaggaaagagagtgggatgttg

SEQ ID NO: 6810272 - DNA, 56 bp, Homo sapiens
tgcttgatactcattgcaaggctaatcatatttggcttgtttctatttatcaagta

SEQ ID NO: 6810273 - DNA, 86 bp, Homo sapiens
tagttcagaccctccaagattgcttagaagatgcctttcatccaggaaggcagcaagaattccaggttatctgtggggctaaatta

SEQ ID NO: 6810274 - DNA, 106 bp, Homo sapiens
attagtacaagattactaactggagcccttttcctagatactgttacttataaattgtaggtatatggtacgttagaagaaggggtcctagtattcttgacctgat

SEQ ID NO: 6810275 - DNA, 79 bp, Homo sapiens
cgcttagctgccagcccagctgcctgcctgctgtctccccacagggctgcagtagagccagcatgggaaacattgagtg

SEQ ID NO: 6810276 - DNA, 58 bp, Homo sapiens
tcagggaataagtagatgagtgaatgaatgaatacacttgaatggcattgttccttga

SEQ ID NO: 6810277 - DNA, 93 bp, Homo sapiens
tgtgcctctttgtttttgtaaataaagtgctgataatggtcattcgtacctcacaatgtcacgtgcgggtttactgagataaaatatggcacg

SEQ ID NO: 6810278 - DNA, 64 bp, Homo sapiens
ttcagtttgccagtgttttattgatgattttcacattgatgttcatcagggatattggcctgaa

SEQ ID NO: 6810279 - DNA, 123 bp, Homo sapiens
aggaaggacagagtgtttccagactccatactatcagccacttgtgatgctggggaagttcctctacacaagttcccctggtgccacgatctgcttcacgagtctgggcatgtcctgactcct

SEQ ID NO: 6810280 - DNA, 84 bp, Homo sapiens
gatttcccgtcttggcccatcgtaggtgctcaacaattgtttctcaaatgaccagcgcctgcagagggaccctgacatgaactc

SEQ ID NO: 6810281 - DNA, 79 bp, Homo sapiens
ctggctgctgtttggaagaggctctggtgggagttggtgggctgatgccttagaccaaacaagagctggcagtagctgg

SEQ ID NO: 6810282 - DNA, 82 bp, Homo sapiens
agccaacaccagaggtgggagtgatctggtaggtggtaactgctgtgtcccaagctaatggctcactgtttcttgtgtggct

SEQ ID NO: 6810283 - DNA, 76 bp, Homo sapiens
gtgaggtcattcattatagtaatttttagtgtgcttgccaaatgccaagggaaatcatatggtgcagtaatctcac

SEQ ID NO: 6810284 - DNA, 79 bp, Homo sapiens
cagtagctctgtgaccactagcacagctgccagtggaccccctggtcaccctgatgctggtggtccctgctagtcactg

SEQ ID NO: 6810285 - DNA, 72 bp, Homo sapiens
agcttaactgaaggcagatgtgattaatttcctcatcattgattgacattaactatattagccagttttgct

SEQ ID NO: 6810286 - DNA, 71 bp, Homo sapiens
ccgctgaagccggtgacatttcaccaaagctactccctttggaagcagctggtgcaaatgtcactcagcgg

SEQ ID NO: 6810287 - DNA, 55 bp, Homo sapiens
gtctgacacctagagtccaggatcagtgaactgatcttggttccgtgtgtttgat

SEQ ID NO: 6810288 - DNA, 60 bp, Homo sapiens
tacagctgctggtgctccatgctggcaggaatagaattattatggggcctcagcagggtg

SEQ ID NO: 6810289 - DNA, 58 bp, Homo sapiens
atgctaaatggccagtaccaaaggagggaaaagaactcctggggatgttctttagcat

SEQ ID NO: 6810290 - DNA, 73 bp, Homo sapiens
gctgcgcggcctctgtgaaatccgtgggagtcccagggggcacctcaaagcggtatgcagacggctctgcagc

SEQ ID NO: 6810291 - DNA, 72 bp, Homo sapiens
ccaggttcaagccattctcctgcctcagcctccggagtagctgggagtacaggaatgtgccaccacacctgg

SEQ ID NO: 6810292 - DNA, 68 bp, Homo sapiens
ggcagagtgctctgggcaggggctggggtccgggagtcagcccactcctctgcccagggcctcctgcc

SEQ ID NO: 6810293 - DNA, 60 bp, Homo sapiens
ttcttggcctctctcatcctaggctgtcttctttctatgccttgattagagaactaagga

SEQ ID NO: 6810294 - DNA, 78 bp, Homo sapiens
gaaacctagatatgtgctgggctgggtggcagtgccacagctgggcactttactccccaacataaatgtaggcatttc

SEQ ID NO: 6810295 - DNA, 79 bp, Homo sapiens
ggatggtgttcctgctgagcgtctgtcatttctacgggatgatttccaaagatggagctcctaggatgaggcaccctcc

SEQ ID NO: 6810296 - DNA, 57 bp, Homo sapiens
ctccacccagctccctggaaactgtcaaggataactctggcaggagctgggtaggag

SEQ ID NO: 6810297 - DNA, 66 bp, Homo sapiens
tttatcagagatatgtgtggacgtatgcatttagatagaaatattctactacataggtctggtaaa

SEQ ID NO: 6810298 - DNA, 58 bp, Homo sapiens
taaccatagccatcaattgtctgattttataatctatttactgtcatggctatggttg

SEQ ID NO: 6810299 - DNA, 65 bp, Homo sapiens
ctctgctctgctcctattcctgctcccctagctgggcccagcagaatctgggagcagcagtcaag

SEQ ID NO: 6810300 - DNA, 57 bp, Homo sapiens
tcagaagactactaggacacataatcctcttcaaatgtttcctaagtggtttgctga

SEQ ID NO: 6810301 - DNA, 57 bp, Homo sapiens
ttcagtccagcggccccaggcagggacaggtggcttccctgccagtcctggtctgaa

SEQ ID NO: 6810302 - DNA, 83 bp, Homo sapiens
tgagtcacctgtcctccattcagcattccattttcacactcttctagggagagtttgggtgggacagcttggaccaggtgtca

SEQ ID NO: 6810303 - DNA, 75 bp, Homo sapiens
gctgaaaggaagaagtatttttgtcctgttgtaatttttattcaaaagggactcaaaatacttttcaaattcagc

SEQ ID NO: 6810304 - DNA, 77 bp, Homo sapiens
ggatcttgttaaaatgccgattctgattctgtagatctagggtgagattcaagatcctgcatttgtagcaagtttcc

SEQ ID NO: 6810305 - DNA, 106 bp, Homo sapiens
tttggtgtacatcgtgtagctgcctttgtagatgtgtttttatctcagctgataatccgaaattgagatatcatgcatcaacagtagctttcaatttttatctgaa

SEQ ID NO: 6810306 - DNA, 65 bp, Homo sapiens
tttggcaggctgcttgggtcatgtctgctcttcagttggacatacctaaggcaggacctgaagaa

SEQ ID NO: 6810307 - DNA, 69 bp, Homo sapiens
caagagcatttagttagctggtctaggccttgctagttgggccagctcagttctcttgatcgtctcttg

SEQ ID NO: 6810308 - DNA, 75 bp, Homo sapiens
gaagggttgacacttgatttttataataaatggtctttgtattatgctgttaggaaaatcaaaatattgcccttt

SEQ ID NO: 6810309 - DNA, 67 bp, Homo sapiens
cttgaactcaatgtgaggaagaatgtagtactgtttgcaactcccttccgtcatttagttattcaag

SEQ ID NO: 6810310 - DNA, 63 bp, Homo sapiens
cagagagaggtgccgataatggttctgcagtgctcacagctaccttgttggtctctctctctg

SEQ ID NO: 6810311 - DNA, 71 bp, Homo sapiens
cttactttgtctctgtggtacgtttcatcccgaggctcttgggacagagggttgacagagtatggagggag

SEQ ID NO: 6810312 - DNA, 64 bp, Homo sapiens
gcacagatagaccttatgagatttgacttcaattctagtcaagttcataatttcttatttgtgt

SEQ ID NO: 6810313 - DNA, 69 bp, Homo sapiens
agagtcagtgcaagctggctaggaaggtgggggcagccacaaagtcctggtaggctatgtcatgtcttt

SEQ ID NO: 6810314 - DNA, 55 bp, Homo sapiens
cccatgattcaattgtctccatctggtaccttctacgacacaagggaattatggg

SEQ ID NO: 6810315 - DNA, 57 bp, Homo sapiens
agttgtgtctgactatctgagaaaggatgaatttacacattcagcagcagacacact

SEQ ID NO: 6810316 - DNA, 56 bp, Homo sapiens
tttctctcgaggtggagttttccagagcttgcgaaaatcttctgcctatgaagaaa

SEQ ID NO: 6810317 - DNA, 55 bp, Homo sapiens
ctttggaagccaggcagttcacacagttgatggttgtttctttaggcttctaagg

SEQ ID NO: 6810318 - DNA, 62 bp, Homo sapiens
gggcagtgagtttctgtgagccacagtctccccctctttctgtgctcctaccacttctgccc

SEQ ID NO: 6810319 - DNA, 83 bp, Homo sapiens
cctccacaactccgcctcccagcagtaaccagtggaaatggggcagcactctcagctctgctactctgtggggtgcagtgagg

SEQ ID NO: 6810320 - DNA, 88 bp, Homo sapiens
tcccggcgccatctcagagtccttccagcaggcatttattgaacacctaatgtgccttgctctctggggctgaagggaaggtatggga

SEQ ID NO: 6810321 - DNA, 118 bp, Homo sapiens
gtccaactgcagccttcctaaggtacctcttgagatcaagacacagggagaaggaacaacacacacactccctgctggatttagagagaactgagaggaggctgcggtttaactggac

SEQ ID NO: 6810322 - DNA, 81 bp, Homo sapiens
gtaccacattctaaaggacatgttttggtaaatgctgttttgctgaaagactgcaattatagcctgctttgaatgaggtgc

SEQ ID NO: 6810323 - DNA, 67 bp, Homo sapiens
tttactcatactttagaattttaaaatgtcatgtagtgtgatatatattcatgcagatgtgggtgaa

SEQ ID NO: 6810324 - DNA, 106 bp, Homo sapiens
agagagagagagtgtgtgtatttgtgtgactgtgtgtttgtgtgtgttgtgcatttacatagagtatcatactggatgcatcactttatatagttattttttctct

SEQ ID NO: 6810325 - DNA, 66 bp, Homo sapiens
ttaaaggctttgattccattgcccttttcctagatggggaagaaatggaaatccaagcaactttga

SEQ ID NO: 6810326 - DNA, 61 bp, Homo sapiens
gaggcagaaggctgaggagtgacttcctgagatcaccacctcatcaagctggattgtcctc

SEQ ID NO: 6810327 - DNA, 55 bp, Homo sapiens
ttccttgaggtattcagttttaaatgtttacatttaggctcagatacccagggaa

SEQ ID NO: 6810328 - DNA, 78 bp, Homo sapiens
taggttggtgcaaaagtaattgcggttttcacaattaagagtgatggcaaaaatcacaattacttttgcaccaaccta

SEQ ID NO: 6810329 - DNA, 61 bp, Homo sapiens
atgaatccattcctgccacagaatttgattgcgggcctactgtgtgctcggatggactcgt

SEQ ID NO: 6810330 - DNA, 60 bp, Homo sapiens
tatctggtctgtaaaatgggtgatgtaagggcctcatctactttaaggattctggggata

SEQ ID NO: 6810331 - DNA, 58 bp, Homo sapiens
ttcctgcccctgagagctcccagaccaagacgggagagtgaggcatcaggggcagggg

SEQ ID NO: 6810332 - DNA, 60 bp, Homo sapiens
acaattggaaagttcttaagggatactggcttttgctttgtcttgatattttccacttgt

SEQ ID NO: 6810333 - DNA, 91 bp, Homo sapiens
cttggctccttgccctgtgccttctcagcctcgaggcagacagtctgtgtcagaggtagagatggcacctacagaaggtaccagagctgag

SEQ ID NO: 6810334 - DNA, 74 bp, Homo sapiens
ggggctgtcctgtgctttacaggatcattagcaacattcccagattctactcacaagacaccagtggcagcccc

SEQ ID NO: 6810335 - DNA, 60 bp, Homo sapiens
tccattttctaagtatcacttatatacacaatgtattatcaggtgatccaggaaaacgga

SEQ ID NO: 6810336 - DNA, 71 bp, Homo sapiens
gtgtcaggccaactgcatggtgaccaagttaccctggttgatggtcgtgatgagccagtagttgccaatat

SEQ ID NO: 6810337 - DNA, 85 bp, Homo sapiens
gcctctgacttacaagctagggaagcttgggcacatcaccgagtctctctaagcctcagtttcctcagctgtaaaataaggaggc

SEQ ID NO: 6810338 - DNA, 130 bp, Homo sapiens
cagaggtgtctaccacagctggaaactcctgttcaaatttcttaggtcatgaccctccataaggttctggagcatgacagtcctgaagagaacggggaaggtttctatacacctagctgcttcatctcag

SEQ ID NO: 6810339 - DNA, 74 bp, Homo sapiens
atgatatgggaaaattttgtctctgaacagcttactaaatagttttagagcctctttagggacttccctgtgat

SEQ ID NO: 6810340 - DNA, 80 bp, Homo sapiens
tcacatcactgaaaggagggctcacaaaagtggtctgcaggcagtgcttactccaagcccgctttttacactgaaaatga

SEQ ID NO: 6810341 - DNA, 96 bp, Homo sapiens
gataatgtggggctttactttgggaggctgagttgagaggattacttgaaatcaggaattcaagaccagctgggcaacaaaatgaaaccccatgtc

SEQ ID NO: 6810342 - DNA, 58 bp, Homo sapiens
tttctagaaacatgacattgatctctttattcagagaggtaattgcaggtttctgaaa

SEQ ID NO: 6810343 - DNA, 56 bp, Homo sapiens
ggtgaggggcacctctgcccggccacccctactgggaagtgaggagcccctcagcc

SEQ ID NO: 6810344 - DNA, 82 bp, Homo sapiens
aggatgggggatgcacagggagggggccagctccattctgccttgagaggcctgtgctttcttccctcctgccaccccacct

SEQ ID NO: 6810345 - DNA, 62 bp, Homo sapiens
ccagtaatgtaaacacagagacagaacattgagatgtgcctagttctgtatttacagtttgg

SEQ ID NO: 6810346 - DNA, 67 bp, Homo sapiens
gtgccctctaaagaggtctcatgtgtcctgggctgtgcagccctaggcacactgggccctttaccac

SEQ ID NO: 6810347 - DNA, 97 bp, Homo sapiens
caaactctgatgcatagccagctaagggaagcatgattctagcaacaaattcctatccatgtatcttacttctcattagctgcacagtcagagggtg

SEQ ID NO: 6810348 - DNA, 67 bp, Homo sapiens
ctatatgatgttctggaaaaggcaattgagacaataaaattatcagtggtttccagggattaggtgg

SEQ ID NO: 6810349 - DNA, 77 bp, Homo sapiens
ggctatgtgtccagcatctttgatcttactggttttcagtctggttattgtaacagggactcgctggacataccgtc

SEQ ID NO: 6810350 - DNA, 81 bp, Homo sapiens
tcctctgttatattctcattcattaatctggtactatagtttataaacaacaagtgacagggaaaatgacactgctgagga

SEQ ID NO: 6810351 - DNA, 61 bp, Homo sapiens
ttcagagcccaaatggagattatctctcaattttgacatttatttgtattttggctttggg

SEQ ID NO: 6810352 - DNA, 55 bp, Homo sapiens
agattatcttctactgctggttttatcacagagaatagtagtaaaaagataatct

SEQ ID NO: 6810353 - DNA, 56 bp, Homo sapiens
ggcccagatcggaggggaggggcgctgctcccacccacccagaagatcctggcgcc

SEQ ID NO: 6810354 - DNA, 93 bp, Homo sapiens
tacatgtgtctttttctcctttttccacttgggacccattagttatcatggaaataatgattctggtgagaatgaggaataaagacataagta

SEQ ID NO: 6810355 - DNA, 67 bp, Homo sapiens
ggagatattttgagctgtttctctggtggctttttaaagtaaaaaagctagaggcatctctgtcttc

SEQ ID NO: 6810356 - DNA, 55 bp, Homo sapiens
cccaggctcagggcagactttcagtctggggctgaggtggccctgtgtgtctagg

SEQ ID NO: 6810357 - DNA, 74 bp, Homo sapiens
gtctcttcttctctgtatgggattcccttgtgaaatatttgggaactctatcatggaaagcatcgagaagagac

SEQ ID NO: 6810358 - DNA, 96 bp, Homo sapiens
ggcctagatagcctctcagcttttagaaccgagccttccgagatgcttggagagttctacctctgaaggcgagcgggcacaaagagtagtggggtc

SEQ ID NO: 6810359 - DNA, 56 bp, Homo sapiens
gctggctgtgttccttctgccatcttccattgattaaagcaggccacagggccagc

SEQ ID NO: 6810360 - DNA, 57 bp, Homo sapiens
gcttgtcacgtggcacgggaccttggtagagtgtcctagggatgccatcgtgtaagt

SEQ ID NO: 6810361 - DNA, 58 bp, Homo sapiens
gcagtagggcctggcccccaaaagcacaagccactaagctgtgtcccaggctcaacgc

SEQ ID NO: 6810362 - DNA, 71 bp, Homo sapiens
caattttaatttgggagcatgctgataataaaaagatgtgtgtgcatgcatgcatccacaagttaaaaatg

SEQ ID NO: 6810363 - DNA, 61 bp, Homo sapiens
aaggaatgaagaatctaggattccctgatcaatactataggcacttagaacatcattcctt

SEQ ID NO: 6810364 - DNA, 57 bp, Homo sapiens
gggaagctggtcacccacaggcctaccgttttccaggaacgagggtgcccatttccc

SEQ ID NO: 6810365 - DNA, 98 bp, Homo sapiens
gatattctatgccttgtgcttcagaacaggcagtcgaaagggaggaaagttggttttccttgagatgactgtcttgttccctcattggtttgggattc

SEQ ID NO: 6810366 - DNA, 55 bp, Homo sapiens
aaaggcatgctgctgaatgatgggtatggaactttttaaaaaagtacatgctttt

SEQ ID NO: 6810367 - DNA, 74 bp, Homo sapiens
ggatgcgggggtcttcaggtctagttggtatcactccacagaaatccattcatctgagggccaggcctgtttcc

SEQ ID NO: 6810368 - DNA, 112 bp, Homo sapiens
ggggtccatccatctgggctgtggtggaggggattttcattttgcatggattcaaaggaacattccagcagtaaggaaagtacattcaccaccactccaggttcaatccccc

SEQ ID NO: 6810369 - DNA, 57 bp, Homo sapiens
cactatctgccattcatttacttgtttgattctgtatacacatgtggcagtatagtg

SEQ ID NO: 6810370 - DNA, 130 bp, Homo sapiens
gacctcagtttctttatctgtaaaacggggataattatggcaccttattattgcgggtttctcatgtggcgtactggcatgtagtaggtgctataaaagcatttgctgttgtcaaaattagatgggggtc

SEQ ID NO: 6810371 - DNA, 60 bp, Homo sapiens
ggcttgggttgtcctctttctgttaaattcccagatttagcagaaaggctgccttctgcc

SEQ ID NO: 6810372 - DNA, 66 bp, Homo sapiens
caggtgggccgtaatctctgggtagctaaagcccagcagcagcccgaggatcatgtgtcaaccctg

SEQ ID NO: 6810373 - DNA, 76 bp, Homo sapiens
taggttggtgcaaaagtaattgtggttttcaccattaaaagaatggcaaaatcacgattacttttgcaccaaccta

SEQ ID NO: 6810374 - DNA, 89 bp, Homo sapiens
ttgcaaaggtgcttgaaatgactgaggcctgataacagttgtagagattcctagaggttaaaaaggattcagttaatagaccagtgcgg

SEQ ID NO: 6810375 - DNA, 86 bp, Homo sapiens
gccttgtcctgagtttctcacttggcttcaggaaggccccaggttggattccagaaaccagtgaagatgtggccacaggaggaggt

SEQ ID NO: 6810376 - DNA, 85 bp, Homo sapiens
cctaggagaggggcagtgcacccgggccctgggtgatggggggatcagggcccccaagaagaggtgccactcccgcttcgccggg

SEQ ID NO: 6810377 - DNA, 83 bp, Homo sapiens
gagagagagagagagagagagctaatattaagcttcaaaagtgataggctttagggtttagctttctctcccgactttctgtt

SEQ ID NO: 6810378 - DNA, 67 bp, Homo sapiens
tggtttcctatggcagaggagttattttctagcagaaaccatttattccttcttcctttagtaacca

SEQ ID NO: 6810379 - DNA, 78 bp, Homo sapiens
gcaaactgcctcatctgtggtcaaaatagaaacttctcagttgccttgattgacctagaaatgttttatgtaatttgc

SEQ ID NO: 6810380 - DNA, 90 bp, Homo sapiens
tgaaatgtgagggcatgagatttgggaggggtcaggggaggaatgatatgggttggctctgtccccacccaaatctcatctttaatttta

SEQ ID NO: 6810381 - DNA, 61 bp, Homo sapiens
caggcagaggcttttcatggctcttgtgggaaaaagagtccttgctgacaagtcctgcctg

SEQ ID NO: 6810382 - DNA, 81 bp, Homo sapiens
gtatcagttaggaacattaatgtgatttctaccaaaaggtgattactttccattaagtcacagtgatgtttcagatcttac

SEQ ID NO: 6810383 - DNA, 57 bp, Homo sapiens
cttgtctacctggctcctgagacagaaccagggcctctgagacccaggtggacacgg

SEQ ID NO: 6810384 - DNA, 59 bp, Homo sapiens
gatatcacagcagtggcctctttacaaaggcttaatgaaggaagtcctgctgtgctgtc

SEQ ID NO: 6810385 - DNA, 59 bp, Homo sapiens
agttcctgaaagatgagtaattaattgtgtgctgaactgattgctgaattttaggaact

SEQ ID NO: 6810386 - DNA, 84 bp, Homo sapiens
gcaactagtgcacgcttggcttatacagagaagacgctgaaaaaaaagtttattgtgtgaaagctcaagtggtcagcctggtgc

SEQ ID NO: 6810387 - DNA, 76 bp, Homo sapiens
ttgatatgctgctgcgcttgtctactgtttgtctgatattgacaattataaacagggcagtgcaaccagtatttga

SEQ ID NO: 6810388 - DNA, 104 bp, Homo sapiens
aggctcaattgctgcctttgtgtacagattgatcatggagaggggaggttttttcaagtggattttctaatgaaatctgtacagtagggacagaagttaagtct

SEQ ID NO: 6810389 - DNA, 102 bp, Homo sapiens
gccaacttgggagaaaggcaaagagacaagaattccaacgctggctacttgacagcacaatgtgactggagtctcttggctgacttgtattctctcactggt

SEQ ID NO: 6810390 - DNA, 93 bp, Homo sapiens
tttctgaaagtatcgacagatgacagtagcacttttaacttggagaagaagagcactttaagtgcattctgtcatcttggttacttactgaaa

SEQ ID NO: 6810391 - DNA, 66 bp, Homo sapiens
gtggctgcctggggaatgtgaggattgtcccaaagcacaatcactggctcctcacggcaaggccat

SEQ ID NO: 6810392 - DNA, 85 bp, Homo sapiens
ggctcactgcagcttctaactcctgggctcaagtgatcttcctgtcacatgagtctcccaagtagttggaacacaggtgccagcc

SEQ ID NO: 6810393 - DNA, 108 bp, Homo sapiens
atctagtttgaaagtcagccagctcctggtctgagctctaaaactaactccagatgaattgcccttacagtaatcagatccagcgtctctggctgatctctattagat

SEQ ID NO: 6810394 - DNA, 80 bp, Homo sapiens
aggaagcccttcagagggacattcaagggaaattttgaccacaccgtttttctccttaggtgttcacttgagacctccct

SEQ ID NO: 6810395 - DNA, 80 bp, Homo sapiens
ccactttttaaaatccttcaattagaaccaattgaccagagcccatgtgtaattgctaaatgaaggagaagggaacttgg

SEQ ID NO: 6810396 - DNA, 58 bp, Homo sapiens
gcagtccagatgtggtgtgattgggtctcctgctcgggttcttaaacgactgggctgt

SEQ ID NO: 6810397 - DNA, 107 bp, Homo sapiens
atttgaagatgtagcacagtttaaatgagtgactgcagtggctatttcaatctaccaggggaggtctttgcatcttatttattatggattatcttgcatctttaaat

SEQ ID NO: 6810398 - DNA, 56 bp, Homo sapiens
ctatgtgtcttgaaacaagactctgaggtgtaaatgtctttttcaagatcacatag

SEQ ID NO: 6810399 - DNA, 102 bp, Homo sapiens
ttggcagaagcactgcaaagccacaatgaaatcagttttaacttacattgaaggactttaattgttagattgtggtgtcattgcaagtgttaattcagtcaa

SEQ ID NO: 6810400 - DNA, 62 bp, Homo sapiens
tctccagggcccccgagcgttggctgaggaccagagccagccagtgagcggagcctgggaga

SEQ ID NO: 6810401 - DNA, 61 bp, Homo sapiens
tcatgtgaaattgctgacacttgaccatttttgacttacaaaaaatggcagtttcatatga

SEQ ID NO: 6810402 - DNA, 79 bp, Homo sapiens
gttgacctgggaagctatgatgacttttaaggagattttaaacctctgttcaaaaaggttttatgttttccacttcaac

SEQ ID NO: 6810403 - DNA, 58 bp, Homo sapiens
ctctctctcctgggtaaaagggttgattgccatccaggcacatccccatgagagagag

SEQ ID NO: 6810404 - DNA, 77 bp, Homo sapiens
catctagacacaatccattctgtagaatgcatctgaacaatttgtatagattgcatatggaatgtattgtaaagatg

SEQ ID NO: 6810405 - DNA, 61 bp, Homo sapiens
tggtagccactggggaagccagatctaggcatgtggcctgatggctcctgcggtggaacca

SEQ ID NO: 6810406 - DNA, 113 bp, Homo sapiens
gggtgaaggggcagaggtgagtgggagggaaggctgggggctggggagaacttcatgaccagagtgggccagctccctgcccctggggctgcctcccacgtgccccctcaccc

SEQ ID NO: 6810407 - DNA, 59 bp, Homo sapiens
gtctatactactatacagatgtaaatgaaatacatgtttactaagccagtggtatagat

SEQ ID NO: 6810408 - DNA, 87 bp, Homo sapiens
aggtgatccttagacttagaacaggcagaattccaaagagcatcaaagcatttggggaagtttggtttaagaagataaggactccct

SEQ ID NO: 6810409 - DNA, 56 bp, Homo sapiens
agtccatgctgtctacagaatcagtgtatatgggttccacataggacagttggact

SEQ ID NO: 6810410 - DNA, 55 bp, Homo sapiens
ttctaccaacattgaaagccggatgtcaccaagacatcatgcttgtgttggagaa

SEQ ID NO: 6810411 - DNA, 83 bp, Homo sapiens
agcttgtattcagatctaagagattcaaaagctctaattctagctgttgtgcaatttaaaatcttcctaggctgaaatgagct

SEQ ID NO: 6810412 - DNA, 75 bp, Homo sapiens
gtcccggagctgactggctgccttttcagtgtgcccccgccactggccagtgcctgccagtgcagctgatgagac

SEQ ID NO: 6810413 - DNA, 57 bp, Homo sapiens
gagttctgtgagccatcctagcaaattatcaaaccttaggaggggtcatgggaactc

SEQ ID NO: 6810414 - DNA, 62 bp, Homo sapiens
tcggggaggaaattggcttgacttgtctacttaccaagtcagggaaacaggttttcccttga

SEQ ID NO: 6810415 - DNA, 65 bp, Homo sapiens
atgtgctcatatgtgtgttagtgacatgtatgtgcacatgtctgggtatatgcatatgatcacgt

SEQ ID NO: 6810416 - DNA, 83 bp, Homo sapiens
ttcattgatgtggtttaatgtatattcctgtaatctttccctgttttataaacttacaatcataattgagccacattagagag

SEQ ID NO: 6810417 - DNA, 84 bp, Homo sapiens
cttcagtatgcgaaccacaagtggatatgtggacaaatattaatgtattcacctaaatgtagtttgtaatataataacttgaag

SEQ ID NO: 6810418 - DNA, 73 bp, Homo sapiens
gagtctggctgctttagaattgaaacagatggacttgagggtttctgtatctaattttacagtagcatatctc

SEQ ID NO: 6810419 - DNA, 77 bp, Homo sapiens
aggaaggatccagtggtttctccatgtaccaagtggatgccaatgaagactaaaccgccttgaaaagactccatcct

SEQ ID NO: 6810420 - DNA, 112 bp, Homo sapiens
ggaattcagatgagagtctttggaagagtgagggatgaagaactgcgggacaaatctgctgctgcgggacctcatcctatcctagggctcttccctgggactttctgacgcc

SEQ ID NO: 6810421 - DNA, 64 bp, Homo sapiens
gcttccatactaataaaacagaatgcccacttcctgcattttatatggcacattggttggaagt

SEQ ID NO: 6810422 - DNA, 56 bp, Homo sapiens
aagggggaggatattgagttgtccttgggattttctttaagtgattcctttccctt

SEQ ID NO: 6810423 - DNA, 56 bp, Homo sapiens
tttcacaggggcaacctccatgtggagacacatggtgattcagtgctgcctgggaa

SEQ ID NO: 6810424 - DNA, 56 bp, Homo sapiens
ccctgctgccccgggaggcccatggaagtggccaggctgggtccccagctgcaggg

SEQ ID NO: 6810425 - DNA, 56 bp, Homo sapiens
gacagggcgcccagcctgtttctggtgctgccagcctgccatgttcccgccctgtc

SEQ ID NO: 6810426 - DNA, 72 bp, Homo sapiens
gtgtcactttggctagttcattacatatgctttttgattgcagttagagcctttggagctgctattaggcac

SEQ ID NO: 6810427 - DNA, 55 bp, Homo sapiens
gagtgttcccacaccccagttgttaggacaaggtgctagggaagggggacacctc

SEQ ID NO: 6810428 - DNA, 71 bp, Homo sapiens
tctgccaggagccatgagcaagaatccagccaatcaccaccttctttgttgcttgccagttccctggcaga

SEQ ID NO: 6810429 - DNA, 68 bp, Homo sapiens
tgtggaatttctttcaggtatgtagtgggacatagctgtccacagtatagctaaaggaaatacccaca

SEQ ID NO: 6810430 - DNA, 61 bp, Homo sapiens
ccttacaagaaatttctgcatatatgcacaaagcatcatgttcaagaatattttgtagagg

SEQ ID NO: 6810431 - DNA, 66 bp, Homo sapiens
tcaggactcctggctttccctcttaggctaaaaatatctagctgaagaaaggatgacaggaactga

SEQ ID NO: 6810432 - DNA, 119 bp, Homo sapiens
ctgcagatcaagacttttaaagttcacttcctgacttgcagcagctctttgaatgttttccaagcttgcaagcatgctgttgtaaagtaaaagtgaagcttttaaagtttgcacagcag

SEQ ID NO: 6810433 - DNA, 78 bp, Homo sapiens
aataggtcacacatgataagaaagtttaaaccagagcacagaaaagcttgattttaaaattgtcgttgtgtatttatt

SEQ ID NO: 6810434 - DNA, 73 bp, Homo sapiens
gaaggattcacctgttagtaaaaatctgtagtttgacctacatgaaagatgacagctacgggatgaaaatttc

SEQ ID NO: 6810435 - DNA, 81 bp, Homo sapiens
aagctataggaaagatttgtcacatgaatgctccaataagagactttgggttatatgatgttcaaactcttccactagctt

SEQ ID NO: 6810436 - DNA, 76 bp, Homo sapiens
gaataatccctgctcagctcacctggcagctcttctctcaggttatgagtttcaggtgggctgggcgcggtggttc

SEQ ID NO: 6810437 - DNA, 90 bp, Homo sapiens
agcatcagactgatgacaatgttgggtatttacagtgacaacaagacttggtgtcatccaagagtttccagcaaggtcatgctgattgct

SEQ ID NO: 6810438 - DNA, 87 bp, Homo sapiens
aagatgaaagaagttcacagactggtcagtcaacttattttttgaaccatgtattagctgatggtcctgtcttaattcctttatctt

SEQ ID NO: 6810439 - DNA, 69 bp, Homo sapiens
caagtatttattgagcacctactatgtgtccagatactgttctgggcactgggaatgctgatgggcttg

SEQ ID NO: 6810440 - DNA, 58 bp, Homo sapiens
tgcaatagaagatttctggcttattgaaataccaattggcttccattttctgtttgta

SEQ ID NO: 6810441 - DNA, 72 bp, Homo sapiens
tacatacctccccacattcacttctctgtccacctgggccaggtgagaagccatttgaatgcgatatatgtg

SEQ ID NO: 6810442 - DNA, 67 bp, Homo sapiens
tctaggccacaaagagggctttgattctcagttccctaggagcgggaaggagctctctggtcggagg

SEQ ID NO: 6810443 - DNA, 77 bp, Homo sapiens
tcactgatgtggcagtgccgtttggttcaggacactgtcctttgtctccaggaccattgcaactgccccttcactga

SEQ ID NO: 6810444 - DNA, 79 bp, Homo sapiens
ggtaaatgacactaggctttttgcactctcaaaagtaattttttttccttggtgcagggacctgtcagtatcattaacc

SEQ ID NO: 6810445 - DNA, 58 bp, Homo sapiens
ttctctgatgttcttcattgtcatccacatggagtagagcaaatggacactcagggaa

SEQ ID NO: 6810446 - DNA, 58 bp, Homo sapiens
ctggggcatgggcccctagaggcagggactccgatccccactccccagctgcccccag

SEQ ID NO: 6810447 - DNA, 64 bp, Homo sapiens
tttgaagtgtatgaaaatacaggttgtctggggacgttgttctgatattttcatataggacaaa

SEQ ID NO: 6810448 - DNA, 68 bp, Homo sapiens
gatgaagctttgaagtctaatctatattcctttagccatggttttggaattagactttatgcattatc

SEQ ID NO: 6810449 - DNA, 60 bp, Homo sapiens
tcaagtgagatggctggtgaggtttggtggttgagaagtcatcagtccttttcattatga

SEQ ID NO: 6810450 - DNA, 66 bp, Homo sapiens
tcaaaggaagaacaaagctcagccagatgcccaaaatatggcttcattattgtttttcctccatga

SEQ ID NO: 6810451 - DNA, 55 bp, Homo sapiens
gggaaggtaggtaagatggggcaatttgataaattctgacttgatctattctccc

SEQ ID NO: 6810452 - DNA, 85 bp, Homo sapiens
gctcggaaccagcagccctgcagaagtgcccaggattttctttgtttaaaagcaagtcttcagggtctgctgagggtgtacgggt

SEQ ID NO: 6810453 - DNA, 91 bp, Homo sapiens
gtcggtgcagtggatacgctcgtggatgcgcagggcggccttgctggagcaggagtagctgcattccgagcacttctcaggatgctccgac

SEQ ID NO: 6810454 - DNA, 70 bp, Homo sapiens
cagggtcaaaaccttggggccagtcacacaatctactcagggtaggatgactggaacccaagtgagcttg

SEQ ID NO: 6810455 - DNA, 68 bp, Homo sapiens
ggtagcccactgaacttcagcaatcaccagtgcccagcacatggccagccctgaggttcagccctatc

SEQ ID NO: 6810456 - DNA, 57 bp, Homo sapiens
ccatggctaagtatctgtagaatcatttcctttctacaatgcaaacttggcccatgg

SEQ ID NO: 6810457 - DNA, 61 bp, Homo sapiens
ctgcaggtcatcggccagtgtcttcttcttggagaagccaatgatacgggtgatcttgcgg

SEQ ID NO: 6810458 - DNA, 59 bp, Homo sapiens
gccttggctgatgtgcgaatgaaagcagtcctcggctggtttatacaatagccagaagc

SEQ ID NO: 6810459 - DNA, 61 bp, Homo sapiens
ggtaccgagaacacagaagtagggccttgtcttcactcaagctgctgtgtgtgcctcagcc

SEQ ID NO: 6810460 - DNA, 57 bp, Homo sapiens
gggctggcatcggttgctgagaggtggaaggagtacctctctgcagcgtgttagctc

SEQ ID NO: 6810461 - DNA, 88 bp, Homo sapiens
agaggcagacatatgttgtaaacattccaatcgtgaggaatctcagagttttcttggaatgttaagacaaagcattctctcttcctct

SEQ ID NO: 6810462 - DNA, 66 bp, Homo sapiens
gccagctgaagggaagctcctggctgagccccagcaccctctgttggagcttctggtcagcctggc

SEQ ID NO: 6810463 - DNA, 72 bp, Homo sapiens
tagtcctgccccaggtggatggctcgcatagctccacaggctttgtgaacttgtctggctgggccagacctg

SEQ ID NO: 6810464 - DNA, 129 bp, Homo sapiens
acaaaataacccagccgtcctccactgcagcctctggggaccggggacacggcagttttatttgttgacttccaacttcagtcctgagcggtgggctttagaacgagcctggctgtcttttattcttgt

SEQ ID NO: 6810465 - DNA, 64 bp, Homo sapiens
ggggtcaaggcagcagggcctgtgggccccgataaggctccacagaggacaactgcctggcccc

SEQ ID NO: 6810466 - DNA, 66 bp, Homo sapiens
gaggctgttggctgatctgagtcattttctacataaaatgcaaacttggaagcagtgaacaacttt

SEQ ID NO: 6810467 - DNA, 85 bp, Homo sapiens
gagtttcagattccctttaagtagaatatattataaaaattgtgagaggcaaggatgaatattcagacaagggagtttaaaattc

SEQ ID NO: 6810468 - DNA, 61 bp, Homo sapiens
gtgtctgtttacttattggtaaagagtttgttacttaaagctctttatatagtaaagatat

SEQ ID NO: 6810469 - DNA, 60 bp, Homo sapiens
gccctcggcgctttgcgacactggcccctgtccccagaacccgcacagcctgccaggcgc

SEQ ID NO: 6810470 - DNA, 57 bp, Homo sapiens
tcatgcactatagtgtttgacacactcattctgtcaggtgaaatactgtaggcaaga

SEQ ID NO: 6810471 - DNA, 80 bp, Homo sapiens
aattgtaggacgtagataacttttgggtattcatggactttgtattctgtgttaaagctctaaagttttctctttcagtt

SEQ ID NO: 6810472 - DNA, 69 bp, Homo sapiens
gctactgaaatggtgtgctggagtccacttctaactgtgacttttcttcccagctccatgttcagtagc

SEQ ID NO: 6810473 - DNA, 88 bp, Homo sapiens
ttttatttcatattgactttagaacatagcaacagaattagttggtttgttgattcaagttttgtgttcttgtcactattgagtgaag

SEQ ID NO: 6810474 - DNA, 56 bp, Homo sapiens
aggagacacatcacactagcatctgagcaaaagcaggagctgggatgtggactctt

SEQ ID NO: 6810475 - DNA, 66 bp, Homo sapiens
ggaatttagatgtttctcaactcttttctcattctaggaactgataagtggggaattctgaggtcc

SEQ ID NO: 6810476 - DNA, 59 bp, Homo sapiens
ctagagggcagcagcaacaactctttacaaagggctctgaagcctgcatgccactccgg

SEQ ID NO: 6810477 - DNA, 62 bp, Homo sapiens
tggggacattcatgcaggttgttggcaggaggtctcagttcctgcatgtatgaacgtctcca

SEQ ID NO: 6810478 - DNA, 72 bp, Homo sapiens
tagagcaaggactgaagacctcctgtcagcggaatgtgtgtttggctgtggcctcttccagtaattgctctg

SEQ ID NO: 6810479 - DNA, 65 bp, Homo sapiens
agtatgtgtgtagacctttgcccatacattctcgtttgtctgaggttaatcctgctgcatctgct

SEQ ID NO: 6810480 - DNA, 64 bp, Homo sapiens
tagcatgctggttacgtgtagcatgctggttatgtgtagcatgctggttatgtgtggcatgctg

SEQ ID NO: 6810481 - DNA, 74 bp, Homo sapiens
aagttggtgaagctgtgcatttgtctattgcaatcattttgcagtacacacatatgtattcgtgttatgaattt

SEQ ID NO: 6810482 - DNA, 94 bp, Homo sapiens
ggaggcacctcattttaaaaataggttttgtaccagcagattcaccagagtgaaatttctaggtagagaagcttagtgactagtgcagtgtccc

SEQ ID NO: 6810483 - DNA, 80 bp, Homo sapiens
gctgactcatgctattccagaatgtaaattattccgcaggaaccaggttaaacactttggaagtggcgatgccagttggt

SEQ ID NO: 6810484 - DNA, 74 bp, Homo sapiens
actccctgcagggttgccatgccaaaaccaacaactccacggtgaacatggctggtcacaccactgcagggtgt

SEQ ID NO: 6810485 - DNA, 71 bp, Homo sapiens
agagaagcatgtcccttgtgattcaaaagaccaaatttcctcttttggaggataaggatattgatttctct

SEQ ID NO: 6810486 - DNA, 127 bp, Homo sapiens
ctgtggactccagtctgagaaatggttctcttgttagtgtgcatggatgcctcaactgggttcaggcatgaagactatgtttgaggcccctgaatgcacagcagagaaagctcaactgcagacacag

SEQ ID NO: 6810487 - DNA, 57 bp, Homo sapiens
aggtatcaacagcagagtctgaggaaggactgaaccccagaatgttcctggatgcct

SEQ ID NO: 6810488 - DNA, 64 bp, Homo sapiens
gcaataggcaatagtagatgctgggaaactgtaattccaggtgtgtgttttatggctttattgt

SEQ ID NO: 6810489 - DNA, 63 bp, Homo sapiens
ggctccagaaatcatagagcagagatcgcctctccctactctgctttgtccaagttctgggct

SEQ ID NO: 6810490 - DNA, 60 bp, Homo sapiens
agcctgtgtgaagccctcagagtatcattcatggttgcagcagggctactcacagaggtt

SEQ ID NO: 6810491 - DNA, 85 bp, Homo sapiens
ggataaagtctcacatatgtctctgtacaacagtctcgggctgtcattgtttaggcttgcagaatttatgtaatgatgaagatcc

SEQ ID NO: 6810492 - DNA, 73 bp, Homo sapiens
gcaggcttctcttaagtgtggcaggcagggaacaggctaactcaccctgtcttcatgcctgaaagaagaatgc

SEQ ID NO: 6810493 - DNA, 61 bp, Homo sapiens
ggccagtgattttcttttcttgtagcatccttatctggctttgatatgaacgttactggcc

SEQ ID NO: 6810494 - DNA, 77 bp, Homo sapiens
cctgatgcggtttatgggtgaccagtccaagccccggggcaaggatgagatggatctgctctatgaactgctgaagg

SEQ ID NO: 6810495 - DNA, 87 bp, Homo sapiens
catttaaaaaatcttagcattacaggctgaagaaaatcttggtatggtgattatctttagtgacagttgtgcaagaaaaattaaatg

SEQ ID NO: 6810496 - DNA, 57 bp, Homo sapiens
ggctgggctgcgggacgctgggcatgctgagaggccaccctggctctgagcccagcc

SEQ ID NO: 6810497 - DNA, 56 bp, Homo sapiens
gcctgtgaaagggaggatgagcggcgcggcacagccctccacacctgttcgcaggc

SEQ ID NO: 6810498 - DNA, 57 bp, Homo sapiens
ttgcgcctccctgtgccaggcattttgatcggtgctagtggtaaaggggatgggcaa

SEQ ID NO: 6810499 - DNA, 93 bp, Homo sapiens
ggatttaaggttgacctaatatggtttagtttaatgagttttggactcagggctttatttcactgtaccataaacactcaaattctaaaattc

SEQ ID NO: 6810500 - DNA, 67 bp, Homo sapiens
caaagtggaggctctggggccagggtcccggaaaacattaacaaggcccccagatgcttcttctgtg

SEQ ID NO: 6810501 - DNA, 79 bp, Homo sapiens
ccatccagtaagtgtgaggactgtgctaagtgccatgagaaactcaggacacactgcaagagcctggcacttactgagg

SEQ ID NO: 6810502 - DNA, 81 bp, Homo sapiens
gattctctggtgtgctgagtcaaggcagcgatcttccaagtgtggtcgctgtacctccatcagcacctcctgggacttgtc

SEQ ID NO: 6810503 - DNA, 100 bp, Homo sapiens
agctgtgtaagtggagggtgtaccactgtataagcaaaatgaaatataagaatgttctcaagtatgtacgtggcacaaacgtaacttcatatgcacaact

SEQ ID NO: 6810504 - DNA, 90 bp, Homo sapiens
cttatgcacctaccgtgtcatggttttcagagctactctgagctttctctgtccaggtgttcaagctggaggccacggaaggtgcgtagg

SEQ ID NO: 6810505 - DNA, 65 bp, Homo sapiens
gtcaagttctgggttctgggttattggggtgactgccctcaaactcctaatcacccatctttgat

SEQ ID NO: 6810506 - DNA, 56 bp, Homo sapiens
cagaggcagtggggttgctcctgttgtctgtgcagactggagttcctctgcctctg

SEQ ID NO: 6810507 - DNA, 79 bp, Homo sapiens
ggtcaacccctatgcctgtgcacaagactttagtctcacaaacctgagactgaaggaagcgggcaggggtagggggacc

SEQ ID NO: 6810508 - DNA, 61 bp, Homo sapiens
tggccttgagtggtctccgcccatccccacccctgccatgcctgttgccatctcaaggcca

SEQ ID NO: 6810509 - DNA, 117 bp, Homo sapiens
taaatttgcatttcagataaacaatgaataatgatttagtataagtgtgtgccatgcaaaattcaggacatacttagagtaaacaagtatttgttgttcatctgaaatttaaacttg

SEQ ID NO: 6810510 - DNA, 129 bp, Homo sapiens
ctctccctcctccagccccagcagccaggggcctggaggttggcggagggctgagcagcccagcttcctgcttcctggcctcacaagcaggcctctgtgaagttgccagggctccaggggcaggggctg

SEQ ID NO: 6810511 - DNA, 55 bp, Homo sapiens
gggcaggttattggagtagggagaacagaaactcgtcccatgtccatatcagccc

SEQ ID NO: 6810512 - DNA, 79 bp, Homo sapiens
gtgaatatgtgaataaacttgatctgattaccgatatcttttttaaaaagtctctttaggtattcatttacatgttcac

SEQ ID NO: 6810513 - DNA, 63 bp, Homo sapiens
ggtgcaaaaatctatcaccagcaacagaaggtgcagactgtgttggtggtggtaattttgtcc

SEQ ID NO: 6810514 - DNA, 124 bp, Homo sapiens
ggcaaaggggcagcccctctctgttgactggctctggttttctttcaagtggcatgcactaccccactctgttgcataccctgtgccagagaaaacaagcccgtggggccagacccctttttcc

SEQ ID NO: 6810515 - DNA, 68 bp, Homo sapiens
acccactttatgtaattgtagcaaaatgatgcagcctttgtgtaacatcgtgtttcattgctctgggt

SEQ ID NO: 6810516 - DNA, 88 bp, Homo sapiens
cagaggccaatttgtggtatctggcctaattctatagaaagttcctctcatgtagtgtttctcagatatttgcattccttgacttctg

SEQ ID NO: 6810517 - DNA, 129 bp, Homo sapiens
tggggctcattggtgattattgcaccaaatttctgagcctcattcatgaggcccctgaattcttttcttctcaggagcttctgaggaaggctcagccttgggtaaagtcagagtattccgtatcttcca

SEQ ID NO: 6810518 - DNA, 75 bp, Homo sapiens
gggtggctaagccctcaggtaaacaaagacactctcatcaggcgggactcttcaagggcctagaggtgaccgccc

SEQ ID NO: 6810519 - DNA, 102 bp, Homo sapiens
atagatgcagtgtgtttctgttttttccttatgcaatctgaaaataacttcatgaagccgagaaggaagatgtgaacagtcaagcatcctaatcacatttat

SEQ ID NO: 6810520 - DNA, 69 bp, Homo sapiens
ttagaggcatgattcagtaaagatgtgagatttcacctattcaagcacatgatctgaatttgcatctga

SEQ ID NO: 6810521 - DNA, 90 bp, Homo sapiens
tgtggaggcagccgagtcagattgcagacagggcttgaccttcaccaatggggtagccttgggcaatttggacactgggctgtttcttca

SEQ ID NO: 6810522 - DNA, 55 bp, Homo sapiens
cagctgggcctcctgagccctgggcaggacagggttagtgggccaggcccaggtg

SEQ ID NO: 6810523 - DNA, 83 bp, Homo sapiens
ctgagcctcgtaccctctgcagccctaagttgggactactcacacctccctccctctgagagtgctcagagggtacagctcag

SEQ ID NO: 6810524 - DNA, 85 bp, Homo sapiens
ctttattttcattaagctgaatcccaagtgaaatagtttcttttcccttacttactggaactttcattctgctttgaaaataagg

SEQ ID NO: 6810525 - DNA, 70 bp, Homo sapiens
tctgttgctttgattcttggcttatcagaatttctctgtatctgagctgaagtcaggagtcagcttcaga

SEQ ID NO: 6810526 - DNA, 92 bp, Homo sapiens
ggctggacatggcttatgggctacggtttgctgatccttgacttagatctaagctgcaaccttagctataggcttatttttgagttccagcc

SEQ ID NO: 6810527 - DNA, 85 bp, Homo sapiens
ggcatatggagatgaggtaacaagcctggataatctacaaactcctgagtccatgcttaaataccttaaagtgcgccatattgcc

SEQ ID NO: 6810528 - DNA, 62 bp, Homo sapiens
gtgcagagccatccaggtgcctgttgattttcattacagcagcaaggcctggaactctccat

SEQ ID NO: 6810529 - DNA, 84 bp, Homo sapiens
tctgtgtctggactgcaaaataaggatctttctattacactttctgtcctatttttcttgcagtccttttcagctggacgtgga

SEQ ID NO: 6810530 - DNA, 69 bp, Homo sapiens
ccagcagtcggatctgagcctgtacatggaagacatcacgtcattctcctgctcagagtccccctgcgg

SEQ ID NO: 6810531 - DNA, 76 bp, Homo sapiens
gctgcacacactgagcagtggtgaaaatctcttggcaacagaaaagatgtgagtggctgtacagtgtgtctgtagc

SEQ ID NO: 6810532 - DNA, 86 bp, Homo sapiens
ccctccctcaggggctgtgcatttcccagccatctctttgaagttaggctttttgggttggaggagtagtttgccttttggatggg

SEQ ID NO: 6810533 - DNA, 58 bp, Homo sapiens
gaggttgagggtggagacatctgctgtcttagaagtccagtcttggctctcaaccatc

SEQ ID NO: 6810534 - DNA, 59 bp, Homo sapiens
gccaccatcttcccatgccaacccccacagggtaaagagtttgggcaggaggaggtggc

SEQ ID NO: 6810535 - DNA, 71 bp, Homo sapiens
gcctaccagaatagaatgaaagaagggtttatttgatcctgtgttcaagtcattcatttattccactaggc

SEQ ID NO: 6810536 - DNA, 69 bp, Homo sapiens
atgtccattctcttcctagtgatgggctttgctacaggaggagggccaggataggagtgagatagacat

SEQ ID NO: 6810537 - DNA, 77 bp, Homo sapiens
tgaagtatattagtttactgcttgatctctgctcccctaaagcagagccaaatctaaagtgaatattgatgacttta

SEQ ID NO: 6810538 - DNA, 55 bp, Homo sapiens
gcagggagttggagaaggagtattttactcctttaaactcctttcaagtccctgt

SEQ ID NO: 6810539 - DNA, 58 bp, Homo sapiens
aggagctctcccatgctgcagataccgttctgaatctctgcagtttgtcaaggttcct

SEQ ID NO: 6810540 - DNA, 71 bp, Homo sapiens
cccaaactctcccactcactctgaggaacaagggttcacactgggagatgaagtgggcagtggagtcaggg

SEQ ID NO: 6810541 - DNA, 65 bp, Homo sapiens
ctccaggggcgtcaacttgtaaagaccacagtgtgaacaatctcttgaaggttgtgcccctgcag

SEQ ID NO: 6810542 - DNA, 78 bp, Homo sapiens
ggtgagaatatgtttaattatctgggttttgccatgacaggcagggccaggctcagctattaagaaacggttgtctcc

SEQ ID NO: 6810543 - DNA, 104 bp, Homo sapiens
tttcattctgcttttattttgcttgcctgttaggagaaacaaattaaggccaaagactttgtttccattgactcaagcaccaaatgacctgtttcaagatgaga

SEQ ID NO: 6810544 - DNA, 65 bp, Homo sapiens
tattttttgaacattttctatgttatagatatatttgtggatgctgagaatgttcatggtaaata

SEQ ID NO: 6810545 - DNA, 57 bp, Homo sapiens
atacaggccttggcaggcatgtgacagagaaggtttgttatatgcttaaggatgtgt

SEQ ID NO: 6810546 - DNA, 73 bp, Homo sapiens
gagtgtaatggtttgaggcaaattcaacatatttcttaaaaacttgttgagtctgcccaaattaagaacactt

SEQ ID NO: 6810547 - DNA, 55 bp, Homo sapiens
tttatagtgttaatttcctagggaaaagaattctccctgggtcttattctgtgaa

SEQ ID NO: 6810548 - DNA, 61 bp, Homo sapiens
actcctttggcagcatgttgagacctaaggacctccctcagaataatgtttctaaaggtgt

SEQ ID NO: 6810549 - DNA, 60 bp, Homo sapiens
agggcagaccacgtgcaaggatgctcaagaaggcaaactaagggagatgtgggctgtcct

SEQ ID NO: 6810550 - DNA, 67 bp, Homo sapiens
ctctgttaagtatcctttgctgtctgcctctcactgctaaaccagattaactggatgcttaaaaggg

SEQ ID NO: 6810551 - DNA, 75 bp, Homo sapiens
agacccccatgcaagaatggtaataatgtgactttaacttacattgaaatccaattatcatatgtttgtgggtct

SEQ ID NO: 6810552 - DNA, 85 bp, Homo sapiens
gacagggacgtggaaccagaggggccctgcctgggcgggtgtgtcctctgtgcgggtgggaggctctggaaggcccgcctctgtt

SEQ ID NO: 6810553 - DNA, 76 bp, Homo sapiens
gacagggtggtgatgagggcagttcttgttgctgtgggagtgcaaagcagggagcctacctcatcccaacaatgtc

SEQ ID NO: 6810554 - DNA, 69 bp, Homo sapiens
agctgataatcatgcatggctattatgaggcagaaggtgggaccttctgtcctttgctatcaatgagct

SEQ ID NO: 6810555 - DNA, 58 bp, Homo sapiens
gtccctaccgtttatctactaaactgggctttcctggagtgccaaaacggaaggtggc

SEQ ID NO: 6810556 - DNA, 61 bp, Homo sapiens
tttactttgaaacctaagatattgaggagttttaaatacatgtcctaggtttgaaggtaaa

SEQ ID NO: 6810557 - DNA, 63 bp, Homo sapiens
aacctttcagtggctaccgatgcttttgggacaaccaaaatcttcagcacagctgacaaggtt

SEQ ID NO: 6810558 - DNA, 65 bp, Homo sapiens
aaagcattgctggattttgggctttaataattctttatagatagactaatccagcaacttgtttt

SEQ ID NO: 6810559 - DNA, 62 bp, Homo sapiens
ggcagagagctctgctgctgcccaggctcaggagccagggatgttctcagagctttctttcc

SEQ ID NO: 6810560 - DNA, 77 bp, Homo sapiens
gcccctgtctttattacattttccacccttgtcatttgtgattaggccaacactgtgaagatgtattatggattggc

SEQ ID NO: 6810561 - DNA, 88 bp, Homo sapiens
ctgtgagggctgggtgggccaggcgtctaggccctggagccaggaagtccaggtaccgtccacgtctggccctgactcactcttttgg

SEQ ID NO: 6810562 - DNA, 130 bp, Homo sapiens
atacacctgtgtctgtgtgtgtgtatgcgtgagtgttctaaatgccattcgtttcatacacctgtgtctgtgtgtgtgtatgcgtgagtgttctaaatgccattcgtttcatacacctgtgtctgtgtgt

SEQ ID NO: 6810563 - DNA, 86 bp, Homo sapiens
gagtcttgctctgttgcccaggctggagtgcagaggcacgatctcggctcactgcaacctccacctcccgggttcaagcgattctc

SEQ ID NO: 6810564 - DNA, 61 bp, Homo sapiens
ttcttttcctacacagcgatttaaccctttactagggtaaaggatagttataggataagaa

SEQ ID NO: 6810565 - DNA, 66 bp, Homo sapiens
ctctcttctccctcccatgtctccatgcactctatgtaatgaggaaatagagggaatgaaggagag

SEQ ID NO: 6810566 - DNA, 58 bp, Homo sapiens
caggtcatgatctgaaagttgtcatggagcactttaagcaggaacaggtcatgatctg

SEQ ID NO: 6810567 - DNA, 103 bp, Homo sapiens
catttaaggaaatccaatagtcaaaaaaccccttttatagaagaacagagcttttctaggaaatctgctgatggaagaggggtagatcaggttttctaaaatg

SEQ ID NO: 6810568 - DNA, 92 bp, Homo sapiens
cctactctgaaggtttgttggtttgggtctccaaaagtcagtataagttgttgttaaatgaggccagactgaaaccaacacctcatatttgg

SEQ ID NO: 6810569 - DNA, 73 bp, Homo sapiens
ggagtgcagtggcaagatgactactcactgccacctccaacttctaggctcgagagatcctcttgccacctcc

SEQ ID NO: 6810570 - DNA, 83 bp, Homo sapiens
ggctttcaatttgatctgaaatagctactgcagagtccctgaggggtggtctgctctctgctatctcagacatagttgttgcc

SEQ ID NO: 6810571 - DNA, 58 bp, Homo sapiens
gcaggtgtgcagccctggaggaggcctatgggtattccagtgtgtgcagattaagtgc

SEQ ID NO: 6810572 - DNA, 99 bp, Homo sapiens
ggaatttgtattttatcctgaagttgacaaactttgcaaaacttacagttcttgaagactgaggtcatgcatagtttctactcccagaaaatgaattcc

SEQ ID NO: 6810573 - DNA, 61 bp, Homo sapiens
gccagaggactctgggcgtgtatggggagtaggtatccctgggtacgcagggctcctctgc

SEQ ID NO: 6810574 - DNA, 121 bp, Homo sapiens
gcagcagtgggagcggttcaccctggctttattctgttggccctctcatcctgtccctgccgcttagacaaggatcaaggatgggccaatgggatgcaaaggtagctgaacccacacctgc

SEQ ID NO: 6810575 - DNA, 58 bp, Homo sapiens
cctgagcagtttgcacaaaaaatgcatatgatgacattttgcctcttggctgcttagg

SEQ ID NO: 6810576 - DNA, 107 bp, Homo sapiens
atatgtgtgtttctgattttgtaatttgatactcattgtggtgctcagatgttaactgggtggattaggatagggtattttaatttggtggattgggatacatgtat

SEQ ID NO: 6810577 - DNA, 93 bp, Homo sapiens
actctaggtttctctccagcagtgggaaacatgaactatgtgatatttttaatatttttgagatccttttctattgtttcgagacttctgagt

SEQ ID NO: 6810578 - DNA, 82 bp, Homo sapiens
ggttccaagtctttgctactgtgaatagtgccacaataaacatacgtgtgcatgtgtctttatagtagcatgatttataatc

SEQ ID NO: 6810579 - DNA, 88 bp, Homo sapiens
gttgttacagagttggagctgagagccaggctggcttccaagtctgtgctcataaacacggtgccatcctggattcagaccaaacgac

SEQ ID NO: 6810580 - DNA, 73 bp, Homo sapiens
tctcccttcaattatctgccttgatgtctgatacagattagcacaggccttcaagcccaggaactgaaagaga

SEQ ID NO: 6810581 - DNA, 76 bp, Homo sapiens
gggaagagaggccaagatgatctttacagtgttttcaaactctgacagcagctttaagtcactggttactcatccc

SEQ ID NO: 6810582 - DNA, 72 bp, Homo sapiens
ctgagcacccgacagtgcctgtcatatggtaggcacttagcgaatatttggaggccactgttgagtgaatgg

SEQ ID NO: 6810583 - DNA, 75 bp, Homo sapiens
gcaaaattagagttctatttctaacatgttatctaatgctgatgggtgtatgtgaaatagaaatcttatgtatgc

SEQ ID NO: 6810584 - DNA, 68 bp, Homo sapiens
ggttgggggtgagaaggcaggggcactccagggactggcatcacccgagtgtctactcactcccaggc

SEQ ID NO: 6810585 - DNA, 75 bp, Homo sapiens
atcccaatcttcactggatctttgatttcatgtaagtccatcctgcttgaaattgtatctcaggagacttggggt

SEQ ID NO: 6810586 - DNA, 66 bp, Homo sapiens
tgaggtggtgcaggccagcaggggcgaggttcatttctcactgttggtcctgcaagttttacctta

SEQ ID NO: 6810587 - DNA, 63 bp, Homo sapiens
ggcagctttgacctgaaggcagcagttccaacccggtttgtattcctgggtcaaggagaggct

SEQ ID NO: 6810588 - DNA, 89 bp, Homo sapiens
gttaaaacggttgcatttcaaaagaaatagttgcatttactatatggtactgtaatatggttcttttgatcaccatattgtgatttaac

SEQ ID NO: 6810589 - DNA, 67 bp, Homo sapiens
tcgagcctgggctgcggtggtaggttgtagattcttcaacaggggctgttgcggtgctaggaggtga

SEQ ID NO: 6810590 - DNA, 58 bp, Homo sapiens
tggagtaattctggttttgatgttatctttgaaatgtcaaggaaggtctgttgctcca

SEQ ID NO: 6810591 - DNA, 74 bp, Homo sapiens
tttaaatttgcatgggggtcagagcagtgaaagatgttgtttatagtctcctgagccttgactgcaattttaga

SEQ ID NO: 6810592 - DNA, 65 bp, Homo sapiens
ccgctttttctgtgcctttcagatgtctctctctttcttgacatttcaagatatttaaaaggtgg

SEQ ID NO: 6810593 - DNA, 56 bp, Homo sapiens
aggtagagccactgtcagcatcatgattgaagtactggccagtgtggctctgatct

SEQ ID NO: 6810594 - DNA, 56 bp, Homo sapiens
gacagcagacaaaccatgttttactttgattcagttcagcggtggtgcctgctgtc

SEQ ID NO: 6810595 - DNA, 130 bp, Homo sapiens
agactcacaggtggggttaagcggagtgacgggaaggttaattctggatgcacagggaatctgaagatggaattgtgaaacattcatggatttgccccagtattccagccacccatgcctgtgtgggtct

SEQ ID NO: 6810596 - DNA, 58 bp, Homo sapiens
gtctgtccctcctccacctgtcccaccacacggggcaccactaagagcagggaccggc

SEQ ID NO: 6810597 - DNA, 69 bp, Homo sapiens
gccagagacctaagattgcaaactctctccaggctccttggggagagctccaatctttggagtcctggt

SEQ ID NO: 6810598 - DNA, 109 bp, Homo sapiens
tctttgcttgccaagaactttgtttccatatttgtagcagctaaataaggataagctcaggcatacagaaatggaactatattgctctcatttgtgtgctacttaaaga

SEQ ID NO: 6810599 - DNA, 58 bp, Homo sapiens
aacattgttttgcacaactcttcataaagaaagagttttaatggtgccagacactgtt

SEQ ID NO: 6810600 - DNA, 92 bp, Homo sapiens
gcaaaaaggagaggagattgtggcattttccacagcttcatttgttcctgggaaaaccatgtatctatttccttttctaacatttcacatgc

SEQ ID NO: 6810601 - DNA, 77 bp, Homo sapiens
ttcaaatataaccatgattaatctaagaaggcttaaaggccttctaatagaagatgattatttatggtttatatgaa

SEQ ID NO: 6810602 - DNA, 83 bp, Homo sapiens
acaatgaatgatgattagaagttatagaggtgcagattcatatccacacagataagtgttttctaacaaaccattatcattgt

SEQ ID NO: 6810603 - DNA, 92 bp, Homo sapiens
cacttacatctcccaatatatttcttgttattctcgttgagtactgcattcagacagaggttgccaataaagtttattgtaggagctaagtg

SEQ ID NO: 6810604 - DNA, 118 bp, Homo sapiens
cacatttatcacaaatactttcctgttctgttggctttttaaagttgtgttttattgtatttaatagtaataaagtttaaaagtcaatagtataaaggataaattatagacaaatgtg

SEQ ID NO: 6810605 - DNA, 60 bp, Homo sapiens
ggcggcccagtgtcccggtcgtggcaggcgccatctgcccgaccagcgcctgggtcagcc

SEQ ID NO: 6810606 - DNA, 55 bp, Homo sapiens
gtatccatgtgttcgcatcatttagcttccacttttaagtgagaacatgtggtat

SEQ ID NO: 6810607 - DNA, 59 bp, Homo sapiens
tgctggctgtgattttgccaacagagataaaattcgtgctggctgtgttattgccaaca

SEQ ID NO: 6810608 - DNA, 55 bp, Homo sapiens
gtgtcaaatccactcctcttttgaaatatatcaagggagaatggtattatggcat

SEQ ID NO: 6810609 - DNA, 122 bp, Homo sapiens
taggagttgggtagctaagagggctttgtgttttgtctctgggttcctactgctttgaagttaaaatggaaatttggcaagtgggaaattagtaaagtgctctaaatgcttttggcatcttg

SEQ ID NO: 6810610 - DNA, 73 bp, Homo sapiens
tgtcaatgtatatgaaaatatcctgctttagatggattaagtatgtgccagaatgtttttatacactttgata

SEQ ID NO: 6810611 - DNA, 66 bp, Homo sapiens
cacagctgcagcactccagtagccgcctccatctccacatggctcctccctgtgtgtgcgtctgtg

SEQ ID NO: 6810612 - DNA, 102 bp, Homo sapiens
gagatgatgccactccaggtacttgaagacgcactgactcgtttttgtctttgctgatgcgtgtacagtctatcttttttccatctcaagtctagccatctc

SEQ ID NO: 6810613 - DNA, 72 bp, Homo sapiens
taagttttgtctggtcaaatcacttgtaggtttctgtcttctaactgaaccctgactaataagcagaacttg

SEQ ID NO: 6810614 - DNA, 70 bp, Homo sapiens
cctccactcctcagccagcatcagggagaaagaagcttccagagtccatgttggctcaggaccaaggagg

SEQ ID NO: 6810615 - DNA, 101 bp, Homo sapiens
agatcttcaggtatagctggatccaggggcaagaatgctgtcagcaggcttctgctctggtgttctctgccttaactccattttcaagcagcttggagtct

SEQ ID NO: 6810616 - DNA, 59 bp, Homo sapiens
actaaatctgcagagtttagtgcagtttagtgtgctgccctaaatgccgcagttttagt

SEQ ID NO: 6810617 - DNA, 73 bp, Homo sapiens
atgtatattgataaaatgcagacatgtattaggtttaaataactttgacatgtctgcgttatatcaatatcat

SEQ ID NO: 6810618 - DNA, 88 bp, Homo sapiens
gagaactctgaagtcagttgagtgatcaaaatggcaccttctgttatttatagcagaaactgcttgtggtcatctgacattccttctc

SEQ ID NO: 6810619 - DNA, 97 bp, Homo sapiens
catcgtgcaccagttgctgaaaaatggcaacatggtatagtgagaagaacgtggcttccagaccagagatctgccactcagcactggtgcaatggtg

SEQ ID NO: 6810620 - DNA, 61 bp, Homo sapiens
acagattgggaactgtctcctttatgggaaagctctttatatttgggacaccccagtttgt

SEQ ID NO: 6810621 - DNA, 57 bp, Homo sapiens
agagcctgagcctgatcttgaaatccagtcagctgcattgggaagggcatgggctct

SEQ ID NO: 6810622 - DNA, 84 bp, Homo sapiens
tttatggaatgtattttagtttatgatatgaggtcctttttattccgtgtagtgaccaatattatgctaattatagtctttagg

SEQ ID NO: 6810623 - DNA, 61 bp, Homo sapiens
gtgttttacccatgttgagaataggcagacaatatgacatctgggcttgggtagaaatcac

SEQ ID NO: 6810624 - DNA, 123 bp, Homo sapiens
ttcaaacttgactatttggcagacattatctggaaaatgaacaaattaattctgtcacttccaagaaaataagtgacagtatttgttgccaatgatgaaactcaagctttcaagaattttgaa

SEQ ID NO: 6810625 - DNA, 64 bp, Homo sapiens
gtctgggaggaattacaaagtgatatgaccacgtcttgttaatctttgagtcttcatccctgac

SEQ ID NO: 6810626 - DNA, 108 bp, Homo sapiens
gctgggggacctggggtaatgcctctgttttcaggcatccctacagttaggtgtggccatatgcctaggttgccaatggaaggtgagaggcaatttcccacttctggc

SEQ ID NO: 6810627 - DNA, 65 bp, Homo sapiens
tactttgatcttcatttgttctgtatttattatcaattgaatatagggacagagaggatgaagta

SEQ ID NO: 6810628 - DNA, 86 bp, Homo sapiens
ttctgacacatcataccattcccaatttgctaatatgttccttttgaatatgctttagtgtcaagtttggggtggggtggacagaa

SEQ ID NO: 6810629 - DNA, 55 bp, Homo sapiens
aggctctgggctctagattttggggacacccctgccatcgtggaggttacagtct

SEQ ID NO: 6810630 - DNA, 81 bp, Homo sapiens
gaaagtaagtaggttatctaaggtaactccagaggattatgaacaatatcctgcttgttacttatagagatctcttcattc

SEQ ID NO: 6810631 - DNA, 56 bp, Homo sapiens
acccatgagctgcttgggatgcctcacatgcagaccaccccaactggcccatgggt

SEQ ID NO: 6810632 - DNA, 112 bp, Homo sapiens
ccagttcccacagactggctgaaatctgagcaagcaaggtccagtggaggccaaatgggaagggcctccacaggtggtgtttgcttctggggaaagtaatctggggagaagg

SEQ ID NO: 6810633 - DNA, 117 bp, Homo sapiens
gacagggattatgcaacaggtgagacttcatggccagattgacatgtaggtaaagttgttaccacatatgaggtgttattctatggggcctgacttaccttaacttgcttccccgtc

SEQ ID NO: 6810634 - DNA, 130 bp, Homo sapiens
gcttccagcggcagcactcctgtacttagaagtctggctgaagttttgcagagagtaaggaaaatcccatttgctccaggctgcagactctgagcagtttggctgctgagtctgggtcctgtcctggagc

SEQ ID NO: 6810635 - DNA, 64 bp, Homo sapiens
tcctcttcaaaaggatttcctttctccctattaatcaaggtcaggtatcttttgttggggagga

SEQ ID NO: 6810636 - DNA, 94 bp, Homo sapiens
ctgtggttgacaatcttctcatactgggcacagccattggccatggtgctgtccatgtgcaaggagtggctgttgttcctgaacagaaccacag

SEQ ID NO: 6810637 - DNA, 86 bp, Homo sapiens
cgggatagggatgtagtcctgtattgtggatgaggcaaagaagaattaaatttatccagaatcaggatttttcgtctggtatcctg

SEQ ID NO: 6810638 - DNA, 64 bp, Homo sapiens
aaggcttctccccagtatggattctctgatgtgtaatcaagtctgacctctgggtgaaggcctt

SEQ ID NO: 6810639 - DNA, 60 bp, Homo sapiens
taatttatgtagggaactcagctctgtgcctggcacataatgagctctttataaatgtta

SEQ ID NO: 6810640 - DNA, 76 bp, Homo sapiens
ggcacttggcctaatttctcagtgtgatcaggcctctgcagagagagttcttgccctagaaaatgaccacagtgcc

SEQ ID NO: 6810641 - DNA, 98 bp, Homo sapiens
aggggtgccttgggtggtggcaggaagaggagggtgaacttcagtgactctcccctgagcagttcccttcttttccagctgcccttagctggcccctt

SEQ ID NO: 6810642 - DNA, 73 bp, Homo sapiens
gccccaaagcaggctcccttctcggaattcttgcccagagagcccagttgtaccctgaagggagcctggttgc

SEQ ID NO: 6810643 - DNA, 63 bp, Homo sapiens
gtgaagaaagtgaacgtgttcagtttacatttgtaaggtagaccgtgcgttccctttttacac

SEQ ID NO: 6810644 - DNA, 73 bp, Homo sapiens
gaggacttcgggtgcttttagatatgtagcttctagccatattatctatttaaaagcatacatacccttcctc

SEQ ID NO: 6810645 - DNA, 71 bp, Homo sapiens
gcttggctccttctggaggccatagggaaggatcggtttcctggcttttccagcttctagaggcagcctgc

SEQ ID NO: 6810646 - DNA, 65 bp, Homo sapiens
ctggcatggggctttccaagcttaattagctcatgtttgtaaagttcttaggaagctcaggccag

SEQ ID NO: 6810647 - DNA, 96 bp, Homo sapiens
ccacatttgtctgtgtagagcttttactgctgtattgaatgagacaatcttttttaataagaaaagttcatcttactgctggtgacgagtaagtgg

SEQ ID NO: 6810648 - DNA, 101 bp, Homo sapiens
aagctttttcctgtgtttttctcagagatttatggaaaactgtcagaatcagtgattatgtaaaagtttctctagagtctttgaaaccatggaaaaggctt

SEQ ID NO: 6810649 - DNA, 113 bp, Homo sapiens
cagtcacctgggcacagtattcatcactgacgctgagattccaggccccgatagtccaatttagtgtcggagatgtgggtcccggcatcagtgaaaaaacatccccaggtttg

SEQ ID NO: 6810650 - DNA, 79 bp, Homo sapiens
cctctatatggtttccgtttatatggctttgtaaagaaagactttaccaaagatacataaatgtgatagcatagctagg

SEQ ID NO: 6810651 - DNA, 130 bp, Homo sapiens
agctcattagtggcctagttgctcagctggctcaggttcttgtttcaaacagacccctgcactgctgggcgtctttctggaaacaaacaaccctactgtagctttggggttccatggctttttgtgtttt

SEQ ID NO: 6810652 - DNA, 57 bp, Homo sapiens
ggagtgggaaagctgccttgtagatcccagagtttacaagtctgttgatcccaaact

SEQ ID NO: 6810653 - DNA, 83 bp, Homo sapiens
cttgaccaggcattaggaccaggcttggagataggggtcagtgatgggctcttgtactacttaggatctggagtctggtcagg

SEQ ID NO: 6810654 - DNA, 130 bp, Homo sapiens
tcacttttgttaaactgcttgtcacactttgtctttgtttttaagatgatagatctgtcaatgtgaaatgttccatattacagttctgtttctttaggacaaaaatgaaatccaagctatttctaaagga

SEQ ID NO: 6810655 - DNA, 86 bp, Homo sapiens
tgccggcaaacgctgctctgttaattgctgtaataaacagactttattatatccctttgcagtaaatggattatgttgtcagggta

SEQ ID NO: 6810656 - DNA, 58 bp, Homo sapiens
tgtgttcttgcccaggagtttggtttcttctctctgagctcctggcacagtggaacca

SEQ ID NO: 6810657 - DNA, 57 bp, Homo sapiens
tgcggatggattaggagagcccaaacaatgacctcggttttgccaaatccatttgca

SEQ ID NO: 6810658 - DNA, 62 bp, Homo sapiens
cagttaccagatcgcaggaggtggggccagcacgtccccctccagccaagccttggtagctg

SEQ ID NO: 6810659 - DNA, 60 bp, Homo sapiens
tgctacttccaggaatgctgaggcatggtctgcattcaacagtgttccggaagactggca

SEQ ID NO: 6810660 - DNA, 70 bp, Homo sapiens
gatgggataatatcaaatttcctatggtttagcaaacattgacaaataggggaaattaggattgctcatc

SEQ ID NO: 6810661 - DNA, 83 bp, Homo sapiens
ccatgaaataggctttggaagatcaagcaatgcacttaggcccagaaaaacattgttttggcttctagcttaagaactcatgg

SEQ ID NO: 6810662 - DNA, 81 bp, Homo sapiens
gatgaaaagtattttcaatgagttccactctgttgctttcattcttctaatggagtggtacttacttggctattctttatc

SEQ ID NO: 6810663 - DNA, 58 bp, Homo sapiens
aatgagataagcaggaatgtccaattaaacaaacccttgggcaaattgctatttcttt

SEQ ID NO: 6810664 - DNA, 62 bp, Homo sapiens
tggcttcaggcagaatttagacatagaataactctaatttgattattctgcattgagtgcta

SEQ ID NO: 6810665 - DNA, 84 bp, Homo sapiens
gccccaaccctgatatgaactgtgagtgtgatggggtagcacacagcaatgctgcattcgctcgcattgatagatggacgaggc

SEQ ID NO: 6810666 - DNA, 79 bp, Homo sapiens
cagagcacaagaccaatttgaattaaccagagcagaagtgacctctcattgaagcattttgtgtatttccttggttctg

SEQ ID NO: 6810667 - DNA, 56 bp, Homo sapiens
gtctagggctcctcagtgacaagcagggctgcctccgccgtactgtggagcaaggc

SEQ ID NO: 6810668 - DNA, 79 bp, Homo sapiens
tgccccaggttgcctgtcccaggtgcactgggcccaggccaggtttctttctgggatagggggcttgaggaagagggta

SEQ ID NO: 6810669 - DNA, 64 bp, Homo sapiens
gcctttttctgtttgcttcaagacattatttttcgaagatgaattgaggaaaacagtcgtaggc

SEQ ID NO: 6810670 - DNA, 92 bp, Homo sapiens
cagatgtcatatgatatgtcttaactctagaaaggtttattttctgtacaaagaatcagaaacttggagagataatcccatattggcatctg

SEQ ID NO: 6810671 - DNA, 61 bp, Homo sapiens
ttggaaattttgtgacacttcttgagacaccttgagtttctctgagttgttacaaaaccag

SEQ ID NO: 6810672 - DNA, 57 bp, Homo sapiens
tggggtgcggggccaggaaggaattcttctttaaaccttcttgaatacccaacccca

SEQ ID NO: 6810673 - DNA, 56 bp, Homo sapiens
ttggcagtgtctgcaaaatggaatatttaatacctatgaaatgcactcactgtcaa

SEQ ID NO: 6810674 - DNA, 76 bp, Homo sapiens
gcggccagagcccagggtcatgcaggatgagcctagagaggaaggcaggggcctggtgatcctggacttggactgc

SEQ ID NO: 6810675 - DNA, 70 bp, Homo sapiens
ctcattcttcatcactaccttgtgagttgggtttcattatcatgtccattttagagatgaagaaactgag

SEQ ID NO: 6810676 - DNA, 57 bp, Homo sapiens
ggacactttaggccaccatgcaaggttttcagacttagcatttcctccaaagtgtcc

SEQ ID NO: 6810677 - DNA, 124 bp, Homo sapiens
tacaaagagaataatatggcagtttgatggcgaatgtctaaacatagcttttattatataaagagaaaagttgaggctcttagaaatttggaaatcatatcgacttcaacacattttttttgta

SEQ ID NO: 6810678 - DNA, 102 bp, Homo sapiens
cgtgctttttttggtcttctagttttcccacaacagatctgtattaaacatcaaatttagtttagagaattggggatgattaattagcccagcagacttatg

SEQ ID NO: 6810679 - DNA, 81 bp, Homo sapiens
ccttgtaatttgttcccaagcagaatagatatgttcttatatttggatgctctaggtctgatggggcagaaaattacatgg

SEQ ID NO: 6810680 - DNA, 61 bp, Homo sapiens
aaagactgtgatccaaatggcctattttccagtgaatgccaacttggatatacatttcttt

SEQ ID NO: 6810681 - DNA, 97 bp, Homo sapiens
cacaggccaaagaaacaggccccagatggagtcccgtggagttctgccatctctttggctgagctgaattgctgccatttgcctgcatctgtcagtg

SEQ ID NO: 6810682 - DNA, 57 bp, Homo sapiens
cttccaaagcactttatggaccttgtatttggacaacacctccatgaagcttggaag

SEQ ID NO: 6810683 - DNA, 76 bp, Homo sapiens
gaacatacttatcttgcctttaactgctcatcttctgcaataggactgagctccctgagggcaggccttgtggctc

SEQ ID NO: 6810684 - DNA, 78 bp, Homo sapiens
tccttgtctccctggcttctgggtctgtgagagcaacctgaggctctcattttaccaaggtcggggactggatacgga

SEQ ID NO: 6810685 - DNA, 75 bp, Homo sapiens
ttaactgcacctctaggtccagcacggtgtagcttgacctatcttaagcacctcatgtggaccaggtatatttaa

SEQ ID NO: 6810686 - DNA, 70 bp, Homo sapiens
cgccatctccacatgcccacagcctctggtcattcatgagggctgataaatgcgcatggtggggtgggcg

SEQ ID NO: 6810687 - DNA, 77 bp, Homo sapiens
gaattatgtcttgcctggcagtctttattaatattggatcctgcagttataaagattgttatgtatctttatagttc

SEQ ID NO: 6810688 - DNA, 80 bp, Homo sapiens
ggaaaggcaggccagagtggctgagaggctgggagtaggggagcctgttctctcagcgatagtgatgggggtgcctttcc

SEQ ID NO: 6810689 - DNA, 74 bp, Homo sapiens
gccttaaagaactgaagctctagtcagggacacagataagttattcaatgattagagtttagtgtgataagtgt

SEQ ID NO: 6810690 - DNA, 67 bp, Homo sapiens
agggagatatgtcctgagacattgacaactccccaaagtcttgaatatgtctatgacatatttcctt

SEQ ID NO: 6810691 - DNA, 65 bp, Homo sapiens
ccgggcgctgcgcccccgcgcgctctgcctgctgagcggcgccggagggaggtgcggaggccggg

SEQ ID NO: 6810692 - DNA, 76 bp, Homo sapiens
ttttgatgttgttgatttggttttgctgtgggagttagtaagctatggggcaggcaccagctcagcaatattctga

SEQ ID NO: 6810693 - DNA, 70 bp, Homo sapiens
ttgctttctattagtgtggttaggatggatatttttggattccacttctattggtcatgataaaaagcaa

SEQ ID NO: 6810694 - DNA, 60 bp, Homo sapiens
tttaatactatggggatgaacatgtaagcaaatgcaactctatctccccataatgttgga

SEQ ID NO: 6810695 - DNA, 60 bp, Homo sapiens
ctcatgacatggacatgattgtatgttggttagcaacttacaactgtcagatgttttgag

SEQ ID NO: 6810696 - DNA, 78 bp, Homo sapiens
gcccatacagatggtggtcccacagcccacccgctagaataccagtgcctgggctgtggagcacctttgcagatgggc

SEQ ID NO: 6810697 - DNA, 90 bp, Homo sapiens
cagcagatgggtttggctgccttctatttagcttatccactagcacattcatggatgctgaattccagggccccactacccagccttctg

SEQ ID NO: 6810698 - DNA, 55 bp, Homo sapiens
gagccgtgccagccctgtctcgccatcccagccgaggagggcagcgcgatggctc

SEQ ID NO: 6810699 - DNA, 69 bp, Homo sapiens
tctacagcttcagtgtgccccagtgctgccctctctgccagcaggacctgggctcgaggaagctggagg

SEQ ID NO: 6810700 - DNA, 60 bp, Homo sapiens
ttttttgtgtgttcctgaaggcacgatataacgacagaagtttttaggaattccaagaga

SEQ ID NO: 6810701 - DNA, 108 bp, Homo sapiens
acaaatatttattgagcctactgtgagccaggcctgcatgcacaaaggtcggtgagaatattctagtacagggcttggctcataagtggatgctcaacagatatttgt

SEQ ID NO: 6810702 - DNA, 79 bp, Homo sapiens
taaaccaagcatttctagccagtcacattcaactgaaattgatacagtgtagtgatgatttagagtgcttcttagttta

SEQ ID NO: 6810703 - DNA, 70 bp, Homo sapiens
cccaagtgggtatatgtgtgtgtgtgcatgtgcatttgcatacatcacctatatattcacaaatattggg

SEQ ID NO: 6810704 - DNA, 57 bp, Homo sapiens
ctgtacatctctgaggacagtaccagagcccatgaggtcctcccttgaattgtgcag

SEQ ID NO: 6810705 - DNA, 80 bp, Homo sapiens
attatacacatacctcgtgtttgtattgcagcttcccccagggagctcaaagcactttgcaaatatgaattgcgaataat

SEQ ID NO: 6810706 - DNA, 73 bp, Homo sapiens
tattgtatttaagaagcttctgctaatgcctagcccaatgataggcattaaggatgagcttctcttgctgata

SEQ ID NO: 6810707 - DNA, 130 bp, Homo sapiens
atgctgagatgaatcagaaatttgcgccccaccccaccccggcttctattaggtcggtgcaaaagtaattgcatcaacctaatatcagctcatgggttagtggtgttcacaaccatctgatttctattgt

SEQ ID NO: 6810708 - DNA, 89 bp, Homo sapiens
ggagtgcctgtgaggggccagctgcctgttctgccagtttgcctagagggctgggacaggcttggccctgtggataaggttcaaactcc

SEQ ID NO: 6810709 - DNA, 60 bp, Homo sapiens
ggctgtggccaaacaccagtttaggatttttccttcctttctagttttgctgccacttcc

SEQ ID NO: 6810710 - DNA, 71 bp, Homo sapiens
ggagccaggctttctcctgactcacataaacatggcccaaatgtgcagctctagagccaagcctctgttcc

SEQ ID NO: 6810711 - DNA, 72 bp, Homo sapiens
cagacattgtgaaagttgccacaccagttgcaaggtgctggtcagagcaactgctcacaaatttcttgtttg

SEQ ID NO: 6810712 - DNA, 79 bp, Homo sapiens
cttcagagagtttgtgagtccttgaagcaaaaggaaaaattttgctgtgaagtgcaagcattcacgtgtgctcctggag

SEQ ID NO: 6810713 - DNA, 66 bp, Homo sapiens
ctagagccctttctccaggcacctgccacctaggggaggtttcctgggacagaagaggagctgtgg

SEQ ID NO: 6810714 - DNA, 90 bp, Homo sapiens
aatttgaaacaacgttttatcgtgtgctcttcccataaaaagagttgaaacaggttatgaagagcatatgaagagcatatgaaacaggtt

SEQ ID NO: 6810715 - DNA, 66 bp, Homo sapiens
gtgcttatagattttttgttagcagccctcatgtagttgttggttgtttataaaaatatctagcat

SEQ ID NO: 6810716 - DNA, 59 bp, Homo sapiens
gctgaacacatttctcctgcctccaggacagagcatcaggcatgaggaatcattgcagc

SEQ ID NO: 6810717 - DNA, 66 bp, Homo sapiens
ggtggcctcagctttttgtttacatagttttagtccttgctttgtaaaacaaaatttgtggagacc

SEQ ID NO: 6810718 - DNA, 72 bp, Homo sapiens
aatgacggttttagcacggtaacacataaagtcatttcctggcttgtgttttacatgtggctttctattatt

SEQ ID NO: 6810719 - DNA, 65 bp, Homo sapiens
aacttcatggagctggtatttttatgcccattttatggatgtgaaatctgaggcccatgatggtt

SEQ ID NO: 6810720 - DNA, 60 bp, Homo sapiens
gtcaatatcgccaagtgtctcttgaacttgctaacaagaagagaccagaggtgagttgac

SEQ ID NO: 6810721 - DNA, 79 bp, Homo sapiens
acacctaagaaacatttgagtggtaattacagaaaatatgcttttttctaagtgaacattcaagtttctgtttatgtgt

SEQ ID NO: 6810722 - DNA, 57 bp, Homo sapiens
gcactgagagctttattctagagaagacctggatcttcacagtgaaatctgcagtgc

SEQ ID NO: 6810723 - DNA, 59 bp, Homo sapiens
acccaggcgggagtgcagtgtcatgatctcggctcacctgcaacctctgcctcccgggt

SEQ ID NO: 6810724 - DNA, 68 bp, Homo sapiens
tagaataagcttttgattagaggaggagtgtgaagcacttcttctgagagaaaaagctcattatttta

SEQ ID NO: 6810725 - DNA, 59 bp, Homo sapiens
ggctattgctatcattctggtggtgacagttattaccatcgacggtagatagaatggcc

SEQ ID NO: 6810726 - DNA, 63 bp, Homo sapiens
gaagggacaccagaagacataagcagaaggaaggcttttgctcctggttctggtgtacttttc

SEQ ID NO: 6810727 - DNA, 126 bp, Homo sapiens
gcccctggagctatcacctccagatcctgctacttgtacctttgcagccccaggtagccagtggcaagggccaggggtggcagcagggctgggagtggagaagagtgtgagaaagtgctgcggggc

SEQ ID NO: 6810728 - DNA, 68 bp, Homo sapiens
gtgcatatgtatgtacttatgtgtgtgtatttttgcatttgtgttaacatgtgtacatatatatgtgc

SEQ ID NO: 6810729 - DNA, 65 bp, Homo sapiens
ttgaaagggtcatttcagttgcaattccagaggccttctggaatcagctttagtgtccttggcaa

SEQ ID NO: 6810730 - DNA, 66 bp, Homo sapiens
gacctcagccatggggtggatcagcccgtgggagagaccgagctgaagcccacgtggcttgtagtc

SEQ ID NO: 6810731 - DNA, 81 bp, Homo sapiens
ccagggcccaggcaggcaggggatgtgccagtggtccttgccacgggccaccagctttgccaccctgctccagggccctgg

SEQ ID NO: 6810732 - DNA, 78 bp, Homo sapiens
ggccccatttctctaaatggtctctttgttccctgctgggctgctcagtatcagatgtgattaaagggagatggggtt

SEQ ID NO: 6810733 - DNA, 87 bp, Homo sapiens
gccaagtacagaatcagagtgaaaactgagctcaaagcatattagttggttctgagtgatatatttactctttgttctacacttggc

SEQ ID NO: 6810734 - DNA, 64 bp, Homo sapiens
gtatagaacttttggaggctgcgggtgggctagtgtgagaatgtgaagcttccaaaggctgtat

SEQ ID NO: 6810735 - DNA, 56 bp, Homo sapiens
ggaattacagagttgttaagtcagcaaggtgctgagaaaacagtttgtaataatcc

SEQ ID NO: 6810736 - DNA, 55 bp, Homo sapiens
atcaatgcttgccaaatggaagagagcaagtcttaatttggcatgaagtattgat

SEQ ID NO: 6810737 - DNA, 61 bp, Homo sapiens
ggccagggagctcctaagtcttctcctatctttgaggctgagactctggggatctctgtcc

SEQ ID NO: 6810738 - DNA, 56 bp, Homo sapiens
gtatctttcaccagctcccaggtgattcttctgcatggatatggtgggaaagatgc

SEQ ID NO: 6810739 - DNA, 78 bp, Homo sapiens
ttagcttcagggtagggctgaggcaacaagggagtgggcttccttagcagccccaaagcctgggcctcctgaagctgg

SEQ ID NO: 6810740 - DNA, 57 bp, Homo sapiens
cagaactgacctctgattctaggactgacctctgaccctggaactgattcagttctg

SEQ ID NO: 6810741 - DNA, 81 bp, Homo sapiens
ctctttgccagttgcaactaagttgcccagtccctgggaggccccagggttcagtagcattagaggctcattggctttgag

SEQ ID NO: 6810742 - DNA, 116 bp, Homo sapiens
gttgcgggaaataggcgaagacggggcgcgcaagggagctgagcctgggtggaccgcgtcagggcgcggggagctcgaggcgcagcggctgcagctccggcctcagagcccgcggc

SEQ ID NO: 6810743 - DNA, 55 bp, Homo sapiens
ctgacagctgctgccgccgcatcccggatctccaaagtgcggcgggagcggccag

SEQ ID NO: 6810744 - DNA, 64 bp, Homo sapiens
atcaatgctctgtacccagaataatcccatttcggagggtgcatggatggggcagatgcatgat

SEQ ID NO: 6810745 - DNA, 60 bp, Homo sapiens
cccacagacctcaattatgtaagtaataaaccttttaatactctcttggggtgtgtgtgg

SEQ ID NO: 6810746 - DNA, 80 bp, Homo sapiens
ggcgaccgcggcaggttggggcggctgctcgctcgcgcgcagaacgcggcggtcagctgcgcccggcctgaagttgtccc

SEQ ID NO: 6810747 - DNA, 81 bp, Homo sapiens
ttgtgtgttttatggctgttacagctgggagagtagttaccaacagctgtctgttagctttagcaattatttagtctagga

SEQ ID NO: 6810748 - DNA, 65 bp, Homo sapiens
tcctattgaactataattatgatttgattttagatggtcaacttgtcgcattttggtcaatagga

SEQ ID NO: 6810749 - DNA, 66 bp, Homo sapiens
ggaaagtggtggtggaaagaggagtgaaatttacacatctctttcatgaaactaccccttaactcc

SEQ ID NO: 6810750 - DNA, 66 bp, Homo sapiens
gagagatttagaagcttgcttcaagttatatagccatgtaggacttgtttcaggtttgattgcctc

SEQ ID NO: 6810751 - DNA, 93 bp, Homo sapiens
agttattttgtagacgtgcatttttcatccctcttgggtaaatatttacaagtaggatttttgggtcatggataagtacgtgtatgtttaact

SEQ ID NO: 6810752 - DNA, 68 bp, Homo sapiens
ggaatgtgaatttatttggaataagagttttttgcagacaagttaaggctctccaaatgatataatcc

SEQ ID NO: 6810753 - DNA, 82 bp, Homo sapiens
ccaaggttgtcagctgcctttccagacattgataggcaccttgcctcttagggttaaatgtctgtagatgtgctgaacctgg

SEQ ID NO: 6810754 - DNA, 99 bp, Homo sapiens
gctggtacatgtgcttattcagccttttgggcaattcagtgggacctgacacatgttgtcatcctgccctggagaaggctgacagttggtggtgccagt

SEQ ID NO: 6810755 - DNA, 65 bp, Homo sapiens
gctctgcacatttgttattttgaggtacatcaccttggacttcaggatcaatatatgatgttagc

SEQ ID NO: 6810756 - DNA, 81 bp, Homo sapiens
tatcaggtcatctgtatgtcctcagcttgtttgccaccggcccacacccatagtcagctggagatcatgctgatactgata

SEQ ID NO: 6810757 - DNA, 90 bp, Homo sapiens
tcttccttcaattcttcttcaatattcagtggaaaagccattgcatgggaatgaacacaatggccattgacacaggaggatgaaggaagg

SEQ ID NO: 6810758 - DNA, 74 bp, Homo sapiens
ggctggggttgcagtcatattgaggctgcacagagcctggaggctccagcacccaatgtggctaagctctggct

SEQ ID NO: 6810759 - DNA, 64 bp, Homo sapiens
gggtggaggagaacaggccccatgatgctatcaatgtcccgggttctttttatctttctacgcc

SEQ ID NO: 6810760 - DNA, 89 bp, Homo sapiens
ctttgatgttgcctactgtacttttcttggctagattgtctactttttccttattaagcagcctggacaagtgcaaaacaatattagag

SEQ ID NO: 6810761 - DNA, 77 bp, Homo sapiens
acggtgaggtcatacaaggcactggtgatttatgtctcctggccttttatctccagcagtgcttttgagcccactgt

SEQ ID NO: 6810762 - DNA, 87 bp, Homo sapiens
ttctgtgggcacagccaaaggcacacatacctttctgcaattgtaagcaagactgggagtatgcctctgactcctgagcccacagaa

SEQ ID NO: 6810763 - DNA, 74 bp, Homo sapiens
taggtgccactagctccatttctgggaggaaaggattcaggtattgtccttttggaaatggaaatggtggtctg

SEQ ID NO: 6810764 - DNA, 69 bp, Homo sapiens
aggaatgcctggatttgggactcaaataatgtcattatgactcagtttgtctgtatctaaatccttcct

SEQ ID NO: 6810765 - DNA, 84 bp, Homo sapiens
tttaactctatattgctggtggctctgatttcatgatgcattgtgcttatgaaactctagctttcagcactaaaatgagttaaa

SEQ ID NO: 6810766 - DNA, 84 bp, Homo sapiens
gtcagttatgcagaagaatgagcttggagttggtccagagactagaaactcttgtatgttcaattcttggcattttcttttgac

SEQ ID NO: 6810767 - DNA, 87 bp, Homo sapiens
ggagcactcagcttggcctgccactgccacgccactctgccttttggtcaagtgagccctcacaatggcggtcagtgagcctgctct

SEQ ID NO: 6810768 - DNA, 58 bp, Homo sapiens
ggcagttgctgtggatgaggttataaagtatcacctcctttgattttacagcactgcc

SEQ ID NO: 6810769 - DNA, 73 bp, Homo sapiens
acgttggtggatatgatgttattataaatactactctatgtcaaaggctgttataacatcggttgactaatgt

SEQ ID NO: 6810770 - DNA, 69 bp, Homo sapiens
gcaagcctttccacaatgcaaatgtcatgctgaaaattttggcaattgctttagggaaaggtaagttgc

SEQ ID NO: 6810771 - DNA, 58 bp, Homo sapiens
tgagatggagtctcgctctgttgcccacgctggagtacagtggcgcgatctccgctca

SEQ ID NO: 6810772 - DNA, 91 bp, Homo sapiens
gcagcagaccttgtttaatgtttccctggcttccttccctctgttttcagtctctggggaggagtggaaaggaaggacaatctcatgctgc

SEQ ID NO: 6810773 - DNA, 71 bp, Homo sapiens
tctttaaggtaaagcatttcacacaaaaagtgaacattgatttccactgagtgaagactttgcctttaaga

SEQ ID NO: 6810774 - DNA, 92 bp, Homo sapiens
gggattgattggcacagatagatcaagtgtctcccactgacattgtaatggaggaggtagaagagaacttgaaatgtctattgttcaatctc

SEQ ID NO: 6810775 - DNA, 62 bp, Homo sapiens
gaattactagtgctgataaaggacagcttcttgaggagagaaggccttcagctctggttttc

SEQ ID NO: 6810776 - DNA, 59 bp, Homo sapiens
tctgtcactctagagatggcagcctagatgaggtgcttatattttaagaagtcgataga

SEQ ID NO: 6810777 - DNA, 56 bp, Homo sapiens
ttctccatatctgtgctgattcacctcacactagatcagtgcaattctatggggaa

SEQ ID NO: 6810778 - DNA, 119 bp, Homo sapiens
atcatttggttttgtgtgacttatccatgaaagccatctgtattaagtgaagcagcaactttgctttactttccgtggagatgaaagcttgaattatgtgtacacaattttagaatgat

SEQ ID NO: 6810779 - DNA, 57 bp, Homo sapiens
ggaacatttcctggcagagagggcatttctcccctcccctctcccagagcttgttcc

SEQ ID NO: 6810780 - DNA, 75 bp, Homo sapiens
gtttgggaggctagggagttcaagatcaaagcactggcagaatcactggtgaggtctgcttcctagtttgcagat

SEQ ID NO: 6810781 - DNA, 74 bp, Homo sapiens
gcagttttagtggatctggggcagggcctgagtgtctcagtttctgaaatgttccgaggtgatgctaatgctgc

SEQ ID NO: 6810782 - DNA, 88 bp, Homo sapiens
catcagggttgtttccatctgagagctgtgaagaagctgttccatgcctctctcctaatttcaggtgctttgctgaaaatccttggtg

SEQ ID NO: 6810783 - DNA, 74 bp, Homo sapiens
cctctttttctcttttctgtggctttcccaacttgccatggatgcagaggagaaggccaagaaggaagcagagg

SEQ ID NO: 6810784 - DNA, 55 bp, Homo sapiens
aatccactaatgaagaatgggctatagcaaagaatctgtttattagaagtggatt

SEQ ID NO: 6810785 - DNA, 64 bp, Homo sapiens
gcatgtagctctcaggtcttggactgcagggagcacaatttgccaagagcctcagctgccgtgc

SEQ ID NO: 6810786 - DNA, 130 bp, Homo sapiens
aaagtgaagccagctaaaagctttgtcagctcgctcttgaaagcaataatatggtcacaaaacttgctgtgaccattctgtctctttacaaattttgtaaggctggcctgcttttttcttccttctaaat

SEQ ID NO: 6810787 - DNA, 100 bp, Homo sapiens
ggagcttgttagaaatggaatttctccggctccaccctaaaccctgttcagtcagaacctttgaggttggagccaagaactctgtgttttaacaagctct

SEQ ID NO: 6810788 - DNA, 61 bp, Homo sapiens
ccctggctctggtaacattgggtagctccctagttgttggccttccctacctgggccaggg

SEQ ID NO: 6810789 - DNA, 70 bp, Homo sapiens
tatggagagtggatatgggagcaaagcagaagcatgatgtatctttctcccagccatcctctctatcata

SEQ ID NO: 6810790 - DNA, 69 bp, Homo sapiens
gtagtttagctttcatgaacctggtcgtccacaatggactgccaggattttgtaaagtccctaaattgc

SEQ ID NO: 6810791 - DNA, 63 bp, Homo sapiens
cagttctttggtcctaaccctgcaggtgccaactcccccaatcctgcaagtccagaagagctg

SEQ ID NO: 6810792 - DNA, 75 bp, Homo sapiens
ggctgaggctggaacaagggcgtggcggtcgcaggctccagggcacgacggtccttcctcttccccttctcagcc

SEQ ID NO: 6810793 - DNA, 130 bp, Homo sapiens
ttacatgatgtgcgacacttcatgaaatgattcttctattatcagatatttaagttatcaacagcattttgttgttataaatatgactgatgaaggtcttttgcagaaatgttataaacatgtctggtta

SEQ ID NO: 6810794 - DNA, 56 bp, Homo sapiens
gacctggctttgggccccggcagtagtcttcctgctgggcggaccttgggtaggtc

SEQ ID NO: 6810795 - DNA, 65 bp, Homo sapiens
gcaggaccatattactttggtgacagttcttatatatgaactattgcttagagcaatggggatgc

SEQ ID NO: 6810796 - DNA, 69 bp, Homo sapiens
cagctgtctagcccctttattttacagacgatctcctcgtctgaggcctagagaggggcttgatacttg

SEQ ID NO: 6810797 - DNA, 81 bp, Homo sapiens
tcaatgtgcagctataaacagggcctcagctgattctggagggagccctggagcagagatggccccttggagctgccatga

SEQ ID NO: 6810798 - DNA, 61 bp, Homo sapiens
ggtgtcagtttagttgaagaaagactaagtctaggtcatattctgtcattgaactgaggct

SEQ ID NO: 6810799 - DNA, 57 bp, Homo sapiens
ggcattaggtgaatgctcagcaaatgaatctgtgtgtgagcgtggaatcctgatggc

SEQ ID NO: 6810800 - DNA, 82 bp, Homo sapiens
tgtctgagtttttatacaggtgctctacagacaggacactcattcaagggggtcttgaaatgcgataggcatttttcaggca

SEQ ID NO: 6810801 - DNA, 78 bp, Homo sapiens
tgtgaataatgatgtgtattagttagtttaatgtcttccaagtgcatttcattttgaatgatatactcagatagcaca

SEQ ID NO: 6810802 - DNA, 76 bp, Homo sapiens
tcgcctgagccccagaggttgagtctgcagtgagctgtgaacatgccactgcacttcagcctgggtgacagagcga

SEQ ID NO: 6810803 - DNA, 58 bp, Homo sapiens
gagccatgaccagcagattctctttatgtcgcatgggccagaactgggtccatggctt

SEQ ID NO: 6810804 - DNA, 64 bp, Homo sapiens
ggggatggaggcgtgtggtcctcattcccctggtcatccccagaggcaccacatctccctcccc

SEQ ID NO: 6810805 - DNA, 89 bp, Homo sapiens
cgtttgcttccaatctttcgtttctcctgtctgcttcccacatgccacaagagaaggggactcagcaagggaacaaagatgagttaatg

SEQ ID NO: 6810806 - DNA, 67 bp, Homo sapiens
ccttccttcctgtcttccttactgatcttgggaaaggcctgcctagtgcgggaggatggaggtaggg

SEQ ID NO: 6810807 - DNA, 56 bp, Homo sapiens
ctgactgtaattctgttcttaattgctattcaaatgaggaaaggagggcaagtcag

SEQ ID NO: 6810808 - DNA, 79 bp, Homo sapiens
gggaaccctgaatgaggaaaagagtgaggttttctgaatagggcagttatcttcctttagttttcccttcttcagtccc

SEQ ID NO: 6810809 - DNA, 74 bp, Homo sapiens
atttagaattttgttagactaattgaatcagactattaataaaaagtcaaattcagtgtgacaacattgtaggt

SEQ ID NO: 6810810 - DNA, 71 bp, Homo sapiens
gctttgcgtctcataaactcagttttctcatccatagaataggtggttgggagggtttaatgtgacaaagc

SEQ ID NO: 6810811 - DNA, 74 bp, Homo sapiens
tatatggcacagctattttatttattcatgtatttatcaattaatttgggaatggaaatagcatgtgtcattta

SEQ ID NO: 6810812 - DNA, 123 bp, Homo sapiens
gagacactggcgttttgtgatgccaccatagaaacagcagctttcaggatcatcttggcaaggaagagacaggggatagaactgacagctgcctgtaaatgccaggctaggaatgtgtgtctc

SEQ ID NO: 6810813 - DNA, 70 bp, Homo sapiens
ctttattttattcagtctgttcagtctggcgtctccttagctattgactgcctttttgagcaaaatgaag

SEQ ID NO: 6810814 - DNA, 68 bp, Homo sapiens
tgtgagccagagttgaatgtgagtctctccaaaatagaggcagatacagtttagtctctggtaatcca

SEQ ID NO: 6810815 - DNA, 89 bp, Homo sapiens
ctcatggttttattactgacacaggggtataagagatgtttgaaaaaaggtcatcctttataagacttgtattcaggggtaaacctgag

SEQ ID NO: 6810816 - DNA, 78 bp, Homo sapiens
gatttgtctttctaggacttaccagaatttgtaaacttatttattccctaccatgtaagttctatgagaagagaaatc

SEQ ID NO: 6810817 - DNA, 62 bp, Homo sapiens
gggagatgtggggacaaaatgatggccatgtgcctgtgccgtcctctctccccacctctccc

SEQ ID NO: 6810818 - DNA, 79 bp, Homo sapiens
gatgacatttaattggatggtttaagttgtaggaccccaaaagatgggcttcacaatggcaaaccattaaatggtcatc

SEQ ID NO: 6810819 - DNA, 64 bp, Homo sapiens
acagcagccagccactgtgagcatcttgcctgcgctctgctccgtggtgtgttgcccctgctgt

SEQ ID NO: 6810820 - DNA, 62 bp, Homo sapiens
gaaagagaacctgggcctagatgctaatggaaactatcccatgctttctcagactctctttc

SEQ ID NO: 6810821 - DNA, 62 bp, Homo sapiens
agttaataatggaaagacacatgacatatctaccacagattattgtgtcagtccattcagct

SEQ ID NO: 6810822 - DNA, 88 bp, Homo sapiens
ttgagtgccctgttgtccatcttcttggtgtagcattcgattcctaaaggttgaaggctaccatgggggtggactcagggtcatttgg

SEQ ID NO: 6810823 - DNA, 55 bp, Homo sapiens
gtggcagctcatgttgttttaataatcacaaattgcaagccaccactgctgccac

SEQ ID NO: 6810824 - DNA, 66 bp, Homo sapiens
ctgattggcatggctcacagccctgtccccaagccctccccagacagagcagtccttgtcaatcag

SEQ ID NO: 6810825 - DNA, 56 bp, Homo sapiens
ttcctggcctctctctgagcagttccagatagggttgctctccaggggtccgggga

SEQ ID NO: 6810826 - DNA, 77 bp, Homo sapiens
tttgtttttgtttgagatgggttattgctctttcgcccaggctggagtgcactggcaccatctcagctcattgcaaa

SEQ ID NO: 6810827 - DNA, 83 bp, Homo sapiens
gccatatcatggcactgagggaatttctgtgcgttagtctttggcaattaaaccttatgctgttccccagtgctgtgagtggc

SEQ ID NO: 6810828 - DNA, 76 bp, Homo sapiens
gggaataagttgctcttggctctcattttattatagcagatgcagcaatgaaatgtaagtagagagttttattgct

SEQ ID NO: 6810829 - DNA, 85 bp, Homo sapiens
gagtaatgcaattaccatccttggctcgctctctgtgggatgttctcacagatcagtggcaaagggttggtaggctattttcctc

SEQ ID NO: 6810830 - DNA, 56 bp, Homo sapiens
gcacttagggtatgtactgggcacgtcactgcctaggtacttcctcccctaaatgt

SEQ ID NO: 6810831 - DNA, 107 bp, Homo sapiens
aaggggccgatttagctggtaggactggcagaacgtgatgcgggtgtggcagaacttgggctggaacgtcttgcacatcttcactgttagacttgagctagttcctt

SEQ ID NO: 6810832 - DNA, 91 bp, Homo sapiens
gactgaggtccaggctgacccctagaggacatgccccagcacagtttgggccaaacctttccctagggtctcaacgtcggacaaaccagtc

SEQ ID NO: 6810833 - DNA, 60 bp, Homo sapiens
tgttgaggtgtctacatcttcagtgcagtctttatctgcctctgagagatgcttcacaca

SEQ ID NO: 6810834 - DNA, 86 bp, Homo sapiens
tgacaatgatttcccctacacagaagaaacagaagaaaccatttttttatgacctgaagcttctgttgcagtatgaaatcatgtta

SEQ ID NO: 6810835 - DNA, 66 bp, Homo sapiens
gtgtgccaagagatagttgctgccaatgccaacggcagctatttactgagtgtctctcctgtatat

SEQ ID NO: 6810836 - DNA, 128 bp, Homo sapiens
gatccaccttgttaatctgcatacgacattctttcacacctgcaaggagctttcatttcacatttgcaaggtgaaggtgaggcccttgcaggggatggggatgggtagagcagtgtctgaggtaggtt

SEQ ID NO: 6810837 - DNA, 83 bp, Homo sapiens
cctctctgtcagccgtgctagtaggagacctagctctttggaatacaagctcagggctgcttacctggaatggctactggagg

SEQ ID NO: 6810838 - DNA, 61 bp, Homo sapiens
aggtaactagcattagcttctggacttctttgtgccagggctgtgttaggtgcggttacct

SEQ ID NO: 6810839 - DNA, 64 bp, Homo sapiens
tgacattcacaggtaaacattccatcaatcagggtatctgaggagagttagacctgtgttgtca

SEQ ID NO: 6810840 - DNA, 66 bp, Homo sapiens
ttaaaggctatgatattattgagacaagcataaaaatgagtgtcttcttcattcatcggtttttaa

SEQ ID NO: 6810841 - DNA, 59 bp, Homo sapiens
gcttcagcatttcttttctcttctcattctctgtaggaagagtctgagtgtgcaagggc

SEQ ID NO: 6810842 - DNA, 92 bp, Homo sapiens
ggattcaaaatatagattatttaaatttgtttataggtctttatcagtttatgcttattcagcaagtttgggtacttctgttgctatgatcc

SEQ ID NO: 6810843 - DNA, 69 bp, Homo sapiens
ttacctcaatttttattgcttttttgcttagaaaaactatgtagaagatgccttaaagttgaaaggtaa

SEQ ID NO: 6810844 - DNA, 75 bp, Homo sapiens
ggtccagtcacttcattttacagatggggactctaagccccagagatttgtctacatgatgtgattatatgggcc

SEQ ID NO: 6810845 - DNA, 69 bp, Homo sapiens
agaagtggacactctcttcctctcttcacgtcccagagttctgaagcagtggacctcagtgctatttct

SEQ ID NO: 6810846 - DNA, 86 bp, Homo sapiens
agtcagagaggagctgagagatgactgatgttgaggtcaagtcatccttctgttctcacagccatttctccctctctttcctgact

SEQ ID NO: 6810847 - DNA, 85 bp, Homo sapiens
gattctgctttgctggtacccaagcatgtccagtgtgcccacggggtgctgggcactgtctctggggaagcagcaaaccagactc

SEQ ID NO: 6810848 - DNA, 69 bp, Homo sapiens
tctgtttatgacggagctggttgctgcggctgccaggtgctggcagtcggaagctgtgcgtaaatcagg

SEQ ID NO: 6810849 - DNA, 57 bp, Homo sapiens
ctgtcaatttatgttgacatgcagtaaaattgaaaatcaggtcaatattgttgacag

SEQ ID NO: 6810850 - DNA, 96 bp, Homo sapiens
actggaacatagtaatgtaagtggcagagtttgttctataggcctattaatgttgtttataggtccactgcaatttgccaaatatattataccagt

SEQ ID NO: 6810851 - DNA, 70 bp, Homo sapiens
tgcggcctactgtcatgtgatgtgagttcctggagggcaggagttctgacctacatgcagcaggcacgca

SEQ ID NO: 6810852 - DNA, 58 bp, Homo sapiens
aaaattattaccttgggaggttgtgttcattagaacattctcatttggtgatcatttt

SEQ ID NO: 6810853 - DNA, 62 bp, Homo sapiens
gcctgactcctatccatgttctttgcccctgcggccagagccacagtggataggagccgtgt

SEQ ID NO: 6810854 - DNA, 83 bp, Homo sapiens
tggaaacgtctgctacaagtagctgcctagcatggctttccttcttgggagaagccagcttcagctgcccgtgggcgtgtgcg

SEQ ID NO: 6810855 - DNA, 99 bp, Homo sapiens
cctctgctgtgggtgcttgcttctcacatgcacctgagccacactgctgccccgtgctggcagaggtgcatgatgcagagtgcagcctccagagatagg

SEQ ID NO: 6810856 - DNA, 70 bp, Homo sapiens
tctcattgtggaaatgaatgcatgtggatagctgtggtatccattaatgattatttctgtgccatgtaga

SEQ ID NO: 6810857 - DNA, 56 bp, Homo sapiens
actgtttcactctttaagaattgcctatgtaattcaattttgcagaggaatgcagt

SEQ ID NO: 6810858 - DNA, 128 bp, Homo sapiens
atgagctctggggtgttctgtaatggaaagagatggaaggcaatggcaagagaaagcacctactctgtgctacttttacatatgctattgtatttaatcctcaaaacaagccaaagatgtgggtacat

SEQ ID NO: 6810859 - DNA, 81 bp, Homo sapiens
ctccacaacattcactgtctgtacccaagactgtcatgcctaccaactctaagttttatatgacagcagggatttttggag

SEQ ID NO: 6810860 - DNA, 82 bp, Homo sapiens
gttgagttcaaaccctttttcactctaccaaggtccatctcatgggactttggtcttagaggaggaataaaaagagaacaac

SEQ ID NO: 6810861 - DNA, 59 bp, Homo sapiens
gcatgcctgcctggtgggcgtggcctggaagcccgggtagcaccggcagtggtaggtgc

SEQ ID NO: 6810862 - DNA, 101 bp, Homo sapiens
aggcttctaccacagacgccgaaagaggcagatctgcctgcagcagggtacaaccagagcaggcagggactttgcaaatctttctggccggtgaaaagttt

SEQ ID NO: 6810863 - DNA, 71 bp, Homo sapiens
gtgacccgtatggaaatgtctccttctggagggaacccagaggaaaaatatctccctattccaagggtcac

SEQ ID NO: 6810864 - DNA, 79 bp, Homo sapiens
gtaagaaaaataaatgtccagagtaaagcacattcttatttcagtaaagggttgtgtgaagctatggcatttttcttac

SEQ ID NO: 6810865 - DNA, 84 bp, Homo sapiens
gttctcctctgcctcgcttacttcctaccactctctcctcacccagaagagtgtatgaacttaagagagagctcttctcagaac

SEQ ID NO: 6810866 - DNA, 129 bp, Homo sapiens
accttcaatgcagtatgctggtctttaggaatgaaaatggccatagaccttgtgcatggcaacatgcatgtgctggacttttgctggtctatttttactttcttttgacctgcctcgaactgatgaaat

SEQ ID NO: 6810867 - DNA, 75 bp, Homo sapiens
ctgagcacttgaaatgtggctagtccaattaatgaattgtccaggatcagtttttaaagccacacagggctacgg

SEQ ID NO: 6810868 - DNA, 64 bp, Homo sapiens
gaagcacatggctatagctattgccgatgatctgtaacgttgtttatagctcaggccatgcttc

SEQ ID NO: 6810869 - DNA, 67 bp, Homo sapiens
acttactataggtaggtggaaaagtaatggcaaaaacctattatgttgcaccaacctaataataagt

SEQ ID NO: 6810870 - DNA, 66 bp, Homo sapiens
caaaattgatgaatgtatgatttgaaaagaaacctcaaacttaagattatgcaagcatcaatattg

SEQ ID NO: 6810871 - DNA, 62 bp, Homo sapiens
tctgctgtacttttggtctgttttccttggttaaaaaaggctgtatcaaaagtagtggcaga

SEQ ID NO: 6810872 - DNA, 62 bp, Homo sapiens
cttcacacccactaggatggctataataaaaaagtcaaacaaatgttggtgcggatgtggag

SEQ ID NO: 6810873 - DNA, 94 bp, Homo sapiens
ggaaataagtaggctctgaatctggggggaaaatagttgtcaagaaccaaatatttggcttcctgtttcccagaaagtgtttgctgctgtttcc

SEQ ID NO: 6810874 - DNA, 96 bp, Homo sapiens
gggacaggcaaagaggaagagagctctgccttgtcctgtctcctctgcttgtgacttggacaaggcagagcgcttttcaggaggttgcatggtccc

SEQ ID NO: 6810875 - DNA, 130 bp, Homo sapiens
tgagggataaaattatttcttaaattgaaggaaaatttatcacttaaggtaattgttgctgaaattgttttatagttttagttgaaattgcttgttaataattcctggcatttattcaattcatctttca

SEQ ID NO: 6810876 - DNA, 60 bp, Homo sapiens
aggcagcagcgttgggtttttaggggttcagtctttcctcagagcatagcgctgtctcct

SEQ ID NO: 6810877 - DNA, 68 bp, Homo sapiens
tggaaaacaggtctctcagacccaccctgccaagacccagggtggctcagtgtcaggccctgcgtcca

SEQ ID NO: 6810878 - DNA, 55 bp, Homo sapiens
ctgaggcacagtgaacttctcctgccaggtagggagaggcccacaggagcttcag

SEQ ID NO: 6810879 - DNA, 61 bp, Homo sapiens
ggagagaattccatggacatgtgctaatgtttttgttagtctcctccatacaattctctct

SEQ ID NO: 6810880 - DNA, 70 bp, Homo sapiens
tcaagcttgtttctcctgggggtgctcttccaaggatatttgggctgcctccggagttgcagtgtcttgg

SEQ ID NO: 6810881 - DNA, 66 bp, Homo sapiens
aacctgtcaattatgccattgcaatatttcagaagctttaactgaagtgtcatatagtgtcaggtt

SEQ ID NO: 6810882 - DNA, 86 bp, Homo sapiens
agtgtatcttagcagacttggctactgttccactgtgattgagttatgaagcatgtacagctagcaaggtttctgtaggtaaaact

SEQ ID NO: 6810883 - DNA, 65 bp, Homo sapiens
ttttaacttcccttcctcactctacttgtttttcttacaatggggggaggaagggataggaaaaa

SEQ ID NO: 6810884 - DNA, 66 bp, Homo sapiens
gtcaatatggttataagagcctttcagagcaaaacttaaaacctcagggctaggtagccatttggc

SEQ ID NO: 6810885 - DNA, 64 bp, Homo sapiens
ccacgccctccctgagcccggccgaaaatcaaccggctctcgtgggtagcagaggaggccgtgg

SEQ ID NO: 6810886 - DNA, 89 bp, Homo sapiens
ggagttttgctcttgttgcccagggtggagtgcagtggcgtgatctcagctcactgcaacctccgcctcccgggttcaagccattctcc

SEQ ID NO: 6810887 - DNA, 81 bp, Homo sapiens
ggttaggaataaaggccaaaatttgcatttaaatggatatattttaagaagaaatgccaatttgtgacctttacccttgcc

SEQ ID NO: 6810888 - DNA, 63 bp, Homo sapiens
gagcattgccacatggtgcatttcctaggtaggcatgtctaaaatcattaagtggcctagctc

SEQ ID NO: 6810889 - DNA, 64 bp, Homo sapiens
aaagagaggctgctggactatatgccctttctgaatactggggcctcagattttgtttcttttt

SEQ ID NO: 6810890 - DNA, 70 bp, Homo sapiens
gttcctaatttggtttctgatgacattctggcagaattgaattttgttcttggaaatcaggtcctggaac

SEQ ID NO: 6810891 - DNA, 103 bp, Homo sapiens
gaagtctgactctaaagttcatattcttgatatagatagttaatccctgaatttatttgggaaactcatcagtttagaaacctatggaccatagaatcggctc

SEQ ID NO: 6810892 - DNA, 70 bp, Homo sapiens
tccggtgcctggtttggggaatgttcgtgggatatgttccaaaggactgacagacctatcaggtactgga

SEQ ID NO: 6810893 - DNA, 127 bp, Homo sapiens
taggtttttacatggacagagctgggttgaaaagtgggtttgactgttgctagctttgtcatcttgggcaggctctttaacttgtctaaattcttgattcctcatctctgtaaaatggaaagaccta

SEQ ID NO: 6810894 - DNA, 60 bp, Homo sapiens
attttaaagtggcattaagtaaactacaaagtgtatagtacataaatgccatttagaggt

SEQ ID NO: 6810895 - DNA, 59 bp, Homo sapiens
tgatcttcagcacaggttctagacaccgctgttctcaggcccactgtgttgaaagatca

SEQ ID NO: 6810896 - DNA, 97 bp, Homo sapiens
gtgaggatagacttgtgcttgcctggcatttctggggcccaggcctccccattctgtgcccatgtggctctagaaaggccaaagccacctcctctac

SEQ ID NO: 6810897 - DNA, 103 bp, Homo sapiens
tattttgagatacaggtttgtcgtattctctgattgaaagtaacttgtacatgtttggttttcatttacattagggaagatggcagcaagtattcctagagtg

SEQ ID NO: 6810898 - DNA, 97 bp, Homo sapiens
gtctataaataaattaacacctggtctttctttgatagtggagaactagaaagtactgtaggtctaatattgtcaaagtgagaccttgtctgtgggc

SEQ ID NO: 6810899 - DNA, 74 bp, Homo sapiens
attgtcacattatatgtgaggatagctcattttttaaatataccaatgctctatcttcagggtggtgtgagaat

SEQ ID NO: 6810900 - DNA, 63 bp, Homo sapiens
ctgctgttgccgtggtccaggcagtggatgatgatgatctaaagcaaggaattggcaacagag

SEQ ID NO: 6810901 - DNA, 96 bp, Homo sapiens
gttagaagtccagcagtggtctctctctgggctaaaatcaaggtgtcggcaaggctgcattccttctggagcccggggagcccacagtttcctagc

SEQ ID NO: 6810902 - DNA, 89 bp, Homo sapiens
aaggaggcggctttttacaggtacttgctgctgaaaaataatttccctgccagatacactgtgagtgcattagcctgttcttactcctt

SEQ ID NO: 6810903 - DNA, 58 bp, Homo sapiens
tccagtctgtagtgcacagtgatcatgcctgtgaatggccactgtactccagcctgga

SEQ ID NO: 6810904 - DNA, 103 bp, Homo sapiens
cagctgcctcaacccagtcctgtactttctttcaaggggggcaaaaatagagtcaggctcctccagaaactgaggcagaacaagttgggtgagcatccagctg

SEQ ID NO: 6810905 - DNA, 77 bp, Homo sapiens
gtggctgcattgaaaatcattatgtattctgagtgaaacacccagaatttaagtggattattcttgagtgcagtcat

SEQ ID NO: 6810906 - DNA, 112 bp, Homo sapiens
gccaggcgactccacgatggcttccgtcctcaggttcaccatcaactaagacagactgaagatgtaagtagtaatggaaggacacaaaaggtacaagagtcagaggccaggc

SEQ ID NO: 6810907 - DNA, 79 bp, Homo sapiens
atttaatgtagaccaaagaaaacacatctgggccaatatccagctcttagggcaccagtgtgcaatctctggcttaaat

SEQ ID NO: 6810908 - DNA, 79 bp, Homo sapiens
aactcgggcttgttcataaagacagttcagaaacctctgtcctatactttatgtaatagaataaagcccctttggagtt

SEQ ID NO: 6810909 - DNA, 113 bp, Homo sapiens
gggaaggaaggaggtgccaagccctccgctcagtggaggtcagtggaggtttgcttcctgctcacactgggcctgattgggtcggagggcacgcgggggccgctgtctgtcct

SEQ ID NO: 6810910 - DNA, 129 bp, Homo sapiens
ggtgagagctgtaagtagagtgtggtgatggagtccagcaggggaactgtgggccagcttgactcaggccggtttcaggaactcctgcagcatgttttgttccacagcctccatgaagagctcaaagcc

SEQ ID NO: 6810911 - DNA, 75 bp, Homo sapiens
gggccacttccaggatgggctgtcctactctgttttcaagaccatcacagaccaggtcctaatgggtgtggaccc

SEQ ID NO: 6810912 - DNA, 66 bp, Homo sapiens
ggatgggcgtggccgggatggaaatgggactggattccagagcatcagacctggccgcctccatcc

SEQ ID NO: 6810913 - DNA, 56 bp, Homo sapiens
ttaagccactcaagagatagagcacttcccctttgctctgtgtttcagctgcttga

SEQ ID NO: 6810914 - DNA, 58 bp, Homo sapiens
atgtacttgcgtatgtatagattgttccctgtcttggtattgtgcatatgcagtgcat

SEQ ID NO: 6810915 - DNA, 95 bp, Homo sapiens
gcatgatgaggacactatactgctctgttttcatatgttttcaatgttccacgacaaacatgtttagaaagcagctgaagcatcttcttttatgc

SEQ ID NO: 6810916 - DNA, 57 bp, Homo sapiens
gaaattactgggccctgattgcaacaaacttccttgaagatcctgggccagtctttc

SEQ ID NO: 6810917 - DNA, 92 bp, Homo sapiens
aggacatgcttcgagatgtgaaccattctgtctaagctggctacgttttccttgaatgcacggggtgatatgaatggtctcagcagtgtctt

SEQ ID NO: 6810918 - DNA, 57 bp, Homo sapiens
gcctttatttacgaaagggaaattgagttacagacttcctgttgtgagtagagctgc

SEQ ID NO: 6810919 - DNA, 79 bp, Homo sapiens
aggctggagtgcaatggcgtgatctcagcttaccgcaacctccgcctcctgggttcatgccattctcctgccccagcct

SEQ ID NO: 6810920 - DNA, 63 bp, Homo sapiens
gcaggaggttgattctctgaggacccagcatgtgggaggacccagagcacagcctccagatgc

SEQ ID NO: 6810921 - DNA, 64 bp, Homo sapiens
tctctctgtttgcccacatttttattactgttcacggtagtcaggaaagggtaagcggtgaaga

SEQ ID NO: 6810922 - DNA, 60 bp, Homo sapiens
gatcatctgggctccttgtagtgatggacacattttcatgaggcaaggtcttagatgatt

SEQ ID NO: 6810923 - DNA, 114 bp, Homo sapiens
aggcactattccaagtattttacatatattgcttcattaagttctcacagtatcaatatacagttgagaaaactgaagcagacagatataggttaaatgacttgtccaaggtct

SEQ ID NO: 6810924 - DNA, 113 bp, Homo sapiens
cccagtcaggtttggggacaagctggctgctgggcctgttcccgtattttggtccaggtgggtgccaggcccagggagcgggggtggcggcgccgtctcccagccttgctggg

SEQ ID NO: 6810925 - DNA, 72 bp, Homo sapiens
tgcctggctggtggcggaggtgggcagatggtgaggactccctagcacccagcttgtcacagacgtcaggca

SEQ ID NO: 6810926 - DNA, 79 bp, Homo sapiens
gtcatagagtccagtaaaatttgaaactgtccaattatatcagaaagttcttcatttttattggaaataaaactatgac

SEQ ID NO: 6810927 - DNA, 59 bp, Homo sapiens
ttgtattagtaagtcagctgcttggtttcatgtcaccatagcctgactattctggacaa

SEQ ID NO: 6810928 - DNA, 71 bp, Homo sapiens
cctgttgacctggcagcgcagcatgaagtcggtgaaatcctcttactgctccgtatgccacctcctccagg

SEQ ID NO: 6810929 - DNA, 73 bp, Homo sapiens
gtttgatatgtaactactccttatatgccattttattttgtgcatacatgtgattgtagtatacatattaggt

SEQ ID NO: 6810930 - DNA, 57 bp, Homo sapiens
ctggtatggaatttgatgcttgacttttcaatatgtgtccatgcagtttccatacag

SEQ ID NO: 6810931 - DNA, 81 bp, Homo sapiens
tccacatccaccgagggggcgggaggcggcaggaccagcaggggcagcccgttctcttcgctggccctcggggaggtcggg

SEQ ID NO: 6810932 - DNA, 98 bp, Homo sapiens
tgaaatagtaggatattcttgataactcttcttataatgcgtgatctagaaagcaagaattatgttaaaatatagaaggtgagtgaatacttatttca

SEQ ID NO: 6810933 - DNA, 81 bp, Homo sapiens
tctctactggcaaggcttagtcagagggtgctgggtgaccatcagggccctggtgactggggctggcctgacagtgtttga

SEQ ID NO: 6810934 - DNA, 77 bp, Homo sapiens
atgtctttatgacttattcagaaggagaaatggaactaaagctcagtcctctaattcttgaatgagaagtgaagcat

SEQ ID NO: 6810935 - DNA, 84 bp, Homo sapiens
gtcaggagggtcccgagccctgtcagaaattcctcctgacaatgaccacatgggctgtctcacagggctaggccctgccctggc

SEQ ID NO: 6810936 - DNA, 58 bp, Homo sapiens
gtacctgagcacgcggtccgaggcctggctggacttggacacgtcgcagctctggtgc

SEQ ID NO: 6810937 - DNA, 64 bp, Homo sapiens
aagggttggggaagagcaaattcactctctctttgagctgggacatctgtcttcttctgccctt

SEQ ID NO: 6810938 - DNA, 58 bp, Homo sapiens
ttaaagtcacagttagactacccaagtctataaacttgggtataaaacttggctataa

SEQ ID NO: 6810939 - DNA, 67 bp, Homo sapiens
cgggtaaaggtcgccctcaaggtgacccgcctactttgcgggatgcctgggagttgcgatctgcccg

SEQ ID NO: 6810940 - DNA, 77 bp, Homo sapiens
gcaccagcatcacctggaggcctgctggaaacgcctaacttcaggtcctaccccaggccttctgagttggaatctgc

SEQ ID NO: 6810941 - DNA, 61 bp, Homo sapiens
tattgtgtgtgtgtgtgtgtgtgtgtgtgtgtgtacagacatacataagcaccacattttg

SEQ ID NO: 6810942 - DNA, 88 bp, Homo sapiens
caaacagaaagagaacatgagaaccaggtctgtgttttgcctctgggaaaagcataccatgtgttcatcttgtttcctcttttgtttg

SEQ ID NO: 6810943 - DNA, 123 bp, Homo sapiens
tgtggctagaaatcgtatttataaaagtttactataagtaagtcattgcaatgcactgttaagtaccatgggtattgtatttatttatgtgactctaaattgattctttcagcagtcaacaca

SEQ ID NO: 6810944 - DNA, 85 bp, Homo sapiens
cttccccagctttgctgatgtggtgctggagttccgacgaggcagccggaatttctctccgtgctattttagtatcgctgagagg

SEQ ID NO: 6810945 - DNA, 68 bp, Homo sapiens
cagacgaggcaatagagcccagaggtgatggagttttcctccacctacgagtcactgtggtctctctg

SEQ ID NO: 6810946 - DNA, 69 bp, Homo sapiens
taggggaactgctgacctcaggtcatcctaaaacctgaggatgtcagatgatgtcagcaggacactcta

SEQ ID NO: 6810947 - DNA, 107 bp, Homo sapiens
ttgagatggagtctcactctgtcgcccaggctggagagcagtggctcaatcgatctcagctcactgcaaactccgcttcccaggttcaagcgattctcctgtctcag

SEQ ID NO: 6810948 - DNA, 82 bp, Homo sapiens
cactgttagattaaatgctttgcaagatctgccatgatgcactgtatcatctcattcatccaaggatttatttcaacctgtg

SEQ ID NO: 6810949 - DNA, 95 bp, Homo sapiens
tggatatagcctgatttcttcattcctttatgcactgatctagaagagcgtccttcatgtagacagatttaaaggaatggattaatgaatatcca

SEQ ID NO: 6810950 - DNA, 59 bp, Homo sapiens
tctgtccatttggagttggaagattccattgaaatcttcatggctgataattggatagg

SEQ ID NO: 6810951 - DNA, 77 bp, Homo sapiens
ccggggaggctgaggcaggagttcaggctgcgggacacccctgcagcctggcttcgcgcctccgtttctgcatctgg

SEQ ID NO: 6810952 - DNA, 103 bp, Homo sapiens
tgaagtaataccaagtacaacattcagctaatgggaataagagtattattttgcatatactctcagttactaataattggaaatgttggctacatttacttta

SEQ ID NO: 6810953 - DNA, 115 bp, Homo sapiens
catggaagtgatgaatgtgaagggtgcattgcgcggggctgcacagccagctgttttgctgttactgtcttcacagtctctcttgtagtgcagctagttccagttttcttctatg

SEQ ID NO: 6810954 - DNA, 56 bp, Homo sapiens
gcccatgtagtatttcctttgtgagctcacacaagattaggctacgagcatggtgc

SEQ ID NO: 6810955 - DNA, 58 bp, Homo sapiens
atgcacaagtgtgtgtgtgtatgtgaatttatgtattcatacacacacacctgtgtat

SEQ ID NO: 6810956 - DNA, 74 bp, Homo sapiens
taatttgcaatggctttcagcaaggatagattactggtaccttgattctacttttttgagggttatgttgattg

SEQ ID NO: 6810957 - DNA, 68 bp, Homo sapiens
atgtgaccatctgtgaataattggctcctgcttacgtgtagctctcattactttacagatgtatgcat

SEQ ID NO: 6810958 - DNA, 59 bp, Homo sapiens
ttattttagtgatagaaaaaactgtggctgaaccaagttttctgggatcactggaatga

SEQ ID NO: 6810959 - DNA, 62 bp, Homo sapiens
tagaagcactgacagagtttgacttgatctgaggaaagttctgaaattctgacagtctttta

SEQ ID NO: 6810960 - DNA, 80 bp, Homo sapiens
gggtcccagccttgggggatccaggaccctgggcaggcactaaaggcagggacttggatagaaagaggcaagatgggccc

SEQ ID NO: 6810961 - DNA, 82 bp, Homo sapiens
tatccccaactaaactccccgtgtttctggctgtttgataagacattatcattagatacgcaggcagttttaaaggaggata

SEQ ID NO: 6810962 - DNA, 57 bp, Homo sapiens
ggcagcagggtagccatttctccctgactggggtgtccaccatggtgctctgcagcc

SEQ ID NO: 6810963 - DNA, 101 bp, Homo sapiens
tgaggcaggagaattgcttgaaaccgtgaggtggatgttgcagtgagccaggattgtaccactgcactccagcctgggcggcgaagcaagactctgtctca

SEQ ID NO: 6810964 - DNA, 61 bp, Homo sapiens
gcagggccaggtctgggatttgatgcaggggccgagcacctgcttccagaggaggccccgt

SEQ ID NO: 6810965 - DNA, 70 bp, Homo sapiens
tcagtgcttaccctctattagaagaaaaatataccacacatttccatagtgaatgggtaatgcaaactga

SEQ ID NO: 6810966 - DNA, 59 bp, Homo sapiens
gactcactaccctccagcacaagacttagaagcaggaagtctggtttaggtagtgagtc

SEQ ID NO: 6810967 - DNA, 77 bp, Homo sapiens
acctcccaaagtgcaaggattacaggcatgagccactatgcccaagccatgcctcgtactttgctatttttaaaagt

SEQ ID NO: 6810968 - DNA, 66 bp, Homo sapiens
tcattcataacggcaaatgtcacctgtcggagttagacggtgcacagcctgtgctgctgtgtgggg

SEQ ID NO: 6810969 - DNA, 69 bp, Homo sapiens
acctagatctacaagttgtgacttgatacctacaagtaaggtatagtttgcgatttgtggttctttggt

SEQ ID NO: 6810970 - DNA, 71 bp, Homo sapiens
tggtgggcccgcgtcccgccgccgagccagagccaaagacgaggtcggtgcgcgaggcgcggtcccacaca

SEQ ID NO: 6810971 - DNA, 70 bp, Homo sapiens
tctggtaaaatcctgaaccagagaaagaagctcctatgcctgccaaggagttctctggctcctttccaga

SEQ ID NO: 6810972 - DNA, 78 bp, Homo sapiens
gcacccagtgggggagccaggaagtattgatgtttctgccagtttagcgtcaacacttgctggtttcctctctggagc

SEQ ID NO: 6810973 - DNA, 73 bp, Homo sapiens
tcactacagaatcaaatacgggcttaaaatttcaaacggaaaaatattgccaatatgttgattctatgtagga

SEQ ID NO: 6810974 - DNA, 67 bp, Homo sapiens
ttggttgctagattgtgtgcatgtgtaagataaattggttttacaacagacacatattctaaaccaa

SEQ ID NO: 6810975 - DNA, 96 bp, Homo sapiens
cattgggtaggagtaagtgtatgtagcctatactagtgggaacaactaccccaccaacactgttctgggcaaatgtcactttcttttttccccttg

SEQ ID NO: 6810976 - DNA, 77 bp, Homo sapiens
tctggaagcttttgagattgttgctctggtaaagaaaagtccagaagtgcttggcatgtctacagaagaagtctaga

SEQ ID NO: 6810977 - DNA, 60 bp, Homo sapiens
gttggaaagcagccgcagccaatacctaattaaatgggcattgtgtggctgtgttccaat

SEQ ID NO: 6810978 - DNA, 60 bp, Homo sapiens
tgagtctgaagaattagagaaggcttctatttaaatcctttgcaaagttatttagactca

SEQ ID NO: 6810979 - DNA, 61 bp, Homo sapiens
attgtcacccattgtttcttcttccctgacaccagggagtctgattttttatgggtgtagt

SEQ ID NO: 6810980 - DNA, 84 bp, Homo sapiens
atggccatgtcagtgtagtataaggttaaaaccttgcatgcgtcaatgctcagtaggtaccaatactgaatgactagtggccat

SEQ ID NO: 6810981 - DNA, 57 bp, Homo sapiens
gaagttgtaagcctgggaaggtaatcacagaatctctggccagggcaaagcaatttc

SEQ ID NO: 6810982 - DNA, 71 bp, Homo sapiens
ctccaagctttggaatctgcatcctcttattttgcaatagaaaggagcaaatgtagtttcccaacttgggg

SEQ ID NO: 6810983 - DNA, 93 bp, Homo sapiens
tgaagcctgtccaaataagttgcaaaatagtgtctagagcctgcaatcctgtccgtggtgctattttgttatttgtgtgagtctcaggtttca

SEQ ID NO: 6810984 - DNA, 66 bp, Homo sapiens
gctggcttgctttcatgaagtctatagagaacccttttctctgctgcccatgatggtatagctggc

SEQ ID NO: 6810985 - DNA, 78 bp, Homo sapiens
tttttataattaggcaggtcatattagattagggcccgctctaatgaccctattttaacttgattacctctgtagaga

SEQ ID NO: 6810986 - DNA, 85 bp, Homo sapiens
gccttgtgattcacatgtgtacagtcctcccaccagaccctgaacttggtcagggcagcatatgtggttgattcatccctggggc

SEQ ID NO: 6810987 - DNA, 75 bp, Homo sapiens
gaatgtgttagatcatttctcccggccaaaaactactgccaataatagagtgcccaatagaattctaatatattc

SEQ ID NO: 6810988 - DNA, 60 bp, Homo sapiens
gccagggacaggatcaagctgcccagttacaaatctgttatgtatattctgtgccctggt

SEQ ID NO: 6810989 - DNA, 58 bp, Homo sapiens
tgaaccagcagccagctgcatttattgtcctggatgtcagtgccaactttgctggtca

SEQ ID NO: 6810990 - DNA, 68 bp, Homo sapiens
gggactctgagggtctctctcggctccacgcgcccactcaagtgtcgcggcagaaagagtcggagccc

SEQ ID NO: 6810991 - DNA, 76 bp, Homo sapiens
taattcagtttgtttgactgttagagttgatcctccaggcataaaaggatgtttagtcatcaaacaaacaggatta

SEQ ID NO: 6810992 - DNA, 58 bp, Homo sapiens
acctctgtgtgatgcgcaaagtacacctgtttctattgtacctgcctctcgcggtggt

SEQ ID NO: 6810993 - DNA, 58 bp, Homo sapiens
tcaccactcccttttctacttctacccaaaattgggtaagttgataagagagtctaga

SEQ ID NO: 6810994 - DNA, 86 bp, Homo sapiens
ggagaagtacggtgagcctgtcattattcagagaggctagatcctctgtgttgagaaggatcatgatgggctcctcggtgttctcc

SEQ ID NO: 6810995 - DNA, 83 bp, Homo sapiens
gaatcattcagtcatgctggttttgatccacatggttttcaagccagttgagttattttaagcacagcatgaaagaagaattt

SEQ ID NO: 6810996 - DNA, 64 bp, Homo sapiens
gaacatgcatataggtaaatggaccagtatacatgctattctgttctgttttgtaagcatgttt

SEQ ID NO: 6810997 - DNA, 62 bp, Homo sapiens
attttcagtgtcaatttttaaatatatttttctttgtgtattctggtggtgacgttggagat

SEQ ID NO: 6810998 - DNA, 63 bp, Homo sapiens
gagaacaaaagatagcccaaacatacatctctaatgataggtgtgcctttatcttctgtactc

SEQ ID NO: 6810999 - DNA, 65 bp, Homo sapiens
gttccaggcctctagccctctcttcgctgctcccagccaggaagagtccgagaggcgactggagc

SEQ ID NO: 6811000 - DNA, 66 bp, Homo sapiens
aggtttcccagcccactctggaacccaatcaatgtatagaggccccagattctgggctgggtccct

SEQ ID NO: 6811001 - DNA, 64 bp, Homo sapiens
tcatgaacctgaggtcacatcgctcatcgaagtcaggggagcaagatttaaacccaggtcatgg

SEQ ID NO: 6811002 - DNA, 56 bp, Homo sapiens
ttgtttcagtccagaaggaagtctggtgcctgtcagtccatcttgggcagaagcag

SEQ ID NO: 6811003 - DNA, 61 bp, Homo sapiens
accactgagtgtccttcagggtgatcccatatattcctaccctaaaagaccagtctgtggt

SEQ ID NO: 6811004 - DNA, 80 bp, Homo sapiens
tgtaagaaagaacagtctagtgcattaatgtgaatattctaagatagatgtttatcttaatggactcagaggtacttaca

SEQ ID NO: 6811005 - DNA, 56 bp, Homo sapiens
ttcagagctcagaaaagtgtctctttaaggagatgacatttaagttgaagcctgag

SEQ ID NO: 6811006 - DNA, 66 bp, Homo sapiens
gcagccagctggagaccactgtttgctggctcctgccttaaaacagtgacttccaacctcagctgt

SEQ ID NO: 6811007 - DNA, 108 bp, Homo sapiens
ggggcacacgagagctgagcagtcacttccttccttgtgtgtgagactgacttctgtctataagcagggggatggagttgaaatgcctgctcatcttttatgtgtttc

SEQ ID NO: 6811008 - DNA, 76 bp, Homo sapiens
ctggagccaggaatgtcgtcataaacatgaagccccgtaccagggcatcttggcagggcaatgttcctagctgcag

SEQ ID NO: 6811009 - DNA, 80 bp, Homo sapiens
ctggtttggtgttgaattttgtcattgttgaatataaatagatattcacaaaatgatatagatacatacacctatgctgg

SEQ ID NO: 6811010 - DNA, 57 bp, Homo sapiens
tttggtgatctccatggggaacagtggagactgatctcaaacagtgagttcaccaga

SEQ ID NO: 6811011 - DNA, 59 bp, Homo sapiens
ggcccagctgtctgcctgagaggagctgctgatgcaatctttctgcagggagctgggct

SEQ ID NO: 6811012 - DNA, 74 bp, Homo sapiens
ttgcactgtgtgaccctggccttgccagtgcattcctaaaatggaagaacagcaagtgaggcgtcagcagtcaa

SEQ ID NO: 6811013 - DNA, 55 bp, Homo sapiens
ggctatgagatgggaccagtacctgcaagagaaattggttgccccacctcatgcc

SEQ ID NO: 6811014 - DNA, 68 bp, Homo sapiens
aatgtgcataaaaatcctcatcctccttgaaatatttgaggagttaggatgtttatatgttgcccatt

SEQ ID NO: 6811015 - DNA, 75 bp, Homo sapiens
agggcagaacaactctagctgctcagccttctgcccacttaccaccaggctgtgtttcccctggagcttctccct

SEQ ID NO: 6811016 - DNA, 88 bp, Homo sapiens
tgtaagaaatcgaggccaaggcactggaagtcccattgtctctggatgctgagaccttgaatttcatgccatggacccctcccttaca

SEQ ID NO: 6811017 - DNA, 104 bp, Homo sapiens
caggcccagccttctcacccacccagccccacacggtctagctctgcctgaagtaggtgcttggctcgtgcacacagatggacgggtggatgcggctgggcctg

SEQ ID NO: 6811018 - DNA, 58 bp, Homo sapiens
ctagtctttttgatctggtggatattttatccacatagcacgtctcaatttggactag

SEQ ID NO: 6811019 - DNA, 68 bp, Homo sapiens
tctactttctgtcacaataattgccagcacatgtgtgttacatggaatgttgtgtataggtcagtaga

SEQ ID NO: 6811020 - DNA, 68 bp, Homo sapiens
acttaaaacagcctttccaattgctgctgctgcaagaaagctgcagtgctcctcaggaaggcttgagt

SEQ ID NO: 6811021 - DNA, 64 bp, Homo sapiens
catatcctggctgcaccagtgacccttcttatccagaggggaaatcttagtggagctggttatg

SEQ ID NO: 6811022 - DNA, 99 bp, Homo sapiens
gggctgctttcctgctggcattcttgctccctggacagattcttgcaatacccaggtagcagtagcctgccagcgtggttttgataaaagcacatgccc

SEQ ID NO: 6811023 - DNA, 70 bp, Homo sapiens
gtgaatagatgaatagaacaatgattgaaaggataaataacatatcttaatctgttttatcatttgttac

SEQ ID NO: 6811024 - DNA, 55 bp, Homo sapiens
agcaatctcaaggattgctaggtgaatcctagccactcccttaaggaggtttgct

SEQ ID NO: 6811025 - DNA, 74 bp, Homo sapiens
ctgctctgcatggttatataagatgggtaggcttgttaggcggtagccacaacctgttcgtttccacagaggag

SEQ ID NO: 6811026 - DNA, 57 bp, Homo sapiens
aggcagtttctgggacagcatattaaaagacatgagcttcagacaaagaaactgctt

SEQ ID NO: 6811027 - DNA, 95 bp, Homo sapiens
aggggtgtggttttaggggcttttcagcacacacaggtggcattgcttcatgtggctctgctactcctttgctcgaaatcttttaaagaccccct

SEQ ID NO: 6811028 - DNA, 56 bp, Homo sapiens
gtatctgagtgggtatgggatcctggggtcaggcccatgttcacttgctcaggagc

SEQ ID NO: 6811029 - DNA, 65 bp, Homo sapiens
gcctgagggtggccaaattgtatggcctctagagccagccatcacatccaggctacctccgtggc

SEQ ID NO: 6811030 - DNA, 88 bp, Homo sapiens
ggggtcttggtctgtcacccaggctggagtgcagtggcacgatctcggctcactgcaagctctgcctcccgggttcacgccattctcc

SEQ ID NO: 6811031 - DNA, 57 bp, Homo sapiens
acactccatttcccagctgctcttattgccaggtgtagacacaggggaatgtgaggt

SEQ ID NO: 6811032 - DNA, 97 bp, Homo sapiens
taactcagcctttcaatttctcagcaggcagaaatctgcagaacttttctgaaggttacttctgctcagaaggctttaaaattgaaaagcagaattg

SEQ ID NO: 6811033 - DNA, 60 bp, Homo sapiens
agttcaacctttggatctggggcttaccatcactccagaatccatgacagacgttgaact

SEQ ID NO: 6811034 - DNA, 77 bp, Homo sapiens
atatagtgtattatgaggtatttggactttatcaaagggacttttgttgtccaaagcccaggtgtctttcactatgt

SEQ ID NO: 6811035 - DNA, 130 bp, Homo sapiens
agacaaagccttactagctttaggatcttggctataaatggtaaattagtagtagcttttgaaatccttgggcattcaagttggctaattttttcattttataagaggaaggttgggacagctgatatct

SEQ ID NO: 6811036 - DNA, 58 bp, Homo sapiens
aaggtatatctttaaaagtgaatgcaattttatttgctttttatttgagacatgcctt

SEQ ID NO: 6811037 - DNA, 58 bp, Homo sapiens
tgccagcaggtagatattggccatgataacatggaccagtggagaggcatgcttggca

SEQ ID NO: 6811038 - DNA, 69 bp, Homo sapiens
gcaatgttatcctgtgtcagtttatccgcatgatgtaaagtaagtgaactatacgataacatgatttgc

SEQ ID NO: 6811039 - DNA, 127 bp, Homo sapiens
tttgggaactgtccccacccctgaggccaatctggttctgaaccttctcttccttgccttgggcagctttgggggagggttagcaaaggcacagaacagaaaggccctgggctgtgcaggctccaaa

SEQ ID NO: 6811040 - DNA, 113 bp, Homo sapiens
tgggcgggactggagaaaggagagagttttttggctttgaaggatgtagggctcctgagaataccacaggtccagctcaaagtgctcctgtcctttcacggtcccagagccca

SEQ ID NO: 6811041 - DNA, 95 bp, Homo sapiens
ggtgaagttactgggtaagaggctttgtgtgtgtttaacttcagtggtgtagtacaaactgtttcaaagtagctgtatccatgtgcactttcacc

SEQ ID NO: 6811042 - DNA, 93 bp, Homo sapiens
gttacagagaggtttttaaaaacgttctttattggctctcccaacaatcccatatgggtatagtcatcaagaatgaaaagcagatcctgtggc

SEQ ID NO: 6811043 - DNA, 66 bp, Homo sapiens
tttctattaatatgttaattctgtgaagtactgtatttctacacggttacaacgtactaatggaga

SEQ ID NO: 6811044 - DNA, 65 bp, Homo sapiens
agtgacaaccaggcactcctgaggtctgaccctaaccttttggtcgagcctccagccttgtcact

SEQ ID NO: 6811045 - DNA, 79 bp, Homo sapiens
gagcacttactgtatgccaggtgcactcaagacctgctgctaagtgggaagctgggttcagaggcacatggaacagctc

SEQ ID NO: 6811046 - DNA, 59 bp, Homo sapiens
ccgtctttcttctttattacagtggctgggactttcagtcctgtgttaaacaagagcgg

SEQ ID NO: 6811047 - DNA, 60 bp, Homo sapiens
gagtcccacccactcagtatagactccaggatccaggagtccagagaagggaggggactc

SEQ ID NO: 6811048 - DNA, 74 bp, Homo sapiens
aggcgggggacaggcctgagacatctgagataataaagacatgattgtctcagccctggggcttgtctcccctt

SEQ ID NO: 6811049 - DNA, 69 bp, Homo sapiens
gctcctgtaaagagctaaagtataaggggcttaaaaaaatattcaatgcttttgttctttactcactgt

SEQ ID NO: 6811050 - DNA, 76 bp, Homo sapiens
ggcccagtttgtgcaggatgcgggggtaccacttgagacaataagtggtggctggcatcttggcacaggttgtgcc

SEQ ID NO: 6811051 - DNA, 63 bp, Homo sapiens
ctctgggcaagtttcttcatgagcttcagtcttgtctgctctaagtgaggatactgctcagag

SEQ ID NO: 6811052 - DNA, 59 bp, Homo sapiens
cctgaagatggtgatgggatcagagaagcttatcacagataccaaaatcatcttatagg

SEQ ID NO: 6811053 - DNA, 80 bp, Homo sapiens
aggatcaaggtgctgagcgatgcggctgctggtgagggctccttcctggcgagcagacccccatcttctcactgtgtcct

SEQ ID NO: 6811054 - DNA, 63 bp, Homo sapiens
gactgtacaaattcattgaactgtacatttaaattgtgtgcacttcattgtaaattgtacctc

SEQ ID NO: 6811055 - DNA, 56 bp, Homo sapiens
cccccacaggtgtctgaggcaggggattgtctcctttatccactgtacctgggggg

SEQ ID NO: 6811056 - DNA, 73 bp, Homo sapiens
acctgcatcaccaccagaaagactctgtgtgagggactaattttacttggacactttttgggcactgtcaggt

SEQ ID NO: 6811057 - DNA, 70 bp, Homo sapiens
ctttgctttaactgaaagtgctcctgaatttaagtgttcatttgtgaaggagcactttcagtttgtaaag

SEQ ID NO: 6811058 - DNA, 115 bp, Homo sapiens
gattctctagtcacattgcctagtcatggtcttgtgagagtaacagttagtggatccaggctttgaactctgctttatacagacctagtaatctaggcagagactggattgaatc

SEQ ID NO: 6811059 - DNA, 96 bp, Homo sapiens
tcaaccacctttggtgcaggaagaaaactaattagatgggcaatgctgtaagccatatctatttgttttagattttcttcagtctaaaagagttga

SEQ ID NO: 6811060 - DNA, 58 bp, Homo sapiens
ttattgagtatctgcttggtgtcaggctctattctaggtattggggatactacagtga

SEQ ID NO: 6811061 - DNA, 72 bp, Homo sapiens
gttggtggatttttaagtgagttgactgtcgaaaagatttagtacacaagacacatttaaaaggcctctgac

SEQ ID NO: 6811062 - DNA, 64 bp, Homo sapiens
ctggggccaaatttggccatgagcattttcactttgggagatgtcaggacaagttggcaggcag

SEQ ID NO: 6811063 - DNA, 122 bp, Homo sapiens
tcctattttgaaaaagaaaaaagtctattactattaaatatatctgttagttgaatatcaatcactttttctaaagggtagatttggccaatgagtgatttttttttttttttttttttgga

SEQ ID NO: 6811064 - DNA, 58 bp, Homo sapiens
tcagcattggagaggagggccggaggcccctattgacaattctcttctccagagctgg

SEQ ID NO: 6811065 - DNA, 61 bp, Homo sapiens
tcctgggtccatggcagccgaaggaccaacaacttcatcatcgctgttaaggaccctcgga

SEQ ID NO: 6811066 - DNA, 72 bp, Homo sapiens
tggctactttcctttgatcttctgcttcctttgaacaaagtagcagaaggtcttgaagggcaaaagtggcca

SEQ ID NO: 6811067 - DNA, 67 bp, Homo sapiens
tagtgaactccactgaaggcagggacttcattcactgctccatccctaatgcttacaggagttcctg

SEQ ID NO: 6811068 - DNA, 71 bp, Homo sapiens
cagacagccatcgccgcaggcatctgcccacatggaaagcaaggcggtaagcagaggcgatggaatgtgtg

SEQ ID NO: 6811069 - DNA, 63 bp, Homo sapiens
gtcagctcagcaggtgggagtgtgccttggccctgaggaagcacctgcctgctagagcctgac

SEQ ID NO: 6811070 - DNA, 80 bp, Homo sapiens
aagcatcgtggcgaggcgggcaggggtgcagggtcccggcagggcagcccaggtgccctctgccttactgtcggctgctt

SEQ ID NO: 6811071 - DNA, 67 bp, Homo sapiens
ggatgagaaaattcattccatccaggacaacgtagggactccatggaaaagggcctgttttccatcc

SEQ ID NO: 6811072 - DNA, 68 bp, Homo sapiens
catttacttaaatctttacaagagagagggaagataatctaatcagattgtaaaggtttagaagaatg

SEQ ID NO: 6811073 - DNA, 78 bp, Homo sapiens
ctttgttcccaaatataatgcaagagacaagttggctagatcagtcttatcttgcagatattggtcgggagttcaagg

SEQ ID NO: 6811074 - DNA, 55 bp, Homo sapiens
gggcttgggtattgtgagaggtcagacaggtttgtctcctgtcacgtccaggcct

SEQ ID NO: 6811075 - DNA, 79 bp, Homo sapiens
gactaggctcaatgaaaggaagaactctggcaggccagtaaaagacatctacctttcattcaaacagagcccacaagtc

SEQ ID NO: 6811076 - DNA, 71 bp, Homo sapiens
ggttgtactagagcagtgttttccaatagaatgtttagtgatgatggaaatgttctgtatctgctatagcc

SEQ ID NO: 6811077 - DNA, 60 bp, Homo sapiens
ggcggccttgccgctcagcagtggggtcttgtccgtgggcccgcacagcggtaggccgcc

SEQ ID NO: 6811078 - DNA, 67 bp, Homo sapiens
ggcgagttgtacagcatccagtgcagagagaatggcattttggtctcactaggtggctttacctccc

SEQ ID NO: 6811079 - DNA, 73 bp, Homo sapiens
caggtggccatgggccctgctggagtcctggcaggaggcgccatcagtgccaggcccagcagggcggcccctg

SEQ ID NO: 6811080 - DNA, 59 bp, Homo sapiens
ggtggtgtgatctcctcaactagactgtaatctgctttcaggacagggatcacatcatc

SEQ ID NO: 6811081 - DNA, 85 bp, Homo sapiens
tgtttgacttgtgagctaagatgttgtttttctcttggaataccattctgtttcaaagaacaaatgatatatggttattcagaca

SEQ ID NO: 6811082 - DNA, 68 bp, Homo sapiens
ctagagtgtgagggattaaatgagcagggattttgtttattttgttcactatatccctcagtgtctag

SEQ ID NO: 6811083 - DNA, 84 bp, Homo sapiens
gtcttgagtttgaacttcatgccaagcatgttcagaagtctttgcagagattcaagctgtggtgtggggtgcaggtgataagat

SEQ ID NO: 6811084 - DNA, 73 bp, Homo sapiens
acatcactagtgtgccttgtatttgtgtggatttttgtcctgcaaataggaaaagggcataacctttaaatgt

SEQ ID NO: 6811085 - DNA, 81 bp, Homo sapiens
cctttcccattggattttgcctggattcagctgagacaggagaagatttctctgggtcccaaattctattttcatgaaagg

SEQ ID NO: 6811086 - DNA, 67 bp, Homo sapiens
taaaatgtcaaaataattgatttgttttctcttgattgtgaaaactgatgaagagtttggcatttta

SEQ ID NO: 6811087 - DNA, 55 bp, Homo sapiens
acagtaggtatctcataaggttgttggaacaactaaatgcattggtatctattgt

SEQ ID NO: 6811088 - DNA, 95 bp, Homo sapiens
ctgaggaaaattctccaaacgtcatacatggattaatcccactcaaggatactcctggatttgtctaggtcatgactttcaagcagttttctcag

SEQ ID NO: 6811089 - DNA, 66 bp, Homo sapiens
ctatgaccccagcatgaataaggctctgtgtgtgaaaagtgaatgggtagcaatgtggggtcatgg

SEQ ID NO: 6811090 - DNA, 68 bp, Homo sapiens
taccatgtcaagcgagacatgtttaatgacaagtggatcttgttttgacatctggctagattttggta

SEQ ID NO: 6811091 - DNA, 109 bp, Homo sapiens
tcttcttggtttgcaagatcatctatctagtcagtatattttgaattaattctcttctgatacagagatactctagatcaaatggattgatctgaaccaatttcaaaga

SEQ ID NO: 6811092 - DNA, 79 bp, Homo sapiens
cctggggccagttcctctcagagttacaggatgtatccttaatcatggcttgtgggaggcagaagttactgcccccggg

SEQ ID NO: 6811093 - DNA, 62 bp, Homo sapiens
ggatagtggtttgacttcatggacttttactaccaagggtctccatgttaacatcactttcc

SEQ ID NO: 6811094 - DNA, 64 bp, Homo sapiens
tcttttataagcatagtaccgtagcagctgcttaagtgcagcgttcagggaatgtttaacaaga

SEQ ID NO: 6811095 - DNA, 59 bp, Homo sapiens
gacccacagacctggaagtatttgactatttgaataactggtacaggtttactggtgtc

SEQ ID NO: 6811096 - DNA, 55 bp, Homo sapiens
gagagggagccagccaggaaccgggaaacttgcctctgctcttggattccctctc

SEQ ID NO: 6811097 - DNA, 62 bp, Homo sapiens
cgatgaattctgaaccctgtagatgttttgttctactgggaggcactattcaggaggcattg

SEQ ID NO: 6811098 - DNA, 78 bp, Homo sapiens
ggattttctgagccttcaaatttttttaaaggacttctcagtctggaaagatgaaatttgaatagggatagaaagttt

SEQ ID NO: 6811099 - DNA, 81 bp, Homo sapiens
gcccagagaggaggggcacagtgagtggccacctagagaggtgaccagagaaaggcactggaaggtcccaccttactgggc

SEQ ID NO: 6811100 - DNA, 80 bp, Homo sapiens
ggggagctgtgctgtacactgcaggatgcattgcaagatccttggcctgaattcaatagctgtcagtagcactgttcccc

SEQ ID NO: 6811101 - DNA, 59 bp, Homo sapiens
ggtccatttcccctgaaagcaacctcctgacatgtgtgaggtgggcaggtggagtggcc

SEQ ID NO: 6811102 - DNA, 93 bp, Homo sapiens
aggagattagattctcataggagcgtgaaccttattgtaaactgcacaagcaagggatctaggctgtatgctccttatgagactctaatgcct

SEQ ID NO: 6811103 - DNA, 76 bp, Homo sapiens
cccagtctccagggagcagggaattacagcgcaggaggaacctgtccatctgtcctgcctcactgctccctctggg

SEQ ID NO: 6811104 - DNA, 60 bp, Homo sapiens
cccagggctgtagaatgtccaatctctgtagtgggttctggagttatggcaagccctggg

SEQ ID NO: 6811105 - DNA, 64 bp, Homo sapiens
gggagaaggagtgctggccggggcatcgggagccccaggctgtctgtcctttgctgcctgtccc

SEQ ID NO: 6811106 - DNA, 77 bp, Homo sapiens
ttccctatctccaaattcagtcacagtctgagatgccaaaggttagggcttcaacagatgaatttgggggaggagag

SEQ ID NO: 6811107 - DNA, 123 bp, Homo sapiens
acacttaattgcttctatatgcttattgcttaattacataaaatgcggtagtccctttataatgtttctgtaaaagtgcccacctttactgtgatttaggcagaccaaaaagcaagagagtgt

SEQ ID NO: 6811108 - DNA, 61 bp, Homo sapiens
agagctaggaccagagtgaacgttggtctctaaattagcagctttctggtctctacactct

SEQ ID NO: 6811109 - DNA, 58 bp, Homo sapiens
cattgtctcagttaatccttcacaactttatggttgtagaggaggaaactgaggcttg

SEQ ID NO: 6811110 - DNA, 71 bp, Homo sapiens
atctcaaagtaccatcttcagagctttaaaatatctttctcccaaggaaatggaaatggaatactttggat

SEQ ID NO: 6811111 - DNA, 64 bp, Homo sapiens
tctctcaatttgggtttgactgatgctttctcatgaaaacatcagaatatccatgttgggaaga

SEQ ID NO: 6811112 - DNA, 80 bp, Homo sapiens
ccttttttatgctagttattagctactcattgatttgatcttcctggttggtttgatgaaagatagtgaactagaggagg

SEQ ID NO: 6811113 - DNA, 87 bp, Homo sapiens
gcctcggagcaggcctggtggtgcaggaagcatctggctgtcacgcctggagctagtgtgcccctggcccccggcctgcttgctggc

SEQ ID NO: 6811114 - DNA, 93 bp, Homo sapiens
agagacttttctgagagtaaacatagcctgtggctcacactttgataccaacacagtttgcttagttttcttttcccaacatagagaagcttt

SEQ ID NO: 6811115 - DNA, 111 bp, Homo sapiens
agtcatttaaccttctagcatgtatgcacattgtagccacacaattacaagagctaaagcaacataactgtgaggctatatcatggcaaagcaactaaaagctcagtgact

SEQ ID NO: 6811116 - DNA, 85 bp, Homo sapiens
ttggtgtcatgagtcaggtgtctatctaacctggtcaatcagctatggctgtgggccaggctggaaagaacagacatggcagcag

SEQ ID NO: 6811117 - DNA, 66 bp, Homo sapiens
tgaattcaggttgacgttgccagcattattgtctccctgctgcgcaatgcttggtctgctggttca

SEQ ID NO: 6811118 - DNA, 75 bp, Homo sapiens
gcctctaggtcagtgcagctccctcacctgcttgatgtaaatctcaagttgtacctaagctgcgatctaagaggc

SEQ ID NO: 6811119 - DNA, 86 bp, Homo sapiens
tgaatggtctctcactctaggtaacacaactaattcaaatgcaatgttaggagagttgtttttgcctagatgaaataagatcttta

SEQ ID NO: 6811120 - DNA, 57 bp, Homo sapiens
ccactggtgccatcttggttctcagtcacccctggaggcataggttggtaccagtgg

SEQ ID NO: 6811121 - DNA, 61 bp, Homo sapiens
gggcagaggggataacaggtgtagatgttaaatgattttctgggcaaagtcccatttgctt

SEQ ID NO: 6811122 - DNA, 55 bp, Homo sapiens
agactgtgcctcattttttaagtgcccagcattggtaatggacaggcaatagtct

SEQ ID NO: 6811123 - DNA, 66 bp, Homo sapiens
gaggctggtggatcatgaggtcaggagttcgagaccagcctgaccaacgtggtgaaaccccatctc

SEQ ID NO: 6811124 - DNA, 60 bp, Homo sapiens
ggaggagcacttctgagctcagtgaatgactaggctgaagctccgtactatgacttttcc

SEQ ID NO: 6811125 - DNA, 64 bp, Homo sapiens
tccccagcctcgcagccctccagaagccagccctcagctgggagcagctttgcgagggagggga

SEQ ID NO: 6811126 - DNA, 89 bp, Homo sapiens
aggggccttctgttttccacacctcagtcaccctactaggagtagacaaaacttctcagtgtgttgagaggtctggagaaatggccttt

SEQ ID NO: 6811127 - DNA, 105 bp, Homo sapiens
agacttgtcgcatggaagtactcatggtccagagccccctttccagctttgaggctgggctctggaaatgggagctcctattatctccccattgcagttaagtct

SEQ ID NO: 6811128 - DNA, 76 bp, Homo sapiens
ctagactgtggtgctcgaaactttttaagggatgcctgactcctcaagaagtctgtaccatttgaatgagctctag

SEQ ID NO: 6811129 - DNA, 61 bp, Homo sapiens
gctgtagaaaccatctcactgctcagatcttaaaatctgtagccaagagaggctttgaagc

SEQ ID NO: 6811130 - DNA, 55 bp, Homo sapiens
actctttacttaaactctaagttgctaaccaactaatgaagtttgggttgagagt

SEQ ID NO: 6811131 - DNA, 70 bp, Homo sapiens
tgggtctgtcaaaagttttcaataaactaccttttctgaacccagtttattttgaaacatgataagccca

SEQ ID NO: 6811132 - DNA, 62 bp, Homo sapiens
tttaaactgggattcttcacaaggtgatggtagcattaccagagggcaaaccccagtgtgaa

SEQ ID NO: 6811133 - DNA, 57 bp, Homo sapiens
gtggggtcctgagtgctccacgctgaccagctgcatggccttgaaccaggtctccac

SEQ ID NO: 6811134 - DNA, 58 bp, Homo sapiens
ttgagctgatttttgaaggaggctgaggaggaggctttaattctttaattcagtttga

SEQ ID NO: 6811135 - DNA, 127 bp, Homo sapiens
cttggcttcctataaattgttttgtccttcctctcagctgcaatcagaagctaagggctcccgcaggccttgttctgatctgctgcagggaatggagggtttttgaaacagagaggacttggctgag

SEQ ID NO: 6811136 - DNA, 62 bp, Homo sapiens
gcccctcctgtgctcacctggaggcctctgtgctcagggcacccctgagacaaaggaggggc

SEQ ID NO: 6811137 - DNA, 55 bp, Homo sapiens
tttctagatgcttttgaaaatccctgctgtgggcgggtaaagaggcatctagaaa

SEQ ID NO: 6811138 - DNA, 70 bp, Homo sapiens
gtatatggatatggatgctttactgctgtgcttgtatccaagctggcactggatcgtgcatatcttatgc

SEQ ID NO: 6811139 - DNA, 64 bp, Homo sapiens
gtgttcattttcatttgttcagtttcttttgtcactcagaaaacatgatattgaggctgggcac

SEQ ID NO: 6811140 - DNA, 55 bp, Homo sapiens
ctgcatcctaacctccatgcagtcatcactggctgcactgcccttcaggtgacag

SEQ ID NO: 6811141 - DNA, 78 bp, Homo sapiens
cgctacgggcgctacgtggccacccagtggtgcgtggccgtctacagcctgtgcttcctggccacagtggccgtggtg

SEQ ID NO: 6811142 - DNA, 77 bp, Homo sapiens
gttcgaaaggtaaagtatctgcccaagttcagctatcaaattagttgtatcttttactggaattttatctttaaagc

SEQ ID NO: 6811143 - DNA, 78 bp, Homo sapiens
gctgactgtcatctggcctggccttgtgtttatccttcattagcggaacgggcatggccagggcagatggcaggcagc

SEQ ID NO: 6811144 - DNA, 98 bp, Homo sapiens
gtggtgtgtgagatcgacttctgttaacttgtaagagttgatggtgtgcatctttttttacacttagcattgagcgaaatcacattgaaatcagccat

SEQ ID NO: 6811145 - DNA, 65 bp, Homo sapiens
ttgcagtgtcatctagacgtggtagaaaaatagatatacccatgccatgttctgaattactgtaa

SEQ ID NO: 6811146 - DNA, 95 bp, Homo sapiens
actttatcgaaccaagtaaacatcagcaaatactactagtttttaaccattagttttaaaagtgatatttggagcaatatttggtatgatacagt

SEQ ID NO: 6811147 - DNA, 59 bp, Homo sapiens
tgtagtccaaaaatggggaaatattggctttaaccctattttatccccactggattaca

SEQ ID NO: 6811148 - DNA, 74 bp, Homo sapiens
tctggtggaccatgatgtgtagattctgttatgttttatgattttttctaacacagtcgtcgtcattttccagg

SEQ ID NO: 6811149 - DNA, 74 bp, Homo sapiens
tggcttaaaagtccacaaaattactatcttacagctctgtagggcagaagttcaatgtggttcttactaggcta

SEQ ID NO: 6811150 - DNA, 96 bp, Homo sapiens
gctaatgatccatagtaagatcccattatcaatcaggtttgtcggtatcgaacttcataaacaactgatggtaatctttgctatgaaaagtgtggt

SEQ ID NO: 6811151 - DNA, 62 bp, Homo sapiens
aacatagggtagctgtatgtcagtacttccctcctagaccagcatgcctgcatcttagtgtt

SEQ ID NO: 6811152 - DNA, 64 bp, Homo sapiens
tgacacaagatgctgacctcttgaaatcccttggatggaccatttcaaagagtgggcattgtca

SEQ ID NO: 6811153 - DNA, 83 bp, Homo sapiens
gtaccaatgtcaatttcctggttttgatattgtactatagttatgcaagatgttaccattagggaaaactgactgaagggtac

SEQ ID NO: 6811154 - DNA, 94 bp, Homo sapiens
taggcttcatcatatggttgaattctggccaatggaatgtgagaagaagtaatgtatgccacttccagaattagaatttaagatggtaggcctg

SEQ ID NO: 6811155 - DNA, 70 bp, Homo sapiens
tacacatgcggtttgcacgatatttccatgggacagcactgttctaaagagaggcgtgagaccttgtgta

SEQ ID NO: 6811156 - DNA, 75 bp, Homo sapiens
gctttcctgccctgtctaagctgtcagtatagcctatacctatggttttgctgacagtcaagatagcatattagc

SEQ ID NO: 6811157 - DNA, 66 bp, Homo sapiens
ctttgcccacatctgcttatttcattcccattcttttgtggggatgaggaagtagtgggggcaagg

SEQ ID NO: 6811158 - DNA, 67 bp, Homo sapiens
gtattctgccttcagacaccacagccagtttgatagttgtcccacatgctgttctgaagcagaaggc

SEQ ID NO: 6811159 - DNA, 74 bp, Homo sapiens
tgccctttggctgtcccaatcatatttgtaggtcaaaaaaagaccccatgtgtggagggcatgcatggagggca

SEQ ID NO: 6811160 - DNA, 71 bp, Homo sapiens
tgcgcaatcaaccttgtgaggatcaaatgaaacacgtacagttttcactgcagcccatgaagggatgtgca

SEQ ID NO: 6811161 - DNA, 66 bp, Homo sapiens
ctgtcagataagtggtatttttagcttttatgtgaaaccactttttaaagttgatcattttgacag

SEQ ID NO: 6811162 - DNA, 98 bp, Homo sapiens
ggcttgaaaaaactgcctgtgttttaaaatgtgcttgtgtttgtttcctaatgcagtactttgaagatattttaggtttaggtaagttgctttaagtt

SEQ ID NO: 6811163 - DNA, 63 bp, Homo sapiens
gaggaatggctcaggaaatgtgattttatgagagctcaagagttcatgtcttagcctatcctc

SEQ ID NO: 6811164 - DNA, 88 bp, Homo sapiens
agaactcagggacggtatggaactggctttacagatttgcctcttgttgcttgctattaaagttagtttcttatatgtctctgactct

SEQ ID NO: 6811165 - DNA, 62 bp, Homo sapiens
catctgacatctccctctgacatgtaaacaagactcttgaaagtgttcagaggaagaggatg

SEQ ID NO: 6811166 - DNA, 69 bp, Homo sapiens
ctcagacatgaagtctgacaaaagagccttgtgtggtgtagggctcagagtccagtttcttgtgctgag

SEQ ID NO: 6811167 - DNA, 69 bp, Homo sapiens
ggacacttggggtggtaaggcagcctgggagccagaacccctgggctgcccagcaggccccaggggtct

SEQ ID NO: 6811168 - DNA, 129 bp, Homo sapiens
ggcccccaggaggctgggcaggaggagcagggcacacagcatgctgcccagggactctctggctccagagtacccagcagtggctgctgctataaacctggctctcctgcctggccccagaggaggcac

SEQ ID NO: 6811169 - DNA, 80 bp, Homo sapiens
tgcacagactgtggcagctggggcatttgggagcctctgcagctcagcagctcccctcatgctccaccccgcacctggca

SEQ ID NO: 6811170 - DNA, 89 bp, Homo sapiens
ttgatgaataactgtgacaattgttgttgcatttttaaacatacacaaaaagtgaggccagcaacattgagactgcagttggatatcaa

SEQ ID NO: 6811171 - DNA, 75 bp, Homo sapiens
gaagtaaataaaaccactcttcctcttattttttaatgacgtgaaatgacaggttttgtggattatatttaggtc

SEQ ID NO: 6811172 - DNA, 59 bp, Homo sapiens
cccctcttccgggcaagccccaggcgtgagtcactggagagcgcgacgggaggaagggg

SEQ ID NO: 6811173 - DNA, 107 bp, Homo sapiens
agccaagtggctcactgggggatgggcattccaggcagatggatcagcaagcgcaaaggcttgaagcggggaatgtgcctggagtgttcaagaaagccagggtggct

SEQ ID NO: 6811174 - DNA, 84 bp, Homo sapiens
tgatggaggcagatcaacagtgaagagatcaagagaggaaatgcagaaactggttctagacctggcactgccctgtctgtgtca

SEQ ID NO: 6811175 - DNA, 60 bp, Homo sapiens
agacagctgaacctttccctggagctgcgctgttgctcaaggcgaatgttcaatgcgttt

SEQ ID NO: 6811176 - DNA, 84 bp, Homo sapiens
agggtcatggaaatggagtctgagggggtaagagaactgcctgaccccagagcttctgaccctcagatcatgtccatagaaact

SEQ ID NO: 6811177 - DNA, 61 bp, Homo sapiens
gctctgccaaggacccattctcttgatttcagctcaatgatcttgtctgccttggcagggc

SEQ ID NO: 6811178 - DNA, 123 bp, Homo sapiens
tcatgtgaaacagtgctaagtgctcacgtgaaacagtactaagtgctcacatgaaacgatgctaagtgctcacgtgaaatgatgctaagtgctcacgtgaaacagtactaagtgctcacatga

SEQ ID NO: 6811179 - DNA, 58 bp, Homo sapiens
tgaatggaagggttcatgtgtgaaggattgaagtgcctgcacatgcaacttttattta

SEQ ID NO: 6811180 - DNA, 59 bp, Homo sapiens
gctcaggtgtgtggctctggaccatgtgggaccaggtggttccttccctgcccttcagc

SEQ ID NO: 6811181 - DNA, 84 bp, Homo sapiens
cctgagaaggggacgggtcacaggcttgtcagcatgaggctcagcggggcttagcccactctggagcctgttccccttcccagg

SEQ ID NO: 6811182 - DNA, 89 bp, Homo sapiens
ctcttctcaccttgcagaatggagtgagagttaccaaatgtagagcaaggtcacagacttgtctccagggatgctaggtgatgacagag

SEQ ID NO: 6811183 - DNA, 58 bp, Homo sapiens
gcccaggctggagtgcagtggcgcaatcttggttcactgcaacctccgccttccgggt

SEQ ID NO: 6811184 - DNA, 56 bp, Homo sapiens
attgctgactcaataattgaaggaatctcttggttgcttcattgtgtggtcacagt

SEQ ID NO: 6811185 - DNA, 72 bp, Homo sapiens
tctgctggactgggagatctgttgggactgggcagagtctgtcttggtcactgtggatccccagtgcacaga

SEQ ID NO: 6811186 - DNA, 55 bp, Homo sapiens
cagaacagaggccttatgtttcagaaactaatgggaattatggtcactgttcctg

SEQ ID NO: 6811187 - DNA, 129 bp, Homo sapiens
agacataaaaaaacaatgttttcaaaagatactgaatgtcatggaaaaatttattcttatgttaagtgaaaaataggaagataaacatttgtatgtaaggaatcattagaatattgttaaaatgtgtgt

SEQ ID NO: 6811188 - DNA, 114 bp, Homo sapiens
ttcttttaaaagttattcttgtcattcattgtgatctgcagctctgaaagatacacctacgaacatgttcatagaaagagcatagtattataaatggctagacttttagaagga

SEQ ID NO: 6811189 - DNA, 62 bp, Homo sapiens
ttactttgctttctcattacaggcggccttcccctctgctccactggagagagtcagagtaa

SEQ ID NO: 6811190 - DNA, 90 bp, Homo sapiens
tattaaaagattgagaggacaagattaaccatagttaagtctttttacctctgatttaggaaatggaagattttgcttaattttttaata

SEQ ID NO: 6811191 - DNA, 58 bp, Homo sapiens
gcctggaaggtggaggttgcagtgagctgagatcgcgctactgcactccagcctgggt

SEQ ID NO: 6811192 - DNA, 70 bp, Homo sapiens
ctggataatttgggttgtggacccccctgaaatatcgtcttgagttatctctatcacctaaattaaacag

SEQ ID NO: 6811193 - DNA, 56 bp, Homo sapiens
gtctgtggtccctgctggggacagattgtgtcacgtgagcctcacagggaccagac

SEQ ID NO: 6811194 - DNA, 68 bp, Homo sapiens
agcagatctggcagtattaagagaagtgactcatacaacaggagtcacggctaaacttcaggtctcct

SEQ ID NO: 6811195 - DNA, 120 bp, Homo sapiens
tagttttaacatatataagcagtttaagctttttataaacattggactaggtttcataccaaaaagctatttcaaagtttgagacactataggtttgggttgtgacacaaatggagactg

SEQ ID NO: 6811196 - DNA, 58 bp, Homo sapiens
tcttcaaggaagtgatgtcttctgtaagtcaagagaaggcaagaaactttctgggaga

SEQ ID NO: 6811197 - DNA, 64 bp, Homo sapiens
tgcagatatctgaaggatgaacctctcaggtagaggaaacatccaaagcaaatatcttaaagca

SEQ ID NO: 6811198 - DNA, 87 bp, Homo sapiens
ttgatcaatcagatctgttgaagtatgataagtacctaagtgtatcagagggtaagtggacatttcagcaaagttttgattggtcaa

SEQ ID NO: 6811199 - DNA, 111 bp, Homo sapiens
ggtagccaactatttatagggtagaagtctggctttaaggagtaaaaatgcctccatttcatgttggttttattaccccttaaacaccagtgcccttgaattgtgtgctcc

SEQ ID NO: 6811200 - DNA, 58 bp, Homo sapiens
agcaccgtcatagccaggtaagatttgcattgtctcttcatctggtcacagacgggct

SEQ ID NO: 6811201 - DNA, 129 bp, Homo sapiens
atagggtgcatctagggggtaatgggattgtttgatatagaggcaggaaatagttcagtcaaactgtaggaaaactacagtgataatttcatgtttagacattccaaggccccttttgttacagcatgt

SEQ ID NO: 6811202 - DNA, 63 bp, Homo sapiens
ttgaagatgctgtctcttccagatccttcaagattggaaaaagaaggtgatgagcatttttaa

SEQ ID NO: 6811203 - DNA, 86 bp, Homo sapiens
acagaaaaatcatttaacctctatttttataaaagtgaacaatgccattttgtatagtctgtggatgtcgtagatggtagttatgt

SEQ ID NO: 6811204 - DNA, 73 bp, Homo sapiens
gctagtgccatttctcaaaacacagtttgggaaacacagccctaattgatcctttaaggaagtggcaattagc

SEQ ID NO: 6811205 - DNA, 76 bp, Homo sapiens
gagtgtgtgttttatccctgccaatggtaactttatttgcaaagctgagtacgtttggaagatagaaacaatactt

SEQ ID NO: 6811206 - DNA, 82 bp, Homo sapiens
aggatcagaggctttaaatggcttgcccaagtcagaaaactaagtggctgaggcaagatttgaacccaggcaatctggtcct

SEQ ID NO: 6811207 - DNA, 65 bp, Homo sapiens
gcagatcctttatagcagtgtccaagtacagatcccctgttagggcaaagctaaaaggaacctgc

SEQ ID NO: 6811208 - DNA, 100 bp, Homo sapiens
taaggaaaaggcaggcagctgctgggttcagcctgtgggagaaaacaacctacaaagtgctcggtgaactcatccctcagctgcagcgtctgtttcctta

SEQ ID NO: 6811209 - DNA, 57 bp, Homo sapiens
tgggcaggttgttatttgacataatgttttctactatgtctgtaacccacttgcccg

SEQ ID NO: 6811210 - DNA, 65 bp, Homo sapiens
cctgatccttttctgcagagccagaaaccatttcgttcaaggtggccaaaaggaagaaggttagg

SEQ ID NO: 6811211 - DNA, 98 bp, Homo sapiens
gaaattcttaactacctctctgctcactattacatggacagtgttgtccttcatgttcttgtgagaagtgagtaataggtataacatgtgaaggtttc

SEQ ID NO: 6811212 - DNA, 64 bp, Homo sapiens
ctaaggacttttatggaaacctaacttgggatgatttaattccaggtatctttatgaaacttag

SEQ ID NO: 6811213 - DNA, 65 bp, Homo sapiens
aggaagcccagagtcaagcttaccattaaatttttgtgtaacggtaataaagactttgctttcct

SEQ ID NO: 6811214 - DNA, 69 bp, Homo sapiens
gggtcacgcagaggctgtagggaaggttgctattcttaggcccctactatctcaggcgtctgctgactc

SEQ ID NO: 6811215 - DNA, 63 bp, Homo sapiens
gaaagcacagtgggcagagcagccctccatactcatgggggcagggatgaccctctgtgcttc

SEQ ID NO: 6811216 - DNA, 101 bp, Homo sapiens
cttagctctgcttccttattgactctaagttcctcaaatgcagagattctttccatctttgtcatattgaaggtgcttaataaatttggtgtataaataag

SEQ ID NO: 6811217 - DNA, 129 bp, Homo sapiens
tttgtttctctgaggccaatgggtgggaggaagtataaagaagtgtaaacaggaaagccagctgggcctggagttccaagtgcccatatttcatcagcttcctctccataactgtggcagggacactta

SEQ ID NO: 6811218 - DNA, 130 bp, Homo sapiens
ttgtttcatagacagagagggagggtgaaaatgaaggctttaaagtcagggagattgaggcttgaatccttctggctctggctcctggctttgtggtccaggtcacattccttaaatctgtgatcctcaa

SEQ ID NO: 6811219 - DNA, 56 bp, Homo sapiens
cttaggaaaagaagacatttctacagtatttgtagtaatgtgatgcttttcctcag

SEQ ID NO: 6811220 - DNA, 67 bp, Homo sapiens
accagcaaagtctcaggcagaggaaggctatgcttgatagcaacaccatctggtgagaaaagctggt

SEQ ID NO: 6811221 - DNA, 71 bp, Homo sapiens
gagactaaagggaagggtgatggagctgcctccagataggcagacaaaccagtaaacccttcctcagtgtc

SEQ ID NO: 6811222 - DNA, 129 bp, Homo sapiens
aagcaagtaagtcatggacattctatgcataggtcaagttaatgttattttatgctaaattgcatagcattctgtgataggcatttaactctaagtgtatctaaggataaaaaatgtgattgcctgttt

SEQ ID NO: 6811223 - DNA, 63 bp, Homo sapiens
tgcttctcagagcctcagtttgcccatgtgtaaaactgagatattaagctctggcttgaggca

SEQ ID NO: 6811224 - DNA, 56 bp, Homo sapiens
tcagctcccaggaactaagaatcatgatttgaaatataaggactcctgggagttgg

SEQ ID NO: 6811225 - DNA, 61 bp, Homo sapiens
tcaactttctatctctatcctgtttgtttgtttaaagaggctggattgagcatagacatga

SEQ ID NO: 6811226 - DNA, 84 bp, Homo sapiens
ttgtgaatatcaaatgagtgtacgtgaaagtagatatataagttattatgttcaatgtttatatttcttcgttcattctcacag

SEQ ID NO: 6811227 - DNA, 91 bp, Homo sapiens
ctgttggcctcctgcagatgaccagccgagataaacagagggcacccactctctgttgcaatgtgcatggtgatgtgaaggaatcaatcag

SEQ ID NO: 6811228 - DNA, 83 bp, Homo sapiens
gtaacttggttgtccagaagagatcacagttcttggcaaacatgtttacgttactctaggatgtggctttggacagatgttat

SEQ ID NO: 6811229 - DNA, 93 bp, Homo sapiens
attgatcactttttcttatgaaatgtattcagatatgtattgaagacttatttgaatgcagtctgtacattttaagaatttcagctgtttaat

SEQ ID NO: 6811230 - DNA, 59 bp, Homo sapiens
ggtcaagggacttgctcaaggccacacagctagaaagaggcagagccaggcctttggcc

SEQ ID NO: 6811231 - DNA, 108 bp, Homo sapiens
taggcagacttcttgcccctccttggggagaccctgaggttttctgtactagacagagtttgttagtgcagctgagccccatggctgcccacagcggtaacctgctta

SEQ ID NO: 6811232 - DNA, 72 bp, Homo sapiens
ctattgaatgaagtccctttttactaaatttggatatctagtgagttttcaagggacatttattttaagtag

SEQ ID NO: 6811233 - DNA, 82 bp, Homo sapiens
gcacacaaccgcaagctgtcagtgaggtgagacatgcaacaagccaaggtatgtctttattctctgatgcgcggtttggtgt

SEQ ID NO: 6811234 - DNA, 77 bp, Homo sapiens
ttccaaagagaagaaatatggattatagattcgcagtttagaatctgtagagacgaatgtgttattttcctctggaa

SEQ ID NO: 6811235 - DNA, 115 bp, Homo sapiens
cgaggtcagtgaagatttaaacaggggatacagtgcctcttaagtgtcacccagtatagctgagtgacacttcagaggcaaagtctaccttgtcttaattgcagtcacaaccctg

SEQ ID NO: 6811236 - DNA, 76 bp, Homo sapiens
gcctatatgatggagggaagtattttggcaaagcatgcatgcctggctcatgacaatatgttctttcattattagc

SEQ ID NO: 6811237 - DNA, 106 bp, Homo sapiens
atatactacattttctttatccattcatttgtcaacaggcatttaggttgttttcatatctttgctattgtaaatcacgtggcaataaacatgggaatgtggatat

SEQ ID NO: 6811238 - DNA, 57 bp, Homo sapiens
tctttctaatggttcttgacctttaaagtcaaggaaggttatttttgcttagaaaga

SEQ ID NO: 6811239 - DNA, 73 bp, Homo sapiens
gttctatcaggttgtaagccaggagtgtggaccctggagtggggatccactctaattactaccttcttagaac

SEQ ID NO: 6811240 - DNA, 57 bp, Homo sapiens
ttggcagtcaccatcgtgtagatggtaatggatggtatgatttggggtgattgctga

SEQ ID NO: 6811241 - DNA, 64 bp, Homo sapiens
agtggggaggaaaggctccctccctctgcaccagtctttgcagagggtccttaccttcctcact

SEQ ID NO: 6811242 - DNA, 79 bp, Homo sapiens
gcttctacctcctcacagatgagcatcgccagctcttctctgcaaggaaagagctggattgtgctgcagaggagagagc

SEQ ID NO: 6811243 - DNA, 62 bp, Homo sapiens
tatgatagtgagggaagtcatagtcatctgaagtgatgtctagcacatcatctcactgcata

SEQ ID NO: 6811244 - DNA, 68 bp, Homo sapiens
tcaatgtcattgactttccagaagcaacctatacctcgggtttgctcttgatacatcaagaactttga

SEQ ID NO: 6811245 - DNA, 66 bp, Homo sapiens
ggcagccttagcaggtccctgcagcctaagcgtgctgtcagggccaccctctgctgggtgctgacc

SEQ ID NO: 6811246 - DNA, 62 bp, Homo sapiens
cgttctcctgctggtgcctccttcttgccgagagcaagggagcatgggtgaagcaggccacg

SEQ ID NO: 6811247 - DNA, 60 bp, Homo sapiens
caagtgaatgatgtgaagtgtaaacaaccatctatgtttcatgttactgtcatacacttg

SEQ ID NO: 6811248 - DNA, 126 bp, Homo sapiens
gattatcatgtacaagagtgagattatcatgtacaagagtgagattatcatgtacaagagtgagattatcatgtacaagagtgagattatcatgtacaagagtgagattatcatgtacaagagatc

SEQ ID NO: 6811249 - DNA, 71 bp, Homo sapiens
acagaagcatggcaggtgtggggttttatggggagcacttccgtatcctcttcctgctgtgcttgagctgt

SEQ ID NO: 6811250 - DNA, 60 bp, Homo sapiens
ggccaacaggagaggggaatgtagagtctgtgaccatggcttcccacttttctcagtgcc

SEQ ID NO: 6811251 - DNA, 56 bp, Homo sapiens
tctgctttgctgcctcctgatctagaagatttagactaggaattcaagtagacaga

SEQ ID NO: 6811252 - DNA, 92 bp, Homo sapiens
atttttgtgtggagacaaggtctcactatgtggcccaggctggtctcgaactcctgggctcaagtgatcctcctgcctcggcctccaggagt

SEQ ID NO: 6811253 - DNA, 64 bp, Homo sapiens
ggccctttcctgtcataatgtccgatgtcaggccacgaggcttcgaatggcaaggaaagaggct

SEQ ID NO: 6811254 - DNA, 69 bp, Homo sapiens
gtcaatagcatacccagtatctggacaagagtacttctctggaagatgacctgggtaaaacttcatgat

SEQ ID NO: 6811255 - DNA, 90 bp, Homo sapiens
cttagtaggactgtggtgggacctggcaatttgcatctctcacaagctctcaagtgatggtgatgctgctggtctggaacctcctttgag

SEQ ID NO: 6811256 - DNA, 82 bp, Homo sapiens
agcgctgggttgtggcctgggctagggggccaagagggccgagtctaaggtggtttgcctgcccacgactacagcaggggct

SEQ ID NO: 6811257 - DNA, 66 bp, Homo sapiens
agtgagttcacaaagtactgtatgcatctgtttgaagatgggcagaaatcttgtgaccatctcact

SEQ ID NO: 6811258 - DNA, 87 bp, Homo sapiens
gaacaagagagcagggactgagccagtgggactgactatcaacatgacaaatctcatttggctttgttttaaattgctctccagttc

SEQ ID NO: 6811259 - DNA, 57 bp, Homo sapiens
gacagacactattggtatgcctgctacagtaagcagccacccttctgagtgattgtt

SEQ ID NO: 6811260 - DNA, 129 bp, Homo sapiens
atggaattaggaccagaagcttgtctgatgctttcctttttactgtatgagtgtggtagtctttgaacaagtgaatggcatcatagtgcagtagaggagagcccaggattggaatctagcttttaccat

SEQ ID NO: 6811261 - DNA, 104 bp, Homo sapiens
ttctagacttttaaagcccaattcagcaattattttaaggagaggtcaaacaagcaggctgaagctacaaaagattattgctgttttggttaaagcagctagga

SEQ ID NO: 6811262 - DNA, 84 bp, Homo sapiens
gaagccttatgttattttctaagataaaacttgaatgaaatttcttgaagtttcttgaatcttggagtgggactttcaggcttc

SEQ ID NO: 6811263 - DNA, 114 bp, Homo sapiens
gccccaccaagcctgtgtgtgaccccagagtctggttgttttgcctcattcaggtttctctgggtccccggaatgattcaggatccacgctctccgtcagctctggaacggggc

SEQ ID NO: 6811264 - DNA, 87 bp, Homo sapiens
attataaagcataacagtacatccttttctcttgcagtcctttattaaaagaaagaggaagaggaagtattggaccatgcctataat

SEQ ID NO: 6811265 - DNA, 61 bp, Homo sapiens
gagctgaggctcaggctggcgttatctggctgcagcagccgccgcctgcaggcctcgggtc

SEQ ID NO: 6811266 - DNA, 85 bp, Homo sapiens
gcattgattagccttgaagttcatgtgtctgcagacccatataaaaatgtattatctgtcaatatatgtgctgcagggaaaatgt

SEQ ID NO: 6811267 - DNA, 70 bp, Homo sapiens
ctgagtgacttccatttctggcctcccttccttatctgtaaaatgggtaggttgaaataggttatctaag

SEQ ID NO: 6811268 - DNA, 93 bp, Homo sapiens
tatcttcattatgtaggtaaagacagtgacttctaaagagactaaacatactccaaatagatacttattcgttgtttacaaataaggaggata

SEQ ID NO: 6811269 - DNA, 58 bp, Homo sapiens
tgcttgtccctctttatgatggcatttacccctttgcataaagatgtgggggccagca

SEQ ID NO: 6811270 - DNA, 67 bp, Homo sapiens
ggtgagaaagcacacacctcactgcctgcttctgttgaaggttgtgtaaatgtctgtctttcttccc

SEQ ID NO: 6811271 - DNA, 77 bp, Homo sapiens
atgatgaattagcttcagcttgtggggcacacacagatggaagtataaggtggcctcaggagtaagtaaatccccat

SEQ ID NO: 6811272 - DNA, 81 bp, Homo sapiens
cctctctcctgtgcaccctccctgtggtcctgagccctgagggaaaggctggtccagggaggccttgcctgggaggggtgg

SEQ ID NO: 6811273 - DNA, 70 bp, Homo sapiens
gttctccaggcgcctccttctccactctttctccagtgctggagacctaggggtgtgcatcctggaggat

SEQ ID NO: 6811274 - DNA, 75 bp, Homo sapiens
ttctcttgcttgatacatggaggaaatgcctctgtaaccctgaaagggttttctttgatgtaacagcaacttgaa

SEQ ID NO: 6811275 - DNA, 77 bp, Homo sapiens
cttccttccttcctcacccactacactcaagggccagagatggcctaggtgttgagtgggggagaaagggaagggag

SEQ ID NO: 6811276 - DNA, 92 bp, Homo sapiens
tccctctgcctttggaaaattctttcatggctaataagataacacttctattcccattttattgctgtgttagggacagtctagaggttgga

SEQ ID NO: 6811277 - DNA, 76 bp, Homo sapiens
cggagggaaggcggggcaagcacagcgagcgtgcgcaatagcgcagtagcggcgcatgcccatttggcttcccccg

SEQ ID NO: 6811278 - DNA, 112 bp, Homo sapiens
gctcacaacagcctctgtttttactatgtgaactctgactctcatgcctgatgggcatcaaatccaagggtatgaatcaggttctctggaagggaactgaggatgcttgagc

SEQ ID NO: 6811279 - DNA, 68 bp, Homo sapiens
tgctgaggcagtcctaacaggagcagaaaggataacagctgcctctgtgcaggtgtgtttgatcagca

SEQ ID NO: 6811280 - DNA, 65 bp, Homo sapiens
aggtaggtgctgtgatcacccctgttttatagaacaagaaacggaaggctggagaagtaccatct

SEQ ID NO: 6811281 - DNA, 64 bp, Homo sapiens
gtgcattctttgaatgcttctaatgactgacaggattaggaatctggtattcagagaatggaac

SEQ ID NO: 6811282 - DNA, 62 bp, Homo sapiens
actttgtaacagctgcttaatagagcggggaaatgtttctgttttaagccctgttaggaggt

SEQ ID NO: 6811283 - DNA, 98 bp, Homo sapiens
catttcacaggctccaagtgcttcgttctgtattgggaacttgggagaaattcaatgcctgtcagatgaagtaattgtggagtaattgctgtgagctg

SEQ ID NO: 6811284 - DNA, 70 bp, Homo sapiens
gaaggtggcctggggtctcaattctagcgggctgatgcagcccacctggctctgaggctccagattcttc

SEQ ID NO: 6811285 - DNA, 57 bp, Homo sapiens
caggttagcaacatggttagagaagtgcagccctctggatcacttgtggctaccctg

SEQ ID NO: 6811286 - DNA, 72 bp, Homo sapiens
tcttcaagatcccctctgaagtgtgtgtagcactagttgctctatctttgcttgagggaaagagcttggaga

SEQ ID NO: 6811287 - DNA, 71 bp, Homo sapiens
gccctttcccaatttcgagagttttagagtttcattattagagagctaaaaaggaattggaaaagttaggt

SEQ ID NO: 6811288 - DNA, 72 bp, Homo sapiens
acatagtaagtgctcagtaaatgtcagttaacacaatcctaacagcttctatttattgagcacttgctatgt

SEQ ID NO: 6811289 - DNA, 62 bp, Homo sapiens
gagtggcttttttatggtaatgttttataacaacacaaacgtactttgtcttagagccactt

SEQ ID NO: 6811290 - DNA, 62 bp, Homo sapiens
taaactttcctttgtctgggtgtggtttaagcacaggccatgtttggcagaaggattgttta

SEQ ID NO: 6811291 - DNA, 86 bp, Homo sapiens
cttaaaattgttgttactttcttgagtgatgcttagtgtggaggcaactctacagagggtttctaaggatttggcaatttgttgag

SEQ ID NO: 6811292 - DNA, 130 bp, Homo sapiens
tacaaacatatgccaaaagcagagcacttttctaacatagtttaagattgctaggagatgaagaggctacatgtctgtaattattttaggggggtgctttataagaactgtttgcttaaggatgactgta

SEQ ID NO: 6811293 - DNA, 66 bp, Homo sapiens
ccagggaatttgacttcagcctgtacttgtaactactgttctctatgggtagaagtcaaaaaatgg

SEQ ID NO: 6811294 - DNA, 68 bp, Homo sapiens
gtctgaaacaagtttaagggatctatgttaaagctgcctaagcatagatatgtatacttgtttgaggc

SEQ ID NO: 6811295 - DNA, 75 bp, Homo sapiens
gagttcttcctgccacaggtcttagaggttgagtgtttggactaagccctgagcgtgaggaggaagtactgactc

SEQ ID NO: 6811296 - DNA, 55 bp, Homo sapiens
taagatggtccagaagggaggcttttcttaccctttgaagagggccaacctctta

SEQ ID NO: 6811297 - DNA, 68 bp, Homo sapiens
gagaatttctgaaaggtatcccaaaacatcttgttcttatggctaatgggctctattcagagtttttc

SEQ ID NO: 6811298 - DNA, 75 bp, Homo sapiens
taactactaggtttaggccaggcaggcccaggcctagtttcgggcctggcgccgggctgcctgtctttggtttta

SEQ ID NO: 6811299 - DNA, 56 bp, Homo sapiens
actgtgtgtgtgtgtgtgtgtgtgtgtgtgcgtacacgtgtgtgtacatagatagt

SEQ ID NO: 6811300 - DNA, 58 bp, Homo sapiens
ggccaagagctccttcttaaccgcacaggcatgtgaggcccagaagactggctctgcc

SEQ ID NO: 6811301 - DNA, 55 bp, Homo sapiens
gctggctgtatcacctggccaggtattatttgcattaataggagaacagctaagc

SEQ ID NO: 6811302 - DNA, 88 bp, Homo sapiens
tgaacattcgaggactggtttcccggaactacagtggtttaaatcgtgcttgatgactgtttttaaaagagccttctatgactgttta

SEQ ID NO: 6811303 - DNA, 56 bp, Homo sapiens
cagcatctcgtggctggatagagatggcacagccccagcctccatgtagatagctg

SEQ ID NO: 6811304 - DNA, 123 bp, Homo sapiens
gttgtgactctacttgtataaataattaattttttatgtcttgccagttcctggaaccagcttgatattctttgtgtagaagctagcctggagccagcagacatgaataggcagaagcagaat

SEQ ID NO: 6811305 - DNA, 79 bp, Homo sapiens
taatacctggtgtgtttagcttctgggctgtagtgagcatcacacagagcttcccagcctgagcattgcctaaatatta

SEQ ID NO: 6811306 - DNA, 72 bp, Homo sapiens
atgacaatgtgacagaccaatgatacaatgggaaaagcctgaaacagtacgttgagtttgattaaaagtcat

SEQ ID NO: 6811307 - DNA, 57 bp, Homo sapiens
aatgtcagcctgaaagctattcttcacttcaaggggattagagcttcagctgatatt

SEQ ID NO: 6811308 - DNA, 61 bp, Homo sapiens
ctgcagagaatggtgaagtatttctgtctgatttcatgaagcttgtcaccatttctttcag

SEQ ID NO: 6811309 - DNA, 55 bp, Homo sapiens
agccattattgagtgcctgctgcgtgcataggtttgtagtaggcactgtggggtt

SEQ ID NO: 6811310 - DNA, 76 bp, Homo sapiens
agggaaaagagctcctggaccttggacaaatacatttctaaaaaaggtttaggatattaatgttcagagtttccct

SEQ ID NO: 6811311 - DNA, 60 bp, Homo sapiens
atggactggacatggagggtgagagagacatcaaacctgaacctttggtttttggttcat

SEQ ID NO: 6811312 - DNA, 66 bp, Homo sapiens
aagaaagtgctttgtaaattatatagcatagtagaactgtgtgcaataatgtacaaaaactgtctt

SEQ ID NO: 6811313 - DNA, 61 bp, Homo sapiens
cttcactgtactttggcaatgcttaaagttttggaagtgtagcaaaatgcctatggtgaag

SEQ ID NO: 6811314 - DNA, 70 bp, Homo sapiens
tgctgccttagcagccaggcaattcagcttctgctgcttccccatctgtctggattgctgagccccagta

SEQ ID NO: 6811315 - DNA, 65 bp, Homo sapiens
ggtttggtaagaagctttggttttatattttgttccctcgataagaatcagtcttctgccaaatt

SEQ ID NO: 6811316 - DNA, 57 bp, Homo sapiens
cctcttggccagagaccagagcagggcttagcccactcatagcttcaggccaggtgg

SEQ ID NO: 6811317 - DNA, 78 bp, Homo sapiens
tcggacgcctgagaagaggaactgggggctgagtcctgtcctggcctggccgctccccattcctccctctgcctctga

SEQ ID NO: 6811318 - DNA, 59 bp, Homo sapiens
ggcagtggaccaaatgaatggtaatgagttcagaggagccgcttaatcatttgtctgcc

SEQ ID NO: 6811319 - DNA, 129 bp, Homo sapiens
cttattctatagactacaatttctacctatattcaaatggcatttagttgcgtattgcatatattttatctgatttgtagctacatgtctgaagctaggacaatgatattagtaaatagtacagtaaag

SEQ ID NO: 6811320 - DNA, 84 bp, Homo sapiens
gttaaaatgcatatttccaggccccactctagacctgttgaattcaaatctctgaggatgaggccctggaatcagcattttagc

SEQ ID NO: 6811321 - DNA, 66 bp, Homo sapiens
tagacattggccattcctgtggcactgtgcattgggcacatgatgccacgggaatgcctagttctg

SEQ ID NO: 6811322 - DNA, 71 bp, Homo sapiens
aggagtcagattttctctggtttgttccaggaagttttccgtagaatcccagaggacatccagtgattctt

SEQ ID NO: 6811323 - DNA, 55 bp, Homo sapiens
gtgtctttattcctctatgtttcccaactctggttccaaagaatagtgaagacac

SEQ ID NO: 6811324 - DNA, 65 bp, Homo sapiens
tcaggaaaggtttgttgaatggggaactaagaagtgaattcgttcgttcgacaaacgtttcctga

SEQ ID NO: 6811325 - DNA, 63 bp, Homo sapiens
ggcagtttggggctagtgggcaaggagatttttcccacttcttgcttctctagatcaactact

SEQ ID NO: 6811326 - DNA, 73 bp, Homo sapiens
tgtgactgtattacatatttttgaaaactactccgtggcatattgttaggaagtttcagaaaatgcaggaata

SEQ ID NO: 6811327 - DNA, 63 bp, Homo sapiens
gttagcagtatggagcgaggcccagatccagacttctgtcggcctaattttatatctgtggac

SEQ ID NO: 6811328 - DNA, 130 bp, Homo sapiens
aactagtcatgactcctgattaggcagagacctaggaagctgtgcggaccctgcaggtttgctacagctctttcaggagtgtttgctacagtttcctttgctttgctttaaccataaggagacacaagtt

SEQ ID NO: 6811329 - DNA, 83 bp, Homo sapiens
tggagaagaaggtctaccagggatctaggagggcatgcaacatatgccaggcattattccgatccctgtgtattggttctcca

SEQ ID NO: 6811330 - DNA, 56 bp, Homo sapiens
ttttgaccaaattatacggggttttaccacctcttgtgtgtagctattggtcaaaa

SEQ ID NO: 6811331 - DNA, 57 bp, Homo sapiens
gccacatccaggtggatcaaattagttaagagggctgtgagttcatttgcatgtggt

SEQ ID NO: 6811332 - DNA, 82 bp, Homo sapiens
ctgggccacgggaagaacaaaatctaatttgggcatttcattttatgagttgatcattatttggtttcctttcctggttcag

SEQ ID NO: 6811333 - DNA, 70 bp, Homo sapiens
ccaggggagctgtagaaagccctgggctgggaaggagacctcaggtccagctgttgcagcctccccatgg

SEQ ID NO: 6811334 - DNA, 56 bp, Homo sapiens
aaggcagagggctggatcagagggtctcttaagaccccttctagctcatctgtttt

SEQ ID NO: 6811335 - DNA, 125 bp, Homo sapiens
tgtctgtaggttatggatgtgattgagattggaaatactgagagataaacacacgttctagtgagttcactggtttaactttgtctttgcaggtttcagtttttattgctctacccctttttaca

SEQ ID NO: 6811336 - DNA, 88 bp, Homo sapiens
gctggagccaacccttggcctgctccagagaggccactggtgagcttgttattactgatggcttttcagggcagcccctgagcccagt

SEQ ID NO: 6811337 - DNA, 61 bp, Homo sapiens
gccattatccattttgagtcttaccgcaactcttgtggggtcaggcaagactggtggtggc

SEQ ID NO: 6811338 - DNA, 117 bp, Homo sapiens
ggcatctgctgctccctttgcataagacgggagggtatacgtttcctgagctgatctgactctgagagccagggtgggtgaatgctattttgttgctggtagagggatctgtgggcc

SEQ ID NO: 6811339 - DNA, 67 bp, Homo sapiens
actgctacattgaaatttgtcatgtaactatattcattcattatgcatgattctgcaaatgagtagt

SEQ ID NO: 6811340 - DNA, 57 bp, Homo sapiens
gagactacagccttttttgaacttggatggtgacttcataaagagtgctgttgtttt

SEQ ID NO: 6811341 - DNA, 55 bp, Homo sapiens
gtggagagttaagtgtctgggagccttccctcctgaatgcgacatttctctccac

SEQ ID NO: 6811342 - DNA, 96 bp, Homo sapiens
tcatagaaaaaattcccaagtttcagtgttgacagatggtgttactctgcaatataagcagcaatgtcctcacgagactattgattttgtttgtga

SEQ ID NO: 6811343 - DNA, 74 bp, Homo sapiens
tcagtatgtgctaactgtcatgcacatgtgtttataatgctgagcatatgatgatacttggtcatccatgctgg

SEQ ID NO: 6811344 - DNA, 78 bp, Homo sapiens
ctttcttgctacagattttgtgaagaagtgttactcaaactttaggtgacattaacaccataagtgtgttaggggaag

SEQ ID NO: 6811345 - DNA, 78 bp, Homo sapiens
gcctgatcacagtccgccggcctcacccctgtgtccttgggcagctgggaggaaaggctgggggtcttcagatggggt

SEQ ID NO: 6811346 - DNA, 55 bp, Homo sapiens
gaagaggtgagaccaccactgaaacccactctgttttgtggaattctcactcttc

SEQ ID NO: 6811347 - DNA, 89 bp, Homo sapiens
ttcctgtatttgctttgttttgatttgaaatcagtctttgggattacattggataattttttcatgttattaatagtgctgtgcaggga

SEQ ID NO: 6811348 - DNA, 55 bp, Homo sapiens
atgatggagaatgtatgctatggaagaaattctactgtatgtgttctctagtcat

SEQ ID NO: 6811349 - DNA, 61 bp, Homo sapiens
cagaccccctgaagagaggaagctggaccactttgtgctctaaggtcagggcgaaggtctg

SEQ ID NO: 6811350 - DNA, 82 bp, Homo sapiens
agtcatcaggttttgtgaggacctcagcagagtctgtcctcaggcaggagtcattgagaggggtccttggagttctggagct

SEQ ID NO: 6811351 - DNA, 75 bp, Homo sapiens
ccaagcagccttttccaaggacactctgtcaacctacacagaccagtgacttcattcctaaaaaaggcctgcagg

SEQ ID NO: 6811352 - DNA, 68 bp, Homo sapiens
tttcttgatctgagatctaaaccagaggttgtttgaaagacctctggtgaattagtccagacctgaaa

SEQ ID NO: 6811353 - DNA, 69 bp, Homo sapiens
cagcataatgatgcagttactgtctcatgttatttagcttgggttcaggcatcattattttatcagttg

SEQ ID NO: 6811354 - DNA, 99 bp, Homo sapiens
gagcagagctgcattcctttctggaggtcctagaggataattcattcccttgccttttccagcttccagaggccacctggattcctcagctcatgactc

SEQ ID NO: 6811355 - DNA, 67 bp, Homo sapiens
tttatggtaagatggcaatcatttggagagtttgaataatgtaatctgatttccatcttaaaataaa

SEQ ID NO: 6811356 - DNA, 107 bp, Homo sapiens
gtgtttgacattcttgtgggctctctaaagtcttagatcactccagccttgtatgctaactttggagactgataaaggctattggtgcctaaaaggctgtgaaatgt

SEQ ID NO: 6811357 - DNA, 125 bp, Homo sapiens
tggctgagtttactggagataagtatagttttatagtaggtcatagagatgctgtttcatccatttgaggatatgaaagtgcaattctgtagaatatttgaacttgacatatccccactgggcca

SEQ ID NO: 6811358 - DNA, 78 bp, Homo sapiens
ctgagaaaggaattcaaagctactgactttagctacttattacctcaagtctgcaggctgtgattttttaaatttcag

SEQ ID NO: 6811359 - DNA, 102 bp, Homo sapiens
aagagaaaacattaggttggtgcaaaaggcattgtggtttttgcctataaaagtaatggcaaaaaccgcaattccttttgcaccaacctaatatttttactt

SEQ ID NO: 6811360 - DNA, 83 bp, Homo sapiens
ccctggggccggggtgcagctgagggcctcttctagggacccaactcctgatccagcccctgccggccgcaccttccgcaggg

SEQ ID NO: 6811361 - DNA, 69 bp, Homo sapiens
tgagtactgatttaagatacacacatgtgaatcattctctctgtggctgtgtctcaagtcagagcatca

SEQ ID NO: 6811362 - DNA, 99 bp, Homo sapiens
caggaacaggccattttcacttcttttgtgattcctcagttacttcaggccatctggatgtatacgtgcaagtcacaggggatatgatggcttagcttg

SEQ ID NO: 6811363 - DNA, 76 bp, Homo sapiens
ggctgggttcctcctggaggctctagggaaaaatcgaatttcttgtattttccaccttctggaggctacccatgtt

SEQ ID NO: 6811364 - DNA, 59 bp, Homo sapiens
ggccagactgagtgaggtcaaggtcttttgcctctgaagttccatgctcagtcccggct

SEQ ID NO: 6811365 - DNA, 71 bp, Homo sapiens
gctgtcaccgtctgggcatctgagcccagggagcccccgaggtcagctgtctccccagagtggagagcagc

SEQ ID NO: 6811366 - DNA, 70 bp, Homo sapiens
taatctgagtgtgactggttaatgaggctgaaaaagagtatcatgatttaatacactcatctactgattg

SEQ ID NO: 6811367 - DNA, 59 bp, Homo sapiens
attgtaaatggttgaaccccagagaattttcctgtctcactgggccatccttttacaat

SEQ ID NO: 6811368 - DNA, 63 bp, Homo sapiens
cctggcagtcaggggagtccttaggaagaggaagacagaatagggcgccccgggaatgtcagg

SEQ ID NO: 6811369 - DNA, 62 bp, Homo sapiens
gctccagatgtatactttccaaggttctgctctcagccctttttaaaagtggcatctgaagt

SEQ ID NO: 6811370 - DNA, 68 bp, Homo sapiens
gtatcagcaagtatgcatttggggtgattaggtaagaatctagataattaccatgcaacttgtgaaac

SEQ ID NO: 6811371 - DNA, 66 bp, Homo sapiens
atttatggccaggttctggggaggtacaaagtatgattcttgcttccagggacttggaatttaaat

SEQ ID NO: 6811372 - DNA, 90 bp, Homo sapiens
cttggcctaacaagcggcagccctggctagggcgagggcagttgcttccgaggccccgccccagcctgggctgagccgggagcggccgag

SEQ ID NO: 6811373 - DNA, 72 bp, Homo sapiens
gtgctttgctcctttccctgtggtgctggtctttaaaacaaacaaaccaaccacaaagaatgggggaagcat

SEQ ID NO: 6811374 - DNA, 85 bp, Homo sapiens
gtctccttagcatcattagtcacttcttccttcatcacttcccagtggataggaggttagtaagtggcttaaccgctaccgagat

SEQ ID NO: 6811375 - DNA, 66 bp, Homo sapiens
ggagagaacagggacgttgagggagatggatcaaagggccatttgttgagaacgtgccttctctcc

SEQ ID NO: 6811376 - DNA, 89 bp, Homo sapiens
gaggagagaggcctgactttcctgccaaggccagagttgcccctggctccagctcgcctggctggatctgggtccagggcttcctcctt

SEQ ID NO: 6811377 - DNA, 60 bp, Homo sapiens
gatttgcattctgaaagctaccaaggagtagaggctctgacagtttttaagaattaaatt

SEQ ID NO: 6811378 - DNA, 67 bp, Homo sapiens
gttagagatacatttgtagcttgaagagttgcttatttgataagttatcggagtgtgtttcaaagac

SEQ ID NO: 6811379 - DNA, 70 bp, Homo sapiens
ctgcatccatgttgctgcaaaggatctaatttccttctttttaatagctgtgtagtattccatggtgtag

SEQ ID NO: 6811380 - DNA, 63 bp, Homo sapiens
ctcagtagtggggagcccagtgtcagaggcatccctcagagcacagaatcttcccatgcaaag

SEQ ID NO: 6811381 - DNA, 118 bp, Homo sapiens
cattaccccattggttgcagccaataaaagtgggaataggacattggaaggtagttatgcattagactatttcctatttcttgtcccctacagttgctgtttttactgcacggttttg

SEQ ID NO: 6811382 - DNA, 55 bp, Homo sapiens
atgcacaaacccacaattagtccatatttagaaaactttctgtgggttcaagcat

SEQ ID NO: 6811383 - DNA, 90 bp, Homo sapiens
ccagagctggtgtcaaatgtcagattctgttagagctgaaggggcctctggcttgtctcagggtctgattgaccttgggccagcccctgg

SEQ ID NO: 6811384 - DNA, 80 bp, Homo sapiens
gtggcttatttactactgcatcccctgtatctggcatagtgagcccccactaatactggtggaaagagtgaatgagtaac

SEQ ID NO: 6811385 - DNA, 69 bp, Homo sapiens
tagttcaatctaggttgagtcataccaattttcttaatagcagggtctgattctatctaggtagaactg

SEQ ID NO: 6811386 - DNA, 99 bp, Homo sapiens
gaggcaggaggatcacttgagcccaggaggtggaggctgcagtgagcaatgatcacatcactgcactccagcctgggcgacggagtgggaccctgtctc

SEQ ID NO: 6811387 - DNA, 58 bp, Homo sapiens
tatttctgattgctcatgaggcagaattggaaagggaaaaatgcagcaatcagaaata

SEQ ID NO: 6811388 - DNA, 130 bp, Homo sapiens
gaaacataagaggcttcttatttcttgcatgctcacttttatactgtaactagaagattccaaacaaatactgattgcaaattatataagggatgctgcattttgaaataagttataacctcaactcttt

SEQ ID NO: 6811389 - DNA, 78 bp, Homo sapiens
caaagccaactcagcttgtgctgttcctctgtcttgttttggagtggggagttaaaatgtgctgcaaagttggctttg

SEQ ID NO: 6811390 - DNA, 60 bp, Homo sapiens
tggaggcccatgcagagtccatgaggggtggcttctttcccacagactgtatgggcacca

SEQ ID NO: 6811391 - DNA, 89 bp, Homo sapiens
agtttgccttaatttttcttctgctttcttactaaaaatgaagacattcaatactaatcttgctggaagaagccttaaccaagcaaact

SEQ ID NO: 6811392 - DNA, 55 bp, Homo sapiens
agctttgcaacctgaggccagttactttcctctcttggcttcagtttagcaggct

SEQ ID NO: 6811393 - DNA, 65 bp, Homo sapiens
ggctaggagccgctgcactaggtgctagggacccactgaattttcaccagagcagtggcttggtc

SEQ ID NO: 6811394 - DNA, 61 bp, Homo sapiens
gcctgtccactaaacagccaagcatgttgggaaattgttgtgaggtggtttggaagcaggt

SEQ ID NO: 6811395 - DNA, 59 bp, Homo sapiens
ttgtttccctggatctagagctgccgcctcaatcagcgactggcattcaggtgaggcag

SEQ ID NO: 6811396 - DNA, 62 bp, Homo sapiens
tccaggaatagtcatgttttaggcctaagatctatttttacaactagaaagactttcttgga

SEQ ID NO: 6811397 - DNA, 59 bp, Homo sapiens
tctttacagaaggaacactactcagttttcattgaatggaggggtttttctgtcaagga

SEQ ID NO: 6811398 - DNA, 55 bp, Homo sapiens
gtgtagctttatattgtgttgggagaaatggaatcccccgatattacagctgcac

SEQ ID NO: 6811399 - DNA, 93 bp, Homo sapiens
ccaggtgctgcgctaggctctgggaacagacgggtgggcaagagagcccaagcccactgctcagagccaagcatctactccagcatatcttgg

SEQ ID NO: 6811400 - DNA, 86 bp, Homo sapiens
agagaccattctggttaaatgtttcagtgaaaagttaagactggtctatcggtcttaactatcatttgaacacctggaaaatctct

SEQ ID NO: 6811401 - DNA, 84 bp, Homo sapiens
tgagtgatggacagaaggtagcacctatgaacgtcagattttcctgtttgcagaggcatagtgactactttaatctataattca

SEQ ID NO: 6811402 - DNA, 59 bp, Homo sapiens
gggaaaaatcattgcctgtcaggagcttggagatttagtccccaggcagagatttaccc

SEQ ID NO: 6811403 - DNA, 65 bp, Homo sapiens
gggtggatggtgaggtagctctcagcccccaccactggttgcatttgctgttctgaccatcaccc

SEQ ID NO: 6811404 - DNA, 69 bp, Homo sapiens
gcgtcgctctggacaggggcgctttggggtgagatgtgcgctcgcggccttgatccatttagtggacgc

SEQ ID NO: 6811405 - DNA, 91 bp, Homo sapiens
gaatacccagaagccttcttttctgtgtcccttattctagcttttgcgctgctgtacaaattccacaagagaagatgctctttggatattc

SEQ ID NO: 6811406 - DNA, 57 bp, Homo sapiens
gagctggcaagtctgtccttggcagttgccaagaggtgggttggacagatacagctt

SEQ ID NO: 6811407 - DNA, 74 bp, Homo sapiens
cgggcagtgcccagcggggcagctgtgcctggaccctggcaccaacgactcggccaccctggacgcactgttcg

SEQ ID NO: 6811408 - DNA, 56 bp, Homo sapiens
cctatttccagattctgcttgttggcaacatggtcattccaagcattggaattagg

SEQ ID NO: 6811409 - DNA, 71 bp, Homo sapiens
ttcctgtggtcagacattgccaacgcttttcttggacctaaggtcccagaccttggcgctgggcacaggga

SEQ ID NO: 6811410 - DNA, 83 bp, Homo sapiens
aagaagtgagttactgagagatcaagccacaggatggtgggagtaggccaagatccagtgcttgactgttgaacttgcttttt

SEQ ID NO: 6811411 - DNA, 67 bp, Homo sapiens
gcataggaaaagtctagattgatgagtgggtagttaaccagaaacttcactcaattgacttttttgc

SEQ ID NO: 6811412 - DNA, 58 bp, Homo sapiens
tggaatgttcccaaaatccctgtagatacgaaagtcagtatctgaaggaatgattcca

SEQ ID NO: 6811413 - DNA, 59 bp, Homo sapiens
gcccctgcctttgaacctggagatcctgaccatgatctcctggtgctgctatcaggggt

SEQ ID NO: 6811414 - DNA, 65 bp, Homo sapiens
gaagctttattgcaagtgaggcaataaaaagggaagaaatccaattactttatgtgcagagcttt

SEQ ID NO: 6811415 - DNA, 60 bp, Homo sapiens
gacttacattgcatcattgaaatgccagaattgtcttggcaggcagtggggtaaggagtt

SEQ ID NO: 6811416 - DNA, 89 bp, Homo sapiens
cagcttcagttctgggaatgaaaagcaacaatttcaggtgttgataaatgcttggcagagttctttttctcttttcagagctgatcctg

SEQ ID NO: 6811417 - DNA, 74 bp, Homo sapiens
ctgtgctgacaatggaactgttgtaggtaaagtcattttcagattaaatacaacaatttccacattagaatcag

SEQ ID NO: 6811418 - DNA, 90 bp, Homo sapiens
tgcaacctggggactcagctccagtttcctgactgagcctggccaggttggccgccacccataaactggagaccagagtgcccaggttca

SEQ ID NO: 6811419 - DNA, 81 bp, Homo sapiens
ggctgccatccttcagttatcacagtactgtacctttagaatagacagcatcagcactgtgataactgagccagggcagcc

SEQ ID NO: 6811420 - DNA, 61 bp, Homo sapiens
gtaccatgggatctagggcccacctaggtaggcatctctagtggggccattcacctggtat

SEQ ID NO: 6811421 - DNA, 114 bp, Homo sapiens
ccctacctccatcttgcaaacagcaggtgtctgataggtgtgtggttcatggcccagtggacacattacattggagaaggcacacccacctctgttttcaggatggtggacggg

SEQ ID NO: 6811422 - DNA, 108 bp, Homo sapiens
gtcattatacatttgttcaaacccataggtacatggaattggacatttggaatgtacatcatcaagagtgaaccttcatgtaaactgtggactttgggttataatgat

SEQ ID NO: 6811423 - DNA, 56 bp, Homo sapiens
tctggtacagcacagagcaggtgcttggcttgacccagcatctggctgcttctaga

SEQ ID NO: 6811424 - DNA, 60 bp, Homo sapiens
gcctctggagcttgtttcagatggtggcactgcccagcactatctggcaagctgcagggc

SEQ ID NO: 6811425 - DNA, 72 bp, Homo sapiens
accatacatactgagtggactgataaatgtttaattttaatgcagcaaattggctattgagtgtgtgctggt

SEQ ID NO: 6811426 - DNA, 56 bp, Homo sapiens
ccagctgtgccgtgtggatagcgttagattccgcagctttccacctgcgctgctgg

SEQ ID NO: 6811427 - DNA, 56 bp, Homo sapiens
ttagagtatagctaactgtattaggtggaagctcacctatatttagctatctctga

SEQ ID NO: 6811428 - DNA, 59 bp, Homo sapiens
cccaactgccaggccctgggcagagataaaagaatgtggatgagtggcaggcagatggg

SEQ ID NO: 6811429 - DNA, 95 bp, Homo sapiens
aggacctgaaattgtgagactgaaccaaataaaactgaatcatgtgttttaaactatatatttggtcagaactctctttagtgtagccaagtcct

SEQ ID NO: 6811430 - DNA, 106 bp, Homo sapiens
tagaactgagagacaagtcaaattaggaacgctcaggaaaaccacttttactgtctcttggaaggtcctgggcgattttctgaatatgaatctgttaccagtttta

SEQ ID NO: 6811431 - DNA, 76 bp, Homo sapiens
agtgcaaaatgtgaggcagcacggagattatggagataataacacataatctaagttaactccccactgttgctct

SEQ ID NO: 6811432 - DNA, 79 bp, Homo sapiens
catctgtatttctagaatggtagcactattgctgatgaactagatggtaccagtgctgcacttctggggatcacacttg

SEQ ID NO: 6811433 - DNA, 75 bp, Homo sapiens
ggatggatggatggataggtggatagctaagataacagcttctctctctaaagctaacacattccagctatttcc

SEQ ID NO: 6811434 - DNA, 83 bp, Homo sapiens
cagcccctttcacaggaccttcttcagaggccagcctctggtggggaatagaggcaccctggaggagactgtgccagctgctg

SEQ ID NO: 6811435 - DNA, 80 bp, Homo sapiens
accagctggagtttttggccataacgtattaacaatttttggatgaatcatgctgtggtcattataagcctctctctggt

SEQ ID NO: 6811436 - DNA, 56 bp, Homo sapiens
taaacctctgtgctatgacaccctcagtacctgggctaggggtgggcagaggtttg

SEQ ID NO: 6811437 - DNA, 77 bp, Homo sapiens
gtttctagcacgtgacagacactctgtccagcctgggattgagtggtgggcagggtctctgttatcaggcagcttac

SEQ ID NO: 6811438 - DNA, 116 bp, Homo sapiens
tgaaaaagaatagctttatgaaattaacacagcaggctaacttaatgcattatttgaaatcatcttgttaaatcaataaagcacttgggttggtaatatttgaattcactttatca

SEQ ID NO: 6811439 - DNA, 65 bp, Homo sapiens
actaagggctgctgtagaagcagagcccactgccctggccatgctcttctatgtagtctcaaagt

SEQ ID NO: 6811440 - DNA, 74 bp, Homo sapiens
aggctggaccggttgttacaacaattttttccgtctagaattcggcggtaaggtctgagacaacacctcagctt

SEQ ID NO: 6811441 - DNA, 79 bp, Homo sapiens
gatgcctatgaactctgcaaagctatgtcacacaaagacatctagcatgacaagctttacagaattgaatggatgcatt

SEQ ID NO: 6811442 - DNA, 78 bp, Homo sapiens
agttggatttggactgtgaacaatttgctgaaattatgacattattttttaaaaaattagaccagttcaggtccaatt

SEQ ID NO: 6811443 - DNA, 100 bp, Homo sapiens
gaggcaggaaaaagcgcttgaacccaggaggcggaggttgccatgagccgagatcgtgccattgcactccagccttggcaacaagagtgaactctgtctc

SEQ ID NO: 6811444 - DNA, 71 bp, Homo sapiens
agaaaaggttgaaagtaggattattgccttacccacagtctagcttgtgtctttcctttcacactttttct

SEQ ID NO: 6811445 - DNA, 55 bp, Homo sapiens
gagatgagaagagagatggcagcaccaattctcctccttcttctcttccagtctt

SEQ ID NO: 6811446 - DNA, 56 bp, Homo sapiens
gtagaagaacttgtgccagagggtggaataaactctcttatcacaattcattttgc

SEQ ID NO: 6811447 - DNA, 113 bp, Homo sapiens
ctcatttatttttacttcttttggaacttaacatctgacttgcagacataataagtatgtattatatttactgtatttgaagttgaaagatgaaagaagaaaatatgaatgag

SEQ ID NO: 6811448 - DNA, 64 bp, Homo sapiens
aaggcagaaagtacagatgagacactttttgaaagagttcttctttttgtactctttttgcttt

SEQ ID NO: 6811449 - DNA, 63 bp, Homo sapiens
aactacttttcataatgaagcagcatattttcttgatgtgtctttttacctgtgatgagtgtt

SEQ ID NO: 6811450 - DNA, 66 bp, Homo sapiens
ttagtgtcttcttcatcctctgtttgcagtgaacatgatattcgctaatcagtgaagagacattaa

SEQ ID NO: 6811451 - DNA, 77 bp, Homo sapiens
gactcctcctgcagaacgatgcctcctttgacggtagatagatacgtcagagatgaggtcgttactcagcgcttgtc

SEQ ID NO: 6811452 - DNA, 64 bp, Homo sapiens
atatctgaggcagcttgccactctaaataggccctccctatctactgccagcagtctcaggtgt

SEQ ID NO: 6811453 - DNA, 59 bp, Homo sapiens
ccagggctttgtaatatgagcacttaacatctttcaagtgatctctccaaggcacctgg

SEQ ID NO: 6811454 - DNA, 70 bp, Homo sapiens
gagagattaaaactgaagccttggagtgacagagggaatttttgtcctacctgattttcagttttctttt

SEQ ID NO: 6811455 - DNA, 87 bp, Homo sapiens
agcaatgttttgtttcttgttagtacatgaaaaatcattggagattgtcagttaccctactaacaatgagaacaagccagataagct

SEQ ID NO: 6811456 - DNA, 81 bp, Homo sapiens
ccgcctacacgcgccagcaggtcttggagctggagaaggaatttcactacaaccgctacctgacacggcgccggagggtgg

SEQ ID NO: 6811457 - DNA, 74 bp, Homo sapiens
gcagcagttctggctaaagcaaaaccacaccagcaatacgctctgtggtctggctttagtctaagaagtgctgc

SEQ ID NO: 6811458 - DNA, 100 bp, Homo sapiens
ttttctcagtgcttacgtgctcctggacatggagcggaggatgaactcgactgcattctcaatgatctctgtgcccaggaggcttaggaatttggggaag

SEQ ID NO: 6811459 - DNA, 73 bp, Homo sapiens
ggttctcaagaatagctgcaaacagggcaattggcctaaaaacaattttctgaaagccaattcattgaaagcc

SEQ ID NO: 6811460 - DNA, 71 bp, Homo sapiens
tggttctctacattcatgaggttcagagggtttagaaaaccatctgaacccttaggattttatttgaacca

SEQ ID NO: 6811461 - DNA, 64 bp, Homo sapiens
tgagatttgggaggggctggggtgaaataatatggtttggctctgtgtctccacccaaatctca

SEQ ID NO: 6811462 - DNA, 60 bp, Homo sapiens
gggctggtagggacaagaggggagggaagtgaattgctcaaggctggtcccaccaagccc

SEQ ID NO: 6811463 - DNA, 89 bp, Homo sapiens
ctccagggtgtgagtccagcgggagagtgttgatgagaattattttatgagatatttatactgctgagtttaataaaatcaaatttgag

SEQ ID NO: 6811464 - DNA, 72 bp, Homo sapiens
ggaacttttgtttcatttactcattaagctttctgaaatgggagctttggcaatgaaacacaagaaaattcc

SEQ ID NO: 6811465 - DNA, 62 bp, Homo sapiens
gtttccccatctctaacatggagctggtgactcctcagctgtccaggccatggtggggaggc

SEQ ID NO: 6811466 - DNA, 66 bp, Homo sapiens
tgatcatgcttaaagttggagtcatgagctcacccagtccaagactccccacgttaaggaatgtca

SEQ ID NO: 6811467 - DNA, 55 bp, Homo sapiens
gatgagtcattcacagtcgtgaatgccaaataatcacagatatggaagactcatc

SEQ ID NO: 6811468 - DNA, 65 bp, Homo sapiens
cccaagttccaagaagtaaagggctctctccacttttatccttccatctatccctggagcttggg

SEQ ID NO: 6811469 - DNA, 92 bp, Homo sapiens
tctgttgttttaagccacgcagtttgtggacattttttatgcagtcttggaagctaaaacgatgtttaaaagctctggctgaaataggcaga

SEQ ID NO: 6811470 - DNA, 82 bp, Homo sapiens
gctatcatggaacccatgcaattcccagtgtttctactatggagggaaatgtttctggatattgtgggttctgtgcatctgc

SEQ ID NO: 6811471 - DNA, 80 bp, Homo sapiens
gaggagtcactgcaggtttttcaggaggagagtgacaacacaatctagtacctcttcgagagccagcagccacagtcctt

SEQ ID NO: 6811472 - DNA, 69 bp, Homo sapiens
tccctgaatgattctatttgcagcttggattgagattcactagcattgttgaaggacttggggcagggg

SEQ ID NO: 6811473 - DNA, 70 bp, Homo sapiens
gaaagcagttctctggggatctctagctgactccattctatgcacggctagcccaggagaattgtctttc

SEQ ID NO: 6811474 - DNA, 94 bp, Homo sapiens
aagccccggcatcttcttgctgccgtcccagacaacagaagttaccagatgaacagacttggatgggccacgggggtggagagctggaaagctt

SEQ ID NO: 6811475 - DNA, 81 bp, Homo sapiens
ggagcactgtaagaagttggaaatgattgagaggttataaaattgccccctgttcttcttccaatattctgttgatgttcc

SEQ ID NO: 6811476 - DNA, 64 bp, Homo sapiens
cgcgtgtctggcctgggcctgccggtgcaacagcagttgtcgccaccggtcctaggccgcgccg

SEQ ID NO: 6811477 - DNA, 56 bp, Homo sapiens
gtgctggctggggcatcaggcagccctggagaggaggtggccatccggcccagcac

SEQ ID NO: 6811478 - DNA, 101 bp, Homo sapiens
atagaaactattagattgctgcaaaagtcattgtggtttttgacattgaaattaaaggcaaaaaccacaatgacttttgcaccaacctaatggtttactgt

SEQ ID NO: 6811479 - DNA, 58 bp, Homo sapiens
gactggggcagtgacttgtagagcttctggtcctttgcaaataccatgctgtcctgtc

SEQ ID NO: 6811480 - DNA, 74 bp, Homo sapiens
caaacattcccagaagtccagccatgggcctgagagacttctactggacatggtgacttttggggactaatttg

SEQ ID NO: 6811481 - DNA, 64 bp, Homo sapiens
ggatgaagaagacaaggagcttgtgatctaacaatggaaacagaggcttatgtttatttcttcc

SEQ ID NO: 6811482 - DNA, 99 bp, Homo sapiens
tcacaaatgcttgtttaattggcctcttagaggttagggtggactttgaaaatccctaagaactctgagggtgctaattttttttaccaagaacttgga

SEQ ID NO: 6811483 - DNA, 64 bp, Homo sapiens
gaagtcactaagatttaaagtattagtgtaggaaaatacgatacacagtaatcatagagacttt

SEQ ID NO: 6811484 - DNA, 83 bp, Homo sapiens
ggtgggtgtccgggtgagtggcaggtcagggccgtgggatgggccttctcctgcagcgagcccgacactgagctacagccacc

SEQ ID NO: 6811485 - DNA, 62 bp, Homo sapiens
ggaaagtgaccccatgttaagtcgaggagctccttatgtcttattatgaggttagactttct

SEQ ID NO: 6811486 - DNA, 56 bp, Homo sapiens
agtgttctaacaactgctttcatggattcataccatgtcagagcttgtaggacatt

SEQ ID NO: 6811487 - DNA, 62 bp, Homo sapiens
tttggttattgtgagtgtataggtgggtttactatctatgaattccatttcacgatattgaa

SEQ ID NO: 6811488 - DNA, 87 bp, Homo sapiens
tgagtgccttttaaaagggcccaagtctggttccactgtatctacttcactggctagccgaggggtgggcccattgggaagtcctca

SEQ ID NO: 6811489 - DNA, 55 bp, Homo sapiens
gtttccagccaatcccctcaggggtctagagatgcctgggctgtggtttggagac

SEQ ID NO: 6811490 - DNA, 57 bp, Homo sapiens
gccttgcgcccccggagtcggctcagaggagagattgactgccatgagggtgagggc

SEQ ID NO: 6811491 - DNA, 64 bp, Homo sapiens
gggtgagcacattaatggtttcatccattaaatcttttggtgctgagaattgatgtccttgtcc

SEQ ID NO: 6811492 - DNA, 77 bp, Homo sapiens
cttcccggcctggctcccgaagccctcagtgtccctattgattcctaggccgctgcagatgggagctggttgtgagg

SEQ ID NO: 6811493 - DNA, 70 bp, Homo sapiens
gtgtgaatttctgcttaagcaagaaagcagcaagttgttgctgctgaggctaaagtataggaaaatccat

SEQ ID NO: 6811494 - DNA, 58 bp, Homo sapiens
taggctccagtgtgtggcgagtgttcatttataggcagcgctcggcatggggagtctg

SEQ ID NO: 6811495 - DNA, 73 bp, Homo sapiens
ttccacctcctggggctgaggtcgccaagcgtgctgcgtgcagctgctgagccctggcacaggtgggctggaa

SEQ ID NO: 6811496 - DNA, 80 bp, Homo sapiens
ggggttaagactacatttctcagtacctgaattggcttaattcttggattaaatggaataatcagtagttcttaacaccc

SEQ ID NO: 6811497 - DNA, 113 bp, Homo sapiens
gagaaacatgaaggacatactttttagtgctgttattggtcattttaagctcagtgtgggtgaaatgatatctgataacaaataagaagtttgtgtgtgtcctttcagctctc

SEQ ID NO: 6811498 - DNA, 60 bp, Homo sapiens
ctcctgcaagcctccccaagcagtcaataaatttgcttgattcaaaacaggaggtaggag

SEQ ID NO: 6811499 - DNA, 59 bp, Homo sapiens
tcatccctcagccacctttgaggaagtaaacatggacttcctccctgagctgtggggga

SEQ ID NO: 6811500 - DNA, 111 bp, Homo sapiens
tcttgggtttggaatactattttatggctatgaacagaatgcttcttcattgccagttgctcaccagcagctaagaagtacctcttttcctgaagcctccaaatcaatgga

SEQ ID NO: 6811501 - DNA, 77 bp, Homo sapiens
ttcaacatttgatacaagtcaggcaaactcactaaaggaagagtctgcaaatgagggggcttgagtcagatcttgga

SEQ ID NO: 6811502 - DNA, 59 bp, Homo sapiens
ttgtgtttctatgctaagaaagtgccacgctgctaactctttagagctcagaaatacag

SEQ ID NO: 6811503 - DNA, 55 bp, Homo sapiens
accttacttctgtactgtctctcgggaatgggaggaggggcagtaagtgtggggt

SEQ ID NO: 6811504 - DNA, 68 bp, Homo sapiens
tgaggccggcgcgcccccgaccctggcccccgccgtggcccccgggtcgctgccgctgctggacccca

SEQ ID NO: 6811505 - DNA, 78 bp, Homo sapiens
ggtttgacagctcagaacatgaaaagtctgttgccataagtactgaaacaattggggcaacattcatgttctgtaacc

SEQ ID NO: 6811506 - DNA, 58 bp, Homo sapiens
acaatgcaataggagctagaaacaaaaatgatttcaagcaggaagcctgatgtattgt

SEQ ID NO: 6811507 - DNA, 84 bp, Homo sapiens
gtagtgattaaatcataattcaaataagcttaaataaggagaaaacatttatagcatgaatgaattgtgaaatgtgagcactac

SEQ ID NO: 6811508 - DNA, 64 bp, Homo sapiens
agtgcatgtatctacagtcacaaagcaacttcttgggctttatctgttgtcttttacatgtatt

SEQ ID NO: 6811509 - DNA, 67 bp, Homo sapiens
gtctgtccctgatactggttaacaggaatatgtggcatttacagttatctgcagataagggaaagac

SEQ ID NO: 6811510 - DNA, 130 bp, Homo sapiens
gataactgactacatattttattttttaatgcagatgttcagcattctataaatatggattcttaatgacttgggacaaaaatattagaatgtatgaacaactgaagaatggaatgagtggctgcagagc

SEQ ID NO: 6811511 - DNA, 63 bp, Homo sapiens
tcagaggagatggttaccagggccccttctaacacaccattctggatgtgccttccttcctga

SEQ ID NO: 6811512 - DNA, 97 bp, Homo sapiens
tggagagcccttgatgtttattgcaaataatgcgagccagttttgtcattggcacttactggttttttgcttgtttgttagatatctgtatcttcca

SEQ ID NO: 6811513 - DNA, 127 bp, Homo sapiens
atttggacattctaatgctatcaaaataacatccaagccagtctcagttcctactttctcaatctcaagtatggagcttcacgggggacagcatttggaagtaaattgctgtataaggacatcaaat

SEQ ID NO: 6811514 - DNA, 69 bp, Homo sapiens
gaaaggcctgtgcttctaatgtgggaaaggaaatggcttacttatctccatggaaacacatgcactttc

SEQ ID NO: 6811515 - DNA, 94 bp, Homo sapiens
cctgccgcaccagtctccttcccttcaagtgttccttcctgtggccctggaaaatcccttcatggggacagtgagggatggggtagtgctcagg

SEQ ID NO: 6811516 - DNA, 67 bp, Homo sapiens
catgttctttcagtccagatccctgtattttattagaatcacaggcaaagaagattggtggaatgtg

SEQ ID NO: 6811517 - DNA, 59 bp, Homo sapiens
ccaaaccctgattttacaaatgtctggattatctagtttgtggagtagtcaggtcttgg

SEQ ID NO: 6811518 - DNA, 72 bp, Homo sapiens
gaattggcccagaaaatatggctaaggtgaccaattttcttggtttccccaggaattttctggctttagttc

SEQ ID NO: 6811519 - DNA, 55 bp, Homo sapiens
gtcacaatgcaagtgttcagtggccacaagtggctagtgacaactgtattggaac

SEQ ID NO: 6811520 - DNA, 56 bp, Homo sapiens
tctccactctgagtgcctttcagcgagagcccgcctgaggttctttgagatggaga

SEQ ID NO: 6811521 - DNA, 71 bp, Homo sapiens
atgatgtgtgtgtgtgtgtgtgcctgtgtgtgtgtttacaaaaagagtaatgaacacattccacacatcat

SEQ ID NO: 6811522 - DNA, 58 bp, Homo sapiens
ttgaaaattgttgtacttgataatggagcctccttgtggggaatcagcagtatttcag

SEQ ID NO: 6811523 - DNA, 91 bp, Homo sapiens
ttgcttttatttaggaaagacaaaatgtcattccaaaactagaagaaattgtttggggggaaatattttgtctaatttgtagggaaagcag

SEQ ID NO: 6811524 - DNA, 112 bp, Homo sapiens
cctttctttctagaaaaggcagtagctaaaaggggatttaaggtaagaagaagggttttgttttgttttgtttaggtttgtttttaaaatactgctgtttttgttggagagg

SEQ ID NO: 6811525 - DNA, 80 bp, Homo sapiens
tcacatggtatactagatagacagtatcaaggaccaacttactggatgatacttaacaatgtctgaatgctgtgatgtga

SEQ ID NO: 6811526 - DNA, 64 bp, Homo sapiens
acagctaacagaatctggagagggagctgtgtgcaagggctgccttttaggagctgtggcctgt

SEQ ID NO: 6811527 - DNA, 64 bp, Homo sapiens
actttaaactgtcattttatatagttattagaatgctagtggtatgtaatgtaatagttttagt

SEQ ID NO: 6811528 - DNA, 70 bp, Homo sapiens
cagatggtgctggctgcattggcaagtcaattatccatcagtaacacatgtttgtgtagtcagttatctg

SEQ ID NO: 6811529 - DNA, 75 bp, Homo sapiens
agggatgagctgcacgcagcatccaagagagcagcccagctcttaaagcacctccttggatgtgtggggctccct

SEQ ID NO: 6811530 - DNA, 59 bp, Homo sapiens
acttaaggaaaatggacatcaaacagttaatttgtttaggtgcctgttttcttgaaagt

SEQ ID NO: 6811531 - DNA, 71 bp, Homo sapiens
gagtgtaaaaccccagccagctggttggacgcctggcctaggttaacagcagctgctggcgttgatcactc

SEQ ID NO: 6811532 - DNA, 79 bp, Homo sapiens
tttttagtcaacagtctggtttatataatagataatttgctcattaaatgtatgtattttgctaggctgagattaggaa

SEQ ID NO: 6811533 - DNA, 57 bp, Homo sapiens
aggcagggagggtatcccagggtcaagtcccccagcccaggggtgcccagactgtct

SEQ ID NO: 6811534 - DNA, 73 bp, Homo sapiens
aaggcaacagtcttgagataaaactttgttcaccatttccccttcttaaagtgcagcttagtactgttttctt

SEQ ID NO: 6811535 - DNA, 68 bp, Homo sapiens
cctccaacaattataaatattttctaggggtaacgatatgtgcccttgtgactgtacttgtgtggagg

SEQ ID NO: 6811536 - DNA, 87 bp, Homo sapiens
gaggtccaggatcatgattattctttcttttgtgctactatttagtgacaagttaggttttaatccaaaagtgtgctctggggcctc

SEQ ID NO: 6811537 - DNA, 70 bp, Homo sapiens
tcaagttaggcgcagcacgtgagagttggcagttttccacccaccgacctgagttgctgtggttagatga

SEQ ID NO: 6811538 - DNA, 80 bp, Homo sapiens
ggttgaacattttgatactgagaaaaacaaatggaatccatgttttcattgtccttttcctgagtgttgtattgttctcc

SEQ ID NO: 6811539 - DNA, 75 bp, Homo sapiens
gggctgggcaggcctcatggtgtgtccttcctcctgagggtgaagggcaagatacgtgagcatggcctcagaccc

SEQ ID NO: 6811540 - DNA, 97 bp, Homo sapiens
aatagtccacattcctgcatggcaagtatttactgcagctgacttgaagttacacaattagttgggacatgttctttccccaggagtgtggcctgtt

SEQ ID NO: 6811541 - DNA, 91 bp, Homo sapiens
ctgccctatcctttgtccactttttgaactggaacaactgcaagaatttgctaagggttgaaacagcaagaaacagagaaaggataagcag

SEQ ID NO: 6811542 - DNA, 72 bp, Homo sapiens
cataacctagagtgctagaattctgtgcctgattctcttgggcctcatgcaacaacacattctggcaggatg

SEQ ID NO: 6811543 - DNA, 57 bp, Homo sapiens
tgagaacagttggaagcagtcatttcatttgaaagttagctttatccaactttttca

SEQ ID NO: 6811544 - DNA, 78 bp, Homo sapiens
tgcacggggaatatggttgatctggccaagacgtggaaatgtgcttgttcatctgcataccaagtgattccttgtgca

SEQ ID NO: 6811545 - DNA, 64 bp, Homo sapiens
accacctcactagttaaagaagtcagcgactggtcacttcagataactggtgtcaccaaggggt

SEQ ID NO: 6811546 - DNA, 74 bp, Homo sapiens
catcccatagaaagaggcaggggttgcaattgaaaacacactgacagattaaaccccagttctcttactggatg

SEQ ID NO: 6811547 - DNA, 68 bp, Homo sapiens
aggctgtgttctcatctggatctcaggattctcttataagtccatgtggttgtggtggaatttagttt

SEQ ID NO: 6811548 - DNA, 63 bp, Homo sapiens
tttggtgccacaagaatacaaagcagagaatttctaggctgatttgattactagtggcctgaa

SEQ ID NO: 6811549 - DNA, 58 bp, Homo sapiens
ttggatcgacagtggaataaaaatcaccatttagggaaatctctcattgttggttcag

SEQ ID NO: 6811550 - DNA, 80 bp, Homo sapiens
cagggaaggcaagttagggctgcctatggctagatagaactattcctttctcgtttagttcagctccttgaagaaacctg

SEQ ID NO: 6811551 - DNA, 122 bp, Homo sapiens
cattcatccatcgagggacccttaggttgtttctatatcttacctattgtaaataaagctgcaatgaacatgtgggtgcagatattttttgagatactgattttctttcctttggatatatg

SEQ ID NO: 6811552 - DNA, 130 bp, Homo sapiens
gcatcagaaacaaaaattggattttagagctagttaatggtttagggccctggcaaacactccatgcttttagttgggaccctcaaacaattacactgcagaaaataaagttccctaaaaagtctgaagc

SEQ ID NO: 6811553 - DNA, 80 bp, Homo sapiens
atgaagtacatgactggaggcagagaaaccaattttgagcacaaggctgagatgatctttcctgtagtcctcagcttcat

SEQ ID NO: 6811554 - DNA, 86 bp, Homo sapiens
cagagtattgccagccagggaagctcacccaagtttcagtgtccagtctccgggtcgcgggtggtttttactggggctctattttg

SEQ ID NO: 6811555 - DNA, 58 bp, Homo sapiens
cgggcgcctgtagtcccagctactcgggaggctgaggcaggagaatggcgggaacccg

SEQ ID NO: 6811556 - DNA, 55 bp, Homo sapiens
ctgaattggggagaggaaatgagaatgaatttctctcttccagttcccactttgg

SEQ ID NO: 6811557 - DNA, 66 bp, Homo sapiens
ggagctggctgtgtggaaagggcaggcagcaacaagagctacactttgtttcccagagctcgctcc

SEQ ID NO: 6811558 - DNA, 67 bp, Homo sapiens
atgttatgtatgagggaatgattaaatacaataatgaaagtttggttaggaaacttctatatgacgt

SEQ ID NO: 6811559 - DNA, 68 bp, Homo sapiens
caccctgccaccctcctcctggcctttcacagccttgaccaggagaggccaaggttggaggcagggtg

SEQ ID NO: 6811560 - DNA, 73 bp, Homo sapiens
gcctgactcccggaaatgtagagggcgtgcctcctgggaccgtcttcacatccttcccatgggaaaggcaggc

SEQ ID NO: 6811561 - DNA, 58 bp, Homo sapiens
cccatgctgagtggcctgagatctttgtgtgtctctcccttccagccacccagatggg

SEQ ID NO: 6811562 - DNA, 67 bp, Homo sapiens
gagccagctgttcacatttccaaaacccctatgtcaacgaatgggttttggaaatgtgatcagcctc

SEQ ID NO: 6811563 - DNA, 67 bp, Homo sapiens
tgaaagtagtcgttctctagatacctaggaatacacattttaacattctgagagcaactgcccttta

SEQ ID NO: 6811564 - DNA, 88 bp, Homo sapiens
gacagaaaattttatataattaaatgctgatttacctgtaaaaagtgacatgggtgtgctcagataattaatcatgaaattatttgtc

SEQ ID NO: 6811565 - DNA, 71 bp, Homo sapiens
gcctgacgtgtgtccccatttcaagagactattcagaaaatcttaatggaagacatttgtcttacataggt

SEQ ID NO: 6811566 - DNA, 56 bp, Homo sapiens
catttttctcctgacatctggggttggtttcattgaggatttacaggggaaaagtg

SEQ ID NO: 6811567 - DNA, 56 bp, Homo sapiens
caggctttttctgctgtcctctctcacccagaagagatttagcaggaagcagcctg

SEQ ID NO: 6811568 - DNA, 93 bp, Homo sapiens
tcttgtcctggaagatgggttcgtgatggaagatgattaatagcagcttgactttgttaaacagttacatgtgctgggcaccctaggacaaga

SEQ ID NO: 6811569 - DNA, 59 bp, Homo sapiens
tagtgtctgaatgcacctgtttaagtcagcttcttgttctcccaggtatttaggcattg

SEQ ID NO: 6811570 - DNA, 109 bp, Homo sapiens
atcagtgttttaatcggatttttaaaaaacattttatttctttgtacaattaccatcctatgtaaagatgaaatttgtgttgagttgaagattgtcatggaataaagat

SEQ ID NO: 6811571 - DNA, 80 bp, Homo sapiens
tgatgcttaacagacttgggattttctagcagcctctgcctctctgcctggagattttcctacagtttgtttttgcttca

SEQ ID NO: 6811572 - DNA, 63 bp, Homo sapiens
gacttaaatttctggtccatctagtgcatattttagtgtaagttgtaacagaaatttaatgtc

SEQ ID NO: 6811573 - DNA, 80 bp, Homo sapiens
actgacctccagatggatccactttcacttttactttccatttatgtagaatatgtggtaggatctggatgggcgtctgt

SEQ ID NO: 6811574 - DNA, 76 bp, Homo sapiens
gcctagtgccatgaggtgttcgctggccttttgcttgcctcaaagcaaaagaacaatagcactcaacatgcttggt

SEQ ID NO: 6811575 - DNA, 97 bp, Homo sapiens
tgtggaaaacaaactctgagcaaatggctgcatttgtgtaaatttgcttttaaaaattattctgatgtagtcattggtcttagaaatggagtctata

SEQ ID NO: 6811576 - DNA, 61 bp, Homo sapiens
caatagctctttgtacaagtagatggttaataactatctattaattattaggagtcttttg

SEQ ID NO: 6811577 - DNA, 78 bp, Homo sapiens
tctctgctgcggcaccacctggccttgggttttactctgttccaaaaagccccaggcctgttggatggcgctcagaga

SEQ ID NO: 6811578 - DNA, 82 bp, Homo sapiens
gaggagaaagagaggacaggattgagctgaactgttcaggagctggaatggttaggacttggattgtccagagagttttctc

SEQ ID NO: 6811579 - DNA, 96 bp, Homo sapiens
agtatatttggcattttttccgcatttttaaggcttgaaatgaaatctgtaagcaggaagttcacagagtttatttcaagggataggtgtattact

SEQ ID NO: 6811580 - DNA, 61 bp, Homo sapiens
tcagatcaggccactcttcagctcagcatcggtgtgtggccttaaagagaggctgagctgg

SEQ ID NO: 6811581 - DNA, 84 bp, Homo sapiens
tggttctgctcaaaggtccagaggtcccgtcacctaggagcaacatcatcagggatgcagcacttggttaaccagcatgagcca

SEQ ID NO: 6811582 - DNA, 87 bp, Homo sapiens
atgctgaagaccaatttgggccatggcgaggctgcagcatagctggccttggaagcctggtttgtaggttggttggaatcatagcat

SEQ ID NO: 6811583 - DNA, 67 bp, Homo sapiens
tctccccattgaagttcacaagacgggaggccatttctcctcattcttggtgcatcaaatccggagg

SEQ ID NO: 6811584 - DNA, 64 bp, Homo sapiens
cagttccacagagtctcactatgacagcatcattgccctcacagtgagaaatttgttggcattg

SEQ ID NO: 6811585 - DNA, 89 bp, Homo sapiens
tctgtcctacccaccttggagctctttagagtctcccttctgggttctgaatgccagtgggagacagtgagagctgggtagagaaaagg

SEQ ID NO: 6811586 - DNA, 82 bp, Homo sapiens
atgctgtcttcatcgggggaatagaaattaaaagtaacagggcttgagtacaaatgtttttgtttgtccccatgaacagtgt

SEQ ID NO: 6811587 - DNA, 57 bp, Homo sapiens
cagttctggtgacacgaagtttgctatctcaatggggtagcccgttcatcatagctg

SEQ ID NO: 6811588 - DNA, 60 bp, Homo sapiens
gcacatgagctgctgggatgggcttgcccctgtcctgggcccttacccagctccgtgtgt

SEQ ID NO: 6811589 - DNA, 79 bp, Homo sapiens
ctcttcagtggctttgtttccaaatgaaaaccagaaaaatgatgctggaatttcatagaggcagcggcggatggaagag

SEQ ID NO: 6811590 - DNA, 76 bp, Homo sapiens
tgaagatgaagacaaagcagtgctgtgagaacacttccaaaagtgacttaaaggaacttactgctgccatcattca

SEQ ID NO: 6811591 - DNA, 128 bp, Homo sapiens
ctccacccccttcaaaatagcttttcgtcaaaattataactgctttgttttattgaattgctgaaatttaatggtttaatgggtgaaggcatgaaggaaaggctgtaaaaatgtgaataatggtgtag

SEQ ID NO: 6811592 - DNA, 80 bp, Homo sapiens
taatttaacagttactctagaggtcttgcaagacatcacagtaaattcttgtgataacccttctgataactgtgaaattg

SEQ ID NO: 6811593 - DNA, 83 bp, Homo sapiens
ttcttccttacaagttcatggctggtccactccctggaggctgtgccacacagaccccagagatcagctgcccttgagaagag

SEQ ID NO: 6811594 - DNA, 79 bp, Homo sapiens
agatgtctttctgagatgaattaactgacttagacatacagaagtagagtcaccttgaaatgtcttgaaaagaaattct

SEQ ID NO: 6811595 - DNA, 61 bp, Homo sapiens
ctgaaactccatgagaaattgcaagataaaattgcccagcaagcatgctctggaatttcag

SEQ ID NO: 6811596 - DNA, 73 bp, Homo sapiens
aaatcttggttctcttagctgtaaagtcaattctagtgtttctcaaactgtcttgtgttaaagaaccagattt

SEQ ID NO: 6811597 - DNA, 66 bp, Homo sapiens
gaatgtccaaggcaagtgtgcagagtaaaagcagaagccctgagacgcagctgtgccttggaactc

SEQ ID NO: 6811598 - DNA, 62 bp, Homo sapiens
actgttcaagttttatgctggaaaataacttgatgttcatagtctccagctaaatgtgcagt

SEQ ID NO: 6811599 - DNA, 86 bp, Homo sapiens
gccctggtgctgagaactccaggttcccggtccctgcggggaccccagggctcaccactgggatcctggcagagcggccctggggt

SEQ ID NO: 6811600 - DNA, 60 bp, Homo sapiens
ttcctagctgacgggttgataggtgtagcaaaccaccatggaacacgtttagctatggaa

SEQ ID NO: 6811601 - DNA, 95 bp, Homo sapiens
cccttaacacctgccacatagaggaggatattaaggattttctttgcctttagttctttcctctgtttgccattcttcacagtagggattggggg

SEQ ID NO: 6811602 - DNA, 57 bp, Homo sapiens
gaatagcatcattaccttggatgtcctggctctgacatccgttgtgctgttgctctc

SEQ ID NO: 6811603 - DNA, 80 bp, Homo sapiens
tcagggacacaaggctttcagatgtttgttcttatgtttgatcttatgaatttgctagcaagtattctgaaaattcctga

SEQ ID NO: 6811604 - DNA, 90 bp, Homo sapiens
ttaggatgaaataaagtttattccagcaatctgcttagcagccttgttaatgtcaaggctaatgagtgctgctgatgaataaattcctga

SEQ ID NO: 6811605 - DNA, 59 bp, Homo sapiens
ggctgtcttgatcatttacaggccaattgtgaagccactgatgaaatcactgggcagcc

SEQ ID NO: 6811606 - DNA, 63 bp, Homo sapiens
cgaagcaggttttcttctatatttgggtagaagccatccctaattatggaataatttgcaacg

SEQ ID NO: 6811607 - DNA, 87 bp, Homo sapiens
tgagccagatgtgcgggatcttggtggcactgacatcagacaccaggcggtgcttgacgtgtagccgccccggcaccatcatggtca

SEQ ID NO: 6811608 - DNA, 64 bp, Homo sapiens
ctctcattcctgtttgttgtttagccggtatatgcaaggctgtaaagaacattaggaatcagag

SEQ ID NO: 6811609 - DNA, 93 bp, Homo sapiens
tgtgccctcttcctggccagctgagagcccctgccctgtgtctgcctccaccagccatagggctccagctgtcagttgccttgaaagggcaca

SEQ ID NO: 6811610 - DNA, 57 bp, Homo sapiens
tccacccccaagcctcttggtaggaactgcatcatatttaatgaggctgggggtgga

SEQ ID NO: 6811611 - DNA, 89 bp, Homo sapiens
gccctggagaagtggtgtccaggaccctattctcactctgacctgtggtttcagtggacttgggttttgaaggagtccttctcaagggc

SEQ ID NO: 6811612 - DNA, 68 bp, Homo sapiens
gcacctgtgttttccctcagtttcatttctattctctctggatgaaataaagaaaggatatagtgtgt

SEQ ID NO: 6811613 - DNA, 94 bp, Homo sapiens
tgccttgagaagagaagatggtgaggcccgtgaataatccctaaaggaaactggatttcctggcatttacaaacccaccctctttgaaaaggca

SEQ ID NO: 6811614 - DNA, 98 bp, Homo sapiens
actatgatgattggggttcaggagagatttgtttaagatgcttaagacaaaaccagaaaatctctacccgatggtttgtgatacctgtaatccgtagt

SEQ ID NO: 6811615 - DNA, 64 bp, Homo sapiens
cttcctaccaggacatgcattaataatggctccttgtgactcgtaaagtgcatgctaggggaag

SEQ ID NO: 6811616 - DNA, 67 bp, Homo sapiens
tgttggttttggctatgtctacactgagtaaagtggatatttgcagtgttcctgtagcctgccaaca

SEQ ID NO: 6811617 - DNA, 86 bp, Homo sapiens
aggtgtttctattttcaggttcccagggaaggacttattaaacaactatgtcagcagagcctgcaggcctgaaaaagtgaatgctt

SEQ ID NO: 6811618 - DNA, 64 bp, Homo sapiens
gagaccagtcatctttttaccagaatgttgtatgtttctgagtgatcagatgcattgctttctc

SEQ ID NO: 6811619 - DNA, 66 bp, Homo sapiens
tagattctgaggccttgctcaagattattctgacataataactcttcagtaggtcctcagaatctg

SEQ ID NO: 6811620 - DNA, 61 bp, Homo sapiens
gacggccaccccttggggctgggtgcagagcccccatccagccgcggtgagggtggctgtc

SEQ ID NO: 6811621 - DNA, 72 bp, Homo sapiens
atgcctttcacaggtgactggggataactcactacctggaggtccatgtcattctcatcgctgtgattgcat

SEQ ID NO: 6811622 - DNA, 59 bp, Homo sapiens
agccagaatttgaacccacaaatgtctgattgcagcatggcaggtgcagattctgtgct

SEQ ID NO: 6811623 - DNA, 83 bp, Homo sapiens
cagtagtaggattttgttgttgttagtgttaatttttttcccttgcctagaaaatgtactaataagcaacatttccaatactg

SEQ ID NO: 6811624 - DNA, 99 bp, Homo sapiens
gtcatttaaagaggagatggccacttttgtgaaattgaaagaaggaaatagtgacctcttcatactcatcacataggtatcattccctgtttaaactgc

SEQ ID NO: 6811625 - DNA, 69 bp, Homo sapiens
ccagggtcggtggcttggttgccaggtgaaggaagatctgctcctggcttcttagaccagtggccttgg

SEQ ID NO: 6811626 - DNA, 129 bp, Homo sapiens
aacacaccactctgcttcttcccacagagttctgagacagcttttacataatgatcttgaacatattgtaatcttgtttatgacagaaatgaaaagctgtcatcacatttctgttttggagagttcatt

SEQ ID NO: 6811627 - DNA, 130 bp, Homo sapiens
acccaagatataaaacagataatatcagagaaactttcttgaacggagtgtacgttgtagaaacctagacctacaacatagacccagttcaacaaagtttctctgattttatctgttttatatcttaggt

SEQ ID NO: 6811628 - DNA, 71 bp, Homo sapiens
gttgcccaggcctggagtgcaatggcacagtcttggctcactgcagtctttgcctcccaggttcaagcgat

SEQ ID NO: 6811629 - DNA, 96 bp, Homo sapiens
aacctacctggctttttataattatgagttatattattgcctcctcttaaaggccctgtgacttataacatagaatttgacagagtgcttgtggtt

SEQ ID NO: 6811630 - DNA, 104 bp, Homo sapiens
ggatagtgctctccttgatgtgttagctggcccttctttcaggtcccctttgaatggtaatattggcacagaaattaacatctcacagagacccaatattgtcc

SEQ ID NO: 6811631 - DNA, 63 bp, Homo sapiens
caccatttttagatgggccaaatagatgctctagacctctgtggtggcatctgtaaaatggtg

SEQ ID NO: 6811632 - DNA, 68 bp, Homo sapiens
gcgagtaaatgtggaagcaggttgctaacaggaccttgtcttgttgcagtcaattccagagactgtgc

SEQ ID NO: 6811633 - DNA, 77 bp, Homo sapiens
gaagattgcgtttagaagatggcattttaaatgtgggtttctccaaaggaagtgccactcttcttccagctatcttt

SEQ ID NO: 6811634 - DNA, 79 bp, Homo sapiens
gtaaatatgagtcagcacctgagtaataagcttgtttctattataattaataatattgctggggtgggccatgttctgc

SEQ ID NO: 6811635 - DNA, 58 bp, Homo sapiens
ctggaagtggggttggcttgaacgagatgttttatggtgtcacaaaccccattttaag

SEQ ID NO: 6811636 - DNA, 75 bp, Homo sapiens
gtgttctgcaatgctgcctcctttgaggaagtgtctgacagcctccacttctagcaaggggcagctgcagaaaat

SEQ ID NO: 6811637 - DNA, 81 bp, Homo sapiens
ctttgaataaatagcttaaactctttgaagttatagtttctcacttataaaacacaagagttgggctaggttgtcacaagg

SEQ ID NO: 6811638 - DNA, 67 bp, Homo sapiens
gtgggctcatcagcagggttctgggcaatggtcaaaatttgccatgcccctccttgtggtcgcccac

SEQ ID NO: 6811639 - DNA, 67 bp, Homo sapiens
caggtgctgaagaagtctgttcgccctgaaattcctccttggtcacagctttttcagcagcaacctg

SEQ ID NO: 6811640 - DNA, 91 bp, Homo sapiens
tggtgttgttatacaagctcttgagtaaactagttttccagcaaactgtgttaaaacactagtggatttctgggcttacaggacaatatca

SEQ ID NO: 6811641 - DNA, 89 bp, Homo sapiens
ctggcctccagggctttgtacatggtaggctttcattcattcgtttgcacattcggtgaaggtctactgtgtgccaggccctgtgccag

SEQ ID NO: 6811642 - DNA, 110 bp, Homo sapiens
ttgtgttttatcctctgttagctggtatagactcagtttggcattttaattgttcagaatattgactttgtttcctgagtctatcaagcatgattcagaataaagcatga

SEQ ID NO: 6811643 - DNA, 96 bp, Homo sapiens
agtcaatctcctcagtctggtgaatttcacaggagtcctttctataacacttcctataagaaactttcctatgaatgcttattgaggaaggttact

SEQ ID NO: 6811644 - DNA, 56 bp, Homo sapiens
cccaaccccagacagtgcatcttgttcgggtttcaagaagcctgggtggaggtggg

SEQ ID NO: 6811645 - DNA, 58 bp, Homo sapiens
gtccacagagaaagttcctctcaggccacagaggcctgctggcaattttcctgaagac

SEQ ID NO: 6811646 - DNA, 59 bp, Homo sapiens
gcctctctggaagaatacacttagaaaggaaactcatcttttcttttcttttggggggc

SEQ ID NO: 6811647 - DNA, 63 bp, Homo sapiens
cagttacttgggggtgttttccttggtattgtctaaatgggccaagtaaacattctcagattg

SEQ ID NO: 6811648 - DNA, 56 bp, Homo sapiens
taccaggcagctgcacagaggcctaagtgcacaggaaaggtggaggtgctctggta

SEQ ID NO: 6811649 - DNA, 66 bp, Homo sapiens
tcccagggacagctaggtggggcttgaggtagttatagcttctagatttgtcccctgtccctggga

SEQ ID NO: 6811650 - DNA, 101 bp, Homo sapiens
ggtgggtggggacaaggctttggctaagcatgctccagctgcaggcgccctctgtgtgtgctgttggaggtgctggagccagaacttggtcttgacctgct

SEQ ID NO: 6811651 - DNA, 62 bp, Homo sapiens
caacagcagcatgacagctgggtacagggctcctaaccctcgcctgccccatgtttctgttg

SEQ ID NO: 6811652 - DNA, 65 bp, Homo sapiens
attgatagactctctttttgtgtgtggttggagctcaagcagccacaattgagagattctgcaat

SEQ ID NO: 6811653 - DNA, 71 bp, Homo sapiens
gatggcgggggaggagctgcaggcggcagagagtaatcaagcactcatttacgcgcctccttcctttcgtc

SEQ ID NO: 6811654 - DNA, 62 bp, Homo sapiens
tggcaggaccttctcttggctcacacctcctgttctttgggcctctcaccagggtcctttca

SEQ ID NO: 6811655 - DNA, 94 bp, Homo sapiens
ggatctgttcaagaagacttgagttgggtgcttactattctatgtacttgggataccaacaatagaataaggcacagattctttcaagggaccc

SEQ ID NO: 6811656 - DNA, 83 bp, Homo sapiens
taattagactgaggttatggggttttaggaagactacagtgattcagtgtccttttcatcaccccaaatctatggtcttttta

SEQ ID NO: 6811657 - DNA, 63 bp, Homo sapiens
cagctattattttctctaaattaaaccaacactgagggattatttaggggaaaggatagactg

SEQ ID NO: 6811658 - DNA, 73 bp, Homo sapiens
gcgggaccagagcctctcagccccttggggtcctcccctccccggtcccatctcagggttgaaggttctctgt

SEQ ID NO: 6811659 - DNA, 75 bp, Homo sapiens
tatttggacttcctctttcaatgagtatgagaggacaaactccattactgaaataaagagaataaagtcctaatg

SEQ ID NO: 6811660 - DNA, 83 bp, Homo sapiens
cagaccatacttttccagggctggctgagcctgggctgttcatgagcagacactcctgagccgtcctggaaaagggagatctg

SEQ ID NO: 6811661 - DNA, 70 bp, Homo sapiens
atgaagaaccctagtgtgaagaagaggtgatacataaatatcaccctagacattgaactagggttctcat

SEQ ID NO: 6811662 - DNA, 81 bp, Homo sapiens
ttccgctgcctccctctgattgttggatggaccctcaaccagaggcctggtgggccccagcacgtctggggaggggctgag

SEQ ID NO: 6811663 - DNA, 73 bp, Homo sapiens
gagtcttgaaagcacattagagtaaatgagagtgactgaccctctgaaattcttgtgagctttccaaggactc

SEQ ID NO: 6811664 - DNA, 58 bp, Homo sapiens
tgtgtggttttcatataatcactccaagcaaatgcgctgatcacatgaaaaccatgca

SEQ ID NO: 6811665 - DNA, 64 bp, Homo sapiens
gttgttgattcatatgtaacatccctggtttaggagagctgggatagtggggtagaatcataac

SEQ ID NO: 6811666 - DNA, 81 bp, Homo sapiens
ggcagcctccccagacagcgggaggcctgggaatttgggcctagaacaaagcctctctgctgggagcacaaacaggctgcc

SEQ ID NO: 6811667 - DNA, 91 bp, Homo sapiens
agtttcctttcattaatgaggtcatctgttttggttactgagggaaactcaaaactctcgggacctagatacctgataatgctgaacagct

SEQ ID NO: 6811668 - DNA, 56 bp, Homo sapiens
gaggccagtgtgctgtgttttctgaaataggaaggaaacaaaccacagtgagcctt

SEQ ID NO: 6811669 - DNA, 77 bp, Homo sapiens
caaaggccaatttgtgcttgcagataagaagtctgattaaaaagtcagctttgcaagttagaaaatggatacctttg

SEQ ID NO: 6811670 - DNA, 79 bp, Homo sapiens
acaaggagtaactggaaagtattctttcactggtggtgataaagaacaccaaggcagaacttccccagactctccctgt

SEQ ID NO: 6811671 - DNA, 55 bp, Homo sapiens
actcagagtttgcgttccatacgccgttccacggctcgaagcaacagttctgagt

SEQ ID NO: 6811672 - DNA, 62 bp, Homo sapiens
gttccatgcattcctgctctgcgcatcaaagcccctgtgtgacagaaggaatgcgtttgaac

SEQ ID NO: 6811673 - DNA, 87 bp, Homo sapiens
gccagtggggccctgtggtcacaaggcagataataaggaggttgcctctttggtctgtggcttgggtctgaaagggtcctactgtgc

SEQ ID NO: 6811674 - DNA, 129 bp, Homo sapiens
gctgggtggagacctcctaagaagaggtaagagtcttgttctttctctgtaaaaggaaaatggttttctaacgttttactgttccagagaaagacaaaacgcccaacctccatttacatctgtctcagc

SEQ ID NO: 6811675 - DNA, 111 bp, Homo sapiens
agggcacttagcaccttgcagaaataagaggctttataactatttgttccataatagatggttggctgaataaatgaatagagctgttttctccaaagcccaagatgctct

SEQ ID NO: 6811676 - DNA, 104 bp, Homo sapiens
tcttttgaaaacaaccttcaggcctctcagaggcccaggagtcactgggctggcccagagactcagagatccctggaggtcctgagaaggggttggttggagga

SEQ ID NO: 6811677 - DNA, 57 bp, Homo sapiens
catacctcagattgctgccttgggcacagttttgtttcctagcatttttggggtatg

SEQ ID NO: 6811678 - DNA, 69 bp, Homo sapiens
ctctggcagagtctgctgtctgcagaggtgctgatgataacccctgcaggtgacaccactcttcctgag

SEQ ID NO: 6811679 - DNA, 83 bp, Homo sapiens
aaaaatgcaggttcttgggccacattctctaggtgtctatgattcatctggtttcatggttgggcttaggaacctgaattttt

SEQ ID NO: 6811680 - DNA, 66 bp, Homo sapiens
tataggaaagcgtgtgtgatgggcaatgccttagggcaagatgattcactacaatgttctcttata

SEQ ID NO: 6811681 - DNA, 81 bp, Homo sapiens
agctggtcccccactctaaaggagcctttcctgttcttccatgccggaaggagcccgtggtagatgggagggtgtttagct

SEQ ID NO: 6811682 - DNA, 57 bp, Homo sapiens
ttctttatttctatcacagattgaagagattgctctggagtttgaggaagttaagaa

SEQ ID NO: 6811683 - DNA, 101 bp, Homo sapiens
tgaggcaggaaaatcgcttgaacccaggagatggaggttgtggtgagccaagatcacgccactgcactctagcctgggcaacagagcgagactccatctca

SEQ ID NO: 6811684 - DNA, 55 bp, Homo sapiens
gatcagagcctgcctcaaaagcctcagccttgtgacttttgtgtagctgctggtt

SEQ ID NO: 6811685 - DNA, 55 bp, Homo sapiens
ttcactcatttttgtgtcctgcaaggcatttgcaaagaatgcagaagagagtgga

SEQ ID NO: 6811686 - DNA, 62 bp, Homo sapiens
ttcctgggagctagccacatctgactgctacaataccatagatcctggacagattccaggga

SEQ ID NO: 6811687 - DNA, 66 bp, Homo sapiens
agccagctcttggctcatggagagcaaggaccactcctcttgcatgagatccaggagtccctggct

SEQ ID NO: 6811688 - DNA, 81 bp, Homo sapiens
atggtatctggatgcccataaaatagagtctaaactcttgattgtgatgtaaaggctctcaatatgatccagtcctaccat

SEQ ID NO: 6811689 - DNA, 88 bp, Homo sapiens
attctgaatttgagttcttagttgtgcttgtgtgtgtgcacatagtaaacacacacacaggttaaaataattgggagatcattagaat

SEQ ID NO: 6811690 - DNA, 82 bp, Homo sapiens
gtccctgcttcttccttagttatttggtcccctcctcctcccagcaggattagggtaggaactgagtggaagggcaggagac

SEQ ID NO: 6811691 - DNA, 77 bp, Homo sapiens
tctcatgacatctttagttattgaatatagaaatttaagtattttagtatgagactgctagggaatagccatagaga

SEQ ID NO: 6811692 - DNA, 65 bp, Homo sapiens
tttcttgccaaacacatgagcatctctgaaatatcatttagtatgtcagtgtttaggcaatgaaa

SEQ ID NO: 6811693 - DNA, 58 bp, Homo sapiens
gggtagctgcactttgccaggaaaatgaggagtaagccttccagagttcagtctgccc

SEQ ID NO: 6811694 - DNA, 57 bp, Homo sapiens
gattgtatcttgaacttgtttatttttaccttagtaattaaggttcaggttacattc

SEQ ID NO: 6811695 - DNA, 64 bp, Homo sapiens
ttcagtcctgctgtcaggcttcagctgagatcacatcctctttgattctccagtatgggctgag

SEQ ID NO: 6811696 - DNA, 64 bp, Homo sapiens
tgaatttatattgctgagagtttcagtaaaacaagactagattttctttgaagcaataaattca

SEQ ID NO: 6811697 - DNA, 56 bp, Homo sapiens
gtgttagctatttgccctaaatgagaaaatccattctaggagtaatgagctagcac

SEQ ID NO: 6811698 - DNA, 55 bp, Homo sapiens
atgaaatgtctggatctttttctaattgtttgggaatagggtccatggatttcat

SEQ ID NO: 6811699 - DNA, 59 bp, Homo sapiens
ctcccgcacctccacccagacacacacacactcgttctgcacaggagggccgtggtgag

SEQ ID NO: 6811700 - DNA, 65 bp, Homo sapiens
tcccggcgcgcaggccgcggctcctcggagttgaggtgctggggcttggcctgcttgcgccgcga

SEQ ID NO: 6811701 - DNA, 82 bp, Homo sapiens
attgatcctggtggtgaggtggtgataaatcattgcaggtggggggaaattgatttttataccacctctcacttatttcaat

SEQ ID NO: 6811702 - DNA, 70 bp, Homo sapiens
tggccatcaattgccacccagaccttgaagccactctgcttgtctctagggcaatgtgaactcctggcca

SEQ ID NO: 6811703 - DNA, 55 bp, Homo sapiens
gatactaggcatggctgggcatccgacattcaggggagagctagggcctagaatc

SEQ ID NO: 6811704 - DNA, 58 bp, Homo sapiens
gtgggggacggtggcaggggccctgtgttgccagctgcggctgctgctcctccctcgc

SEQ ID NO: 6811705 - DNA, 79 bp, Homo sapiens
catgggttgctcatagggtgaggataaaagaataatagtcactactgggtttttggcttcagcctttgggtgaattatg

SEQ ID NO: 6811706 - DNA, 70 bp, Homo sapiens
gtatgctgcaggtcatccctgtgcttctctgccagcatctgcagatcctcatacttgatctggtgcatgc

SEQ ID NO: 6811707 - DNA, 70 bp, Homo sapiens
agtatttctgattctatgctggaagtaataatgactgagtactttatttcaaagtggagaattagacact

SEQ ID NO: 6811708 - DNA, 57 bp, Homo sapiens
tggttctccattcagcttcctgtgggctgctgtctccaccggaaggggagggaacca

SEQ ID NO: 6811709 - DNA, 62 bp, Homo sapiens
gtcttggcatgtgcagctgggatggaaatgctcctccagtggacagttacagcagctaagac

SEQ ID NO: 6811710 - DNA, 55 bp, Homo sapiens
gcttggtgttctcaagagtctgccctttccgaggaagaagaggatacaaccaggc

SEQ ID NO: 6811711 - DNA, 66 bp, Homo sapiens
cagccaacattgtgagcagatttttatctagcagttgtctatctgctgtctgtgtatttgttgctg

SEQ ID NO: 6811712 - DNA, 56 bp, Homo sapiens
ctctggtttatttcttggaaaggaattctgacctttgccatcaagtctggcctgag

SEQ ID NO: 6811713 - DNA, 87 bp, Homo sapiens
cagatttctgagtatcagtttagtaggtgatatcaattgcaacttcgcagaattatcacaagtattaaataaaggacttagtatctg

SEQ ID NO: 6811714 - DNA, 91 bp, Homo sapiens
ggatggcaagtgcctggaaagccttggattgggtttcagttagtaattataaaatgctaagtataatccagggtattctagtttcccttcc

SEQ ID NO: 6811715 - DNA, 87 bp, Homo sapiens
gatgtctgccagttcacagtgttttctttgcattgctcaagggtaaagtgaaagataacaacactgttttgaacatgtttagatgtc

SEQ ID NO: 6811716 - DNA, 99 bp, Homo sapiens
tgaagttactataagcatttatgtattatataagtcttgggggacatagcttttcatttctgagttgtatagtaagtgaatgtttattaaaaactgtca

SEQ ID NO: 6811717 - DNA, 85 bp, Homo sapiens
ttatctgttttgctttttgagcttccccacgaggttttatttcaagaagaccatctgctgctacaaaaagcttgagaacaattga

SEQ ID NO: 6811718 - DNA, 79 bp, Homo sapiens
gcagggcgtgcaggagggagggagcagtgattaagagccaaagctcgcatcagacctgtctcctcttgccaagtcttgc

SEQ ID NO: 6811719 - DNA, 71 bp, Homo sapiens
aatttattcatacatttattcccaggtttaacaaatgcctggcgtattctagataaagcattgagtaaatt

SEQ ID NO: 6811720 - DNA, 59 bp, Homo sapiens
gtcacttggggtaagccaagaggtgttgtcttcccactcttactttaccaccaagtcgc

SEQ ID NO: 6811721 - DNA, 58 bp, Homo sapiens
tggctccttccgcagcatgcctgctcacccccagaacccgcagctgtgggaagagcca

SEQ ID NO: 6811722 - DNA, 76 bp, Homo sapiens
gttcaatacaggtcaagtgtgactattttttcatattacctttatggtgtgagagagtgcatttgcatatttgaac

SEQ ID NO: 6811723 - DNA, 62 bp, Homo sapiens
ctaggtatggtaattgacctctatttcagatggaataagagaggaaatggtggccatcttgg

SEQ ID NO: 6811724 - DNA, 64 bp, Homo sapiens
gaagtcataaagagtagcatttcgaatacagtaaacactgtattatgattgttgttcatgattc

SEQ ID NO: 6811725 - DNA, 86 bp, Homo sapiens
ggtgctgctggtttttagtgcttaggagttggccatgttaaatttcccacaccacaagtaactcttttccagaagccagtggcatt

SEQ ID NO: 6811726 - DNA, 81 bp, Homo sapiens
gacctcagagcctggcatcctccctcaagctgaaggccaatttgcccttcagtgacctggatgcctgtccaggctctggtc

SEQ ID NO: 6811727 - DNA, 63 bp, Homo sapiens
agaaggtggctactcagtcatcctggatccctgattgactgcaataagtaaacacccccttct

SEQ ID NO: 6811728 - DNA, 93 bp, Homo sapiens
tccggagctctcacttctctgcactgaagccaacagacatgaggcttcataattcatgctgcaaagctggccagtagcagagtgagcaccaga

SEQ ID NO: 6811729 - DNA, 62 bp, Homo sapiens
cctgtgagtcacaatagtactacagtatctgttgaactgtgtactgagggtgaattcacagg

SEQ ID NO: 6811730 - DNA, 57 bp, Homo sapiens
tcacaaaggagaatgtcagcataatagctgctgtttgattgatgaatcctgttgtga

SEQ ID NO: 6811731 - DNA, 92 bp, Homo sapiens
ctaagcctgccgcttgctttacctgtggtatatttcagcaccatcctccaagcccaaagccactaaagtggggcacagcctacaggtcctag

SEQ ID NO: 6811732 - DNA, 56 bp, Homo sapiens
caagtttgctgatccttgttttaaacaataaacaaagccaggaaccagtaaacctg

SEQ ID NO: 6811733 - DNA, 101 bp, Homo sapiens
gtgagtgaaaaggcatggatttgaagatttgtccacagagtgatgaatggctgtactctcagtttctatctgtgtgaaaatctactcgtcctcacagtcac

SEQ ID NO: 6811734 - DNA, 55 bp, Homo sapiens
gcagttggtagaaggtccagggagaccacttggaatatcttttgtcccctgctgc

SEQ ID NO: 6811735 - DNA, 63 bp, Homo sapiens
gtgcttttatctatcagattggttcctgcttagggaagcagcatgtatgagggtgaacggcac

SEQ ID NO: 6811736 - DNA, 58 bp, Homo sapiens
acttcccaggcgctgtgtgctgcaaaggttgcagctgaccagcaagtcctgggcaggt

SEQ ID NO: 6811737 - DNA, 62 bp, Homo sapiens
cgtggtccttggtgctgctcccacaggttcacaagactgtggttgcagtgccaagtatcacg

SEQ ID NO: 6811738 - DNA, 129 bp, Homo sapiens
aaggaacagtgagactaaggcgcttctagaaggtcatcctggttaggtttgtaactttatgtagaagttacaagacactgctgacacagggactggtatggttgtggttttaatgtaaaatagttctat

SEQ ID NO: 6811739 - DNA, 79 bp, Homo sapiens
gtttcacaggctcatttctcactccagcaactttctaacacttcctaacgagaaagctggagcctgaggactgtggggc

SEQ ID NO: 6811740 - DNA, 73 bp, Homo sapiens
tgcaaaatatgtggccattctgtttgtgtctctttcaaatgtgaaatatatacataatggtataagttaagca

SEQ ID NO: 6811741 - DNA, 73 bp, Homo sapiens
aaggaataagaatgtggataagtgaaacaaagtaccagtttggaactacagtactatatctataggcttcctt

SEQ ID NO: 6811742 - DNA, 77 bp, Homo sapiens
ggcctcatttaaagtgttgggtgtccaggactcagcagcatggcttgtgttcaatcattccaacactttaaaatgcc

SEQ ID NO: 6811743 - DNA, 57 bp, Homo sapiens
accctatacactatgctaagggttcacactttgccctggcaatgggagtagtagggt

SEQ ID NO: 6811744 - DNA, 56 bp, Homo sapiens
ttcaccttccaggagggtctttgaggttacctagtacagagacactggaggaagag

SEQ ID NO: 6811745 - DNA, 63 bp, Homo sapiens
aagctacgtgaattctcccagtaacagatgaggaaattgaggctcagagatgttcagtagctt

SEQ ID NO: 6811746 - DNA, 74 bp, Homo sapiens
gccttgactgttatgggtgtcagcttaacattccatagatgggtggttagtttttatatcccataatataaagc

SEQ ID NO: 6811747 - DNA, 76 bp, Homo sapiens
tgagttaaatgagaacatgaaagaggcatttacttttcaccttttgtgccactgatttcccatttcacttaactta

SEQ ID NO: 6811748 - DNA, 64 bp, Homo sapiens
ccaggtgattcttgagaatcttctctgaagaggagttatatttttcagatagatttttagctgg

SEQ ID NO: 6811749 - DNA, 77 bp, Homo sapiens
gctggagaggttatgagacttgtctgtggtctcaatcaggcgagtgcagaaccagtcctcagacccaattgtccagc

SEQ ID NO: 6811750 - DNA, 129 bp, Homo sapiens
caaccccaaccaaccctcaagttccttcccagagccctcggcccttggctccctcccctgtggcattacacaggatggagagtgaggggtcactgcctctagggaggaaacagaatgtctggggaaaag

SEQ ID NO: 6811751 - DNA, 60 bp, Homo sapiens
gttccctagcctgccactctttcactacccacataacagaaagctgggtaggagaggagc

SEQ ID NO: 6811752 - DNA, 110 bp, Homo sapiens
cttcattctccagcaatgaagaggaaacatggccattcagactgtggaggaactggatgaggagacatctggaagtacagtctggaggcctgtgttggggagagatggag

SEQ ID NO: 6811753 - DNA, 63 bp, Homo sapiens
attaggatgtagctatgtcatcatcccatccctgatgggatggatcaattaagctgccctagt

SEQ ID NO: 6811754 - DNA, 94 bp, Homo sapiens
aatctgtggaatgtccttcaaggtccttggtgtgtctagtgtagagtttggagtcacaggcttgaggaccatggaggagattctggcacagatt

SEQ ID NO: 6811755 - DNA, 85 bp, Homo sapiens
gatgtttgtcagctaggatagaggtggtataccacaggactcttgcctttggtccattcttgttcagcatttgtattataacatc

SEQ ID NO: 6811756 - DNA, 90 bp, Homo sapiens
gtatttaatacatgtatggtattttatacatgtatgtatggtattttatacatgcatggggtaatggtattttatacatgtattttatac

SEQ ID NO: 6811757 - DNA, 55 bp, Homo sapiens
ccaccagaagctgggagaagctgggaacaggttctctctgagagcatctggaagg

SEQ ID NO: 6811758 - DNA, 111 bp, Homo sapiens
gactctttcttatgtttcttataatgtcaattgctggcagctggatctgcatgcacactgctgtgttggagctttcagtaatggcctacaagaacagcatgagggagagtc

SEQ ID NO: 6811759 - DNA, 67 bp, Homo sapiens
ggcattctgttatagagaagagctaaccattccccatttctatgtatttgtttgtatcagaatggcc

SEQ ID NO: 6811760 - DNA, 88 bp, Homo sapiens
cagcagaattttggaagggaaagaaagtacttctcattttagagaagcaagttctctactttcttaagtttcctcttaggttttactg

SEQ ID NO: 6811761 - DNA, 75 bp, Homo sapiens
tgattagagttttctgtgttgtcattattgtatctcctgttaatacagtgtctgacacgtaggaagcactaatta

SEQ ID NO: 6811762 - DNA, 69 bp, Homo sapiens
gccagagagtttaattcagagctgaataactggaagaaagaactcagcactgaatctggatttgctggt

SEQ ID NO: 6811763 - DNA, 119 bp, Homo sapiens
tggatctgagtgtcattaggagccttgcagacaagtgtttctgggtaacttctcagtaacatctttgacatttgtttagttgcagacctaaatggccactgatggatactgcagtttca

SEQ ID NO: 6811764 - DNA, 68 bp, Homo sapiens
agggctagcccagctttcttcatcaagtgccacgtcccgtgatgtcccgggatgaagaagggctccct

SEQ ID NO: 6811765 - DNA, 86 bp, Homo sapiens
tgctggtatcttttctattattatctttgaatgggactcattattgtctgagctatttattaaaatagtgaaggaaaagatcagta

SEQ ID NO: 6811766 - DNA, 56 bp, Homo sapiens
gtgaagaggacccagatctggcttctttcccaagaagagggtggtgtgctcttcgc

SEQ ID NO: 6811767 - DNA, 68 bp, Homo sapiens
gccgtgagatcagacacggcttgtgacgcgtgtggacgcgtgtgaggttgctgtttgttcgtcatggc

SEQ ID NO: 6811768 - DNA, 67 bp, Homo sapiens
gaacgtgcaccaggaggtcatgagtataataaaaaacggtttatgacctgcactggagcataacttc

SEQ ID NO: 6811769 - DNA, 65 bp, Homo sapiens
aattcactgcgtatgtcaaagctagatcgaccaaaatagactggtttttccatatgagatgtttt

SEQ ID NO: 6811770 - DNA, 79 bp, Homo sapiens
ttttagcagtcctgaatactggacggtgggattaatttatccttaaaatcaaacaccttgggaatttggactcataaaa

SEQ ID NO: 6811771 - DNA, 130 bp, Homo sapiens
ttgttttcctttttctgacctgtgtaaaaagttgactactaaggaatgtgtgttttagagaatggaagtgctgaaaatatttctgtggtttgtaaaattaattatatgaggtgtggggtaagggaaggaa

SEQ ID NO: 6811772 - DNA, 130 bp, Homo sapiens
gggaggttgcagctgactgcatggggtgccaggacacttgggtccatgggcagcccccagtgggctggtcaggggtgctagagtggggccactttcctggatcctctccaggtcataagctgacttcacc

SEQ ID NO: 6811773 - DNA, 55 bp, Homo sapiens
ggaagaaaagcttccagcgcctcccctccaaccggcccttgaggcttcgcttacc

SEQ ID NO: 6811774 - DNA, 129 bp, Homo sapiens
atagtatggcttttctgtgcatgatatttgacaagctgggcatgtacctcttctggcctcagttttcccttttattaaattgagacactttgggcatcacttcaccttgtccaggacaagttgcattat

SEQ ID NO: 6811775 - DNA, 129 bp, Homo sapiens
cccaatacatcggtgaactccattgtagggagcgctacttaagaggggtaaaaaggccccaaatctctctttttaacctaccttaagagcaacaggttaccttagctttatggaggcaaccgtatgtgg

SEQ ID NO: 6811776 - DNA, 70 bp, Homo sapiens
gttgtttgtggaggtagaaatgaagctctggtgatcaaccagcagggctcatcaagcctctccgcctggc

SEQ ID NO: 6811777 - DNA, 57 bp, Homo sapiens
acactttacagcttcctttgcagaatgtcgggggagtcaattttagctgtgaggtgt

SEQ ID NO: 6811778 - DNA, 110 bp, Homo sapiens
taatatgaggggatatctgaataaagggatagaattgaatgtatgaaaaggaagtaaaatacgagttaatattcaagttattctttcttccagtttcctattcactattg

SEQ ID NO: 6811779 - DNA, 63 bp, Homo sapiens
caggcttgtgactattccaaagaatgaattacatggagtgatgcaatggaatgtctaagcctg

SEQ ID NO: 6811780 - DNA, 62 bp, Homo sapiens
ggcctttgggcagtgggcttagcggcgtgcaccatgccactcgggccacacgtgccctggcc

SEQ ID NO: 6811781 - DNA, 71 bp, Homo sapiens
tccagcaagctatgttcaatgtgtccctgtttgaaagggaacacatcttagactgaaatatgcttgctgga

SEQ ID NO: 6811782 - DNA, 59 bp, Homo sapiens
cacagctaatggaagtggaatcagttctcagagctgggttttccattccagtggctgtg

SEQ ID NO: 6811783 - DNA, 59 bp, Homo sapiens
gaattgctgatgacctaatgcagaatagtttcattcctgcatatggaggttagcaactc

SEQ ID NO: 6811784 - DNA, 82 bp, Homo sapiens
tagagagctggaaccaatttatgctccttctgacattcacagggaatgctccgtataaatcttggtctcttcttccttttta

SEQ ID NO: 6811785 - DNA, 56 bp, Homo sapiens
catgtcagtcacaaagttctaaagcttctgctttggaatgtttcttgtactgaatg

SEQ ID NO: 6811786 - DNA, 65 bp, Homo sapiens
gcaacaagtgtaaacatgcattggtatttacaatgtcccaggtgctgtgctatgcacttgtatgt

SEQ ID NO: 6811787 - DNA, 97 bp, Homo sapiens
ttgattgtatgacccaggaaaaggctgattgattgtgggaaagtagggttcactacttgcattatatttatcacaatttctgggcccatgaagacag

SEQ ID NO: 6811788 - DNA, 56 bp, Homo sapiens
gggtctgcgaactgtctggaattcgtcccttaatgagtttacaactgtccagcccc

SEQ ID NO: 6811789 - DNA, 67 bp, Homo sapiens
agtacaggagagtggcagcaagaatgacttgtgtttgttctctctaagctccacatttcctaaaact

SEQ ID NO: 6811790 - DNA, 88 bp, Homo sapiens
tcatctgtcaactttctacccattcatcacctagcctgtcacacttgacataagcttctgaagggatgggcgaaagggaggcaggaga

SEQ ID NO: 6811791 - DNA, 77 bp, Homo sapiens
ttctgcttgtattaggttggtgcaaaagtaattgtgatttttgccattacttttgcaccaacctaatagaatatgaa

SEQ ID NO: 6811792 - DNA, 55 bp, Homo sapiens
tcctgaggtatatgctttgcagtaattttaatgcaggtttatttcaacttcagga

SEQ ID NO: 6811793 - DNA, 86 bp, Homo sapiens
ctctgctttcctgggtagaccatgggctcctgggacataagaagtgaatcttgtgtacgttggtgtctctgggacccagagcagag

SEQ ID NO: 6811794 - DNA, 78 bp, Homo sapiens
ctctcagttacttgacacaaccaattgaatcttgctcaaggcagtggaagttgggtttgtgtcagttgcaaccaagag

SEQ ID NO: 6811795 - DNA, 81 bp, Homo sapiens
caagtagagccacaagagtcaatttgtttttgctattttgatttaagatacatcaaagcaaattggaatgtggttataatg

SEQ ID NO: 6811796 - DNA, 62 bp, Homo sapiens
ctggaagtgcttgccgactgacagctctcaggtatcacaaggctgtggagtggtacatccag

SEQ ID NO: 6811797 - DNA, 75 bp, Homo sapiens
gggggctccaggcgagaatgtgttcccgcctttcccagcgtctagaggcacccacatcccttgctcggggcccct

SEQ ID NO: 6811798 - DNA, 75 bp, Homo sapiens
tactgtcttccaggtctggaggttggaaactgaaggttcaggtatctgcagggctggaatcttctgagagcggta

SEQ ID NO: 6811799 - DNA, 107 bp, Homo sapiens
tctttggacctcatttggaaatggaagagattggaacagatggctcctaaagcttcttccagctcatattctatcagtttataaattctactttgtagttgtagaga

SEQ ID NO: 6811800 - DNA, 105 bp, Homo sapiens
gttctagtatggccagctcagttttatctgtgacatctggcagggtcagttttctagtcctgagtttccagataagaccttttcctgagcttctcaaactttaac

SEQ ID NO: 6811801 - DNA, 66 bp, Homo sapiens
ggggctttgacataagacttagagtattgtatcttaattacagacaaataactttttatgtccccc

SEQ ID NO: 6811802 - DNA, 62 bp, Homo sapiens
ggcagccccatcagagacgctgggctgacacactcaccgtcttggagatattctgggctgct

SEQ ID NO: 6811803 - DNA, 70 bp, Homo sapiens
gaagtcagtaatgctggatgacttacattcttgacaacttgtggcaactgaattcagcattctgcacttc

SEQ ID NO: 6811804 - DNA, 56 bp, Homo sapiens
gcagtgttgactatggtatgagtgccttctgtggccaactagattttcaatgctgt

SEQ ID NO: 6811805 - DNA, 97 bp, Homo sapiens
aacatgtgttatgaattcctcagctctgaatgaggctttaaggctttcctaaagtccaattttgttcaggctatgttgaaatttaccatctcatgtt

SEQ ID NO: 6811806 - DNA, 67 bp, Homo sapiens
ggaattctgcaaaatgtttaaggcctattcattccatgtgtatctctcccttcatttgtagagttcc

SEQ ID NO: 6811807 - DNA, 89 bp, Homo sapiens
gcagctgggggctgtgtcagtgaaccaggctgcgtccctgagtacttccagtaggtgggggtgtcctggtgcacacagctcaagggtgc

SEQ ID NO: 6811808 - DNA, 106 bp, Homo sapiens
tggaacactttgttggaatgtttaatcagggatgaaaaatgtcagagctcttgccctaatgattaattctgattaactcatttagccaatctggtttatacttcca

SEQ ID NO: 6811809 - DNA, 68 bp, Homo sapiens
ggagatcagttaagaggccacggcagttataccactgttcaaagctgagtagtggcctcttgcctgcc

SEQ ID NO: 6811810 - DNA, 69 bp, Homo sapiens
ttgaagtgtccactgggctttctctgcaccaggtatcacaacttgcagggaaaacccaggatgctttaa

SEQ ID NO: 6811811 - DNA, 63 bp, Homo sapiens
tggtccctattgtggtaagtgggcctccatcctgcttggctctcttagaaactatagagatta

SEQ ID NO: 6811812 - DNA, 72 bp, Homo sapiens
actttgtaaccatttaggggggaaaatatctatgaagtgatactatgttcttcctaaatagtgcttcaaggt

SEQ ID NO: 6811813 - DNA, 111 bp, Homo sapiens
ggaataagaagtaggtgttagtatgaggaggttatgttcatatcttagtgcttttgctaactggccttgggtaaagccccttcatttctctgaacctcagtttctctttct

SEQ ID NO: 6811814 - DNA, 116 bp, Homo sapiens
gagctacatggtggctgagaacctgttggggcaggggtggtgctatctccacagtcccacctggagactgtgtggaccactctgaggctcaggagggaacaaaagctgccaagctc

SEQ ID NO: 6811815 - DNA, 84 bp, Homo sapiens
gctggaaatgtgtaagggtgtgcactaagaattttccagacaaagaagaaagggaaaagcatgctactttatataggtttgagc

SEQ ID NO: 6811816 - DNA, 88 bp, Homo sapiens
ggtatttaaacaagtatttcttccacggtggatttagtaattcttacaaaatccaccgtggaagaagctcctatttttccattctgcc

SEQ ID NO: 6811817 - DNA, 94 bp, Homo sapiens
agaaaatatcagtgagctatttctgagattttgcctaagctttgtgtgtacaatatatagatattagcaaaattttattcttttgatgctttct

SEQ ID NO: 6811818 - DNA, 123 bp, Homo sapiens
cactgggaacgttggaacttttcagaaagcatttttgtgtaagattctgcaaggcagatctttagagaggtgtcataatcagttttgcatgtgttttgtttgagtcaaccaacgttatttgtg

SEQ ID NO: 6811819 - DNA, 78 bp, Homo sapiens
gagagggtccccaaaagacaggtgtctgcggcccttccagctgtcggagtgggagggacgggcacggagggccctctt

SEQ ID NO: 6811820 - DNA, 60 bp, Homo sapiens
gtgagatacagcttgtgacttggggcataatggagtacgtaccaggcactgttgtggcac

SEQ ID NO: 6811821 - DNA, 77 bp, Homo sapiens
gttcttgagcccccaaattttaatcattgtctctttggttgctactatggcaacttacaatgttagagtctcaatac

SEQ ID NO: 6811822 - DNA, 100 bp, Homo sapiens
gttctgccgttctgccgtcagccttgaaggtgccgatgtgccctgtgggcctggcctgggtacccttggcggccttgctgggagtcgaccgggtgcgagc

SEQ ID NO: 6811823 - DNA, 98 bp, Homo sapiens
caagcccttggcactttcttctgccccttgcctgacagtgtttgcctttctttggatgatggagcagtgagatcatccaggtgccccccaggggcttg

SEQ ID NO: 6811824 - DNA, 70 bp, Homo sapiens
cctggacctctgggtgccactgtctgtacatgtccagcttggcaggcagctggcatcctaaggattcagg

SEQ ID NO: 6811825 - DNA, 85 bp, Homo sapiens
ccatttgccaaggctgttatatttttgcccatgaggaattactcaattttggtcatgtagtagagacagctttgtagacaaatgg

SEQ ID NO: 6811826 - DNA, 64 bp, Homo sapiens
ggcccgtagatccccggaagcgcctttggttgccagcaggtgtcggcgagggtcttcagtggcc

SEQ ID NO: 6811827 - DNA, 55 bp, Homo sapiens
gcctaggggtacagtctgcctttacagtgatcactgtgagaaggtttccgtgggt

SEQ ID NO: 6811828 - DNA, 79 bp, Homo sapiens
aaggacacaatggattaacaaatgaaaattactatatgcatccagcatatagtaagcagtctgtaaattcttgttcttt

SEQ ID NO: 6811829 - DNA, 73 bp, Homo sapiens
cctccattctcccaggctcagactggcttgtttggactccagcatccacagcctcagcctgcagagaaatagg

SEQ ID NO: 6811830 - DNA, 88 bp, Homo sapiens
ctttatgagttgctaaatggaacatgaattaatatggtctatcttgttctagagtgcattatatgtttcaatgggtcaatttataaag

SEQ ID NO: 6811831 - DNA, 56 bp, Homo sapiens
ttgtattccagccaccacaggcactccagcctgtggctttcggttgtgaatgacag

SEQ ID NO: 6811832 - DNA, 89 bp, Homo sapiens
atatcactgctccatggagagtgaaagtctctctagttttcatgcctaccaaactagtagagatccagctttccttccagaagtaatat

SEQ ID NO: 6811833 - DNA, 56 bp, Homo sapiens
cagaccagacactcgcatcgacattacctgcttggcttctgcgatgtctgtgtttg

SEQ ID NO: 6811834 - DNA, 73 bp, Homo sapiens
ggaaagcctgcctgggtcacccaaaagggccaggccatcctgtttacctggtgggtaatctggtgggttctcc

SEQ ID NO: 6811835 - DNA, 59 bp, Homo sapiens
ggaaattcaggttatatttgcaactatgctctagttgtgagaatgaacactgaattttc

SEQ ID NO: 6811836 - DNA, 56 bp, Homo sapiens
caccagcgactgtgaccagcaatagccccctggctccagctgtcctgtagctggtg

SEQ ID NO: 6811837 - DNA, 74 bp, Homo sapiens
ctttttccttaggcagatgttaacaggaaaagatagttcttcatttatcctcaaacttctgcttcaagagaaag

SEQ ID NO: 6811838 - DNA, 78 bp, Homo sapiens
ggagtttgggccctgaattgagactgctcttgactgttcttggtcttgtgagagctctcttcataacggcctgaatcc

SEQ ID NO: 6811839 - DNA, 71 bp, Homo sapiens
gcattcctgagggccccctacttggcaaacaaaacccttgaaagtgggcctgtagggttttcaggaacaac

SEQ ID NO: 6811840 - DNA, 86 bp, Homo sapiens
ggtcaagcacaggtgagtaacaatgggtgatgaactgtagcagtcaacatgcagaagtgctttctggaaacacttgtgttctgatc

SEQ ID NO: 6811841 - DNA, 89 bp, Homo sapiens
tatatatgtgtgtgtgtagtttgtgtgtatatgtatatagatgcacatatgaatatacatatatacatacatacacacacatatacata

SEQ ID NO: 6811842 - DNA, 86 bp, Homo sapiens
gggtgcctgggaatcacattttatctgagattgacacgttcaatatgcacatggcaatctccctgaaatcaattgaaaccgcaccc

SEQ ID NO: 6811843 - DNA, 64 bp, Homo sapiens
gtgggatggaacttggggagattatgatatatgtgttatgtactctgcaatgtttgaattttat

SEQ ID NO: 6811844 - DNA, 63 bp, Homo sapiens
gctaggtgaccttggctcttacagggtgatcttcacattctgtcaccgagggcatccaaaagc

SEQ ID NO: 6811845 - DNA, 63 bp, Homo sapiens
aggctggagtgcagttgcacagtcttgttgcgagtacaggcgttgagctactgcacccagcct

SEQ ID NO: 6811846 - DNA, 75 bp, Homo sapiens
taaatatccttgagattttcagcttgactgggagaagaattttttccaccagctgaaaatcagtaagcccattta

SEQ ID NO: 6811847 - DNA, 64 bp, Homo sapiens
acagagtcataagcatgttttagggtcttcatcgtgaaccactctttaacagactttgatctgt

SEQ ID NO: 6811848 - DNA, 73 bp, Homo sapiens
gagtctggaatttcgttcatagtagaaatggcttaaaaattgaaaatcattatgctggaggagaaaaagactt

SEQ ID NO: 6811849 - DNA, 57 bp, Homo sapiens
gcgggccagtgtcttggtgatctggaagggtgacttgcaggcagaggcttggctagc

SEQ ID NO: 6811850 - DNA, 55 bp, Homo sapiens
ctcccaggtctttgggttcctcatctgagaaatagatggggaggagaattgggag

SEQ ID NO: 6811851 - DNA, 76 bp, Homo sapiens
ggcaggaagtacaaagtgaaataattctgagactattaaagtccagggccttgtcacattgattacattcttagct

SEQ ID NO: 6811852 - DNA, 59 bp, Homo sapiens
ctcttgcttcccaaggcgggggaactgatggtttcctacatcaccagggggagtaaaag

SEQ ID NO: 6811853 - DNA, 65 bp, Homo sapiens
ggtagctctgggactagaaccccaggggcaatctggacttcctggctctaagtcctgagtgcacc

SEQ ID NO: 6811854 - DNA, 55 bp, Homo sapiens
catatgcctgcaaataccagtaattggccttacagtgtgaataagcaggcatttg

SEQ ID NO: 6811855 - DNA, 82 bp, Homo sapiens
ggtgaatctataccattgtttctaccagctgtctctggagtgagtattgggattggaagcggtggtggtcaaaggctttatc

SEQ ID NO: 6811856 - DNA, 62 bp, Homo sapiens
gggcctaggggacaagcctgggtctgtctgctactcactcccatgctcgtcccactaagctc

SEQ ID NO: 6811857 - DNA, 68 bp, Homo sapiens
gacaggattttgatttcttgattatgccctctgtgacgaggccataaattgctggtcaaaattcagtc

SEQ ID NO: 6811858 - DNA, 76 bp, Homo sapiens
agtaaatggctgagctccctgtgtgttgggtaatttatgttcctttgtccattgattcgttcaactgccatttact

SEQ ID NO: 6811859 - DNA, 58 bp, Homo sapiens
tgggtgcaggacgcctccgctccacgcctgggtgggctggagacaacgtcctgcccca

SEQ ID NO: 6811860 - DNA, 90 bp, Homo sapiens
acatcacatatagttcaaagtagagttgtggaattacttttccatgacaatgtttaagaattgtacagctttgctgttatctagtgatgt

SEQ ID NO: 6811861 - DNA, 55 bp, Homo sapiens
tgtgttacctgcactggatttctgctctgcttgactaaaagtcccagctaacaca

SEQ ID NO: 6811862 - DNA, 83 bp, Homo sapiens
agctctgtttttatagttttaagtgactatatagaatattaaaaagatacagctgtctggaatttaagataaagatcggagct

SEQ ID NO: 6811863 - DNA, 56 bp, Homo sapiens
ggcccacagcacctgcagccagttgggagcttcctgcaagtccagggctgtgaact

SEQ ID NO: 6811864 - DNA, 67 bp, Homo sapiens
gtatattgcaagttaaaaattattagtgctacattaagcaactgggaaattaggggcttgcactgac

SEQ ID NO: 6811865 - DNA, 71 bp, Homo sapiens
tcactgaaagtttgagtgatttgacacagttcttgagtgtgtcagatttaggctcaaacgcagtcagttga

SEQ ID NO: 6811866 - DNA, 86 bp, Homo sapiens
ggagggaagggagctgggaggagccaggtggggcctgtttatgggggagccttgcctcattgtgcttctcccagtacctgcacccc

SEQ ID NO: 6811867 - DNA, 61 bp, Homo sapiens
cagggcctgcattgttgaccaccaattccttggagagggaggcagctcctgcagtgccctg

SEQ ID NO: 6811868 - DNA, 98 bp, Homo sapiens
ttcctttattcagactaaggtacagaaggatttctagtagttgtataaaaaatgagtaactgatacattattatttgagttcctctctacctaaggaa

SEQ ID NO: 6811869 - DNA, 83 bp, Homo sapiens
ggaggacttagtgagttaagtgtcctgagcggcacctgcactcaggtgacactcagtgctgctggctcctgtcacaattctcc

SEQ ID NO: 6811870 - DNA, 61 bp, Homo sapiens
gcttacacagcttctatccttgaagaaccttggtgcctacaatagctgagagctggtaggc

SEQ ID NO: 6811871 - DNA, 65 bp, Homo sapiens
aattcaagccattgagggttttccctgagaaaaggaattagaggagagcccttaggtttagagtt

SEQ ID NO: 6811872 - DNA, 65 bp, Homo sapiens
acttctgagcattatttaatgatgggcttttgatttgagctcacatcatagtaagctcattgagt

SEQ ID NO: 6811873 - DNA, 66 bp, Homo sapiens
aatctctgttgctatgatagttaagatactaggaaagtcctttgtgaactatgaatagaagagatt

SEQ ID NO: 6811874 - DNA, 58 bp, Homo sapiens
ttgtacactgttgatgggaatgcaaattagtacaaccattatggaaaacagtgtagaa

SEQ ID NO: 6811875 - DNA, 74 bp, Homo sapiens
gtccactcctgggttctaaatttgaaatgttctctcttaatcaatgaactcttggaacagcacctggtgtggat

SEQ ID NO: 6811876 - DNA, 59 bp, Homo sapiens
agtacatttttgtaacagatctctatggtatttcctagatactgttcaatgatgatact

SEQ ID NO: 6811877 - DNA, 70 bp, Homo sapiens
gtgactccaaagggaagagtggaagtgactggattgttttaaaagtcagtttcaatttgccttgagtcat

SEQ ID NO: 6811878 - DNA, 70 bp, Homo sapiens
aggaacaaacagtcaggacagtctggactctattatttcatttcttccacacaactaattgtttgtttct

SEQ ID NO: 6811879 - DNA, 63 bp, Homo sapiens
agtgccacacttctgattaacgtagctttgtagtaagttttaaaatcagaaagtgtgagctct

SEQ ID NO: 6811880 - DNA, 75 bp, Homo sapiens
gtaaggacgtataagatgtgacaggcctggaattagcaatgcaattcctctgtcatttttatcattggcccctgc

SEQ ID NO: 6811881 - DNA, 102 bp, Homo sapiens
ctagatattttactgttcattccctgtctcttcaatcctgtggcccttattcagcctcccaggtatcagggtagaagagtataagaaatacaaattatttag

SEQ ID NO: 6811882 - DNA, 62 bp, Homo sapiens
ctcgcctcccttagggcacactgacctttgaatttaaagtcagcctgcactcagggagcggg

SEQ ID NO: 6811883 - DNA, 102 bp, Homo sapiens
tgctgcagccacccagatcattgtgtagtagaggtggcaccattttactatgtgtcctccctgcactcagtgaagtctgtgaagggaggggtcagtgcagca

SEQ ID NO: 6811884 - DNA, 59 bp, Homo sapiens
cctcagtttatcctctgtaacatggaaggccaaatgtgtaatttaggggattattgagg

SEQ ID NO: 6811885 - DNA, 63 bp, Homo sapiens
ccctcctacttccttccaaacattcatttaatttaaaggtgacagggacagggagagggaagg

SEQ ID NO: 6811886 - DNA, 66 bp, Homo sapiens
agtgactggaggctggtgtaagtccctgcgacagctgggctccaactacatcagccttaccacact

SEQ ID NO: 6811887 - DNA, 80 bp, Homo sapiens
cctacatatttgccatataattattcagcatcaaaccttattaatcaaatcgatgctgtgttttaaatggaaattgcagg

SEQ ID NO: 6811888 - DNA, 129 bp, Homo sapiens
gttcataatcgagtctttgttttagtggctgtggttggcatggctgcagttgggccctcagatcttgcagattatgaccaggcagcaggctcgccaagccgtgggcactaactcaagctcccctggagc

SEQ ID NO: 6811889 - DNA, 79 bp, Homo sapiens
gacaagtgaaaagagtgtttcaactttggctgatttattcagccagctgttcagacattctttttaagtgatgcttgtc

SEQ ID NO: 6811890 - DNA, 57 bp, Homo sapiens
gtggtattgaagtctaaagaaggtagttaccaaccgatcttctagaccttataccac

SEQ ID NO: 6811891 - DNA, 63 bp, Homo sapiens
agtccaaatggtttttgcatattcaggttatctttgacctgaagcagagaaaaccagaagact

SEQ ID NO: 6811892 - DNA, 62 bp, Homo sapiens
caagagccctgacggggacagatgggtgctggctgtccccctctgtcaccatcagggtggtg

SEQ ID NO: 6811893 - DNA, 56 bp, Homo sapiens
acatacgtgtgtgcacacatatgcacacaaagacatacacatgcacacatgtgtgt

SEQ ID NO: 6811894 - DNA, 103 bp, Homo sapiens
ggaggacttgttaagacacatgcagctgggctccatccccaaagtttccgattcagtaggtctgaggtggggctggagcatttgccttttttataagtttccc

SEQ ID NO: 6811895 - DNA, 75 bp, Homo sapiens
cttggctttcttccttgctgtctgctccaggcggactccctccaccaggcagcctcggcaagggcagcctcgaag

SEQ ID NO: 6811896 - DNA, 70 bp, Homo sapiens
gagggacttctcatttacctttgcaatcaaggaactcacagagcatttgttgtagagtaggtaggccctt

SEQ ID NO: 6811897 - DNA, 73 bp, Homo sapiens
tgtctatttaaaaggaatgtttcaagggaatcattgcatgtttatatccttgactttgccttttaaatgttca

SEQ ID NO: 6811898 - DNA, 58 bp, Homo sapiens
gcaaaagagccagctacctcagtttccaaatatgtcaaacaaagtactggccttttgt

SEQ ID NO: 6811899 - DNA, 76 bp, Homo sapiens
gggagggaggatgggagaagaatgagagaaatatatagagtataaagttcttctttatctcagtatcctcttaccc

SEQ ID NO: 6811900 - DNA, 58 bp, Homo sapiens
tctgtggactgtgtgagaggtgggagacagagaagccctcctaggcattgtccaaggg

SEQ ID NO: 6811901 - DNA, 58 bp, Homo sapiens
tgagaagcactccttgccaagtgatttgagacctgtgtttgggcaaggttccttttca

SEQ ID NO: 6811902 - DNA, 79 bp, Homo sapiens
gagctcccatcgtggcacaccctccggctatctacagtgatgacacactggagcagtggctggatggtgtgctgggctc

SEQ ID NO: 6811903 - DNA, 73 bp, Homo sapiens
ggagacaaaaataggccaatcttctgtttgaaagaagcagaaactttctagggcttcagggttttaagtctct

SEQ ID NO: 6811904 - DNA, 109 bp, Homo sapiens
cctgccaacaccttgatttcaaactttgagtgtccagaactaagggaatccatttctgttatacagtctgtggcacttcattattggagctttagggtaacaggacagg

SEQ ID NO: 6811905 - DNA, 63 bp, Homo sapiens
gaatgcacacgtgtgtgcatgcactgtgagctggtgtgtgcatgtgcactggtgtgtgcgttc

SEQ ID NO: 6811906 - DNA, 73 bp, Homo sapiens
agcaggttgtgatacactcagatttgctgctcaattccccttcaacgatccatgagtgtagtcagaaacttct

SEQ ID NO: 6811907 - DNA, 126 bp, Homo sapiens
aggagcagcccacaaccaacgaatgactctcaagagttggagtataaattccccagtcctcttgccctcagctgggttcatttcaagtccaagtcttgggttcaacaccatgttctatactctcct

SEQ ID NO: 6811908 - DNA, 64 bp, Homo sapiens
aaaggcttctcagaaaggccttgcttatgtagtcaaggatcaatatttttgaaaagaagttttt

SEQ ID NO: 6811909 - DNA, 85 bp, Homo sapiens
gccaaaaggaaggataagacacacacatatgctgagttagggcgctttgctcactcaaggttgtggtgttgcatcttcatctggt

SEQ ID NO: 6811910 - DNA, 56 bp, Homo sapiens
aaacttgctggcacgtgtatggatgagcattctcactcctgcaaaaggacaagttt

SEQ ID NO: 6811911 - DNA, 66 bp, Homo sapiens
aaaggatccgttttaacaatgggagttttgccagtggaaatcccaatgggatgaaacctgtccttt

SEQ ID NO: 6811912 - DNA, 67 bp, Homo sapiens
cccagcatgggagctatctccatcactctatcatggccactagtgaaataaagctgcctatggtggg

SEQ ID NO: 6811913 - DNA, 68 bp, Homo sapiens
acaaattttaagataaccagcgctcaatgaaaacaaaacgcaggtgagctctgacttttgggaattgt

SEQ ID NO: 6811914 - DNA, 77 bp, Homo sapiens
agatagggagtcaggagacctggtaagccaagtgtgtgacattggctgagctaacaggtctctcaatttcttcatct

SEQ ID NO: 6811915 - DNA, 55 bp, Homo sapiens
accagggtacttctaggtggggcttgcagctgcccctgtcctgctaggccctggt

SEQ ID NO: 6811916 - DNA, 70 bp, Homo sapiens
actcggatggatataatacaacctgctaagtgtcctagcacttagcaggttgtattatcattgtccgtgt

SEQ ID NO: 6811917 - DNA, 60 bp, Homo sapiens
gctaccctgccctcaggctgcttccctcccaagggaaacactatgccaagacagggaagc

SEQ ID NO: 6811918 - DNA, 58 bp, Homo sapiens
aggggccatgtaagtgtatcacatccaacataaaagatgcgtacctgcatgtgccttt

SEQ ID NO: 6811919 - DNA, 64 bp, Homo sapiens
caagccagggggcccttgcaggtgagcgagccaagcctttcttttctcagggcctctctgcttg

SEQ ID NO: 6811920 - DNA, 123 bp, Homo sapiens
gccacgactcagattgcatccaagtgagcactatatctctttcatctttttcttatggtgcagaagcacaagagggtgagcaggtacacatggtgactcttaagaattcaactcaaaactggc

SEQ ID NO: 6811921 - DNA, 70 bp, Homo sapiens
ggagtgccaggccaggctgcatttgcccctcgcagtaaaccctggggtgaaaccagccagcctgtgctcc

SEQ ID NO: 6811922 - DNA, 70 bp, Homo sapiens
gtgtttctgatgctattttaaccacttatagttaccattgtgagaggagaaatgcattaacaagaaacac

SEQ ID NO: 6811923 - DNA, 76 bp, Homo sapiens
accaaggacactgaccccaagctgtcctgcctagcgtccagcgtcttctaggagggtggggtctgcctgtcctggt

SEQ ID NO: 6811924 - DNA, 87 bp, Homo sapiens
ttccatcagcaagaccttatttttacctaatttatgagaggtatttctctgttcagaagaggtgaaagttctggcttctggggggaa

SEQ ID NO: 6811925 - DNA, 91 bp, Homo sapiens
ttctgtccttccttttgcttgcctcatgcccaattttccaagccaaggaaaggattgggaaggcgtggaagtagaaggtctgggcacagaa

SEQ ID NO: 6811926 - DNA, 77 bp, Homo sapiens
gggaacttttcagaacataatgtgagcatatttgggaaaggcaatgtgcaattcactgttatgtctgtgcttttcct

SEQ ID NO: 6811927 - DNA, 120 bp, Homo sapiens
ggagtgaaagttcccaccaccctttctcttacccgctggggagtagggctgtattgttaaggagccatggcgccactagagggaagtattggatagggaggaaaagaaacttcacattcc

SEQ ID NO: 6811928 - DNA, 62 bp, Homo sapiens
aggccaaggccagcaggggagctgaaatccaaaattagcacactgacctgaagccttggcct

SEQ ID NO: 6811929 - DNA, 64 bp, Homo sapiens
gacttccatttttgtttgtcagagtaaggactgggcacgaccaccttcaaactagatagaagtt

SEQ ID NO: 6811930 - DNA, 67 bp, Homo sapiens
tcatatcagaaggtagcaaatccacccattatggagtgaattgtgacccctctgtatttatatgtga

SEQ ID NO: 6811931 - DNA, 118 bp, Homo sapiens
cttctgatctgcttgtctctgtgcaaatcaaggaagtactgcggcgtattcagagggaccacctgtctggaagaccagacttcccgaactgcaacacgaggaatacagaatcaagaag

SEQ ID NO: 6811932 - DNA, 74 bp, Homo sapiens
gataaaaagttttgactcagtggacgtactagcttgtaaaggttaggacctgctgggattacaaataaaacatc

SEQ ID NO: 6811933 - DNA, 58 bp, Homo sapiens
tgctcagtgcagtgaaaggtttactgagctacaaattagtaaactgtctgcttgagca

SEQ ID NO: 6811934 - DNA, 79 bp, Homo sapiens
gctagaaatcgacttcagaatttgtgagactagggggaaaataacccattcaaaactattctagaagttgttttttggc

SEQ ID NO: 6811935 - DNA, 58 bp, Homo sapiens
gcttcctgagtacaccctcatcttagaactgaggctcaaggtgtctgctcaagggagc

SEQ ID NO: 6811936 - DNA, 111 bp, Homo sapiens
ttgctatttaatttagacattctgtctgtggagcttctgatgtgtattccttatctaacatatacattacttgataagacaggctctatgattatctaaattgaaaagcaa

SEQ ID NO: 6811937 - DNA, 130 bp, Homo sapiens
cgatctctactcactacaacctccacctcccaggttcaagcaattctcctgcctcagcctcccgagtagctgggactgcaggcacacgctgccatgcctggctaattttttgtattttagtagagatgcg

SEQ ID NO: 6811938 - DNA, 56 bp, Homo sapiens
ttggtgtttctggaaagtctgtaaggcagctaatgcagagctccccaagacaccaa

SEQ ID NO: 6811939 - DNA, 81 bp, Homo sapiens
gcagtggtgggtaaaactgctggcactttagcatgaatcaatgcagtggctccaaaccgtagtcattttattcttcattgc

SEQ ID NO: 6811940 - DNA, 81 bp, Homo sapiens
ttcactctgggcctggggctgttgagaggttccttgctaagggggttctctctcctaagagctctaggaatccaaggtgga

SEQ ID NO: 6811941 - DNA, 55 bp, Homo sapiens
gctctcaggtgccactttgtgggttgcaaatcaaactcacttgggcaattggagc

SEQ ID NO: 6811942 - DNA, 58 bp, Homo sapiens
accaggctccctgccagggccggcgcagtgcagcgcctgagctactagggagtctggt

SEQ ID NO: 6811943 - DNA, 57 bp, Homo sapiens
aaaatgttaagaatgcagacaaatggcacttagtgcccagtgagttcttgacagatt

SEQ ID NO: 6811944 - DNA, 75 bp, Homo sapiens
gagggaatgagtggcagaagccaagtctgcagttgggaaatcatgggacgtgctggcttttcctctctgatcctc

SEQ ID NO: 6811945 - DNA, 95 bp, Homo sapiens
ttgatcttccgctggcatgtactgaagggcctttctaggttctgatttgaatgtgtgaaatcacaggctatttagagtgccatgttttagatcaa

SEQ ID NO: 6811946 - DNA, 85 bp, Homo sapiens
tgttagaatgcatgttgcttggcccactccagagaatccgattcagtaggtctggggtgggccccaggtatctgtatttttaaca

SEQ ID NO: 6811947 - DNA, 64 bp, Homo sapiens
gggtctattttaagtctgattaatggagatactaatcttcattagcaaggtcttcaagtgactt

SEQ ID NO: 6811948 - DNA, 68 bp, Homo sapiens
cgtagcccttcaaaatttacgcagtttgtacatatagatatgtgctgtatatattttgaagtgatacg

SEQ ID NO: 6811949 - DNA, 128 bp, Homo sapiens
tttaagggatggaaaataatgagtgtgaatgttagactttatttcaaaagagcttggggttgttagaaaatcaccaaggctttaggaatttctacctttcagctagaatcattgtgataaatggtaaa

SEQ ID NO: 6811950 - DNA, 56 bp, Homo sapiens
gggttcagtccctcttgctactccatcttacaaggagctgtgaaggtgttgagccc

SEQ ID NO: 6811951 - DNA, 64 bp, Homo sapiens
ggaatagatgggggataaattgtatgtccttataaaaataatttgggtgtctgtcatcagttcc

SEQ ID NO: 6811952 - DNA, 81 bp, Homo sapiens
actcactaaaggaatattaggggcttactgggccaataatctgccaagacagtgacctaatattctgccaccacagtgggt

SEQ ID NO: 6811953 - DNA, 80 bp, Homo sapiens
gagacagaacattccagcaggcagacaggagatgaggatgcttcatcacttcagcactgatggactgaatgcttcttctc

SEQ ID NO: 6811954 - DNA, 85 bp, Homo sapiens
ggtgctctgttcactgaatgatataagatctttctaaattgagcttttagaaatagtttggtattttcatgaaaaaaatagtact

SEQ ID NO: 6811955 - DNA, 71 bp, Homo sapiens
agggacattgtcaatggtggtagatttcagacagtcctgctcatttttttacaactatttgccatgttgtt

SEQ ID NO: 6811956 - DNA, 103 bp, Homo sapiens
tgggaaaaatgttgtttagtcaatttgcattggtcataaattgagtgatttcattgttgtgattatatacatgacttgcacttgtctgaaatagcattgacca

SEQ ID NO: 6811957 - DNA, 55 bp, Homo sapiens
cagggcccaagacacaatgaggacgtttgtttctgatgtgtatcttagggccctg

SEQ ID NO: 6811958 - DNA, 67 bp, Homo sapiens
gctttcattagctgctgagataattatatactgtagaagagtacaaccatataagtagctggaaagt

SEQ ID NO: 6811959 - DNA, 57 bp, Homo sapiens
aaggcattctttagcttctaaggcattataacaatatgcagaagcacaagatgtctt

SEQ ID NO: 6811960 - DNA, 63 bp, Homo sapiens
tttgtgtgcccagagcagtggccatgtggagaagccatcagccaactgcctgaggctcacagg

SEQ ID NO: 6811961 - DNA, 79 bp, Homo sapiens
ctaagcaagttgtcctgtaaagactaaccagttgtcaaaatctcactgagatttttaaggtttgtttatatatgtttag

SEQ ID NO: 6811962 - DNA, 93 bp, Homo sapiens
tttattcaacagttcaagcaagtttctgttatgaccatttctgagaacaggacagttgggcccagacaaaaccattgaatatgttagagtgaa

SEQ ID NO: 6811963 - DNA, 91 bp, Homo sapiens
tctgaactcagttcttgcagttcccaaattcacagctatcttgggatatgttgatttgtgggctgcaaaatatgagaaattctacctcaga

SEQ ID NO: 6811964 - DNA, 57 bp, Homo sapiens
cgctgtgtttacatcattgctgttagttcttgcagttcctgtgtgaccgagacagtg

SEQ ID NO: 6811965 - DNA, 61 bp, Homo sapiens
taggactgggtcccctttggaggtcacactgattgattagtgctctctggggacagttcta

SEQ ID NO: 6811966 - DNA, 68 bp, Homo sapiens
ctcgctggcttttccggttcccgcgaccctcggcgctcgcccgggggggtcccagaggaagccgcgag

SEQ ID NO: 6811967 - DNA, 62 bp, Homo sapiens
ctagaatgtaagtttcatcagcgaaggggctctgtctgttttgctcatagctgcatccctag

SEQ ID NO: 6811968 - DNA, 93 bp, Homo sapiens
caagagtatgtgtcaaataaatgaatgggaatagatggatatttcttgtgtctattttaaccctcttatatataccaaggaacacaatttgtg

SEQ ID NO: 6811969 - DNA, 58 bp, Homo sapiens
tttaggtgtctgctcattgaagccgtcccagggaaagccctcagaggagatacctaaa

SEQ ID NO: 6811970 - DNA, 69 bp, Homo sapiens
gaacttgggcagcatcctccacagtcaaacgttctaagctcttttgtgtgactgggctggcccatgttc

SEQ ID NO: 6811971 - DNA, 64 bp, Homo sapiens
catggatcccagtgcttggcatacagcacaggataacatgtctgcattgtctcctgggagcatg

SEQ ID NO: 6811972 - DNA, 68 bp, Homo sapiens
tggacgatgagatggggctggaaggtacaagacagtccttcagtcccatgtttctctttatctctcca

SEQ ID NO: 6811973 - DNA, 84 bp, Homo sapiens
tgcagggagaggccagctgagctgctgcacagacctgctgggatcatcacagctgtgcgcttcaggccagtgcctcttcctgta

SEQ ID NO: 6811974 - DNA, 55 bp, Homo sapiens
gacagtagtccttgctattcatatcaatcgagttgtgaatggaaggggtgctgtt

SEQ ID NO: 6811975 - DNA, 80 bp, Homo sapiens
gaatcacctgatttccttgtccgcaatccctgggagacactcttcagggtctgactgaatggaaaaggaagcagggaatc

SEQ ID NO: 6811976 - DNA, 88 bp, Homo sapiens
gcttatagctgtaatccaactctgaatactgctgataaggttatcaatactaaatctttgaagagtttgatagagttgagttgaaagc

SEQ ID NO: 6811977 - DNA, 93 bp, Homo sapiens
taaaaatgccccagttgtaacttacacatttactacacttcttattacattttgaggtcattaagtttaagtcatgtttgatgggcattttta

SEQ ID NO: 6811978 - DNA, 60 bp, Homo sapiens
ggggtgtggctggcaacccattgtcaccgtgtaagtacagtataactccatgccaccctt

SEQ ID NO: 6811979 - DNA, 75 bp, Homo sapiens
tagttttctcctctatttctgtatgtatttccttaatatgtagtttcagaagtggaatttattagagataaacta

SEQ ID NO: 6811980 - DNA, 64 bp, Homo sapiens
ctgtggctggcctgtctgacatttgctctgggagatgagccagggtctgcccaggccaccacgg

SEQ ID NO: 6811981 - DNA, 61 bp, Homo sapiens
gagcagcttgcgctgtcttcaccatgtgattgcttttatctggccagtgcaggagctgctc

SEQ ID NO: 6811982 - DNA, 57 bp, Homo sapiens
ggagtgcatgggtgctagaactagctggccactttggtgctggcacgggtggactcc

SEQ ID NO: 6811983 - DNA, 65 bp, Homo sapiens
gctttgctgaggccaggccccaccggagtgaggacactactggcatgggtggccctcggcccggc

SEQ ID NO: 6811984 - DNA, 83 bp, Homo sapiens
ctctgccacgtggtaaaagcttccggggggaggcattagttatttctgtctgaggagtttttgaccaaacgtaaacatcagag

SEQ ID NO: 6811985 - DNA, 55 bp, Homo sapiens
ggccccacagccagtggagactgagccatggccacctctctggaaggtgggagcc

SEQ ID NO: 6811986 - DNA, 83 bp, Homo sapiens
ttcttgcaaggtgattttctctctcttgttaggaagagtgacttccattcttaacaaagtaacgggaaaagaagaggtaagaa

SEQ ID NO: 6811987 - DNA, 87 bp, Homo sapiens
tgggagaactacatatagggtagaacaggaaattggcatatcagttgagtctggactcgattttcctctaccctgttgttttcacca

SEQ ID NO: 6811988 - DNA, 70 bp, Homo sapiens
ctgttaactgttgtgcgggtctctggcttcggactgcctatggttgaatcctggcaccaacaattaacag

SEQ ID NO: 6811989 - DNA, 98 bp, Homo sapiens
gaggtgggaggattgcttgttccccggaggttgaagctacagtgagccttgattgtgtcactgcactccagcctgggcaacaggtaagactctgtctc

SEQ ID NO: 6811990 - DNA, 65 bp, Homo sapiens
atttttcaaatcaaatttgtttctgattactcaagtaggtagaaatagatattggtaagaaaaat

SEQ ID NO: 6811991 - DNA, 68 bp, Homo sapiens
tcaggtggggcagccaggtacctttatagtatgatttgaaggcctcaggtgaggctgccctagcctga

SEQ ID NO: 6811992 - DNA, 107 bp, Homo sapiens
ccaggccttgttctggaagtagcagtgccaggctttagcccgggccctcggacaccaggatgcttgctctttagccatggccactctcgttccaggtataaggctgg

SEQ ID NO: 6811993 - DNA, 81 bp, Homo sapiens
gggaggattggatggggggttgtttaatgtgcataacccattgttatgcacattatctaatccattgttatccagccttct

SEQ ID NO: 6811994 - DNA, 58 bp, Homo sapiens
gtgctgtttttggtgaacgaagcaccccatgggcttggtggggtcttggagacagcac

SEQ ID NO: 6811995 - DNA, 82 bp, Homo sapiens
ggctttggagtaacaacgaggtgaggtggcccctggttcccaccagaggcagtttcggctggtttgaataattccatgggtt

SEQ ID NO: 6811996 - DNA, 66 bp, Homo sapiens
tgtcttggcatgcatgggcaatcagatgtttgaagaaaattgatgaataaccatgtgtccaagaca

SEQ ID NO: 6811997 - DNA, 67 bp, Homo sapiens
cggtggtgtaagaaccttctagagccctctagctcagcgtggggtttcatggttctcacaatgactg

SEQ ID NO: 6811998 - DNA, 56 bp, Homo sapiens
gcccagcacagctggaagagtcaactggtcacagaaggtttgggctgatgttgggc

SEQ ID NO: 6811999 - DNA, 58 bp, Homo sapiens
ctgtgttagtctctcaagctactgtaaattaccagaaacttgatgagataaacagcag

SEQ ID NO: 6812000 - DNA, 59 bp, Homo sapiens
aagtgagtggcctggagaggtgaggaaagaatcaatggtaactccaaggtctctggctt

SEQ ID NO: 6812001 - DNA, 60 bp, Homo sapiens
taggagagtcatgtttcaatgcttgtagcaaccaaccctacctggcaacatgttcttctg

SEQ ID NO: 6812002 - DNA, 76 bp, Homo sapiens
cttcaggtctataatgaggaacaatttgagaatagcccaaatgggctcccttcctatgttccctatttgactgaag

SEQ ID NO: 6812003 - DNA, 101 bp, Homo sapiens
cagcagacacctcgtgttttttgtgccctgtagatccccagtgctcagcactgtggctggctcatcataggtgttcaaaataaacaggtggatcccagctg

SEQ ID NO: 6812004 - DNA, 72 bp, Homo sapiens
cggaggcgggaccaggggcggggcgaggccctcagccggctcccagggcactcaccctccctccccgccccg

SEQ ID NO: 6812005 - DNA, 60 bp, Homo sapiens
gaaagaatacttcgtaagtaggatccttttcattttgggatcaaatttagtattcttctc

SEQ ID NO: 6812006 - DNA, 61 bp, Homo sapiens
caggtcttatttatttctgtatccccagcagaaggcccgggacacagtagatgagtgactg

SEQ ID NO: 6812007 - DNA, 64 bp, Homo sapiens
ggccggggtccgggcagtaggctgcaggcttcgtcctctgacagcagacagcctggcccctgcc

SEQ ID NO: 6812008 - DNA, 65 bp, Homo sapiens
tgccaaaggacattgttaatgacatgttcctgattacagaagcaatcaaataaatgtcctgggta

SEQ ID NO: 6812009 - DNA, 68 bp, Homo sapiens
gtcctggatgggtctgagcagagaggtggcgtgatggtcatctcattgtagaaagactgatttggaac

SEQ ID NO: 6812010 - DNA, 55 bp, Homo sapiens
ggtgctagttggctgtgttgcttagctacccatgaccacacaggctgacagcacc

SEQ ID NO: 6812011 - DNA, 78 bp, Homo sapiens
gcacaggaagtccttgaggttgttgatgaaatccagggaatctctatgacctctcctattgccttatctttcctgtgc

SEQ ID NO: 6812012 - DNA, 79 bp, Homo sapiens
gcaggagtgccaggaggtactggtttagatagagcagccattaagggcctcactgagcagtggttcttgagcgcagagc

SEQ ID NO: 6812013 - DNA, 130 bp, Homo sapiens
gacttcacatctgcaaagtgaggatagggagacctacttgatggggttgttgtgaaggtgaagagagaggaagtctgtcaaagcaattaaacaacacccggcatgtggagctctgtgcctcgccctgctt

SEQ ID NO: 6812014 - DNA, 112 bp, Homo sapiens
atgatgaggaaggagcatgagtatgagtagcccccacctcttaaaaagaatgtagtttatatagagctttgaagaatgtggcatttatttataacagcctcttttttattgt

SEQ ID NO: 6812015 - DNA, 61 bp, Homo sapiens
accagctgatttaagaataaagagagcacttaaactcagatttcctttcttgtcagctggt

SEQ ID NO: 6812016 - DNA, 62 bp, Homo sapiens
ggtcagaggtcacaagctggcatcccttggagaatatggccagcacacatgcttctttggcc

SEQ ID NO: 6812017 - DNA, 79 bp, Homo sapiens
tggggtcagtaggaacctagggtcaaaaaatgggatacagtctccccctttatgcagttgatcttttcttgctgcccca

SEQ ID NO: 6812018 - DNA, 71 bp, Homo sapiens
cagcttgacaactgtgctttgaggccgggtgtggtggctcacgcctgtaatcccagcactttgggaggctg

SEQ ID NO: 6812019 - DNA, 74 bp, Homo sapiens
ggggagtgaagtaaggccttcttgagcatgaattttagcccaaatttattttctggacagtcttgcttttcccc

SEQ ID NO: 6812020 - DNA, 75 bp, Homo sapiens
ggaaaagtgttaaggtgttgataattccaagaaagcttttatttgtcctacaatcattactttgataccttttct

SEQ ID NO: 6812021 - DNA, 74 bp, Homo sapiens
tttagaaattgcagagtgggtgtgggcgtgccatgtttcttaagttgcctaagacccaaaaggttatttttaaa

SEQ ID NO: 6812022 - DNA, 63 bp, Homo sapiens
gctgaaggtgtaggctataacagctgactcctcacagctggcaaacagcttacggccctctgc

SEQ ID NO: 6812023 - DNA, 104 bp, Homo sapiens
gggtacatgaacagggcatgaggtatatgttcatgtatgtgtaaatgaatccctatatacatttatattcatgttcctgcgtgtacttgtgaagttgtgtactc

SEQ ID NO: 6812024 - DNA, 87 bp, Homo sapiens
gaccatgaaatctgtatgttgacctcctagacaccccgctttttgggggtgcattcagatctgaggagcagcagccagagagtgatc

SEQ ID NO: 6812025 - DNA, 76 bp, Homo sapiens
ggggccagggttcagggcgggcgtcccggctccactctggagccccgagcatgcagccccctggtgcccgggcccc

SEQ ID NO: 6812026 - DNA, 95 bp, Homo sapiens
acctcctgagatcattatccaatctactatgggggataccattcccctcacccatatgtctcccacggtacaggataaacaagaatccaacaggt

SEQ ID NO: 6812027 - DNA, 119 bp, Homo sapiens
tcccacggctgtggggggtctcagggcagaggcccatggtcatggctgtgggactctcagggtggagggcttgtggtcgtggctgtgggggtctctgggcagagtccatggctgtgggg

SEQ ID NO: 6812028 - DNA, 62 bp, Homo sapiens
tgttgactcaacactgtgggcatgtagataaaatagctgttggcagtacagagagttagtca

SEQ ID NO: 6812029 - DNA, 73 bp, Homo sapiens
ggctgcctgagtggaggtcgagggaaagtcactgcctgcatcggctgtcccctccttccccttcaaggctgcc

SEQ ID NO: 6812030 - DNA, 129 bp, Homo sapiens
agtctgcagagagaggagaataggggcagagatgtggagagaagcagagataagatgtagagacaaaatattctctggagcatttcacctacattctagtcactttttgtattcctacttctgcatcct

SEQ ID NO: 6812031 - DNA, 56 bp, Homo sapiens
tccccctggctctcccatagcctccatcaggaggttagataagaaggttgtgggga

SEQ ID NO: 6812032 - DNA, 82 bp, Homo sapiens
ctgcaggtggagtacctgagtcttaggtttacattggtcttttggggcaccagtgagaatgaagataaggctgaacctgcag

SEQ ID NO: 6812033 - DNA, 58 bp, Homo sapiens
tgtgaccttatttagaaataccatctttgtggatatatgtggcttaaatgaggtcata

SEQ ID NO: 6812034 - DNA, 130 bp, Homo sapiens
aatggtgggatgctagaagtgatggtagtaagagttatataatgtgtagttcattggacaatagtgtatgagcagtataactatgcatttatataattatattatttttgaaacatagcgtcctattgat

SEQ ID NO: 6812035 - DNA, 63 bp, Homo sapiens
gcagctagatggttcatgccagagaggaacataactcctcatctgataaatcactcttactgc

SEQ ID NO: 6812036 - DNA, 55 bp, Homo sapiens
tggcaggaaataccctgcctagaacaaatactcctgctgcagggatttcttgcca

SEQ ID NO: 6812037 - DNA, 86 bp, Homo sapiens
ctgtaggtcggaaatctgagtgtggccttactaggttctctggctcagggtctctcccaagggcacattcaaggggccatctacag

SEQ ID NO: 6812038 - DNA, 73 bp, Homo sapiens
ggaaatttgctttagtttagaagatcctcctcaatatggcagaaacaaatattttgaactagaggtaaattcc

SEQ ID NO: 6812039 - DNA, 103 bp, Homo sapiens
tacatgtgtttcaaatgtatagctaggaattgaaaagtggtctgagcttcaaaaagtcttactatattttaatacttccatatgaatttgacttcattatgta

SEQ ID NO: 6812040 - DNA, 73 bp, Homo sapiens
gtttccactctcctgctttattttaggaaataatgatgtttctggaaccacaaaagtatgaaagcatgggaac

SEQ ID NO: 6812041 - DNA, 80 bp, Homo sapiens
ttagagaattgcaaacaatgggctcacaagacctgaatgaattccaaatcatctagtgggcttattgagccattttctga

SEQ ID NO: 6812042 - DNA, 57 bp, Homo sapiens
tcttcagctccttgttccttaggctgaaaatgattgggctaaggaagggggtgaaga

SEQ ID NO: 6812043 - DNA, 58 bp, Homo sapiens
gtggcttccatgtgcatctgactgggaccagacctccagcaaaaccatgaaaggtcac

SEQ ID NO: 6812044 - DNA, 60 bp, Homo sapiens
gggcttcttatcctctttttgtaagttagcaaactgatggtcagactggttaagtagtcc

SEQ ID NO: 6812045 - DNA, 66 bp, Homo sapiens
ttactttcttcacatttaaatgtggtggcttgggggagaaaccatacttgaaatggataggagtaa

SEQ ID NO: 6812046 - DNA, 68 bp, Homo sapiens
caacactgacaatggactgattttcatggctttgaaaatttttaagttagttcattcaattagggttg

SEQ ID NO: 6812047 - DNA, 69 bp, Homo sapiens
tctgaggaagttgcccagctgggcctgagttggggaactgggcctgagtttgggaactgggatctcgga

SEQ ID NO: 6812048 - DNA, 106 bp, Homo sapiens
gggcacacagctcgcaaatgtcaacccagggctcaagcgtaggcagcacggcaccagagctgctgctcagaacccctgggctgcaggtgcacagcacactgtgccc

SEQ ID NO: 6812049 - DNA, 118 bp, Homo sapiens
caggatggcaaattgaaaaacacgtaaccatgttctacagatggaaaggggtgcttggttattatgaaggccccctcgcaagcgtgtgggacatgggtgtgttctctgggttgtactg

SEQ ID NO: 6812050 - DNA, 127 bp, Homo sapiens
aggtccttgtgaagttgagtcgaccactggttacagaagtggatattagagtaatacactaccagtgaaaatcattcagtgaccacttcccatcagagccgatcacagttcatcttgacatggacct

SEQ ID NO: 6812051 - DNA, 61 bp, Homo sapiens
cactgggcaggatacttcatgggactctgctagctcaagtcctgaagagccctgctctgtg

SEQ ID NO: 6812052 - DNA, 58 bp, Homo sapiens
ggccaaggagaaatgctgtgctttccttcacaggacaagccagggtttctctttctcc

SEQ ID NO: 6812053 - DNA, 125 bp, Homo sapiens
agggaatatttggattggtgtggcctattgatgttatttattgaaacactttggaacaaattctataggctgagttgataattttgatgtgagtatgccaaaggggcatcagttactatttccct

SEQ ID NO: 6812054 - DNA, 57 bp, Homo sapiens
tggtttatgctgttgcagctctctgggatcaggcctgtgagctgaactgcatgacca

SEQ ID NO: 6812055 - DNA, 88 bp, Homo sapiens
tggtttctggttgttggctgtatcctgaaccttactgtaaaatggtaacaatagtgtttgctagtcacaattttaaattagaaggcca

SEQ ID NO: 6812056 - DNA, 58 bp, Homo sapiens
cccagtgccctcgaggtgtgctcagaggtcaaacgggcaggcctgagagatgactggg

SEQ ID NO: 6812057 - DNA, 61 bp, Homo sapiens
ggtacagctagttaaacatttgcaggacaaatataaccgaatgtgtagcaggtgctgtgcc

SEQ ID NO: 6812058 - DNA, 77 bp, Homo sapiens
actatgtttccctgttttatatcctaacaagaaatgttacttgttcttgattccgataaagatgggagaaacacggt

SEQ ID NO: 6812059 - DNA, 125 bp, Homo sapiens
tgtggaggcctgaggggtgcgcctgtatgggaagtgtattagtacgtgtttctgcgtccttttctgtctgtgggtgtgcagaggtttgtggtgttgctccgtctgcaggtgttcaggggtctgca

SEQ ID NO: 6812060 - DNA, 58 bp, Homo sapiens
acccaggctggagtgcagtggggcgatcttggctcactgcaagctctgcctcccgggt

SEQ ID NO: 6812061 - DNA, 65 bp, Homo sapiens
actcacaatttttcagtgactattgcagacttggctgagataagcttctttgaaaaattgtcagt

SEQ ID NO: 6812062 - DNA, 71 bp, Homo sapiens
atagcttctttcccctagtctggacttcttagtgtcagaaaaatctgacatcagaaaggggaagaagctgt

SEQ ID NO: 6812063 - DNA, 123 bp, Homo sapiens
ttgttgttaattaaacccctattgagcactaattgcaattactctagagaatcctcaatatatttatacttgtgttctactagagaaaatgtgtctgagtagcaaaattatttaaaataacag

SEQ ID NO: 6812064 - DNA, 57 bp, Homo sapiens
cctgcccactgcccggtcagcctcgttgctatggggactggtgggcggtgagggggg

SEQ ID NO: 6812065 - DNA, 58 bp, Homo sapiens
cagacaccagcccctctgtgtccccagcactcggggagcagagcgggcgggggtcctg

SEQ ID NO: 6812066 - DNA, 63 bp, Homo sapiens
tgagacaggagaggcccctcctagttggcatggttttaagggggaggtaatcttgaggtctta

SEQ ID NO: 6812067 - DNA, 87 bp, Homo sapiens
gccttgaaagtgaattgtttgcatgacctgatttccttcagtctggtcattgcagtggcaaatcacagcgcctcaatttccactggt

SEQ ID NO: 6812068 - DNA, 60 bp, Homo sapiens
gagtacacctgtgtgcctggcaacatccagctctgtgtttctgctccattgaggtgtctc

SEQ ID NO: 6812069 - DNA, 92 bp, Homo sapiens
gcccagggaagggtgtgaaggggaagctgcgcctttggggaaccgctcagcctcagaagctctgctcctttgcaagcgcccttctgcttggt

SEQ ID NO: 6812070 - DNA, 68 bp, Homo sapiens
tgtgttgagaactaatgatgtactaggcactattttgtgtgctttagatagatttagtctttacaaca

SEQ ID NO: 6812071 - DNA, 103 bp, Homo sapiens
ttgagacggagtcttgctctgttgcctaggctggagtgcagtgacatgatcttggctcactgcaagctccgcctcaagggttcacaccattctcctgtctcag

SEQ ID NO: 6812072 - DNA, 129 bp, Homo sapiens
ttctttaaaaattttgactttcttatgtagtgcttctgttgttgacagtaactccaactgcctcttgtttgtaactgaagttcatacaacagactatgagccaaagttagtgattaactgtttggaaag

SEQ ID NO: 6812073 - DNA, 94 bp, Homo sapiens
tatgctctacatacccttgctgtgggagatgacctggcttagctatcccttcctgggccacgtcatctcccacaacaaggatatatagagcatg

SEQ ID NO: 6812074 - DNA, 88 bp, Homo sapiens
cctgatatgagcaattgttgcttgttctttcatttgtcatggtggtgccctgagtgacagaaagaatatgtcaatccctcctgttagg

SEQ ID NO: 6812075 - DNA, 60 bp, Homo sapiens
tttgtttcatcagctccaggttaggcaaacacaagtagctctggcctgcagtgaagcaag

SEQ ID NO: 6812076 - DNA, 66 bp, Homo sapiens
tgctggtatttgcagcctgtcatcatattagtacaatgatgaaatttgctgctaagttcctcagca

SEQ ID NO: 6812077 - DNA, 81 bp, Homo sapiens
ttctttctgtagagaatgagttggtacataaggaacctcattatagtgacttatgtacccactcatattccccagagagag

SEQ ID NO: 6812078 - DNA, 60 bp, Homo sapiens
ggaagaggcagcgggtgcagtatatgctaatgaccattagactttatccctgtttttctc

SEQ ID NO: 6812079 - DNA, 97 bp, Homo sapiens
tctagggctatgtggtatttaaggggctccagaaattttagggcagctgagatctaaatccttcccttcctggagtaccctctgtctaactcctaga

SEQ ID NO: 6812080 - DNA, 72 bp, Homo sapiens
gcccgcttcacagcccggcttccccggttgctaggcagatttcgcctcgcacacttccgggttgaggcgcgt

SEQ ID NO: 6812081 - DNA, 76 bp, Homo sapiens
cttaatatattcttgcctgatagcaaggaagaagaataattcccttcctgggctgcagggaagagcatggagaaag

SEQ ID NO: 6812082 - DNA, 80 bp, Homo sapiens
ctgtattagaactcttggaagttcttagccttttcaggttatgaaatacctgaaagtaaaattttctaagatttaataag

SEQ ID NO: 6812083 - DNA, 57 bp, Homo sapiens
ttctcatttatgtctttgccatccataaactctagtgggtgattttgaaagtgagaa

SEQ ID NO: 6812084 - DNA, 106 bp, Homo sapiens
ggtcatttggccaaatgcctgggttttgttgttgtttcttattgacgagtgatgaaggagaaaccaatagaagcaagaacagaatggaggtgtgtgcctagaaacc

SEQ ID NO: 6812085 - DNA, 64 bp, Homo sapiens
gccttaaagacaactgcagagcaaagaatccaagcgatttacttttgcgtagtgtctccgaggt

SEQ ID NO: 6812086 - DNA, 130 bp, Homo sapiens
aaggtatatagcccggttgtctctcattttgcccggtgttcaaagtctggtatgcttaattccattttgattgtgcgtcttaaactaagacatcattttattctacagagcgctgtcgggctttggcctt

SEQ ID NO: 6812087 - DNA, 114 bp, Homo sapiens
agatgcatttgttcaggatgcatttattcaagttgcatttgttcaggtgcatttgttaaggatgtatttattcaggatgtaactgtttgggatgcatctgttccagatgcatct

SEQ ID NO: 6812088 - DNA, 87 bp, Homo sapiens
tcaagaagtcccagaagtcacagagagaatattgtgtttcagaaattgggttgaaatattgcttattggatagaggggattatttga

SEQ ID NO: 6812089 - DNA, 65 bp, Homo sapiens
gattacagttaggtgtgtagtggtatatctcacttgtttctttatcaccagctcctagctgaatt

SEQ ID NO: 6812090 - DNA, 61 bp, Homo sapiens
ggcacatgtcctcaggccgctggtggaggcttcactctccaggagaggtgtggggactgcc

SEQ ID NO: 6812091 - DNA, 61 bp, Homo sapiens
ttaaggctgtaagatacattcaggccaagatccattcctttgtgttggcttttagccttaa

SEQ ID NO: 6812092 - DNA, 72 bp, Homo sapiens
ggcctccttctacaaagtgctttagaaatgaaagggaacttagagaggattgaatttgtagggagagaggct

SEQ ID NO: 6812093 - DNA, 59 bp, Homo sapiens
tcctttcctggaagttattcctcatctacttctagatgaaagtgcttccaggcaattga

SEQ ID NO: 6812094 - DNA, 60 bp, Homo sapiens
agttcggtgtctcctcaatgagctcgtgttttcactgaagttctcttgggggcctgagct

SEQ ID NO: 6812095 - DNA, 57 bp, Homo sapiens
ctgcttcaccctgcctgagaaccagggagcactgcatttctccacagggtggaggag

SEQ ID NO: 6812096 - DNA, 130 bp, Homo sapiens
actctccagatcttctataattacaattcaatttgtcagaatttacttaatagccatgtgcctaagcataagggaaacacttggtctgtttagcaaaccttctgtcagagcagaaatacaagaagattgt

SEQ ID NO: 6812097 - DNA, 80 bp, Homo sapiens
taagtggtgtgactcatagctctcagtttttggtagacagctgaagccagagaacattcagagctgtagacaaacactta

SEQ ID NO: 6812098 - DNA, 83 bp, Homo sapiens
ggggtcatctgacctggctttggggataggcttcctgtaaggaagggcaggagttagccagacaaagtgggtcagaaggcccc

SEQ ID NO: 6812099 - DNA, 58 bp, Homo sapiens
tcccctctttctggaaacacaagcagtctcctcatgtcagttttgcaggcagagggga

SEQ ID NO: 6812100 - DNA, 94 bp, Homo sapiens
tagatttcacccatagcgtaatacttcaagatgcataaattcaaggatagaataaattaagtagattcagtgttaagggtgggaaggagttcta

SEQ ID NO: 6812101 - DNA, 79 bp, Homo sapiens
ggtggaaggtggggctttgcaggcggcaccctggccagtgggctcagtggtgtggctggcagagtttacttcttgaacc

SEQ ID NO: 6812102 - DNA, 114 bp, Homo sapiens
acagggaggcatcatgcagggtatgtataccaggggatggaaatgttggggccatcttggactcctctctaacccactggagcacaagcccattgccattctgcctggctctgt

SEQ ID NO: 6812103 - DNA, 58 bp, Homo sapiens
gacaagagaattcctatgccgctgtaatggcctacataggaaaagcattcttcttgtt

SEQ ID NO: 6812104 - DNA, 73 bp, Homo sapiens
taggagcatcaggagagtgtctggaggaagctaacatccccatgttctttatcagcatctcctattgtttttg

SEQ ID NO: 6812105 - DNA, 81 bp, Homo sapiens
aagggtgaaaggaaacagagtagaagaaagcagactttcacaaaggaaagttgctgattctgtctgtgatcaatcacgctt

SEQ ID NO: 6812106 - DNA, 104 bp, Homo sapiens
ggagattccgaaagttaggtgtggatttctcataatgcacaggtttgctgggcagagagttgggaaaatccctgcctgatgacttatactctttcccaatttcc

SEQ ID NO: 6812107 - DNA, 108 bp, Homo sapiens
tctatgtacatgttgtttttatttccagtttgtggtattttattataaggaattattttaacttgaaaataggtacggattagaatgtaagaatcaatttgtcataga

SEQ ID NO: 6812108 - DNA, 67 bp, Homo sapiens
cctggataatagatcctgttcttgttgactggatgaagttaataaagcttctgagtctagatccagg

SEQ ID NO: 6812109 - DNA, 68 bp, Homo sapiens
aatggctacatagtagacctttgcttaaaggtaacatgctttaaggcattctcctactaataggcatt

SEQ ID NO: 6812110 - DNA, 68 bp, Homo sapiens
gggccaggtatcgtctttagtagcttatggaaaatgtgccagaccaatggctgagggatgcctggttc

SEQ ID NO: 6812111 - DNA, 99 bp, Homo sapiens
gaggcaggagaatcgcttgaacctggaaggcggaggttgtagtgagccgagatcgtgccactgcactccagcctgggcgacagagcgatgctccgtctc

SEQ ID NO: 6812112 - DNA, 102 bp, Homo sapiens
gataggagacgccgtgaggatggtgttggagagggcgggaacggcccacccctattgtatgggcggctgagtcttctcggacacctcctgaggtctcctttc

SEQ ID NO: 6812113 - DNA, 87 bp, Homo sapiens
tcattatagaagaactttgcttgggtcaaactcagaaaatgaaaggaataaatttaggttggctccaaggcaaaggaaattatagga

SEQ ID NO: 6812114 - DNA, 71 bp, Homo sapiens
agctgggcattggatggactggaactcagaatgctgggttttctcaggatggtgtgtacaatgcactggct

SEQ ID NO: 6812115 - DNA, 94 bp, Homo sapiens
gaaacccagagggctttagcagggtaaatgtagatggagaggcctagagaaaaacttttccttctttataattttcctgcttctattctgtttc

SEQ ID NO: 6812116 - DNA, 89 bp, Homo sapiens
ccagggctgctgttgggccaggggtggggacaccttggatggggcgttgctctccccaggctcagagactaagacacacacagacttgg

SEQ ID NO: 6812117 - DNA, 92 bp, Homo sapiens
tgacagatttgttgtgcttgtcatcacaaaggctgcttcatgattttataagaaaataaagcaagcctttgttcctgcaaacaattcagtca

SEQ ID NO: 6812118 - DNA, 64 bp, Homo sapiens
ggcagtttatattatgtgtgtgtgtataatcatttacttaatacattttttagtttaacctgcc

SEQ ID NO: 6812119 - DNA, 67 bp, Homo sapiens
gcctggtccctgataggtggctgggctgacaccaggcactgggctcagtcctgtaggggctccaggt

SEQ ID NO: 6812120 - DNA, 88 bp, Homo sapiens
taaattagaggatgaggaggtgaggttttggggtgcttttaaaggctttaaaagttgctggctttggttcattattagctctaattta

SEQ ID NO: 6812121 - DNA, 98 bp, Homo sapiens
aagtaatatgtataaaactaaaagatagctgtgaggcttgaagtaattccaacagatcttgtatgcttcctgtccttacttagattaatgcattgctt

SEQ ID NO: 6812122 - DNA, 89 bp, Homo sapiens
aaaactacacataagcattctgagaaatttctttgtgatgtgtgcattcatctcacattgttgaaactttcttatgattgtgcagtttt

SEQ ID NO: 6812123 - DNA, 63 bp, Homo sapiens
gatgtgagggcagcccctttgttggccaatgacaagttacatggtttacccctgtcctatatc

SEQ ID NO: 6812124 - DNA, 57 bp, Homo sapiens
ttactggaatcccgggtggctgggagtggagtcctgattgccatgggttctcagtga

SEQ ID NO: 6812125 - DNA, 126 bp, Homo sapiens
aatgaatgaaaggaggaaagtcggccagagctcaaacagtcgcatctctgcccttagcatgccggtggtgctgctttgatttgggctttgggggacttcctgaccgtttagtttagtttttgcatt

SEQ ID NO: 6812126 - DNA, 86 bp, Homo sapiens
gaaggttgtaggaaataattctggaaaagaaagttaagatcaggacctgaaaatcctctaattctagaataagttttcttaatctc

SEQ ID NO: 6812127 - DNA, 83 bp, Homo sapiens
ttagaaagagacagcctggcttaatctgtcttctgaaacgcaaggtcagcagactggaggatatcagctgccactctttttga

SEQ ID NO: 6812128 - DNA, 55 bp, Homo sapiens
ctgctgtccaaggtgccttacatattgtccaaatatggccactatggtgcagcag

SEQ ID NO: 6812129 - DNA, 80 bp, Homo sapiens
gacctaaacttagtctgccattaaagagcgttcagatcctttgaaaatttagggcgcagtgtggcaggagtttatgggtt

SEQ ID NO: 6812130 - DNA, 125 bp, Homo sapiens
ctcctattcgttgaatcatttcctaaaataaacaagctgcagacaagccattatttcagagtctgctttgtgtgtgtgtgtgtgtgtgtgtgtgtgttggggggactaagacagctggaaaggag

SEQ ID NO: 6812131 - DNA, 67 bp, Homo sapiens
tgtccaagaacccaagcgaatgcccacatctgcaagtccctgggcatgtgtcttggggctctgggta

SEQ ID NO: 6812132 - DNA, 61 bp, Homo sapiens
caggtgacctgggatccgctgccagtacaatcccatcctgagcagctgcccccagtccctg

SEQ ID NO: 6812133 - DNA, 102 bp, Homo sapiens
gtgctcctggcatcccctcctggagcattggtgaggaaattattgtacagaaatccgcactgtgctctcagtgagtctgggtgtgagataccatcaggagac

SEQ ID NO: 6812134 - DNA, 69 bp, Homo sapiens
ggcacatacctacttccttttcagctttgaaaatcacaagaaaggctgagtcaagttagggtgaaggct

SEQ ID NO: 6812135 - DNA, 80 bp, Homo sapiens
attgttttgtagaatgacccttggtttaagcttgtctgtcagttttcttgtggtcatatctaatatcatttcaaagcaat

SEQ ID NO: 6812136 - DNA, 78 bp, Homo sapiens
gaagctagaaatgaaaccccgttccctaaatgaaaaacttcttctcaaatggcaaatgtgggtcccatacttggcgtc

SEQ ID NO: 6812137 - DNA, 55 bp, Homo sapiens
gtaataggagtctgtgtgattttgtcagtaatagaaatcacatgacagctgttgc

SEQ ID NO: 6812138 - DNA, 60 bp, Homo sapiens
gacatgtttaattgaaggtggcaagaagggctagctcagttaacattcaattaaacagtc

SEQ ID NO: 6812139 - DNA, 64 bp, Homo sapiens
cagagatcatagggttgctggggacctttagaactccagtggctttcagcaactttagatcctg

SEQ ID NO: 6812140 - DNA, 84 bp, Homo sapiens
aggaagagaagacatgtggattctagtttcctcatttccatacttgattatgaggccaaattgagtatttatgacttgcctcct

SEQ ID NO: 6812141 - DNA, 92 bp, Homo sapiens
gtaggttacaagtaaatagtcacccaaataaaaacatcatgttttccactggttgttgctcttttttaggtgagtatttgatgtataccaac

SEQ ID NO: 6812142 - DNA, 80 bp, Homo sapiens
acagtgaaatatgtggtatattactgatattctaagaataaaattaaaagtagaagtgggaatataaaatatttcaaggt

SEQ ID NO: 6812143 - DNA, 60 bp, Homo sapiens
tctataccaggggcctgcagtgcattgctgtttgtggtgcatgctgccaactggcttaga

SEQ ID NO: 6812144 - DNA, 57 bp, Homo sapiens
gtgaaggaagtaaattctgtctggcaactttcaggataaagtctttatttctttcat

SEQ ID NO: 6812145 - DNA, 90 bp, Homo sapiens
aaagtctagctaaaatcagtgctgtaaacaaaaggaaacatttacgtttgtttctgtttgccatatatagtagccttgattttttacttt

SEQ ID NO: 6812146 - DNA, 57 bp, Homo sapiens
gtgccaagcacagaggggccactgtgtgcagctacagaggcccagctggcctggcac

SEQ ID NO: 6812147 - DNA, 62 bp, Homo sapiens
gactcttcaaaggtagctggggtcaggcctttttcaaagggtctcttgccatgcctcagagc

SEQ ID NO: 6812148 - DNA, 63 bp, Homo sapiens
ggagagaacagagcagactctcagccctggagttcctggggccaaggaggctctgtggtttcc

SEQ ID NO: 6812149 - DNA, 115 bp, Homo sapiens
ggagcttaagtcattatttctcactctttttagatgccgcagaagatctaactcttaacctggacctattcaaagatagatgttgagaaatacagatcaatggctcaaaagcttc

SEQ ID NO: 6812150 - DNA, 60 bp, Homo sapiens
attacagagtcttgggaggtcagttgggcattaattctttcctcacaagagtctgctaat

SEQ ID NO: 6812151 - DNA, 97 bp, Homo sapiens
taaagaggcagttaggaatcagagagagcaggaaacctccggcaaggctggttcattagtgcctctgctgattaatcaagacctggctgccactttg

SEQ ID NO: 6812152 - DNA, 72 bp, Homo sapiens
gtcatggagtgtgcagcatgctctgctaggagctgtggaaagattcagaagcaggagtgtgcacaaaatgat

SEQ ID NO: 6812153 - DNA, 86 bp, Homo sapiens
gctgcagctttttactcttccatttctacttcacagttcctgtgcaccaggggtatgtgggacagagaggaggagtagagctcagc

SEQ ID NO: 6812154 - DNA, 92 bp, Homo sapiens
aggacggcgggtgcggcctggcctccagatgtgggctgtgagtgacccccacccaccccatgtccatatggggggtgaggccacctctgcct

SEQ ID NO: 6812155 - DNA, 86 bp, Homo sapiens
tgtgcttctgcgcctagcctcaggtttactatgtataaatgaagtctaaataaccacctggtgggctagtgcaagtattaagcaca

SEQ ID NO: 6812156 - DNA, 57 bp, Homo sapiens
tgtcttcaaatacagtcatattgagagttgagctttcagtatatgaatttgggggta

SEQ ID NO: 6812157 - DNA, 100 bp, Homo sapiens
gaggcaggagaatcgcttgaatccaggtggcggaggttgtggtgagccaagattgcaccattgcactccagcctgggcaacaagatcgaaactccatctc

SEQ ID NO: 6812158 - DNA, 130 bp, Homo sapiens
agtgggcaaggccatgctctcaggaggcattcagtgagatggtcctggcccagcccacgggaacggctgccttggtagtgaccatcttgccctgttcctgttccttttctcatccccatccttgcctcct

SEQ ID NO: 6812159 - DNA, 78 bp, Homo sapiens
gtttgtacttggatttagtaaaattgagggaattttggggctcttcccaatttcttcctcatttgcctgtttgcagac

SEQ ID NO: 6812160 - DNA, 59 bp, Homo sapiens
tccagggcctgaggttgaagtgttaattttcaacacagatgtgcttctaggctcctgga

SEQ ID NO: 6812161 - DNA, 84 bp, Homo sapiens
atatgggtccactttgttcctttcacaaagaaaatggtctgcattgaggtttcttttcaagaggggcaaggaggaatctcgtat

SEQ ID NO: 6812162 - DNA, 83 bp, Homo sapiens
gcagggttctcagcagtgatggagggcaggggagagatgtaaaggctttgagactggttcccatcgctggaaagaggctctgt

SEQ ID NO: 6812163 - DNA, 67 bp, Homo sapiens
ttgactgccaaggcttttaaactgtcaaggaattgctgccagaaatccttgaagagtgggcggtcga

SEQ ID NO: 6812164 - DNA, 61 bp, Homo sapiens
tgatgctgagcctgggactgacacgggcccatgctggggccagttaccatggccagcctta

SEQ ID NO: 6812165 - DNA, 78 bp, Homo sapiens
gctgagattataggtgggtgcctatgtatgtatataatatatagtatatcatattgtaagcacctcataagtttcagc

SEQ ID NO: 6812166 - DNA, 125 bp, Homo sapiens
aattttagacttgtatctctttgtaaggacccttggaaattaacagggattgtccatactctgagaggaagtggcttctctgtctagtttctaccacttataattatgttggtctttttaaaatt

SEQ ID NO: 6812167 - DNA, 81 bp, Homo sapiens
gagggagaaacagaagggaaagcttttacagaaggtccccaaagggccaaagagagtttcttctttcttttctttaacctc

SEQ ID NO: 6812168 - DNA, 63 bp, Homo sapiens
gtaactttaaatgatgttggtttaatttgagtagctttttaattaaagtaaaccaacatttgc

SEQ ID NO: 6812169 - DNA, 98 bp, Homo sapiens
aaggggaacaaatgagatcgtgtaggcgatgccactttgcacattctgaagcactaaatgaatgtgcaatggtgtcaccacatggtcttttgcctctt

SEQ ID NO: 6812170 - DNA, 55 bp, Homo sapiens
gggtgtaagggtacagctcaatggattttcacaagctgagcacacctgtacaccc

SEQ ID NO: 6812171 - DNA, 70 bp, Homo sapiens
agacctttcataaacagtagaagactagagctctctccctctgtctctctctctgtgtgtgtgtatctct

SEQ ID NO: 6812172 - DNA, 61 bp, Homo sapiens
ggtgccagctgctgtgaggaccacagggattttcttttcctgtgtttgatgagaagccacc

SEQ ID NO: 6812173 - DNA, 71 bp, Homo sapiens
tgtgttggtattgaggaaagtatttcaattaggacagatagttagaagtctcttagtaatatccaaccaca

SEQ ID NO: 6812174 - DNA, 59 bp, Homo sapiens
tttcctgtacttccggcctgctacatgaatggcaaagtaggccctggaggtcagagaaa

SEQ ID NO: 6812175 - DNA, 130 bp, Homo sapiens
agtttgaaagaatcagaatgctattggtaatgatgaaatgttgaggcagtgacttggacttggataaagcttcttcattttttcaacatatttaagattaagtggttgtagaatattgtctttctttgct

SEQ ID NO: 6812176 - DNA, 67 bp, Homo sapiens
aaaggaatgcgaggaaagagatggaaaatgtataaaccccatttctagtcctcatgcatcattcttt

SEQ ID NO: 6812177 - DNA, 66 bp, Homo sapiens
cccttgtgctccctcccgtctggccagcaccaggcccactggtcagatgtaaatggagacgctggg

SEQ ID NO: 6812178 - DNA, 65 bp, Homo sapiens
ggtccagctccctagaaaacagactcagatgtagattgcatgcaggaagttttttgggaagtacc

SEQ ID NO: 6812179 - DNA, 59 bp, Homo sapiens
gtcactggcttggcaggaggaagatccctgggggtccagaccaactgaccaggcagggc

SEQ ID NO: 6812180 - DNA, 76 bp, Homo sapiens
gagaaggggttgaagagtagtctctaatatccagcaccagttggccttaggttccctgcctccagaccttattctc

SEQ ID NO: 6812181 - DNA, 79 bp, Homo sapiens
ttaaatgagaataattttcatagtaatgatgaaagccaacattaacacagcacttattatgggctaggaactcatttaa

SEQ ID NO: 6812182 - DNA, 84 bp, Homo sapiens
gacaacctgtagggacttggcgatcacttgaatatacagagagatagaatgtaagaaggattccaaaagttcctaagtattgtc

SEQ ID NO: 6812183 - DNA, 59 bp, Homo sapiens
tcaccactaggaattgtgtagtttacaaaacacataaaaagccctttcctgagaggtga

SEQ ID NO: 6812184 - DNA, 74 bp, Homo sapiens
tgtgggttctgggtgttgattttacactaaaaaaattatttttggagtcgatgaacacacagtatttgctcaca

SEQ ID NO: 6812185 - DNA, 66 bp, Homo sapiens
gccagaaaagcagtaaatgtatgaccttcagttaagaaaaggtcatggcttcactgctatgctggc

SEQ ID NO: 6812186 - DNA, 77 bp, Homo sapiens
gctgggtcctgaggttgccaggcaacaagtcatgtacttggcatggtagttagtttcctggaaacattaggagaagc

SEQ ID NO: 6812187 - DNA, 56 bp, Homo sapiens
tgtcatttaaagctttccagatttgaagaatgtgtggaaggccagaaagaatgaca

SEQ ID NO: 6812188 - DNA, 65 bp, Homo sapiens
tgaacccatcaactgatagtaacgcttgatttttggttcacagatgtaccttagtgatgggtaca

SEQ ID NO: 6812189 - DNA, 117 bp, Homo sapiens
tctgttttaagaattgagaaagcctctgtgttcctgccttccagaatacacatagcagtggaaagcactggttatgtgtgtatgagaagggggccaatatttaatgtaagaaatgga

SEQ ID NO: 6812190 - DNA, 62 bp, Homo sapiens
tgttcgccacctccccgcttgcttgccggcagtctggtgtacaaggcagaaggggcgagaca

SEQ ID NO: 6812191 - DNA, 66 bp, Homo sapiens
caatctctatcctcttttctctgtctacctgtagacaataatctaagtaagggaggaaagaaattg

SEQ ID NO: 6812192 - DNA, 73 bp, Homo sapiens
ggccatggtaaggcttagataagtgaggatatgtaaatagcaactgtcaacatttatcaagttattgtgtgcc

SEQ ID NO: 6812193 - DNA, 60 bp, Homo sapiens
agctggcagcattagaccctgggcccatttggtgccttttactacactaggctgccagct

SEQ ID NO: 6812194 - DNA, 57 bp, Homo sapiens
gttgcaaactcctacttctcatggaagtatgtatatagagaagttagacattgcaat

SEQ ID NO: 6812195 - DNA, 63 bp, Homo sapiens
tagtaaaacctgcttttcaacaccattgatcaaatactggctcggtgacagtaggttttatta

SEQ ID NO: 6812196 - DNA, 69 bp, Homo sapiens
ttgagatattcagttccattgaactgggagactttgtttcttttggctgtcaatgactgagttgcttag

SEQ ID NO: 6812197 - DNA, 90 bp, Homo sapiens
ttcagggaatacttgcttaatcctctcttatgttgagcctttgggtttgccgtcaagtataggattgttattcaggtcgtgttaactgaa

SEQ ID NO: 6812198 - DNA, 64 bp, Homo sapiens
acatgcactggttgaggggtttgtcacagaggtgtctctcacagagcccttccattagtcttgt

SEQ ID NO: 6812199 - DNA, 70 bp, Homo sapiens
tctctagtataaaagcaacctatgacttagtgttgaagttaaggattgtctggctatttatgcttagaga

SEQ ID NO: 6812200 - DNA, 102 bp, Homo sapiens
tgtgttcccatggagctagcaccatcctcccgggcctgcacagactcagagcagctgtgcctccgagatgggctcgcctgggaactagctccgtgtgttaca

SEQ ID NO: 6812201 - DNA, 58 bp, Homo sapiens
caggcatttaactctctaatggccattctgagggacgccatgggagctgttaatcctg

SEQ ID NO: 6812202 - DNA, 112 bp, Homo sapiens
tctccctgtctatcatttataaatttatcctgccattattgagctcctatcccatacagaggacaatttcaggtggataggttttcagagagtgattgtttttacagggaga

SEQ ID NO: 6812203 - DNA, 78 bp, Homo sapiens
taggggaccgtgatttctggctttctatatttgagagcttccagatgaagagagaacagtgagttctggacatcccta

SEQ ID NO: 6812204 - DNA, 84 bp, Homo sapiens
tgaacggtcctgtgctgtgaaagctgccacactgttctagatcacacggaatattcagtgggttagtttttaaagggacactca

SEQ ID NO: 6812205 - DNA, 65 bp, Homo sapiens
actcccttgaaagtatatgctcaattttgtgggaattagcttatgtgtacttttctgaggagagt

SEQ ID NO: 6812206 - DNA, 72 bp, Homo sapiens
ttccctgctgcagatcagctgagtcctggccactctcagtgacatggcccagaagtttggaaaggcaaggaa

SEQ ID NO: 6812207 - DNA, 68 bp, Homo sapiens
atcaaggctattatcttgtcagttctactctcctcaatatttctggagatgacaaaataagtcttggt

SEQ ID NO: 6812208 - DNA, 57 bp, Homo sapiens
gaatcaggagccatgtggattctaaatttatgattcagcagccatggcttctgactc

SEQ ID NO: 6812209 - DNA, 63 bp, Homo sapiens
agagtatgggaaggtctttgatataaggcttttatctataggtttaagtccttcctttgcttt

SEQ ID NO: 6812210 - DNA, 62 bp, Homo sapiens
ccccagcagcacctggggcagtgggtctccagctttacaccaatgccctaggggatgcgggg

SEQ ID NO: 6812211 - DNA, 65 bp, Homo sapiens
cgccagggcttcagaggttttggcagggactcatgtttggccgggtgacccaggagcccttggcg

SEQ ID NO: 6812212 - DNA, 109 bp, Homo sapiens
gggtcaggaaacttggaatgggggaatctgtttagactcagttgaaactgaccatctggaaacagaaagtcaggctgagcctttcttaccagtttaagtagcttgtctc

SEQ ID NO: 6812213 - DNA, 80 bp, Homo sapiens
cttgggtgcttcttttttgtcttgtctgtggctgcttaagtctgatggctcctacataacccagcgaactcgcacccgag

SEQ ID NO: 6812214 - DNA, 85 bp, Homo sapiens
ggccaggttgatggacttgagagaatcggaggagtccctcctgccatgaccgagggagagctcatcatctgattcctccctggcc

SEQ ID NO: 6812215 - DNA, 78 bp, Homo sapiens
aagtaaggcgttttgatgatcatgacctgaatctttccctaaagacttcagagtcagggatctcagagggcctggctt

SEQ ID NO: 6812216 - DNA, 73 bp, Homo sapiens
gaggagagaagacagaagtgatgattaatgggatcttttaccagattccaggaacactctgtgtcccttcctc

SEQ ID NO: 6812217 - DNA, 59 bp, Homo sapiens
gcagtttcagacatatctccatgtagaataagcaaagtggaggtttgggctctcactgc

SEQ ID NO: 6812218 - DNA, 65 bp, Homo sapiens
gaaggattgcccagaagagacgtgaaggggagcattagcatctcttcatggccatctggttcttc

SEQ ID NO: 6812219 - DNA, 57 bp, Homo sapiens
gcgtggggcagcccagggcttcagctccagcctggagacctgcttcttgtcacatgc

SEQ ID NO: 6812220 - DNA, 80 bp, Homo sapiens
agggggaagcaggggcagtttctcgtttgccatcttagaggagatgtgtttaccaggggaacatgttttcttttgctcct

SEQ ID NO: 6812221 - DNA, 67 bp, Homo sapiens
ctcagggcttagtgatataattaacttcattttgaacttggtcatagtgaagatatagcagccttag

SEQ ID NO: 6812222 - DNA, 59 bp, Homo sapiens
tgccatgaaagttcttagacatgtatcctagtacctatgtgtccccattttctatggca

SEQ ID NO: 6812223 - DNA, 107 bp, Homo sapiens
ccccatccctagaagcccttgctaacccagtctcctcgtgtaaacctttccccaggtttacactccaggctggggtgggcaaacaggggctcagctataggatgggg

SEQ ID NO: 6812224 - DNA, 68 bp, Homo sapiens
tgttcaaatcttttgcttattttgtgttgggttgtttttctccttcctgagtagtaagggtttggata

SEQ ID NO: 6812225 - DNA, 72 bp, Homo sapiens
aagtgctcaggaccaaatgaaccaatctccctttcattgtaccctgaatatggtatttggttttgtttgctt

SEQ ID NO: 6812226 - DNA, 59 bp, Homo sapiens
agagagaaggtggtggtgatgtgtctgaatgcggagattgaataaccacctttttcttt

SEQ ID NO: 6812227 - DNA, 66 bp, Homo sapiens
gggctgtgtatcagttatctattgttgtataacaaacactcaacaatgtatggcttaacacaacct

SEQ ID NO: 6812228 - DNA, 73 bp, Homo sapiens
gaggagtttatccgagggcataagaaactggcaacttcatgtaaccatggcaaattatgttctttgaattctc

SEQ ID NO: 6812229 - DNA, 66 bp, Homo sapiens
cacattgcttctgttgcaatgatccagcgctgccattgtagtgtgaaaggagccatagacagtgtg

SEQ ID NO: 6812230 - DNA, 61 bp, Homo sapiens
cagttagtgtgttcctgtcttctagacttatctacagggatcagaaacatagccctgactg

SEQ ID NO: 6812231 - DNA, 77 bp, Homo sapiens
gttcagcctgattggtccatttaccctctcttgaacaaataaactctaggagaacgctgtgtactaattggcttaac

SEQ ID NO: 6812232 - DNA, 79 bp, Homo sapiens
agtagaggaagctgctggagtagtgtgccaggaccactctgagctccaactgatctcacagcagaaagctttctttgct

SEQ ID NO: 6812233 - DNA, 58 bp, Homo sapiens
aaataaaaggcagaggaaggaagaattccccccccttttttttcctgcctcattgttt

SEQ ID NO: 6812234 - DNA, 100 bp, Homo sapiens
cggtgagttttatacctaacacaactttagtctggagggaaatggtctcacatgaactttctttcctgctgaggatacgttaatatcaagactttcactg

SEQ ID NO: 6812235 - DNA, 66 bp, Homo sapiens
cccagaacttaatccaggcgaatgcagaaggcctttgctggttttctggtttgggtagtctttggg

SEQ ID NO: 6812236 - DNA, 86 bp, Homo sapiens
gaaagtattttagcatcttgattatgacatgacttctctggtcccaaggcttcatgtagatggttccctctgcctagaatctgttc

SEQ ID NO: 6812237 - DNA, 72 bp, Homo sapiens
gcctatacccattgcaagtagttgttagaaggacaatcaccttattcaacagcttactcaatggtgatttgc

SEQ ID NO: 6812238 - DNA, 57 bp, Homo sapiens
ggatccgtttgtgtgggagtatttaagcctattgatgtctcctggaaagacggttcc

SEQ ID NO: 6812239 - DNA, 60 bp, Homo sapiens
gacatagagagagtagtagcatctcacctgtggtagaggcttctactgctcacttatgtc

SEQ ID NO: 6812240 - DNA, 71 bp, Homo sapiens
ggtggtgtctgctgccctggagcctggaggactccagtcctgtgcaccagagcagggcagcagggctcacc

SEQ ID NO: 6812241 - DNA, 64 bp, Homo sapiens
ctcgtgtgagaatcacagccaggtcagctggtagcctctggcaagtgatttatcatgtcccgag

SEQ ID NO: 6812242 - DNA, 84 bp, Homo sapiens
gagaaggcaggatggcaggagtggagaccatggggatttgagccacttcctcacgtaacttacttgtgccttcacgaccttctc

SEQ ID NO: 6812243 - DNA, 70 bp, Homo sapiens
ccatctccaagatgcttttctgggtttctctgtttacagttagctcttttgtgagcatttggccagatgg

SEQ ID NO: 6812244 - DNA, 105 bp, Homo sapiens
atttgagccctttaaatgtgtgataaagattaaatcaaattggtcaaagctattcttggaatgatctttttaatttgaatctgtatttgttgaagagcttcaagt

SEQ ID NO: 6812245 - DNA, 67 bp, Homo sapiens
acagctgtgctaccttttcattgagttgacttctgatttcctttccatgcaaacagtggctagctgt

SEQ ID NO: 6812246 - DNA, 75 bp, Homo sapiens
cagggtggcatttcagtattttcataacctatttgaataggtcataacattttagaatgttgaatataagccctg

SEQ ID NO: 6812247 - DNA, 71 bp, Homo sapiens
gaaatacaatctagtctgtcagcaaagagaagtgtcaggatgaaagctttgtaccaggcttagagtatttc

SEQ ID NO: 6812248 - DNA, 94 bp, Homo sapiens
aagcaatgtacctctttatttaggttgaaaattgattcaaaagaattgtaactggctcagtgacaactatgaatatttaggtaaatttcagctt

SEQ ID NO: 6812249 - DNA, 55 bp, Homo sapiens
ggttttatagcagtactatcaggagagtaactggcaacagtactgctataaaact

SEQ ID NO: 6812250 - DNA, 80 bp, Homo sapiens
gctgtgttccattgttgtaggtgaagatgataataatgatgatattagctctttgcaaaatacaacaatggtaaccctgt

SEQ ID NO: 6812251 - DNA, 122 bp, Homo sapiens
ctgcttaaggaaagtgcgtgggaaagtggccatttggaatagatttgttagaaaagtttgaaattcttggacttcaactaatttgttttccatggatcccatgaggatacttgtaaaagcag

SEQ ID NO: 6812252 - DNA, 68 bp, Homo sapiens
tatgttctaaccttgtctttcccttcagccattctaccaatatggggcaacttaggagttagagcatg

SEQ ID NO: 6812253 - DNA, 60 bp, Homo sapiens
gtgcgggtggttggttagggtccttcccgtgcacagcttgactccggccagcaactgcat

SEQ ID NO: 6812254 - DNA, 87 bp, Homo sapiens
ggagcagcccggcttctgggacacccaaggaaagagcagggagggaccctgactcctgcaagggtgttctaaggagctcttctcttc

SEQ ID NO: 6812255 - DNA, 81 bp, Homo sapiens
gccttcacgttgaaagcttttcatttagtttgtttgacatttaataatacaacctagctagataaaagcttttattaaggc

SEQ ID NO: 6812256 - DNA, 100 bp, Homo sapiens
tctcaccaggtgaccttgggctcaatcggtattcttgtccctgagccttagtttctcttctgtgctctggggaaatggatatgtacctggtcatgtgaga

SEQ ID NO: 6812257 - DNA, 57 bp, Homo sapiens
gcttggggctcctgtaagcaagaactcaaaggtccttgagaggacagagccataagc

SEQ ID NO: 6812258 - DNA, 114 bp, Homo sapiens
gcaaggaggaggtgtgaggaggagggagcctctggcagctttttgtttcaggctagaactttctagcaaggcttcagagctgtctgacccacctgctgacttattctcccctgc

SEQ ID NO: 6812259 - DNA, 97 bp, Homo sapiens
gtcctgtgaccaacacggcagggcttcgctcctggtgcaccatgctccgcgcggtcaggcggccacaagccatgctgtaactgtcagtccataggat

SEQ ID NO: 6812260 - DNA, 66 bp, Homo sapiens
gaagtttctagtttcatttgcaggcaggaaagttcaacttcctgtttcaaaataacaagagggttc

SEQ ID NO: 6812261 - DNA, 81 bp, Homo sapiens
cacagtaggagaatctggctcatgtcgtcgcaagtatatggttcttgctgagataagctatgaccagggaattcctatttg

SEQ ID NO: 6812262 - DNA, 65 bp, Homo sapiens
aggcctgtgtgtaggccaggggagtgtattgaaacttcaggccattttcaagcctgcaccagctt

SEQ ID NO: 6812263 - DNA, 69 bp, Homo sapiens
gggcgtggtggcttctcgcctgtcatcccggtgctttgggaggctggggcgggaagactgcttaagccc

SEQ ID NO: 6812264 - DNA, 70 bp, Homo sapiens
tgttggcaggaggcttcagttcctcatcacatgggcctctccataggattgcttgagtgtcctcacaaca

SEQ ID NO: 6812265 - DNA, 81 bp, Homo sapiens
cagagtaagactgaaaagtgtctgttgagttaatgaaaaagtgaattaactagttgatgttacttttctaggtttactctg

SEQ ID NO: 6812266 - DNA, 78 bp, Homo sapiens
cagacaccaggctcagactcccaggccctctgtctgccccgcacgcctgccatgtctgagctcttgagcatgggtctg

SEQ ID NO: 6812267 - DNA, 92 bp, Homo sapiens
gacttactgaaaactcatcactaatgtgtagcagaaccaggattctagccaggatatcctgactctaaatattgaatgttccttttccggtc

SEQ ID NO: 6812268 - DNA, 94 bp, Homo sapiens
taccatacagcaacatatttgaagcactctaatgtaagacacaaaggtcgactctcattacgattggtttgttcagatctctgttgtttaggta

SEQ ID NO: 6812269 - DNA, 67 bp, Homo sapiens
tacaggttacacttttaaaagttatggagcaaatgaacgtacatctgatacttgagtgtaccctgta

SEQ ID NO: 6812270 - DNA, 73 bp, Homo sapiens
gaggtaggagtgcagaatgcactttcctggagtctagaatttcaaaattctgtatctgtactattcctgcctc

SEQ ID NO: 6812271 - DNA, 60 bp, Homo sapiens
gtttgtttttaaagtaataatgtattagtctctagtgcattcaatacagtaagaatagat

SEQ ID NO: 6812272 - DNA, 72 bp, Homo sapiens
cgaatttatgtgagccttttctctggacacaggttagtttctggagcgtgaatggctaagcacatagacttg

SEQ ID NO: 6812273 - DNA, 74 bp, Homo sapiens
ccagagtcatgagggttggggtggagcttcggggaactccagaattcgaataccccagccttctgtagttctgg

SEQ ID NO: 6812274 - DNA, 72 bp, Homo sapiens
gagctcccgttagtgattataaaacagtttttttctctttgaaaagcagaaaatgatcacaaccttgagttc

SEQ ID NO: 6812275 - DNA, 55 bp, Homo sapiens
ttaagtaagaccttatgtcttgaaggtagtttaggacataaaaatgctgacttag

SEQ ID NO: 6812276 - DNA, 112 bp, Homo sapiens
cagtaaaaaaggtgagaaccaccatcactagggaaagaacaagggtattaatatcgccttaatttatagaatttcttggataatgctggggttgattttcatctgattattg

SEQ ID NO: 6812277 - DNA, 89 bp, Homo sapiens
tttcaggttcagtgacttttcccttgcaacaaagggaggctcaagagaccttgttttggaaccaaaggatgttattgaaccttttgaaa

SEQ ID NO: 6812278 - DNA, 79 bp, Homo sapiens
aatgctttcttcagaattagagctcttcttgaggtggcgaattcactcaaggtatgcattaatactctagaaacacatt

SEQ ID NO: 6812279 - DNA, 74 bp, Homo sapiens
ctgtctccgttgtacaggcagggaaactgaggctctggtagcttcacttccccagtgccttacagctggaaagg

SEQ ID NO: 6812280 - DNA, 65 bp, Homo sapiens
ctggagattttgcatttctaacaagctgccaggtgatgctgaggcagctgaagctgcagttccag

SEQ ID NO: 6812281 - DNA, 55 bp, Homo sapiens
ggggctagagtgttggctgggagaactatcccaggctgggaacgattctaggccc

SEQ ID NO: 6812282 - DNA, 98 bp, Homo sapiens
gttggtttagttgtggcattttagaacagctgacttgggactaaagcatctttctatctgggatcagtatttctaagttgcctttaagctgaataaac

SEQ ID NO: 6812283 - DNA, 83 bp, Homo sapiens
ggggctggcttgaacaggtcttagtaggttctggcactaaaatgaatgaaaggcaaaagaacccaaaactttagctagacccc

SEQ ID NO: 6812284 - DNA, 57 bp, Homo sapiens
agagctggctgctgcggtgctttcaagtcatctattgtttcattgtaggtgggctct

SEQ ID NO: 6812285 - DNA, 55 bp, Homo sapiens
tttcacataaatggagtaaagagcatttaatgaactgagctccatgcatgtgaaa

SEQ ID NO: 6812286 - DNA, 89 bp, Homo sapiens
tcctttgggtaataaatgagacatgctggggttcccttgtttaataggtttctaggtctggctccaggatctcatgatgtgctctggga

SEQ ID NO: 6812287 - DNA, 76 bp, Homo sapiens
tggagcaagaaccaaaatgaagctaggtttgttcaatcatacttaaagaggctacttttggtttattttgtctcca

SEQ ID NO: 6812288 - DNA, 69 bp, Homo sapiens
actgttgcatctttgggtacaaacttgcctttccaatgggataggttaatttctgctgaaagagacagt

SEQ ID NO: 6812289 - DNA, 64 bp, Homo sapiens
agctagagtcaaggggcagattcagtcttttgtgaaactagtggaagggtttcttgactttgct

SEQ ID NO: 6812290 - DNA, 73 bp, Homo sapiens
cagttaactctttacatgtttgattcagtgctggaaaggctataggtattgaaaggctctaaaaagttaagtg

SEQ ID NO: 6812291 - DNA, 71 bp, Homo sapiens
ctgcctagttctgggtggccagtatttagaaatggttaatttgcttctgattctgccccctgaagctgcag

SEQ ID NO: 6812292 - DNA, 83 bp, Homo sapiens
tagcatagctcattctgggtgctctgtactaataatcaaaccacactaaattgaatttgaagagcatcatgatgctaagtctg

SEQ ID NO: 6812293 - DNA, 71 bp, Homo sapiens
agcctcatgcccaatgtcacaatttttgaacagatggcctccttccttcctgtttactgacatgcaaggct

SEQ ID NO: 6812294 - DNA, 129 bp, Homo sapiens
gaagggtccgctgctcaggcagcatccccgtgcctctcctccagtgggtccctcaggtagaatcggggcaggccccactggacgtgcagggaggaggctcggaggatgcatcctttgcaggacccggtc

SEQ ID NO: 6812295 - DNA, 59 bp, Homo sapiens
gggaggttgtgaggaattcacctagatcatatgaccagtgtgggcctcacaatgctccc

SEQ ID NO: 6812296 - DNA, 68 bp, Homo sapiens
cacatttcctgaagaccttaaaaaggcaaatttcaaaattctgagaacacaggttttcaggatatgtg

SEQ ID NO: 6812297 - DNA, 67 bp, Homo sapiens
tcattaaagcagcctcatttgtggtaagaaaccatcattcccgaaataggttgctttcaagaaatga

SEQ ID NO: 6812298 - DNA, 128 bp, Homo sapiens
tgacttttccaagttttggttcaagttcaataaagacataaaacaagtgggtcaggttccaggaaaaacataatcatttgtacttgtgtgcttgtatttaaatcaatgaactaggagcggggaggtga

SEQ ID NO: 6812299 - DNA, 55 bp, Homo sapiens
ttcagaatgacttatgtaaggcgaagggcacttgcaaacgtgagtgatttttgga

SEQ ID NO: 6812300 - DNA, 59 bp, Homo sapiens
tgtcatgccacactctccccaggggtgcttttcttccttgattggcagatggcttgaca

SEQ ID NO: 6812301 - DNA, 83 bp, Homo sapiens
tttacttaacattcattcagcaaaaatcatgttattgtatccttgttacttggtcacttttgccagtggatgttgacgtcaga

SEQ ID NO: 6812302 - DNA, 74 bp, Homo sapiens
atctaatgatgtgaacaagcagcttttaaagtctttgcagggactgggcttatttcttgtgaacattgtgagat

SEQ ID NO: 6812303 - DNA, 62 bp, Homo sapiens
ggagggtccctgctcagggccaggacccgtgcatttatgggggctggaaggagggactgttc

SEQ ID NO: 6812304 - DNA, 119 bp, Homo sapiens
gtttatgcagttattataaattcatcattatgggcagggcagtgtataagaaagccagaatccacaacttgaaaaggtaatcactgatgcaactgttttgtctacataactgcataaac

SEQ ID NO: 6812305 - DNA, 76 bp, Homo sapiens
ggctcccacctgctggggctgtccatcagcactaatactggcagtgcctgaggccaggacccccagcaggccagcc

SEQ ID NO: 6812306 - DNA, 75 bp, Homo sapiens
gagcctaggcaacgatattgccctagttttaatcacaaagcaaggagaatcctaggaaatactgtttcaaggctc

SEQ ID NO: 6812307 - DNA, 126 bp, Homo sapiens
ctgctcctagtaagaagccaactagaatggaactgaggaataactgagttgccagcatagtttggaagactcaggaattattcagctcaactgtccattcccagttcaggagtcttcaaagggcag

SEQ ID NO: 6812308 - DNA, 70 bp, Homo sapiens
ggacacctttcggcctgcctgttcctctctctgctgtcccccagcagcagagctggcttcatgggtgtgc

SEQ ID NO: 6812309 - DNA, 56 bp, Homo sapiens
ggggcctgacactgcaggtgtagacccgtcacaggtgtctctgccgatcagggccc

SEQ ID NO: 6812310 - DNA, 77 bp, Homo sapiens
atctccaggtcctggtcttgagtcttaaccaccgcttcagtggcttgagccaaccaccaggaacacagtctggggat

SEQ ID NO: 6812311 - DNA, 88 bp, Homo sapiens
cctctgttgatggtgaatcattttactgggcagtttgggctaggttatgccatggtagcaacatctcagtggctttcaacaacagagg

SEQ ID NO: 6812312 - DNA, 58 bp, Homo sapiens
ggggaggccagtgaaatgttataaaggttcaggaggagctttgctcactctccttccc

SEQ ID NO: 6812313 - DNA, 63 bp, Homo sapiens
tctgttttacacacctatgaaagactaagaacctcagtctgggaagtgggtgggtggggtgga

SEQ ID NO: 6812314 - DNA, 65 bp, Homo sapiens
ctgcacttttccttagggtcagccagatctggtaagtaggtatgctcttctagggataaaggcag

SEQ ID NO: 6812315 - DNA, 95 bp, Homo sapiens
gattgcagggcatagctaaaggaatttaagactctggaattcatacagcctgactcttttatgcattccttcagaaactagttagccctgttatc

SEQ ID NO: 6812316 - DNA, 58 bp, Homo sapiens
gctcaggaccgaggggtgggaattcaaaactccatggagccgccatccctttctgggc

SEQ ID NO: 6812317 - DNA, 69 bp, Homo sapiens
tgggaataggcttggtaggcacgatcagtccaggaaattcttttcagtgccttctgagcctagtctcca

SEQ ID NO: 6812318 - DNA, 74 bp, Homo sapiens
ggcaaagtgggaaggtcacgattggaacccaggtccacatgtgactctggtgcctacgatctttgtactgtgct

SEQ ID NO: 6812319 - DNA, 104 bp, Homo sapiens
aggtactgattcccctggggtcctgcccacagctgctggacaacctcactctggacctgtctgtacctgtggcatcctccattcagtggtctagatcagtgctt

SEQ ID NO: 6812320 - DNA, 74 bp, Homo sapiens
gtctgctcctcctcccagctgggacccagccagctcagtggcatcgcagcagctgggaagactggaagacagac

SEQ ID NO: 6812321 - DNA, 64 bp, Homo sapiens
ttgggctagataattatttgtgaatagggagctttcctgtgcattgtaggatgtttagcagcaa

SEQ ID NO: 6812322 - DNA, 69 bp, Homo sapiens
agtggaggttctatgtgtaggaggtcccaggatagtgagtcctcttccttctcactgtggaaaagaact

SEQ ID NO: 6812323 - DNA, 60 bp, Homo sapiens
tacctgacaggggagcttatttgtgaattcagcaaccatgttttgagcttcaatcaggtg

SEQ ID NO: 6812324 - DNA, 70 bp, Homo sapiens
ttgaatgcatctttgagctccttttgtcctctgcatatgtccactgaggagaggagggaggtgtgtacaa

SEQ ID NO: 6812325 - DNA, 72 bp, Homo sapiens
tcctagcccagggtcaccagttcataggcacagagattggatcctaggtctgtctgaccccagaggctggga

SEQ ID NO: 6812326 - DNA, 55 bp, Homo sapiens
atctccaggaagtgtcatttacctaccctgcggtgtgaatagtgcccctggaggt

SEQ ID NO: 6812327 - DNA, 62 bp, Homo sapiens
ggacttgaattttgagggagccaaggtgacacttcactgtgaagcccagagaggttcactcc

SEQ ID NO: 6812328 - DNA, 68 bp, Homo sapiens
tcctgcctccgagactcgagtgtcctcagctcctccagctctgggctcacgagtctggacatgcagga

SEQ ID NO: 6812329 - DNA, 78 bp, Homo sapiens
gagaagtggttgttggcagtgctacagtcagtaacagcgcttctgtgaacaaggccaagcattctagcaacaaacctc

SEQ ID NO: 6812330 - DNA, 78 bp, Homo sapiens
aggggtccatttttatatgttactccctctagcaaggttgaataaatatgccagtgaaacatggaagaatggattttt

SEQ ID NO: 6812331 - DNA, 105 bp, Homo sapiens
tgtgtttcttctcatgattctaggcattgaagatacagcagagaacaaaacataaaaaaatcacttatcttctgcagtctgtgttctcatgaggggaaactgaca

SEQ ID NO: 6812332 - DNA, 57 bp, Homo sapiens
ggcctgtgggcaggggcgccgcagggtccacccctaggcctcctacagtcatgggcc

SEQ ID NO: 6812333 - DNA, 105 bp, Homo sapiens
tgtcaaagatgactgatatacacagtttaaacgattagtactgtaatagatatattcgggaaacgagctagtatttagttgaaaattgtgtgtcatttttaggca

SEQ ID NO: 6812334 - DNA, 64 bp, Homo sapiens
gctctcaactgtcacagctgatctgttcctggagcaaagggagcagaaaggtgacagtgggtgt

SEQ ID NO: 6812335 - DNA, 68 bp, Homo sapiens
aggcttgaattcttggcccaatttctctcacttctgcatgaagtcaccaaatgccagtgattctgctt

SEQ ID NO: 6812336 - DNA, 76 bp, Homo sapiens
tgaaatgaaggtggacagatttttttggctttccatcaaattgagtaaagaaaaggtaaccgcttatctaatttca

SEQ ID NO: 6812337 - DNA, 68 bp, Homo sapiens
tcttcttgattcatctcagcagagctttcccaagggcatccagggccagctgatgagaatgaggaagg

SEQ ID NO: 6812338 - DNA, 60 bp, Homo sapiens
gggcaggcaccgcggcggcaggttgttatttttgggggctcagcgccgcgcgtcctgctt

SEQ ID NO: 6812339 - DNA, 66 bp, Homo sapiens
accttagtgtttgacgtttttgttggaaagtaaggagcaggcagattgttaatgttgcactaaggt

SEQ ID NO: 6812340 - DNA, 75 bp, Homo sapiens
ctcaggcaggccgtgtccctcctcagcctcactttccccttgtgtaaaatgagggaagggactgcgccttctaag

SEQ ID NO: 6812341 - DNA, 62 bp, Homo sapiens
tgtctgggatgttggcagccacttcaaaatcagacctctgtggcagcattttttccagaaca

SEQ ID NO: 6812342 - DNA, 55 bp, Homo sapiens
tctggctttcctggagcaagaaaaccagtggttttcttggccgaagaagtgaaga

SEQ ID NO: 6812343 - DNA, 65 bp, Homo sapiens
aggattacttgattttagttttatctagaacactctggaaagcagttcttagaatcgggaatcct

SEQ ID NO: 6812344 - DNA, 62 bp, Homo sapiens
gacatgcatagctttggagctaggatgccagcctatgccttcctgtgccagtctatgtgttc

SEQ ID NO: 6812345 - DNA, 73 bp, Homo sapiens
gcaactgtagggtgtcttctgtttgcaggtaacttgtaatcaacctgtccttgaatcctagcatcctatctgc

SEQ ID NO: 6812346 - DNA, 71 bp, Homo sapiens
gaacttgcgcgacatttttaacactacatgtgattgtgttttgtataaaagtgtttgtgttctaagagttc

SEQ ID NO: 6812347 - DNA, 117 bp, Homo sapiens
gctgggagtatttgggtttgctctagcctgcagaatagaaaggaggggctcttgtcccttcttgggggcagggtccatctttcaatattgctgtttaggtatttcactgctgtcagc

SEQ ID NO: 6812348 - DNA, 62 bp, Homo sapiens
ctctctagaggcccaccttgagtcacttcattaccataaactatcaggtgtggtcaagggag

SEQ ID NO: 6812349 - DNA, 78 bp, Homo sapiens
tctcttagtgctgatagcatcataaagtctttgccagggataaaacgactatgtggctgctgcagtgactattactga

SEQ ID NO: 6812350 - DNA, 69 bp, Homo sapiens
tacctgtgtccaaaatgtatttcgctctcttaatcacagaggttaaataaagttggattattttaggta

SEQ ID NO: 6812351 - DNA, 79 bp, Homo sapiens
tgagacacctgagctcactggtgaactctgcttccaagtactcctgcaaagcacattacaagctcagtccatgttctca

SEQ ID NO: 6812352 - DNA, 104 bp, Homo sapiens
tcctatcttatgtgaaaaagttttgggccatgaaatattagtaactgtttcaaaaacagaatagctatatttctgtggtcaaataatttcattatatcatagga

SEQ ID NO: 6812353 - DNA, 61 bp, Homo sapiens
cttgtattcagtgatttcacaatagctctccagagaatgtttaaagactcactgaaacgag

SEQ ID NO: 6812354 - DNA, 93 bp, Homo sapiens
cttctggaagcgggagggctgggtcagccgtgggaatattcatgaggggtggggaagggtccctggggatgttggcctgccggcttccaggag

SEQ ID NO: 6812355 - DNA, 66 bp, Homo sapiens
caggaaggagctgggagggacacatgcattcctaggatgagcatgacagctgcccagctcctcctg

SEQ ID NO: 6812356 - DNA, 65 bp, Homo sapiens
ggtctagctacctgaacaatgcagactgcgtcccttcgcagctgtggagtggggagtactggtcc

SEQ ID NO: 6812357 - DNA, 85 bp, Homo sapiens
tttgttatgccactgagatttgagggttaatctgatgcggcattgtattctggcctatttcaattctctactgctatctgacaaa

SEQ ID NO: 6812358 - DNA, 83 bp, Homo sapiens
atttgttataattgttccttggaagaacttgaggtactgtgctaagaaccttcatgttttccaaggaaagtgttgtaaaaaat

SEQ ID NO: 6812359 - DNA, 65 bp, Homo sapiens
tcagggtatgtgcgtaataagtgacagacattttacgtcgtgttacatgtgtgcacacattctgg

SEQ ID NO: 6812360 - DNA, 67 bp, Homo sapiens
ttagctggtttgcaagtataatcaaagtgaataacaagagaccaaatttgagatcttgcccagttgg

SEQ ID NO: 6812361 - DNA, 62 bp, Homo sapiens
atagttacctggatgatctttcatattctgtagattctgtaggacacaccaggtccagctgt

SEQ ID NO: 6812362 - DNA, 62 bp, Homo sapiens
cttttgtttatttcatctttgtattgtcaccaaccacacagcaggggtggaataaacgtttg

SEQ ID NO: 6812363 - DNA, 77 bp, Homo sapiens
gctccccgtttcactgcactatagcaccaccagcaactagcagggctggtgtcatatgcacattctggtttgggggt

SEQ ID NO: 6812364 - DNA, 61 bp, Homo sapiens
agctatagctggatcttaagtggcattctgagaatgaggaactcaattttctgctgtagct

SEQ ID NO: 6812365 - DNA, 84 bp, Homo sapiens
gagggtgcccgtaggattaactgggaagggtgaaatatctgataatttttcagtcattacggactagtactaccaaggcccctt

SEQ ID NO: 6812366 - DNA, 84 bp, Homo sapiens
gagtggacatgggtgggtggagaggaagagatgttaaggatgctccccagttttctggcttacttcactcatttgatgtcattc

SEQ ID NO: 6812367 - DNA, 78 bp, Homo sapiens
gataaaggtcacactcccagagctgaggctacgtgagtctaagctgttacctcagttatgggagtgtggctggaactc

SEQ ID NO: 6812368 - DNA, 84 bp, Homo sapiens
aatgttgttttgccccagctggttaaaatagagaaatgagtgcagtttttgtattctggcaagctgtatgggcatcatggtatt

SEQ ID NO: 6812369 - DNA, 84 bp, Homo sapiens
gcgcatgatggagatgctacttatgatgctcccttaagatgggcaggatgcccggggaagaaatctgggttcttcatggtgtgt

SEQ ID NO: 6812370 - DNA, 81 bp, Homo sapiens
gcaacagagcaagcatgtcagaagaacaatgagatataggatttgtgtttttttctaccctgacattttgcttcctgttgc

SEQ ID NO: 6812371 - DNA, 63 bp, Homo sapiens
tctgccttggagaaaaaggaattgataacattctcgttaccattcaagttctctccttacaga

SEQ ID NO: 6812372 - DNA, 79 bp, Homo sapiens
ttaaacagctattttttacacatctgtttggcccttttgcacgacatgcagtcaggaggtgtaacgaatacaggtttga

SEQ ID NO: 6812373 - DNA, 66 bp, Homo sapiens
gctcacttcacctggcgagggaatggccaggacgcgtcccccccaaggccaggctgagaccggagc

SEQ ID NO: 6812374 - DNA, 56 bp, Homo sapiens
cagaagcagtcagcagcacctttgtggaccgtgcagtgggcttctaactgctcctg

SEQ ID NO: 6812375 - DNA, 89 bp, Homo sapiens
gggaacccttttagaaatttgccttgaattaaacgattgttgttcatgagaccaagaagtgtttatttcagcaacagaaagaccttcct

SEQ ID NO: 6812376 - DNA, 106 bp, Homo sapiens
aagttttgttctggagaccctgtgtattgcaaaggtcccattcaagaagaggacttcctctcttttggagagcacctgtgcagtaaagggttaacctagcaagctt

SEQ ID NO: 6812377 - DNA, 71 bp, Homo sapiens
gcatatgggtgtagttaggagtggggtggggctgaagcagttaggatcccacacctgtctattcctagtgc

SEQ ID NO: 6812378 - DNA, 69 bp, Homo sapiens
cctttaactgggagcagtattttgttttgctcagtttcataatggagaacagctgttcgcagatgtagg

SEQ ID NO: 6812379 - DNA, 60 bp, Homo sapiens
cttggtgagactcccacccaccgacatgctctgatgtgaagggtgaggtgtttagccagg

SEQ ID NO: 6812380 - DNA, 78 bp, Homo sapiens
ccttcatatgtaaagtgcttaaaaattctagcattaaactaatagggtagttttgaggattatatgtgacaatgaagg

SEQ ID NO: 6812381 - DNA, 64 bp, Homo sapiens
gcaatgggcacagcccagcccaactgaacttgagccagtcgtaaaggctgtggtggtgccttgc

SEQ ID NO: 6812382 - DNA, 55 bp, Homo sapiens
ctcatatatctgtaaggtggataatatcgtttaccaccactttgcagatagtgag

SEQ ID NO: 6812383 - DNA, 56 bp, Homo sapiens
gacaatgagtgaggcacctgggccagtggcaaggcccactgcttgtctaagttgtc

SEQ ID NO: 6812384 - DNA, 80 bp, Homo sapiens
ggaattctgggagtcaggagggtgacaggccctggcaggtgggggtcttggctagtaccttcctgccagaacaggattcc

SEQ ID NO: 6812385 - DNA, 69 bp, Homo sapiens
cctcccaaaattcatgtcaaaatcctaacccccaaggtgatggtattaggaggtggagcctttgggagg

SEQ ID NO: 6812386 - DNA, 61 bp, Homo sapiens
gaccctcctgtcttctaaccaaaccaaaaattaattagtgaagaagagagacaggagggtc

SEQ ID NO: 6812387 - DNA, 56 bp, Homo sapiens
aactacagctcttgtctttctgatgttttggactattaaaggcaatgactgtggtt

SEQ ID NO: 6812388 - DNA, 94 bp, Homo sapiens
ctacctcatcacccagctgtggcccacttacgtcatgtgtgatatgtgttctgctgtgtgataatggtggtgttctgctgtgtgatgatggtag

SEQ ID NO: 6812389 - DNA, 115 bp, Homo sapiens
gaaaggcttcgtgacaaaaccaaggtgcggagggccgttgggagggcttgaaggaaaccccattggtctctgatttcacagctgtcttccgtctcggtctgcaaccctgtctttc

SEQ ID NO: 6812390 - DNA, 74 bp, Homo sapiens
tacttttgttaaggtctgaatatagaacttaagtatattacttagaaagggattctagattttgacttgatgta

SEQ ID NO: 6812391 - DNA, 58 bp, Homo sapiens
aggatccagccaaaatgtaccagaagaagctggcagagcatgtgtgggactggatcct

SEQ ID NO: 6812392 - DNA, 74 bp, Homo sapiens
ccggagatgctgcagctcgagggtcccgcctgcaccatccatggctctcgagatccttcagagcgcggacccgg

SEQ ID NO: 6812393 - DNA, 74 bp, Homo sapiens
tccaataactcaaatatgttgtctgaattaatgaactttccatttctctttagacttcaatttgggttgctggg

SEQ ID NO: 6812394 - DNA, 84 bp, Homo sapiens
tggcttttacttgtgtttgtttgattttagtggctactttagggtttctagtaacactgtccaatagatacataatgtgagcca

SEQ ID NO: 6812395 - DNA, 102 bp, Homo sapiens
ggttggagtggacctcctccctgagccgtgctgggaagttgcgtgcacctggggcagcagggcaagtgatcctggagcaccgtggagaagaactacctggct

SEQ ID NO: 6812396 - DNA, 78 bp, Homo sapiens
gggaaagacatggctctagtgatgcactgggaactttctccgtctctcagctcagcttccacagagcagctcttttct

SEQ ID NO: 6812397 - DNA, 108 bp, Homo sapiens
gggaaaacaggacaaccaggcacctggggccacttggtggcagtgtgggcaggaacggctgctatctaggcaaggtggtccagggtgccaggagtcattgctattccc

SEQ ID NO: 6812398 - DNA, 58 bp, Homo sapiens
gcagagagtgaagcttgggaatcttgaatatattgcgggatttgcttgtctgctctgc

SEQ ID NO: 6812399 - DNA, 67 bp, Homo sapiens
gaatagcctactgggcttctgtgtagcacagcactgtgtaagtcgcaggtgttcagtaaatgtattt

SEQ ID NO: 6812400 - DNA, 73 bp, Homo sapiens
caccagcttaaccaagggatcaatgtcaacaccaccaataattggatgaattgaaatcattgggcacctggtg

SEQ ID NO: 6812401 - DNA, 55 bp, Homo sapiens
tcaatctgcttttgtcatttatgatttatcaggatcagtgtgactggcaaattga

SEQ ID NO: 6812402 - DNA, 78 bp, Homo sapiens
tgctgttgtgaatagtgccgcaataaacatatgtgtgcatgtgtctttatagcagcatgatttacaatcctttgggca

SEQ ID NO: 6812403 - DNA, 125 bp, Homo sapiens
tacacagtaggtgctttataatgttttgttgaataatggaatgcctcacatgtattttcttagctaagaatgataaacacaaggtgatttcatgtattcccaacatgtgagtttttctctgtgta

SEQ ID NO: 6812404 - DNA, 64 bp, Homo sapiens
tcctcaagtgcctaaccccttgtatgaagaagttactctctctgctggggttggcaccccaggg

SEQ ID NO: 6812405 - DNA, 68 bp, Homo sapiens
tgggagtggatgggggctggagaagaggggcttgccaggtgaagctccaggccctcaatccatttcca

SEQ ID NO: 6812406 - DNA, 57 bp, Homo sapiens
ggtgaaggggctctcacagggcagtatgtttgagacccttagagggctctccttact

SEQ ID NO: 6812407 - DNA, 87 bp, Homo sapiens
cctccattattatattaaaccctctctgtagggcctaagtggacactgtaactgagcaccattgagatggttatgaattcagggagg

SEQ ID NO: 6812408 - DNA, 106 bp, Homo sapiens
cctgtgtgtgcgtgtgtgtgtgcatgtgtgtgtgtgcgtgtgtctctgtgtgcatgtgtatgcatatgtgtgcacacgtgtaggtgtgtgtgcatgcacgcgcagg

SEQ ID NO: 6812409 - DNA, 63 bp, Homo sapiens
ctcagcgcccctccacccccagctgcccgcctgcctgtgggctcctgatttgagggggctgag

SEQ ID NO: 6812410 - DNA, 70 bp, Homo sapiens
gccacatggctagcaccgcgttgctggcgctctgctccaccggcgcgttcagcgggctggccgtggaggc

SEQ ID NO: 6812411 - DNA, 62 bp, Homo sapiens
tcttgttcatttctgtgtcttcggtgtctagaacaggcctggcacatgatagatgctcaaga

SEQ ID NO: 6812412 - DNA, 74 bp, Homo sapiens
gtgagccctgctgagtccggctcagatgatcagaagcatcctgccagcccacagactcatgagcagtactacac

SEQ ID NO: 6812413 - DNA, 84 bp, Homo sapiens
ctccttgtcctgcaacctcacatggcataagagaagacaggcaaaagaaactaatgctgtgtgctcacgtagtggaagatagag

SEQ ID NO: 6812414 - DNA, 60 bp, Homo sapiens
gccaggtatagactccagttctcacatttccagttttgtagctgtacttctgaacctggt

SEQ ID NO: 6812415 - DNA, 55 bp, Homo sapiens
cagcaggtctggatctcctgctttctatctgaaaggcactggtctggatctcctg

SEQ ID NO: 6812416 - DNA, 89 bp, Homo sapiens
gacctgctctaagctggtggagagtaagaaagctgggacttcattattcaaggtttattcagtttagaagggaaaataattagcaagtc

SEQ ID NO: 6812417 - DNA, 74 bp, Homo sapiens
cgcggcgctcgcgtcacgtgcccctcggtcgaccaatgatccccggcgggcgcggtgacgtcagagtagcggcg

SEQ ID NO: 6812418 - DNA, 76 bp, Homo sapiens
tagggaagatgaggcccttccccaaggtcacgggctcctaagtggaggctgtgggatgggacctcagctgcccctg

SEQ ID NO: 6812419 - DNA, 58 bp, Homo sapiens
gttttagatgcttaaaattgaggttttatacctcaactttagtgtagctatttagaat

SEQ ID NO: 6812420 - DNA, 59 bp, Homo sapiens
aagattctagaggaacttcttagagtaattgtttctgagtttgaaatctttagagtttt

SEQ ID NO: 6812421 - DNA, 81 bp, Homo sapiens
tccttggagaagacattaatgaggtgatgacacatttttatttaaatgccttatgtagattattaatccatttctcctgga

SEQ ID NO: 6812422 - DNA, 98 bp, Homo sapiens
cagagctcccacaccccctctgcagctcctgcctctctggttgggcctcccaggttcagaaaagactcaggggctgaggtggtctgtatggatcgatg

SEQ ID NO: 6812423 - DNA, 80 bp, Homo sapiens
gagctcttttccatgtcaataaatataactgcatgctatcatttttagtggctgcaatatgttgcattgtatggatgctc

SEQ ID NO: 6812424 - DNA, 55 bp, Homo sapiens
tgcctccattcctgggtcattgtgaagattagataatgccagcaggctgtaggca

SEQ ID NO: 6812425 - DNA, 84 bp, Homo sapiens
tcagctcggttcagataaggggcacagcagagcttgcctgggacttcttccagagcacctgctcattgccagaaccaaggctga

SEQ ID NO: 6812426 - DNA, 76 bp, Homo sapiens
cccccaggaggcccccaggctctggagaacctgcggggaaccaaggcttcctgaggcttgggggtcagcctggggg

SEQ ID NO: 6812427 - DNA, 65 bp, Homo sapiens
tatgaattctgttcattgatgacttcacttaagaaaggtttgtgcttagtggacagtattacata

SEQ ID NO: 6812428 - DNA, 82 bp, Homo sapiens
gagatggaacaaggaataactctaaaggtacaggaggtcaggtcatgcctactgtctttggggctgtacctgtttccatctt

SEQ ID NO: 6812429 - DNA, 57 bp, Homo sapiens
gggaggagagaggtggtggccatgaagtattctgatctttcattacttgtctcccct

SEQ ID NO: 6812430 - DNA, 78 bp, Homo sapiens
gtttaccctttgtcaccagtggctttggtatttccatgtctggcattgcataaacttctctggtgtgaaaggataaat

SEQ ID NO: 6812431 - DNA, 74 bp, Homo sapiens
catggttgagaaggaaatagagaagtagcctggtggctgtttctggttctgttcctacaagtaactggactatg

SEQ ID NO: 6812432 - DNA, 97 bp, Homo sapiens
gttgccaaaatgttgataattactgaactgggatgatggacatacagggagttcaatattgatcctatttcagtgtatgtttaaaaatttccgtaac

SEQ ID NO: 6812433 - DNA, 85 bp, Homo sapiens
gtggcgtcagctttcccatccagagagcctctccagtgggcacattagacaggaaacattaggatggagaagaagcctggcacac

SEQ ID NO: 6812434 - DNA, 86 bp, Homo sapiens
ccggcggctcccgcgagagggaacggatcccagcgcggccgcggctccccgcgcggtaaccccgatctctcagcgcgggcccccgg

SEQ ID NO: 6812435 - DNA, 100 bp, Homo sapiens
cattaagaaggtttgagaccagaaagtttgagaactgtagattggagggaacattatcataacaaagatcaaattttccttgactctcaatcctgagatg

SEQ ID NO: 6812436 - DNA, 59 bp, Homo sapiens
gccaagtgagttgcgtaaatggaataattacatttcctattcctgggcgacacatttgc

SEQ ID NO: 6812437 - DNA, 67 bp, Homo sapiens
gactttggagcagctacttcctctgggactgtttaaaagaaggggtgtggggctcagctttaaggtc

SEQ ID NO: 6812438 - DNA, 75 bp, Homo sapiens
gccacagatttttggtaaataatttggttaccacattacatcttgaaggactaaattatttcactaattgtgagc

SEQ ID NO: 6812439 - DNA, 77 bp, Homo sapiens
gtgaataagtctcatgagagctgatgactttacaaggggcttcccctttcactcagctctcattgtctcttgtctgc

SEQ ID NO: 6812440 - DNA, 56 bp, Homo sapiens
aggaggtgtagatttcctgtcactgttccttatcaacagagaaagagcagcctcct

SEQ ID NO: 6812441 - DNA, 78 bp, Homo sapiens
atgtttctactttcagtttaatgatgccctgctgtatacaacaccagtgcagtctgggatgtataaactgaacaacat

SEQ ID NO: 6812442 - DNA, 64 bp, Homo sapiens
gagactgaggttccagtctggggttccctttgggcaagtccctttcccactgggcctcagtttc

SEQ ID NO: 6812443 - DNA, 56 bp, Homo sapiens
tcagcacttactagtggcctttcggcagttcccgagaagatcaccagcaaggctga

SEQ ID NO: 6812444 - DNA, 68 bp, Homo sapiens
tattccattcacttagcattattgagaacccagtttgaacaaggtattatgcagagttgagaggaatg

SEQ ID NO: 6812445 - DNA, 57 bp, Homo sapiens
tgcccagtgtctccaacatcagatgtcgtcacattcacgtctggagacctgattgca

SEQ ID NO: 6812446 - DNA, 77 bp, Homo sapiens
ttcctggaatgtagagtatctgttttatagtagatgtttgttacttttcctctgtttaggactttacaatttaggaa

SEQ ID NO: 6812447 - DNA, 90 bp, Homo sapiens
gcaaaagaaaagaaacacattcaagatgcattcacttagccattatcttttttcctaagttttgttgtgtactgagttcatttctattgc

SEQ ID NO: 6812448 - DNA, 78 bp, Homo sapiens
gatgggcaggggccctgcttccgtttaaccacagccctgtgacatgccccaaaagggaagcagcagccgcctgtcctc

SEQ ID NO: 6812449 - DNA, 79 bp, Homo sapiens
tttgtcattaccattgcttgatagctgaaaattggaaacagtgccagttaataagaaatgggtatatccatatgataga

SEQ ID NO: 6812450 - DNA, 130 bp, Homo sapiens
tggattaagttgttaatgagaactagggcacaggctcagttcactggattttcacttcttgagacatggaatcatgtactgaataaatcaagtgcaactggcttcaccttagcctcaatgaccagcacca

SEQ ID NO: 6812451 - DNA, 56 bp, Homo sapiens
gtttctgcatttacaaaatgagggttagtaggagccttcaagacaatgcagcaagc

SEQ ID NO: 6812452 - DNA, 76 bp, Homo sapiens
ctggaaaatttccttcaaaatgtgcccccagatttatttagcgaattgctggaccataggtttgtaaattttccag

SEQ ID NO: 6812453 - DNA, 105 bp, Homo sapiens
ccctttgtctatgaacaggaatcagtctggacagagcttcaggagctcaatagactctgagctaatgttgttcattcagaatctgcatcttcagactacaaaggg

SEQ ID NO: 6812454 - DNA, 58 bp, Homo sapiens
gaattggtttaaaaggccatttaccacttcttttgtaattggccttttaaaccaactc

SEQ ID NO: 6812455 - DNA, 84 bp, Homo sapiens
tatttgtatggaatgttgtctctttatatcccatttcaaaatggcaggagattgaaacaggaagtaaacagacaataataaatg

SEQ ID NO: 6812456 - DNA, 96 bp, Homo sapiens
gtgcattttagatcatattttttagttgatcattcaacatgggtgaactgaacttcctagtatcccattgatgcaactgaatgtagtcctgtgcac

SEQ ID NO: 6812457 - DNA, 82 bp, Homo sapiens
ggtaggtggggatttgaagcatggtacttgttcaacatcctgtgaatttcattagtgtgttactattgcttcacctactact

SEQ ID NO: 6812458 - DNA, 80 bp, Homo sapiens
gtatcctacttaaatggaagtgtatttagtgttctgttattaagaataatgtgagctttggtttgtagtcagtagtatat

SEQ ID NO: 6812459 - DNA, 55 bp, Homo sapiens
cacggtgataacagatggcatcctcctgcccgggaggccaggctcttattctgtg

SEQ ID NO: 6812460 - DNA, 80 bp, Homo sapiens
tgtatatgattaggattaaaagttaatgcaaggagtttttcaaagaacttgtactaatttacagttcttcagtgtgtata

SEQ ID NO: 6812461 - DNA, 75 bp, Homo sapiens
aaccgcattcttctcccttaccttccagactttttctttgttcagtggtggtggctgtaagggagagaagtggtt

SEQ ID NO: 6812462 - DNA, 63 bp, Homo sapiens
tctcagaataatcttgggcctgcttttcttcctttcctgcaagtagataacactgttctgaga

SEQ ID NO: 6812463 - DNA, 57 bp, Homo sapiens
ggcaggagaatcgctggaagcaaggaggtggagattgcagccagccgagaccatgcc

SEQ ID NO: 6812464 - DNA, 69 bp, Homo sapiens
tgctcccatcaggaacttggcctgcactaacctcccaggggaggtaataggtcccaggtttgggcagca

SEQ ID NO: 6812465 - DNA, 97 bp, Homo sapiens
catgggaacattttcggcttgaggcagtactggcattccaagaggcagttcctggctctgtcagtgctgttcttcagctggaagctctgtttctctg

SEQ ID NO: 6812466 - DNA, 92 bp, Homo sapiens
gtttatagcctcatttgacactacttttcaagtagtttttgacaaatatttgaattacttgaggaaaagtagtgtcaaatgagggtataaac

SEQ ID NO: 6812467 - DNA, 77 bp, Homo sapiens
ccttgtgaatcaacatgacaggagaagagagtgatgagaaataaaatcagtctcccttttcctctgtgaatacaagg

SEQ ID NO: 6812468 - DNA, 110 bp, Homo sapiens
gcttgctacatctgctcacctcagcagcttgctttccaagacaagataatttgagaagagtctagttgtgagaaagcaatgtccaatgctagggaaactttgtggcaagc

SEQ ID NO: 6812469 - DNA, 78 bp, Homo sapiens
tctctgattgctttttggggcttggggcttgaaaatgccaggcatttcagactccaaattcataagaggcagtgagga

SEQ ID NO: 6812470 - DNA, 69 bp, Homo sapiens
tacagcaaagccagttagcacatcattgcaatgcatggttgttacagcaggaagctactgtgctctgta

SEQ ID NO: 6812471 - DNA, 60 bp, Homo sapiens
tttgctgaataaatgtgtgactgaagattcccacttctgtttcaggcagttattcacaaa

SEQ ID NO: 6812472 - DNA, 72 bp, Homo sapiens
catttgctggggtcttgggagttaaagccaagtaaacttgagacaactcacttccagttgcttcagcatatg

SEQ ID NO: 6812473 - DNA, 63 bp, Homo sapiens
cagagtcatcttcaaactgtgcaagctgaaaatcagctcataaagtgagaatatgaccaactg

SEQ ID NO: 6812474 - DNA, 66 bp, Homo sapiens
ggcagctacacgtgcccctggggtttatcagtcctcgctcaagaaacccagggacacgtagctgct

SEQ ID NO: 6812475 - DNA, 98 bp, Homo sapiens
ctacaggtaagctcaaaggagaccaggtcagagatggtgaacctgcctgtacaagccactgccaccattggccagtctccacagagcttgtgctgtgg

SEQ ID NO: 6812476 - DNA, 87 bp, Homo sapiens
tggcagctggggctgaagacacccaagggcttgactgctcactaacttggctgacagttaaatttggctgttttctcaaagctgtta

SEQ ID NO: 6812477 - DNA, 65 bp, Homo sapiens
cttgccatttaggctggctgtggtctgatggcctctccacagtccaggagcaacttgaaggcaag

SEQ ID NO: 6812478 - DNA, 89 bp, Homo sapiens
agtatgatgattcttgactggaacagttaattctgtggtatctgccaaatagtgattttctgtttccatcattccttcatttattaact

SEQ ID NO: 6812479 - DNA, 64 bp, Homo sapiens
tggcaggtccactcacagatctaggtctttcacaagttctggcctttgtctggagtggccttca

SEQ ID NO: 6812480 - DNA, 97 bp, Homo sapiens
ggaaggccatgttagacggcaaaatggttttctagaacatgaaatggaatatacattgccctcatttctataaaccaggactctaacaagggcttcc

SEQ ID NO: 6812481 - DNA, 75 bp, Homo sapiens
ccatagctttctccataataagctctctaattggtgggtgtaacccagcaatagtgtgtttgtttcagagtgtgg

SEQ ID NO: 6812482 - DNA, 64 bp, Homo sapiens
gaaaatggttggggcataagacatgggtatgtccaaaattcgtagattatgcaaaactgttttc

SEQ ID NO: 6812483 - DNA, 63 bp, Homo sapiens
tggatctatctccaggggtccttgagtgcacggaagctggctttccccagaggaggggatcca

SEQ ID NO: 6812484 - DNA, 65 bp, Homo sapiens
aggtcaggaggttaagagtcttttgccaactggccttaggtaagtctctttacctctccaggctt

SEQ ID NO: 6812485 - DNA, 85 bp, Homo sapiens
tctcttcttgggtgtgttttcttgacatatttggaatgagtgctcgtgcaaatggagcatgtataagaaaacctcaaactggaga

SEQ ID NO: 6812486 - DNA, 88 bp, Homo sapiens
tttgggaaagtcttctaaattaccaagacaatactgtattaagagagattttgtatttggtgtatttaatgagcaagcaactcccaaa

SEQ ID NO: 6812487 - DNA, 112 bp, Homo sapiens
ggaaggaaggaaggaaaatgcaggagaagaatacattggaaatcagaataagttaagttatttcaattcagcaatgtcatgatttttttgatcagggttgtttcatttttct

SEQ ID NO: 6812488 - DNA, 107 bp, Homo sapiens
tgtttccctgggcctagaacccctactaggaagcagagctgagcaacaaaatgcccgccacaccagcttgctaactggtaggggtccagttcataacctggcgagca

SEQ ID NO: 6812489 - DNA, 90 bp, Homo sapiens
ttccctaaatccctcttaatgcctacccatggttagacatacagcaagtgcttctgaagtggatgggtgcatggatggatgcaaagggga

SEQ ID NO: 6812490 - DNA, 55 bp, Homo sapiens
ccacggagcatgtttgaaagggagagtcctacctgcattcatcatgactctgtgg

SEQ ID NO: 6812491 - DNA, 72 bp, Homo sapiens
atgccacatttatctctctccggtgaagttcagaatgaaaatttacatgtggagggggcataaatgaggtat

SEQ ID NO: 6812492 - DNA, 56 bp, Homo sapiens
tccctgccctgccttcatggttatctctgctatgtcaggttggaaagcagaaagga

SEQ ID NO: 6812493 - DNA, 67 bp, Homo sapiens
cagggcaacgtggcccctgaacgattctcacatgagttgaggtttggctgggcctgtacttgccctg

SEQ ID NO: 6812494 - DNA, 63 bp, Homo sapiens
ggcagcatctgtatcctaggctgattgtgaggaatcaatgagaaaagcctgcaaatgcttgcc

SEQ ID NO: 6812495 - DNA, 91 bp, Homo sapiens
gaatgtctcattgtcattggaacagccagggtcaggcagcttctgctcggactgacgtggcgtctgacccttggtgggttgccagacattc

SEQ ID NO: 6812496 - DNA, 71 bp, Homo sapiens
ccgggcggagtgggcggtgaggataccacagctactgcttccctgcacagttcgccttctccaaggcccgg

SEQ ID NO: 6812497 - DNA, 55 bp, Homo sapiens
caaatgttgctgtaatgtttgtgaagcagacgtttttcctccacaggagcatttg

SEQ ID NO: 6812498 - DNA, 70 bp, Homo sapiens
cagactgggcctcagctgccaacaggatgtgcctgctatcccgttgccagcctgactgcctggcagtctg

SEQ ID NO: 6812499 - DNA, 70 bp, Homo sapiens
acaggagtgtgcattcctctcctcaggtctctctcttttgggggtctgaatgtctagtgctgattcctgt

SEQ ID NO: 6812500 - DNA, 65 bp, Homo sapiens
ctggcacagttaacatatgctacaaacaaccatcttcagacagtgtagcgaaccaactgtgccag

SEQ ID NO: 6812501 - DNA, 58 bp, Homo sapiens
gccctgaggcaaaagaacagtcactgcaagttcaaggctgccataatgtctcggaggt

SEQ ID NO: 6812502 - DNA, 68 bp, Homo sapiens
ggtaaggccttggcagaggccaggctgctacaaatgaaatccacctggcttcagagtctggccatgcc

SEQ ID NO: 6812503 - DNA, 70 bp, Homo sapiens
ggtaatttgtgtttatgaagttattctgccacaaagatgaacaggcaagatgataaagaaccagtttacc

SEQ ID NO: 6812504 - DNA, 60 bp, Homo sapiens
acatgttctaatattgtgacatagcgtagaattaagctggcttactaagtagaaacatgt

SEQ ID NO: 6812505 - DNA, 130 bp, Homo sapiens
cactgggaatttctggagtctgggagttctgtcttggggtgcctctgcatgctcagcacccacatttgagaaatgctggtgagtgaagagatgagaggtccctggccttagaagtcttccagtctagtag

SEQ ID NO: 6812506 - DNA, 68 bp, Homo sapiens
ctcagcaggcactgtgccttacagatgataactgctcaccacgtgcttgggcatattgcctggctgag

SEQ ID NO: 6812507 - DNA, 112 bp, Homo sapiens
actgtatttctcttttggtaatctgtacttctaatttgaatttgaatattgtacaagtcaaatatactaagaggtaaagattgcagataaaagagcaaattttcccagcagt

SEQ ID NO: 6812508 - DNA, 65 bp, Homo sapiens
gcctcaggtggttgtttggattctaacaagacaatgcttgtaaaacactcagcacctagcaaggc

SEQ ID NO: 6812509 - DNA, 67 bp, Homo sapiens
aagctttgccacactctagtttccatggaagccaattctaaggtggaaactagagtgtgggaagctt

SEQ ID NO: 6812510 - DNA, 74 bp, Homo sapiens
tgaagattttgaggcctgtgagtgagtgttctgttaagaatgtgcactttgatgcagggctcagtaattttgca

SEQ ID NO: 6812511 - DNA, 103 bp, Homo sapiens
gcatgaggaagcaggcatggtacgacaggctcagccccagcccagatagcattcacatcttcctggatgggggttgatgcccatcactcacctgctctttagc

SEQ ID NO: 6812512 - DNA, 82 bp, Homo sapiens
tgctgctccacaggtacagacaagtagttcagacaagatcctctcactacccaaactcttgcctacttgtcaaccagcagta

SEQ ID NO: 6812513 - DNA, 73 bp, Homo sapiens
agttgcaggtggatgggtctgtgttctggccaaaaataatgctagaataaatgctacctatcacatctggact

SEQ ID NO: 6812514 - DNA, 81 bp, Homo sapiens
attaggagtaacaggatccaaagaatgtattgaacttcattgttttagttggcatctttgcgagccttttaatgatctgat

SEQ ID NO: 6812515 - DNA, 58 bp, Homo sapiens
cagctccttctttgacaagtggcagactcctgagtcttcccaatgcaaagtaggactg

SEQ ID NO: 6812516 - DNA, 90 bp, Homo sapiens
ttcacttagtagggcactatttgtgactgaatttcaatataaacattgcttacttttggaatttaaatactttggtggcctaattatgaa

SEQ ID NO: 6812517 - DNA, 63 bp, Homo sapiens
aggaccaccggtccatccacccaagcactagacccgctcagacatgtattgaccgtgtggcct

SEQ ID NO: 6812518 - DNA, 84 bp, Homo sapiens
caaaaagttcattctttgagtttgatttctgttattttataatatatcagaaatagtcacattggaggaaatcagaactgtttg

SEQ ID NO: 6812519 - DNA, 56 bp, Homo sapiens
tttgtttatcgcttgctcacataggtctgtgtcctgaagcttggcagatgagcgaa

SEQ ID NO: 6812520 - DNA, 72 bp, Homo sapiens
gtgtgtgtgcatgtgtgtgtacatgtgtctgcatatatgtgtgaatgcatgtgtgtagcatcagcacaccac

SEQ ID NO: 6812521 - DNA, 88 bp, Homo sapiens
gagatgtttaattgggtttcctggcatttttttaatgaaattttttgtggcttaaaaatgctgtggtagctgtgttcataaatatctc

SEQ ID NO: 6812522 - DNA, 71 bp, Homo sapiens
ttttctgttcctttgaatgttttattttaattaccagatgaatgtttttgtacatgaaaggaaacaggaaa

SEQ ID NO: 6812523 - DNA, 117 bp, Homo sapiens
taggattctatgatctacaaacagcaactgttgacctatgtttcttcatctgaagaaatccataattttagattcagatatttaggacaatatgctagaatgttcatggtatgcctg

SEQ ID NO: 6812524 - DNA, 65 bp, Homo sapiens
ctggtttcttggcccccagtccttctggaaacccctcccctgactggagcccccaaggacaccag

SEQ ID NO: 6812525 - DNA, 92 bp, Homo sapiens
catgaaaattatgaatgtgtttctagagaaaatatttacattggcaataagcctagtaactattctctaggagtctctcagaaattaacatg

SEQ ID NO: 6812526 - DNA, 91 bp, Homo sapiens
ttctttaccttttatcaatgcagtatgttttccccatgagtgtagttttctaatctggctgacatcctgtatgagatcaaaagtgtgagaa

SEQ ID NO: 6812527 - DNA, 106 bp, Homo sapiens
ctgtcctcactttcagttgtcagcagtgcttcagtgtgagatgaaataaattgccaagccctttcatcttctataatcagctctgcacagctgagtacacccacag

SEQ ID NO: 6812528 - DNA, 66 bp, Homo sapiens
aggctggagtacagtggctattcacaggtgcaatcatagtacattataaccttgaactcctggcct

SEQ ID NO: 6812529 - DNA, 66 bp, Homo sapiens
cctatctggcttttaccccacggcccagttctagctggggcattgtaaggcaaaagccatttgagg

SEQ ID NO: 6812530 - DNA, 59 bp, Homo sapiens
ggtttcttactcacttatgctttattcatagagagggagagcatacatcataagaaacc

SEQ ID NO: 6812531 - DNA, 56 bp, Homo sapiens
gccagatctagagcttttccatctatgcaaaacaggtgagattgctttagtctggc

SEQ ID NO: 6812532 - DNA, 84 bp, Homo sapiens
gtgggggtggtgagcagagcagaatgtgaaggtggggtgaagccccctcgccggccacccctgctcttgccctcccatccccgc

SEQ ID NO: 6812533 - DNA, 65 bp, Homo sapiens
catgttggccaggctggtctcaaactcctgacctcaggtgatccaccagcctcggcctcccaatg

SEQ ID NO: 6812534 - DNA, 71 bp, Homo sapiens
tgctgtggcagtttatgtatagcagtctcattaaggaactggggaaaaataacatcaactagtcacagaca

SEQ ID NO: 6812535 - DNA, 69 bp, Homo sapiens
tgcaggccggccctaggcctcactttccaacagtttcttctagcccaggcctggtgactggcttctgca

SEQ ID NO: 6812536 - DNA, 58 bp, Homo sapiens
cattgctcttgctcccaatgttgcattcaagagaaatacttaggagcacagagtgatg

SEQ ID NO: 6812537 - DNA, 58 bp, Homo sapiens
gcctcccgcagcccccacagccactgcaccgtgagccagaggaggctgtgtgggtggc

SEQ ID NO: 6812538 - DNA, 117 bp, Homo sapiens
aatataaacattaagaggttggggaattttgtctgtttttgttcactgctgaatccctagtgtccaggacagtgcgagacacagtaacccagagtgggcacctaatgaatgtatatt

SEQ ID NO: 6812539 - DNA, 68 bp, Homo sapiens
ttaatcacaggcatagattgctccttcaaaagtaattctcatcagtgagctctttgtgtagtggttga

SEQ ID NO: 6812540 - DNA, 87 bp, Homo sapiens
tgtgtcctcgtatgttctcagagtctctgctggggattgactggcaagcctagtttcttaattttgagaaataatgaaaggagctca

SEQ ID NO: 6812541 - DNA, 62 bp, Homo sapiens
gctggggttccctgggcgtacctgcaatgatcccgtccatttgctccagggcagcttccagc

SEQ ID NO: 6812542 - DNA, 94 bp, Homo sapiens
taagtttggatgcatcttgctgacttgcattatttataattacaaacacaagcagctatgattgagctttgcagcaaatgttttccttctcttg

SEQ ID NO: 6812543 - DNA, 81 bp, Homo sapiens
ctgagtttctttcccctttgtcttcctgtgggtttggctaatgagaggccctgagaagaagtcggagggcaagagaagcag

SEQ ID NO: 6812544 - DNA, 86 bp, Homo sapiens
gctttaaaaatctttttcagatgagccctggatattattgtacctgtagagagatatttattcatactgtcagataaatgtagagc

SEQ ID NO: 6812545 - DNA, 68 bp, Homo sapiens
gtccagaagctgcatgccccactcaactgtcaagagttagagcaggcaactctgcagtgcctctggac

SEQ ID NO: 6812546 - DNA, 79 bp, Homo sapiens
agggcggcaggaactcagagtctagtctcttggctcgggcgagacacagagaccccttctggggcccagtctgtcccct

SEQ ID NO: 6812547 - DNA, 76 bp, Homo sapiens
agggactagacctgccaggacaagagtgaggtctgatcagattaagactcccaggttgcctggcaggcaagtttct

SEQ ID NO: 6812548 - DNA, 59 bp, Homo sapiens
tttcagaaagctgaacatatgactcatttctgtgtgcgtgtgtgtgcgtctttgtgaag

SEQ ID NO: 6812549 - DNA, 111 bp, Homo sapiens
tcatataattttgttgttttgagttctatcttcaggatactggttctaaaattggaattcccaagtcccaggctggaatcaatattctggctcttactgactattgtgtgg

SEQ ID NO: 6812550 - DNA, 73 bp, Homo sapiens
ggagtgaatcagcccatccaaggcttggcatgcagtagtgagccaagggttgccatggagatgggcgaggccc

SEQ ID NO: 6812551 - DNA, 85 bp, Homo sapiens
atgtctaagatacacatgcatttggagttttcaagtccttcagtgaacaaattggactaaaggctctcagtgacacatcagatat

SEQ ID NO: 6812552 - DNA, 65 bp, Homo sapiens
ggtttgtcatgatataatttctgtgaatatttatttttaaaataaagagattgtgtctacaaatc

SEQ ID NO: 6812553 - DNA, 94 bp, Homo sapiens
gcctcagcaagagcaagcgggaagaagaggagcggcaggggaggcctttcccagctgccttccctgttctttcagctcgtggcttggctggggc

SEQ ID NO: 6812554 - DNA, 57 bp, Homo sapiens
ggaggctgggcacatactccctcgccaactccggcagggctatgttggccaccttcc

SEQ ID NO: 6812555 - DNA, 68 bp, Homo sapiens
gcttgggaggggagcgacattccgtgccgggctccacgctcggctacgctgagcttcccagaccgagc

SEQ ID NO: 6812556 - DNA, 130 bp, Homo sapiens
gaagcatttggggacttagaggaatgataaatgcaaacagcccagaatccagaaactgtcttgaacatttaaactctagactctgggaatgtgtgcatgtcttcagttagtcagatgtagataatttttc

SEQ ID NO: 6812557 - DNA, 61 bp, Homo sapiens
gctcaggcaccagccacctatttctaggcagcactttctgtccagggcctggtgtctgagc

SEQ ID NO: 6812558 - DNA, 62 bp, Homo sapiens
tggggatgtaaatgaggtgataggaggggcctcaagtccttggtctcctctttgcattccta

SEQ ID NO: 6812559 - DNA, 74 bp, Homo sapiens
ggattcgggtagagaaaaatattttctatttattttattgcagagtctgaggtaatatttttctccctgactcc

SEQ ID NO: 6812560 - DNA, 76 bp, Homo sapiens
tctgatctggggtggcagaatgtttaagaacataagctgcactcagacagcagttcataaacattttgaggtcagg

SEQ ID NO: 6812561 - DNA, 87 bp, Homo sapiens
tactgggttaatgttatctgaagacagtttttttgtggtttaattgagtcatggttcattgtcttttattgcatgttaatgccagtg

SEQ ID NO: 6812562 - DNA, 80 bp, Homo sapiens
acctatgtggtaggcagaattctgatatgacacctaatgccccctggccatgtagaattccttctactttgagtgtgggt

SEQ ID NO: 6812563 - DNA, 84 bp, Homo sapiens
gctgaggaagggcatcacgtctgtctgcagggttttactgtatggatcctgtgtaaatagatctggttgtacttcatttgcagc

SEQ ID NO: 6812564 - DNA, 59 bp, Homo sapiens
tgctcagctagggaaggttagcttgctaaatgactgtcaaggggcctctcctattggca

SEQ ID NO: 6812565 - DNA, 61 bp, Homo sapiens
atgaaatcatgtagttattgcaagattgcaatttgtctttgcatatatttcatggttttgt

SEQ ID NO: 6812566 - DNA, 67 bp, Homo sapiens
aggctaagaggccttcagatactggaacttacaccagcagccccccagtttcttaggcctttggcct

SEQ ID NO: 6812567 - DNA, 64 bp, Homo sapiens
ctcacatttctccccaggacacatgcggtagacatgctgcaacttgtttggagagaaaggcaag

SEQ ID NO: 6812568 - DNA, 78 bp, Homo sapiens
ttaggttggtgcaaaagcagttgtggtttttgcctgaaaggaatggcaaaaaccgcaattatttttgcaccaagataa

SEQ ID NO: 6812569 - DNA, 85 bp, Homo sapiens
tttgagaaattgggcagctgatctctgactccctggcccattgttttcttgggctctgatagagattattgcatagtttattaag

SEQ ID NO: 6812570 - DNA, 79 bp, Homo sapiens
ggactcccagagaccccgctgcccttctgagctgctgctttccaacttaggaattgcccgtggggtcctcacggagtcc

SEQ ID NO: 6812571 - DNA, 73 bp, Homo sapiens
ggtggcgccgtagtgtagtcggagtggcacagctgaaactcttagaggcctctgcaattacattgtgcccatc

SEQ ID NO: 6812572 - DNA, 81 bp, Homo sapiens
gaaaagagttccccttgaattttcagagaggggatttggttttatgtcccctacatctgaagttgaagtgaaaattgtttt

SEQ ID NO: 6812573 - DNA, 67 bp, Homo sapiens
gaatagtgggagaaggtactggtttagagttgggaaacctggccaaggcattggcttctctcatttc

SEQ ID NO: 6812574 - DNA, 67 bp, Homo sapiens
gtttgttttggcttcttgggatgggtcattatatgtatagtggcctatatgtgagaagaaaacaaat

SEQ ID NO: 6812575 - DNA, 65 bp, Homo sapiens
gtggcttctggctgggcctcagccaactgctggatggctgcctgcaaggccctgcgggaggctgc

SEQ ID NO: 6812576 - DNA, 79 bp, Homo sapiens
agcccatcttccctttttatgtcttcagcacttattgacaaaagcaaagttgagaatggcaaagagggattgttctgct

SEQ ID NO: 6812577 - DNA, 62 bp, Homo sapiens
atggaaatacagccagagcagaaataacagtctatttccctctgcctgtgctgtgttttcat

SEQ ID NO: 6812578 - DNA, 71 bp, Homo sapiens
ttgcttgtttgtttgaagttggtttgtttttattgaatagattataaaactagctgcaggcagtcatgtga

SEQ ID NO: 6812579 - DNA, 78 bp, Homo sapiens
gggtctagtgggaagaggccaggatgctgctcaacaccctataatgtacaggacagcagcctcttacatgaaagactc

SEQ ID NO: 6812580 - DNA, 77 bp, Homo sapiens
aagaatgtgatttgtttatagttataagaaaacgttgaattttttttagcaaaacattatgtctgtgacacattctt

SEQ ID NO: 6812581 - DNA, 93 bp, Homo sapiens
cactgctcttcagcattaatcattggtggatgactgaaataaacagaatttaaagtattctgaggtcattgttgcattaattgaagggctgtg

SEQ ID NO: 6812582 - DNA, 74 bp, Homo sapiens
tctggccaactgcttgcagaagattgtgagggccaaacactacaaatatttgtctgaggcggttgttatccaga

SEQ ID NO: 6812583 - DNA, 76 bp, Homo sapiens
gctgctccttggtatccgagctctggaatgtctgggctgcaactgacaggagttcagaggacaccccaggggcagt

SEQ ID NO: 6812584 - DNA, 73 bp, Homo sapiens
gaggcagagcttgcagtgagccgagattgtgccactgcactccagcctgggtgacagagcaagactctgcctc

SEQ ID NO: 6812585 - DNA, 88 bp, Homo sapiens
atagggtatgattgcaaaagacttttctgaaagcttagctttggataaatcttcagctagcctaggcagagtgcatattctatcctgt

SEQ ID NO: 6812586 - DNA, 57 bp, Homo sapiens
tcctcccctggaccttggttgatctgctttatgcctgccagccaaggaggaggagga

SEQ ID NO: 6812587 - DNA, 62 bp, Homo sapiens
tgcagtggttgagagcccagactcaaaacgtagacatcctgggtttgaatctaccacttgca

SEQ ID NO: 6812588 - DNA, 56 bp, Homo sapiens
ggtgtggcagggcgtgacatttggcccaggtcagtgtctggatcctgctcagttcc

SEQ ID NO: 6812589 - DNA, 109 bp, Homo sapiens
tctctggcctgtaatagatggtgacctgaattttattactagtcaactgccatcagagaggtatgacagtttcgtaggggttgggcagctatttcaagaagggtcagga

SEQ ID NO: 6812590 - DNA, 96 bp, Homo sapiens
actgtgaaagctcagtagcgaatgcgtggaggctgcttcaccctgctgctgcgtggtccagcgtccacacattccagcaattactgattccacagt

SEQ ID NO: 6812591 - DNA, 71 bp, Homo sapiens
agaagcagacagaccatggctattcagaaacctccctgcagagtcaagtagccctggtcctgagtgtttct

SEQ ID NO: 6812592 - DNA, 65 bp, Homo sapiens
gggtcagctgctgggggctgacgggcaagaggtgcagcccgaggcactcatgcaggagctgagcc

SEQ ID NO: 6812593 - DNA, 79 bp, Homo sapiens
aaggaagccccgctctgctgtgtcattggaatgattctctagatctaattctaaagactcatggaagtgggaagtcttt

SEQ ID NO: 6812594 - DNA, 55 bp, Homo sapiens
agtgccaaggtattaatttatatgtaaacctatcttataataatgcctgggctct

SEQ ID NO: 6812595 - DNA, 71 bp, Homo sapiens
ttcagctattatacccacttttcaggcatgtaggagtaagggcaaaggaaaagtcggggatgctagctgaa

SEQ ID NO: 6812596 - DNA, 103 bp, Homo sapiens
ttgagatggagtctcgctctgtcacccaggctggagtgcagtggcgcgatctcggctcactgcaagctccgcctcccgggttcatgccattctcctgcctcag

SEQ ID NO: 6812597 - DNA, 81 bp, Homo sapiens
cttggctttgtttgcatccaagaaggttcttaaagaaaaactcttctatgttaagattggttggtgtaatcagagcacagg

SEQ ID NO: 6812598 - DNA, 73 bp, Homo sapiens
cacctgtaatccctgctactcaggtggctgaggcatgtgaattgcgtgaacctgggaggcagaggttgcagtg

SEQ ID NO: 6812599 - DNA, 73 bp, Homo sapiens
tccccatgtctaaatatgaggttggaataaatacattctaaaaacctttcccatactaagagattatgcggga

SEQ ID NO: 6812600 - DNA, 71 bp, Homo sapiens
gggcagcagggtgcaaggagaaaacggcttctgaaggcacagcttcagagactttctcctcctggctgcct

SEQ ID NO: 6812601 - DNA, 75 bp, Homo sapiens
atcttgggaccttggaggtcagctggcccacctttacctgaggtctggctcttctccacagaattcttgcaaggt

SEQ ID NO: 6812602 - DNA, 78 bp, Homo sapiens
ttcaagagagtgagtgagaaggaagtcacaatgccttttatgacctctcaggaatctcacatgctcacttctgttgaa

SEQ ID NO: 6812603 - DNA, 67 bp, Homo sapiens
gttttcaggttcaataaattatcatccatcagtcaggtggcactctcccatttaatgaactgaaagc

SEQ ID NO: 6812604 - DNA, 98 bp, Homo sapiens
caagtgtccccaatacattttcttctttcatctttggcatcagggccagctacataatctgtggggcccagtgcaaaaggaaaatatggggcttcttg

SEQ ID NO: 6812605 - DNA, 58 bp, Homo sapiens
ctggtagattactgatcagactttgactctctcagagctctggttcatgatctattgg

SEQ ID NO: 6812606 - DNA, 71 bp, Homo sapiens
gttaataaattatcttgggtaactttgtgcagatgtttgtctttctattgccagattacccaggatttggc

SEQ ID NO: 6812607 - DNA, 60 bp, Homo sapiens
tacccaggagaaacagcagggcaataacaaaaatggcctttctcttacttctgttgggta

SEQ ID NO: 6812608 - DNA, 80 bp, Homo sapiens
tcgacactctgggcacacagacccccttaacaccatctccgcccctgatggttatgggagtcatgttgcccagctgttgg

SEQ ID NO: 6812609 - DNA, 96 bp, Homo sapiens
gaaggaacttttgatttggactgatagaattcacccggagctggagagctattctgagtggaaactatcaatacatttagactgatttgttttttt

SEQ ID NO: 6812610 - DNA, 79 bp, Homo sapiens
gccttttgtagaccaccctctctctgtctcaactactcaactctgaaattgtacaaaagtgagtgtgtctcagaatggt

SEQ ID NO: 6812611 - DNA, 81 bp, Homo sapiens
attagcatgaccttggagagggcttggatcacactgtactcagcggttgtgtggttcccttttttatgtttccatgctggt

SEQ ID NO: 6812612 - DNA, 98 bp, Homo sapiens
tactgcattaacctggaaaatcaagcaagaaggcttcctgagggagtcttggcaggcaaggtgctcttgctctattgttcattgtttttgtcatagta

SEQ ID NO: 6812613 - DNA, 74 bp, Homo sapiens
gtgcatttccttctctatctttggcacatcaggtcaaactcctgtgttcccagagaatgaggaatgaagtgcat

SEQ ID NO: 6812614 - DNA, 55 bp, Homo sapiens
tgcagtgttccaggcggcagtgaactgcattcacctcctgtttgggagcatggca

SEQ ID NO: 6812615 - DNA, 72 bp, Homo sapiens
gctttggccagaggagcaggctggctccacgcttgtctgctgggggcgggatgattcctttggactcatggc

SEQ ID NO: 6812616 - DNA, 63 bp, Homo sapiens
gtccgcattgtttaagtgggtggggtttatggtactagagtctacaacgcaagcaacatggat

SEQ ID NO: 6812617 - DNA, 77 bp, Homo sapiens
cccggaacaaacacgggtagatggcaccacctggtggccgcactgccacagagccatcccagcctgtggttccaggg

SEQ ID NO: 6812618 - DNA, 64 bp, Homo sapiens
gcacccagatattgccttgacctgtcaccctggtggctactggcatcaaggtttgttcaggtgt

SEQ ID NO: 6812619 - DNA, 96 bp, Homo sapiens
gggtcaagggcttcccaggaatgcagctgcccctccagggctgggggctggccagcgcctcctgtgttgggcagcagctctctgaagccagggccc

SEQ ID NO: 6812620 - DNA, 60 bp, Homo sapiens
tggtccttgtaggcatttgagctgacaacccctggttcaaagcacatcctaacgaggcca

SEQ ID NO: 6812621 - DNA, 60 bp, Homo sapiens
tggaaggcgtctcgaaggcctagtctgttctgttcacagtagtgtcttaagagccttgca

SEQ ID NO: 6812622 - DNA, 62 bp, Homo sapiens
ttctatgtgttctgaattaggtaaatatgactagaagtcctggagcttcagaatttgtagaa

SEQ ID NO: 6812623 - DNA, 58 bp, Homo sapiens
acccaggctggagtgcagtggggccatctcggctcactgcaagctccgcctcccgggt

SEQ ID NO: 6812624 - DNA, 70 bp, Homo sapiens
tagatgcttgttcagaaataggtacatctgtgtttactgtagtgaacacatatttctgggcaaccattta

SEQ ID NO: 6812625 - DNA, 103 bp, Homo sapiens
ctgaggcaggaggatcgcttgaacccgggaggctaaggttgcagtgagcccatatggcgtcactgcactccagcctgggcgacggagcgaaaccctgtctcag

SEQ ID NO: 6812626 - DNA, 81 bp, Homo sapiens
gggagtagattaccttacaccagtatagactgagttgttgaaaaactgggtttcaacttttgtgaggaataacctattttc

SEQ ID NO: 6812627 - DNA, 83 bp, Homo sapiens
gccctgtctccacctgcatcacaggcaagcaaggctttctgctgggaacagcttgggtgtgcctgcgagctgtggagtgaggc

SEQ ID NO: 6812628 - DNA, 100 bp, Homo sapiens
ggagaagcttcacttcccggaaagcatgggaggcctggaggaggtctttggcaggtcccctctcgggaaatcccctgtgagttgggagtgggaggaattc

SEQ ID NO: 6812629 - DNA, 57 bp, Homo sapiens
ctctgagaagggtaggctccatttcatttaggtgtgaagggtccttccctttcagag

SEQ ID NO: 6812630 - DNA, 63 bp, Homo sapiens
gtggatctactgtatgggataggaatgtgtcatttttttctatcaacaaacacagggattcat

SEQ ID NO: 6812631 - DNA, 75 bp, Homo sapiens
tatcgattttatgttgttttgagaagctaaagatgtaaggaaatttagcatatctgcaagataatgaagatgata

SEQ ID NO: 6812632 - DNA, 120 bp, Homo sapiens
catcatttcataacgtaagtaaaatagagagggagtgaaatggaatagagagagaataaaactcccattactctgtggctatttgattctctatgtattttattcacataatgaatgatg

SEQ ID NO: 6812633 - DNA, 61 bp, Homo sapiens
agccagcctatttctgattccttagtgaaatctgatttaggaaatacaaggtagcctggtt

SEQ ID NO: 6812634 - DNA, 117 bp, Homo sapiens
ggtgatggtgaatacaagaaaacctattaattttccagtgatttacagtgcactacataacataatgcattgttgatttggagtgtgaaagctgttaatttgttctatttagtcact

SEQ ID NO: 6812635 - DNA, 80 bp, Homo sapiens
ccttgccctgtgcctggcccagtggtgtcacctgaggaatggggaatgagcacctctgggtcctggtctagggtacttgg

SEQ ID NO: 6812636 - DNA, 89 bp, Homo sapiens
gtaatctgaatatacctgatcaaggcaaaaatgtaagtgtggtcattatgagtatttcattattgtttttatcagggaaatgagattat

SEQ ID NO: 6812637 - DNA, 79 bp, Homo sapiens
tctgtgtcatcgtggagcagtggtgctctaagggctctgcccacatggacacatcactgcagccactgctgggcacaga

SEQ ID NO: 6812638 - DNA, 103 bp, Homo sapiens
ttgaggtggagtctcgctgtgtccccgaggctggagtgcagtggcgcgatcttggctcactgcaagctccgcctcccgggttcacgccattctcctgcctcag

SEQ ID NO: 6812639 - DNA, 55 bp, Homo sapiens
ggagagtccggatatgtaatatgcatttgataaatattaggtattattgctttcc

SEQ ID NO: 6812640 - DNA, 87 bp, Homo sapiens
acacttcctagttaatatttcacagcagctcatttaacgatgtctctcagaggttgagcagcttctatggaataatcagggaagtgt

SEQ ID NO: 6812641 - DNA, 76 bp, Homo sapiens
tgctctgctcactaaactatgatctaatccttggtgtcctgtttaaaaatgcaggacaatagacataagcagagca

SEQ ID NO: 6812642 - DNA, 68 bp, Homo sapiens
gctgagtttgagaatttgctttgagtctgtgcagagtttcacagctacaaagctcttctacaggcagc

SEQ ID NO: 6812643 - DNA, 77 bp, Homo sapiens
cattttgggtggtcatgttaattatgatcccttcccagccccaggggacaaaggttgataagactaacccaagcatg

SEQ ID NO: 6812644 - DNA, 61 bp, Homo sapiens
agagcttatatcttggccatcctggacatgcactatgattggacacctaagatatgagcct

SEQ ID NO: 6812645 - DNA, 79 bp, Homo sapiens
tgcggccttttcatcttccttggcataggtctgaaggaatttcagagctatgtgggagggtgagagcatccaagccaca

SEQ ID NO: 6812646 - DNA, 63 bp, Homo sapiens
tccctatctgtaagcttgtccacctcttctcctttctggggacaagaatttacatgtagtgga

SEQ ID NO: 6812647 - DNA, 101 bp, Homo sapiens
caggggaccacaaagtgggggctgtcagggcaaagttgccaggaagctacagaatcccgagttatctgaaatgtctacagcaaaccccacatgtcactctg

SEQ ID NO: 6812648 - DNA, 61 bp, Homo sapiens
gaaccccaacttataagacagaaagaactgagctgttcaggctgggttggagatgggggtc

SEQ ID NO: 6812649 - DNA, 59 bp, Homo sapiens
ttcctcctctcatctgtcctaagccaggtttgtggctccaggtacgtatgggaggtgaa

SEQ ID NO: 6812650 - DNA, 58 bp, Homo sapiens
acgtcaccatctacagctccaaacctcctctggggagttcacatgaggatgatgatgt

SEQ ID NO: 6812651 - DNA, 65 bp, Homo sapiens
acagcttctccaattattttctaaggatagattcctagcagtaaaattaatggatcagaaggtgt

SEQ ID NO: 6812652 - DNA, 61 bp, Homo sapiens
gtatcagaatctttggaaatgggacccatcagatgtttcacaagtcaaagtattctgatgc

SEQ ID NO: 6812653 - DNA, 85 bp, Homo sapiens
tgtgtcttggagtctggaatgatgaagaccttgtgctcttaggcaggtccttcctctttattattttagaattcttctggactca

SEQ ID NO: 6812654 - DNA, 64 bp, Homo sapiens
agaactggttacagagggatgttgccgtaatcaaaacacaacttcctgacttctaatgagttct

SEQ ID NO: 6812655 - DNA, 85 bp, Homo sapiens
agaaaagaaatgataagctgatatttgggtataatattatcttgttatccatgttctttgtattagctgaattatttccatttct

SEQ ID NO: 6812656 - DNA, 70 bp, Homo sapiens
agctaactgtaatgaattgttcatgacttgccaattgacatcaggatcagaatgatttttgcagtctgct

SEQ ID NO: 6812657 - DNA, 71 bp, Homo sapiens
catatgggtgaaccttgaaaatattatgttgagtgaaagaaaccagtcataaaaggaccacctattgtatg

SEQ ID NO: 6812658 - DNA, 69 bp, Homo sapiens
gcagtaagttgtgccaaatatacctggaatgaatagaaacataacccgtgttactggcataagggctgt

SEQ ID NO: 6812659 - DNA, 100 bp, Homo sapiens
gcagtctcctcccttgtggcccagacccagctgggtcccttcctcctaggcagctgagggaaggactgctgggttggccacgggcctgggaaggggaagc

SEQ ID NO: 6812660 - DNA, 90 bp, Homo sapiens
gctgtaattgctttgccagacagcagttaaaggacatgtgctttggcaatcattctcttgggcttgcttgcctggttccttagtttcagc

SEQ ID NO: 6812661 - DNA, 55 bp, Homo sapiens
gagaagtccgtgtaagctgttttaagacagagaacattgttcacaggggcttctc

SEQ ID NO: 6812662 - DNA, 55 bp, Homo sapiens
gagctggaggaccaggactgggcaaagacattgctcccagtctccttgcagcatc

SEQ ID NO: 6812663 - DNA, 79 bp, Homo sapiens
gaaattcaagtatgacatcaagtttctcagatattatccaaaacatttgatgaagggcgttggtgcatattctgttttc

SEQ ID NO: 6812664 - DNA, 60 bp, Homo sapiens
gtacaggtctgcgtctcctctggcctgtgagcttctgaggtatttttgcatgcctgatgc

SEQ ID NO: 6812665 - DNA, 68 bp, Homo sapiens
tgtattaaagccttttctgtttaacacacctagagtggtttctgtttcctgcaaagaggtctaataca

SEQ ID NO: 6812666 - DNA, 83 bp, Homo sapiens
ttctttagatagatgtgaaaatagacattatttctctatgattaaccatcagagagaaatagtttttgacacatttcaaggaa

SEQ ID NO: 6812667 - DNA, 75 bp, Homo sapiens
actggctgatggaaggacaggcgccgtgatggttaagtgtgtccatgttggctacctgatttcttttcagccagt

SEQ ID NO: 6812668 - DNA, 60 bp, Homo sapiens
gggtggggacacaggcccacaacttgtctccctgctagggctggggctgtgttttgaccc

SEQ ID NO: 6812669 - DNA, 60 bp, Homo sapiens
agggatgtagactttgtaactcaggaactcttttgggtaaacaatgtttgcctaatctct

SEQ ID NO: 6812670 - DNA, 64 bp, Homo sapiens
tctgctttagacataaaaggtatctgagagcacagggtctttggaacctggtgtctaaagtaga

SEQ ID NO: 6812671 - DNA, 63 bp, Homo sapiens
ggctggctcttcagacaacgactccatccagggtcctgatggtgctcctgcaggaagcaggcc

SEQ ID NO: 6812672 - DNA, 124 bp, Homo sapiens
tctacatgaaaaataaaaggggattattgagaccactctctaggtaactcaggcaaaggctattacaattagggctctgaatgagttaccaagattaaagtgatgattaactttggtcagtaga

SEQ ID NO: 6812673 - DNA, 78 bp, Homo sapiens
tttaaatctttgctatgtattattgataggaattgtgtcattaggccattcctaactaatttgtagcaaaataatgaa

SEQ ID NO: 6812674 - DNA, 97 bp, Homo sapiens
ttcgggggattggcttctagtctagactcttgctgggttagtgtttccatcattctgtcaaggatccagctctaaggctgatagccacttccctgaa

SEQ ID NO: 6812675 - DNA, 72 bp, Homo sapiens
aattacatgatgctaaataactggtttgactggcatttgtcacccaaagagttgtttcagctttgtgcagtt

SEQ ID NO: 6812676 - DNA, 63 bp, Homo sapiens
tgggcacaccacagaattctgtctccaggagtgagtaactgcttgtgacagaactgtgtccca

SEQ ID NO: 6812677 - DNA, 70 bp, Homo sapiens
ttggttcagtttacattaaaatctgtgcttataagtaaaacacagcagatttattgcaggctgatgctgg

SEQ ID NO: 6812678 - DNA, 74 bp, Homo sapiens
gggaacttgaggacagatgctgggcacacagtaggtgcttaataaaagcctgactgtgttcagttcagggcccc

SEQ ID NO: 6812679 - DNA, 66 bp, Homo sapiens
gaaacattggtctgccccttattgtacagagcaacaagacaataaggctttattagctattgtttc

SEQ ID NO: 6812680 - DNA, 61 bp, Homo sapiens
acctgaagagaaatttccctgtataatgaaaacatttgtacagaaaaaattcttggtaggt

SEQ ID NO: 6812681 - DNA, 104 bp, Homo sapiens
tcagatgaaacagctgttttaacagttgggtttttccaaaattaaaatattctattcctgacagtggctagcaactcaactgttaaaacagctgctcatgctga

SEQ ID NO: 6812682 - DNA, 67 bp, Homo sapiens
gtccttaaatgctgctgcaggagctaatatgagcatcatttatttgtagcagagtttaaaatcggac

SEQ ID NO: 6812683 - DNA, 90 bp, Homo sapiens
tccttctgtcccttggaggactgctgcttcttctgtaaggtatctagtgtgtgcctgaaaaagattaagatggtccccaggggtggggga

SEQ ID NO: 6812684 - DNA, 68 bp, Homo sapiens
ctggaacctgggaggctgaggctgcagtgagccaagattgcgccactgcactccagccttggcaacag

SEQ ID NO: 6812685 - DNA, 78 bp, Homo sapiens
atgttaaccattttctatgcattacttaggagcatcctcacagaagccctgtgatgtagctagagtagggaccaacat

SEQ ID NO: 6812686 - DNA, 71 bp, Homo sapiens
gggacgatgtggcctgaatcaggcactgttggaaattctcattttgtgcaatttcaggcatatattgtgac

SEQ ID NO: 6812687 - DNA, 63 bp, Homo sapiens
gggcttctcttatgctaactggttccttcttccttgtgcatgagccactgccttgaggggcct

SEQ ID NO: 6812688 - DNA, 72 bp, Homo sapiens
gctcaaatgccagctcctgcagctcctgtacctcctcggtcgtagcaggaaccccgggaggctggcatcagc

SEQ ID NO: 6812689 - DNA, 56 bp, Homo sapiens
acaggagaagaatttgaaaagagcttccattttgagcttaaaacctctttttctgt

SEQ ID NO: 6812690 - DNA, 73 bp, Homo sapiens
atggtacttttctttatctctggtgttaaaactcacaaaactatgctaccagaacagaagtaaaatttaccat

SEQ ID NO: 6812691 - DNA, 85 bp, Homo sapiens
gtgtagggtgcctctgacacttgtcccacacatagatctcccagggatgactgtgtgggtccgaggtgggatggaaaacttgcat

SEQ ID NO: 6812692 - DNA, 109 bp, Homo sapiens
aactagtggcaatagaattgcagcatgatattccattaggtaacttatttttggctgcttgttaagaagtgttgcctaatgcaatgttgtaaggacaaaaatcacagtt

SEQ ID NO: 6812693 - DNA, 57 bp, Homo sapiens
gatgaaggccttgtcctgatcccttggaaacacagagcatcacagacgtgcctcatc

SEQ ID NO: 6812694 - DNA, 58 bp, Homo sapiens
tgttgattcagaagtttcagggattaattgaccaccaggaactttcatgaatctagca

SEQ ID NO: 6812695 - DNA, 78 bp, Homo sapiens
tgaggaagagtgtgagtctgggaaaattttggatcaccgaggtgcagccataccttccacagccatcactgttgctta

SEQ ID NO: 6812696 - DNA, 75 bp, Homo sapiens
tgctctgtgatcgtttatttaagcttggttttactatctaagtactacagcagttaacgatcagactcagagaca

SEQ ID NO: 6812697 - DNA, 59 bp, Homo sapiens
gcacctgaaccttaatgcattccttaaaagttttcaatgggagcatgagtcaggggtgc

SEQ ID NO: 6812698 - DNA, 61 bp, Homo sapiens
attttatctgcagagtagatgcaagaatggctagtgtctgcatttgcaattgcagtaaggt

SEQ ID NO: 6812699 - DNA, 130 bp, Homo sapiens
ggcagggggttgggggctagcacacagaaaaatgtatgatggaggtgctatcactttttcttgtttgaaaatgtaccatttctacatatcttgtcctgtggcacactagctctgcaactacaattttgtt

SEQ ID NO: 6812700 - DNA, 66 bp, Homo sapiens
ctgtgtgctggggggagcccatgggaactcgatatgggttaaggctggtcccctctgcgtccacgg

SEQ ID NO: 6812701 - DNA, 61 bp, Homo sapiens
attccacatttcttcacttgtcccagtgttttattgggaaagtgttgaggtgtcttgggat

SEQ ID NO: 6812702 - DNA, 76 bp, Homo sapiens
cagatcctgggctcctgatgctcagatttcagctgctaacatatgtaaatgatcccatccaggggcccagctgttg

SEQ ID NO: 6812703 - DNA, 80 bp, Homo sapiens
gtggaaaatgtgcatggagtcatagtcatttagaactgaagctaccctagagaacttctaatctgttcacattgtttcgc

SEQ ID NO: 6812704 - DNA, 65 bp, Homo sapiens
ggctggtcgtcctgttgttgtctcagcctgtgcagcagagcttccgacaggagaggcagccagcc

SEQ ID NO: 6812705 - DNA, 64 bp, Homo sapiens
atcttgaatgaatgactctttataaaatatggaattggaacaagggtcattcatgttttaggat

SEQ ID NO: 6812706 - DNA, 63 bp, Homo sapiens
gaaaggtgctagtttgctttccagctttagaaatagagtctactgaagataactggctctttc

SEQ ID NO: 6812707 - DNA, 75 bp, Homo sapiens
catcaggcagagagggctgagctagaacaaaatgcaattctcttcgttcctgtccagagctctttctgcttgctg

SEQ ID NO: 6812708 - DNA, 69 bp, Homo sapiens
tgagggaaggcttcctggaggaagaggtacaggcactgtctcattattaattcaacagggtctccttca

SEQ ID NO: 6812709 - DNA, 68 bp, Homo sapiens
cctggcttccttcatgacctggtctgcaatgctaactatggtgacgtgaaaggaacatttcagccagg

SEQ ID NO: 6812710 - DNA, 112 bp, Homo sapiens
aagcaatcctctgggtcttttgttaaaatgcagattctgtttcagtatgtctgaagcaaggtctaagtatctgtatttatgacaagcaagcttccaggtgattacaatgctt

SEQ ID NO: 6812711 - DNA, 63 bp, Homo sapiens
gtgacaaatattgttcttggtaaaatcaaaactgaatttgcatgatgagaacaatatgcttac

SEQ ID NO: 6812712 - DNA, 59 bp, Homo sapiens
ccccagtcctgctggccttccctggccccatgtgccggctcaggggacctcaggagggg

SEQ ID NO: 6812713 - DNA, 58 bp, Homo sapiens
gattctccaccctggtgtcatgtttgaaccaccaaatgggcatttggggttgagaatc

SEQ ID NO: 6812714 - DNA, 86 bp, Homo sapiens
taacctaattgatgtatataggactgatcacattttcagattttacttgagtcactgagattatttttgttgttgtttttgggtta

SEQ ID NO: 6812715 - DNA, 100 bp, Homo sapiens
gcaacctggactaaatcatgtaggagaagaaagatgtaaaaggatgtttaaaaaaacattccatatataccttgttttttagccatgaagagaggtttgc

SEQ ID NO: 6812716 - DNA, 59 bp, Homo sapiens
ctccaggagcagagggtggtcagcagggtcccgtgttgcaaggccctagcttcaaggag

SEQ ID NO: 6812717 - DNA, 88 bp, Homo sapiens
ggcgaggtggctcaggcctgtaatcccagcactttgggaggccaaggtgggcggatcacaaggtcaggagattgagaccatcctggct

SEQ ID NO: 6812718 - DNA, 72 bp, Homo sapiens
aagaaatgctggtgaatataggtacttggaaaataaggtgttttcatcacctcccacctatttcactttctt

SEQ ID NO: 6812719 - DNA, 77 bp, Homo sapiens
gcttctctgtcattggggatgtgtgaaccagtccactgagaggcccagcacacggaatcccttttgtgacacagggc

SEQ ID NO: 6812720 - DNA, 99 bp, Homo sapiens
atctatgaggtgcttttatattgttttctttgcagtttctgagactgttaaagctcaaaagtaagaggctgcaggctggaaatcagagggactctagat

SEQ ID NO: 6812721 - DNA, 60 bp, Homo sapiens
tcacagtgcacccctcacagggtttcacatgacttagtgagttattatgtgcactggtga

SEQ ID NO: 6812722 - DNA, 69 bp, Homo sapiens
gtcaagccagtcagctcagtagatgtcccaattaatacactcaatgatcatgctgacaatggcaatgac

SEQ ID NO: 6812723 - DNA, 87 bp, Homo sapiens
gagtcatcccaggctggcagggtggttgagagaggtgtgtcactcctcacctcccctcacctctcctgcttcctgcacccatggctc

SEQ ID NO: 6812724 - DNA, 56 bp, Homo sapiens
caggatgggatgtagtgggcccttcccagagatgcctagaactaacccatgtcctg

SEQ ID NO: 6812725 - DNA, 76 bp, Homo sapiens
ctgtagctctccactgtcctttgctggttcttcctaatgttcctaacctctaacattgcagtggtaggtgccccag

SEQ ID NO: 6812726 - DNA, 121 bp, Homo sapiens
aaaaaattgggaaaattgaaaaataaatcaaggagggattatatttattttggttagcttcaaaaacattttttaccatttgaaataagaaattcttctttgcagttatctctaatttttt

SEQ ID NO: 6812727 - DNA, 61 bp, Homo sapiens
accgtggttgccaaaacagggctctgggtgtaccaagctcagagctggtaggtaggtaggt

SEQ ID NO: 6812728 - DNA, 58 bp, Homo sapiens
cctgcagctgtccggagtgagtaggcagggctgacacatgacctccgcagcagcatgg

SEQ ID NO: 6812729 - DNA, 76 bp, Homo sapiens
cctcagcctccatcatgtttgatcctgaggaagaagaggtctgtccagccccattttgcagatgatgaagctgagg

SEQ ID NO: 6812730 - DNA, 75 bp, Homo sapiens
cttggatattgagcctgagaaagaagcagagtagagcttgaagtagctctggagtcttctcagaagatattgaag

SEQ ID NO: 6812731 - DNA, 90 bp, Homo sapiens
ttgtatcatgtttgctattgttctagtggctgaagcaaaccacatagtcaaacctagaaggagagcaacaatccaagggcatggctacag

SEQ ID NO: 6812732 - DNA, 60 bp, Homo sapiens
tgtatggcttggaaatagtttagctgaacattatgctttaatattttactggccattgca

SEQ ID NO: 6812733 - DNA, 80 bp, Homo sapiens
tagaaatacaaattataggccccatcctagatctactgaatcagaaactctagggatggggctcagcaatttgttacctg

SEQ ID NO: 6812734 - DNA, 58 bp, Homo sapiens
gctcaggagctcttggtggcgcgggtccgcttccgcttcaccatcacaggcttctggc

SEQ ID NO: 6812735 - DNA, 79 bp, Homo sapiens
tgaaacttttcctttatcttagaactgtaccatatactatcaagtcgtttgtgtgtgaagggaagatagaggttattca

SEQ ID NO: 6812736 - DNA, 55 bp, Homo sapiens
tcagagttacccaaaacattctctgtttaacccaagtctgttaggatgactctga

SEQ ID NO: 6812737 - DNA, 79 bp, Homo sapiens
cagtgaagcaacagaagatagagtgaatgaataaagacacatgaatgcactaaatcttttgtgcacatggcttttactg

SEQ ID NO: 6812738 - DNA, 130 bp, Homo sapiens
taagcattttatccaagtacaaatgttaaaagcagagtaacttaagcaattgtgtatacaaaggtatacagacactgtaggttatttttcttcttgaatcatttttgctgcatagtaaattgcaattaca

SEQ ID NO: 6812739 - DNA, 76 bp, Homo sapiens
agagtattcctgcatattattttgggttattttgttctaggactctatcaccctgtgattgcaaagaaagtgctct

SEQ ID NO: 6812740 - DNA, 55 bp, Homo sapiens
ttgactgggccagacagagatccttgctggggatctctctggtggtcacagtcag

SEQ ID NO: 6812741 - DNA, 63 bp, Homo sapiens
ggaggctccaggatatgttggatacctggcgcagtgcctggcaaataacaatcctgagtgtct

SEQ ID NO: 6812742 - DNA, 58 bp, Homo sapiens
gctgattctgatgcttcacaaaggtaatgatttattcattctctgcctcagaatgagt

SEQ ID NO: 6812743 - DNA, 112 bp, Homo sapiens
tggttgccgggcaccgccccattcgtctattgggccaaagaagatgccgttcggtcacctagaatggcatatgtggtttttattggtctaaatgtgaagcagtgcccgccca

SEQ ID NO: 6812744 - DNA, 60 bp, Homo sapiens
gtcgcaaggtcctgaccaccatgtggattcctccacgtgtaggtggacaggatctttgac

SEQ ID NO: 6812745 - DNA, 105 bp, Homo sapiens
ttcccttccttagccttgaagcgggagtaaccactagacagaaggctgtgagggaggactctggcacttccactgtggctgctttgcctttgggcaggaggggaa

SEQ ID NO: 6812746 - DNA, 58 bp, Homo sapiens
gagactgcgctgaccttcaaatccagcgagtggtgacacgggtctgtcagctagtgtt

SEQ ID NO: 6812747 - DNA, 84 bp, Homo sapiens
gtgattaactgatctggagttagagtagacactgaactagaaaaagtcatcaatgtatactcagcatttagcttaagtagttgc

SEQ ID NO: 6812748 - DNA, 63 bp, Homo sapiens
gctgaattgagttggggagctaccaaggtagaaagcacttggaaagtttttactgaagacagc

SEQ ID NO: 6812749 - DNA, 118 bp, Homo sapiens
gagagagcaattgagattgggactgactaacagttgcttgccctgcagcatacttcaggtaaatagcttaaaagtagcttagtgtaacaaggggtcatttcttttttctttctctttc

SEQ ID NO: 6812750 - DNA, 102 bp, Homo sapiens
cagaggactgggatggacagagaaccagcagcacagtatcccaggagtgacgtagcccagccagctcacagcaccctgaggtgctggccccacccacctctg

SEQ ID NO: 6812751 - DNA, 80 bp, Homo sapiens
cggggagctgccgggcgcgcggcctgcaaacctgcgaccggctggggtgatacccgggctgtgcaccatccacctccctg

SEQ ID NO: 6812752 - DNA, 60 bp, Homo sapiens
ctttgggtagtatttatttgtttgaaatactgggatgttttgggcaaatgcaattcaaag

SEQ ID NO: 6812753 - DNA, 56 bp, Homo sapiens
tcagatgctaagttatcagcaggctcagtcatgtccctcttgatttttagctctgg

SEQ ID NO: 6812754 - DNA, 67 bp, Homo sapiens
tgttccatctgtgtacaggcagcaaacaccataaatgtctgatcatttggcctgatatcttggagca

SEQ ID NO: 6812755 - DNA, 65 bp, Homo sapiens
taggcaaactgagcatcagaaagtttaagttatttgcccagactcacttgatgttgtagtgccta

SEQ ID NO: 6812756 - DNA, 79 bp, Homo sapiens
ccacagtggctagataactagaatttcaggctcaattaaggccttggaatctaagtcatagtaaattatcttcactggg

SEQ ID NO: 6812757 - DNA, 55 bp, Homo sapiens
ttgacaaaggaattgaatctctgggagcggttcggaatttttcttcctgtgttaa

SEQ ID NO: 6812758 - DNA, 88 bp, Homo sapiens
atgaagcacctcctatgcctggggccagtcactgaggatacaattgttcacaagacagacctggtccttccggcctaaggcgcaccgt

SEQ ID NO: 6812759 - DNA, 122 bp, Homo sapiens
gggcggcccctctgaaccaggctcctcgaggccatctggacgccctggcaacatgggcaggaagcggcttccatggcaactggcgtccagggaggcgctgcctggcaacggggccatggccc

SEQ ID NO: 6812760 - DNA, 84 bp, Homo sapiens
tctatttttctcaatcacaaaggttctgtcaagtaatacaaagtcatctggtggctttacaaggcagaactgattaaaaatgga

SEQ ID NO: 6812761 - DNA, 80 bp, Homo sapiens
gcttaaaacttacattttcaagttattatactgacttccagatttcagagtagttctttgcagagtggaaatgtttaagt

SEQ ID NO: 6812762 - DNA, 76 bp, Homo sapiens
ggaatgagatacacacagggaatggagggatcagtacagctgaagtgcagagcctagccctttcctctctcatttc

SEQ ID NO: 6812763 - DNA, 60 bp, Homo sapiens
ctggcgagcaggaggcgacggcagaggaaacttcaacccgatgaacttcctggttgcggg

SEQ ID NO: 6812764 - DNA, 89 bp, Homo sapiens
tttgcatagctataggcatctgcttttgagaatttactttgatgacataggagtcaatgatgaaaagcaggcttgaagagagatgtgga

SEQ ID NO: 6812765 - DNA, 72 bp, Homo sapiens
ctccattttacattgaagtactgtaaacctgtgagctaatggtcaccagttacataaatgataaaatgagag

SEQ ID NO: 6812766 - DNA, 60 bp, Homo sapiens
tttgctcaatcatcagatagatgcttagaaaacatcatactgtctggatgtttaagcaga

SEQ ID NO: 6812767 - DNA, 90 bp, Homo sapiens
gccctgctgacagcttgctgtgccccctgcctgccccagtacgagcgggccctggacgtggcggcagagcccaagcacgagcggcagcgc

SEQ ID NO: 6812768 - DNA, 91 bp, Homo sapiens
gccaggatggtctcgatctcctgacctcgtgatccagccgcttcggcctcccaaagtgctgggattacaggtgtcggccatcgcgcctggc

SEQ ID NO: 6812769 - DNA, 62 bp, Homo sapiens
ggcaggccctgcacagtggtcctgtgtttagtcagctcaggcccagtctgacaggggctgtc

SEQ ID NO: 6812770 - DNA, 95 bp, Homo sapiens
gctctgccttgttggggggtgtgtgaggggctaatcataaagaataatttgggagctagttctggacacacgttcccagactgattgggtagagc

SEQ ID NO: 6812771 - DNA, 65 bp, Homo sapiens
gctctgaaagtggtattatattactgagaggaagggagcttagtgaggaaatccattatcaaggt

SEQ ID NO: 6812772 - DNA, 57 bp, Homo sapiens
ctagatttttcatcttccaggctctccaaatcctggtgagattaactgagaatctag

SEQ ID NO: 6812773 - DNA, 67 bp, Homo sapiens
gcagagggcagagcactgaattgggagtaaagacacttggtctggatttctgcctctacctctctgc

SEQ ID NO: 6812774 - DNA, 60 bp, Homo sapiens
ggtcagtcccctggcaggagggacgtgcagaaaagcacggggcaggcagaggggctggcc

SEQ ID NO: 6812775 - DNA, 56 bp, Homo sapiens
cctcaaaaatgcaggtactccataataacattcaaggaaaattgcgtattttgagg

SEQ ID NO: 6812776 - DNA, 58 bp, Homo sapiens
gaatggttatgtggatagcagataaccaaagttgtctgctgatgtcacatagccattt

SEQ ID NO: 6812777 - DNA, 70 bp, Homo sapiens
tgtttctcctccccttgagtctgggatggtcctgtgacttgctttaattcaacagactggggaagaagca

SEQ ID NO: 6812778 - DNA, 122 bp, Homo sapiens
tagcaacattctattaagtagttctaaatggagtatattttgattgtatgtgttggtgttttattgagcattgctgtaaggtatatcatatttgtaaatctgctcttaagaatattctgcta

SEQ ID NO: 6812779 - DNA, 70 bp, Homo sapiens
tgataggatgggcagacaggacggcaccagccatggttgctggctctccctggcatgcctcatttcttta

SEQ ID NO: 6812780 - DNA, 62 bp, Homo sapiens
gctatgcattgaatcctatcaggcaaattgaagaaaatttagcaaaggtagggttcagaagc

SEQ ID NO: 6812781 - DNA, 91 bp, Homo sapiens
cctggcctcttcccactgagctatttacgctgctggggatcaatactattgataaatccatgtaaatggtaatgtggctgtcaggccctgg

SEQ ID NO: 6812782 - DNA, 68 bp, Homo sapiens
tggtgtctgggactcagattgtgctgttcatggacagagagaattgggtttacagaatattttcacca

SEQ ID NO: 6812783 - DNA, 58 bp, Homo sapiens
ctctgcccagtgcccacaggagcagggctggccagtcccctgaggccctgggccagag

SEQ ID NO: 6812784 - DNA, 74 bp, Homo sapiens
gtggtctctaagtagaggaatcattttgtgcattgtttccagagccaccagatttactttactattagaatcat

SEQ ID NO: 6812785 - DNA, 73 bp, Homo sapiens
atcatcctaaactggggaaatggatattattatttacactgaatattcttcacctgagtcagtctaggaggat

SEQ ID NO: 6812786 - DNA, 57 bp, Homo sapiens
tgacagaactggaattggaactcaggcagcctgatttcagagttcacgttcttgtca

SEQ ID NO: 6812787 - DNA, 72 bp, Homo sapiens
ggtgctgatttttcctctttattctgagatagcaagtggcatgcaacagaatatgatcggaatacagatacc

SEQ ID NO: 6812788 - DNA, 69 bp, Homo sapiens
gactttaaccagctaacatgtggaatgatgtacttcattccctcattgttcactggccccagtagagtc

SEQ ID NO: 6812789 - DNA, 55 bp, Homo sapiens
actgcatttagttatgagaaaaacccctttagggttgtatttgcctgaatgcagt

SEQ ID NO: 6812790 - DNA, 60 bp, Homo sapiens
gtgcagtctcttcgagccgcagggctgtgtcagacagctggggtcggttggggagggcgc

SEQ ID NO: 6812791 - DNA, 129 bp, Homo sapiens
caccaaaaaaattagatgttattactgattactgaaagactgaatatttaggatatattttattttgatagttttatcagtagataggactcagtagaaatagcaagtccctatatttttcctggttag

SEQ ID NO: 6812792 - DNA, 90 bp, Homo sapiens
acatattttgccattgaaggtttaatgaactgtgttaactgaatatgttttcatattaggtgtgtttataagaccttctttagaaaatgt

SEQ ID NO: 6812793 - DNA, 61 bp, Homo sapiens
ggtgtaaaaacatactatttctagccaactgagggactacctaggaaatatgtttttaccc

SEQ ID NO: 6812794 - DNA, 56 bp, Homo sapiens
gctgggaagagatgcacatgattggctctcgtgagctcgtgtgaatcatctccagc

SEQ ID NO: 6812795 - DNA, 82 bp, Homo sapiens
gagcaaatgacttgcagtacctggagtacttcagaccatatcaatcagaatctgactgtcttcatatctgtgtctcctgttc

SEQ ID NO: 6812796 - DNA, 130 bp, Homo sapiens
aacaactattagcatacaattggttaaatccatttcaaagataattaccaaacataaagtaaaactttatttggaaatgcatctcttgagatggttggggctgttatttttctgtttgctcctggttctt

SEQ ID NO: 6812797 - DNA, 95 bp, Homo sapiens
gggcaaatgatttgctgaaggtcacagagctagcaaatagagcttcagaaaagttctgaggccaaggttgctattcttttcgctatctgttgccc

SEQ ID NO: 6812798 - DNA, 67 bp, Homo sapiens
gagatgaatgtaaacaaaggcagatgtccataatcataacgtcaagatgttttcgttagttcatctc

SEQ ID NO: 6812799 - DNA, 84 bp, Homo sapiens
ctgggaggggacacaggtcctgcagggagagtaaacagcctggctccaatgtcacctccttcaggagtcttccccagttcctag

SEQ ID NO: 6812800 - DNA, 74 bp, Homo sapiens
tagacgacatctttcctagatacccagaaaacgggagtcgctgtcaggctgggagtttctagagaaagactcta

SEQ ID NO: 6812801 - DNA, 55 bp, Homo sapiens
cccaggaaagtgaatctaattggctagattcagccaatggagtgcatctcctggg

SEQ ID NO: 6812802 - DNA, 55 bp, Homo sapiens
ttcacatgttggacatagaggaaaggatatgcaccagtcctctgccaactgtgga

SEQ ID NO: 6812803 - DNA, 98 bp, Homo sapiens
aacaaccaagcattttaagacagaaactcaaggccaacctggatcagtttttaacagaagccagttcaagttatggcgtttgttgtagatgggttgtt

SEQ ID NO: 6812804 - DNA, 73 bp, Homo sapiens
cttttctattgacagagctttcaccatgacattagtatggagacacttatggggaaagttgtcaggagagagg

SEQ ID NO: 6812805 - DNA, 67 bp, Homo sapiens
ctaggggaagaggactgtggcatcctagcaccaccaagtatcagctggggtaccaaacctctcctag

SEQ ID NO: 6812806 - DNA, 77 bp, Homo sapiens
cggacgctgagcccccgcccaccctcccccgggcccaacaaaggaagggggtgtccagggggtatcccagctctccg

SEQ ID NO: 6812807 - DNA, 112 bp, Homo sapiens
atagatgagtaaagaaattgtgttgtgtatatatgtgtgtgtatatacgtatatatgtgtgtatatgtatgtacgcacatattctctacatagtagaataatactcagctat

SEQ ID NO: 6812808 - DNA, 81 bp, Homo sapiens
ctttgttaaaaagtaggggctggagttcgaggttacagtgagctatgattgcggcactgaagtccagcctgggtgacagag

SEQ ID NO: 6812809 - DNA, 89 bp, Homo sapiens
gcttgaaagagctcctgctgcatcctgcctggtccagagcaacaggaataaccacccaggtcagtgagtgcacaggagctaaatcaagc

SEQ ID NO: 6812810 - DNA, 68 bp, Homo sapiens
acagttcccctcaacagggctgggaccatctgcaggcacttacttcagctgtgtgccaggggagatgt

SEQ ID NO: 6812811 - DNA, 70 bp, Homo sapiens
ggctttgatgtggtgtcaatttggggccttgtgtttgtgccagagggatacacatattaaactgcaggcc

SEQ ID NO: 6812812 - DNA, 82 bp, Homo sapiens
tagagtcttctgctttattttgttttgttgtttgcaaaagcaatgtaagactgtatgagacaatataaaccttgaggctcta

SEQ ID NO: 6812813 - DNA, 86 bp, Homo sapiens
ttgcttttctacctctgcctctggttttggtccctggcagctgctgatttagggcaaaatcccagagctcagagtcagaagactaa

SEQ ID NO: 6812814 - DNA, 124 bp, Homo sapiens
tttctggctcagacccagtcttagcatctcaggatctgttaagttgttccattttctaaaaggcaattggaacttgagaggaattctaacatcctttgtgcaaatggatgctgcaaaccagaaa

SEQ ID NO: 6812815 - DNA, 55 bp, Homo sapiens
gcagtccttgctgtgtaataaatatggagtcacatttgttcacacacagggcagc

SEQ ID NO: 6812816 - DNA, 55 bp, Homo sapiens
gtgattctgcacgtcattcctggctcaacagcctgaatgagtcctgctggatcac

SEQ ID NO: 6812817 - DNA, 72 bp, Homo sapiens
cccatccagcgtttggcctcttagttgtggagtgccacatggttctgtacttcaggggctctgttgggcggg

SEQ ID NO: 6812818 - DNA, 76 bp, Homo sapiens
ggtttgtctggagtggcagtcatctgaaggcttaattgggctggagtgttcaagatgacccagtcacacgattgcc

SEQ ID NO: 6812819 - DNA, 60 bp, Homo sapiens
tgctttataaccatttctgtgggttcagcaatcaccaaccagagagaggtaaattgagca

SEQ ID NO: 6812820 - DNA, 108 bp, Homo sapiens
gctgggctttggcatggcctctagcatgcctgctgtggtgtgaggctcagcagctctattgcccatgtctaacccagctggatgcatggaggctctggctttcccagc

SEQ ID NO: 6812821 - DNA, 74 bp, Homo sapiens
ccatcaggcaccagtggaattattctgtggtgattagtcataggctgtaataattcacattgtatgctcagtgg

SEQ ID NO: 6812822 - DNA, 129 bp, Homo sapiens
ccctttgatgaagatggcaaggataggtgaggtcatgtctgtatcgtgcaatgagctcatctgaagacaaggtctggataattgcaaggtgtagttatggtttcaaaatatttctgtttcaacaagtgg

SEQ ID NO: 6812823 - DNA, 55 bp, Homo sapiens
ggctcaggtttccttcccagctctaccacctggagctttgtgaagtgactgagct

SEQ ID NO: 6812824 - DNA, 64 bp, Homo sapiens
aaaagttctgtatttcaatgtctttattttcagtatgggccgaggagtgcagatcactgctttt

SEQ ID NO: 6812825 - DNA, 63 bp, Homo sapiens
catgaccaaaatcattacactgggaaaatgaagttcagactagtgtgtttgaattatggtatg

SEQ ID NO: 6812826 - DNA, 88 bp, Homo sapiens
ttaatataggagtgcagatcctgattgcagttcttttagataaatagagaagtgggattgcaggatcttagggtagttctgtttttaa

SEQ ID NO: 6812827 - DNA, 60 bp, Homo sapiens
cttccggtctcgctgggtttggggcaagttaccaaggccccaggacagcgcaatcggagg

SEQ ID NO: 6812828 - DNA, 68 bp, Homo sapiens
gctatttttgagccatttataaagccagttttcaataggcttgtgttatagaaggattaaattatagc

SEQ ID NO: 6812829 - DNA, 74 bp, Homo sapiens
gttgccctttagagaaagttttcttttcctgcttcttctcaaaggggaagaaagcatctggtagggtcttcaac

SEQ ID NO: 6812830 - DNA, 76 bp, Homo sapiens
ggttatgacactttactgtttacagctaatgcatagttacttgcatgccatggttgtacagtagcagactatgacc

SEQ ID NO: 6812831 - DNA, 76 bp, Homo sapiens
ggttcagggggatgatttcacaccttgcactttagttttacccagtgtaggaaaaacaatgatctgcctgacaacc

SEQ ID NO: 6812832 - DNA, 93 bp, Homo sapiens
ggaggtgtcttgctttttggggggccctgaagtagggagggtactgtttcttttctgaaagatgttcagggccctgagagggcagtcacgttc

SEQ ID NO: 6812833 - DNA, 77 bp, Homo sapiens
ctgtgttggagtagacagtgggaagtatgggacccagaggcaggtgcttgatttcttccattgcctcttcaaagcag

SEQ ID NO: 6812834 - DNA, 59 bp, Homo sapiens
caggaggacaagatttttggattcaggcttgcctgaccccaaaggctatgtatcttctg

SEQ ID NO: 6812835 - DNA, 62 bp, Homo sapiens
agccccaagtccctatgtttccacccctttctaaggacaggcgtggaggagcggctggggct

SEQ ID NO: 6812836 - DNA, 56 bp, Homo sapiens
gcaactgccggcagagccacgcccgcccggccacagttcctgtaaccggcagctgc

SEQ ID NO: 6812837 - DNA, 59 bp, Homo sapiens
ctcttctctcagagggaaacatgagtgagaacctgactcgcaacccctatgagatagag

SEQ ID NO: 6812838 - DNA, 62 bp, Homo sapiens
gattacccgactcccttcaatgggttgtttgtatctcttcccatcaaagggtgctggtagtc

SEQ ID NO: 6812839 - DNA, 77 bp, Homo sapiens
gggcctttgaaagcccttgagctgagatgcactcagagtcgcttgagactgcttcccagtaagggtttataaagccc

SEQ ID NO: 6812840 - DNA, 60 bp, Homo sapiens
ttccagttttgttctctcttactcagaaatgaggaaaagtcctgagaccagaaaatggaa

SEQ ID NO: 6812841 - DNA, 77 bp, Homo sapiens
gtaaataacagttgttcccagcaatgaaagttgaatgttgttgcccctttgttttcacatgctgggcaatagtttgc

SEQ ID NO: 6812842 - DNA, 80 bp, Homo sapiens
ggtactgatgaacatttaaagcctcttgatatagtcagttacactgatttacaagaggttttgtgtcacttttcattgcc

SEQ ID NO: 6812843 - DNA, 74 bp, Homo sapiens
ggagtggatatttaaaaaaattatctagttataatggaatttcactgtataatttttgtttgatgtccaatttc

SEQ ID NO: 6812844 - DNA, 62 bp, Homo sapiens
ggggcaggggctctggtgattggcatgagagaccaccgatgtcaccccagaggcctggcctc

SEQ ID NO: 6812845 - DNA, 83 bp, Homo sapiens
cctggagatcttgttaaagtgcagattctgatctaccaggtctgggctaggcgggagagtctgcatttctacaagctcccagg

SEQ ID NO: 6812846 - DNA, 83 bp, Homo sapiens
aggagaccatccatagattgagagatggtgtttgcaagatatttacagataagactatatccagactatggaaggatcttcct

SEQ ID NO: 6812847 - DNA, 79 bp, Homo sapiens
gctttccctattcaaggcagcttcatgtgactgtggacactgtacgccatcctcatcaaagcgcttggagtaggggtgc

SEQ ID NO: 6812848 - DNA, 56 bp, Homo sapiens
gtgcaaagggctttgcatacagaatctcacttgttctttgcaggagccctttgaac

SEQ ID NO: 6812849 - DNA, 120 bp, Homo sapiens
caagttgaattgtttcatgatgtgaagttttccatttgccatgtaggttaatcattcaaaacctggtgattacttctatttgtaatcagaagaatttcatgatcaaacagtccatttttg

SEQ ID NO: 6812850 - DNA, 92 bp, Homo sapiens
gcccagtgatttctagccctctttaatccttccctacaccaactgctgcggtaatgaggggcaaggggcggctgaggattgaggtcacgggc

SEQ ID NO: 6812851 - DNA, 68 bp, Homo sapiens
cccttgaaaagactcttctctcttctatcattttaacaaaaatggcagtagaaaagaatccctgaggg

SEQ ID NO: 6812852 - DNA, 67 bp, Homo sapiens
gtttgaagatctgtcaaccccatatttgcttacaaaggaagctgtataaaggcacaggttttctgac

SEQ ID NO: 6812853 - DNA, 66 bp, Homo sapiens
gatctagtagtgtcttaaacaaggtcaaaggtagtttctggcctttggaaagtaagcagctagatt

SEQ ID NO: 6812854 - DNA, 98 bp, Homo sapiens
agtaatcagttttatacaagttagaaagtaaatcatttgacagtgtttattctttacatgtactggtttgacttatatgtgtttgttaagtgattatt

SEQ ID NO: 6812855 - DNA, 129 bp, Homo sapiens
cttcaccttcaatacctgcacgcatctccatcagtcactgatggtctttctggtttcctcttttatctaccacatgaaaagactatctgattataatttgatgcctgataatttctaagttaggtggag

SEQ ID NO: 6812856 - DNA, 55 bp, Homo sapiens
tcactctgaaaacttacctttgtagactctttgccaaaggtctgttcagtggtga

SEQ ID NO: 6812857 - DNA, 58 bp, Homo sapiens
tcaaggaagtcttattgcacaggagtatcctggaacccagtgcaattgattttttaga

SEQ ID NO: 6812858 - DNA, 61 bp, Homo sapiens
gaatgtttaaaaggtgcagtttgagcttatttatgctcataggatgtattcatggacattt

SEQ ID NO: 6812859 - DNA, 87 bp, Homo sapiens
gtactcagggttgggactttggaacagccttgctactctggggtgcttgcagcagggcctgtacaagtcccaccccagccctggtat

SEQ ID NO: 6812860 - DNA, 78 bp, Homo sapiens
gtctttgttgatctcagacaggtggacaggggtctggacgaggcttactgtttgggtctgaggtcagtgctcatgggc

SEQ ID NO: 6812861 - DNA, 63 bp, Homo sapiens
gaactaaagttcacggtcagctttaggaattctaaaaggctgaaagaccttgaaccttaattc

SEQ ID NO: 6812862 - DNA, 63 bp, Homo sapiens
caagctgggtgcgggcagtatagggacaaagactctgcccttgggatgccaaccatccacttg

SEQ ID NO: 6812863 - DNA, 55 bp, Homo sapiens
accactgaggccggagcactgaagagtccagctctttttcacctctgtcagcggt

SEQ ID NO: 6812864 - DNA, 59 bp, Homo sapiens
gcactggtagagaattgtagcctgcaagaactcaatgttccaggagttctaataggtgt

SEQ ID NO: 6812865 - DNA, 60 bp, Homo sapiens
agggaagtttatcatatcctcacagagacgtgagcatattgtctttggtgtctcttcctt

SEQ ID NO: 6812866 - DNA, 60 bp, Homo sapiens
tgccagttgggaaaacagacatttttagtgtgtgtctgcagttcagatctaattgtggca

SEQ ID NO: 6812867 - DNA, 76 bp, Homo sapiens
tcagagggacttgcaggggagactgcgtttcctctaagtcaaattagtggggatgttttcacttgtatccctatga

SEQ ID NO: 6812868 - DNA, 60 bp, Homo sapiens
cacttcacactgtggggttcttgtcatcagtatctctgaagctcttccacagtcgaggtg

SEQ ID NO: 6812869 - DNA, 55 bp, Homo sapiens
gaccctcttcctcttcgattcctccacggtgccagagatcaaggaggggaaggtc

SEQ ID NO: 6812870 - DNA, 71 bp, Homo sapiens
ttctcccacctcaaccaccaattgtagatgtattcagatagcatgacatttgaaaaagttgatggagagaa

SEQ ID NO: 6812871 - DNA, 74 bp, Homo sapiens
ggtaagcaggcaagtttggaaagcaaggtgataggtgatagtctacagctgcaagtaagcttgctcctcttgct

SEQ ID NO: 6812872 - DNA, 71 bp, Homo sapiens
atgtgcctaagctctgttcattaatctgtgataattagacttatttgcaaaggttaacagcagtggcacat

SEQ ID NO: 6812873 - DNA, 68 bp, Homo sapiens
ggaggtagaaaacacatatgcaggtatgaacaatcaaagaaaacttgcactttgtggattgtatttcc

SEQ ID NO: 6812874 - DNA, 58 bp, Homo sapiens
caaagtttccacatgaaaggcttttgcttttagcttgcacagccatatggagactctg

SEQ ID NO: 6812875 - DNA, 56 bp, Homo sapiens
aagtgcagagagaaataaagcaagaaaatctccgatggcctttctctctgctattt

SEQ ID NO: 6812876 - DNA, 78 bp, Homo sapiens
taggtttgatgttatttctgaaagatcattggcatatcctccagcttgtattttcttagaagcaactgataaaacctg

SEQ ID NO: 6812877 - DNA, 61 bp, Homo sapiens
tcttggacacaatggttttccatatgggcaaagactctaaatgaaggccatttgttccaga

SEQ ID NO: 6812878 - DNA, 79 bp, Homo sapiens
atggcgggtcattgttactgtttagttgcctgatgggtttctggctcctaaatccaagtaacgaagcagatcctgctgt

SEQ ID NO: 6812879 - DNA, 100 bp, Homo sapiens
ccgcgcgcctcagtcctcccttggtggcctcgccgcggctctgctgggagacccggcgctggcggctgctgaggccggagcggagggcccgggagcgtgg

SEQ ID NO: 6812880 - DNA, 101 bp, Homo sapiens
ttgagatggagtcttgctgttgcctgggctggagtgcaatggcgccatcctggctcactgcaatctctgcctcctgggttctagcaattctcctgcctcag

SEQ ID NO: 6812881 - DNA, 73 bp, Homo sapiens
gagaagattgaaggctgggaattaacaactgaaccttctctcactcataattcttcaggccttttgtctcctc

SEQ ID NO: 6812882 - DNA, 63 bp, Homo sapiens
tcctctcacagatcctgtgttactcagagctactaagcctagaaaacatggaactggagaggg

SEQ ID NO: 6812883 - DNA, 58 bp, Homo sapiens
cttcagagagtccagggactgcactgcataggttcccttagccctgcactcctggtag

SEQ ID NO: 6812884 - DNA, 61 bp, Homo sapiens
agcagatgcattatgattgaaaagctcttggcacagagtcctgcactcatgaagcactgct

SEQ ID NO: 6812885 - DNA, 59 bp, Homo sapiens
gcagctatgcctcccctgtgtcttttatgcctgtcggtatgtccggacagaggctctgc

SEQ ID NO: 6812886 - DNA, 58 bp, Homo sapiens
tgtcaaactcaagggcttgatcaaatgattagtgatgactagacttttgtgtttggca

SEQ ID NO: 6812887 - DNA, 62 bp, Homo sapiens
tccactccatgcccctcagccagtataagtggtggccatatggagtgggccatggagtgaga

SEQ ID NO: 6812888 - DNA, 58 bp, Homo sapiens
agcccttgcagactgtcagcattggagtgggccccacatgaaggcagtgccaagggct

SEQ ID NO: 6812889 - DNA, 76 bp, Homo sapiens
agtcatctttatacatcagtatgtttagatatgtatcattgtttctaatggctgctgagtactccataggatggtt

SEQ ID NO: 6812890 - DNA, 91 bp, Homo sapiens
ggatgtcctgggacaagtttcccctaagtgaagtgttgataagtctgcttatcagaaagatattactgggggtgtgatatgtagggcatct

SEQ ID NO: 6812891 - DNA, 59 bp, Homo sapiens
gaaatgaccctcagtgaatcttacatagtgttcatgccaccccttgaggagtcactttc

SEQ ID NO: 6812892 - DNA, 97 bp, Homo sapiens
ttattgatttcttaggagcattagtaatttataatcctgagcaaactagcagaattaaggaaaaaaattatttcaatgctcttggaagaatcgatga

SEQ ID NO: 6812893 - DNA, 65 bp, Homo sapiens
agcaaggatattacagggctagttatgagtttccaggctttaggacagtcctgtaaacatttgct

SEQ ID NO: 6812894 - DNA, 88 bp, Homo sapiens
ttatgcattttgcagtgtgtggttgaactatgttttatctgaccattcttgtgtacatttaggtagtttccaacattcattatcataa

SEQ ID NO: 6812895 - DNA, 79 bp, Homo sapiens
aggctggagtgcaatggcgtgatctcggctcactacaacctccacttcccgggttcaagcaattctcctgcctcagcct

SEQ ID NO: 6812896 - DNA, 86 bp, Homo sapiens
aaatgattgcaaaagccctggcatccacaaatgcttagattcattatggtatctttggtattttggatggggcttaagctacattt

SEQ ID NO: 6812897 - DNA, 75 bp, Homo sapiens
taagaccatcaggctgataggaggaactgatactaaatagagttatcagtgactcagatgtagtcaagtggcttg

SEQ ID NO: 6812898 - DNA, 84 bp, Homo sapiens
gtgagcagctggctaggggcttccaaccctaccgactcctcacccggggtccctgggttcccgtggaagtgtcagtcagcccac

SEQ ID NO: 6812899 - DNA, 82 bp, Homo sapiens
tcccttttcccccaactgagattttttgaaaaggtggaattgaaccaaaccagcctcaaagtatctcatggagagcaaggga

SEQ ID NO: 6812900 - DNA, 111 bp, Homo sapiens
ctcacaatacttgtgtccttcatatgtattaggtgttttacagacattttttctatcataattctatataataagtgttaggtaaacatcttaacagatgaggaaactgag

SEQ ID NO: 6812901 - DNA, 76 bp, Homo sapiens
tgtacagggagccaagtcctccatgtgactaggtcatctgaccaggtccttttgagggctactagttttttctgca

SEQ ID NO: 6812902 - DNA, 65 bp, Homo sapiens
gcttgggttcgatgtatatgtagcccgggcatggggcagggcttcttaacatttggacaccacgc

SEQ ID NO: 6812903 - DNA, 62 bp, Homo sapiens
tcattcggcaatagtgtgttagatagtgaaataccatggaaagacactgcaattgccaatga

SEQ ID NO: 6812904 - DNA, 86 bp, Homo sapiens
aaggcataaaggaagacttgtcagggatgctgataagagaatttttgccttatgggtagggtttgataagattccttccatgtctt

SEQ ID NO: 6812905 - DNA, 76 bp, Homo sapiens
ttgatctattcttgctgaggcattactctttaggacctcatccttactgtttgatcagcaagataaatagagccaa

SEQ ID NO: 6812906 - DNA, 75 bp, Homo sapiens
ttttaacatgagaatgcattcatgttttgtctgtgaacatttactttcaaaagtaatgtatgctcatcgtagaaa

SEQ ID NO: 6812907 - DNA, 67 bp, Homo sapiens
gggggaagactgggctagtgatctgagaaactgtcaagcgattattaaagcttaggtcttatcctcc

SEQ ID NO: 6812908 - DNA, 81 bp, Homo sapiens
cttgttgctctacccagatttcttattttctgtttcttttacattaaggaacctaggactatagatatcatgaggggcaag

SEQ ID NO: 6812909 - DNA, 93 bp, Homo sapiens
gttggagaagtggaaatgccctttcactcagcacaaacagcaacattcccatgagctgaggagatgggctttttagggagtagttcatccaac

SEQ ID NO: 6812910 - DNA, 68 bp, Homo sapiens
tcctgctgtatttacatgagtcaaagcacaaagtgcttgtgcttttatgaatgcagatgatactagga

SEQ ID NO: 6812911 - DNA, 55 bp, Homo sapiens
tcagggcaagattggttaataattaaagaatctattatttatcaatttgccctga

SEQ ID NO: 6812912 - DNA, 86 bp, Homo sapiens
gtctgacttggtgggtgggttgttgcagttgaagtctccaggaaatgctcatggacaggtgcacacagcagccaaggggtcagggc

SEQ ID NO: 6812913 - DNA, 76 bp, Homo sapiens
ggtggaataaatgggtggatggatagatgtatggatgaataaatccatacatctggatgtatgcatttaatgaacc

SEQ ID NO: 6812914 - DNA, 71 bp, Homo sapiens
gggcaacagtgtcaaggggtggcccaggccctggagccaaccctggaagcatcacttcttgcctgttgccc

SEQ ID NO: 6812915 - DNA, 106 bp, Homo sapiens
tttgtttattcatttatttatttggcaattatttaaatatcacaggcactgggatatataatgcctgtaataatgctaagcactgggagatataatgatagacaag

SEQ ID NO: 6812916 - DNA, 78 bp, Homo sapiens
gcactaaagccaggattggttcccaggcaggtggaggtagattccatacaccaggttaccaatcactgctctagttgc

SEQ ID NO: 6812917 - DNA, 59 bp, Homo sapiens
ggcacagcgactaccatcgaaagttgatagggcagacgttcgaatgggtcgttgctgcc

SEQ ID NO: 6812918 - DNA, 91 bp, Homo sapiens
gaccgaaaataaaactctcttgagaaacttgttgccctcctgaaaattctgtctggaatgggacttagcaataggatttttaagtttggtc

SEQ ID NO: 6812919 - DNA, 57 bp, Homo sapiens
atctgcaggtgggtgtctcagagaagaaagccatctctctgtgcattgcctgctggt

SEQ ID NO: 6812920 - DNA, 66 bp, Homo sapiens
tgaaattctaggctaatgctgctacccatgcaaagtcctggaggcagcatgagcctggtgaattca

SEQ ID NO: 6812921 - DNA, 100 bp, Homo sapiens
gtattttaataaggacttgaatgatgtataatattgagagcccaagcagcaggaaaggcatttcagaccatatgtgattatctgagtcctgattaagtac

SEQ ID NO: 6812922 - DNA, 62 bp, Homo sapiens
tcctctctccaccaagccacccaaatattaagcaatgggtaggctctgtaggtagagatggg

SEQ ID NO: 6812923 - DNA, 67 bp, Homo sapiens
tagacactgaggattcaagagggaacaagacagacatggttcttgccctcatggaattcacattcta

SEQ ID NO: 6812924 - DNA, 61 bp, Homo sapiens
tctgtgttttggttttaggatcagtgcaaattcacatgacataataatccaaacatacaga

SEQ ID NO: 6812925 - DNA, 62 bp, Homo sapiens
ctgtttgtacagtgcccacttctgcctccttgggagatcagaatttccttctgtgcaagcag

SEQ ID NO: 6812926 - DNA, 63 bp, Homo sapiens
ggccaagatggaaggagagatggccgttcgtccagctcccagcctctctccatctcagtggcc

SEQ ID NO: 6812927 - DNA, 64 bp, Homo sapiens
tcctcccagctgcctgtgaggcagaattaatattcccattctgcagacaggaagctgaggctga

SEQ ID NO: 6812928 - DNA, 85 bp, Homo sapiens
gatgtttgaattcaaaattttgttatttaatctgtgaatcaaattttagtagaagacagataacaaaacagttttttcaaggatc

SEQ ID NO: 6812929 - DNA, 58 bp, Homo sapiens
gagctggctccgccatgctgctccccactcatgcagagcaagcattgctggttaggtc

SEQ ID NO: 6812930 - DNA, 88 bp, Homo sapiens
atgtaatggggtgcgtcagctggatccgagttagatattgctgtaaatgttgcttagctttgccatctgtcacatactctttttgcat

SEQ ID NO: 6812931 - DNA, 103 bp, Homo sapiens
gtcctatggggccaatcattaactttgtattttatggtacattctaaatacctcccatgggtatgtacataacatgaaatgcagggtaatgggcagatgggac

SEQ ID NO: 6812932 - DNA, 60 bp, Homo sapiens
gagtctctgggagggaaagaagctgtccttcctccatgcttctctttggttcagagattt

SEQ ID NO: 6812933 - DNA, 77 bp, Homo sapiens
ggggagcagcagaagtgcgtgggaacagagttgaacaggatgtggacttggacctgagcctggccctgccgctcccc

SEQ ID NO: 6812934 - DNA, 77 bp, Homo sapiens
tttcagctgaagatccaggcaaaagttggaaataaatgcaattttcaagttctgttctagggtaacttaagttgaga

SEQ ID NO: 6812935 - DNA, 70 bp, Homo sapiens
ttttcgtcggatgttgagtttacctggaatgccccggtgttattttgggaaggcagacatcccacggaaa

SEQ ID NO: 6812936 - DNA, 60 bp, Homo sapiens
gaaatattaggttggagcaaaagtaattgtgggccatttttgcaacaacctatatatttt

SEQ ID NO: 6812937 - DNA, 75 bp, Homo sapiens
ccctatctgacacatgtgcttgtgggtagcctcccttgcagaataagaggctcctgggagatactgtgagttggg

SEQ ID NO: 6812938 - DNA, 80 bp, Homo sapiens
atatactgtataggacaagtcataattgcaatgtataatcatgttatgtacattcatggtgacttgtatgtatggtctat

SEQ ID NO: 6812939 - DNA, 129 bp, Homo sapiens
cccctttggctctggagaaatggaagtggggctgccaggggctagaggtgccccagagggatgcaaatagtgggcctcttgagcttttactcctgctcagttctcagctaaagggtaagaggcagaggg

SEQ ID NO: 6812940 - DNA, 101 bp, Homo sapiens
tgaggcaggagaatggcgtgaacccaggaggcagagcttgcagtgagccgagattgtgccactgcactccagcctgggtgacagagcaagactctgcctca

SEQ ID NO: 6812941 - DNA, 71 bp, Homo sapiens
actggcacttggctgagaggttctgggcacaagaagaactgctttgggagcctggcacccaagttccatgt

SEQ ID NO: 6812942 - DNA, 77 bp, Homo sapiens
ttgtttcttgcctgcttggagtcctccagcaccaggagaagttggtgggtttggcaggataccaagtcccaaaacaa

SEQ ID NO: 6812943 - DNA, 59 bp, Homo sapiens
tgatggattctaactgaacagaatatgaaagattcactgatacggttttagagtccaca

SEQ ID NO: 6812944 - DNA, 82 bp, Homo sapiens
gtgaggatgcatgaggggggttaggaagttggagaagtaagatgatcaaatgtcctaaattgcctccactttaatgccttat

SEQ ID NO: 6812945 - DNA, 66 bp, Homo sapiens
atagaaacagggaagcaaagcagcttagtttttagaatgacttcaactttgttctctgctttctgt

SEQ ID NO: 6812946 - DNA, 79 bp, Homo sapiens
gaggcctcccaagctgtgctgaactgtgagccaattaaacttctttcctttataaattacccagtcttgggcagttctt

SEQ ID NO: 6812947 - DNA, 65 bp, Homo sapiens
gtgacctatcaacgctgactggttgggcactccagtaacaaacaccaaagcgagtgatatgtcat

SEQ ID NO: 6812948 - DNA, 98 bp, Homo sapiens
tgccccactcatgaaattattgttctggcttctctctgtctttgctcaaataggaatagagcaaagatacagacagagccaaaataatgtgagttgca

SEQ ID NO: 6812949 - DNA, 65 bp, Homo sapiens
tgtgccacatacacagtacattatttcatgtggctctattgtatgagtgcatgtgtgtgtgtata

SEQ ID NO: 6812950 - DNA, 87 bp, Homo sapiens
gtgttacgtcttccttctcttgtccttttgttctgtcatgcttagactaggcagtgagctggagggaaggaactgactagtttgcat

SEQ ID NO: 6812951 - DNA, 130 bp, Homo sapiens
tactatccaggactctcctggatagatactatccaggactctcctggatagatactatccaggactctcctggatagatactatccaggactctcctggatagatactatccaggactctcctggataga

SEQ ID NO: 6812952 - DNA, 61 bp, Homo sapiens
gagtgagggcagcaggggctgcactgaaccttgaggcttccccgagcagctaccctcgctc

SEQ ID NO: 6812953 - DNA, 84 bp, Homo sapiens
acagagacagactatgagccaggctggatagaaactgtgctgcatgcattggtgtcttcctcttggcttgagcttgtccattgt

SEQ ID NO: 6812954 - DNA, 85 bp, Homo sapiens
ttttcttcctctccttgacccttcccttcagttggctgggcttttcagttcattgactcagggaaggggaaatgaagagagaaaa

SEQ ID NO: 6812955 - DNA, 57 bp, Homo sapiens
gaaagaatgctatagtgacttccatttgagcagttgctgttggctagcattactttc

SEQ ID NO: 6812956 - DNA, 62 bp, Homo sapiens
ggtcccgggcgctcctctcttctgagaagtagtcgaggcggcggaagtgcccgtacggcacc

SEQ ID NO: 6812957 - DNA, 60 bp, Homo sapiens
tttttgcctgagagtgaaaataatggataatatccattgtaaccacccattagacagaaa

SEQ ID NO: 6812958 - DNA, 100 bp, Homo sapiens
gagtttttagtagggacctgcttttgagcccagtgctcagcttgaacaggttaattgagccttctgggacaaatctcagcattggttatattattatttc

SEQ ID NO: 6812959 - DNA, 71 bp, Homo sapiens
atcatatcttttctcttccctattaaaactcctcctctgttcagggaacttggggaagaaaaggatgtgat

SEQ ID NO: 6812960 - DNA, 79 bp, Homo sapiens
tggttctaaaaaactattttattatgctattcacatttctagatgtgattcaagaaagtaaaatgttgagtcagggcta

SEQ ID NO: 6812961 - DNA, 88 bp, Homo sapiens
ttgcccatgaggaaatgcctccagggcttcgtgtctcagtgctctcaaagagacccagagagcggggcctttctttctccgtgggcaa

SEQ ID NO: 6812962 - DNA, 56 bp, Homo sapiens
ctgtttcatgaatgcaatttcatcggtgtctggaaattgcacagtttatggtgcag

SEQ ID NO: 6812963 - DNA, 75 bp, Homo sapiens
catatttataggcagaatccacagtagaacgtggtacctaaacttctactagtggtctctttctgtgaagtcttg

SEQ ID NO: 6812964 - DNA, 59 bp, Homo sapiens
ctctgagcagaggccgtggctacttgatctgccgggaccagggcaacgctgtctcagag

SEQ ID NO: 6812965 - DNA, 69 bp, Homo sapiens
tagaccctggctagggcttaacctggctctgactagacctaaattaggcttaggccctggctagggctg

SEQ ID NO: 6812966 - DNA, 94 bp, Homo sapiens
gtggacactgcgtctgatgtccagggtaagtctctgccttccaggcccagcctagagcagtgggtaccatggcacatctgacagcattgcacac

SEQ ID NO: 6812967 - DNA, 94 bp, Homo sapiens
ctgatctacaaatttggaagaactgaagagctgtggacctgagatcactccttaaatcacattttctttgtgttatattctgtttgtagataag

SEQ ID NO: 6812968 - DNA, 76 bp, Homo sapiens
ggtgccaccagatgctgttgctactaccactggcaaagtttaagggtaaaatagcataaagtttctgtgtggttct

SEQ ID NO: 6812969 - DNA, 82 bp, Homo sapiens
gggcctatttattgtgagttccaaggcatgctgggtagggatgcttaagagcctgtggttgctttgggatcctgacaggccc

SEQ ID NO: 6812970 - DNA, 77 bp, Homo sapiens
acactttggaggactttggaagatggctgtatttaatgtaacttaaataacttattctcctcagagcctcttagtgt

SEQ ID NO: 6812971 - DNA, 80 bp, Homo sapiens
ctccaccctgctgggaatcccgttcttcgccatgggtaactatccatccttgtggtaatcggattcttaccggtttgggg

SEQ ID NO: 6812972 - DNA, 69 bp, Homo sapiens
gtgaggaccttcttgctgtgtcctaacatgatggaaggtggaagggcaaaagagatgaactatccttac

SEQ ID NO: 6812973 - DNA, 73 bp, Homo sapiens
gttgccccagtacacactgacctgaacttagcatcccggagaatgaaagggacagttggggcagtggggcagc

SEQ ID NO: 6812974 - DNA, 63 bp, Homo sapiens
tcacagacctggtgggaggtggcatggagaattccagacttcctccagttgccatgttggtga

SEQ ID NO: 6812975 - DNA, 110 bp, Homo sapiens
gaaatgaaatgtgtttacatgagaattagggggctcagcatggatggagagaggctgaaactccttcatagcctgggtcctacaggtctaatgtattatagcttttagtc

SEQ ID NO: 6812976 - DNA, 71 bp, Homo sapiens
cctctgcagatgtctgtgcctgcagggagtgtttccatacaacccctgggcttgggcattggaagcagagg

SEQ ID NO: 6812977 - DNA, 60 bp, Homo sapiens
tacagaagttaacactattgctatgacacagaacttagggacaagtgtgtaacttgtgta

SEQ ID NO: 6812978 - DNA, 71 bp, Homo sapiens
gccaccgagccccgtggttgagttgggctacaggccgccctgtccccaccaacacagcacatctcggcggt

SEQ ID NO: 6812979 - DNA, 55 bp, Homo sapiens
tgctttgtgagtgtgtaatgacagaaaccaaggatctgtacacaaagtcaaagta

SEQ ID NO: 6812980 - DNA, 80 bp, Homo sapiens
taactgagtgccagagaatttgagacttgcccaaggtcataataaatttgtgggagagctggaattcacttattcagttg

SEQ ID NO: 6812981 - DNA, 56 bp, Homo sapiens
gaaggaggtctgatacaatatggtcatgtaagatgacctctgatcagtcctttttc

SEQ ID NO: 6812982 - DNA, 75 bp, Homo sapiens
gggggcaaaatacgtgaatttcttccttctcctagaagaaatcctgggtttcttcctagaaggaagaaatctccc

SEQ ID NO: 6812983 - DNA, 71 bp, Homo sapiens
ggtggggacagctctcacatggctcggcagagtggctgggcgcctcaccatggggagcagtgctcctgacc

SEQ ID NO: 6812984 - DNA, 111 bp, Homo sapiens
gcaccaagccccactttcagcttccctctcagattggcagctgtccactttctggggtcgaagaagagaacagctgcaaattgttagaggaggggtggcagcggggggtgt

SEQ ID NO: 6812985 - DNA, 62 bp, Homo sapiens
gctagaaatgctcaagagaaagtgatgaaaatctagaatcattttgcttttgaagtttcagt

SEQ ID NO: 6812986 - DNA, 62 bp, Homo sapiens
cctcctctgctgttttgtatacaggcttctatggaggtctgctatgtgaactgtagggaagg

SEQ ID NO: 6812987 - DNA, 75 bp, Homo sapiens
cattatattacagcactgttaaagatactgaaatatattgaagttttaccttgacattgctgtagtgtccagatg

SEQ ID NO: 6812988 - DNA, 76 bp, Homo sapiens
ttgtttgagcccaggaggtcgaagctgcagtaagctacaatcatgccactgcactccagcctgggagacaaagcaa

SEQ ID NO: 6812989 - DNA, 67 bp, Homo sapiens
gaagaatgtgctaatgaaaactttcaggaacagtgatttcctcaaggtttctaccagcatgttaatc

SEQ ID NO: 6812990 - DNA, 62 bp, Homo sapiens
gctttcaaactgcctgtaaaatcttgggttcttatgaattttggagtccagtagttgaaggt

SEQ ID NO: 6812991 - DNA, 59 bp, Homo sapiens
tttccagcctgcagaatcacctcttcttcatagtaggaaagaactctgcagactgggaa

SEQ ID NO: 6812992 - DNA, 70 bp, Homo sapiens
gcctagaaaactttgcagggagaatgttttctaagccaacacctagaagacaagcaagagtttgctgggc

SEQ ID NO: 6812993 - DNA, 101 bp, Homo sapiens
ggtcatatttgaaatggtgttatttttcaatagaagttcttcacgaaggcatcatctctaaaatgtggttatcttttgttaggagaaaacatcaaatgacc

SEQ ID NO: 6812994 - DNA, 94 bp, Homo sapiens
tccagctcagcaaaagtccctctgcacttcaccttagctcctcaggacaagggagtggaggctgaggctgcagagatcccagacctgagaagga

SEQ ID NO: 6812995 - DNA, 72 bp, Homo sapiens
gtactctttctctgtgggctttatgcatcttttgtcttataaaatgtatgatgtctacagagtcagatgtat

SEQ ID NO: 6812996 - DNA, 62 bp, Homo sapiens
gctggcagactgggggcagaaccaaggcccatgcggggcaggaagtggccctagactccagc

SEQ ID NO: 6812997 - DNA, 56 bp, Homo sapiens
tcggcagggccgtgagcggtgtctgtgcttgaggaccagctccaggcccctgctga

SEQ ID NO: 6812998 - DNA, 72 bp, Homo sapiens
gaccgacgtcctccccttttggaagtccagggagcagagatccctggctctggccaccgggagggcaaggtc

SEQ ID NO: 6812999 - DNA, 81 bp, Homo sapiens
ccatcgaaggctttaggcaggtgaatgatggactaggattgtattttaggaagattattcacatgagaagctgaacaatgg

SEQ ID NO: 6813000 - DNA, 75 bp, Homo sapiens
tcctgacctcttgaatgaatagttgctagaaggggcctaagagcttcgagaggagaaaaattcattcaatcagga

SEQ ID NO: 6813001 - DNA, 55 bp, Homo sapiens
ttcacattggtgatatgtttctttgggaggaagaaacttttttaaatgatgtgaa

SEQ ID NO: 6813002 - DNA, 77 bp, Homo sapiens
gagaattctttcacagcttccacttaaggattaatgtttaagaaatttgtctttctagtggagctggattattcatc

SEQ ID NO: 6813003 - DNA, 65 bp, Homo sapiens
ggccctggggagcttcaggtggcttacacgccagctctgggtggcttttggggttctttatggtt

SEQ ID NO: 6813004 - DNA, 79 bp, Homo sapiens
gaaggagtagggacagagacttgctggaggcacctggagagtgtgtttcctcacttctctgactcttcccagatccttt

SEQ ID NO: 6813005 - DNA, 57 bp, Homo sapiens
gggcactggaaggctctcaggctctggaatacaccagcaccctactttcacatgccc

SEQ ID NO: 6813006 - DNA, 113 bp, Homo sapiens
tcccagggaatgcttactggactctgctgaaggtgccacttccctcagactatggtgggagcgggtatgaggatgagggtggcatgcacagagttgagttaacaggtgtggga

SEQ ID NO: 6813007 - DNA, 57 bp, Homo sapiens
gatgtatagctttaactgaccctgggttttgcagaccagggtttgtttaatacactc

SEQ ID NO: 6813008 - DNA, 71 bp, Homo sapiens
agtctagcacagttgtctgatttcttccttagggtaaattatcaggataaagccaggcactgtggtgtgct

SEQ ID NO: 6813009 - DNA, 64 bp, Homo sapiens
gacatgggctgcttctccagcacctgcttccaacagggtactgtggtcagcagcaaccagtgtc

SEQ ID NO: 6813010 - DNA, 105 bp, Homo sapiens
tagcagggatgggctgggggtgccagggctgctactggctgaaagtcattttagggaaatttattgggtgagcaagctctgggcctccctccccatctcctgcta

SEQ ID NO: 6813011 - DNA, 130 bp, Homo sapiens
ctcttattgattacctgaaatagtgtgccagggctcatctgagactgacataataatactgaataattcctgaacaattatagtggaagttgagatgatatcctttagctgttggtcttaatgagttaag

SEQ ID NO: 6813012 - DNA, 106 bp, Homo sapiens
cctgttggcctgcactggatggtgtcatgagcagctcttcctccagatgtactcagaggatcattgccatgtctcatgctaccctagtgcttagtgatccaacagg

SEQ ID NO: 6813013 - DNA, 65 bp, Homo sapiens
ccttgactcttggtgattactgggttatgcatgtaaacagtacaactccacaagactagtcaagg

SEQ ID NO: 6813014 - DNA, 82 bp, Homo sapiens
tggatattccacattatgactatttaacttcacagacaagagaagcagtgaaacaaatggatgtcatagttggatatactca

SEQ ID NO: 6813015 - DNA, 78 bp, Homo sapiens
gacttgaacattgtcacattcctagcttgggctcagaaattgcctgttgctacttttgtgacttaatgcttctaggtt

SEQ ID NO: 6813016 - DNA, 55 bp, Homo sapiens
tctgtcaaatgagcaagtaactcttagaacctgaaatacaagcttttttggcagg

SEQ ID NO: 6813017 - DNA, 92 bp, Homo sapiens
ctggtttgcgccgcccggcatcgggatccgggacctctgcccgccgggcgctgcctgcgcgttcctggaactgggctgggcggagaaatcag

SEQ ID NO: 6813018 - DNA, 87 bp, Homo sapiens
acacagcatctgtgattaaatactagttattaaagcttttgaaatatcatccaattgctttagttaccatagtgcaccatgctgtgt

SEQ ID NO: 6813019 - DNA, 82 bp, Homo sapiens
tgtttctaggtttatgtggtcattgacatatttgtatataagcacgctcatctgtaaatggtcagataaacctaccgaaata

SEQ ID NO: 6813020 - DNA, 84 bp, Homo sapiens
gctgtctacagtgatgagggaattttgtgcactccacattgctttccagtactagtgccatagacattcagcactcactacagc

SEQ ID NO: 6813021 - DNA, 86 bp, Homo sapiens
tttggaaggctgaggcgggcgcatcacctgaggtcaggagttcgagaccagcctgaccaacgtggtgaaaccccgtctcttctaaa

SEQ ID NO: 6813022 - DNA, 60 bp, Homo sapiens
tcagtttaggacagttttctgtaatctagctattgcaaataactgtactgaatattctga

SEQ ID NO: 6813023 - DNA, 59 bp, Homo sapiens
ggtgaggcttggcaaaagagtggtatagccatggcttaatcacagatcttcccagcccc

SEQ ID NO: 6813024 - DNA, 80 bp, Homo sapiens
cagcgatgtctaaactaaattcattaaatcggtggaaatccttatgaatacccaagcaatgatttagattagcgtagctg

SEQ ID NO: 6813025 - DNA, 83 bp, Homo sapiens
tattgaggtagatcagaagtggttttcagtgtctcgtaaaaagtcaaaggtgccctgtataacatcttttgtttcccttaata

SEQ ID NO: 6813026 - DNA, 97 bp, Homo sapiens
ggctgattgtattagcacgtacttcctctttcctcccaccatcattaagacgaggtccaggaagggtggatagtaacgtgactttctatggtctccc

SEQ ID NO: 6813027 - DNA, 64 bp, Homo sapiens
ggatgttagaacactttggaagctctgaattttaaaaatttgaaagtgttgatatgtgacatcc

SEQ ID NO: 6813028 - DNA, 80 bp, Homo sapiens
gtgctcctcctggtgtcgcctggtcagttagcttcatctacaattgcatatgtaacttctaggctgcacacggcatgcac

SEQ ID NO: 6813029 - DNA, 64 bp, Homo sapiens
gggaagttctgatatttgcaggtaccatgttatcaaggtttttgtacatgtaagattgcatcct

SEQ ID NO: 6813030 - DNA, 58 bp, Homo sapiens
ctgaaacctggctggccaggtatggttaaagtaaatatgccttccagctccttttcag

SEQ ID NO: 6813031 - DNA, 62 bp, Homo sapiens
cctctcagaagtttatgtcagaagttggaaactcccagttctaacattctacttttgactgg

SEQ ID NO: 6813032 - DNA, 67 bp, Homo sapiens
caggcagctgtgccttgctgcacggtggctgcacctggcccctgcagtgctccgccagccccgcctg

SEQ ID NO: 6813033 - DNA, 68 bp, Homo sapiens
tgtggtcaaggcaatctcatggcttcttgtttgggtgattgagaagataaattgagattgggaccaca

SEQ ID NO: 6813034 - DNA, 68 bp, Homo sapiens
gcattaaaatcatcttcatcttacacagacagaaagtgatgtctgtaagggaaggtgatttgcactgt

SEQ ID NO: 6813035 - DNA, 58 bp, Homo sapiens
caccaggtggaaatgtcacagcctgacccagaggctggccccagagtttcacttggtg

SEQ ID NO: 6813036 - DNA, 60 bp, Homo sapiens
ttttatttataagccacttgctgcatgaccctccaagtagacctgtggcttaaaataaag

SEQ ID NO: 6813037 - DNA, 82 bp, Homo sapiens
gggttcttatcaagcttacggtcatacagctaggggatcgaagaacagggatcccagcccagatttgtgtgactgtaaaccc

SEQ ID NO: 6813038 - DNA, 105 bp, Homo sapiens
gggatggaggaatgagtccgcttacattcctggaggtttttcggcataggagaggtttatgtcctggtctagcttccgggagagaagtgcctcattctatccccc

SEQ ID NO: 6813039 - DNA, 64 bp, Homo sapiens
ggctccttgcagaaatctccaaggctcccctatgcctgggaaggctctgatttcttgcaaagcc

SEQ ID NO: 6813040 - DNA, 63 bp, Homo sapiens
gctctgctgcccaggcctgctaggcctgcacagggccatggcgggggtccctggcggcagggc

SEQ ID NO: 6813041 - DNA, 71 bp, Homo sapiens
aggggaaggaagaggctggtagtgcccgtggccctggcgggactggctttgcctctgcctctcagttccct

SEQ ID NO: 6813042 - DNA, 61 bp, Homo sapiens
cagatggcagggcagctctgcaggtaacttctggcgccgtctgctgctgcctccgcctctg

SEQ ID NO: 6813043 - DNA, 64 bp, Homo sapiens
gcttttaaagttgttcttggcaaaggggttagtctaaagcaaactagttgccatgaataaaagc

SEQ ID NO: 6813044 - DNA, 70 bp, Homo sapiens
aagagactggagttacgagttcattttcctcttgttactgaggggtctgggccagggagtccggtttctt

SEQ ID NO: 6813045 - DNA, 80 bp, Homo sapiens
acgttacttcctggaggaataagttttccacagaaacattttgcataattggaaaacttctcttgagtgaggtattatgt

SEQ ID NO: 6813046 - DNA, 61 bp, Homo sapiens
tccttgcctttttcatctcctccaggaagcccatgagcctccagaggcaaaaaggtatgga

SEQ ID NO: 6813047 - DNA, 94 bp, Homo sapiens
ccagctcaattggaagaaaaagcagatgaaggcctgaatgtctactgagttttcagtgacttcctcaaacttctcacttacctttcagtgctgg

SEQ ID NO: 6813048 - DNA, 66 bp, Homo sapiens
ggtaacttagtaaaataccttttgatgattagcctcattaggaatattttctgagtagtttgtgcc

SEQ ID NO: 6813049 - DNA, 78 bp, Homo sapiens
gtgtgtgtgtgttcagagatagatatagacatttggaggatatatttgtgtattttgtgtctcaggacacataatcac

SEQ ID NO: 6813050 - DNA, 65 bp, Homo sapiens
agcacagcaccatcctggtacccttttttcagctacactctggataccagtcctgtgtttgtgct

SEQ ID NO: 6813051 - DNA, 84 bp, Homo sapiens
aaggagaaagaaatggctcctcgtaagaatatgatattttcccctttccaagaaaatagataatgccagggtcactatctcctt

SEQ ID NO: 6813052 - DNA, 60 bp, Homo sapiens
gccttctctctttctgacctgagcttgacctcacctcatcataggccctagagagaaggc

SEQ ID NO: 6813053 - DNA, 60 bp, Homo sapiens
ggttcagcagcatttaaggatccaagtctcttggatttggtggtttggatgtgtgtaacc

SEQ ID NO: 6813054 - DNA, 67 bp, Homo sapiens
caccttgaactaataggtatcttgtactgaattttcccctcttcagtactgttagttattcaaggtg

SEQ ID NO: 6813055 - DNA, 58 bp, Homo sapiens
tcttcacatggaacatgaagctaatgacctctgcttctatttcttagggatgtgaaga

SEQ ID NO: 6813056 - DNA, 72 bp, Homo sapiens
gcatatcaatagctgggacctgaattagcaccatatggagcagagttctcttccagctaaccaagggtatgt

SEQ ID NO: 6813057 - DNA, 59 bp, Homo sapiens
tatcatggtgaatttctctgggctcgtgggttaggggtcacagtggagccaccaaggta

SEQ ID NO: 6813058 - DNA, 55 bp, Homo sapiens
aggcctgacttgaatttagggctgcaatcagatgcactgagatcaatgttggcct

SEQ ID NO: 6813059 - DNA, 67 bp, Homo sapiens
cagttagtgtcatgttaacaaagctctgggacatatcttcaggccaaggtagacatgactgaggctg

SEQ ID NO: 6813060 - DNA, 68 bp, Homo sapiens
tctcttcatttctataccatgctagagactctcaggcatacatgaaaaggtactgactggtggaggga

SEQ ID NO: 6813061 - DNA, 64 bp, Homo sapiens
ggaggagggggacgtatcctggtatgaagctgcaggtggtgtgcagaatgcttcccccaccgcc

SEQ ID NO: 6813062 - DNA, 63 bp, Homo sapiens
ttggcaaatcctagctatcacggctttattctctcaaagagtcagtagtgaggtatttgccaa

SEQ ID NO: 6813063 - DNA, 56 bp, Homo sapiens
cccggcctctgcctggtggcctgagagctgcgggctatggctggccagggggcggg

SEQ ID NO: 6813064 - DNA, 66 bp, Homo sapiens
ctgagcgagagaagcacatgatgccactggaaattgataaaatcttgtataacttctctccctcag

SEQ ID NO: 6813065 - DNA, 95 bp, Homo sapiens
gtaattcccctctgacacatattatgcttctgaagaagaaaagaccttaaacagagtcatttctttaaacagagctgctgagtatgtcaaattat

SEQ ID NO: 6813066 - DNA, 100 bp, Homo sapiens
acaaacacacttaggttaattaaatggtggtcattcattttttggtagatatcttccctgagaagactgcatcatatttggtaaactgcaggatgtttgt

SEQ ID NO: 6813067 - DNA, 58 bp, Homo sapiens
ggagaccttaaggtgcttcctataagtctggcttttgaggaaatactctaaggtctcc

SEQ ID NO: 6813068 - DNA, 130 bp, Homo sapiens
agtgacaagaatgaagtggcaagggtgtgaccccactgcaaaggggaaagaagcattattaaaattactgctacctagtgcttctctttatttgtaggttttcacattgagtgttatattctttgttatt

SEQ ID NO: 6813069 - DNA, 89 bp, Homo sapiens
gaagttacgttttagatgtactttgttttcatgaaacagctctaagagatgttgttaaatgaaaaaagcacacgataaaaatgtaactc

SEQ ID NO: 6813070 - DNA, 78 bp, Homo sapiens
gacgtttagtatcacttagcctcatccactggctgccaggatgacagttaatggatgcggctgcgtgaccgtgatgtc

SEQ ID NO: 6813071 - DNA, 55 bp, Homo sapiens
tctactctggtggggacctgccatcttggttggcaagaagcccttcctgggtgga

SEQ ID NO: 6813072 - DNA, 66 bp, Homo sapiens
gcagagactagtagtgcagactgcccagggtaatttgggtctggttttccactcatgagttttggc

SEQ ID NO: 6813073 - DNA, 83 bp, Homo sapiens
gcaaattgttttctttctatgtcccttttatttccagttgaataagaattctttgggctcagagagggaggagagcaaaatgt

SEQ ID NO: 6813074 - DNA, 82 bp, Homo sapiens
caagcaggagctgaggacctactgtgtgcccagcatgcagctggctgtgatggagctgcataggtcactgctctctgtcgtg

SEQ ID NO: 6813075 - DNA, 86 bp, Homo sapiens
ggggagtgtcaggaggagtcagaccctgctgagctatagacaggcccagctgtaacgggtctgcacctctcttcctgcccttcccc

SEQ ID NO: 6813076 - DNA, 58 bp, Homo sapiens
ttgagtgacttcaaaattcagttagacaaaacagacagctgagttctgtggttctcaa

SEQ ID NO: 6813077 - DNA, 73 bp, Homo sapiens
taagatcaaagaagagatgtgggctgctgtgcattgtgcatgccagtgtatttagtccagtctctcatgctta

SEQ ID NO: 6813078 - DNA, 59 bp, Homo sapiens
tgttaggtccttgcatccatggtgctaaatgagtatgagaagatgtcaaggactggaca

SEQ ID NO: 6813079 - DNA, 68 bp, Homo sapiens
cgaggaagctgaggcccatggcaaggtagtctttaaaagacactttgttttcacgcttcatttctttg

SEQ ID NO: 6813080 - DNA, 84 bp, Homo sapiens
attctattttcccattgtgctttcattcaatatagagcttaacagctgaagcaatgtatgttgtagagggaatggggtcaggat

SEQ ID NO: 6813081 - DNA, 127 bp, Homo sapiens
ggggcagccattagaaatgaactcttctggtcccatgttgatctttgggttggggtactaaaaaattaactcttaaccatgagcagtgaaaacatgtcatgggaaggcctcgctatgggcttgctct

SEQ ID NO: 6813082 - DNA, 73 bp, Homo sapiens
ggaagtcagagaggctgtaagtgtggagcctaggcctgaatgagaatcctgggcctcttgctctctctgctcc

SEQ ID NO: 6813083 - DNA, 119 bp, Homo sapiens
ctcataagaagggaacggtctgggattggtgaatcctcaggtaatttaaaatactcctaatgtttagtgtttcaaattacttgaggattcaccaatcccagacctttcccttcttaggg

SEQ ID NO: 6813084 - DNA, 69 bp, Homo sapiens
cctttattttactatgacgggaagtcttcctattcttaaaagattagcctgctctttagtgaaagatgg

SEQ ID NO: 6813085 - DNA, 114 bp, Homo sapiens
ggggcctctgaatgggaggaaatcaggacaacaatatgctgagtttttcaccactggctgctgggcaattcaggatattgagccctgtgtgaccttcccaacagaaaaatcacc

SEQ ID NO: 6813086 - DNA, 65 bp, Homo sapiens
ttgggcttggtcggtttgaggctttttctctcccattgacaattgtctcgagacctgacccccaa

SEQ ID NO: 6813087 - DNA, 72 bp, Homo sapiens
tgaaaagcatatgcttgcttggtgctaatgacgttttacagtcttatagatgaagcaacatgtgtaatttca

SEQ ID NO: 6813088 - DNA, 84 bp, Homo sapiens
gagctaacatcaaagggggagaggtgtttggatgcttagagagccagcctccgcacgtttctcatcctccattgaatgcagctc

SEQ ID NO: 6813089 - DNA, 72 bp, Homo sapiens
ggcatgagaacttacacatcattcaatggtgatattaataataattcagtaatcattaatgatgtacatgct

SEQ ID NO: 6813090 - DNA, 55 bp, Homo sapiens
tccaatctcagcagaatactgtgtcccctatgggattacttattcactaggtgga

SEQ ID NO: 6813091 - DNA, 60 bp, Homo sapiens
ccaaggcccatagtttacattaagattcactcttgtgttgtacattctatgggattttgg

SEQ ID NO: 6813092 - DNA, 63 bp, Homo sapiens
gtctatttgggatcatgatatgggagccaacttggaggggctctgacagaccacagatgtgac

SEQ ID NO: 6813093 - DNA, 64 bp, Homo sapiens
ttcctcatgcttgttctcagctcaaatttcatctagatgtttcagagttagtagagcatgtgaa

SEQ ID NO: 6813094 - DNA, 62 bp, Homo sapiens
ccaagaaagcctccttggagcaccctggactggcctgggatcagttaaggagagttttacgg

SEQ ID NO: 6813095 - DNA, 61 bp, Homo sapiens
ctgtggctatggtgtacatactttctgatttatctcaaacagtcgtgcataatagttatgg

SEQ ID NO: 6813096 - DNA, 59 bp, Homo sapiens
tgtgaccttatttggaaatagggtctttgcagttgtaatcaagttcagatgaggtcaca

SEQ ID NO: 6813097 - DNA, 65 bp, Homo sapiens
ggaggccatcagggagggcattatgctttgcagtggcattgcagctgcctttccttgtggcctcc

SEQ ID NO: 6813098 - DNA, 61 bp, Homo sapiens
aatgcagcttcttgtatgaagttagagctactctgggttttaaaaagtatagaagtttatt

SEQ ID NO: 6813099 - DNA, 68 bp, Homo sapiens
agccctgataggagggtgacctcagggttcaaagtcactgctgggtcccaggtccctccctcgaggct

SEQ ID NO: 6813100 - DNA, 84 bp, Homo sapiens
gttctgaccttggttgagcttcctaatcagctacctcttgaaccaaaggagaaataagaataggaagtcacatcaagggagagc

SEQ ID NO: 6813101 - DNA, 58 bp, Homo sapiens
tctctgtgtgtcatggacaagtgtcatacatagtgatttgcacagaaaaccatagaga

SEQ ID NO: 6813102 - DNA, 60 bp, Homo sapiens
aagccgggcctgagaaatgacagcagcttcctcctgcggtttattcttcctgccttgctt

SEQ ID NO: 6813103 - DNA, 79 bp, Homo sapiens
tggtgcttgagatggtgaagaagacagcacacgcatttacacagcattgatgtttctgctgctcttcactgctttacca

SEQ ID NO: 6813104 - DNA, 84 bp, Homo sapiens
gcaacagtcacgccctttttctctagagtagctgattggctctaggcttagcacttgcttcagagacagggctcacactgttgc

SEQ ID NO: 6813105 - DNA, 56 bp, Homo sapiens
aggattggctttggaggcggcggtcctcactcagacctgtgcctcctgctagtcct

SEQ ID NO: 6813106 - DNA, 56 bp, Homo sapiens
ctgctgcattcctctttatgagccttctctggggtgcttaaggtacaatgcagcag

SEQ ID NO: 6813107 - DNA, 62 bp, Homo sapiens
gcagagccaggagcccaggatccagcgcactgggcaccgacctgggacctggtcatctttgc

SEQ ID NO: 6813108 - DNA, 130 bp, Homo sapiens
gagatgaaagctgcccaggatggggattacagcagtgcccgagcgctcttcattatcgagacacttctggaggtgacggggcctcgttgtaaaatgcctattttcccatattttccagtctcaaaagctc

SEQ ID NO: 6813109 - DNA, 55 bp, Homo sapiens
gcctggagagcactgtgcgcttgctgcacagaagtacactgcagagtctccaggc

SEQ ID NO: 6813110 - DNA, 64 bp, Homo sapiens
ggcagaggagtgggccgttatggtatgagccacttagccgtggccagagcccagtctctctgct

SEQ ID NO: 6813111 - DNA, 82 bp, Homo sapiens
tgtgaaagtacttaatgccactgaattgtaaacttaaaaatggttaaaaaggtacattttaggtattatatattttatcaca

SEQ ID NO: 6813112 - DNA, 74 bp, Homo sapiens
attcaggtattgcctaaggagataaagtggaaaacagttaattacctcctttgacttctgggcagcacatgaat

SEQ ID NO: 6813113 - DNA, 129 bp, Homo sapiens
tttctccccaataccttctgccaggggtggaatcactggtttccaggagaaaagagctctgatcaagcaatttctcctccagagagacacaggccaccccattctgcacagttggtacaggatcagaaa

SEQ ID NO: 6813114 - DNA, 67 bp, Homo sapiens
ctggatagattaatcctgactcgaggaatatagggtgatttcttgaaagaggcaaagtttgatccag

SEQ ID NO: 6813115 - DNA, 72 bp, Homo sapiens
ctctatgaaatagagctgggttaaactttgtcaccaacaatgggtttctgtcccagctctgccactatagag

SEQ ID NO: 6813116 - DNA, 58 bp, Homo sapiens
gattaagggttcagaatgcagtggtagcctgctactctggccatcttggaccttgatc

SEQ ID NO: 6813117 - DNA, 59 bp, Homo sapiens
gctgtttgcccccactccttcagtgcgacagacagcctcagagctggtggggagacagc

SEQ ID NO: 6813118 - DNA, 80 bp, Homo sapiens
gttctgctccctgcctgctgtagcggcttcacttttgtgatgtgatgagctagcaaatagcatgtaggaaggtactgaac

SEQ ID NO: 6813119 - DNA, 96 bp, Homo sapiens
cttgagcaggtttcttcatctctctgtgttccaagtctccatttatgaaactgggatgacttctgctttacagagttgatatgaggcttgcatgag

SEQ ID NO: 6813120 - DNA, 63 bp, Homo sapiens
tacaggtttacgcacttcctgtctgtctcctctatgagaatggagtctgcggcagacactgta

SEQ ID NO: 6813121 - DNA, 91 bp, Homo sapiens
gtagaagagagaatgcaagcatcttgagagtcagggactacatcttagatacatttgtttccttcatgatgcttagcagagcttcttgtac

SEQ ID NO: 6813122 - DNA, 56 bp, Homo sapiens
ggcttagtgtttctgctcagccttctttcttggaggcctgggcttgatgttgagtt

SEQ ID NO: 6813123 - DNA, 129 bp, Homo sapiens
tcagtcttcatggagcatactgaagcacatgtttgtaagcagtctgcttgtgacaatatcataatattggatacagtaaccagtctacttagaaaaagtgtgcccttcggttaactggaagataactgg

SEQ ID NO: 6813124 - DNA, 76 bp, Homo sapiens
cagctggaggcctttgtggagctcatggcagggtcagctttaatcatcagccaggctgctccagggaggccagctg

SEQ ID NO: 6813125 - DNA, 60 bp, Homo sapiens
atttctccaaggttctttgtcatgtgttacatgttacaactccctgaacctcggagcaat

SEQ ID NO: 6813126 - DNA, 106 bp, Homo sapiens
tccccaggttcccagtaatggccacgtttgaggcaacctctcaggtactgatgtatgtgacctacagcagactgaaggttgtgttaggtcctgagggcttgtggga

SEQ ID NO: 6813127 - DNA, 60 bp, Homo sapiens
gccactaactagtgcacattgtttctcaatgtgccattgagacacaaggcacagtaagtc

SEQ ID NO: 6813128 - DNA, 63 bp, Homo sapiens
ttctgattcattctcagtttctagaggaaagtatttattttctaaggatgagactgaacagaa

SEQ ID NO: 6813129 - DNA, 68 bp, Homo sapiens
tgcaccatttccaactacccctccatttgggagcactaatccaagctggagagcttgaaagtgatgca

SEQ ID NO: 6813130 - DNA, 90 bp, Homo sapiens
aatctctgtacatgttaatcttaagtttagatttctctatatctggtttcctaagaggaggagagaaaactcattgaggtgtcaggggtt

SEQ ID NO: 6813131 - DNA, 62 bp, Homo sapiens
aagattcctcttaatgaggctgacttgtatttttacaaagcaaatcatctaagagagatctt

SEQ ID NO: 6813132 - DNA, 61 bp, Homo sapiens
cagtcacacaagtggacttggggtcagatcctccagcccctcccaagtctcctggtggctg

SEQ ID NO: 6813133 - DNA, 129 bp, Homo sapiens
cagttgaagggaaaagcgggatgggtttcgtgcctctggcagcgaagcgtgtacttggtctaagatcttgagcagaaggtaagagcgtgttgccaaagcagagctcagtgctcccgatatatcttctgg

SEQ ID NO: 6813134 - DNA, 55 bp, Homo sapiens
accacagtctcgaagcactgcaggaaaggtccactgcagtgtccctaacagtggt

SEQ ID NO: 6813135 - DNA, 57 bp, Homo sapiens
ggcttctcgtgccgaagcaagatctgcatgattatgctgccaagcacgagttgagtt

SEQ ID NO: 6813136 - DNA, 110 bp, Homo sapiens
ttcacaaacatttattaaactgcttctatggtctagatgattcaaagtggtattaggcaatacttctgtcatcaaggagtttttggtctagtggggcaggatggggtgag

SEQ ID NO: 6813137 - DNA, 95 bp, Homo sapiens
ttgttgtgaggggctgtcctgtgcgttgtgaaatgtttagcatcattcttggcctctgctcactaaatgccagtagtactcccctcgttgtacaa

SEQ ID NO: 6813138 - DNA, 60 bp, Homo sapiens
ggcagaggaaggatgaattcacttcctttttttgagctaggatatccatcttttcctgcc

SEQ ID NO: 6813139 - DNA, 67 bp, Homo sapiens
attcctacatatagtcaaattacattttacagtatatgtcaaatgtagttgactgtgctgtaggaat

SEQ ID NO: 6813140 - DNA, 62 bp, Homo sapiens
tgtgtggggagagaatgggtcttggcctcctcagaggagcaaacctgttctccccacatgca

SEQ ID NO: 6813141 - DNA, 91 bp, Homo sapiens
attcaagttaatctggacccttagaatgtgatcttatgttagaaatagagtccttgcagaggtcactagttaaggtgaggttatactgaat

SEQ ID NO: 6813142 - DNA, 72 bp, Homo sapiens
aagaatactatgttgtgacacatgaaaatcatatgaaatttggatttcagtgtctatagataaggttttctt

SEQ ID NO: 6813143 - DNA, 72 bp, Homo sapiens
cccattggtcatcatgcttgggtctagctctggtcctgccactaactagctgtgtgatgggaaacctttggg

SEQ ID NO: 6813144 - DNA, 111 bp, Homo sapiens
catgtaaactaagatacatactttatcagcgtcaaaggtacttctcctctaaacagagtaggagataacaatacctttgacgttgataaagcacgtatcttagttgatatg

SEQ ID NO: 6813145 - DNA, 56 bp, Homo sapiens
cccagcactttgaatatgtcaccctacttcctttggcctgcagagtttctgctggg

SEQ ID NO: 6813146 - DNA, 116 bp, Homo sapiens
cccttagttcaacttatttcttggcttctgaacaatagtggtaacaaagcccacaggaaaatttggccttccagacacattgttgtgatgattaggaaatatgctagaactgatgg

SEQ ID NO: 6813147 - DNA, 81 bp, Homo sapiens
taggcgtgatgtgctgctgtatctgccttgctgccttctcctgagtggaagctgcagctacagtgttggttattacacctg

SEQ ID NO: 6813148 - DNA, 108 bp, Homo sapiens
cttccttagaggacttatcactgggccatcctgggaagcatgttgtcctatggaagattgtgaccgtgggcagacagtgctttgcagctgaggcagtccctgatgagg

SEQ ID NO: 6813149 - DNA, 55 bp, Homo sapiens
taggcaggtgtgcactgcccactggcgcagggctgtgggtacctgcacctgtctg

SEQ ID NO: 6813150 - DNA, 72 bp, Homo sapiens
gactcatcaggattcaccccagagctgggaatactatctctttccttgtggggtggatacctgggtaaagtt

SEQ ID NO: 6813151 - DNA, 129 bp, Homo sapiens
gtctcacgagtatacaatggagttttccagaagggacaagacatgtgatgacatcatcactctgatgactgttggaatgcatgcttgtgtactcccatgttttggacacatccgttttaattctaagat

SEQ ID NO: 6813152 - DNA, 79 bp, Homo sapiens
aggaagacaaggaaacggatttgggttaggtcaccactgggaccactgtggagaattaggccaaatctccatggttcct

SEQ ID NO: 6813153 - DNA, 88 bp, Homo sapiens
gtatcattaaatcaccattgcctagaaaaattcctggtactcagccaggtttttaatcctctggaagcactgacatttaagtgattac

SEQ ID NO: 6813154 - DNA, 72 bp, Homo sapiens
gccagggcttggtgaccgattagcactagagcttaggggaagaaaggtgctgaggacacctagccttctggc

SEQ ID NO: 6813155 - DNA, 61 bp, Homo sapiens
tccaatgacaggtgaaaggattggtcttaatagaagagacacttcacccattgtgatagga

SEQ ID NO: 6813156 - DNA, 70 bp, Homo sapiens
acttgtgttccagatttagccaaccgaagatggcagtttctataagtctttggcatttaggagcaggagt

SEQ ID NO: 6813157 - DNA, 56 bp, Homo sapiens
agctgcaggtggacccgtaccggctgaagaatgggcggggcatcatcctgctggct

SEQ ID NO: 6813158 - DNA, 64 bp, Homo sapiens
aatagtcatccagaaagattacagaatgtggtaccactgtggttttaactaatggaagactttt

SEQ ID NO: 6813159 - DNA, 105 bp, Homo sapiens
aggaagagtttttttggcctctctggaaagatttacacggggaaagaatgttctcttcctcattttgttaattttacatcagcaaccagaatgaatctctcccct

SEQ ID NO: 6813160 - DNA, 55 bp, Homo sapiens
gcatagtctgatggtttgaaatatatcgtgtaactttctaaactgttaggcttgc

SEQ ID NO: 6813161 - DNA, 73 bp, Homo sapiens
tgaagaagagtgaggcaagttggggaaactctctcagggtttcattttccagtttgccttagataattcttta

SEQ ID NO: 6813162 - DNA, 57 bp, Homo sapiens
gcccagcccctgggtggacgtgttgggggtgacccctcgttttcccagggttgaggc

SEQ ID NO: 6813163 - DNA, 55 bp, Homo sapiens
tcttaatgccaacaaagtgatttttatataaaaataagcagaattggcattagga

SEQ ID NO: 6813164 - DNA, 56 bp, Homo sapiens
gtgcccctttgcctgatttaaatatctactcaatattttcctggcaacaggggaac

SEQ ID NO: 6813165 - DNA, 79 bp, Homo sapiens
aaagtgtgagctggaaaggtaggatttcaagaccagctgagtctataagaggtcatcaaatctacctgctccccacttt

SEQ ID NO: 6813166 - DNA, 103 bp, Homo sapiens
acacccagcctgggttctgcacctcacctccaagtccgagggctctcaaggtgagtgttttgcttctctcagacttggggggtctgaggacaaggctgtgtgt

SEQ ID NO: 6813167 - DNA, 56 bp, Homo sapiens
atatagacactgaaatccctgccaacccagtttgcatgacaatttcaggtctgtgt

SEQ ID NO: 6813168 - DNA, 63 bp, Homo sapiens
gcagagtttaattaagtgttgtgagcagcctagtgagaaacacactttaaattaaacctctgt

SEQ ID NO: 6813169 - DNA, 97 bp, Homo sapiens
atattaataagtgcatgcttaaacaactgttttttaagtctgtccctagcatatagggcagcatttgaaaaacagatgttaagaaggcaattaatat

SEQ ID NO: 6813170 - DNA, 100 bp, Homo sapiens
ttcatgaaatttcttcttctgtctaatcttgcctcatcaagtctcttcaaaaccaaatctaaaagagccagatgcaacaggaagaagaggactcatagaa

SEQ ID NO: 6813171 - DNA, 70 bp, Homo sapiens
agcatttagcagcccagtttctggccaatgtgtgtgcaagttggttttgtagtgactgggctgttaagct

SEQ ID NO: 6813172 - DNA, 65 bp, Homo sapiens
tccttagcaactgtcatagagcatgacacattataaccatgtttttaaaaaagtttgttgagtga

SEQ ID NO: 6813173 - DNA, 78 bp, Homo sapiens
tgtttctgtcagatggcgagcatccagcgcatccagaaatcactggagccaggtgtgtttgtggtagatgcaaaaata

SEQ ID NO: 6813174 - DNA, 125 bp, Homo sapiens
agtgcagatgcagaagggctgtcatccagcagaggggtaggtgacaactggcctagcgagtgacccttatcatggctacatttgttgatcactttctttgtatgaggcactgctgtgattgcatt

SEQ ID NO: 6813175 - DNA, 64 bp, Homo sapiens
tgtcttcacatgataagccattcctatcagagaaataaaacattagggaggcattttgaagaca

SEQ ID NO: 6813176 - DNA, 76 bp, Homo sapiens
gtgcaccgtgcgcaggagctctgccaggagatggaaaacaagctccttcacgcaggctgccatgtccgtggtccac

SEQ ID NO: 6813177 - DNA, 130 bp, Homo sapiens
ctttcttcttcttcttgttataattgtgcttttcccagccagtcatgaggtttctggctgctgggtttcacagatgccttggccaacaccttgcaaactggctgaagtgccctgtctgacacggagaaag

SEQ ID NO: 6813178 - DNA, 58 bp, Homo sapiens
gaggatgctccataaacactctgggatgactgcagaatgagtgttctgagtactcctc

SEQ ID NO: 6813179 - DNA, 57 bp, Homo sapiens
tgtcaggcaggtcattaagcattttatatacaattgattcttttgataagcttgaca

SEQ ID NO: 6813180 - DNA, 112 bp, Homo sapiens
ggagggatgggtgggagtgccatagtgggtggatagagcagccgccccaggcagaaggttgggcaggctggctttgttccaggtgaatcccaggacttgcggacatccttcc

SEQ ID NO: 6813181 - DNA, 79 bp, Homo sapiens
gtgctcctatctggtcgcaggtactgaaaagcatccaggctatgctttggagtatggaggtgacacaggaagtgagcat

SEQ ID NO: 6813182 - DNA, 86 bp, Homo sapiens
gtttttctatgaacagctttgtatacagtaactcaattttgaggtcttgagttctgtgcaccagatgcttggaatcatagaagaac

SEQ ID NO: 6813183 - DNA, 65 bp, Homo sapiens
tcattgctgccactggatatttcattccttggataatctcattttgaaacattggcagcaactga

SEQ ID NO: 6813184 - DNA, 69 bp, Homo sapiens
ctctatggagactttaaaaagggcaaataggccataatcccagcccttgcttatttatagtcaatagag

SEQ ID NO: 6813185 - DNA, 70 bp, Homo sapiens
tccatctggacctactaattgagataataggtcagggagacctgggtctgtattggtaggtatgattgga

SEQ ID NO: 6813186 - DNA, 89 bp, Homo sapiens
atagaaatcattattgtctaggcttttggagaagcatatgctgtgaaaatgatcacggctgtgctcctaaaagccagtcatgtttctgt

SEQ ID NO: 6813187 - DNA, 113 bp, Homo sapiens
tccttggcctggctgcccttcctgggaggctgtgtacttgcagcaataacgatgactcgaacaacgtcagcaactgcagctgcctcccggggagggcctgcgccagccagggg

SEQ ID NO: 6813188 - DNA, 129 bp, Homo sapiens
gctggggccccaaattgttggtcttctctggactttgggctcttctgaagaggttatcatagagggctgctgtgccctctgggtaggaaccttcagatgaggctgctgctgaggacctgggcacctggc

SEQ ID NO: 6813189 - DNA, 99 bp, Homo sapiens
gaggcaggagagtcgctggaacctgagaggcggagcttgcagtgagccgagatcgcgccactgcactccagcctgggcaacacagcgagactccgtctc

SEQ ID NO: 6813190 - DNA, 65 bp, Homo sapiens
catctaagaaagtattgttttgtggtccaaacctgttgccgtggttagtaaggctttcttaggtg

SEQ ID NO: 6813191 - DNA, 61 bp, Homo sapiens
agcaggacagggcaggtaccgtgctaaaaacccacctcggtcctgctgctcctgtcgtgtt

SEQ ID NO: 6813192 - DNA, 62 bp, Homo sapiens
gtatctgtatgtgttttttcctgaacaagaagtatatggattgactgaacatgtggagatat

SEQ ID NO: 6813193 - DNA, 85 bp, Homo sapiens
tcccatcagatgttcagcatagcagcttcaggactatcatctaagggaaggcggaagaagctggttatgttggtgtctgatttga

SEQ ID NO: 6813194 - DNA, 99 bp, Homo sapiens
ccagcaggtggtctgcagagagacccctgggccagcacaggttgaatcaattgtcactgagcagtagagggtctctttaggacacttaggtctgtctgg

SEQ ID NO: 6813195 - DNA, 83 bp, Homo sapiens
ttttttcaaatatgattgtccttagcaaattatattttattttaacagtggcaatttgagggcacaattttgctttgaaagaa

SEQ ID NO: 6813196 - DNA, 69 bp, Homo sapiens
taaagtcaaaatatgggtaggcattgaaggtcttctactctctggatcctacctaatattttaacttta

SEQ ID NO: 6813197 - DNA, 61 bp, Homo sapiens
atgaaatgtttctgagtgtatatacatacatatgtatgtgtatgcatgtgaaactgattat

SEQ ID NO: 6813198 - DNA, 68 bp, Homo sapiens
cttcatttggcaggctggcctcagcagcccggggtcgtctctctgtatccagctctgcaatgatggag

SEQ ID NO: 6813199 - DNA, 117 bp, Homo sapiens
ggttatgtctttgcactggtcttggtatcagaaacttgaacccagctcaggctttgctaataaagagctgtaagctttgggcaagtcatcttactttccattgtttcagatttattc

SEQ ID NO: 6813200 - DNA, 72 bp, Homo sapiens
gaagtggatatcagagacttggctaccaccaacaagcaactgtgaatgagtaacttctctgaatatctcttt

SEQ ID NO: 6813201 - DNA, 56 bp, Homo sapiens
gagccctggactttcctaaaaccgggaaatcccaggacaggactagaccagagctc

SEQ ID NO: 6813202 - DNA, 66 bp, Homo sapiens
tgctacctgcctttggggagttagagggcagtgagggtgcccacccctggacaggtgagtgtagca

SEQ ID NO: 6813203 - DNA, 79 bp, Homo sapiens
gggtcggtggctccatcctggcctcgctgtccaccttccagcagatgtggatcagcaagcaggagtatgagtcaggccc

SEQ ID NO: 6813204 - DNA, 104 bp, Homo sapiens
tcatggttgaaaattttgtccatgtgcttcctcaggggaacgatgactttctaatttattattcccttggctaatacatggtaaacaaattctaataacagtga

SEQ ID NO: 6813205 - DNA, 55 bp, Homo sapiens
tagcagcactatttgttgtagtgcagagctagatgcaatccacagaagtctgcta

SEQ ID NO: 6813206 - DNA, 64 bp, Homo sapiens
gtttatctgtttaacaaagtatctaacatagcaatcctgttagattctgtgggaaaaggtaaat

SEQ ID NO: 6813207 - DNA, 77 bp, Homo sapiens
taagggagatttcctttgggcactggagatggtggctgttgggccataatcatccagccccagaagggaggacctta

SEQ ID NO: 6813208 - DNA, 130 bp, Homo sapiens
ggtaaaaaaatctagtactaaagagatagcaaggtatgactggagcccaggccatctaactcagtccaggtctcttacattaggttttagtttttgtaactttgttctattatctatactcctcattatc

SEQ ID NO: 6813209 - DNA, 63 bp, Homo sapiens
ggccaggcagagccccgtgcagccatggagtcgctcctgctgccggtgctgctgctgctggcc

SEQ ID NO: 6813210 - DNA, 55 bp, Homo sapiens
gggacctgaggaggggtttcagcctggaggctagggtggcatcctgcccaggccc

SEQ ID NO: 6813211 - DNA, 117 bp, Homo sapiens
gcctttccaaaacctaagtctcttaacccagaagtccaggcctctttctaatggtgctggaggaatgattggcaagcctgagatccgggagtggagattatagggaacggtacaggt

SEQ ID NO: 6813212 - DNA, 71 bp, Homo sapiens
agaagcaggggctcctccacagccatgatgcaacactgaaagctgagctctgatgagggccaccttctttt

SEQ ID NO: 6813213 - DNA, 74 bp, Homo sapiens
gggtcctggtcaataaatactgtgaataaaggtttttaaaaggagaaaggaattctacagtgtattcaggatct

SEQ ID NO: 6813214 - DNA, 61 bp, Homo sapiens
ttcactggatcctagctgagccttgcaatgttctaggcactgggtacagatatgcagtgaa

SEQ ID NO: 6813215 - DNA, 57 bp, Homo sapiens
tcagaatgttcccagtctcagtacattctccccagtgatgctggagtgacattctga

SEQ ID NO: 6813216 - DNA, 66 bp, Homo sapiens
tcagttccagaggtagcaatgacttggagaataaatttggcagtggttcctgttcttctgggctga

SEQ ID NO: 6813217 - DNA, 74 bp, Homo sapiens
acttgaatctctcagcctcactcccttcaaagccaagtactgaagagactgtaaaggcgtgagtaggggcgggt

SEQ ID NO: 6813218 - DNA, 78 bp, Homo sapiens
gcctgtttcctaaatgtgctaatagcatgaaaatgacttatttccatgttctctgttgtgctatgctaagaaacaggc

SEQ ID NO: 6813219 - DNA, 76 bp, Homo sapiens
gcttagcaagctgtattccaagtcactgtgtcctggctaagccgccaagggcattgcttgggaccttgctataggc

SEQ ID NO: 6813220 - DNA, 55 bp, Homo sapiens
gtgggagctttggcatcaggctcatatctaaagatgagtttataggagttctcat

SEQ ID NO: 6813221 - DNA, 87 bp, Homo sapiens
gtggaatgaccaagccatatggtaggtatatgtttaatgttttaagaaaatgctgaactgttctccagcatggctgtaccattttac

SEQ ID NO: 6813222 - DNA, 72 bp, Homo sapiens
gccttcccccactggcccttaagtctgcttaataataagtcctttgcttctgtcattctcctgggggatggc

SEQ ID NO: 6813223 - DNA, 130 bp, Homo sapiens
tgaacgtttccaatgactcgctgggcctgtctacttagatgtcttaacaaagtaaagtcataatccttttgttctggagattgagaaggcattgctgagagatggttaaggagacaaaactgaggcttca

SEQ ID NO: 6813224 - DNA, 98 bp, Homo sapiens
ttcatttctaggtatgtttctgtgttggggtgaggcatatccgccaatggctcctgagaaacggcttccttctgaagcatagaagcaacttatatgaa

SEQ ID NO: 6813225 - DNA, 64 bp, Homo sapiens
gggctggaactcaggatggttaggatgcagctcaagccttgtggcatctctgggttctctgtcc

SEQ ID NO: 6813226 - DNA, 58 bp, Homo sapiens
gcctagttcacagtaggttttcagacagtgtttgaataaatgagcagtgaattaaggt

SEQ ID NO: 6813227 - DNA, 129 bp, Homo sapiens
tgtgccagggactgggccaggcagaggctggggtatccgttagtaagatgggcacggtccctcgctgcctgctctgatttttgccccagctctgagagcagattaatggtattgtaagtcctcattgta

SEQ ID NO: 6813228 - DNA, 59 bp, Homo sapiens
gtagaatattgagtggcagcctgactccctggacttcagagctgctcagatgtcactgc

SEQ ID NO: 6813229 - DNA, 75 bp, Homo sapiens
gccaagggcgggtgggtgggcgaagatgggggtcacagcctctctccctcccatccctcctccaccagctagggc

SEQ ID NO: 6813230 - DNA, 112 bp, Homo sapiens
gtcctggctcatggagacggtgcagatgggcatgctggagcgggcgcagtacagaaggcatgtgcccagcagcagcgtccccgtccatgcctggcactcgggcctgtgggac

SEQ ID NO: 6813231 - DNA, 77 bp, Homo sapiens
ggccccgccccggccttcacgtgacctggcgtgcggagcgcgcacgcgggaacccgcgctggaggcgggcgagggcc

SEQ ID NO: 6813232 - DNA, 68 bp, Homo sapiens
tgaaattagtgaagttacagttgtgtttcaaatgaattgagggacatggtttggcagcattaatatca

SEQ ID NO: 6813233 - DNA, 79 bp, Homo sapiens
tttcaggtcataggttcaaaaggcagatttcaaatcttatatttgttaatatcaatgctgtgaatttgctgaaatgaaa

SEQ ID NO: 6813234 - DNA, 79 bp, Homo sapiens
gaagattttgacactggctgggccagcactcctgggtgccatcagtgcccaactctggtccaggctagtgcccatcttt

SEQ ID NO: 6813235 - DNA, 55 bp, Homo sapiens
ggaagttgctgttccaagggtataatgtttcagttatacaagatgagtaatttct

SEQ ID NO: 6813236 - DNA, 58 bp, Homo sapiens
tcccagagctgataagcctttatctgtaaaatagaaagaacaggctggctcacaggga

SEQ ID NO: 6813237 - DNA, 75 bp, Homo sapiens
aactggtaacgccttctctcaaagggttaggttatcattagctagtaaaatgctttgagggaagatgaaaaagtt

SEQ ID NO: 6813238 - DNA, 60 bp, Homo sapiens
ggctctgacctttcttccaactgccagaaacactcactggctctgagaggttcagatgct

SEQ ID NO: 6813239 - DNA, 65 bp, Homo sapiens
ggagcactgccagtggaaccaccgagtgagcgccacttaggagtggattccacaggagctgcccc

SEQ ID NO: 6813240 - DNA, 62 bp, Homo sapiens
aaggcaaagaagttggtcaggagtgcaattcttttgtttacttttaatttccttctggcttt

SEQ ID NO: 6813241 - DNA, 76 bp, Homo sapiens
gtgatgtaaagtcctttgaaggcaaaaggagacatgcatatgatcttccaaaatgctttcaagttagttacgtcat

SEQ ID NO: 6813242 - DNA, 58 bp, Homo sapiens
gggactttgtctcctaagaactctcagagctgttgtggttgggagtggggaaggtcct

SEQ ID NO: 6813243 - DNA, 59 bp, Homo sapiens
ttttggtatattgtgatgaaaagtgcaaacatttactcaggcatctacaaatgccagaa

SEQ ID NO: 6813244 - DNA, 68 bp, Homo sapiens
ctgcactgccagatataaaaactgtgttacaaaataacagtaattaaaacagcgtgaatctggcacag

SEQ ID NO: 6813245 - DNA, 95 bp, Homo sapiens
gagagaattcaaagttcgaaatttagggagatggggcagagtagctaatttctggccaaaacatctttttatatttcttagcacagaaatctctc

SEQ ID NO: 6813246 - DNA, 57 bp, Homo sapiens
gtccctctgcaaagcctgtgctgaaggagacaccagctcagagcagttcagagggat

SEQ ID NO: 6813247 - DNA, 63 bp, Homo sapiens
ggttgcagagtgctgatttctcattgtatactcacatggttgaaagagagagagcatgccacc

SEQ ID NO: 6813248 - DNA, 81 bp, Homo sapiens
caggtctttcggccatagcgatgatttgggattttgtaccaagtgcaatgggaaagctattaaaggttgtttaaggatttg

SEQ ID NO: 6813249 - DNA, 56 bp, Homo sapiens
gaaggcacccggcgtgcggcggcgctgggttggaaccgccgactccgcgggtcttc

SEQ ID NO: 6813250 - DNA, 57 bp, Homo sapiens
gagcttcctcagcctttctcacccaggaccttaaccttgatccagctgtaggaactc

SEQ ID NO: 6813251 - DNA, 76 bp, Homo sapiens
aggaagaggagcacacacatttctctttttgtaagttagaaacgttaaataagtgacatgttttactcttcatcct

SEQ ID NO: 6813252 - DNA, 95 bp, Homo sapiens
gggcacacgtcaattgcctttcctgccaggtgagacctactgcttgaaggtgggagcagctctgtttacctggaggaggcagggctggtgtgctc

SEQ ID NO: 6813253 - DNA, 89 bp, Homo sapiens
aaaattcttagagcacagtataatggtcttagatagtgatcgaatttacactgttatcaattgatcatttacttgttctggactatttt

SEQ ID NO: 6813254 - DNA, 57 bp, Homo sapiens
gcagagcattggctctatgtgtgcctcctaacacatccaccacatgccaggctctgt

SEQ ID NO: 6813255 - DNA, 57 bp, Homo sapiens
gtggttggaactctgtctctggtttccaaaatttaaaaccacgaggttagcagccac

SEQ ID NO: 6813256 - DNA, 106 bp, Homo sapiens
tgtgtattctatggctaatggactcagcatccaagtgccttttagagccctgatgctctaacaaggcaatttgtgatcctgcgattatcctcagccaagtcataca

SEQ ID NO: 6813257 - DNA, 69 bp, Homo sapiens
accctgcagccctgggcacctgtgaggggccagctgtgggcagaccctgggccacagaggaggtagggt

SEQ ID NO: 6813258 - DNA, 76 bp, Homo sapiens
ggttcccatgttactagtggagaaactgaggctcagctacttggccagggatcgcacagtgagatgggcaaggacc

SEQ ID NO: 6813259 - DNA, 79 bp, Homo sapiens
gatccatcagtagggaatgtgggaggctgtgtggtcactcctaacccagcccctcccacaaatttccttccaatggctc

SEQ ID NO: 6813260 - DNA, 92 bp, Homo sapiens
ggaccactcctgccctggaccggttctgccgtggactggttcccgccgtggaccagttcccgctgtatactggttctgccctggactggttc

SEQ ID NO: 6813261 - DNA, 59 bp, Homo sapiens
ttcctgcctgaggctcctggtgggagtgatgctaccttgggggagtctcaggagaggaa

SEQ ID NO: 6813262 - DNA, 83 bp, Homo sapiens
agaagaaagccaagaatcctgatgaagttagaagagaagcttaacaatttgcctccaccttctgcattggagtctattcttct

SEQ ID NO: 6813263 - DNA, 69 bp, Homo sapiens
acaggacaaagagcactttggttcattctaagaactgaatcttggctgggcacagtgtctcatgcctgt

SEQ ID NO: 6813264 - DNA, 72 bp, Homo sapiens
caagtcagaaatttgtcttgaaataactgaggactcatctcttcaagtttcgcaaggacatatttatacttg

SEQ ID NO: 6813265 - DNA, 75 bp, Homo sapiens
agagaagccagcatttgcctacccagagagtcagcctcctgagtctccacactggcagatgcctttggattttct

SEQ ID NO: 6813266 - DNA, 55 bp, Homo sapiens
ctgtacattcctctgcttctcctcctggtacacggacgatgcaggggcttcacag

SEQ ID NO: 6813267 - DNA, 63 bp, Homo sapiens
aagcaaattattgacgccaagctgtggattttctgaatcaacaatgggtctgtaatggagctt

SEQ ID NO: 6813268 - DNA, 62 bp, Homo sapiens
gatggctcactcccttgattattggcagaaattcttggttcctcagatgggagtgagccatc

SEQ ID NO: 6813269 - DNA, 84 bp, Homo sapiens
gccccaccagccctgaatcgaggctccacagggttggaaggatgcttaccagggccaagagacctcgaggtggggctgcggggc

SEQ ID NO: 6813270 - DNA, 91 bp, Homo sapiens
ctggaagtgcacagcaccgagaaggaagcatgcctttgctggcagagtcagatgggtgtttgtgactttgctcggggaagtgcatgcccag

SEQ ID NO: 6813271 - DNA, 86 bp, Homo sapiens
gtatagaggaaacacatgcagctccatagataagagctcctccatccaaggttgtgttttctgtgtgattgtgtgtgtctgtgtat

SEQ ID NO: 6813272 - DNA, 88 bp, Homo sapiens
ctggtagtgactgcccatccatgtggcagggctggcctccaggatgggtccagccaagcatggcgtggggcatgggcagggacaccag

SEQ ID NO: 6813273 - DNA, 72 bp, Homo sapiens
gagtttatgcatcctcctgagttatgtttaaatgtgttcacatagaacattctttggaggattattcacatc

SEQ ID NO: 6813274 - DNA, 60 bp, Homo sapiens
tagatgcagtataaatcatttctggaggtgacatagtaccccaccgtagtactgtatttg

SEQ ID NO: 6813275 - DNA, 83 bp, Homo sapiens
ctggggctcagcctggctgagaaccaacctgtctaacatggaagctgaagggcaagtaactctcgtgcgggctcctgccccag

SEQ ID NO: 6813276 - DNA, 60 bp, Homo sapiens
ctcctttgttctgtgtatctttgtgagaagggagagcctgcaagggcatagaaaagggag

SEQ ID NO: 6813277 - DNA, 81 bp, Homo sapiens
gtgattttagctcagtgaaagtggttttgaatttctgccctctgaaatggtaagacaacacattatgttgttataagtcac

SEQ ID NO: 6813278 - DNA, 130 bp, Homo sapiens
acagtggctgggttgcattgctgaggatgccatgtagtcctggcagggacacaggtactggcctccttctgccagtgacacacctgttagcattgccatctactctcagtgttcccgcagtactgctatt

SEQ ID NO: 6813279 - DNA, 78 bp, Homo sapiens
tgaagaggtaggcatgcttagtatagactggatattttcttggatattaattatttacacatgagtgtctgtccttca

SEQ ID NO: 6813280 - DNA, 92 bp, Homo sapiens
gaatgattctgagtgtagcttttttagtccgattggtatcggtgatcagcctagtcaatgagacctgtactaatggatacctcttgttattt

SEQ ID NO: 6813281 - DNA, 55 bp, Homo sapiens
ttacacaacatctgtattattagcatcctttttaatgagatagatggaggtgtgg

SEQ ID NO: 6813282 - DNA, 60 bp, Homo sapiens
gatggcggtggccacctccttggagcacttaacacccagaccgacgtggccattgtagtc

SEQ ID NO: 6813283 - DNA, 76 bp, Homo sapiens
ggtggggagggaggggagctccaccctcgcgcaccgtccgcagaggctgaatcaggaggccccttccccaaccacc

SEQ ID NO: 6813284 - DNA, 66 bp, Homo sapiens
accatgcctggctaatttttgtaattttagtagagatggggagttcacgatgttggccaggctggt

SEQ ID NO: 6813285 - DNA, 88 bp, Homo sapiens
ggtattatagacatgaatgagacagcctctgcactcatggaactcacattctagagcagtgttgtccatcagaaaaataatgagaacc

SEQ ID NO: 6813286 - DNA, 55 bp, Homo sapiens
gctaaggaaatgcgcggcacagttggctctgcggtgctgccttatttcccttagc

SEQ ID NO: 6813287 - DNA, 61 bp, Homo sapiens
tatcccagcatctatgtgctgttgatagtaacagtccactgccacatagatgctgaagata

SEQ ID NO: 6813288 - DNA, 81 bp, Homo sapiens
agacatgaacatctttaggggaccatcattctgcctcccagagtcattttcttgtgttccccaccagagatgttacatgct

SEQ ID NO: 6813289 - DNA, 118 bp, Homo sapiens
tagaaacactaaggcttcaaacactacaagtgactatttgagtacatcaaaaaggaaagttctcttaacatggtgatttgaataccacatgtgatgacaattttatgccccgtttcta

SEQ ID NO: 6813290 - DNA, 91 bp, Homo sapiens
ctgtggaggcaggaggcctctccctcacacccttgcccagactggggaccgtctgcggcagtgtccagggctgtggctctcacctctgcgg

SEQ ID NO: 6813291 - DNA, 69 bp, Homo sapiens
agcctggctccctgcaggatcggcttcaattccctgatgtctgtccaaccctgcagggctgcctagact

SEQ ID NO: 6813292 - DNA, 66 bp, Homo sapiens
gaggcatagggcagagtccaggatgggctcaatatagagctctagttgccctctccctgtggcttc

SEQ ID NO: 6813293 - DNA, 58 bp, Homo sapiens
ttctcagtatgtgacgaggaccatcaaatgatgatgttctactcttaccatgctagaa

SEQ ID NO: 6813294 - DNA, 57 bp, Homo sapiens
ctgtcacctctgccctttgcccaccctccctgctgcagccatggggcagagagacag

SEQ ID NO: 6813295 - DNA, 69 bp, Homo sapiens
caggaaaggctttataatagttaatgtgttgtttttagttgtgccatcactgtgataatgctttttctg

SEQ ID NO: 6813296 - DNA, 102 bp, Homo sapiens
gaggaaacaggcaatattgcttcaggttctagttgtttttccaataaatagaaatcaacagagcaaagcctgaacaacattgtaacacatgcctgtgttctt

SEQ ID NO: 6813297 - DNA, 98 bp, Homo sapiens
tgcttgtagaccatccccccagaagatggtatgtgctcctggggaagtcaagaatggcatctcagtggacgtgtctgtcttaggtcagtttacaagca

SEQ ID NO: 6813298 - DNA, 93 bp, Homo sapiens
cctggcctcggcctttgtccagcgaccaggctctgtccccgagaagctacggccgacctgggtctggtgttgggacgcatggaccgggctggg

SEQ ID NO: 6813299 - DNA, 56 bp, Homo sapiens
cacacagtagtatgaggcaaaatatctgattacagagtctaaaactgctttgtgtg

SEQ ID NO: 6813300 - DNA, 79 bp, Homo sapiens
ggctgggggctagcatggattccctcatcagacacccttcccagctgatgggactgccagctgctgatatttcccagcc

SEQ ID NO: 6813301 - DNA, 65 bp, Homo sapiens
gcggctgaggaaaggctggaagggaggctctcccttgcctgccttttctcattatttctagctgt

SEQ ID NO: 6813302 - DNA, 55 bp, Homo sapiens
cagcaggccaatagcagccaatactctcagcctcttggcctggctatccctgctg

SEQ ID NO: 6813303 - DNA, 57 bp, Homo sapiens
gagagctggagttatttctctggatgtttgcatctggaagaaatggctctcaggtcc

SEQ ID NO: 6813304 - DNA, 78 bp, Homo sapiens
gtttgtttgttttgagatggagtcttgctctgcagcccaggctagagtgtcgtggctccatctcagctcaccgcaagc

SEQ ID NO: 6813305 - DNA, 78 bp, Homo sapiens
aaggaattcagcacagctgtggggtcattcatgtggttggggcgggtgatgtgactccacagctgtgctgaattcctt

SEQ ID NO: 6813306 - DNA, 62 bp, Homo sapiens
ctcaggggtcatccgatgtggtcctttttattatttcattggcttcacatgattaccctggg

SEQ ID NO: 6813307 - DNA, 58 bp, Homo sapiens
gcacaggcatcaggctttttctgaattagaaagacaaaaggcagcttggtacctgtgt

SEQ ID NO: 6813308 - DNA, 55 bp, Homo sapiens
aagtgtgtggttattggttaccaactggttattggttattggttacactgcactt

SEQ ID NO: 6813309 - DNA, 67 bp, Homo sapiens
gtgaagtggtagagagagcataagctttgaagtcagacccagggtcagtcctccctctgccactcac

SEQ ID NO: 6813310 - DNA, 96 bp, Homo sapiens
gttcagaatctgaatcggctcatatctctcttatacgtcaacttccacttttctgcaagttggtgtatgagacagaagcctactcagaatctgaat

SEQ ID NO: 6813311 - DNA, 55 bp, Homo sapiens
acagtaactcttttaccctcctccaggtatagatttgggttggagaagtttctgt

SEQ ID NO: 6813312 - DNA, 93 bp, Homo sapiens
tagtctaagctaatcagaacatggcattttttcatggagactatgattggtctgggaagatgcaatgtgacctctgttggcccaatcagatta

SEQ ID NO: 6813313 - DNA, 80 bp, Homo sapiens
tgggaatgtttaaggaaggcgtggcttccccctagatcatggtgcttacagtctaggccatggtttctcaaatattgaca

SEQ ID NO: 6813314 - DNA, 56 bp, Homo sapiens
tagataggaaataaggatttggtggggaatgtctgccagtattatttctctatgta

SEQ ID NO: 6813315 - DNA, 67 bp, Homo sapiens
gtgccagaccactgtgtttgagactattttaaccagctgatgggatactttagacattgtctggtat

SEQ ID NO: 6813316 - DNA, 56 bp, Homo sapiens
cccaggctggagtgcagtagtgtgatctcagctcactgcaacctccgcctcccagg

SEQ ID NO: 6813317 - DNA, 61 bp, Homo sapiens
ggcaccccaggcctggggcctgatcccaggagcacaccctacaggcccagcgctgggggct

SEQ ID NO: 6813318 - DNA, 69 bp, Homo sapiens
tgttggtctgaatacctacatagagactggtgatagtgggacatcagcctcaggtgttcagattttcca

SEQ ID NO: 6813319 - DNA, 65 bp, Homo sapiens
tgattaggtttctattgggaactttgccaacatgcagctccccctctctttgggaacattaatca

SEQ ID NO: 6813320 - DNA, 76 bp, Homo sapiens
ttcagggcactctgacattttgagaatgacatgtttgttgtatgttgtttgttctcttgtcagtccttccctagag

SEQ ID NO: 6813321 - DNA, 64 bp, Homo sapiens
taaggctcttgagatggggagagtatcctggatttccaggtgtgcctgatcacaagggtccttg

SEQ ID NO: 6813322 - DNA, 87 bp, Homo sapiens
ttctgtcaaagctctggaagccctggtagttactgttcttaattggtatgtcagtctcaacaccaatgcccttcctggctgatggag

SEQ ID NO: 6813323 - DNA, 72 bp, Homo sapiens
gtttctagaatgtgaaaatagtaacctggctagttaatttaattaagtccttggtaattttcttttagaaac

SEQ ID NO: 6813324 - DNA, 84 bp, Homo sapiens
ggtcggaggctggcagctggaggctagaggccccgaggcattcccctcgctgtggctctcaaggctcagattcagctactggcc

SEQ ID NO: 6813325 - DNA, 86 bp, Homo sapiens
cctgcctcggcctcccaaagtgcaaggattacaggcatgagccactgtgcccagcccctaatttgtgtatttttagtagaggcagg

SEQ ID NO: 6813326 - DNA, 124 bp, Homo sapiens
tagtgtcctttgacttacttaggctgctgaggtctagttaactctggagagttggaagacattctttcttaaataggtggattggtttgagccttggttaggtctgggttggtttgctttactg

SEQ ID NO: 6813327 - DNA, 127 bp, Homo sapiens
ggcctggttggagctctgtcttctctctcagagagcacccacatttctgcagtgcaagagagtgacctcaatctggtactagaggagtgctggatgtggaggctgagggcagggcctcccccagacc

SEQ ID NO: 6813328 - DNA, 62 bp, Homo sapiens
tggcagtgttgtgccacattcccaccttgcaacaatcacgtggaactgagtggcagctgcca

SEQ ID NO: 6813329 - DNA, 64 bp, Homo sapiens
ggccttcagctcagttgagggcaggtccctatctggatttataacttagtttggttgaagtgtc

SEQ ID NO: 6813330 - DNA, 95 bp, Homo sapiens
ggttaggttaatgagtgtcatacagaatgcataagttaaaactgaatcttcggtatcctattcctgtgtatgtcttgctgccttataatttaacc

SEQ ID NO: 6813331 - DNA, 57 bp, Homo sapiens
gtggacagtgaacccagaggggtgagtggaatccatccagcctgggggtttaaccac

SEQ ID NO: 6813332 - DNA, 66 bp, Homo sapiens
cgtgggacgatgccctgctctcgggaagggacccgcggtccctgctgaagcggggcatgcaccacg

SEQ ID NO: 6813333 - DNA, 69 bp, Homo sapiens
gatttgtgcagggcagtttgtttcggcatggtactctgccacatggtgatatatttgcctgcagagatc

SEQ ID NO: 6813334 - DNA, 58 bp, Homo sapiens
gtgcagttcaaggttgtacagctcaatccaccgagactggatagctttggacttgtgt

SEQ ID NO: 6813335 - DNA, 70 bp, Homo sapiens
ttatgtagttattctgcctttaaggaagtggagcataatttcctcctccttaagtgtgggtggtgcatag

SEQ ID NO: 6813336 - DNA, 86 bp, Homo sapiens
ttgcggtccatgggagtgactggttgtatatggaatgttcctgcaagtatgggacaagcagtaaaggccacagtctcaggatccaa

SEQ ID NO: 6813337 - DNA, 63 bp, Homo sapiens
ggtctaggtgtatgtcctaatttgatgtgttcaaatacaataattaagtcacacacctaaacc

SEQ ID NO: 6813338 - DNA, 115 bp, Homo sapiens
gtggggaccaggtttggggaggccgctgctgctgccgccgcaactgccgctcctactcctaatgttgtggctgttgttccgggagctgcagcctcgccattgctggttatcccac

SEQ ID NO: 6813339 - DNA, 67 bp, Homo sapiens
tctcaccagggagctgagagctactatttggatgtttccagaagcagcagctgggttctcagtgagg

SEQ ID NO: 6813340 - DNA, 66 bp, Homo sapiens
cttatttttggtaaccttgcattctttactgtgaaatctgtgataatgagggtttgccaggttaag

SEQ ID NO: 6813341 - DNA, 74 bp, Homo sapiens
ggttccttgagcacagcggcttcaggaggggatcgggacagctccctttgataagcgtaactgtgctctgagcc

SEQ ID NO: 6813342 - DNA, 68 bp, Homo sapiens
gactgctccttgttggtgtctcctcagtacccagcccagtgcattggagatcagagactagggcagtt

SEQ ID NO: 6813343 - DNA, 129 bp, Homo sapiens
ttttgcatatggaatagatgggaattataggggccaccagagggcagactgtgataagcagaattttggctgtcatgatctccaccctctgatgctactcctgtggttatagtatgttacatggcaaag

SEQ ID NO: 6813344 - DNA, 130 bp, Homo sapiens
tttttatccttgactgaaaatgaaagattccttggctgtctcttaaatacctaaatacatcaaattcaattttatttggtcaaggacattacagttttggtaatttattcacttgaggtcaagtaagtca

SEQ ID NO: 6813345 - DNA, 102 bp, Homo sapiens
tgagacagagtttcgctcttgaccccgaggctggagtgcagtggcctgatcttggctcactgcaacctctgcctcccggattcaagcgattctcctgcctca

SEQ ID NO: 6813346 - DNA, 67 bp, Homo sapiens
tggacagccaaggaattaggaagggggcagagaggaatagatcatcccttcctccctgggctgtgca

SEQ ID NO: 6813347 - DNA, 66 bp, Homo sapiens
actgcttgctagaagcttaaaggtattgggttggactccattgcttgttcatggcctagtggcagt

SEQ ID NO: 6813348 - DNA, 80 bp, Homo sapiens
gagcaatgtggccagtgtgtgcctctgtgttctcatgtgggtacatgtgtctgaagcagtatacactgatacatgagctt

SEQ ID NO: 6813349 - DNA, 56 bp, Homo sapiens
cagcctggtccccggctcacccggccgcatccagcacctcgtagccgtggccgctg

SEQ ID NO: 6813350 - DNA, 82 bp, Homo sapiens
gaggtcctgataaaacatgaggtaagggatgttaagaactcttcctcttcattagtcaatcctgcttcatatgtctagcctt

SEQ ID NO: 6813351 - DNA, 59 bp, Homo sapiens
acagatggtactaaacccatataacttatataactgttatcatggggtcaagccgctgt

SEQ ID NO: 6813352 - DNA, 79 bp, Homo sapiens
gccgctgtttcttcctctcctcacatgagtcacatgagcctgagagccatgttgaaggagaagatctggagctagaggc

SEQ ID NO: 6813353 - DNA, 72 bp, Homo sapiens
ggagcctggtggaaggtgagtgaggcctcgttggtgccaacccaagttgcctttgaccttccccactgctcc

SEQ ID NO: 6813354 - DNA, 86 bp, Homo sapiens
ctgggaagctgccgcctggcattctctccagagagagtctcagctgctcttgctgtctagaatgatcacttggtgtagtttcccag

SEQ ID NO: 6813355 - DNA, 56 bp, Homo sapiens
tgctgtgtctttctgtgaaaagagaaacattatctctttttactcgttcatatgca

SEQ ID NO: 6813356 - DNA, 57 bp, Homo sapiens
ttcccaagccttttccctggatgtcagcctctatccacagcgaggtaggtgtgggag

SEQ ID NO: 6813357 - DNA, 77 bp, Homo sapiens
atttgatgttttataatgtctgcagagccacacaacctcagtaggctgtgggggccatagacgttttattttcagat

SEQ ID NO: 6813358 - DNA, 127 bp, Homo sapiens
cttttataaggagcggtagacaaggtatagttgagatgacttaaatttgggattgattttgcaaccaaggaacgtccctgtgagtcaactaaacaagaaatatttatgtgtctagctcgtttagagg

SEQ ID NO: 6813359 - DNA, 61 bp, Homo sapiens
gctacggaaaaccctgagcaaacttgttttaaagtttgtaccatggggtctttcccttagc

SEQ ID NO: 6813360 - DNA, 64 bp, Homo sapiens
tcccatttcacaacaaaactggccagattccacacccacatgcctggtcagatgtggaatggga

SEQ ID NO: 6813361 - DNA, 62 bp, Homo sapiens
attggagggtctgagctgaggggaaatcacggacgtgcatcacccctaatcagactgctaat

SEQ ID NO: 6813362 - DNA, 101 bp, Homo sapiens
ttgtcatcttcttgcagtaataattctatgctagtggaaagcttctagaaatccaaacagcagtagtcaatgtatagaggagttgtgtaagaggcattcaa

SEQ ID NO: 6813363 - DNA, 86 bp, Homo sapiens
gcccagagcgctctgctggcggcagaggcggcggcgaggctggcgcgcttgccgccgtctgctcgccccgcggaggcgacctgggc

SEQ ID NO: 6813364 - DNA, 91 bp, Homo sapiens
gaacttaaatttatcttgtgggagagcagtggagtcaactgtgaaatatagtgaattgctccattctttgaattcctaagagtttacattc

SEQ ID NO: 6813365 - DNA, 75 bp, Homo sapiens
agtatcagtcttagcagatagtagaacatgtatatgtgatttatgacacattcttttgactgtttaattgatatt

SEQ ID NO: 6813366 - DNA, 63 bp, Homo sapiens
taggaaagcatgagccttgttcttaatgagctcaatcagaaagaggtcatgttgcacaaccta

SEQ ID NO: 6813367 - DNA, 64 bp, Homo sapiens
aaggatcaggcgccatgggaagtgtggtgcggccgtttcccctacttctctccgcctcgtgctt

SEQ ID NO: 6813368 - DNA, 69 bp, Homo sapiens
ggctggtgagggatctctgcctgctctggactgtggcaggagccagcaggaggactctctgagccagcc

SEQ ID NO: 6813369 - DNA, 78 bp, Homo sapiens
tgaggtgtatttccagtgtctgtgtgtagtgctgcagctgtctgagcgtattgccggaggcacctcctttggacttta

SEQ ID NO: 6813370 - DNA, 82 bp, Homo sapiens
ggttatctcagaacttcatattgacgttagctatagatattaagctataaagtgctaaccagtcaatatggtttgaatgact

SEQ ID NO: 6813371 - DNA, 93 bp, Homo sapiens
gatggagttccaaagaaactgaaggctttcccaaggtcacaccactagttattggtagtactgggactagagcccagccgtcctaattctatt

SEQ ID NO: 6813372 - DNA, 58 bp, Homo sapiens
ttcactggggcccacatcaacatggaaccaggctatggtttgtaaggtccccagagaa

SEQ ID NO: 6813373 - DNA, 125 bp, Homo sapiens
cctgggactgctgtgtctagtggggagaaggccacggaatggagctgggaattttaaaatcaagtggctatttcttctgggttcacttctacctcactggtgaattggctgttctctgacccagg

SEQ ID NO: 6813374 - DNA, 58 bp, Homo sapiens
tcaggcttcactcctgtccaaggttagctctgcttctgggtcaggctgggagtcctga

SEQ ID NO: 6813375 - DNA, 77 bp, Homo sapiens
tcagggatgggtggggcagaggcgcttccaaatgcttttcttcatttgaatatagtgtctgtgttttctattgctgg

SEQ ID NO: 6813376 - DNA, 82 bp, Homo sapiens
gcacatggctgtgtacatccaaatgaattagaattcggtaccactgagatttcagttccttggctggccacattccaagtgc

SEQ ID NO: 6813377 - DNA, 70 bp, Homo sapiens
tctgtaggtggggggaaatgctttttaccataaccacggaagatacattatgtctctctgaaaccacgga

SEQ ID NO: 6813378 - DNA, 56 bp, Homo sapiens
cagatggtgaaatgtgattccctagaattgctagggagaggagcgtttcacatctg

SEQ ID NO: 6813379 - DNA, 97 bp, Homo sapiens
ttggattggaattctgagtgtgtcattgagagacgaggtgagacatttttaaaatgttgatgttttcagtgagcacaggcagattttcacaatctaa

SEQ ID NO: 6813380 - DNA, 81 bp, Homo sapiens
ccattcctgtacagagacccacaagagactgaaaaatggtgttggtcaagttgtcttgggttctgtgccttctgggaccgg

SEQ ID NO: 6813381 - DNA, 56 bp, Homo sapiens
caccagctttgcccactgcccaggggatgctttgacggcagtagaggcagctcgtg

SEQ ID NO: 6813382 - DNA, 94 bp, Homo sapiens
gaggtgaggccgtggctcctgagggtcaagggaatgtggccgcgggtgccgtggtgccgcaggctggccttcgccatccctaggccgtgacctc

SEQ ID NO: 6813383 - DNA, 63 bp, Homo sapiens
gaaatgctgaggtgtgtttaatttagaagtcagatattttgaaatgaaaaatcttagcatttt

SEQ ID NO: 6813384 - DNA, 123 bp, Homo sapiens
ggtttctgtttttctgcccttcactccttttcaatagatgtttgggagttaggtctccactgaatgaactacccacgtttctgtccttgaagggctggtggggggcgcttatgtaacattgct

SEQ ID NO: 6813385 - DNA, 57 bp, Homo sapiens
tgggagaaactgtctctcccacatctggattggggcagagaccagctgttactccca

SEQ ID NO: 6813386 - DNA, 60 bp, Homo sapiens
cggctctgaccggattggagagagcttttctttgtgttctctcctcccggggagaggccg

SEQ ID NO: 6813387 - DNA, 121 bp, Homo sapiens
cccagcgcagcgagctaaccccgggacactcccaccccggccggctgaacaggttgcagcgcgacacctgcgctgtctgctgggtcgctcaggaccgcggtgcggggcctggtgcgctggg

SEQ ID NO: 6813388 - DNA, 69 bp, Homo sapiens
gtgacacctttgtgaagtgatgatgtatttgtataagaaaattcattttagtcacaacaggggaattac

SEQ ID NO: 6813389 - DNA, 67 bp, Homo sapiens
aggtagaggttcaaatcccaattgcaacagcaggctgtgtaaccttgggaaatttgacctctctcct

SEQ ID NO: 6813390 - DNA, 77 bp, Homo sapiens
ttttctgatttagaatctttaaaattcatagttgtttttacagtctgagattagggaagattttaaagtagtgaaga

SEQ ID NO: 6813391 - DNA, 74 bp, Homo sapiens
gcagccaaaccaatgaacaacactgaaggaagataacttaatgtattctactagcattgttcacttggccttgt

SEQ ID NO: 6813392 - DNA, 78 bp, Homo sapiens
aacctataagtaatatcagatgacatcttctatggggttattttagcagggatatcatctgacatcttctataaggtt

SEQ ID NO: 6813393 - DNA, 112 bp, Homo sapiens
ggctagttaatgctaaattgaggtttaaaataattataacagttacatcttacatatcaggtgagatgtcatagttcagttcaggtaattttcgtgtggcagtgagctagtc

SEQ ID NO: 6813394 - DNA, 58 bp, Homo sapiens
acccagtctggagtgcagtgacaccatctcggctcactgtaacctccgccttatgggt

SEQ ID NO: 6813395 - DNA, 68 bp, Homo sapiens
gggagtggctggcaggggagggtccacagggctcctcttctgggactctcaggctgtcggcttctcct

SEQ ID NO: 6813396 - DNA, 65 bp, Homo sapiens
atcctatgggggtggcctcttgtgaagtttttctcatatttggtcaagcaaacccccatgaggat

SEQ ID NO: 6813397 - DNA, 56 bp, Homo sapiens
gggtacaggcctgatcatccacagacactagtggacacatgaggaaggcctcaccc

SEQ ID NO: 6813398 - DNA, 72 bp, Homo sapiens
ttcccttaattcatgagtagaatctatatacatatattattctggttttctattgatgaagtacatggggaa

SEQ ID NO: 6813399 - DNA, 78 bp, Homo sapiens
tatgtgtaagtgagatttggaaaatttgatatgccagcaaggacaaagaagtgttgaatttgcaagtttatgcacata

SEQ ID NO: 6813400 - DNA, 90 bp, Homo sapiens
atacacaacactgtaccataatgaccctagagcacctgatggtctagagcacttgatggtctagggtcattatggtacagtgctgtgtat

SEQ ID NO: 6813401 - DNA, 55 bp, Homo sapiens
ggcacacagatggagcactagctaaatcgtaactgttgagtgtcacgtcagtgcc

SEQ ID NO: 6813402 - DNA, 66 bp, Homo sapiens
taaaattaatttcatctggggcagtttatctaatgtgaactgtttcagtttctgaagttttgtttg

SEQ ID NO: 6813403 - DNA, 108 bp, Homo sapiens
ccaaaatgcccttcggtgactttccagcgagtaaaatcttaagcacagtgggatgtccaatgtcttttgaaggttttggctgagagagacaacattcttggaatatgg

SEQ ID NO: 6813404 - DNA, 86 bp, Homo sapiens
ttccgtgctggttgtggtctgaggcatgaatgtgggctttggagccagggttcgaatctcagctttgccacattctagctgtggaa

SEQ ID NO: 6813405 - DNA, 104 bp, Homo sapiens
atctggtattggcaaggaggtggagtaacactgcagatgaaagcataagttggtacagccactttagagaacttcttagtggtctctacttacgctgaacagat

SEQ ID NO: 6813406 - DNA, 82 bp, Homo sapiens
tgtgagtttttaaagagaatgtgaaggagttcttttgatgaacttttttcttactttacaaagtctttttagagccatcaca

SEQ ID NO: 6813407 - DNA, 57 bp, Homo sapiens
cccagcttgctcaccattcccaataataactgcttgcatggagagctctctgctggg

SEQ ID NO: 6813408 - DNA, 75 bp, Homo sapiens
aggggtaaagagggctgaagtgttttatgagttagcccattccttgataacttcagcttttaagttttgccagct

SEQ ID NO: 6813409 - DNA, 80 bp, Homo sapiens
tccatctgttaaatatggtgtcaggtgctcaccttcagaaggggcagctgattagcatcaaggatgtttagcaataagga

SEQ ID NO: 6813410 - DNA, 74 bp, Homo sapiens
tacagtggccttctgtcagtcctgtgcagaactcataggggttctctgtgcagaactcacagaaggccactgta

SEQ ID NO: 6813411 - DNA, 79 bp, Homo sapiens
gagttttagattggaaagcaacttttgagagttgtttggaactcccttagctacttttatttgcttctaataaacactc

SEQ ID NO: 6813412 - DNA, 80 bp, Homo sapiens
gcagaaataagtagtttagtgttgtgagttctggagccagtttatctcctccactaactaaattacttaatcttgtctgc

SEQ ID NO: 6813413 - DNA, 58 bp, Homo sapiens
gtaattcttggtacccactcctacggcactaacgtagatgtgaggattcaggagttac

SEQ ID NO: 6813414 - DNA, 58 bp, Homo sapiens
aggatcaagaggcggccggaaccctccctgagccgagggtccagaactgccctggcct

SEQ ID NO: 6813415 - DNA, 78 bp, Homo sapiens
gtccctgagtgctgtgaaaggccacgtgccaagattaacctgaatttttctttgcaaatggctttgactcaatgggac

SEQ ID NO: 6813416 - DNA, 61 bp, Homo sapiens
ggagagcttggaaataatcatggagataatcttgatgttctttatatattcccaggctgcc

SEQ ID NO: 6813417 - DNA, 56 bp, Homo sapiens
gtgtccagagaactgtgggagcccagaggagggagccccaattctgtctggagcat

SEQ ID NO: 6813418 - DNA, 69 bp, Homo sapiens
gtaggagaacaggacacagtcatccctattctcaaggatacagaaaacttctgggtcctgttcttttac

SEQ ID NO: 6813419 - DNA, 66 bp, Homo sapiens
gactcagctggttcagtttctgggcctcgtgtgggcccccagcagcttaaccacttctctcaagtc

SEQ ID NO: 6813420 - DNA, 73 bp, Homo sapiens
gcattgactcctttcactgatagactcgccgttagggtgcaacatcagcctcacagtttattagagtaagtgc

SEQ ID NO: 6813421 - DNA, 98 bp, Homo sapiens
gctctgctgtcctgctgctttccctgcttgtttataaattggagaacaactttcaacttggtgggagagctgtagtctaataggaacagtaaaatggc

SEQ ID NO: 6813422 - DNA, 98 bp, Homo sapiens
tattgtttaggatatattttgagttggaattttcaggaaaagaaaagcataactgagagatctgtgcttactacaaggtgcatccttgaaaaataata

SEQ ID NO: 6813423 - DNA, 60 bp, Homo sapiens
agccagatccaggagacagctcaaaagcctgaccttgactttctccaggtaagtctggct

SEQ ID NO: 6813424 - DNA, 62 bp, Homo sapiens
ggatagttttccattttgtgatttttaagtggacattacttggaaaattcaaaatggcatcc

SEQ ID NO: 6813425 - DNA, 119 bp, Homo sapiens
gtgttctaaaggaggttgcccagatgtctctatgacagtgggtcttgcaaagagagaaatgttctatgttcagggccacattgttgcatgatggaaaaccaactctttccttgactcac

SEQ ID NO: 6813426 - DNA, 72 bp, Homo sapiens
ttgctgttcattccaaatgaaggaaagggttttcttagcaaaactagaatgttcacctttaaatgacagcag

SEQ ID NO: 6813427 - DNA, 67 bp, Homo sapiens
tctgtttgtagggtagtaccatgctgccaggttaccgctgggtagtttcccctgccctgcagcatga

SEQ ID NO: 6813428 - DNA, 76 bp, Homo sapiens
ttactctgtcacccaggctggagtgtagtggcacgatttcggctcactgcaacctcagcctcctgggttcaagtga

SEQ ID NO: 6813429 - DNA, 62 bp, Homo sapiens
gatgtctctgtctggtccaggaagatgtcagccccacactgcccctcccagataaagagatc

SEQ ID NO: 6813430 - DNA, 58 bp, Homo sapiens
tcttggtcagcactgatgtttcagagcccagcactgatctagaaagggctggccaagg

SEQ ID NO: 6813431 - DNA, 74 bp, Homo sapiens
ctgggtgccaattcatgtttattaggacttctgttagtgctttccctgaatgagtggatttggcttggccctag

SEQ ID NO: 6813432 - DNA, 77 bp, Homo sapiens
tgcaggcaaagaaaggtaaatacatgcttggatcctatgtcaatcacaggcacaattatttccctttccatagtgta

SEQ ID NO: 6813433 - DNA, 61 bp, Homo sapiens
atgaaattcatctgagaatgctgtcaacaaactgataacctatttctctggtggatgttat

SEQ ID NO: 6813434 - DNA, 73 bp, Homo sapiens
gactcctcagagagaatcttggcagctgagcctgcccaaggttcagtgcacccaattctctccatctggaatc

SEQ ID NO: 6813435 - DNA, 55 bp, Homo sapiens
gcagcccaggagcaggcgacccgccccagcctgagcctgttactcttgggctcgt

SEQ ID NO: 6813436 - DNA, 62 bp, Homo sapiens
tttctttagactactatgctgccagaaaaacacatagttctctgggagagtagataaaggaa

SEQ ID NO: 6813437 - DNA, 61 bp, Homo sapiens
ggctgagtgtccttttattagtctgagcccctagagagaccaaagaggcaaccctcgagcc

SEQ ID NO: 6813438 - DNA, 84 bp, Homo sapiens
gtacaagaaattaaaggtctagcaccaggtaaattcatatctcaggattttaaactatagctggatgctttaacttagctgtac

SEQ ID NO: 6813439 - DNA, 89 bp, Homo sapiens
gggcccagctcatgacctttgttatcttcagatgatgctagcattggctgcaaggagaaggatagagaacaaagatcatagctgtgctt

SEQ ID NO: 6813440 - DNA, 60 bp, Homo sapiens
gtggtcgcgggaggctcagtcccagctcattagaaaggcaagctgctcctggctgaccac

SEQ ID NO: 6813441 - DNA, 69 bp, Homo sapiens
tccacgtgttcttgtcgtactgggtgaacttggtcaggttgagccccaggccctggcagagcttgtgga

SEQ ID NO: 6813442 - DNA, 84 bp, Homo sapiens
tgcattcccacagtgctttacatgttttctgctgtccctgccgtagagttcaggcccgtaactgcataatttgtgggaaaagca

SEQ ID NO: 6813443 - DNA, 57 bp, Homo sapiens
tgattctgccctttcttctgacattgtttgagagaagtcattttgggggcagaatta

SEQ ID NO: 6813444 - DNA, 125 bp, Homo sapiens
ttgatcaatttgtttaactcagtgccccatttacccaacagtaaattgcagatgctaaatgactcattactttggcagagtcactggttctgtaattaattatggagcactttaagattgatgaa

SEQ ID NO: 6813445 - DNA, 69 bp, Homo sapiens
tgcctattacacagtaaatggtaaatacatgtacgcatgcaagcatgtaacaatgagctgtgtagtgca

SEQ ID NO: 6813446 - DNA, 65 bp, Homo sapiens
actggctctctgcctttctcaatgacacctttgagacttgggagtcagggaggcagagaggcagt

SEQ ID NO: 6813447 - DNA, 56 bp, Homo sapiens
actttgtctctaagaagggaattattgccagtgatttcatttgttatagacaaagt

SEQ ID NO: 6813448 - DNA, 72 bp, Homo sapiens
gctcccaccaggtgagaagcctggctggccccatagccatgccatgtgtcgggcctgcagtggaccctgagc

SEQ ID NO: 6813449 - DNA, 62 bp, Homo sapiens
tgtcccccactcctggccccatccagctgcaatgcctggaagaggccagaaagtgggagaca

SEQ ID NO: 6813450 - DNA, 72 bp, Homo sapiens
catctatgtaggggatggttccctagaaaaccgggaagaatataaaggatttcagggtcccccctggagatg

SEQ ID NO: 6813451 - DNA, 76 bp, Homo sapiens
tgtctacgaaattatccttttattgtagtaagttattttagagtattattgcaactttagggatagaaagaagaca

SEQ ID NO: 6813452 - DNA, 78 bp, Homo sapiens
ctgccaggctccctgtgggatgaggcgccggctgtgtcatggggtagctggcagggctgtgcccaaagggagaggcag

SEQ ID NO: 6813453 - DNA, 74 bp, Homo sapiens
ggggaggctggggtgtggtggataagctaaagggaaacttggcgttcctcccacacaccttggaaggtcgactt

SEQ ID NO: 6813454 - DNA, 71 bp, Homo sapiens
tagccctgtagatttaggagagttttcagcccctataggcctcacttttcttcatttataaaatgaggcta

SEQ ID NO: 6813455 - DNA, 76 bp, Homo sapiens
aggttttcccacattcattgcattcgtagggtttttcccctgtgtgagtccattgatggatagtgaggaatgactt

SEQ ID NO: 6813456 - DNA, 95 bp, Homo sapiens
ttaaaaggaaaagtgatctgtgcagatagtgatttcagaagcgtcctttgaagtgcttctgtttattctgcaggattttctcacttgcctcttga

SEQ ID NO: 6813457 - DNA, 71 bp, Homo sapiens
tttggacatgcattgcatgagcagtttcaactgtgaactctgacctgcttatccaggcaatgcattccagg

SEQ ID NO: 6813458 - DNA, 63 bp, Homo sapiens
gagctgaagatgtcagaaccgttcagaaatactgcctggggaaagttcttggttcttcggctt

SEQ ID NO: 6813459 - DNA, 130 bp, Homo sapiens
ggaagtcgagtcttctttccataatgtctatagtgctgaacaataagattggttctaaactgaagttagaatgtctaagtgttcagcccaagcgtattagaaaaattactttggtagaacacttactttc

SEQ ID NO: 6813460 - DNA, 94 bp, Homo sapiens
gtttttaattccctcgttccacaggtgttgatgtttattgagtgctatgtcccaggcactattaggcaagggcacgtaacagacagttaaagac

SEQ ID NO: 6813461 - DNA, 63 bp, Homo sapiens
agaaagtggtggggagttctaactgtgaataacgcttgaagatctaaaccctactttctttct

SEQ ID NO: 6813462 - DNA, 72 bp, Homo sapiens
ttgcttgagcccaggggacaatgtggtgagctgagatcacgccactgcacttcagcctgggtgacagagcga

SEQ ID NO: 6813463 - DNA, 56 bp, Homo sapiens
tcctaagatttcctattctcatttcaaaagaaatggagaatttagagtctctagga

SEQ ID NO: 6813464 - DNA, 64 bp, Homo sapiens
cttcccatctccaacatttttctttagggaaatctgaataaaatgaactggtagagttgggagg

SEQ ID NO: 6813465 - DNA, 95 bp, Homo sapiens
ggatctatctgtgtctatatataggcatcctccgtttggtttgtagaactgtcaaaataacttatgatcgtctggcttatggacacaggttatcc

SEQ ID NO: 6813466 - DNA, 112 bp, Homo sapiens
ctccattttagacccatatttgggaaggaggagattagtgtttaggtggaatcacacactagacatcagttggtctttacagacctccttttcaaaacagggaagaatggag

SEQ ID NO: 6813467 - DNA, 90 bp, Homo sapiens
ggggcaagcaaggagacacagtgggtagtggggattagcagggcagccaggtcatgctttcagttgttgcctttgttctttgagtgcttt

SEQ ID NO: 6813468 - DNA, 73 bp, Homo sapiens
ctctttgtttctctaattcagaggaagaagataagtaaagtgtctaattcagagttagacgaaaagcaaaggg

SEQ ID NO: 6813469 - DNA, 104 bp, Homo sapiens
cccagatggtccgtgggcattctgtagttactgcctgcctgctgaagtaaggggttaattaacttcagggcgttgtggctgactgaagctaggctgactctggg

SEQ ID NO: 6813470 - DNA, 56 bp, Homo sapiens
ttcagctcagtttcaataccaggtttaaactctggacacggtttattgcagctgga

SEQ ID NO: 6813471 - DNA, 69 bp, Homo sapiens
agttgtaaaataatgtaggcattagcctctagtaaaatattaagaaggctcatttgactgcattcagct

SEQ ID NO: 6813472 - DNA, 68 bp, Homo sapiens
tcaaaggtcccctgtaagaactggctgatggggcagataatttactggttacagtgggaccttcctga

SEQ ID NO: 6813473 - DNA, 55 bp, Homo sapiens
tggcaggtcagaatttgaatttgggtctgtagatgccacattttactgtttgcca

SEQ ID NO: 6813474 - DNA, 67 bp, Homo sapiens
cttctgcatggtgaggtgggccacagtgagaaaagtgacccttatggctctctcagtgctgcagagg

SEQ ID NO: 6813475 - DNA, 119 bp, Homo sapiens
agtagtggatgtgaatttggcttgtggtgtataaagatgccatacttactgtacttacatttattaggtagtataatctttgttgttttgatatcatacccaggtttccgtaggcttct

SEQ ID NO: 6813476 - DNA, 69 bp, Homo sapiens
tggtgcacgtagacaggttataaatcagtgaggtgcccttacatgtttgttttctctctctgagcatca

SEQ ID NO: 6813477 - DNA, 60 bp, Homo sapiens
acagcaggatttggcgatgttggcactgttgacattttggactcgttaattctttgttgt

SEQ ID NO: 6813478 - DNA, 82 bp, Homo sapiens
gttcttattttgtggtgtgtagtcagtggactttctatgatgtagtatggtctcttagtgcaacatactaggaaatgggaat

SEQ ID NO: 6813479 - DNA, 72 bp, Homo sapiens
ggtagcctaatgggcttggcgacaatttgaagcaatgagttccctcattcttctgccagggtcagggttacc

SEQ ID NO: 6813480 - DNA, 57 bp, Homo sapiens
ttgcctgttatttctcttcctttcatctcaggaggaagagttgcaaagacgggacag

SEQ ID NO: 6813481 - DNA, 73 bp, Homo sapiens
gcctatagttgagtatggatggccctccgtgagcagttcactgtgcccatgtgggggtacacgtacacatggc

SEQ ID NO: 6813482 - DNA, 79 bp, Homo sapiens
ggcagataactccagcaggtccgagacaagttggtgtaaacgttggcacggactggctcacctgttgtgtgattaagtc

SEQ ID NO: 6813483 - DNA, 103 bp, Homo sapiens
ggggaaatttttaaaaatatgtagggcccgatcccacttaaaccatttaaaacaaactgtctggggatgggagttgggcttcggtgttttttgaaagctccct

SEQ ID NO: 6813484 - DNA, 73 bp, Homo sapiens
agcgcggccatggggatggagatgtcacagtcacaggctctgtggctctgaggaccaattcctgtggcttgct

SEQ ID NO: 6813485 - DNA, 82 bp, Homo sapiens
aaatagtaatttagggaaagatgagaatatgatataaatattaattactatgtatcttttgttttccctgctcaacctgttt

SEQ ID NO: 6813486 - DNA, 69 bp, Homo sapiens
agccttgggggaccgcagaggaggccaccgcataggccaggcatatgcagggtctccatctccccagct

SEQ ID NO: 6813487 - DNA, 92 bp, Homo sapiens
agcctccctaaggggctcagagagagtggggtgtggatttggctggtgaatgggagtcccccactccatttctcactttgcctggggaggct

SEQ ID NO: 6813488 - DNA, 108 bp, Homo sapiens
ctaaacaatatttagatgtgtgctgctgaaaaacaaagtctgctatgaagtttactggcactggctgagttgcttcagcaactgcaggccttctgaagttttggctgg

SEQ ID NO: 6813489 - DNA, 67 bp, Homo sapiens
tatgtggccttattatgtacaaaatgaataagccatcatttccagtactatcataaggagctacgtg

SEQ ID NO: 6813490 - DNA, 122 bp, Homo sapiens
cttctgcttgcccctctgtcactgcaagccatgcatgcatgtgtggagttgctgggaggaccacacctggcgcctgcagagcagcaactgcgtgcgcaaagtggccgagaggctggtaaggg

SEQ ID NO: 6813491 - DNA, 128 bp, Homo sapiens
ccaaaattcgttcttcatatttcaaacaaagatgggaaagagttgtagtcaaagctatgttagctcgcttgtttaaccagtactttacacagctcttgaacatttgctctatgaacaactgatgttgg

SEQ ID NO: 6813492 - DNA, 74 bp, Homo sapiens
ggctgcaggttggttggcagctagagagactcccccatcttccccgtcatatttttgccagctaagctgcagct

SEQ ID NO: 6813493 - DNA, 64 bp, Homo sapiens
ggctgatgagttagtattagtcacttcctgaaaggatagtatcacactgttctaacttgcagct

SEQ ID NO: 6813494 - DNA, 76 bp, Homo sapiens
aggagggcctgcagggaagtcccagctcctggggagaccccttgccccggggcaggagtccctgtagagtcctcct

SEQ ID NO: 6813495 - DNA, 72 bp, Homo sapiens
tagaatcacaagttgagaattccatgctgttgaaactatcaaaagtaatagtgaatcgactatgatgatctg

SEQ ID NO: 6813496 - DNA, 86 bp, Homo sapiens
cagagtttctcaaacaattggttaagacgcatcatgctttatgcaaagagcatgagggtgttaaaaccagattcttgctgactctg

SEQ ID NO: 6813497 - DNA, 58 bp, Homo sapiens
gggtcagggctggctgtcgtcacctggggtgccctgcggtcgcaggcagcactgaccc

SEQ ID NO: 6813498 - DNA, 83 bp, Homo sapiens
gtgagacagcccatgtgatttcctgggagtaagctccacacataggtctgctgcccacaatgattacatggatgatgacttac

SEQ ID NO: 6813499 - DNA, 61 bp, Homo sapiens
agtgctctctgagtgagggacaagctggattcagggccagctggttctcaccaggggtgct

SEQ ID NO: 6813500 - DNA, 64 bp, Homo sapiens
tgaatgaatgatcattataaagtgctctggtaattccatgagctcaactggtggtctttattca

SEQ ID NO: 6813501 - DNA, 60 bp, Homo sapiens
tcagatcagtgctgtcccgacaactgaggccaatgacatggcacgtggcagtagatctga

SEQ ID NO: 6813502 - DNA, 71 bp, Homo sapiens
cttgagcccaggagatggaggttgcagtgagccaagatcacaccactgcactccagcctgctggatttagg

SEQ ID NO: 6813503 - DNA, 88 bp, Homo sapiens
aggtctcagttggcagtgaggcagtggctgagaccaggggctcttctgtgtagcccaggcctggcactgcctttctgcctcgagacct

SEQ ID NO: 6813504 - DNA, 123 bp, Homo sapiens
atatgactaacagtttggattttcaagttcaagaatgtttgtgcagagtcatctgagtcctccctacaggtggtttttttcagcacattttacttagtcaaatcatcaaactattgatcatgt

SEQ ID NO: 6813505 - DNA, 75 bp, Homo sapiens
tcagccatttcctgaactctggacttcaaagatgacatctaccacccctgggtccacttcaggactggccgctga

SEQ ID NO: 6813506 - DNA, 99 bp, Homo sapiens
tggggcctgcaggggacagagcctggtggacactgggcatcatggaactgcccagctgatggcctttttcaccaggctccagtcctgcctctagcccca

SEQ ID NO: 6813507 - DNA, 82 bp, Homo sapiens
gtaaagtaacaaagagaacaataattcttctcaggtccctgatatctcagaggatgctgttctttaatacttgtgtttttgc

SEQ ID NO: 6813508 - DNA, 130 bp, Homo sapiens
gtgaataggttatgtgagaggtgactgggttatttgggaggtgactggtttatctggcagtgactgggttatctggtaggggtgactgttatcggggggtgagttggtttatctggggtgcctgggttgt

SEQ ID NO: 6813509 - DNA, 82 bp, Homo sapiens
tggagtcatcacagcagaatttaggaggcagaagccccacagtttcaaattttgcctatgagttctagcatggtagactcca

SEQ ID NO: 6813510 - DNA, 77 bp, Homo sapiens
cacaatcagttgtatcctgccatggtccatcttcatatgtggagggaaccttggctggattggacagaatgattgtg

SEQ ID NO: 6813511 - DNA, 61 bp, Homo sapiens
gggaagaaataaagagggaaatgtctgtggtacaagaaatgacacttttaatttacttccc

SEQ ID NO: 6813512 - DNA, 85 bp, Homo sapiens
gtgctgagctggaaagggactgattgtagcaggaatgaaagaataggattcacattataatcagttctgctgagcagctgagcac

SEQ ID NO: 6813513 - DNA, 55 bp, Homo sapiens
atctcctgttttgagggggatttaggagcctcaggcttcccttagagcaaaagat

SEQ ID NO: 6813514 - DNA, 61 bp, Homo sapiens
ctggtgtcagaactgctgcagataccctataagcagagaggggctgctccagtctggccag

SEQ ID NO: 6813515 - DNA, 105 bp, Homo sapiens
tcacacataagaagtgaaatacaaattcaaattacaatagttgttttctaatttatcagtttggcaaagataaaatgatttgatttgtgttgctaagggtgtaga

SEQ ID NO: 6813516 - DNA, 82 bp, Homo sapiens
tagactgttttgctctggggcctgaggattgcggggccagggaagcaaccaggcccagtctggggccctgtgaagcgatctg

SEQ ID NO: 6813517 - DNA, 76 bp, Homo sapiens
gtggtcctctgagcacgccaggcacgagtgtgcagggagctgctgcaaatgcctcggtgtgcgggtgagcttccgc

SEQ ID NO: 6813518 - DNA, 72 bp, Homo sapiens
gggtgggccggggggtggaaaatgatttcagcccagcacttccaagctgctgtcatagccatccctcccctc

SEQ ID NO: 6813519 - DNA, 78 bp, Homo sapiens
ggttcaggtatgagataaatcaatgaaccccttgaagtggaattgggttgtttgaacactaattttaagccatggacc

SEQ ID NO: 6813520 - DNA, 69 bp, Homo sapiens
ggttttctgattagcaaatctgagggcagggagatattgtgatcaggactgtttgattctggggaagcc

SEQ ID NO: 6813521 - DNA, 74 bp, Homo sapiens
ggaatttttgagatgggtcttgctcttgtcacccaggctggagtgcagtggcacgatctcagctcactgaaacc

SEQ ID NO: 6813522 - DNA, 105 bp, Homo sapiens
gctctgtctctccttggctcggtgaccagccagtgctgtctgtcaagggctggcctctgcggggcagatgctcctggctcttcccgacaggtgagaaatggaagc

SEQ ID NO: 6813523 - DNA, 68 bp, Homo sapiens
ccccagcactgcccaggacctgccaccccgagtgttgcatgggtggctcctatgggcatagccagggg

SEQ ID NO: 6813524 - DNA, 61 bp, Homo sapiens
cgtgccattgttgctgttgaaccctgctgaggtccctgtcttgctccaggaacactggccg

SEQ ID NO: 6813525 - DNA, 81 bp, Homo sapiens
ggaaaaattgggctaaatagagaaaggatattgggaggaaaaatacccaatcttatatcaactgtttggcccagttttgcc

SEQ ID NO: 6813526 - DNA, 57 bp, Homo sapiens
agggaattggaacaccttgccaatgtagtcactatggcaagtcatttctagtaacct

SEQ ID NO: 6813527 - DNA, 72 bp, Homo sapiens
aggcaagattaaaacctttgcctggaagggagtcggaagattctctgggttccagtaaatggtctcatgcct

SEQ ID NO: 6813528 - DNA, 86 bp, Homo sapiens
ggagaatcgcttgaacccagggtggaggttgcagtgagccaagatcgcaccattgcactccggcctgggtgacagggtgagattcc

SEQ ID NO: 6813529 - DNA, 63 bp, Homo sapiens
tgggtatacataggtaacaacatggttatgcaatttttatgtatgcttgagtgtgtatactca

SEQ ID NO: 6813530 - DNA, 68 bp, Homo sapiens
agctctgtaggtcttatcttaggaggatctttgactccttaaatacacatcagataagcttcagagct

SEQ ID NO: 6813531 - DNA, 98 bp, Homo sapiens
cctttttagtgctattgtgatatggaaagagtgcagactgtggagttaaccacatctgggttctcttcttcattcttctatcgcgtgacctcaagagg

SEQ ID NO: 6813532 - DNA, 75 bp, Homo sapiens
gcaggaaaacctgatcagttccaactgggcaggatggacattccgtttggggttcagagtgggaatgatcactgc

SEQ ID NO: 6813533 - DNA, 130 bp, Homo sapiens
acattgctaatcagtcacagcattcttcctgctgagaacccagattactagtcctttgagatttagataaaaatggactggaatttcctatctcacatcttgaagaaatccagtgatggccccaagattt

SEQ ID NO: 6813534 - DNA, 57 bp, Homo sapiens
aagcagaatttcccactagttgtttgaatgacactggcaccaagggaaatactgctt

SEQ ID NO: 6813535 - DNA, 74 bp, Homo sapiens
gtccagctgctgtgcctttgccacttctcagtgctgagctggtttggcagggaatgtggcaggcagcagttggc

SEQ ID NO: 6813536 - DNA, 99 bp, Homo sapiens
gaggcaggagaatcgcttgaaccgggaggccgaggttgcagtgagccgagatcgtgccactgcactccagcctgggcggcagagcgagactcccgtctc

SEQ ID NO: 6813537 - DNA, 78 bp, Homo sapiens
agaataaacatactctcatatttgaagtgaccaatgatatatccttattggtgcaattatgagggtgtgttccattct

SEQ ID NO: 6813538 - DNA, 89 bp, Homo sapiens
caccctttctctccttgcacaaccacatgttgcttttggctaagccctctggtacagttactgttatatgtgctgcagagaagagggtg

SEQ ID NO: 6813539 - DNA, 66 bp, Homo sapiens
tcatccagcggttgtcagctatccaggctcatgtggtgcctgtgatggtgttacactgttggaaga

SEQ ID NO: 6813540 - DNA, 78 bp, Homo sapiens
ggattaacaaagcaatgaatcgagttgcttgttttgtgaattcaagctcactatcacaggtacacttgattgcaatcc

SEQ ID NO: 6813541 - DNA, 78 bp, Homo sapiens
gctggttcacagaagctgccaggagaatggccttccttaactcttggccagaggtttctctcatgtggtgacaccagc

SEQ ID NO: 6813542 - DNA, 61 bp, Homo sapiens
gccagaccacaggatctgatgttggccaagaggccatggccacaggctttctgaggctggc

SEQ ID NO: 6813543 - DNA, 78 bp, Homo sapiens
ggggaagaaataaacagctaatctccattgtgtgcactagaaacagaatctagtgtaatgacacaggttattctctcc

SEQ ID NO: 6813544 - DNA, 76 bp, Homo sapiens
gagtagttattgggttaaaattgcatatatacaatgtctatctctatatgacaggtatgccttataatcactactc

SEQ ID NO: 6813545 - DNA, 62 bp, Homo sapiens
tttgccttcagtttggcttaatatcattcaccattttagatagtgggatactggaaggtaga

SEQ ID NO: 6813546 - DNA, 71 bp, Homo sapiens
catcaagtgacaagacctgtgggcctgtctctcctgctgcaggggccctgctggtcttgttcacgcaggtg

SEQ ID NO: 6813547 - DNA, 91 bp, Homo sapiens
tacttcttccttgcaaagcaaaacattctgtgaactctcaatttttgagaaaatagttcgaatgttcttgctggagtgagtcagcaaagtg

SEQ ID NO: 6813548 - DNA, 72 bp, Homo sapiens
agctcctaggcatgcaaataaatgtgcacactggaaattgagttctgcaatttttccatgacctagaaagct

SEQ ID NO: 6813549 - DNA, 87 bp, Homo sapiens
gcattagattttcaaaaggagccacaatctagatcccttgcatgtgcagttcacaatagggtttgtgctcctatgagaatctaatgc

SEQ ID NO: 6813550 - DNA, 130 bp, Homo sapiens
gggtcaatttaaattggtcagcacgctgttctgttctgaggggttgaggctctcccaaattatcatccctaggactgctgcattcatatcagatagaagaggtgaaggacctgaattatatgttgagccc

SEQ ID NO: 6813551 - DNA, 67 bp, Homo sapiens
agttgcaagcaggtgggcagatattacaataggagcttgtagaattattctctcaattgcttcaatt

SEQ ID NO: 6813552 - DNA, 76 bp, Homo sapiens
gccacccctaagcatcagtgcacacaatcctctgccgagtttcatttctgttggatgtgacactgttaggtgaggc

SEQ ID NO: 6813553 - DNA, 101 bp, Homo sapiens
ctgttgctttgtgcctagttgtctgcttctgctttgctgcattgcgactgggaaactgcaggagctggagctggcagttgcgataatgcagaaagcagcag

SEQ ID NO: 6813554 - DNA, 70 bp, Homo sapiens
agcaaatgtttccgttaaacaaatgtgtattttatttgaaacagatgaaatcataacagtttggcttgct

SEQ ID NO: 6813555 - DNA, 76 bp, Homo sapiens
attctctcacagtgagctgggcatcagtttcctcatatgagaagtctgtctggatagccacagtgaatctgggaat

SEQ ID NO: 6813556 - DNA, 55 bp, Homo sapiens
ggtgcctcagccagggcatctgatgactacacttgcagaagatggtctgagcacc

SEQ ID NO: 6813557 - DNA, 77 bp, Homo sapiens
cagacccaaaaagagttgattcataggttttagagaaaagtttaaaagttggatggactcttggtctatttgggctg

SEQ ID NO: 6813558 - DNA, 87 bp, Homo sapiens
ggtccagaactgggctcgctctggtttggctctgttaaaacgtcgatgcaggccctgggcagttggagtgaggcggttcttgtgatc

SEQ ID NO: 6813559 - DNA, 115 bp, Homo sapiens
ccgggtttgctttcttctcagcctgcgaggctcctcattcagtatgctgtgttgtgtggttagctgttccatagtcatactgaaagtggcttctcagatgctgcttgagtcctgg

SEQ ID NO: 6813560 - DNA, 81 bp, Homo sapiens
gagtagcaaaattcttccaagtctaagttataaatctcagaactcactgaaggatttgtgagttaacttgttttgttgttt

SEQ ID NO: 6813561 - DNA, 55 bp, Homo sapiens
ttctggattttccaactcactgactctggcaaggaagtgatctgggcctttagga

SEQ ID NO: 6813562 - DNA, 66 bp, Homo sapiens
tgccagggagagagggctgcctggtgtgaggtggaccccacctgcccaggagtctctctgtgggca

SEQ ID NO: 6813563 - DNA, 76 bp, Homo sapiens
ttgatgtaagaagaggtggactggaacctgttatatgataagacatgacaggaacccagaaacatttctatatcag

SEQ ID NO: 6813564 - DNA, 57 bp, Homo sapiens
gggatgtggaactcagctggttcactgcagaaccaggagcagctgtgttttcatcct

SEQ ID NO: 6813565 - DNA, 62 bp, Homo sapiens
aggttattgacttctgctctgagctgagcctacaggggcccaggagacatatagaaggacct

SEQ ID NO: 6813566 - DNA, 78 bp, Homo sapiens
atgtgcccacctcccttgagctcgagagctttggtccagctctgtgtctgcagggacatagctcagagctcagcacat

SEQ ID NO: 6813567 - DNA, 61 bp, Homo sapiens
taagtgtctgtaatagtcactatgtgaaatgtaagctgctctcacaattatgagacactta

SEQ ID NO: 6813568 - DNA, 85 bp, Homo sapiens
taaacttcaaagtttggattctcactttaaagcaagggacaaacccctttgtaactggacaagatattcatcactctgaggtttg

SEQ ID NO: 6813569 - DNA, 77 bp, Homo sapiens
gtcttcaggcttatgccatcttccagagacctgcagcagttctgtcagtcccttaaaggtggcagcagcttgaaggc

SEQ ID NO: 6813570 - DNA, 62 bp, Homo sapiens
gaggaaaggctattgctgataatgttttcagtggaaaaacatttcacccatggtctttcctc

SEQ ID NO: 6813571 - DNA, 95 bp, Homo sapiens
agattgacctgtcagggggtttgacagcagtaggagtttccagggtgggaagactcaagaaggagactccactgtgatcctgtgtggttcaatct

SEQ ID NO: 6813572 - DNA, 55 bp, Homo sapiens
cccttccccactttcatgagattagagagataagaacaggaacatggagggaggg

SEQ ID NO: 6813573 - DNA, 57 bp, Homo sapiens
tctttcaaccaagggactatgggtctgtgaattgacttaggtctgagaactgagaga

SEQ ID NO: 6813574 - DNA, 63 bp, Homo sapiens
acagacttcagaggcttgcatttgctttgagcaatgtggcaacattgcttctggagcttctgt

SEQ ID NO: 6813575 - DNA, 73 bp, Homo sapiens
aggttctgttttaggaacattcgtcttgtagaggtaagaagactgcttcaagaatcttcctgaccactaacct

SEQ ID NO: 6813576 - DNA, 58 bp, Homo sapiens
agccttcttagggtcattcctctctggggagtggggagagtgggacatgggagtggtt

SEQ ID NO: 6813577 - DNA, 71 bp, Homo sapiens
aaggaaggacacggggctggctctggtacccccatggtgggcatggggtcggcctgctctgtgctttgctt

SEQ ID NO: 6813578 - DNA, 68 bp, Homo sapiens
caaagggcattttagtgaactgctagggtactcaacctatcatcacatttaattaaaatgtcattttg

SEQ ID NO: 6813579 - DNA, 74 bp, Homo sapiens
aggctgggcatttacataatcttatttaccttcactacagccctcaaaggtagatattgtgaatgttccagttt

SEQ ID NO: 6813580 - DNA, 88 bp, Homo sapiens
gcctcactgaggaatgagggagatgttggtgcatttgaggaactcagaggcatgtaccaacatccccctcattcctcaatctttaggc

SEQ ID NO: 6813581 - DNA, 69 bp, Homo sapiens
cacagttctggaggctggtttctgctgaggcctctctcctggcttgcggaccgttaccttctcactgtg

SEQ ID NO: 6813582 - DNA, 95 bp, Homo sapiens
tctctcgctccctccttgctgccgcattcttctgccttcatcctcttcctttgcaggtagaaagatctgtaggcaagagctaaggggaggaaaga

SEQ ID NO: 6813583 - DNA, 55 bp, Homo sapiens
ctgtccactgttctctgttgtcagcctcacagcacccagaaggagctatgggcag

SEQ ID NO: 6813584 - DNA, 76 bp, Homo sapiens
gataagagctttcatggctgtggggttaacatattttctttaaaaatgtagcactcatcaactatgttctcttatc

SEQ ID NO: 6813585 - DNA, 61 bp, Homo sapiens
tcctcccttctcactgggaagggctgcctgagatgtttccttccttctgaggtgaggagga

SEQ ID NO: 6813586 - DNA, 85 bp, Homo sapiens
atattaggttggtgcaagggtaattgcggttttgccattaaaaatattggcaaaaaccacaattacttttgcactaacctaatat

SEQ ID NO: 6813587 - DNA, 57 bp, Homo sapiens
gtgccaacaatgagaagtcactctctccagccaggatttccctcattgtgttggcac

SEQ ID NO: 6813588 - DNA, 79 bp, Homo sapiens
tggcagaattctctcagagtccccacatctgggtctcttcccttttggaggctgggatggcggagactgtgagctgcga

SEQ ID NO: 6813589 - DNA, 80 bp, Homo sapiens
catgactcattagtgagttgattatattttaccattgttgttcatattttgtcgatgttcttataccattgtgggtcatg

SEQ ID NO: 6813590 - DNA, 55 bp, Homo sapiens
ggcaggtgatctagagtcaatagtgacttacaaagtgttgaccttggttacctct

SEQ ID NO: 6813591 - DNA, 75 bp, Homo sapiens
aatctgtaagcaccactccaaaattgttgtttgaagcttctgaaacaacaggatactcgggggtgcttgtgggtt

SEQ ID NO: 6813592 - DNA, 90 bp, Homo sapiens
ccctggcataaatatgtaactgagaggtaatcacacaaaatatatagttgtatttttgtgtgtttgcttttaaacattgtattttcaggg

SEQ ID NO: 6813593 - DNA, 55 bp, Homo sapiens
ccctagagaaatagcaattagaggtgaaccatctagttctgtaacatttcaaggg

SEQ ID NO: 6813594 - DNA, 59 bp, Homo sapiens
tatgcactgaaaattaacagttggttttatctgggcatgttttgttgaggcagtgtgta

SEQ ID NO: 6813595 - DNA, 97 bp, Homo sapiens
gtcagagcaccgacatgcagcagggtcccttcctcatcgtgactgtcagccagagaaggcagtgacatacctggagggcacctgttgcatctctgcc

SEQ ID NO: 6813596 - DNA, 61 bp, Homo sapiens
gcatttactgtgctagagcatttgtttctcagagcccaaaagctctttctgctgtagatgt

SEQ ID NO: 6813597 - DNA, 56 bp, Homo sapiens
tggccaatggggactagggttgtataattggaaaatacagtctcccctgttgtcca

SEQ ID NO: 6813598 - DNA, 71 bp, Homo sapiens
ggtaataacaccagtcatttattcagtcattcatttattcaaaaatgtttgttaattgtctggtaattgcc

SEQ ID NO: 6813599 - DNA, 129 bp, Homo sapiens
aggggagggatgattttgcatatggatgggcaacacgctgggtttttacagtcttacacccagattttaatgtttgcagtgtaaaggaatccaggtggtcctgagtggcaactgaatcattctttctct

SEQ ID NO: 6813600 - DNA, 86 bp, Homo sapiens
ggggcagggaatgaaagcggcgcttgagactggaaatttagggagatgagttccttgggaacaacgctgaaccatctcactgcccc

SEQ ID NO: 6813601 - DNA, 56 bp, Homo sapiens
gggtgcattggcaatccaatctctccttgatcgggattgatcaggatcaatcaccc

SEQ ID NO: 6813602 - DNA, 74 bp, Homo sapiens
gtgaaatatgggatgctgtcgcagagatgggtttcttctccagtgtctgatgcacagttgtcccttggttgaac

SEQ ID NO: 6813603 - DNA, 61 bp, Homo sapiens
tgctcagagggtgatgtcattttctgtaagggcaagcagcctgaggttctccctgtgagca

SEQ ID NO: 6813604 - DNA, 72 bp, Homo sapiens
gcccaggataaccatggagctttggttgaaagtgtaagcactcacagggcattatggctccagggtcagggc

SEQ ID NO: 6813605 - DNA, 126 bp, Homo sapiens
aagctcaaggaaggatgatccctgcctcaggaagttttgaatcaactgctatttttaacaagtatacagtagaacttgagatcaggtcttcactcagttggtaggaaaagttttccgctgaagctt

SEQ ID NO: 6813606 - DNA, 66 bp, Homo sapiens
tgtggcatgtttcatcacatcaagataattaagccaattttcactgatgcttatgaaagtgtgaca

SEQ ID NO: 6813607 - DNA, 82 bp, Homo sapiens
cttcagaaattggtttagctctttcctgtacagagactcacatatctgtctaatgtgctctgtaggggaaagagagctgaag

SEQ ID NO: 6813608 - DNA, 98 bp, Homo sapiens
gcaccccttcctcaagatgactgacatttattagaaaactatcatagtaactatccacacaatgactatgaggtgaatggtgtccctggaagctgtgc

SEQ ID NO: 6813609 - DNA, 111 bp, Homo sapiens
caccatcttctttgaatctacccttagaggtgacatgccatcactttcattccttggagaccgatgaataagtcctggccaccctcaagggaagcagagagtactagggtg

SEQ ID NO: 6813610 - DNA, 81 bp, Homo sapiens
tctctgtgcctccagggcagaaaaagagggaatgagggaagcctcattacctggaatgctctgtctgcggcacgccaggga

SEQ ID NO: 6813611 - DNA, 55 bp, Homo sapiens
tccctcatcctgacagctggccctgcattatagccagcccttgagatggaaggga

SEQ ID NO: 6813612 - DNA, 75 bp, Homo sapiens
aagccaagagctcccagacctgggcagctcaggagctgacagaaaccaccccccaggtctggagttcaagggttt

SEQ ID NO: 6813613 - DNA, 71 bp, Homo sapiens
agcctctagccctgggaggccagcttgtagctccttatctggcattgcagaagaccttccagggctgagct

SEQ ID NO: 6813614 - DNA, 59 bp, Homo sapiens
tcaactgataaagttgccttagatgttccttttgtctgagggacaattttgatggtaga

SEQ ID NO: 6813615 - DNA, 70 bp, Homo sapiens
ttgtgttcattctgagcccttgtcttcatggtaagaactgtgtccacggctgagaatgattaaagcacaa

SEQ ID NO: 6813616 - DNA, 128 bp, Homo sapiens
agaatcccattaaatttgaatttcagataagcaataaataatttttagtataagtaggtctcatgcattatttgggatgtactaaaaacttttgctgtttatctgaaattgaaatttaactgacatct

SEQ ID NO: 6813617 - DNA, 66 bp, Homo sapiens
gggttccacgtgcagagcctcactccttcctgggagaggactgattgggatgccatgtaggaaccc

SEQ ID NO: 6813618 - DNA, 57 bp, Homo sapiens
gggtttgtttttgttcctgtaaaactggattggttctgcagaggcacaaacaagccc

SEQ ID NO: 6813619 - DNA, 72 bp, Homo sapiens
cttattctactttggacataaaggactgatatccactgaatctgtctactaaggtatgtctaaaagcataag

SEQ ID NO: 6813620 - DNA, 92 bp, Homo sapiens
gctgctgggtgccggggcaggagtgtgagtttggttgagacttaagaaactcactcttaagtctcaacctccctcacctcggtttcctcagc

SEQ ID NO: 6813621 - DNA, 59 bp, Homo sapiens
gcacagagctggccctccaggcctctcagccaacagggttctacatccagcatctgtgt

SEQ ID NO: 6813622 - DNA, 77 bp, Homo sapiens
gctaagcctggttctaagggcttgaaatgtatcagcaaacaaagtagatcaagcccttacagagcttctattttggc

SEQ ID NO: 6813623 - DNA, 78 bp, Homo sapiens
ccacacacaggagagagttgggaaggaggagggtatttcgattctcagggtctttcccaattgttttctgtgatttgg

SEQ ID NO: 6813624 - DNA, 94 bp, Homo sapiens
tctgtcacctctagccatttgtttacactgaagtgttcttctgacattaatgctatcagtgtttgtggcaaatgttagtctttggtggtataga

SEQ ID NO: 6813625 - DNA, 81 bp, Homo sapiens
gcctttgccaggacatgtgataaaggcccgcagatccttgatcaaggtgtcagccactttgtcggagctcctggaaagggc

SEQ ID NO: 6813626 - DNA, 72 bp, Homo sapiens
ggaggcggacatccgcaggttataaagccccagaagatctggggtcctgtgagctgccggtgttccacaccc

SEQ ID NO: 6813627 - DNA, 114 bp, Homo sapiens
gctacagaggtatacaaataggagagtcatagaaaattgctggcagcctttattcaagcccttatggagaaaggatgccatgattgaaggcctcagtttgtcaatccaagtggt

SEQ ID NO: 6813628 - DNA, 91 bp, Homo sapiens
ggcacctccaagaagtgtcattcctggcatctgtctggggctctggcagtgtgccaggaactggctgctggttctgaactcttgccgggct

SEQ ID NO: 6813629 - DNA, 88 bp, Homo sapiens
tggccctctggtctcagagtctcccccagtttgggcagcagattccaagggcccaggagagactctggagagcccagccaaagggcca

SEQ ID NO: 6813630 - DNA, 66 bp, Homo sapiens
tctaggtggatgaggaacatagaagtcagaaaaagaagaaactgtggaggccacatcccacccaga

SEQ ID NO: 6813631 - DNA, 77 bp, Homo sapiens
tctgtgaaatgagaatcatcttattccctacctcacagcagtattgtgaggctcacgaacagaagactcaacacaga

SEQ ID NO: 6813632 - DNA, 113 bp, Homo sapiens
ggtccagttgatattatcaagtacactgaatttgactgtgttcaccacgttctggctccagagaaatgagagtcactagtgaagttggtgccattttgtgtatcttctgcacc

SEQ ID NO: 6813633 - DNA, 99 bp, Homo sapiens
tggcagaagacagactggagtgggctaaagagaagatgtttgctgaggtggtagaggccgtgttcctagacagttcttcccaaaagttttcttctgcta

SEQ ID NO: 6813634 - DNA, 59 bp, Homo sapiens
ccaagggcctccaccttgctcgtcgtcagaggcagacagccaggacttggccctcttgg

SEQ ID NO: 6813635 - DNA, 127 bp, Homo sapiens
tcaattaaaggataatttttattattatgttaaaatgttttgattaatgtgtagttaagcaggtgttaaactagattttggccattatacaagacataagcatggtacttaattatatgttagttga

SEQ ID NO: 6813636 - DNA, 89 bp, Homo sapiens
ttctttgctgaaggggaggaggaggaagggctgcctgccgggctcagggtgagcctccctgctgtccttcctacccttgccctagagaa

SEQ ID NO: 6813637 - DNA, 121 bp, Homo sapiens
gcttctgatgcactgtcatttggaaaccactgccctaggtcaaaccatgccatgatagttcccacatcacgtcatggtttgatctggactttaggaaagtgactggtggcaggcttgaagc

SEQ ID NO: 6813638 - DNA, 83 bp, Homo sapiens
gcttagaagcttgatgagggggaacagagattttaattgtaattgcagaaattatagaattcgcttcactgtgctgtctaggc

SEQ ID NO: 6813639 - DNA, 73 bp, Homo sapiens
tgtttgggaagcaagtgggaggagagcaggccaaggggctatataacccttcagctttcagcttccctgaaca

SEQ ID NO: 6813640 - DNA, 60 bp, Homo sapiens
gtgtaggatttgttgagtttcttagatctgttttttcatgaaatttaggaaattttacgc

SEQ ID NO: 6813641 - DNA, 77 bp, Homo sapiens
gtcattcctggttgctggctctgaagggcaggtaaattagatcaatgtggcctggaggggaccaggaccaggatgac

SEQ ID NO: 6813642 - DNA, 72 bp, Homo sapiens
tgtcctggcatggactagtgctgaggtgggaaatagaaaattcacatttggtttctgggccaagttggggca

SEQ ID NO: 6813643 - DNA, 59 bp, Homo sapiens
tttgctatgaggtgcagtctgagctttttctcagactgtcttagctttatacctacaga

SEQ ID NO: 6813644 - DNA, 56 bp, Homo sapiens
gtacatatcattatgttatgagcacatacatgtatgtgttatgcgtatgtgtgtat

SEQ ID NO: 6813645 - DNA, 75 bp, Homo sapiens
agcttaagtgcaggatgttgggaatcaggactccaattcattgaacatgtgcctgatcctttcacctgtgaagtt

SEQ ID NO: 6813646 - DNA, 82 bp, Homo sapiens
gccccccttcctggtctctgctcacatggctccatgcaggcctcccggccctggtgctgctctgtgtggcagaaagatgggt

SEQ ID NO: 6813647 - DNA, 128 bp, Homo sapiens
tctaaataaaggattatattagctaaaaacgattgaacttgagatatgagtaggtacctttctagtatctggttttgttacaggttcttatggttgattttctgcctgtaatgtagtattttaataga

SEQ ID NO: 6813648 - DNA, 56 bp, Homo sapiens
gaaaggtgagatttgctgcgtccacgtgttgtggagcaaattcaagctcatctttt

SEQ ID NO: 6813649 - DNA, 63 bp, Homo sapiens
tgagtcaatgagttaaataatgggatatgctgtgggcatgtcacagtctgactcagtgactca

SEQ ID NO: 6813650 - DNA, 65 bp, Homo sapiens
agcaactgatattaacaggcaagtgagtgctggtaaagcctctggctctgttgagatttgtagct

SEQ ID NO: 6813651 - DNA, 87 bp, Homo sapiens
atgtttgtttaccagtagtaacaggtgtacagactatcaggtgtcattatgacagatagcacacttgttgcttctgctgtcaagcat

SEQ ID NO: 6813652 - DNA, 76 bp, Homo sapiens
tgattgatgcttgatcattcactggctctgtgaacttgaaaaaggaactgaagctattagaatttaagtttaatca

SEQ ID NO: 6813653 - DNA, 56 bp, Homo sapiens
tagggctgtggtcagtcctctaccttgtcatatagcacagtgtaccacagtcccta

SEQ ID NO: 6813654 - DNA, 88 bp, Homo sapiens
cccagattacatgagttaatgaatatgaagataggtttccccttactaggaaatcagtaaatgttcattaactgtatttaatgcttgg

SEQ ID NO: 6813655 - DNA, 68 bp, Homo sapiens
gtcgatctgagcctatggtcagcatttgccaatagtgtgtacatgcagattatagctaatgatttgat

SEQ ID NO: 6813656 - DNA, 79 bp, Homo sapiens
tactagtcttttaacatgtttcaattgtttgattttcttttaaagaacttcaaaaataagtgagaggtaaaggactgta

SEQ ID NO: 6813657 - DNA, 57 bp, Homo sapiens
aagtttggaatgatagagacctgagttcaagctctggctctgccacttaccagattt

SEQ ID NO: 6813658 - DNA, 58 bp, Homo sapiens
agtgatcctcctgccttagcctcccaaagtgcagaaattacaggcatgaggcatcact

SEQ ID NO: 6813659 - DNA, 82 bp, Homo sapiens
ctgagtcctccctcctggtgagcaggggctagaacagaggtagtcctgcaggcctctgcctcatctgggcacaagggcttag

SEQ ID NO: 6813660 - DNA, 67 bp, Homo sapiens
cctcagtttctctgtctgttacattgggatccccactccctctcagtgtgaattcaggagcctaagg

SEQ ID NO: 6813661 - DNA, 90 bp, Homo sapiens
gcacttagcaagtaacctggagtgctggtttcactggggtgaacaagccagtcaaagccagcattccagccccttttttgttccaagtgc

SEQ ID NO: 6813662 - DNA, 61 bp, Homo sapiens
ggactgcagatagacaagagcctccacttgaggtggggacccttcctgtgctgctgtgtcc

SEQ ID NO: 6813663 - DNA, 130 bp, Homo sapiens
cctagcaatttactcaacatttctctgagggcccaggccactgggtgtaaaggacttaagcacctgttcacatctaatagcttggtcatatacgtctccgggggttgctgggccagaacatggggagagg

SEQ ID NO: 6813664 - DNA, 55 bp, Homo sapiens
ccaagaggtatcttgccataaagatcttcctcccgtggtttcaagttgcctctgg

SEQ ID NO: 6813665 - DNA, 69 bp, Homo sapiens
gcaccacgaagcaaaggcaggagcttgtgagcttgtgagctgacccctctggccttggcctcttagtgt

SEQ ID NO: 6813666 - DNA, 59 bp, Homo sapiens
tctggcaggggttctgcacttgacctaagaggtaaggcaccagcacttctgaaaccaga

SEQ ID NO: 6813667 - DNA, 70 bp, Homo sapiens
cttgccatggccgccgctgctcaggaaagaactttccttagtgctcctgcagcagagggcgggcagcaag

SEQ ID NO: 6813668 - DNA, 64 bp, Homo sapiens
gaacactgtgcattggattcctggtgctccacctcagagccagcttccatggccacgtcagttc

SEQ ID NO: 6813669 - DNA, 73 bp, Homo sapiens
gtagaaaataatatcccaggtgggcacctcgaggaagtgtctttctctggcgccctcctggaattgtgactac

SEQ ID NO: 6813670 - DNA, 72 bp, Homo sapiens
gaacgtcagaggtgagcttcttgctaaggttttgctgtccttaaccttcagcagagctcatttttcacagtc

SEQ ID NO: 6813671 - DNA, 59 bp, Homo sapiens
tcttccacttgcaagtttatggaaatatcagtatgtcaaaataaataaaaagtgggaga

SEQ ID NO: 6813672 - DNA, 91 bp, Homo sapiens
ggttccaagcatttcaggtagagatattcaccctgtagaacgctttgattctgaagaacatatgatatacaaatcctgagattctggggct

SEQ ID NO: 6813673 - DNA, 103 bp, Homo sapiens
ctgcctttccaccttgctctgcagatccagcctccatcccaccacttctcccccgagcaggtaagagtcagagtgctggggtgcagagaggtggggagggcgg

SEQ ID NO: 6813674 - DNA, 70 bp, Homo sapiens
ccacatctgcaaagtcctttttgccatgcaaggtacatacataatcacaggtttcaaggataagatgtgg

SEQ ID NO: 6813675 - DNA, 55 bp, Homo sapiens
tggggtagggaaaagaagtcgagtcctgatggccatcttctttcctctgcaccca

SEQ ID NO: 6813676 - DNA, 73 bp, Homo sapiens
gtcacttagctgttgaaaatttctcagatggctccccttctttgccataaatatttcatagcagatgagtgat

SEQ ID NO: 6813677 - DNA, 73 bp, Homo sapiens
gttcccctgcatttccacctggccacagcaagcagtgatgctgagctgatagccctgggtggggcagggacac

SEQ ID NO: 6813678 - DNA, 69 bp, Homo sapiens
gcatgtctgtgcttggtataataagcctattaaaaggaagtggtctgtctatacctgatacagagttgc

SEQ ID NO: 6813679 - DNA, 61 bp, Homo sapiens
ggaccccggagagggtgcctggaagccaggctgggcaggtatggctgcatcctctgggtcc

SEQ ID NO: 6813680 - DNA, 67 bp, Homo sapiens
gctccaggaggtgcaccagttgtgaggttttggaaaagatctcatgctgtagtgcactaactggagt

SEQ ID NO: 6813681 - DNA, 64 bp, Homo sapiens
ttgatcattttagtctaataaaagtggagttttatggctcattttaattagggtggataatcag

SEQ ID NO: 6813682 - DNA, 81 bp, Homo sapiens
cggcagcaagtctggagggcgatgaggggcatgaggaagtagcttcagcccagaccacctcattgcctcctgtgcgggctg

SEQ ID NO: 6813683 - DNA, 79 bp, Homo sapiens
gattttcatgtgacagttaaaagaagtctatcttagaagtttaattgtaacttagaagtttaattgtatactgaaaatt

SEQ ID NO: 6813684 - DNA, 61 bp, Homo sapiens
gcccaggctccagcttcctgctcagccttaggtcaggagtggtgggttgggatgcctgggc

SEQ ID NO: 6813685 - DNA, 123 bp, Homo sapiens
ttcaagcaacagcctgtgtgttccccaggagttatgctgaggggcaaggttttatgcagctctgtgttcacagcactaacagcaccaggtaaacaacaggcactcaataaatgttgacatgaa

SEQ ID NO: 6813686 - DNA, 55 bp, Homo sapiens
tgcattctttgcaggctacttgtacacagcaaggacgtttcctggagagaattca

SEQ ID NO: 6813687 - DNA, 80 bp, Homo sapiens
ggcccacttgaaagtgctttcccacatttgttgcaatgccaaagtatagaaggaagtgcagggggaagtactgtcaggcc

SEQ ID NO: 6813688 - DNA, 60 bp, Homo sapiens
agggggcattatgaggcttttccacaccatctatgtgcctgagcacttgtggtcctccct

SEQ ID NO: 6813689 - DNA, 111 bp, Homo sapiens
aaggtctgaagaaactgtttcctcttctgccaagcaagtcatcttttatagacagtgagtgctggtcataaagcttgttgcatttagagaaaattaatttctacagatttt

SEQ ID NO: 6813690 - DNA, 69 bp, Homo sapiens
tctgcctgccctgtatcttctcccaatcccccaaatcagggggaagtgagctttgaaatagggcaggga

SEQ ID NO: 6813691 - DNA, 72 bp, Homo sapiens
aggatgacttccctctgccaccttgaaaaggctttgaaacctacaaaacaagaaatggggaggggagttgct

SEQ ID NO: 6813692 - DNA, 77 bp, Homo sapiens
tcactattagcagtatgattgccagttctatcttggtgctgagatgaccaaatggcagtcatcatttttatgtttga

SEQ ID NO: 6813693 - DNA, 63 bp, Homo sapiens
cccttcgccgatgcttgctctgtgctccctcctcagcttccagcacaggctttggtgtgaggg

SEQ ID NO: 6813694 - DNA, 72 bp, Homo sapiens
ggtagaacactggggctctgttgtcctatagtgaccaaaaagctcattcagctagagttcagtgcagtcacc

SEQ ID NO: 6813695 - DNA, 129 bp, Homo sapiens
ctgctgctcatgctcatacaagtcccaatagagaggtttcttccattgtactccctctcctgcccgagcaagagtgccgtccaagaggtctgagtatagggagccctgggatgggcctgaagcaatgtg

SEQ ID NO: 6813696 - DNA, 59 bp, Homo sapiens
cagagtcaatcttatcagttaataaagtcaagttgttgattcagagaagattggccctg

SEQ ID NO: 6813697 - DNA, 102 bp, Homo sapiens
agcttcttttgttgaattaaatccattttgttaagggctttgtatgcaaacctatatccttaagagattaaagatgtaatttagacacacattttagaagct

SEQ ID NO: 6813698 - DNA, 69 bp, Homo sapiens
tcaacagcatggagtcctccaggttggtgcatctctaaacttgacccacctggagatccatggtgtcga

SEQ ID NO: 6813699 - DNA, 93 bp, Homo sapiens
gccccggagacctggaggacagcagtgctggcacttgggtgtccatgggcccgtctgccggctctgcctgtgctgcaagtgttggccgtgggt

SEQ ID NO: 6813700 - DNA, 73 bp, Homo sapiens
ctgaatggaaaggattccaaggccagagaaaagggtgggcctttcctctggccttggaatcctttccattcag

SEQ ID NO: 6813701 - DNA, 58 bp, Homo sapiens
gctgttctgtaaagtaaggataaaaacacctatcccgtgacatgttttgcagaacagc

SEQ ID NO: 6813702 - DNA, 89 bp, Homo sapiens
ggagtatcactctgtcatccaggctggagtgcagtggcacgatcttggctcactgcaacctctgcccccacgggttcaagtgattctcc

SEQ ID NO: 6813703 - DNA, 68 bp, Homo sapiens
ttggttgaatttagattagagcagagacgtcatttgatcttagtgatgtacttgccttatctatccaa

SEQ ID NO: 6813704 - DNA, 87 bp, Homo sapiens
gcatttgaggtgtggcctgattttgcatctctaacaagcttcaagctaatatagatgctgctggtcttggaacatactttgagtagc

SEQ ID NO: 6813705 - DNA, 87 bp, Homo sapiens
ggagaattgcttgaacccaggaggcagaggttgcagtgagccgagatcgtgccaatgcactctagcctggtgacagagcgagactcc

SEQ ID NO: 6813706 - DNA, 87 bp, Homo sapiens
tttaggcaaattattgtatgcagttgcctaattgttagtcacagcaggcctaaaattacaaaactgcttgagatatgtttgtctaga

SEQ ID NO: 6813707 - DNA, 64 bp, Homo sapiens
tgattgtcttctgtggtggagattaaattacagagcttctcctatataaacaggtagacaattg

SEQ ID NO: 6813708 - DNA, 70 bp, Homo sapiens
tcccagcagggccgaccagcctaccatacaggtgccactgaggggcaatggtgggtcctgttccctggga

SEQ ID NO: 6813709 - DNA, 127 bp, Homo sapiens
attaaaaaatactttcatgcataaagagtggtacatgaccacaacctgggaaagccgtggaaagggcataggctttgaaatccacgtcccagttctggctccatctcttttttaatggaagggtaat

SEQ ID NO: 6813710 - DNA, 66 bp, Homo sapiens
gagttgggctgggcctgaggccaaatgagttggcagggtctccctggcctctgccttgccccactc

SEQ ID NO: 6813711 - DNA, 98 bp, Homo sapiens
taaaattttagcaagtcaattcccagtgttttaagaaagtaattttgtactagtgtgtaggatttattccagaaatgcaaggatggtttgatatttta

SEQ ID NO: 6813712 - DNA, 72 bp, Homo sapiens
ggccctgcagcaggagccaggcctggtgcatccctgcattccacactgcgcctgcctgacctgtgcaaagtc

SEQ ID NO: 6813713 - DNA, 66 bp, Homo sapiens
gatcacctgtgaaactggacagcacttgggtttgaaccctagtggtgacatttcacaagctgtatc

SEQ ID NO: 6813714 - DNA, 57 bp, Homo sapiens
tatatggctgaataatattctgttgtgtgggtataccacattttactcagccattta

SEQ ID NO: 6813715 - DNA, 74 bp, Homo sapiens
gcagaggagagggagaaggactatcaggctgccctctggggcaggatggcccaaccttcacccagtctttttgc

SEQ ID NO: 6813716 - DNA, 82 bp, Homo sapiens
ctctgactgtttgaaagtggcaagtccttgcttgaagactcactcattacctttagctcaagggaccacattcaaacaagag

SEQ ID NO: 6813717 - DNA, 70 bp, Homo sapiens
cagctggtcagtggtgagacagaaatttgaatcgacaccattcactgctttgagccactgagccatcctg

SEQ ID NO: 6813718 - DNA, 104 bp, Homo sapiens
aaagactgttccattgcaggggctgtggcacatggtgtgatccaggtctacaggggcacatggtgagcggcaggcctatagggcaggaggatatagacagcttt

SEQ ID NO: 6813719 - DNA, 56 bp, Homo sapiens
tggctccagaagggagggcgccagaaaagatgcctgggaaactctcttcggggcca

SEQ ID NO: 6813720 - DNA, 78 bp, Homo sapiens
agaaggaagtcagaggaatgggccaggctggtaggtgtaatcatggaagtctgtgcaagttctctttacattccttct

SEQ ID NO: 6813721 - DNA, 77 bp, Homo sapiens
tgggatggccacatctgagactttaacctggggccactggggttcctgaatgggtttcagaggtccatgaactccca

SEQ ID NO: 6813722 - DNA, 59 bp, Homo sapiens
gtgctcatagatgatgctcttttcctgttagctggcacatgagctccatctgtcagcat

SEQ ID NO: 6813723 - DNA, 76 bp, Homo sapiens
cagaacacttagccttcagtaaatccactgtgatgggcaaatgcctgccacatttatttgaggctaattgcttctg

SEQ ID NO: 6813724 - DNA, 88 bp, Homo sapiens
atgtgatgaaaagggtcacagggaaaatagtgcgtccacattcaacaattctgatttcagcattcttgtttttcctaccctcatacat

SEQ ID NO: 6813725 - DNA, 96 bp, Homo sapiens
accatcatagtaatgggcaatatcaggtccgcgtaagtcatggcagcagagcaagactaggtaggatttaggtacattatataatactaaaaaggt

SEQ ID NO: 6813726 - DNA, 120 bp, Homo sapiens
catagaaaatttcagcgtataaaataaaattaataatagtagatgcttataaagagcatattgtgttccaggtagtatgcactataggtattaactaattaatagcctgaaaagtctatg

SEQ ID NO: 6813727 - DNA, 63 bp, Homo sapiens
agtcagggacaaggaataagattagtttaaaactaaattgactttaaagctttgtctcttatt

SEQ ID NO: 6813728 - DNA, 97 bp, Homo sapiens
tttcccatcctgtagctagctttgcttactggtgtctgcatgcctttgacaacatgtatcagaaaatagcaaaattttggcttacagatttaggaag

SEQ ID NO: 6813729 - DNA, 65 bp, Homo sapiens
gtataatggtaatcactgtgttagggattaagtatacttcccaccctgtgtttttgccattgtat

SEQ ID NO: 6813730 - DNA, 76 bp, Homo sapiens
caggttctggtagcctcaaatttgagaattaatagctgagttaacctgcttgttttctttgagcccagacagcctg

SEQ ID NO: 6813731 - DNA, 70 bp, Homo sapiens
actgggcagtaaggtgccgctaagagtcagaaaaaattgacaaagctttggcatccttaccaagccgagt

SEQ ID NO: 6813732 - DNA, 60 bp, Homo sapiens
tctctggggctcactttggtcaggcggtagcttagtcgcctttcacagtggtcccaggga

SEQ ID NO: 6813733 - DNA, 62 bp, Homo sapiens
gataatgagcttttgaatactgattttatatgacacagggtcatatttaaaagctttttatc

SEQ ID NO: 6813734 - DNA, 59 bp, Homo sapiens
tgggagccacgtagtgggatgagttgctgcacaaacttttcacagctagtgagcttcta

SEQ ID NO: 6813735 - DNA, 83 bp, Homo sapiens
gtgtgtgtgtctggtgtttatgtttgtgtaggggactcatctttgaccaaattctctgcattgtaaagagccagaacagtcac

SEQ ID NO: 6813736 - DNA, 80 bp, Homo sapiens
gctctttcccagcctggcgagtgggccctggcagtggccctttcttactgtcagggaacaatgttatggcttgagagagc

SEQ ID NO: 6813737 - DNA, 112 bp, Homo sapiens
aattttacttggtaggatagtctggcatcatatggacaaagagttaaacttgtttctataaatgacaaaatagctctctctatatgagtgacagaatttcctgatgaaaatt

SEQ ID NO: 6813738 - DNA, 80 bp, Homo sapiens
tgtgtgcataaaggatttgaagagacagcagaaagaccaactaggaattcattgcagttcttcaggttacaatggacaca

SEQ ID NO: 6813739 - DNA, 129 bp, Homo sapiens
tctccatcttctgctcagagccactgctctcagtcccactcccaggcaggcctctgggtctggctttggggcttcagagggactgctctggtagttgtgacacaacagtgcctctggcggagacagaga

SEQ ID NO: 6813740 - DNA, 75 bp, Homo sapiens
gactttattgctcctttattttctctcgtgtgggggggtctgttcagcacggtcagggtgggggagtggtgggtc

SEQ ID NO: 6813741 - DNA, 73 bp, Homo sapiens
ggacctctcaggatctgatgttgtgaaagttactttcaaaggttaacaactgttagacacttctaaggggtct

SEQ ID NO: 6813742 - DNA, 89 bp, Homo sapiens
gtcccagcagatggcaaagaggtgagaggagcctttgtcttggaccggccccagaggctccgtcatccctctttggttgtttctggtgc

SEQ ID NO: 6813743 - DNA, 65 bp, Homo sapiens
ccgtggctcctggctccaggcagccaaggccctctggcctcctccatgcagccaggagcttctgg

SEQ ID NO: 6813744 - DNA, 102 bp, Homo sapiens
gtacagaactgtactttctgaatatcatttatcattggcgatgatgtaaggcattggagcaaatcaaatgaataagtatttattgagtgcttagttctctac

SEQ ID NO: 6813745 - DNA, 84 bp, Homo sapiens
tgaggttaagatttgcagattaaaacactgagcttgagacaaattgcttaatagtgaaatcaggttttgactgcagtgacctca

SEQ ID NO: 6813746 - DNA, 61 bp, Homo sapiens
ctggagtgccatacctgcgtaggcggctgagttgatctgcacaggcgtaggttgactttag

SEQ ID NO: 6813747 - DNA, 80 bp, Homo sapiens
gtgaagattcaattatatagaagagacatgtgcatagcagttacacgtggctgttcattccttctgtaccttgccttcac

SEQ ID NO: 6813748 - DNA, 59 bp, Homo sapiens
aatttcagggtgaatggactgattcagctcctgagttcactgctactcagcctgagatt

SEQ ID NO: 6813749 - DNA, 63 bp, Homo sapiens
gaccacatcatcctattgtgccccaggttgtcagaataaccaggttttttagatggtggagtc

SEQ ID NO: 6813750 - DNA, 61 bp, Homo sapiens
tgatacaagtttatccatcattgttggagttcaccagcaatgtaaaccctgaagttgatca

SEQ ID NO: 6813751 - DNA, 81 bp, Homo sapiens
agtcttataccttatgatatgcactttatcagaatctatctgttgttagttttggaaggttgtgtattttttaattgggct

SEQ ID NO: 6813752 - DNA, 85 bp, Homo sapiens
gaagttcactaccttttgcttctgcttgctgttctacataatggcacattgtgaaaagccgcaagtatagagcgggcacgacttc

SEQ ID NO: 6813753 - DNA, 61 bp, Homo sapiens
gcgagagatttgccgatttgtagatcttggttagaatgccaattgtgtgaatccttaatgc

SEQ ID NO: 6813754 - DNA, 72 bp, Homo sapiens
cagtgaacaactccaagggacatcatttacctagactatgatgtgagtggtgcttcctggaattgtacaatg

SEQ ID NO: 6813755 - DNA, 61 bp, Homo sapiens
tgtctcaggaaaaactttgtcaagactgttgccagtcttgacattgcaatcttcagagata

SEQ ID NO: 6813756 - DNA, 61 bp, Homo sapiens
atcctggcacatagtaagtactagatatattttgactgttgcttttattatttgccatgat

SEQ ID NO: 6813757 - DNA, 71 bp, Homo sapiens
gggccgctggaaggtgagtgacgtgcgggtcttcttttttatgtggctgtggacacctttcaacgctgcct

SEQ ID NO: 6813758 - DNA, 77 bp, Homo sapiens
cagagtcctctcttggctatccaagttatccataattttttctggattttctttctgaatagcttcaaagaggcctg

SEQ ID NO: 6813759 - DNA, 75 bp, Homo sapiens
gcatatgtagaatgtgtgaattgatttgcagaagtcttgaattcctgaaaataatttcacaagactgccttatgc

SEQ ID NO: 6813760 - DNA, 67 bp, Homo sapiens
ctggcaggtggatggggactcccaggctccccacgctgggtggcatctcccatcacgcctgtgccag

SEQ ID NO: 6813761 - DNA, 85 bp, Homo sapiens
ggctaggaatgacccactgcagagcttttcagttgaggtagtgtcctctttaaccttagctaagaccttggcggcaggcccagcc

SEQ ID NO: 6813762 - DNA, 128 bp, Homo sapiens
cagggaaggatcaacctggtgaactgaatcggggagtgagggtcataaaatcagccccagatcctagtggcatgctttaatattctgcattctccttattctactcaagtagttgctctccttccttg

SEQ ID NO: 6813763 - DNA, 76 bp, Homo sapiens
aagcagaattctaattccattaaattgatgttcaacagaacacactgaattttgtggaaactatggaggtctgctt

SEQ ID NO: 6813764 - DNA, 70 bp, Homo sapiens
cgcccgggtccgagcctctggacccctcgggctcccggctgggtgtcacggggctcgtgtgacggcggcg

SEQ ID NO: 6813765 - DNA, 80 bp, Homo sapiens
gatctgtgaggtggccagaatcttgaggcctttgggtactgatggtaacaatgcttcatgatttggccatgtaatacatc

SEQ ID NO: 6813766 - DNA, 97 bp, Homo sapiens
cacactagactgctgtgccgagtggaaagaacaccaggttgagacttaaaagactggatttaatttccagttggcactgcaatttattagctgtgtg

SEQ ID NO: 6813767 - DNA, 83 bp, Homo sapiens
ctgtgagtcgtatttgaagagacattattgggcactattttactctatttggaatattttcttcctaaatatgatttccacag

SEQ ID NO: 6813768 - DNA, 77 bp, Homo sapiens
gattattgctggcccagggtcacctaggaaattggtagcagcatccaggacttttgactctgagttcagtgcccgtc

SEQ ID NO: 6813769 - DNA, 57 bp, Homo sapiens
tttctcgaagatttggggtaatatgtagacctctctcaacttcaaatcttagagaaa

SEQ ID NO: 6813770 - DNA, 85 bp, Homo sapiens
aagtgattgcatactggctgcacttcaacacatcctctgataaaaaggagaggaaaatgaagtcatgctagattccacatcactt

SEQ ID NO: 6813771 - DNA, 68 bp, Homo sapiens
ctacttctgaccatccccttggaatatcatacaacaccaaccccaatggcacatgggacagtaagtag

SEQ ID NO: 6813772 - DNA, 94 bp, Homo sapiens
gtcacactttgagaagcatggttctaaaggactatacagattaaagtcattaatctctgtgggctttggacttgaagtttcagcagcctttgac

SEQ ID NO: 6813773 - DNA, 78 bp, Homo sapiens
ggtcactcagatttcctctacctttctttacttccctccaagttggtgtctggaaattaagaggaggtttatgtcacc

SEQ ID NO: 6813774 - DNA, 58 bp, Homo sapiens
cctgcccagcttcacctcaggctgcttccaacagtgccaagtgaggtcccttggcagg

SEQ ID NO: 6813775 - DNA, 62 bp, Homo sapiens
aattgttcaagtgtgtgtgtgtgtctacagtggggagggatttaccacttatttgaataatt

SEQ ID NO: 6813776 - DNA, 63 bp, Homo sapiens
gacctcaggcttctgtaattaaggaccaccaaaaaccatctccattttgtttagtctgaggtc

SEQ ID NO: 6813777 - DNA, 61 bp, Homo sapiens
aaattgatgttcccagttgaaatgacgtacccagggtcatgcaggtggaattggtcagttt

SEQ ID NO: 6813778 - DNA, 61 bp, Homo sapiens
gggtcctgtgccctgggtggcgctgaggctcacgctgtacacggggcacggggacagttcc

SEQ ID NO: 6813779 - DNA, 57 bp, Homo sapiens
catggcagctcctccagtgtgatggagtgtgagatctcgctgaagaagctgcacatg

SEQ ID NO: 6813780 - DNA, 81 bp, Homo sapiens
acttctttcaatgtgaaaccatgtaaagatggagtcagcaggtagttgagacatacatggcttatatattgaatagtaagt

SEQ ID NO: 6813781 - DNA, 71 bp, Homo sapiens
agtcagtatagctaaaagtttgtcaatattttctaatcctttcagaggacaaatttttggttttatttatt

SEQ ID NO: 6813782 - DNA, 61 bp, Homo sapiens
ccaaacttgaggagatgctgagaacagattttctaaaatttgttagcatactctagtttgg

SEQ ID NO: 6813783 - DNA, 65 bp, Homo sapiens
tggacttggggagatgaaagtatatattttacttctaggttatatatagtatttctctgaattca

SEQ ID NO: 6813784 - DNA, 61 bp, Homo sapiens
gacagtgacagcttggaaagcagggcattagaccagctattgagggaggctgtttactgtc

SEQ ID NO: 6813785 - DNA, 56 bp, Homo sapiens
ctactgtagtggcctatttacccatcacgtgacgaattggattaggtcaccagtag

SEQ ID NO: 6813786 - DNA, 89 bp, Homo sapiens
cttttggtggcttggcattgtgttgatagaagttatttttcaaggattcctaagctttttctaatcataattgtctccgccatgaaaag

SEQ ID NO: 6813787 - DNA, 85 bp, Homo sapiens
gctgtatttttgatgctgagaaacctgtctggcacacagtgtgtgctcaataaatgtttctgactgaatagatagaagatacagt

SEQ ID NO: 6813788 - DNA, 56 bp, Homo sapiens
ggtctgtcctgcccttgaggattttgattacatgaagaggccttacaggatagacc

SEQ ID NO: 6813789 - DNA, 62 bp, Homo sapiens
gccaccccatcggtagcccacccccttccccgaggctaagggaggcatgccgtggtagtggc

SEQ ID NO: 6813790 - DNA, 63 bp, Homo sapiens
tcttcaaagtgttttccatgcaatgaagcacttgctgtgttgaactgaatgcactactggaga

SEQ ID NO: 6813791 - DNA, 64 bp, Homo sapiens
gagaggcaagttgcctgtttctcctcattcttggtggggtcctaagggtgcatgcttacctctc

SEQ ID NO: 6813792 - DNA, 61 bp, Homo sapiens
gcgggcaataagctgcccaagtaaacaaatactctatccagcttggcagctgagatcctgc

SEQ ID NO: 6813793 - DNA, 76 bp, Homo sapiens
caggggtagtaggataacaaattcagcctttcattgtaggtttctatgaatttagtttctttttcttaccaacctg

SEQ ID NO: 6813794 - DNA, 101 bp, Homo sapiens
agggcacattatgcagcggtaagagttttacgttgtttgtaaaatagtgcaacattatttacagacaaactgtgttaagttgaagatgcatattgcaccct

SEQ ID NO: 6813795 - DNA, 129 bp, Homo sapiens
tcaacagaaatcccatattaaatgtgcctgttgcctaggcagagtgaagcatttctttctattgctcatcatcgataaagagaaaactgctacgctttctgtagcaggcaggactgtgagggaattgga

SEQ ID NO: 6813796 - DNA, 56 bp, Homo sapiens
cccagcttctggcgtggagcctgaccatagtgagctctttatcagccgaggcaggg

SEQ ID NO: 6813797 - DNA, 78 bp, Homo sapiens
tttgttaacccctgcacttggtgagaaaagcacaggtctggcatctggcacactaggtctcaggttgttctcaacaaa

SEQ ID NO: 6813798 - DNA, 78 bp, Homo sapiens
ctagcagcccaggcctcacattgggcttcaagtcttcttcaatataaaatttcaaccaggtgtgtggcctggctctgg

SEQ ID NO: 6813799 - DNA, 65 bp, Homo sapiens
gttttgtgattatatcaccaactataagagttataaattgaggtctgtgataaaagtcatgagac

SEQ ID NO: 6813800 - DNA, 61 bp, Homo sapiens
caggccggtgattctggatgtattttgaagatagagccaataactccggagttttggcctg

SEQ ID NO: 6813801 - DNA, 61 bp, Homo sapiens
gtggcatgaaagcatctgtgattgttagtggtgttataatcacaggtacagctaatgctac

SEQ ID NO: 6813802 - DNA, 76 bp, Homo sapiens
agttgaagagcagtctgctggagagttttccttttgcttggggaagtccgctttcattctcttcaggctttcaact

SEQ ID NO: 6813803 - DNA, 60 bp, Homo sapiens
ggagcaccctgctcagccaagcaaccctgaagtcagaggccggccgagccaaggggctcc

SEQ ID NO: 6813804 - DNA, 110 bp, Homo sapiens
tgatcccaatttagcccacctctctaggcctcagtttccccagttgtgaagaggaaggtaataaactttgcatagctctgtaaggctgcttggagacagctgtaagatta

SEQ ID NO: 6813805 - DNA, 59 bp, Homo sapiens
tggcattgctagtgacccagcaggtctgactgcctttctgctctattgctggcgatcta

SEQ ID NO: 6813806 - DNA, 57 bp, Homo sapiens
gctttagaggaatgggtgagtggacatcttaatatgtagcatctcttatttctcagc

SEQ ID NO: 6813807 - DNA, 66 bp, Homo sapiens
gccagcactgcttcgcagccagggattctgaccctgctggaaaccctacggcagagcagtgatggc

SEQ ID NO: 6813808 - DNA, 67 bp, Homo sapiens
aaggcaaatgatttttatgtctcctttgtctgttcctaagacacttggagtcattagtcatttcctt

SEQ ID NO: 6813809 - DNA, 114 bp, Homo sapiens
gtgggaaattgtgacggagaatattcaagagtgggtgtgggtctgtttgatttcaggtgtagctgtgtaaatagttagccctgcatatatttttgtctactcacaactgcctgc

SEQ ID NO: 6813810 - DNA, 125 bp, Homo sapiens
gaaggagcaaacattgcacacagggaagtggttataacacaggtttgtggtaaataagaagctgtcaaaggccttatccagagcttgtggttgtagccagctgagacccaatgtatgctcacttc

SEQ ID NO: 6813811 - DNA, 81 bp, Homo sapiens
ttttcaagtgctagatgagttttgagaagtgagtaagaaaacagtgtctccaccatcaagaccttatctagttggagaaag

SEQ ID NO: 6813812 - DNA, 87 bp, Homo sapiens
atgaatacctgtgcgtatgggtctgtgatgtgtatgacacctccgtgtgtgtgtacacatgacaggcacccacgcgtgggtgtgtat

SEQ ID NO: 6813813 - DNA, 58 bp, Homo sapiens
ctcctaaaatggtttttggaacttccaagttcttactcagaattccaagccataggag

SEQ ID NO: 6813814 - DNA, 66 bp, Homo sapiens
tggtcctggctgcccatggaccctctgaccttgaaccctcatagcagctccagggcagttattcca

SEQ ID NO: 6813815 - DNA, 63 bp, Homo sapiens
accagtcatagaaagcagtggtgcccaagagcatggcactcacgtctctgtctataaactggt

SEQ ID NO: 6813816 - DNA, 59 bp, Homo sapiens
caatttcagtgctgtggagagggaagtgcattctcaaaaagaccaacacattgagattg

SEQ ID NO: 6813817 - DNA, 76 bp, Homo sapiens
gctccctgtgaggccaggtaccagtcaaatctgtagtgggtctgctagcagagtttggtacctgggggagggaagc

SEQ ID NO: 6813818 - DNA, 73 bp, Homo sapiens
gccaggagcctgcacagttttcaccgtggggaggcacatctggggcatccccagagggctgtttaggcctggc

SEQ ID NO: 6813819 - DNA, 61 bp, Homo sapiens
ggaatactgtgtgtattatgtaaaactgaaagttcattcttcatgctgcatatggttttct

SEQ ID NO: 6813820 - DNA, 55 bp, Homo sapiens
acttggctttagtagtaactgaaaatggtttggagagctgaatttagagctaagt

SEQ ID NO: 6813821 - DNA, 71 bp, Homo sapiens
ggcagtggctgtagtctcttggaatatgctaccccatctaccagttccttgacaaggacacagtccctgct

SEQ ID NO: 6813822 - DNA, 104 bp, Homo sapiens
caacttaatgagagtgttgaagaggggatgttaagcatcagatgagcgattgggctagaacgaacattgaggtcttctctttcctgatactttataaattcttg

SEQ ID NO: 6813823 - DNA, 61 bp, Homo sapiens
gggcagtttattctagatggttttttaaaacagcataccaatttatgatccatgactgccc

SEQ ID NO: 6813824 - DNA, 60 bp, Homo sapiens
ctgtcgtgaggttgtggctttctatgctttaaagaacgggccatttttactttgggacag

SEQ ID NO: 6813825 - DNA, 65 bp, Homo sapiens
gtaacttgctaagggtcccatcaccaatgtcacctccaaggtacatgagggcactctgcatctgc

SEQ ID NO: 6813826 - DNA, 85 bp, Homo sapiens
aaagtgcagattccttggcattgcccctggaattttgattcagcagatttgaggtggggccaaatgctacagtagtctgcatttt

SEQ ID NO: 6813827 - DNA, 101 bp, Homo sapiens
actgctgctccttgctttctcacactttccactgaggtcacttggggcacgactgagtcaagacttccagagggtgtggaaatatcagggaagcaaacagt

SEQ ID NO: 6813828 - DNA, 78 bp, Homo sapiens
gctcctcccttgcaggcagggcctcctggagccttgtgctcatcctgggctctgaggccccagccctgcacagagagc

SEQ ID NO: 6813829 - DNA, 55 bp, Homo sapiens
caggagtccagagtgtcattttctgaagccacaaattcccactgtggagctcttg

SEQ ID NO: 6813830 - DNA, 65 bp, Homo sapiens
tcaaagtaccttcatattattcaaagtttcgcatagatggtgcaatattatgaaaggtaaaatga

SEQ ID NO: 6813831 - DNA, 56 bp, Homo sapiens
gaacactttcctgcctttctgatgtaatcactttgcgcaaacagtaggaaatgttc

SEQ ID NO: 6813832 - DNA, 65 bp, Homo sapiens
actgggagtcagtataagaagcacagtccagcgcaacaaggaactgctctccacttattcccagt

SEQ ID NO: 6813833 - DNA, 55 bp, Homo sapiens
aatgaggttcactgccacggatgggaaaggctgccgcacgttggtttgcctcatt

SEQ ID NO: 6813834 - DNA, 57 bp, Homo sapiens
gctctgtagtgggcatgtgattcagcctttgccagtcaggtaccacattacattggc

SEQ ID NO: 6813835 - DNA, 96 bp, Homo sapiens
gcatttcccatgattggcttcaaatggagcaaccagagctgaacagaatttgggggtttcatgttgagttccagattgccatatgggttcagatgc

SEQ ID NO: 6813836 - DNA, 58 bp, Homo sapiens
ggaccagagaagtgagcacctgctaaggatgtaacttgtgctttgtttctttgtgtcc

SEQ ID NO: 6813837 - DNA, 59 bp, Homo sapiens
tccagcctaggggaacagctgcccccagtccactgtgtcccggcttcccctagtctaga

SEQ ID NO: 6813838 - DNA, 116 bp, Homo sapiens
aggtgccggagagtcaaggaggtgggcctctgacttctctttattggcagtctgtgtggggtggccaggactgaggggtcagagggcccaattccaagtcaactcctgtaggccct

SEQ ID NO: 6813839 - DNA, 61 bp, Homo sapiens
aggaattgtgttgtagtggagagctttttgattttgctctctcttgaattcatagtttcct

SEQ ID NO: 6813840 - DNA, 70 bp, Homo sapiens
ctgtgaaaggggtcacagggaaagcgttaacagatcaatgcctttggctgtgtgctcccttttcccacag

SEQ ID NO: 6813841 - DNA, 55 bp, Homo sapiens
gtgtaagtgtaggaaacagagccagaatgcaggggttcaaatcctgacactacac

SEQ ID NO: 6813842 - DNA, 82 bp, Homo sapiens
aaataagtagcagactgacttctagttcttaataacctggttgtaatctcctttgagagtagagtcttcatctgtcttattt

SEQ ID NO: 6813843 - DNA, 87 bp, Homo sapiens
cccctgttctcacactcccagagctggcagcagcttctcctcatgtctgaggagcctagccatgcttgtgggagatgatggcatggg

SEQ ID NO: 6813844 - DNA, 80 bp, Homo sapiens
ggtctggcttggcagtgtttcaaatcaaaggcattgggatattttatttgactgaggtttgatatataccagcgtagact

SEQ ID NO: 6813845 - DNA, 57 bp, Homo sapiens
caatgatggctaggcagctgctacataagaaagttctgccccgatctgtcatcattg

SEQ ID NO: 6813846 - DNA, 69 bp, Homo sapiens
caggcaagtggctaggccagtgacctcctgtgaagagcataaaaatgaagtctctggcttgtctgcctg

SEQ ID NO: 6813847 - DNA, 59 bp, Homo sapiens
tgaaaacctaagtgctgttgaacgtttgaaaaagcatgtcattaggacttaggtcatca

SEQ ID NO: 6813848 - DNA, 78 bp, Homo sapiens
gcacttggtctgggggcaagcagacagctgtggagttcacagcccacggcaactcacctgccctcaggtccaggtagc

SEQ ID NO: 6813849 - DNA, 110 bp, Homo sapiens
gctggcattgaggcgaacatacctgtgacctatggaattggcagccagaggggagacgagagcactggctgtcaattcataggtcagagccctgtgcactcggtctcggc

SEQ ID NO: 6813850 - DNA, 63 bp, Homo sapiens
gattaacagcccctgattgctgaccttatcttatcatgtcatcttaatcatttggcgttaatc

SEQ ID NO: 6813851 - DNA, 92 bp, Homo sapiens
aatggttcaaagcatatgctacatcctgggggatgtatacaagctccacagaatgtgacctcccagatgataccataagctatttctccatt

SEQ ID NO: 6813852 - DNA, 64 bp, Homo sapiens
tactctctctccttttcccagtatgacttcatggaacgtctggacgggaaggagaagtggagtg

SEQ ID NO: 6813853 - DNA, 97 bp, Homo sapiens
gtggattttaatagaattttaagatgcattcatggcagtttaataagtggttacagtgtaaccatcaaattaggtctgtatgaagttaaaactccac

SEQ ID NO: 6813854 - DNA, 58 bp, Homo sapiens
aaaggattctcttgatttcagtggaaaaaaactctgcttttaagtttgagagaccttt

SEQ ID NO: 6813855 - DNA, 73 bp, Homo sapiens
gcggaggggcagcataaccccttcataattcctaaactgcactgtgatttccccagtcttgctgctcttctgt

SEQ ID NO: 6813856 - DNA, 58 bp, Homo sapiens
gctagactttaagctcctgcagagtaggattatgctttgttcatcattagagtctagc

SEQ ID NO: 6813857 - DNA, 82 bp, Homo sapiens
gagtgacatgatctgacttgctttttaaaggaccagtttgtctactgtggatggtagaaagtaagtatggagtggaagactc

SEQ ID NO: 6813858 - DNA, 93 bp, Homo sapiens
gactgctttaatgggcaaaggaaccaggccacacttaaaacacacttaatattttgcaggagtgttttgtttcctttcttgtttcagtaagtc

SEQ ID NO: 6813859 - DNA, 58 bp, Homo sapiens
cactacaggtttctgaagcaattttgtggatctctatagttctgcttagaaatcagtg

SEQ ID NO: 6813860 - DNA, 76 bp, Homo sapiens
tctaacttctctactccgagcaagaagaggccttgggctcaaaggttcattcccaaatttggagagggaagtggga

SEQ ID NO: 6813861 - DNA, 55 bp, Homo sapiens
ggtgatctgcccgcctcggcctcccaaagtgctgagattacgggcatgagccacc

SEQ ID NO: 6813862 - DNA, 92 bp, Homo sapiens
cttctgttggtttctacagctttatacccatcaaaaggtatatcaaaataacttttcggtatgcagctgttccagagacatctgacagatag

SEQ ID NO: 6813863 - DNA, 94 bp, Homo sapiens
gctctgttctggtcactatgctgggcaacggaagagagaaattaataagacttaattcctgcctttgaattgctcacagtgagatgggacaggc

SEQ ID NO: 6813864 - DNA, 130 bp, Homo sapiens
cgtggcggccccggtggagcgggcgcagctaggcgggcccgagctgcagcggctgacgcaacggctggtccaggtgatgcggcggcggcgctgcgtgggcctaagcgcgccgcagctgggggtgccgcgg

SEQ ID NO: 6813865 - DNA, 75 bp, Homo sapiens
ttttgggttcccctagatgtgaggggaggggcctttctccctatgccaatcccttcaagatttggggaaataaaa

SEQ ID NO: 6813866 - DNA, 95 bp, Homo sapiens
ggtggaagaattgcttgaacttgggaggcagaggttgcagtgagccaagattgtgccactgcactcaagccttggccacagagcaagactccatc

SEQ ID NO: 6813867 - DNA, 66 bp, Homo sapiens
gtaggaaattcaagaactaagtagtcctggaaatttttcagaaagcttagtgtcttgcatttctgc

SEQ ID NO: 6813868 - DNA, 58 bp, Homo sapiens
ttagtagagatttggtgcgtggagtcagccaactgccacgctccagccttctctctaa

SEQ ID NO: 6813869 - DNA, 94 bp, Homo sapiens
gttgtcaatatgtagttagaagggcatactaacataatttatgcaactctttgcattgtattaaaatgtgtttctgttttagcttgttgatgac

SEQ ID NO: 6813870 - DNA, 76 bp, Homo sapiens
tgcattttagcaagaccaatatgtagatatattaaaggttgcacagccctgtcctatgtgttggtccctccttgca

SEQ ID NO: 6813871 - DNA, 81 bp, Homo sapiens
gagaagtaatgagacctgagacctaatctgactgtggtgctagctctaccatggactgagtgaggctcatttaatcttctc

SEQ ID NO: 6813872 - DNA, 75 bp, Homo sapiens
cactttcattcatttacaatccataacttccagttcaagaatctaatttggagttcagagtaaatgttgaaggtg

SEQ ID NO: 6813873 - DNA, 55 bp, Homo sapiens
gtagtagtggtcataatagagaagttatttagactcttgtgtgctgccctgctac

SEQ ID NO: 6813874 - DNA, 116 bp, Homo sapiens
agagtgactggcatggggaatgggtggtagaggtcaaatgatgatcataagatttcttgttctgacattagttgtttctccatgtaatctatgaccatcatccttccaggcactct

SEQ ID NO: 6813875 - DNA, 66 bp, Homo sapiens
cagacgagacacaggtggttcctgtcaggaacagcatttcctggtatgggaagcctgttctctctg

SEQ ID NO: 6813876 - DNA, 93 bp, Homo sapiens
taggtcaatgatatagcacagacagtaaatagtgtggctgtctaagggggcagaatgaacaaggcactgtgactgttaaatgttattgatgta

SEQ ID NO: 6813877 - DNA, 83 bp, Homo sapiens
gttatccagatagacatacaatgtatgaaggtgcagaaattcatctatattcagcacatgtctatttgtaatcatacgataat

SEQ ID NO: 6813878 - DNA, 68 bp, Homo sapiens
tagtcctgggagaactgctgggttggagcactggttggcttaaccgtatccaaagattttccaggctg

SEQ ID NO: 6813879 - DNA, 68 bp, Homo sapiens
tttagtagaatagtatatcaaatggaatttgtataagctcttttaagtgtgattactattttgctgag

SEQ ID NO: 6813880 - DNA, 129 bp, Homo sapiens
acaactacttacagctcatttgaaagtgagaggactcttccacatgacatgagctacctgagaggaaaaagcctgatgcatgaggagctgggtgcccttcagagcaggtgccaaggtgagtgggcaggt

SEQ ID NO: 6813881 - DNA, 67 bp, Homo sapiens
aattcacttgtgcacgctatggaggttctcggggagagatctttgcacctaagtctgtcaaggaatt

SEQ ID NO: 6813882 - DNA, 68 bp, Homo sapiens
tattagatgggaggttcatgtactaggcagacactccaaaatgtctactacaaacctccacactggtg

SEQ ID NO: 6813883 - DNA, 65 bp, Homo sapiens
ttgcctgtgtgtgttgatgtcagtgccccggcgttgggtacaccctcttcacatcacacaagcaa

SEQ ID NO: 6813884 - DNA, 58 bp, Homo sapiens
ggctcaggatgagccttctcattgaactaaatccaggaagaagcatcattctgatgtc

SEQ ID NO: 6813885 - DNA, 95 bp, Homo sapiens
gtatttttagtagagatggggtttcaccatgttggccaggctggtctcaaattcctgacctcaggtgatccacccctcttggcctcccaaagtgc

SEQ ID NO: 6813886 - DNA, 77 bp, Homo sapiens
tattcacaagagtttcactgcaaactgacttttcagggcaaattcaccacccaaaagtctgtagtgaaaggtgaatg

SEQ ID NO: 6813887 - DNA, 67 bp, Homo sapiens
acagatccttgttctgcttttcatacaatcagctttcaagctagtagtccagagctaaggattatgt

SEQ ID NO: 6813888 - DNA, 77 bp, Homo sapiens
gtgacagagtgaaaagctagagcagtagcatcaagatataaaccaaggctcattgtctctcttttcatatatattac

SEQ ID NO: 6813889 - DNA, 76 bp, Homo sapiens
catgaccacatgtgcactgctgtatggccccagggcactgccatgccttccaccccattgagctagtgcacacatg

SEQ ID NO: 6813890 - DNA, 129 bp, Homo sapiens
agagaggaaatgaggtaacactgcaaggtggcttataggattggaaagaatgtgagttttaaaaatcagaaagaccaggcttacatacttactagatctatgaccttgtccaacttatttatttgctct

SEQ ID NO: 6813891 - DNA, 80 bp, Homo sapiens
gaaagagctttagaagtgaaatagctgtacaaatggtggacattgtttttattgagcaattcatctttaaatgcttcctc

SEQ ID NO: 6813892 - DNA, 55 bp, Homo sapiens
ttctcacagtacctaacatgtaatcgcgaatagcacttaaatgtttgctggagaa

SEQ ID NO: 6813893 - DNA, 63 bp, Homo sapiens
ttgcttcccagctggctgagcactggtttatagacttctgtgtacaaatttagccagcagcaa

SEQ ID NO: 6813894 - DNA, 111 bp, Homo sapiens
tttgatattttaagggagctatttattcctcacattcgagtgatgtgtatgggtagttatttgtacaaatttttcacattgaatggaagaatagagtcctttgtattcaag

SEQ ID NO: 6813895 - DNA, 65 bp, Homo sapiens
gaaagagtaccatcatttagatgtgttcaagatccaactttgaactcttttgtctggtacttctc

SEQ ID NO: 6813896 - DNA, 64 bp, Homo sapiens
ggcttctgatggttgccagcaatccttgctgtttcattgacttgcagctaccatcattccagcc

SEQ ID NO: 6813897 - DNA, 68 bp, Homo sapiens
aacagcctgagccatccataccagcttacctctttatgataagctgcaatggatagcttcctgctgtt

SEQ ID NO: 6813898 - DNA, 57 bp, Homo sapiens
ctgtgcagcatctttctaccaggaatctgtgcccctgtgtgtaaggaagctttatgg

SEQ ID NO: 6813899 - DNA, 58 bp, Homo sapiens
gtgggcagccccttcaaggccaaggtcactggtgagtgccggtttgggggaggtccac

SEQ ID NO: 6813900 - DNA, 58 bp, Homo sapiens
ctgctcatccatggaggcgattgttcttggccggtccttcctgcagggatggatgcag

SEQ ID NO: 6813901 - DNA, 55 bp, Homo sapiens
gaagtcttacctccaggtttctggcaatatgcccttatttggaaataaggtcttc

SEQ ID NO: 6813902 - DNA, 83 bp, Homo sapiens
tctgctgtgaataagatgctttccaagaaatcctcagcaagcgttcttacaagttgagattttacttgaaggcattcagttga

SEQ ID NO: 6813903 - DNA, 115 bp, Homo sapiens
gtatctgttctgatcaagtggtacttcactatgctcattgttaatattttgaacaacttggtttgggatgctgatatagagcattctggctcttggtgcagaacataaatgatgc

SEQ ID NO: 6813904 - DNA, 58 bp, Homo sapiens
ccttccacatggtgatttgattataagccaaaggcatcccttctccagtgtggtgagg

SEQ ID NO: 6813905 - DNA, 80 bp, Homo sapiens
tcagctacagggataacccccaagaaggtctttaatagcatatatatgcttgagagtttggaggtgttcctggaaggtga

SEQ ID NO: 6813906 - DNA, 129 bp, Homo sapiens
tgacttcattgaaaacgagcattcagtttggctctcttgtaaggtagtagaatacaattcaataaagctctgttttgtacctttttggggggcatgctggtagttccatgcttgttttctcatttggca

SEQ ID NO: 6813907 - DNA, 56 bp, Homo sapiens
ggggtttggggtgcagacattgccagaggatgggcagcagactgaccttcaacccc

SEQ ID NO: 6813908 - DNA, 88 bp, Homo sapiens
gggcagcagagaggggtcagaaggagggagcttaagccaggcagggttacttgtctctgtgactccttccgcctggcacatgctgccc

SEQ ID NO: 6813909 - DNA, 65 bp, Homo sapiens
gcatgaatattttacacctctgcagtaaactcaattgttaaagcaaggaatagagtagtccatgc

SEQ ID NO: 6813910 - DNA, 127 bp, Homo sapiens
catccgtcaccataaccagcctacagagagcagctggcacagacctcttcaggatgcgggggtctcctcacttctccatgcctcgggaagagtctgtgggagctctctgtgaatgtagtgatgtgtg

SEQ ID NO: 6813911 - DNA, 77 bp, Homo sapiens
gtgctcttccttaagactataaagaaggctgagagaagaaaaagcaaatcaagtggtcttaggtgaagaaaatgcat

SEQ ID NO: 6813912 - DNA, 122 bp, Homo sapiens
cctgcctctaaatgtcaagagtgtctcagttgagggtcttgcaaaagtagcaattccttctctctttggcatggtcctcactataatcattctgatatcaattaaggataataaaaatcagg

SEQ ID NO: 6813913 - DNA, 75 bp, Homo sapiens
agcctgcagcagtttctgtctgttcttatccagtactgccacctattgggcaagctcttcagaagctctgaggtt

SEQ ID NO: 6813914 - DNA, 85 bp, Homo sapiens
ccctggtgcccctttagcccctgcagagacttctgcctttccctaggatacatggttgctgggggtggcagagctagaaccaggg

SEQ ID NO: 6813915 - DNA, 81 bp, Homo sapiens
tcacatatggtttatcctttaccagtcgagaggcatttggattgtttgcacttttggctgttacggataataccgctgtga

SEQ ID NO: 6813916 - DNA, 55 bp, Homo sapiens
ttgaagtatagagtttaagaaccagtaaatttaggtttgcaatttgatacttcag

SEQ ID NO: 6813917 - DNA, 57 bp, Homo sapiens
aaaaggggttatatacttatgtacttaaaatacataatcctggtgtagccctctttt

SEQ ID NO: 6813918 - DNA, 62 bp, Homo sapiens
ggtgggggctgtgcacaggctcactgagacttatttcagaagaaccagaacagccccccacc

SEQ ID NO: 6813919 - DNA, 86 bp, Homo sapiens
tcatttggatttaatggatgaggggcagctctctggattttttcctatgtcctgttcctctatcacgttagataagtatcaagtga

SEQ ID NO: 6813920 - DNA, 72 bp, Homo sapiens
ttaacatttggctttggcaggaagaaaatgtttcagtatagaaatatgtgtctctaccaatgcaattgttaa

SEQ ID NO: 6813921 - DNA, 55 bp, Homo sapiens
tctccttttctatctggattgagggccaccaacccaaatgcatggaagttggaga

SEQ ID NO: 6813922 - DNA, 55 bp, Homo sapiens
aacacagcatcccttaggtcgtcatgcaaaagtaatgatatggtttggctgtgtt

SEQ ID NO: 6813923 - DNA, 59 bp, Homo sapiens
gggtggcaggccctgagcatccctgggggcctggaggctggggccagggcttgccttct

SEQ ID NO: 6813924 - DNA, 65 bp, Homo sapiens
cggttgctggcatcttaatgttctgtaggtggaatatttccaataaacacaaggtgccgtaattg

SEQ ID NO: 6813925 - DNA, 128 bp, Homo sapiens
actggtaggttttcttggtctgggtggagtttatctaaaagcatggttaaagacagtgggtatttttttaagcagtcttgagccatctttatttatattatttacaagctatgaagtcttaagccagt

SEQ ID NO: 6813926 - DNA, 95 bp, Homo sapiens
gcccatcttgcctcctgcttgcaattcacaacaaaaggatatgaggattgaagcagtctcattgtttgatgtggattcagccaaaagctgtgggc

SEQ ID NO: 6813927 - DNA, 61 bp, Homo sapiens
cttcctctgtggccagagtgtaggtcagctcagcaaacagcattgtggcctacagggcaag

SEQ ID NO: 6813928 - DNA, 82 bp, Homo sapiens
gagtggaaggagggctgggagaggcagctttcggatcggcggtcgctttctatgaagtcttcctttcctccctgcttccctc

SEQ ID NO: 6813929 - DNA, 65 bp, Homo sapiens
tttaatgatagtcttacgaaaatgaaatcacccagtagtccttttcaagtgaggctgtctttaga

SEQ ID NO: 6813930 - DNA, 62 bp, Homo sapiens
gcctgtttttgcttcgtttaagttatatttggtggctaagttttcgcaggcagataataggc

SEQ ID NO: 6813931 - DNA, 78 bp, Homo sapiens
tgacaggattgaataagacagtgagtgtaggtaaaactctggaaagcgtgactttaactgttattactcaccctgtta

SEQ ID NO: 6813932 - DNA, 87 bp, Homo sapiens
tcatgcttctgagtctcctgtcgacagttgccacctccttcctgacacactgccccaggcggtgactgtgacaaggtgactccatga

SEQ ID NO: 6813933 - DNA, 62 bp, Homo sapiens
ggccagcatgttataatgcattttgtgaggactcacagctgtgtatgagagcatgctcagtc

SEQ ID NO: 6813934 - DNA, 64 bp, Homo sapiens
agcagtcaggtctgcacagtgagagagtgagctccccgtctgtggctgtgctgggccagaggct

SEQ ID NO: 6813935 - DNA, 73 bp, Homo sapiens
gaagatgatttctccattcccttctccgagcagagctcttgaagaagatgggagttaggagaagtgaatcttt

SEQ ID NO: 6813936 - DNA, 65 bp, Homo sapiens
ggaatgaattcctcacaacagacagatcttgataaagcctaggaaatgtcaaaggaatttattct

SEQ ID NO: 6813937 - DNA, 76 bp, Homo sapiens
gtaatcccattgagaattctttctttgtagtcctgaacaatgacgtgttctttgactccaagaaagtaggggttgc

SEQ ID NO: 6813938 - DNA, 83 bp, Homo sapiens
atctacttaaagatgtcaaggctgtttctgctttattctgcaagagacaatttttggttttgcaagttctagtatgggtgggt

SEQ ID NO: 6813939 - DNA, 87 bp, Homo sapiens
ctgcataatatgcctcatcttgtactcatccctgcctcagctccaggcttcatggaggtaggatagataggaagacctgcaatgcag

SEQ ID NO: 6813940 - DNA, 112 bp, Homo sapiens
tctctctgcttccgggaagtcctattccactgaccacctactgtgtgcacaggcttgtgctgagtggtgctgtggaggggcagaagggagctggaacctggtgatggagaga

SEQ ID NO: 6813941 - DNA, 72 bp, Homo sapiens
ggatcttttccctggactccaactagggactggagagcttcctggtaaattatgtccaggcaagtgggattt

SEQ ID NO: 6813942 - DNA, 60 bp, Homo sapiens
tctgtggactagagaattctgttgatgtaatccatgtaaatgaagctcatgggccacaga

SEQ ID NO: 6813943 - DNA, 61 bp, Homo sapiens
cataatttcactgtcgtatggccgctgagttaatgtacttacaaatgacagagaaagtgtg

SEQ ID NO: 6813944 - DNA, 59 bp, Homo sapiens
tctggctcagggctctgagggaacacctacaatccttcctatcacctacctgagtcaga

SEQ ID NO: 6813945 - DNA, 88 bp, Homo sapiens
tacatgcagacaaagattaaggtattgttagctcaaagaaggagtttacttgagagctatgaattattttaataactttgctgtagta

SEQ ID NO: 6813946 - DNA, 108 bp, Homo sapiens
tggtcacagtggatggtggatggcatggtcaccttgggagcctgctgctgatgaactgcagcatggccatctgggccgtccatcctgcatggtcacgctgtccggcca

SEQ ID NO: 6813947 - DNA, 56 bp, Homo sapiens
tcatgtgttaaactccaagataggtggaatctcaccatcctgacataaccacatga

SEQ ID NO: 6813948 - DNA, 129 bp, Homo sapiens
tctcaggctgctcaagccagcacactgggctttccgcactgggcagcagctcgagccgccgtacggggggtgtggacggctgtgccagtggaagcggtgacggcacctgtgtggcatcgagtgcctggg

SEQ ID NO: 6813949 - DNA, 72 bp, Homo sapiens
gccatgtgcgtcaaagggcagacgaggcgtcagcatgggcaccttttgtgtctgcgtttgtggcgaaatggc

SEQ ID NO: 6813950 - DNA, 86 bp, Homo sapiens
ttctcagcttgagccaaagcacccggccctgggcagctgagcatcagcacagaaccctctgagtcctttgggctctctgctgagga

SEQ ID NO: 6813951 - DNA, 84 bp, Homo sapiens
tttgtttctgaatgccaggctctgtgttcagcctagcagaaaggcctcttatccttttgggctcccacaggcttgtggaataaa

SEQ ID NO: 6813952 - DNA, 71 bp, Homo sapiens
ttttccattataatctagtttaatatgtttaaaagtttaatatgtttaaacgtttagattttgggggaaaa

SEQ ID NO: 6813953 - DNA, 106 bp, Homo sapiens
gcacacttgagtgaagcacagacatgacagttgagcatgtaagagatccattgggtgctacttgagaaagcagttggactgcattctggttctctctgaagtttgc

SEQ ID NO: 6813954 - DNA, 55 bp, Homo sapiens
ttggtggatcctcctgaaagcagacctaatgactaacagcccagggtgctaccaa

SEQ ID NO: 6813955 - DNA, 77 bp, Homo sapiens
ctcacttgggccaagttaaatgccagggctgttgatacagtaaacaggaaaaagggcatttggatttggtccctgag

SEQ ID NO: 6813956 - DNA, 73 bp, Homo sapiens
gctctggatggctggatgtgagatcaagaggttaactggtgcctttccttctgattcatccagagtcctaggc

SEQ ID NO: 6813957 - DNA, 63 bp, Homo sapiens
actgggaggcttcatacaacagaagtttattctcttactgctctggagatggagccttgaggt

SEQ ID NO: 6813958 - DNA, 61 bp, Homo sapiens
agaggagagaagctaacggtgctcatcgtgtggcacgcaggtgcgttgttttctctccact

SEQ ID NO: 6813959 - DNA, 89 bp, Homo sapiens
taattttggggggtgagtttgtaattgtatttagttgttatgggaataacagtatatttaccaaacctttcaccttctaattagagtta

SEQ ID NO: 6813960 - DNA, 56 bp, Homo sapiens
tatgccttttggttcaagcaacatatatggcaatgtttcttgagccaaaaggcata

SEQ ID NO: 6813961 - DNA, 93 bp, Homo sapiens
cacaatagtctttctcttcatctcagtaaatgtgtgatctgggcaaatattccaagatagggacaaagctagagaagagaattgaagattgtg

SEQ ID NO: 6813962 - DNA, 56 bp, Homo sapiens
gtaggcacccagagcctgaggggactgcagaactctccctcagacagggtgcctat

SEQ ID NO: 6813963 - DNA, 102 bp, Homo sapiens
agaagtaatagagaagaagttaagtaaatatctgtagtctttacagaggaacgtcaataacaactgctgaggtatttgatcttacatttattttctaattct

SEQ ID NO: 6813964 - DNA, 73 bp, Homo sapiens
gcctgtggtttaggcaataagcctcaactgtctttctcgaggatatgttcccaggtggttgtactccatgggc

SEQ ID NO: 6813965 - DNA, 57 bp, Homo sapiens
cttccagggtccaggaagagcccgtgtctaggctttttgactcctggcctttggaag

SEQ ID NO: 6813966 - DNA, 72 bp, Homo sapiens
ctattactgtggggggctttgctcagtgggctatgcaggcttggggctggagctgagttccctgggcaatgg

SEQ ID NO: 6813967 - DNA, 66 bp, Homo sapiens
gttggtggcagggtcgtagcgctccacagcattcaggtcattgtggtagtcacggcccgccacagc

SEQ ID NO: 6813968 - DNA, 73 bp, Homo sapiens
gtaaaagatgacaatggacatagttaaaacagaacaaatctagttttaatattttctagttgtcagcaattac

SEQ ID NO: 6813969 - DNA, 75 bp, Homo sapiens
gaaggcagattttaaaaatgtcgttaccagaacgcatcctccatttctcagtaaacaggtttaagtcctgctttt

SEQ ID NO: 6813970 - DNA, 66 bp, Homo sapiens
gggattcagggagcagcccctagaagtaagtgctttcacttgctaggcagtgcttccctgactctt

SEQ ID NO: 6813971 - DNA, 56 bp, Homo sapiens
ggggctgctgggcaagaaacatttcttacgtgataatgtgaagcgtcagaggtccc

SEQ ID NO: 6813972 - DNA, 55 bp, Homo sapiens
tgtttacatatcatttcaggtcctgtgttcccaggatggagactgagagtgagca

SEQ ID NO: 6813973 - DNA, 85 bp, Homo sapiens
gtgcagttctcagaagccagggtcaggggcctcctgccagtgtcacatgtcaggtgggacccggattctcccctactggctgcat

SEQ ID NO: 6813974 - DNA, 129 bp, Homo sapiens
gagtctcaaaggaaagacaagtactgatgggcagtttgaacttggaattgattgaacatttattaaaaatggatcccactattttaagacagcttttctttagtaaaaatgctctttttcttttctttc

SEQ ID NO: 6813975 - DNA, 124 bp, Homo sapiens
gaggagggtctagttctgggaggcggggctatgggtggagctccacaacctgttcctgaggctcctacagttgtcaaagagcaccggctaccccaaggcctcctgacaaaagctcgacttcttc

SEQ ID NO: 6813976 - DNA, 88 bp, Homo sapiens
gcagatactgagggctgggctggcggggacgggtgtgaggagccattcactcctctacttaccactcagccagccagcaagtgcctgt

SEQ ID NO: 6813977 - DNA, 69 bp, Homo sapiens
aggtctgatcatgagattatatgattccatcaattaaaagagaatcagttctacatcttatccagactt

SEQ ID NO: 6813978 - DNA, 61 bp, Homo sapiens
cctgtggcgggggccagtgcctcccctcctctgggcgtggtctggtccctgaccctgcagg

SEQ ID NO: 6813979 - DNA, 77 bp, Homo sapiens
cccatttcttgattccaccagtgaagagcacaaataaagactaagccctcttccggatttatggagagagaagaggg

SEQ ID NO: 6813980 - DNA, 61 bp, Homo sapiens
ttcattgagctgtacacttaggatttgggtgctttactgttgtatgttataactcaatgaa

SEQ ID NO: 6813981 - DNA, 74 bp, Homo sapiens
gtgggctgcttcctccttccacccttgctcagattcccagtgacaggaagctcggggaagccaggtcagcccac

SEQ ID NO: 6813982 - DNA, 105 bp, Homo sapiens
tggagcatgttgagtgcacgacttgttatggatccaagaaagacgctccttggctttcttgtaagatgtttattaaagcaagtcctgccctttccccaacctcca

SEQ ID NO: 6813983 - DNA, 64 bp, Homo sapiens
ggcagtgtccttggggtcatccattatccatgtgttggaggagtgggaccctagggaagatgct

SEQ ID NO: 6813984 - DNA, 69 bp, Homo sapiens
tctagctagcaagctcttggaaatgagctgggcgtgatgccagccagacttccagcttgccagcatggg

SEQ ID NO: 6813985 - DNA, 55 bp, Homo sapiens
gacctcaactctctgggtctgagaagctcccctcagtcacccagagaaggaggtc

SEQ ID NO: 6813986 - DNA, 88 bp, Homo sapiens
aattgggaatggtcccctcagaaagtgacaggggggtgaaacagacttttgcatcccttaaaccacttttttgggggctttctttgtt

SEQ ID NO: 6813987 - DNA, 127 bp, Homo sapiens
aggcaaggctctgagttgcagaggacagaggatttcttcccagccagcacagcccatggtaaagtggactttagcagctggagaggagcaaatcaatctttacccactgggcactaagagtctgtct

SEQ ID NO: 6813988 - DNA, 93 bp, Homo sapiens
ctagtgatagaaaagcatgtgtaattgtaaaaggtaatttggtggaattgttttgaaaaattataatatacatatgcctatcccattaactag

SEQ ID NO: 6813989 - DNA, 73 bp, Homo sapiens
aatttgctttccttctgggcctcagtttctctatctgcacaatgaaggagctggcctagaaaggagacggatt

SEQ ID NO: 6813990 - DNA, 56 bp, Homo sapiens
gcagttactgtcttttcctaaatgggtacacacttgtgtaccaggggcagcactgc

SEQ ID NO: 6813991 - DNA, 63 bp, Homo sapiens
atgtattattcagtcttgtaaggagttaagtctctttgttttcactcctgctgagtgaaacat

SEQ ID NO: 6813992 - DNA, 57 bp, Homo sapiens
gcttgtcagtttgtccctgggtaaggcattttcatacccagagatggacctggctgc

SEQ ID NO: 6813993 - DNA, 70 bp, Homo sapiens
cactttgtgaggccaaggtgggcagatcacttgagatcaggagtttgagaccagcctggccaacatggtg

SEQ ID NO: 6813994 - DNA, 68 bp, Homo sapiens
cctaaaccagttagatgcatcaggtgacctcttacgcctcttggagccttgatgctcactggtttggg

SEQ ID NO: 6813995 - DNA, 125 bp, Homo sapiens
aatataaagtcattggaggtggaattgggaagagatgtgcacagttggcttttgtaaaccagtataagccagctccagcatatcacttgatcagtcctttttctctctctttttggctttttatt

SEQ ID NO: 6813996 - DNA, 63 bp, Homo sapiens
cccaactctaggaaaacagcaaactggtttatgctgaacacagatgatgttccaggaactggg

SEQ ID NO: 6813997 - DNA, 61 bp, Homo sapiens
ggcaaggggtcaggctgagacacaggcacctctgcaggtgacgaggcctgcacctcctgct

SEQ ID NO: 6813998 - DNA, 99 bp, Homo sapiens
gagatggagtctcgctctgttgctcaggctggtgtgcagtggtgcgatctcagctcattgcaacctccacctcctgggttcaagcgattcttctgcctc

SEQ ID NO: 6813999 - DNA, 108 bp, Homo sapiens
taagcctctttcaattatggtaagtagtctatttgcatgtgtctaatccagatgtctgcctatatggataaatgtgcagatgacatgctatgtttgtttgcttgcttg

SEQ ID NO: 6814000 - DNA, 80 bp, Homo sapiens
ctgtatggtaatggctggatctctttggctttgaatgaaaaagctaatatttgttgagaacctactgtatactatatcag

SEQ ID NO: 6814001 - DNA, 113 bp, Homo sapiens
gcaactttcaagagacaatggaagcctgggagggctgggctaatgccttccatgtggccaagatgcgacctctcaggctttaatcagacagtctcagaatgaggttacgttgc

SEQ ID NO: 6814002 - DNA, 82 bp, Homo sapiens
cctgtctgggtctttagttctccactggtcaaatgacggattccagtgggtcagagagctccagatgtacctccgcggcagg

SEQ ID NO: 6814003 - DNA, 88 bp, Homo sapiens
gtcagtgtttttaaagcaatataaagcagctgagattttctattatttacttactgcaataagctgtaatgcattaaataatattggc

SEQ ID NO: 6814004 - DNA, 88 bp, Homo sapiens
ggagtgtggctatgtcaccgaggctggagtgcagtggcatggtctttgctcactgcaacctccacttcccaggttcaagcaattctcc

SEQ ID NO: 6814005 - DNA, 129 bp, Homo sapiens
tgattttgcccaactgtaggccaatgtaaatgttgtaagtacatctaaggtatgtcaggctaagctatagacgtttggtaggttagatgtattaagtgcattttcaacttgtgaattatagtgggttta

SEQ ID NO: 6814006 - DNA, 66 bp, Homo sapiens
tcccttgtttcctgtacaaatttgctcttattttgcctgatacctgagcatgccaggagagtggga

SEQ ID NO: 6814007 - DNA, 73 bp, Homo sapiens
tatctttgaatgtgaccttatttagaaatagtcttcacaaatttaataaggttaagatgaggtcattaagata

SEQ ID NO: 6814008 - DNA, 60 bp, Homo sapiens
acataaatattttatgctctttcatgttttactataaggaagaggcatcactatttgtgt

SEQ ID NO: 6814009 - DNA, 95 bp, Homo sapiens
ccatgtgtatgtatctaaaagtagttaatttaggcaacaatattttacaggtgtaatttgaatctcgctattttattctaggtgcaaagatatgg

SEQ ID NO: 6814010 - DNA, 110 bp, Homo sapiens
tcatttctaaattccctgcctatgactcacagatgtttcaaggggccttcagaatgcctgtggactttagtaggtgagagccatgggcagaggaaagatgtagtagatga

SEQ ID NO: 6814011 - DNA, 77 bp, Homo sapiens
ggaggctggaagcctgagatcaaggggtcggcagggttggttccttctgatgcctctcttcttggcttgtcatttcc

SEQ ID NO: 6814012 - DNA, 78 bp, Homo sapiens
tgttgtttcagtaagcaatctaaaagccttacctaatacattagataggtgagagtgtttttaggttagcagacaata

SEQ ID NO: 6814013 - DNA, 78 bp, Homo sapiens
attggcttattacccagggactattagttgtgtattaacatcaagttaaacactgtatcagtcttcaataagctcaat

SEQ ID NO: 6814014 - DNA, 90 bp, Homo sapiens
cttcccccaacccatccatgaggccagcaacgcttgtagagatcactctgggctgtaatgtggcactgatgggctgggacataagggaag

SEQ ID NO: 6814015 - DNA, 85 bp, Homo sapiens
gtcataataagtcttctccttggtttatgggacatgtaggcaaaaatctacatgtgttttcttctaaaggggttttattaatgac

SEQ ID NO: 6814016 - DNA, 99 bp, Homo sapiens
ctcttactgtactagtgagactaaagctcttactgtactagtgagactaaagctcttactgtactagtgagactaggagtctcactatcattctggggg

SEQ ID NO: 6814017 - DNA, 58 bp, Homo sapiens
ggcctgtgtggatgggcccctggctctcctgtgctccagcctcctctccacacatgcc

SEQ ID NO: 6814018 - DNA, 86 bp, Homo sapiens
ctttccactaaggggtgaccaacagctgtaattttagtggcagtaactgacaggaacagcttgatggcatcatgtttaatgggaag

SEQ ID NO: 6814019 - DNA, 59 bp, Homo sapiens
agatgaaagagtttgacatgattctcaggtaacctgaggaaggtaggattttgtcatct

SEQ ID NO: 6814020 - DNA, 56 bp, Homo sapiens
ctctgagggaggaaagctttatcttttaccttagaaatgaagtcctgccctcagag

SEQ ID NO: 6814021 - DNA, 58 bp, Homo sapiens
caatcactccacaatatggttcttaccccttcagtgagtgctatggtctgagtgtttg

SEQ ID NO: 6814022 - DNA, 65 bp, Homo sapiens
agatctgtcttcttcattgcctatagttccaagtccaactatggcagaggagaggcactagggct

SEQ ID NO: 6814023 - DNA, 81 bp, Homo sapiens
cccacaggcaaattaaattagtatggcatgatattaaaaaatgtcatcctgccatgcatgattaattttcaagtgaatggg

SEQ ID NO: 6814024 - DNA, 95 bp, Homo sapiens
tccaaaatgatagtcgaaattgatggagagggaagaagggaataagagagaaggagtgactgactgattcttcattacaatatttcatatcagga

SEQ ID NO: 6814025 - DNA, 70 bp, Homo sapiens
tgcgttacgtacctgcagggtcatgggccacctgtgagggtgctgcctcaactgtcaggaacaggacgta

SEQ ID NO: 6814026 - DNA, 66 bp, Homo sapiens
gatagaatttgcagcctgcagatataaccatctacgttcgtcatctgaaggctgtcaatgcgtatc

SEQ ID NO: 6814027 - DNA, 75 bp, Homo sapiens
gggcagaacctgggcctaaacaaacaagagccagggcagccagggtctctgcgtggctgggcccagggcttgccc

SEQ ID NO: 6814028 - DNA, 113 bp, Homo sapiens
gtggttagggtattgtaacctaataggactcattctggatgactttctagagacaagctctggttttcatatcctgaatgctcctgttctgttaggataatacactcaattgc

SEQ ID NO: 6814029 - DNA, 81 bp, Homo sapiens
gccacaataaggtattattgtctatgtactagaacagataaggtaataatttaaaatatggcgatgatacccaatgctggc

SEQ ID NO: 6814030 - DNA, 62 bp, Homo sapiens
gtccggttcttagcatgatgcaaaataatttcttttcttttgtataaatgaagatgctggac

SEQ ID NO: 6814031 - DNA, 74 bp, Homo sapiens
ttcattagttaaaagataattttggactatgtctggttgtatgtccaaatattcggtctttctgattttatgag

SEQ ID NO: 6814032 - DNA, 56 bp, Homo sapiens
atcatcatcagagaaaaaaatccagaagctgacctggaaatgtctatgataatgat

SEQ ID NO: 6814033 - DNA, 59 bp, Homo sapiens
tgcgctggcagacactcaaaagctgggagaatattttctgtcaggaaggtctaagtgca

SEQ ID NO: 6814034 - DNA, 115 bp, Homo sapiens
cccgcgaggggctctgcacccgcccttgaggcaccctcaagcagtggcacgtgctgataggtaggcgacagcttgatggtgcgcacgcgggcgtcggcggaggtggcctcgcggg

SEQ ID NO: 6814035 - DNA, 60 bp, Homo sapiens
tgggcttggagtagattaaatgtgaaataagactgtaaagcaactgatctgctcccacca

SEQ ID NO: 6814036 - DNA, 59 bp, Homo sapiens
ggggaagttgacttttgaccacaaccatgtgaagtatgtgtgaccaggtctactttccc

SEQ ID NO: 6814037 - DNA, 56 bp, Homo sapiens
cactggaaccaagacccagggcctagactgcagagtccagggtcagaagttcagtg

SEQ ID NO: 6814038 - DNA, 57 bp, Homo sapiens
atatcaaaataaacagcatgcaggctattgggcctacttgtgcttatgtttagatat

SEQ ID NO: 6814039 - DNA, 83 bp, Homo sapiens
gagggtgcaggtgagcaggtcaggaagtacattgggcagctgcatgctcagctaattcatcacctgctcctctgcttaacctc

SEQ ID NO: 6814040 - DNA, 67 bp, Homo sapiens
gaaaagccacaggccctggaggttgccagagatataccttgtagctccccatgtctgttgcagtttc

SEQ ID NO: 6814041 - DNA, 84 bp, Homo sapiens
gctggtgcttttatgaatctagagggctctgaagagaatatctttaggataattccttaatatcccttttggaagagtattagt

SEQ ID NO: 6814042 - DNA, 64 bp, Homo sapiens
agccgagattggtaccttttcaggaagccatcgcattggtttcctgcgtgtgccactcatggct

SEQ ID NO: 6814043 - DNA, 62 bp, Homo sapiens
gcccgcagagatctttaacaaagtcccttgcaggaggagctgagtgcagatgtctgtgaggt

SEQ ID NO: 6814044 - DNA, 130 bp, Homo sapiens
atgaatgggtggactcagtaaagtagattgccctccccattgtgacctcatccaatctgttgagggtctggataaaacaaaaggtgaaggaaggagggatttactttttttgcttcctgtctgcctgcat

SEQ ID NO: 6814045 - DNA, 101 bp, Homo sapiens
tcacctggctctttttgctggatgtaaagggtgaagaaagagaaagagtttctattccgtatcccatactcctaccccattagacagaaaagtagaggaga

SEQ ID NO: 6814046 - DNA, 65 bp, Homo sapiens
acagggcagagggcagttggtagccacaagacgccaggtagcccccatgctcccctcttttctgt

SEQ ID NO: 6814047 - DNA, 59 bp, Homo sapiens
actctgagaactgagattcccttttcttactgaataaacatgtctcaagtttttatggt

SEQ ID NO: 6814048 - DNA, 80 bp, Homo sapiens
tactaaaagccattgaactgtactttaaatgggtgaatatgaattttatctcaataaagcagtgcaaaagcgttttggtg

SEQ ID NO: 6814049 - DNA, 65 bp, Homo sapiens
tatatttgacaactcttacctaaaacagagccagagggtctctacagggtcagagtttcatggta

SEQ ID NO: 6814050 - DNA, 77 bp, Homo sapiens
tgccacagagctatttcttaaaagctgtacttacactcaggatacagttttccttggtatagaactcttccatggca

SEQ ID NO: 6814051 - DNA, 60 bp, Homo sapiens
gcagcccttgggccatcctagaaccagccaagggcttttttttggcctcagggcccttgc

SEQ ID NO: 6814052 - DNA, 90 bp, Homo sapiens
gtcacaccgtcctatccggattccactggtattcacattcctgggatgtggcggagttccagctgggatccggctgcccatcgctgtggc

SEQ ID NO: 6814053 - DNA, 128 bp, Homo sapiens
ggggtattgtggccagactccaaaagacttgtccacggctgagctaatccggcctgggcccagaggggagcagagcctgcctctggctgtggacagggcgtctggaggggcctcactctgtgtacccc

SEQ ID NO: 6814054 - DNA, 77 bp, Homo sapiens
ttccaagtctctcatggagaaagttggcagacattcaacatggtcatgccaatttctgcatggctatttcttgcggg

SEQ ID NO: 6814055 - DNA, 64 bp, Homo sapiens
gcatgtctatcattgtgtttgccagtcacctagctggtgagggatactgatagaatgagcatgc

SEQ ID NO: 6814056 - DNA, 58 bp, Homo sapiens
ggcacctctaatgagagcagggacaggctttctcatcctaactcaattcaggggtgtc

SEQ ID NO: 6814057 - DNA, 58 bp, Homo sapiens
agctctgggattctcaggccaccggcagttatgacccactggctataattccagagct

SEQ ID NO: 6814058 - DNA, 59 bp, Homo sapiens
ggaaggctccacccaaggcgaggaagggagttgagggctctccaggggaagagccttcc

SEQ ID NO: 6814059 - DNA, 64 bp, Homo sapiens
tagtaagctttctctccccttgcattttacacccaaaggtttgcaacaatgaggaaagctactg

SEQ ID NO: 6814060 - DNA, 69 bp, Homo sapiens
ctgccagctgctgcggttattgctaccttcctgttttaagatgaaagcaatgatggtagacacgtgcag

SEQ ID NO: 6814061 - DNA, 86 bp, Homo sapiens
gggtggttcctcctctgccaagagagaagtatgtttcccccattccggaactcaacgctttcttaggagatgaacagaattcacct

SEQ ID NO: 6814062 - DNA, 64 bp, Homo sapiens
tggaatggataagtcaaagagtatcccatttaaagtttaatgggtactgtcaaattgtcctcta

SEQ ID NO: 6814063 - DNA, 70 bp, Homo sapiens
ggcactgatggactcactaattcctccaccactgagaaacacagagtggaagcagtgagttcactgtgct

SEQ ID NO: 6814064 - DNA, 84 bp, Homo sapiens
gccctggctagggagctccgagtcccggccgcctggtcctttcattctgggcttcttcgagattctcgagggcttccagccggc

SEQ ID NO: 6814065 - DNA, 111 bp, Homo sapiens
cgctaagcaggtcataaagtaagaagtggcagagtcagggtttggaaaccagacagtttcactccagagttcctactctgaaccactaagctatcctgcctgaacatggtg

SEQ ID NO: 6814066 - DNA, 80 bp, Homo sapiens
cctggaggaggaggttggagggctggcctgcagggtcactgcacctctgcccagagcctcttacctccagatccttcagg

SEQ ID NO: 6814067 - DNA, 83 bp, Homo sapiens
gtgttcccattctgagtttttcaaatctgaatttgcttttgtcagcggcttacagataatgaggagactcctgtggcggatgc

SEQ ID NO: 6814068 - DNA, 77 bp, Homo sapiens
ccaccagtggatgaatgctggaccgagagccctagcttctggatccaggtctaggcccttcatctgctgctctgtgg

SEQ ID NO: 6814069 - DNA, 63 bp, Homo sapiens
agcaagccaaggggaaagtcctcaggagggacaaccctgctgacaacttgattttgaactgct

SEQ ID NO: 6814070 - DNA, 65 bp, Homo sapiens
gtaactggcctgctttacaggatcaacttgaaagaaagttggaaactgatgaggtaggtgagtgc

SEQ ID NO: 6814071 - DNA, 79 bp, Homo sapiens
tctaagtactaagggccttcagcgcatagctcaagtctaatccctgaagcttgtcacttaaggtctttgtcacttaaga

SEQ ID NO: 6814072 - DNA, 75 bp, Homo sapiens
attgaagacggaatgagtcttgaaaagtgctgtacagcctaaccccactttttcactggttctcacctctttaat

SEQ ID NO: 6814073 - DNA, 57 bp, Homo sapiens
agccgtgtccagcttttcccaccaagtactaactggggtttaggcctgggcaaagct

SEQ ID NO: 6814074 - DNA, 60 bp, Homo sapiens
ccatttagagatgggagacaggaaaaagcaagaattttatcccctttcttctctgaatgg

SEQ ID NO: 6814075 - DNA, 55 bp, Homo sapiens
aatgtggtctctcttagtagaaatccatgtcgtttctctggaattagaccatgtt

SEQ ID NO: 6814076 - DNA, 59 bp, Homo sapiens
tatcatgtagatgatggtaaaagcatcaagcatatgctgttgctttatcagacatgata

SEQ ID NO: 6814077 - DNA, 58 bp, Homo sapiens
aactcacagatgagctgaatagctttaacaatagcagctgtactttcatctgtttgtt

SEQ ID NO: 6814078 - DNA, 76 bp, Homo sapiens
gcctggcatagctgctggattctgttttgcacatgttggtgtttgcaatcagaaagttcagcggtccttccagtgt

SEQ ID NO: 6814079 - DNA, 63 bp, Homo sapiens
caaacgacctctggcttcttgccctggccaaccacagaggacaatgtgaggcgagtttgtttg

SEQ ID NO: 6814080 - DNA, 74 bp, Homo sapiens
tgatccagtttccatacagagaccaaagtagttattttagtagcactttggtcccatgtgtgtaaacttcagca

SEQ ID NO: 6814081 - DNA, 64 bp, Homo sapiens
tctcctgagtttctcaagcatagagtagtatatttaccttttcatgactgtggcacttaggagg

SEQ ID NO: 6814082 - DNA, 65 bp, Homo sapiens
aggatttgaaggtttaactgagaggcacgccaatacgttttgatgctttattggaacctcatcct

SEQ ID NO: 6814083 - DNA, 75 bp, Homo sapiens
agtaggagcaactggaaggaaaatgagagacagaagtggatgataactgttttccttctcagccattgccctcct

SEQ ID NO: 6814084 - DNA, 67 bp, Homo sapiens
ttgtactcaggagacttatgtcacagtgatggaaacaatgctgctacagaaagcttcaaaggtgcaa

SEQ ID NO: 6814085 - DNA, 60 bp, Homo sapiens
gcatcattctcaagaacatatgtagggtggggcatcatgacatacttttgagaagggagc

SEQ ID NO: 6814086 - DNA, 117 bp, Homo sapiens
ctgtgtcttttaattggagcatttagcccatttacatttaaggttaatattgttatgtgtgaatttgatcctgtcattatgatgttagctggttattttgcttgttagtttacgcag

SEQ ID NO: 6814087 - DNA, 129 bp, Homo sapiens
gctggcacaggagaacgaagagctgcggcggctggtgcagctcatccaggagaaccaggagctgaagctggtgctcaggaaccgcggcagcagcctgggcttctgcagctccgggttcctggctgaggt

SEQ ID NO: 6814088 - DNA, 83 bp, Homo sapiens
ggcaaacactccgtggaggcatgcaggctaggatcaaggcagcaggaggggagcctgtatggttgccatgaggggtgagttcc

SEQ ID NO: 6814089 - DNA, 70 bp, Homo sapiens
ggctcaccgcgggcctccagacccagtattagaatgaggggcctcgggggcttggacccaatggtgggtc

SEQ ID NO: 6814090 - DNA, 74 bp, Homo sapiens
ctgagataatcgcagtgtgtctctgggtttgtctgattggcatttaactgtgtggtatacctgtgattttttag

SEQ ID NO: 6814091 - DNA, 64 bp, Homo sapiens
gctctgtcagttgaggactcacctttgaagccactctggtgcttctgtcttcccactgaggagc

SEQ ID NO: 6814092 - DNA, 64 bp, Homo sapiens
agagaggttaaggagctcttgtctaagcttcccagataggacaaatttgaatcctgacttcttt

SEQ ID NO: 6814093 - DNA, 92 bp, Homo sapiens
tgagccaggtgggctgggcatggtgaatcatgcctgtaatcccagcactcagggaggctgaggcaggcagatcacttgagctcacgagttca

SEQ ID NO: 6814094 - DNA, 80 bp, Homo sapiens
gcagttccacaaagctgtagaatcatcttaatatggggagcaaaaatatgataagatggtcaattatagtcattcactgc

SEQ ID NO: 6814095 - DNA, 57 bp, Homo sapiens
taaagtgctggatttgagtaaaagacagagaatcatgtctgtaatcctagcactttg

SEQ ID NO: 6814096 - DNA, 130 bp, Homo sapiens
caggaaaagtgccccacccaggggagggaccggtatgataaaaggcaagcagcttgagggacagatcctccctgcatccaaaggcctcctcagtctgcagttccagctccaggtaagtgcaccttctctg

SEQ ID NO: 6814097 - DNA, 72 bp, Homo sapiens
acacatgaaaggtagctggcctcatagccactgggtagcccatccttgagagcctggccaccttcagtgtgt

SEQ ID NO: 6814098 - DNA, 59 bp, Homo sapiens
ggtgacaggctaccactgaagttctgaagaaccctttgctattgtgacagcttttcgcc

SEQ ID NO: 6814099 - DNA, 58 bp, Homo sapiens
catggttctgacagactttttcagcttctaaagtgctcaggaggtcaaatggaatctg

SEQ ID NO: 6814100 - DNA, 61 bp, Homo sapiens
caagtatttcctgatggcctgttttgtgcaaggtgatgtaacaggtattcgggaggatttg

SEQ ID NO: 6814101 - DNA, 84 bp, Homo sapiens
cttacttattctaacacctgtcagatgtgattattaagtacaatattattgctgacatggtgttgacacctctgcataagtgag

SEQ ID NO: 6814102 - DNA, 69 bp, Homo sapiens
tcaatgttgaaagaacaattctgtgatgacttctggtgtcatattatgcatgttgttctttctatttgg

SEQ ID NO: 6814103 - DNA, 71 bp, Homo sapiens
aaggtctgctagcttgtagtgatttgtggtaaatcacaattttcatgatccatttacaaaatggtaatctt

SEQ ID NO: 6814104 - DNA, 73 bp, Homo sapiens
tactggtttagagaattttaaaagccttgaataagtaaaattcagggaaaaggtaaaattctaggaaagagta

SEQ ID NO: 6814105 - DNA, 63 bp, Homo sapiens
taacaaggagatggtgggtcatagacttctcctgagtcttaattcatctgccatctcatgttg

SEQ ID NO: 6814106 - DNA, 100 bp, Homo sapiens
ggtgggagccaacacccttctgatggaaggtgggagccaacacccttctgatggaaggtgggagccaacacccttctgatggaaggtgggagccaacacc

SEQ ID NO: 6814107 - DNA, 74 bp, Homo sapiens
gccacctccttgcaaagttgccaagagttccagaagaaagagaaggctacagctttgcacaacagagaggtggc

SEQ ID NO: 6814108 - DNA, 72 bp, Homo sapiens
atgtggacaagattgctgcaatcaacaagtatggggcacacccatgctgggtagtgcaggaatagaccatat

SEQ ID NO: 6814109 - DNA, 68 bp, Homo sapiens
cgtcaagtaatagttctaactttgttgagcgtgttaagtgcttaacacagtgtctaccattattgatg

SEQ ID NO: 6814110 - DNA, 74 bp, Homo sapiens
gcttatggtcttagggtaggcagctggaatataattttaatagaacttagcttgatggctttgaaaccacaggc

SEQ ID NO: 6814111 - DNA, 63 bp, Homo sapiens
acatttcttgcatattctctgaggcaggagagaccttctcttattctggatatgcagagatgt

SEQ ID NO: 6814112 - DNA, 70 bp, Homo sapiens
ctctgtacaatagctattatctccattttagaactggtactaatggctggagagagttagcattatagag

SEQ ID NO: 6814113 - DNA, 55 bp, Homo sapiens
tagccagctgaatgcactacagtttactgtggatgaaagaagcattctatggtta

SEQ ID NO: 6814114 - DNA, 58 bp, Homo sapiens
tcctgcagcctgaaaaacaacagccttaagctgtaggttaacatttctaggtgcaggg

SEQ ID NO: 6814115 - DNA, 71 bp, Homo sapiens
tacaatagggaggtttaggggagccaatatccatctgttcatggcttttattcttcagcactccttaggta

SEQ ID NO: 6814116 - DNA, 61 bp, Homo sapiens
gcatttatgtgtgatgcctcaaggataattctttccttctgagtaatctcacatattatgt

SEQ ID NO: 6814117 - DNA, 90 bp, Homo sapiens
aaatgacaaaaagtgatggcaagtatatcaagaactgaatcaatgcctcctaatctagttgatttctgtatgtatgccagagcatcgttt

SEQ ID NO: 6814118 - DNA, 80 bp, Homo sapiens
gcagtagaggtcggggtggagatggaaaaggcagaggcttagctctgagctcgcccctccctcttatttctcctctctgc

SEQ ID NO: 6814119 - DNA, 73 bp, Homo sapiens
agaagtagtgggaggtaagctggaaaagttggtgcccttctgtgaacttccccagcatcctcagctcacttct

SEQ ID NO: 6814120 - DNA, 56 bp, Homo sapiens
tccaggctggagtgcagtggcgcgatgtcggctcactgcaacctccacctcccggg

SEQ ID NO: 6814121 - DNA, 74 bp, Homo sapiens
ccctaactagcggtttgactttgagcacatcactgcctcctccgtgcctcagtttcctcttctgttgaatgggg

SEQ ID NO: 6814122 - DNA, 79 bp, Homo sapiens
ccctcccttctcaagcaggcctgcctggtcatctgtgaaccatttcatggctggcactggcctgggttccaggggaggg

SEQ ID NO: 6814123 - DNA, 76 bp, Homo sapiens
tgttaggaagctattaaaaggcaagagtatgctggcaaaatgatttcagtgtgtgcctttggatacctgcttagca

SEQ ID NO: 6814124 - DNA, 70 bp, Homo sapiens
acccagcctgccctggaagcccagcctgcaccccacctgcgggttttagactgacccagggctgctgggt

SEQ ID NO: 6814125 - DNA, 86 bp, Homo sapiens
ttttcttagcataagtattttaaggctgcccgtgtatctccagatagatttgacagcagataaaataaaattatctaattagaaaa

SEQ ID NO: 6814126 - DNA, 101 bp, Homo sapiens
aataagatacatctatcacaatggtattagtcaattacagtggggcaagagttgtcccaactacctttgacaatcaccagtgagatattgaatattttatt

SEQ ID NO: 6814127 - DNA, 68 bp, Homo sapiens
ttctcacggctgggttctgagaaagagtaattcaatagcatgcatttcaaaagatccagctggtagga

SEQ ID NO: 6814128 - DNA, 61 bp, Homo sapiens
gaaagtggtgggggatggggaggttcttaacgtatgcatctttgccagccctcgcgctttt

SEQ ID NO: 6814129 - DNA, 57 bp, Homo sapiens
ggggcaccatatgtatatatcctgattacatagtgctgtggtctaaatgtgtgcccc

SEQ ID NO: 6814130 - DNA, 80 bp, Homo sapiens
ggttttcaagtctgttccatgtcttgctctgattgctcataagtggtgcaatccagcacatggacacagtcttccagacc

SEQ ID NO: 6814131 - DNA, 71 bp, Homo sapiens
ttgagttcttacaagtattccaggtccagattccacccagatttactgaactagaagcttgaagagctcag

SEQ ID NO: 6814132 - DNA, 62 bp, Homo sapiens
gaggtcttgctggccatgctcagtatccggagaactctgcagtggatggccagcaggggctc

SEQ ID NO: 6814133 - DNA, 59 bp, Homo sapiens
caggaggccaactgtgggacttgagcatacaaagattttagtacccacctgggttcctg

SEQ ID NO: 6814134 - DNA, 69 bp, Homo sapiens
ttctcccactccgtgcttcagtttccttatcagtaaaaatggctttgaaacacgcccaagtggaaagga

SEQ ID NO: 6814135 - DNA, 129 bp, Homo sapiens
atctggggtcaatgcaggtggattccagtttaggtggatccaattttgggtatcatcagagaaggaagatctctcaagcactatccacccacggcatccacaaaataatatgctcaaccccaccctgat

SEQ ID NO: 6814136 - DNA, 59 bp, Homo sapiens
aattccctcttttgcttgcatctccccaattagactgaattctgtaaaggcagggaatt

SEQ ID NO: 6814137 - DNA, 68 bp, Homo sapiens
aggatcaagttggttgagctttttacaagattttccttattttacctggcatttgccaaagtgatcct

SEQ ID NO: 6814138 - DNA, 61 bp, Homo sapiens
ttgctcaccaactctgaaaatccagatatagcagtagatgctaggaaggagttaggagcaa

SEQ ID NO: 6814139 - DNA, 60 bp, Homo sapiens
gtcaaaggtgacaccattctttaaatcactcagacctcagagtttgaagttatctttgac

SEQ ID NO: 6814140 - DNA, 109 bp, Homo sapiens
aaccagacctttttttttgttgagcattatattataaaagacgtgaatcataacttcaaatgtgtttctgagagttgtagtgtatccactctcaaagtgtcgtttggtt

SEQ ID NO: 6814141 - DNA, 60 bp, Homo sapiens
ccaacgcccagccttgatcaaatgatttttaaatcagatcaaacaaaatgggttagtggg

SEQ ID NO: 6814142 - DNA, 60 bp, Homo sapiens
atgtatgtgtacacaagtatatatacatgtgtatatatgtatatgagtgtatacttacat

SEQ ID NO: 6814143 - DNA, 70 bp, Homo sapiens
gggctaagaagtcaggggacagaggttccaggcccaataccttctctgtccaccttggctgacttaactc

SEQ ID NO: 6814144 - DNA, 70 bp, Homo sapiens
gtctgctggcctagacagaccctgatctccacccccaacccggatcctgggcccttctgggtcaccaggc

SEQ ID NO: 6814145 - DNA, 68 bp, Homo sapiens
gacagaggagatctggtggttgaagtaatcttaattgcctaacttcagaaatactatcagcttttgtt

SEQ ID NO: 6814146 - DNA, 62 bp, Homo sapiens
tgagacccagtaagaagctggcaccaggaaaagagttctgaatgctgtttctggctgactca

SEQ ID NO: 6814147 - DNA, 66 bp, Homo sapiens
gcccccactgcacccatgagctcaagggaggaatttgcttcccctgcagatgagggcagtggtggt

SEQ ID NO: 6814148 - DNA, 80 bp, Homo sapiens
actccaaacctctttgggcaattttctttcctcattgagaagtgagttctgaaattgagtggtcttggaaggaggtgggt

SEQ ID NO: 6814149 - DNA, 55 bp, Homo sapiens
gtggcctgccgcaccccaatatggcagaaacattttcaggccccggcaggtccat

SEQ ID NO: 6814150 - DNA, 56 bp, Homo sapiens
actaggttggggaagttctcctggataatatcctgaagagtattttccaacttggt

SEQ ID NO: 6814151 - DNA, 66 bp, Homo sapiens
tttagagtagtttattatgctaagggcctgggaaacactttagattcagtaaaaaaactacctaga

SEQ ID NO: 6814152 - DNA, 74 bp, Homo sapiens
tcaatgtcaagccatcaggcagcgggttgggggggttgcttggcccaggaacccgtgccctgatgtggagttgg

SEQ ID NO: 6814153 - DNA, 58 bp, Homo sapiens
tcgccatcgtcggacacagtgacttgtttttgagatgctcacagtctgatggtggaga

SEQ ID NO: 6814154 - DNA, 93 bp, Homo sapiens
tgttgccttgaggcctagagctctgctttatctaaatttaaaaggagatggaaacttagagaagagtagagggttctgtagtcttgggcagca

SEQ ID NO: 6814155 - DNA, 103 bp, Homo sapiens
gaactaacaattgaaaagcatcacacagatggctgccaagatgggctgcttcccagcccaaaatctgcaaccctctaaggtggctacaattatcctgaggttc

SEQ ID NO: 6814156 - DNA, 97 bp, Homo sapiens
tacttgagactgccacagaattaaagagcaacaagtttggttttaggaaactaaaattccagcctcagttctattatatgtgtgtgctctcttggta

SEQ ID NO: 6814157 - DNA, 64 bp, Homo sapiens
gctcacctcgctgcaggtgggtggcagtgacggagactgcagtgcgccagagcggtaggagagt

SEQ ID NO: 6814158 - DNA, 66 bp, Homo sapiens
aaacgtgatgggagggtggaaaggctctgagcactcactcagcgtctcggccgtctccaggcgttt

SEQ ID NO: 6814159 - DNA, 100 bp, Homo sapiens
ttgacattttagatttaagtcggtaaagcactgatttaaactggattttaactggatgaaattctgatttaataagtgtactgactggataaaatgccaa

SEQ ID NO: 6814160 - DNA, 55 bp, Homo sapiens
gctctgtttatccctgacaattatctatagcagaatgaagggggatggacagggc

SEQ ID NO: 6814161 - DNA, 56 bp, Homo sapiens
ggccctgaggggctgccccagtctgccaatcacaggcactgagcatctcctctgcc

SEQ ID NO: 6814162 - DNA, 80 bp, Homo sapiens
gtctttctctactgctgaataaaacctcctgcaggtccagaagatcctgcagggggttttattcagcagtagagaaagat

SEQ ID NO: 6814163 - DNA, 61 bp, Homo sapiens
caggcagacatttttgacatagttgcatagctagaaatacataacagataatgtctgcttg

SEQ ID NO: 6814164 - DNA, 72 bp, Homo sapiens
accaagaatagaggcttctcggatggggcagtttgaataaatgaccgctctgagagtgtctcctttttttgt

SEQ ID NO: 6814165 - DNA, 60 bp, Homo sapiens
ggtgagaggacaaagatcagccaccaggaaggggcctccatcctggctctgtcctcagct

SEQ ID NO: 6814166 - DNA, 72 bp, Homo sapiens
gcccacaccttccgcgggccagcgtgggaatgatgtggttcttcccagtggtcctggccctgggatgtgggc

SEQ ID NO: 6814167 - DNA, 56 bp, Homo sapiens
accagaggcagacttacactccagtctgtgattggctacatgtttctgtttctggt

SEQ ID NO: 6814168 - DNA, 67 bp, Homo sapiens
tcagtgattgttgctgttttaagccacgcaattttggagtagcttgttacacagcaatgttatgtga

SEQ ID NO: 6814169 - DNA, 69 bp, Homo sapiens
agctttgcccgctttgctatccagctaacagaaaaacggaggtcagtgaggaatgggaatgggaaagct

SEQ ID NO: 6814170 - DNA, 72 bp, Homo sapiens
gtcacctgcaactcacgctgcaagccctgaagcaagtgcttctggaagctgcaggtggccgtcaccaggggc

SEQ ID NO: 6814171 - DNA, 92 bp, Homo sapiens
gctgcggcattcgtccacctggctctcgcagcgtgtgcccgtgtagccaggagcacaggcacatgagaagctggcgatgccatccacgcagc

SEQ ID NO: 6814172 - DNA, 78 bp, Homo sapiens
gggagatgtgtggagtggctggacgacaagggtgagaggtcttctcaatcacctggtcctcgtcctccactagctccc

SEQ ID NO: 6814173 - DNA, 96 bp, Homo sapiens
gactattaggttgatgcaaaagtaattgcaattttacctttctttacttttaatgggaaaaccgcaattacttttgcaccaacctaatattaagtc

SEQ ID NO: 6814174 - DNA, 60 bp, Homo sapiens
gtatgcttggataaaccgtaattatggaaaactttataattatgtatgcaagctcagtgc

SEQ ID NO: 6814175 - DNA, 72 bp, Homo sapiens
gtgcttctaaaacaagtttccatgcttgaagcgttgagtgtcaagtatctgggagatttgcttttgtaggac

SEQ ID NO: 6814176 - DNA, 67 bp, Homo sapiens
tcctctcagggtgctggccagatgccaaagctgagcttaggacctggagcccagcaccgagtgagga

SEQ ID NO: 6814177 - DNA, 92 bp, Homo sapiens
cttcaaatattctaaacactgtgctccccaggctgtagttcaacctgtcaaagccacagcacttattcagcacagtgtagaagcgtttcaag

SEQ ID NO: 6814178 - DNA, 72 bp, Homo sapiens
aggaacagtgggcaacgattaagaggcaagggctctgtgtctgaccttgcctttattttgtgcctgagtctt

SEQ ID NO: 6814179 - DNA, 99 bp, Homo sapiens
tctgaggctggtgtgggttgggctgtggagaggagctggatgttctcaggtgtgaatgtcctcctccccctctgggccctttatatacgctggctggga

SEQ ID NO: 6814180 - DNA, 128 bp, Homo sapiens
cttactgtatgttagatactctctatgtcaatctctcattcagtcctcacaacctcactaaaagacttcatattatagatgagaaaattgagaattgaagagatgaagtaggtcacacagctagtaag

SEQ ID NO: 6814181 - DNA, 67 bp, Homo sapiens
agctcattcataaaaattagttggcagctaatctttgcatgctgttctctgaacttgagtgaaagct

SEQ ID NO: 6814182 - DNA, 75 bp, Homo sapiens
ttagaataagagtgggcaatagatcaagaccaagggttatttaaagttgtgatttctttgcaagctgtgttctaa

SEQ ID NO: 6814183 - DNA, 67 bp, Homo sapiens
actacaagtgtgcaccaccatgtccagcttaggtgtcagtttgatatgagtcagtagcataagtagt

SEQ ID NO: 6814184 - DNA, 70 bp, Homo sapiens
cagagtatgaaagcatcattcctgctgcttctcctctaggctgattcaacaggatgtgcttcatcttttg

SEQ ID NO: 6814185 - DNA, 117 bp, Homo sapiens
gatctatataatgtatgtttatgtctatatagtcaataatcattaggtcagtagatatttattaaacagctactacattgaaattactgtaaaggcattgtataactaataatgatc

SEQ ID NO: 6814186 - DNA, 70 bp, Homo sapiens
gaaagtcagagatctggagtacaactgcgcccatttggctgcagaaagcaaaatggatctctgtattttc

SEQ ID NO: 6814187 - DNA, 82 bp, Homo sapiens
gtgaaggatgtcctctggggtgagtgggccactttagggccctggtgggagtggcttgctctgcctcagcctccaccttcac

SEQ ID NO: 6814188 - DNA, 65 bp, Homo sapiens
tgttggccccattctcccctgccacagataggttctttccacagaggggatgatggcagctagca

SEQ ID NO: 6814189 - DNA, 105 bp, Homo sapiens
tagatatggctaaggaagtctctagacagaatattgtaagtgccacttagcttcttctaactgtgtatgatatgtactgggagagatgagctttaggcagagcta

SEQ ID NO: 6814190 - DNA, 74 bp, Homo sapiens
cctgagacagtgctgttaataaacacaaattgcaaacaagaaggtagtaagtggaaataatgcactcatttagg

SEQ ID NO: 6814191 - DNA, 60 bp, Homo sapiens
gtcttcaacaataactaccactttgttgtcctcgaagtgacaaggtagttagttggatgc

SEQ ID NO: 6814192 - DNA, 78 bp, Homo sapiens
tgggaaagataaattatgacctgtttctagtcgaggaaaaaattcaggctaagaaaaattcatgtatatttgaactca

SEQ ID NO: 6814193 - DNA, 85 bp, Homo sapiens
ctgcaggagaatttcatgtccttggggctggggaactcaatgttccacattggtgtttctctctccttaaggaccttccatgcag

SEQ ID NO: 6814194 - DNA, 92 bp, Homo sapiens
gtgagttgtttcaagggcagagattaattaagacagcctgtatcattcaggctttgtggactttttctttgttcttctcgaagcctattcat

SEQ ID NO: 6814195 - DNA, 124 bp, Homo sapiens
taagcccctttttatatggcagaggcaatttcatttaatgatggcaatgatggatagttacacattcacaatggattgcttcaatacctgctcataatcctacaatattaaaaagaatccctta

SEQ ID NO: 6814196 - DNA, 75 bp, Homo sapiens
gccccagcgcagttctcttgcctggtgcggatatcgctgggttcccggcagcactggcatgtgaggcggtggcgc

SEQ ID NO: 6814197 - DNA, 62 bp, Homo sapiens
agagtgggcatgaatacatatttgctgaatagatcagcaaattaaccaatcatgctcggttt

SEQ ID NO: 6814198 - DNA, 118 bp, Homo sapiens
ccctatctccatcttctttcttctagggtataattgacttactaggtttgttggaaatccttctgtgtgactcttcagtacaataatatctccaagaagtaatatttgttaggtaggg

SEQ ID NO: 6814199 - DNA, 67 bp, Homo sapiens
gctctataaacattcgatctgtccagaaagtgtgtactgattgagtcagttttgacagatgaagagc

SEQ ID NO: 6814200 - DNA, 102 bp, Homo sapiens
cacttatgagtaaacaattagtttggggattgaaatgtaaataggactagaattcatgaatttgttctcaacatttttcctctctgacaaaactcatgtttg

SEQ ID NO: 6814201 - DNA, 57 bp, Homo sapiens
ccctgccctgtctgcagcctggcttagaaagcccctgcatcatggggaggagcaggg

SEQ ID NO: 6814202 - DNA, 129 bp, Homo sapiens
gaacccgggagcggctccggggctgtcagctgcccgcctggctcctccaaggcctggagctcggacgcgggctctgggggcttctggggcgcggaagcgggctcgcggggagcagtggccgcccccggc

SEQ ID NO: 6814203 - DNA, 85 bp, Homo sapiens
ggccctgatccagcagaggagaccacagctgccaaatgcatcgccagctgcaggccctggctgggtttctttaggggaaaaggcc

SEQ ID NO: 6814204 - DNA, 94 bp, Homo sapiens
gtttaatggggatcatagtcactgccttccatttgtgaaaatcaattgtgataatgtctatgacaaatggaaggtgttctcttcccctgatgac

SEQ ID NO: 6814205 - DNA, 81 bp, Homo sapiens
tgtgatcagaagacattctcataaggattcatattgaatgaaataggattctgatctatagtgttatatttctgatgcaca

SEQ ID NO: 6814206 - DNA, 97 bp, Homo sapiens
cccagcctttagtcactgaaatgggagggaagtgtacagtggcgttttggcccagctgggctctttacccctgtacggtgtttactgaacagctggg

SEQ ID NO: 6814207 - DNA, 81 bp, Homo sapiens
ctgttgtgaatctcgaagtgggtacatgatgcactttcccatttaaggtaaagtacacatttatcccttatctcagaacag

SEQ ID NO: 6814208 - DNA, 72 bp, Homo sapiens
tttttctattcttttcaggcctatttccttagcaatattcttgtgacttaaatggtctgaggatagcaaaaa

SEQ ID NO: 6814209 - DNA, 73 bp, Homo sapiens
agtacagggacattgtaattagacttgggtttgaatctcaactttgcctaataactagctgtgtaactgtgct

SEQ ID NO: 6814210 - DNA, 55 bp, Homo sapiens
gtagttgtaaattggccacagtcgttcatacgagtgctcatgagcccacagctgc

SEQ ID NO: 6814211 - DNA, 70 bp, Homo sapiens
gtcccagagcctccacagatgcaaagggcagttatggtcaatggcctgagctctggggaggcaagggggc

SEQ ID NO: 6814212 - DNA, 64 bp, Homo sapiens
tctcaggactcctctggccataggctccaggaaagctggtggaaaccttggggctcactgaaga

SEQ ID NO: 6814213 - DNA, 72 bp, Homo sapiens
tgtgagaattgttcctcataggccttctggaagatagtacttaacaggcttcagtagggagcatgtctcaca

SEQ ID NO: 6814214 - DNA, 62 bp, Homo sapiens
gaaggcaggagaaaggtgtgttgggcatggtgaatgggcacttagcatcctttcctaccttc

SEQ ID NO: 6814215 - DNA, 90 bp, Homo sapiens
ctgagcagcatgcatgatgttggcagtggcaatagagggggcaagccaacccttgagctccctggcagcaatcactggtgttagctgcag

SEQ ID NO: 6814216 - DNA, 56 bp, Homo sapiens
gatccttatccttaaagatgctcttcctccctgaggagctgcttgctgtgaggatt

SEQ ID NO: 6814217 - DNA, 120 bp, Homo sapiens
cccttccaaagatgttgcagtatagttcttggtctctttaccggagtgttgttaattacacattaaccacatgaagacttgggatggaggagggaggagttcttgcagcctgtggaaggg

SEQ ID NO: 6814218 - DNA, 66 bp, Homo sapiens
tgaattttgacagactattcatttcacgtcatctttgactgtgaaagacaaggttttttcagatca

SEQ ID NO: 6814219 - DNA, 89 bp, Homo sapiens
ccagtgtagccagcattaaaccagagaggatgaggaaggtagggtgcccaagtctgcccttggctctcttgttgtgtaagcacatttgg

SEQ ID NO: 6814220 - DNA, 74 bp, Homo sapiens
ttagaaacagtgcatatatgaagagtatgatggcatgtttataagctgcatatacatgtaccccgattttctaa

SEQ ID NO: 6814221 - DNA, 55 bp, Homo sapiens
tcttcctggtttctgggccatcatgcctgaaagcctggtctggagccagtgagga

SEQ ID NO: 6814222 - DNA, 90 bp, Homo sapiens
ttttttgcgagatagaaattcttgatagagagcttccagactgctggtggcagggaagaaatctggttaagagattcagaaagcagaaaa

SEQ ID NO: 6814223 - DNA, 55 bp, Homo sapiens
agggaacatttgcactgttggtgggaatgtaaactagacagtgtggagattcctt

SEQ ID NO: 6814224 - DNA, 77 bp, Homo sapiens
gcatgggagtaccaatttctgtctaggggttcccatctcttagggatgagaatgccttggaagaagtcctcctctgc

SEQ ID NO: 6814225 - DNA, 63 bp, Homo sapiens
tccacttccatggaaacaagtcactttatcttgaaggtttccctttagcttgcctggaaggga

SEQ ID NO: 6814226 - DNA, 69 bp, Homo sapiens
gcatgctaacaaatgtctgtatgagaaagagaagaggctggggctgtctcttctcacatcagaagctgc

SEQ ID NO: 6814227 - DNA, 70 bp, Homo sapiens
ggagccctggagcggagcccacttcagatggatgagtccagcagagtttaaggcctggatttagggctcc

SEQ ID NO: 6814228 - DNA, 58 bp, Homo sapiens
atggtgctgcctttgcacacagcttggcctgctaagcctgtggcctggctagcaccgt

SEQ ID NO: 6814229 - DNA, 72 bp, Homo sapiens
tcatggttcaatctggcctgactgcagcatccacggcattgtggaaatgctcgccttggccgagacacgtga

SEQ ID NO: 6814230 - DNA, 65 bp, Homo sapiens
gcaggttccttttagctttgccctaacaggggatctgtacttggacactgctataaaggatctgc

SEQ ID NO: 6814231 - DNA, 69 bp, Homo sapiens
gatatttttattatggaaatagctattaataggtttaattggtggctattgtgccaaatgaacagtatc

SEQ ID NO: 6814232 - DNA, 60 bp, Homo sapiens
gggtcaagccgttgcccaaggccacagagttggtgagtggcacggccaggacttgaaccc

SEQ ID NO: 6814233 - DNA, 56 bp, Homo sapiens
gggctgctacgagaactgaataagaaaatgtatgtagagaactcagtgtgcagcct

SEQ ID NO: 6814234 - DNA, 81 bp, Homo sapiens
tgcgaatttggatgataactctttatgatgaagatgcattgtcttgcttatagagagtttcatacccttctaaaataagca

SEQ ID NO: 6814235 - DNA, 103 bp, Homo sapiens
ttgaggcagagtcttgctgtgtcacccaggctggagtgcagtggcgtgatctcggctcactgcaagctctgcctcccgggttcacgccatcctcctgcctcag

SEQ ID NO: 6814236 - DNA, 66 bp, Homo sapiens
gtttgtcccacttctggcagaactgtgcccacctgactcagagattccccggcagtgtggacagac

SEQ ID NO: 6814237 - DNA, 55 bp, Homo sapiens
cctttggagcaactgagagctactcttggaagattaaggctccagtcttcagtgg

SEQ ID NO: 6814238 - DNA, 64 bp, Homo sapiens
tggtgttctcattttcaaaaggagaatagccacagactattccctagagtgattgagagcatca

SEQ ID NO: 6814239 - DNA, 58 bp, Homo sapiens
tctggagtgccctgctctgccctcctcctttccctgggggctcctgccacacttcagg

SEQ ID NO: 6814240 - DNA, 77 bp, Homo sapiens
gtgcattttctcaagagagcacccgtcggtggtaggaaggggcattgctagtacgtcgggtgctggaggaaaccagc

SEQ ID NO: 6814241 - DNA, 83 bp, Homo sapiens
taaattgtacaaggggaagggagtccaagtgttactacaagtaattaatgtgcgtcttctctccctggtcaccctttgatttg

SEQ ID NO: 6814242 - DNA, 93 bp, Homo sapiens
tcatgatcagctatagtgaaatatgtgctgatagcatttttggggacaagaagagttagctagacattctttcactgtttgttgttctcatgg

SEQ ID NO: 6814243 - DNA, 57 bp, Homo sapiens
gcctctctcattttgttctcctgagttcattgcaaccggaacatgaatgtgagtggc

SEQ ID NO: 6814244 - DNA, 63 bp, Homo sapiens
acatacagacctgcagggcagcctcgcactggaatagtggtagccctgacttcttctgagtgt

SEQ ID NO: 6814245 - DNA, 64 bp, Homo sapiens
ggtgaaggaggggtaggaaagggttacttgggaaaggtaacaagatgtcactcctgtccatact

SEQ ID NO: 6814246 - DNA, 62 bp, Homo sapiens
agctgctccaatttttaccattacagagaacttcgtagaattgctgggaattggagccagct

SEQ ID NO: 6814247 - DNA, 64 bp, Homo sapiens
ccccagcctctgctgccatctcttcctcgtgctgctcctggggcagcggtgggtgcggctgggg

SEQ ID NO: 6814248 - DNA, 90 bp, Homo sapiens
cgtagatggatgctcccaggctgccacgattactgctctcaaacatccacatcccagaggcacagagtcactagctaagcatcatccccg

SEQ ID NO: 6814249 - DNA, 66 bp, Homo sapiens
ttgagcctccgtttcctcagctgtaagacgaaaataataattattgcctaggttaacgaggttgaa

SEQ ID NO: 6814250 - DNA, 59 bp, Homo sapiens
gctgtgcctttgcttgtctctcccaagttctatttctattgcttggtaagtaaaacagc

SEQ ID NO: 6814251 - DNA, 96 bp, Homo sapiens
aggagatgggatttcagtgggtaggaaaggctcttccctaggaaaaaaaggaaggggagagccaaatcttcctgctctaggaagcctcaaactcct

SEQ ID NO: 6814252 - DNA, 63 bp, Homo sapiens
ggtccatgaattccttggcaaaacacccaagttgaaaacctcacttgactgtccaggtggacc

SEQ ID NO: 6814253 - DNA, 75 bp, Homo sapiens
atgtcattacagtggacagctatgcacacgttggagattatgtgatgtgtgcatgtgcatccatgtgtacaacat

SEQ ID NO: 6814254 - DNA, 68 bp, Homo sapiens
cagtgtatacacatgtgtatgtgcatgcaaatatggatgtgtagccgcatgtgtactcttataggctg

SEQ ID NO: 6814255 - DNA, 55 bp, Homo sapiens
ggctcctgtcccctcagctgcttgcgtggggctgagcgtcgagggcccaggaacc

SEQ ID NO: 6814256 - DNA, 75 bp, Homo sapiens
gcagttagagagcctttcggagccacgctgtacccagtctggttgtgcagctgtgcctgaaaagtactcttaagc

SEQ ID NO: 6814257 - DNA, 56 bp, Homo sapiens
tggagatggggctttctctagctgagatgttccagccacagccagagctatctcca

SEQ ID NO: 6814258 - DNA, 82 bp, Homo sapiens
tgtttttcaaattgcaggttgtagcccattagtgggtcctgaaatcaatttaatgagttgcaaccagtattttttaaaaata

SEQ ID NO: 6814259 - DNA, 67 bp, Homo sapiens
cccaaccccaacttcctatgttgaaatcctaaccctcaatgtaatattaggaggtggggcctttggg

SEQ ID NO: 6814260 - DNA, 74 bp, Homo sapiens
tcatgtagtatttatctgtattgtagaactgttgctcaatggtaataattaacagtgatgggtctattgcatgg

SEQ ID NO: 6814261 - DNA, 73 bp, Homo sapiens
agggtcatagaatgtagggatctatgtagccatagaatgtagctgggaaaggcaagattccgctctagagcct

SEQ ID NO: 6814262 - DNA, 60 bp, Homo sapiens
gaggccctgagattgctgccctcccatattggaaggagggtctgcgatggcaagggtctt

SEQ ID NO: 6814263 - DNA, 63 bp, Homo sapiens
atggatgcttttcttttcagcaagacttcaattgtctacctgtttatataggagaagctctgt

SEQ ID NO: 6814264 - DNA, 67 bp, Homo sapiens
gtctttcaggatcaaatgaaatcgtcttctgtgtcagctgaatacgagctcccttgacctgaagccc

SEQ ID NO: 6814265 - DNA, 76 bp, Homo sapiens
tgccatataagtgtgtggctgttagttcccggcttgtgcagtgcctaagtatgctgactgccttacctatatggca

SEQ ID NO: 6814266 - DNA, 66 bp, Homo sapiens
gaggggtctcagggctgagggcagtgggcagatatggcccctgcatcccagtcttagcaaatcctc

SEQ ID NO: 6814267 - DNA, 60 bp, Homo sapiens
gtgactcagcaacccacacacggtctcagcagctgagaccgtgtgtgggttgcggtgcac

SEQ ID NO: 6814268 - DNA, 58 bp, Homo sapiens
aggtgcttgagggaagaaattatgcatcttattcatcttcattttcccttcagcacct

SEQ ID NO: 6814269 - DNA, 93 bp, Homo sapiens
ggttgttcctgagcagcagctgggccaggttccccaggtcgtcgaacaggccgcggggcagcgtggtcaggttgttgttggacaggtccagcc

SEQ ID NO: 6814270 - DNA, 55 bp, Homo sapiens
ccactcagttgctctctgttttcgagaagacatgagaagctgcaacatgacctgg

SEQ ID NO: 6814271 - DNA, 57 bp, Homo sapiens
aagtcacagcagggtccctccacgatgacaaagttgggagccactcagctgagagtt

SEQ ID NO: 6814272 - DNA, 70 bp, Homo sapiens
gtggtggctgtagagcctcagtgttccttggctggaagctgcactgctccagtctctgctttgctatcac

SEQ ID NO: 6814273 - DNA, 123 bp, Homo sapiens
ccttggctcccactcgcctgaagggcaggaccttgggccttccctggcatcttgttgccacagagaccaggagccacaggaggagccggatcccctcctccagggaaggggagcttcacgagg

SEQ ID NO: 6814274 - DNA, 68 bp, Homo sapiens
caatagcacatcactccagtgagtttctagttccctgagggactaaccgtggggagatgtgctcattg

SEQ ID NO: 6814275 - DNA, 74 bp, Homo sapiens
cctggccagggggctgggccgggccgtgacaccaccctgggtcagcagagctcaggctccagccctgtgtcggg

SEQ ID NO: 6814276 - DNA, 58 bp, Homo sapiens
ttttattgtgtcacaggcagcaagagcaggtgagttctttcctaatgaaacagtgaaa

SEQ ID NO: 6814277 - DNA, 58 bp, Homo sapiens
tcatttttaaccagctagggacccaatatgtgttgagttctattatggttagaagtgg

SEQ ID NO: 6814278 - DNA, 56 bp, Homo sapiens
cctacacagagcctacttctgcaggatgtgctgcaattcttgtgtgctctgtgagg

SEQ ID NO: 6814279 - DNA, 69 bp, Homo sapiens
aagatgtgaaattgtctctggggacttggaggtgttctaaacctgttgaaccagagacattggcatctt

SEQ ID NO: 6814280 - DNA, 70 bp, Homo sapiens
attctgtgttgcatccctaagccaggaacaaagtccagcccaggcctggctccaggggacacgcagtagt

SEQ ID NO: 6814281 - DNA, 65 bp, Homo sapiens
ccagggttgctgtatggcactttgcagaggagggcatggctgagaagtgtgtcccagcagccggg

SEQ ID NO: 6814282 - DNA, 75 bp, Homo sapiens
cggtcctcgcccccgcgcacgcgcagtgcgccctcctctgcaaaaggggctgcggtcactgcgggggctggaccg

SEQ ID NO: 6814283 - DNA, 58 bp, Homo sapiens
ctttgggggtcccttcctgctctgactttgggtggttttgcaaggttcactcccagag

SEQ ID NO: 6814284 - DNA, 86 bp, Homo sapiens
ttcctaaaggaaaagtgggaactctctgggaggcatcatgctagcaaagccagagatctcttggaagttttaactttctttgggag

SEQ ID NO: 6814285 - DNA, 62 bp, Homo sapiens
ttgtatatatttacggggtacaatgtgatcttttgatcaatgtacattgtagaaatattcaa

SEQ ID NO: 6814286 - DNA, 120 bp, Homo sapiens
caggtacacatgacctaaaatgacaggtttaggtctcagtgatggcccatttggataaggagagatgtctaaggacagttattactgggtgactacatgtggttgttcaggtcgaacctg

SEQ ID NO: 6814287 - DNA, 80 bp, Homo sapiens
gtgtgtgtgtgtgtgtgttttaagccctcctgtgcattaggatcacatggcgagctttaaaataatccagacatgcaggc

SEQ ID NO: 6814288 - DNA, 104 bp, Homo sapiens
gagccatgtgttgtaggtggccatgcttggagctggggaaactgagggaggcttggagaggagctgtccttcagcctcccagctcaaagtggctgccagggctc

SEQ ID NO: 6814289 - DNA, 94 bp, Homo sapiens
tagaataaagatcattctgaaggcttagtctctgaagatggcaagggggaaaactttaaagagggaaagacttcagattttaatttaatttctg

SEQ ID NO: 6814290 - DNA, 59 bp, Homo sapiens
aatgcatatgtaggcaagcagtggcagttctgtgactcttctctaacttacatatcatt

SEQ ID NO: 6814291 - DNA, 83 bp, Homo sapiens
gttgtgaatcagggctgggtcctgctctccctaagatcacagtctaatgagggtgaaggcccagaactacctgatgacacagc

SEQ ID NO: 6814292 - DNA, 62 bp, Homo sapiens
cactgtctgtagacatttttggttgtcacaactgggtgggaggcaaggtgctacagacagtg

SEQ ID NO: 6814293 - DNA, 70 bp, Homo sapiens
ccttaataccaaagattaaatagcaacatgaagcctccttcattttctctttttctgttggagattgagg

SEQ ID NO: 6814294 - DNA, 57 bp, Homo sapiens
aggcaccaggttgtggtttgtcgattgaacccataggcaggatgcatcttggtgtct

SEQ ID NO: 6814295 - DNA, 102 bp, Homo sapiens
aagatctttaacttaaccacattctcaatgtctctttctaaaatgtaaggtaatatacacatacatttggaggattaggatgtgggcatctttggagctctt

SEQ ID NO: 6814296 - DNA, 64 bp, Homo sapiens
tgagatggtgacagcattttgaagttgtacaaagataggtacaaaattgatctgttctatttca

SEQ ID NO: 6814297 - DNA, 95 bp, Homo sapiens
cttgccccttgttttcggcctcagtccagtctcactcttggcaggagactttctggcaaaacttagtgtggataagggttgatagactatgcaag

SEQ ID NO: 6814298 - DNA, 89 bp, Homo sapiens
ctggccagagtgggaggctctctcctggggtggggcccggaagtctgggccaggctggggggagatgtctccctggttttcttggccgg

SEQ ID NO: 6814299 - DNA, 88 bp, Homo sapiens
tacacaagtgctgaggaaggggcccatttggtgcagagcctggctttggggtctccctgaatttggggcctccctggcacggggtgtg

SEQ ID NO: 6814300 - DNA, 77 bp, Homo sapiens
gaaatggatttccacaagtggctggggaaagggagtctctttttagaatgtctcttctttggtccactgtctctttc

SEQ ID NO: 6814301 - DNA, 62 bp, Homo sapiens
tacctgagaagaaacccgtgttttcatgttcatctctttaacatggggcaggtccttaggta

SEQ ID NO: 6814302 - DNA, 96 bp, Homo sapiens
tgtccttgttgacattgttgttgctctgctgacttgtttttctcctggagcggagcctgcctgcagcacagcacagcggtgactcagcactggata

SEQ ID NO: 6814303 - DNA, 58 bp, Homo sapiens
gtggaagaggcaagatagctctctggggcctcttcctaagggcactaatctttttcat

SEQ ID NO: 6814304 - DNA, 84 bp, Homo sapiens
tggacttcctgtgctgccagctgcggcccacgcgcgagagcgtgctgcgcctggggccccgcggcgggcagctgcggctctcca

SEQ ID NO: 6814305 - DNA, 56 bp, Homo sapiens
ggagaaggaaggaggccgggaaccgccttgggtctttggccacgtctctccttccc

SEQ ID NO: 6814306 - DNA, 67 bp, Homo sapiens
aggcaatatgttcttggaaatgaagcttaagtcaggtcttcaggtgacattcagagaacatttgctt

SEQ ID NO: 6814307 - DNA, 57 bp, Homo sapiens
cacttagagcccagagtaagctggtccatttcctcccaggctctgcatttctgagtg

SEQ ID NO: 6814308 - DNA, 58 bp, Homo sapiens
cagagggcgtccgggttaacttccctcaagaaaaaggcagttaacccaagcccttctg

SEQ ID NO: 6814309 - DNA, 64 bp, Homo sapiens
tggcatgtcctctgttcttgctctgccttctgttggctcagggacgttagaggacaggttgcca

SEQ ID NO: 6814310 - DNA, 105 bp, Homo sapiens
cctgccttgaaactgtctgtcctggtgcagtcaatgtcctcggctctgtggaggtccaagtccacagggcacaagggaggttggggggaggaatgtcagggtggg

SEQ ID NO: 6814311 - DNA, 72 bp, Homo sapiens
tcatttttagaggggaaagtggctggtttggacttattaacaatatttgcaatgtgtcctctttatggatga

SEQ ID NO: 6814312 - DNA, 84 bp, Homo sapiens
cacttgtttaatggaatactttttagcctgtaggtcaacagatcaatatgctggcacgaaagggtgtccatgatagattaagtg

SEQ ID NO: 6814313 - DNA, 93 bp, Homo sapiens
ggagtctggctctgtcgcccaggctggagtgcagtggtgcagcgcaatctgggctcactgcaagctcagcctcccgggttcatgccattctcc

SEQ ID NO: 6814314 - DNA, 61 bp, Homo sapiens
ggctgccgagtgggtcatgaggcacttgggcccctacaagtgcagctgacactggtatgcc

SEQ ID NO: 6814315 - DNA, 97 bp, Homo sapiens
cctaaagcaaatccttgaaagattctaattttaagttgaacatgtacatgtaatcattaacatttctcttagagttggactttgcttttgctgcagg

SEQ ID NO: 6814316 - DNA, 73 bp, Homo sapiens
atttttcatatggaaataattagacaagtgcccaaagttataggtatatgttttgtgtttgccactgaagagt

SEQ ID NO: 6814317 - DNA, 93 bp, Homo sapiens
gtacaagctgctttcctggggtggcttgtccttttgcagttaaccgagatgcctggggagaagagcttcccccaacaggatggcaggcgatgc

SEQ ID NO: 6814318 - DNA, 74 bp, Homo sapiens
cagcctcccaaagtgctaggattacaggcgtgagccaccatgcctggctcctacgggtattttgccagcagctg

SEQ ID NO: 6814319 - DNA, 77 bp, Homo sapiens
gtccacagagccctgcaggaggtgggagagtagctagcaagcttttcctcctctccctccctgcctggccctggggc

SEQ ID NO: 6814320 - DNA, 55 bp, Homo sapiens
acataaaatagcaaataaaacaggcttttcctgtgtcctggtgttaattttatgt

SEQ ID NO: 6814321 - DNA, 65 bp, Homo sapiens
ctagaagcaactagatctgtttcaaaactgggaacgtccactaacagaaactagttgactgttgg

SEQ ID NO: 6814322 - DNA, 70 bp, Homo sapiens
ctccagccaaccatgccttaatatgaaccactgtgaaactgacactagaggttgatgagaggtgctgtag

SEQ ID NO: 6814323 - DNA, 63 bp, Homo sapiens
tagggctgattcacattaggaagagatgaagtggttataacttcacaatcaaaatcagttctg

SEQ ID NO: 6814324 - DNA, 62 bp, Homo sapiens
gctggcacggccgtgtgtgtacctataggcttcccgcaagtcctggcactggcctgctgagc

SEQ ID NO: 6814325 - DNA, 101 bp, Homo sapiens
cccgggaactgttagaaatgcacattctcagctgggcctttacctacggagttgtcaaccctggatgggccctgcagtgtgagttctagcaagcccacggg

SEQ ID NO: 6814326 - DNA, 67 bp, Homo sapiens
agctgagggaaaacatttggagcacagattgcaaagcacctgaatttgaaatgtttatttcttggct

SEQ ID NO: 6814327 - DNA, 78 bp, Homo sapiens
ttaatacacctgtatacctaattgctgttgtgaaacacatttctgcacaaattttaggttataggttttctgtgttga

SEQ ID NO: 6814328 - DNA, 59 bp, Homo sapiens
tgttctcgtttctgaagaaaagtattatggagaggtccgacattcacaggagcagagca

SEQ ID NO: 6814329 - DNA, 76 bp, Homo sapiens
ctaggagagaggcatggaacagattcttcctcacagccctgagaagaaaccaaccctgccagcactttgatcttgg

SEQ ID NO: 6814330 - DNA, 64 bp, Homo sapiens
ggatctgggcagcccatgctggcctgcaggtgcgtcactgcatctcatgggcatgccaagctcc

SEQ ID NO: 6814331 - DNA, 82 bp, Homo sapiens
ggagaaaggcagagagcaagatgcagggggaacgacgccctggaaaccggggccctattttcactcctgtggcctgccttcc

SEQ ID NO: 6814332 - DNA, 127 bp, Homo sapiens
cccatctctggggacactacatcacccacaaccgtcgtgtggtcctgcacccgcttggccacctgcaaaggaaaggtgtggagggcggggcccacagctctgttggagggcatgccctagagacggg

SEQ ID NO: 6814333 - DNA, 105 bp, Homo sapiens
cactcattgagaggctttgcttggagtggtccgtttacaaatgaataatgtgagataagtgaattcccactatatgccaagcatgttttaggccctgggtgtgtg

SEQ ID NO: 6814334 - DNA, 80 bp, Homo sapiens
gtgatgagctctacaggtcaagcagtagctctgctccacacagtcattcagggagctaagctgacctgttcctttgtcat

SEQ ID NO: 6814335 - DNA, 85 bp, Homo sapiens
gcctgtttcagtcagtgacctcacttcttaggattgtgtagtctggagaaagcagtctgggagaaggtgagattagtgacctggc

SEQ ID NO: 6814336 - DNA, 109 bp, Homo sapiens
tggttgagacagagtttcactcttgttgcctaggctggagtgcagtgatgccatcttggcttactgcaacctctgcctcccaggttcaagtgattctctgcctcagcca

SEQ ID NO: 6814337 - DNA, 58 bp, Homo sapiens
ctgaggcaagggatggccccgtgcaggctcctgccaggactgccagatcctgccttgg

SEQ ID NO: 6814338 - DNA, 75 bp, Homo sapiens
actctggcatcattcatcatggagtctagccatacaatcaggaaagctttcctccagtgggggtgagcctagagt

SEQ ID NO: 6814339 - DNA, 58 bp, Homo sapiens
gggttgctaataggagtttctgttgtatgccttaggacagaacttcagtagtattccc

SEQ ID NO: 6814340 - DNA, 61 bp, Homo sapiens
gataccagtgaattaggacaaaagggcttcagttcaagcacttacttcctaattccctatc

SEQ ID NO: 6814341 - DNA, 106 bp, Homo sapiens
tcacctggagagcttttccagctcacacaggcaggatcccttcccctctcagtaaggctggtgggtggggctgggcgtgtgtactgggctacagctccccaggtga

SEQ ID NO: 6814342 - DNA, 79 bp, Homo sapiens
gttaagaacttatactacctggctttatgacttagtataaaacactacagttatcaagacagtgtggtactggcttaat

SEQ ID NO: 6814343 - DNA, 75 bp, Homo sapiens
tgaacatatggatacatttctgttagatttatgtctacaagtggaattggtgagtcagaggagtacatatgttca

SEQ ID NO: 6814344 - DNA, 56 bp, Homo sapiens
tcctggagctcactgggagccggttctcttcacagagcagccccatggttctagga

SEQ ID NO: 6814345 - DNA, 102 bp, Homo sapiens
gcattttagagggtctcagttattatcgcattctaatttttgagtcagaagagtaattttcctagaatcaaagaatgggctagttggagatttttttaatgc

SEQ ID NO: 6814346 - DNA, 55 bp, Homo sapiens
ggaggcagcggctcacagagaaaaagctctggcttttctccgcccgctgcgttcc

SEQ ID NO: 6814347 - DNA, 79 bp, Homo sapiens
ttgaggcgcctggatctcgtgggcctttcgtctgagtcgctgtctaactctgaaaactccatgagctcgtcttcctcaa

SEQ ID NO: 6814348 - DNA, 56 bp, Homo sapiens
actgagtggtacattgtgtaatgatggaacgcctttatctacagtgtccattcagt

SEQ ID NO: 6814349 - DNA, 78 bp, Homo sapiens
ttatagggaatttgccagtctctaatggagtctacttcattctacaaaagaactggatctcaaatatctgccctatga

SEQ ID NO: 6814350 - DNA, 90 bp, Homo sapiens
ggaagattcagatcttatattactctttgttttacagttttattgtttacaggaaattgggacacagagaaaaatagagaggaatctacc

SEQ ID NO: 6814351 - DNA, 56 bp, Homo sapiens
ccttggcaggggagaaatatatggaggaaaatcagtacctttgtttcctcccaagg

SEQ ID NO: 6814352 - DNA, 61 bp, Homo sapiens
aggccagcctgcccaaagctgccctttaactgagggttgatctttaactggaaggctgctt

SEQ ID NO: 6814353 - DNA, 76 bp, Homo sapiens
gaatattaacacattttttcagattgagtgttaatttctatgggaagtcaaataccataatggaatgttgatgttt

SEQ ID NO: 6814354 - DNA, 58 bp, Homo sapiens
gggtgagtgggatgtggccactgttttccacactcccggtaccatgaccctctttccc

SEQ ID NO: 6814355 - DNA, 88 bp, Homo sapiens
gtctcctttagggcttcatctgtgccgaaccgtacaaacatttttgtgaaggcagagccagtgaaaaccctgcgaataaaagtgggac

SEQ ID NO: 6814356 - DNA, 100 bp, Homo sapiens
tcaccatgagagcaatgaatggggaggcatggtggagtctgagcaggggtgagccatgctcagccccttgggttctacttgctgcccgaccagctggtga

SEQ ID NO: 6814357 - DNA, 70 bp, Homo sapiens
tgaactgtacatccctaacctaaatcagctggagacaggggaagaaagtgttagattcttactcagttta

SEQ ID NO: 6814358 - DNA, 88 bp, Homo sapiens
ttttgacagcaaaatagtggtttggggcctcatttattatttgaatatttatttggatttccagacagcttaatttattctctcagaa

SEQ ID NO: 6814359 - DNA, 78 bp, Homo sapiens
caagagaggaagtgacagcctgaggtcactctgggggtcgtctagacaagacaccaggtctgttgtcctccaaccttg

SEQ ID NO: 6814360 - DNA, 59 bp, Homo sapiens
tggctcaagtgatcctcctgccacaacctccgagtagctgggacttcaggcatgagcca

SEQ ID NO: 6814361 - DNA, 129 bp, Homo sapiens
agttatggcttttgtgttcattcttcaagtattctgtgatttgtgtttaatacaaggacctcccagacctgacattgcaagggtaggtttaaatataaattctagatgttgagaggtgatatatgacct

SEQ ID NO: 6814362 - DNA, 57 bp, Homo sapiens
cagcccacagcccagcacttgtggagaaccatgttagtgtgtttaggctgcgggttg

SEQ ID NO: 6814363 - DNA, 93 bp, Homo sapiens
taagtggaccagatatagttcttagggtctgtaattttaatgcttaaaagaggatgggaatcagagtcccaagatctgtatatggcacagtta

SEQ ID NO: 6814364 - DNA, 76 bp, Homo sapiens
ttccaaaatgtgagtcccacctcaaagcagggctattgactgcatcaaatcataatttgaggtgttcactttggag

SEQ ID NO: 6814365 - DNA, 58 bp, Homo sapiens
agctctagacctgttccctaaagaaaactaagttcacagggacacacaggatggggct

SEQ ID NO: 6814366 - DNA, 61 bp, Homo sapiens
cctattcagtccttcaaggaggtgattagatagacacatttctcctgtgaaggatgttagg

SEQ ID NO: 6814367 - DNA, 71 bp, Homo sapiens
tctgaagttacattttggtctaattgctagattgaaaatatctgttaatgtgtctgaaatgtcatttttga

SEQ ID NO: 6814368 - DNA, 61 bp, Homo sapiens
aagtgctagtgagtctattgtatggtagataatgacagaatagccttgactcacagctctt

SEQ ID NO: 6814369 - DNA, 59 bp, Homo sapiens
gtattatttacatacatgtgtgtatatctacttgtgtatgtgcatatgtgtaagaatac

SEQ ID NO: 6814370 - DNA, 72 bp, Homo sapiens
ctgagccagggctcaggaaatcagacgtactcatttgaatgattcagcgtttggacctgagtcaaatgccag

SEQ ID NO: 6814371 - DNA, 57 bp, Homo sapiens
tttcagacaggctcagagccgtcatctgcttgaagagtctggggggcttgtctgaag

SEQ ID NO: 6814372 - DNA, 60 bp, Homo sapiens
agagccagtggacttcagtatgggtcgctttcattggcagaccctcaatccacttgtttt

SEQ ID NO: 6814373 - DNA, 70 bp, Homo sapiens
tgccatgtggcttctgaatggaggaggctgcagaacttccttcagtcttctgagccataataaattggca

SEQ ID NO: 6814374 - DNA, 68 bp, Homo sapiens
ggtatatgagtcaaaggcaccaaggtcactgccagtccacagctggccctactgccttgatctgcacc

SEQ ID NO: 6814375 - DNA, 70 bp, Homo sapiens
tttaattatttcaggaacatttaaccacagggttggcaggccggatcttgatacgtgtttcttagttgga

SEQ ID NO: 6814376 - DNA, 62 bp, Homo sapiens
gtttgcagcaagatgtgagcattagaagaaaaatgttagactcacatctatgttaagcaaac

SEQ ID NO: 6814377 - DNA, 76 bp, Homo sapiens
gctggacagccttattctttagtttacaatattttctggcatttgtaagctgttaagattagtgctaagttgtagc

SEQ ID NO: 6814378 - DNA, 56 bp, Homo sapiens
gccagggtgtgcagggacaggatccgcatgtcactgtctttatgtctcactgtggc

SEQ ID NO: 6814379 - DNA, 65 bp, Homo sapiens
caggtctgtgtgccatttccaaccttcaagttgatgaggggagggaaacggtcacacgcaacctg

SEQ ID NO: 6814380 - DNA, 88 bp, Homo sapiens
atctccaagatgtattaagtgcaaaaatgaaagtatagaaccacgttcctgataagctaccatttgtatataaagcatgtgtgggggt

SEQ ID NO: 6814381 - DNA, 62 bp, Homo sapiens
gatttatgaccttcggcagttagacattttctactgtgctgcccttcgtcatctataaaatc

SEQ ID NO: 6814382 - DNA, 72 bp, Homo sapiens
tcccatgagtgtgccatcctcaggccctggggtctcctaggcaagaccagggcctctgtgggctctctcgga

SEQ ID NO: 6814383 - DNA, 81 bp, Homo sapiens
tccctacagcttcatcgtgctgctctgtccataggagaggccaaggtctgtggacactagcagatacggtgtagacaggga

SEQ ID NO: 6814384 - DNA, 57 bp, Homo sapiens
gcccatgaggtggaggctgcagtgagccgaggtcgtgcgctgcactcccgcctgggc

SEQ ID NO: 6814385 - DNA, 76 bp, Homo sapiens
cattgatagggatgcctttctttggtgcaggttcttctgaacctcaggccaagaaagagctccattccctcagatg

SEQ ID NO: 6814386 - DNA, 76 bp, Homo sapiens
gggtagaggtggccaggaagtggggagcaggggctaaaattcagcccgtgcttcgccccctggtgcagctgtatcc

SEQ ID NO: 6814387 - DNA, 104 bp, Homo sapiens
ggtcactagtattaagttcaggttattcgaatgcattccacggtagtgatgacaattcatcaggctagtgtgtgtgttcaccttgtcactcccaccactagact

SEQ ID NO: 6814388 - DNA, 80 bp, Homo sapiens
ccattaccacccccttttgcagatgagaaaactgtggcttagagagatcaagtaatttgcctgtagctggtaagtgatgg

SEQ ID NO: 6814389 - DNA, 66 bp, Homo sapiens
accaaggactggctgcctccaaagtgtgcactgctgtgttatgctgcctggtgagtcatccctggt

SEQ ID NO: 6814390 - DNA, 77 bp, Homo sapiens
taacttttttgttcattttgagctcatcatcatctcattaatgcgtgaatgtagcttcacgatgacagtccatgttg

SEQ ID NO: 6814391 - DNA, 91 bp, Homo sapiens
tctctcggcctggaggcccctggcggcctctgctcccaagcggggagtcgcagccaggctacagcgggcttgatcctcagtgctgggtgga

SEQ ID NO: 6814392 - DNA, 64 bp, Homo sapiens
ggccttctttagtattgagttatggtagcctctaaggctccatgtgatctgaagaattattgcc

SEQ ID NO: 6814393 - DNA, 68 bp, Homo sapiens
agtggtcagaatattccataagggtcttagcaagaaggccagttctctggggatgcactctgaccact

SEQ ID NO: 6814394 - DNA, 91 bp, Homo sapiens
gaggcaggagaatcatctgaacccaggagacaggttgcagtgagccgagatcatgccactgcactccagcctgggcatgagactctgtctc

SEQ ID NO: 6814395 - DNA, 57 bp, Homo sapiens
gtggtcatttgtctgagctccagctagtgaagtatgagtagaacggacatgcaccac

SEQ ID NO: 6814396 - DNA, 75 bp, Homo sapiens
gggatgttataaagcgttgtgccctggtagcagaacaattactgcttcaaatgggtatgctttataataaatgcc

SEQ ID NO: 6814397 - DNA, 63 bp, Homo sapiens
tcctttctctgaaggctgtgttgatgggtgagggcactggcacagcccattcagagaagaggg

SEQ ID NO: 6814398 - DNA, 57 bp, Homo sapiens
ctggggagtgaaggtaattacactagaataacaggtgtaaaccagggtcatccttag

SEQ ID NO: 6814399 - DNA, 70 bp, Homo sapiens
ggagatttcacttggcttttctagtcttgggtggggacccattatggaagtgaagagctctggaatcttc

SEQ ID NO: 6814400 - DNA, 61 bp, Homo sapiens
aagtacttctagatggataatcaccaaatagaaatggtgcaaaatattcagaggagtattt

SEQ ID NO: 6814401 - DNA, 55 bp, Homo sapiens
cacatacaaggcacactggagggaataaaaaagcctttcatggtggtcagatgtg

SEQ ID NO: 6814402 - DNA, 66 bp, Homo sapiens
ttcaactcttcaagatcacatctattgaattgcagtagatcttgtgcacctggtcttaagattgaa

SEQ ID NO: 6814403 - DNA, 123 bp, Homo sapiens
tatcctagtctctgatggtgctgctccacaggtacagacaagtagttcagacaagatcctctcactacccaaactcttgcctacttgtcaaccagcagtatatgtgtgcaagatgtctggata

SEQ ID NO: 6814404 - DNA, 77 bp, Homo sapiens
ggcctgaggccccccagggttaacatgtggtcacggcattctgtggcagcacaaggtggcccatggtgggagaggcc

SEQ ID NO: 6814405 - DNA, 59 bp, Homo sapiens
gcttcagccccttgttgcatgcacagccgaggtgctgtgtgcacgctgggagctggagc

SEQ ID NO: 6814406 - DNA, 64 bp, Homo sapiens
ttggcagatgagccgcgctccaagaaccagctgttgaacgtttgtgagtgcaggctggtgccag

SEQ ID NO: 6814407 - DNA, 88 bp, Homo sapiens
atgaaaggaggttcccagggccgctgctgttgctggctcagagactgagaagtacagaaaggggccccttaagatactttactgccat

SEQ ID NO: 6814408 - DNA, 77 bp, Homo sapiens
ggggaatgggcagtgtggactagagtaggagttgcattgttgctattttgttttcagtccatttggcctaagacccc

SEQ ID NO: 6814409 - DNA, 76 bp, Homo sapiens
ggctcagccagaggggagggtgttgcctgctgctcagtcttcagagtgacattttcccttctctgaacaccctgcc

SEQ ID NO: 6814410 - DNA, 75 bp, Homo sapiens
ggaacatgttacctagggctgtgtctccaggaccatcagtaggggatgctgggatatagcttctagggcatagcc

SEQ ID NO: 6814411 - DNA, 83 bp, Homo sapiens
ggcgagagtcattgcattctttaagccagttacccatttacacctgcaccgtgatggcttatggagagagcaacagacacgcc

SEQ ID NO: 6814412 - DNA, 58 bp, Homo sapiens
gcacctcattttgcaggtagaagcataaggaatgatgatgtcaccatgtgtgaggagc

SEQ ID NO: 6814413 - DNA, 56 bp, Homo sapiens
gatgtgtcctagtacgggtgggtctgaaggcattcccatgtggcataaggatcatc

SEQ ID NO: 6814414 - DNA, 55 bp, Homo sapiens
gggccctgcctaaggaacacactctgcagagtgctgggccaaagcagggttttcc

SEQ ID NO: 6814415 - DNA, 90 bp, Homo sapiens
tgcaaggttattacattattatttattatgtgaaaaattagaaagaacttgattgcccaataataaaatggtaaaagtaatgatggtgta

SEQ ID NO: 6814416 - DNA, 58 bp, Homo sapiens
agcagggactagccgtaggatggaaaagcactcaggcctttctgtctctgtccttgct

SEQ ID NO: 6814417 - DNA, 57 bp, Homo sapiens
gctgctggcgttctgaccagaggatgccgcatcctctccatgtctcacgccactggc

SEQ ID NO: 6814418 - DNA, 58 bp, Homo sapiens
gcagtgcaggacaaatcagtgcagcagatgagagatgtccactgtggtccttcactgc

SEQ ID NO: 6814419 - DNA, 81 bp, Homo sapiens
gatacactggtactctgtgggttggggatggagtaaaatgagaattctgtatgcccaggtttgagtgcccaaggatgtgtc

SEQ ID NO: 6814420 - DNA, 77 bp, Homo sapiens
gaagggattgtgtttttagtatgcactgggtttaccaaaggtgtatcttatgttgtattcaaaatcgccattcattc

SEQ ID NO: 6814421 - DNA, 80 bp, Homo sapiens
gcagggaggttaggtgggtgacttccatgggggttctttcttgtcctgccatgtgtacacccacttccatttcctactgc

SEQ ID NO: 6814422 - DNA, 67 bp, Homo sapiens
gagcctcggtgttttccaacctgcggatcaggaagaatctgtccaaggggaaaggcgccggcggctc

SEQ ID NO: 6814423 - DNA, 77 bp, Homo sapiens
cttattcattcatgacagggctccctgagctaaatcaattagttcataatacaaagagttctgcatgcataaattgg

SEQ ID NO: 6814424 - DNA, 61 bp, Homo sapiens
aggctgagcaggagggcaaaattcagtctgggtacaatctgggctgctcctgtggcagcct

SEQ ID NO: 6814425 - DNA, 65 bp, Homo sapiens
tagttttacattatcttaggtgcgtggtttttattaatcatccacttcactggaatgtaggtctg

SEQ ID NO: 6814426 - DNA, 83 bp, Homo sapiens
agctggccagacatgccccctagggtgccagtggggctgagtacctcagcatcatcaaactggggggctgggaagagccagct

SEQ ID NO: 6814427 - DNA, 60 bp, Homo sapiens
tagctcatgtaatccgaacatattccattaactctatggtgatttcgttttcatgagcta

SEQ ID NO: 6814428 - DNA, 72 bp, Homo sapiens
gggaaactaggttttccgctgcttcagagggtatgtccatagactattcactgtggcagagggagcattccc

SEQ ID NO: 6814429 - DNA, 58 bp, Homo sapiens
ttcatatttcagatagccctttggtccttgtgcctggctacccactgaaatatcagag

SEQ ID NO: 6814430 - DNA, 93 bp, Homo sapiens
agctgtggttgaggagtctgaactggtcccctggctccctcctgcctcaccccagacaggctagccagactcaccaccctctcagccacagct

SEQ ID NO: 6814431 - DNA, 74 bp, Homo sapiens
ctcacaaagttgcagatagtaagtaagttatctaaattcttagagaatcaattcactgctgcagccttgtaggg

SEQ ID NO: 6814432 - DNA, 89 bp, Homo sapiens
ctgaggattcacgcgtgatggatatggaagtgcctcgcacccagggggccctggctagatggcagctttcattgtccacagagcctcag

SEQ ID NO: 6814433 - DNA, 64 bp, Homo sapiens
ctgccacaagctggccctgtgtggtcaagggaagttctggagaaaaagggccagctgtgagtag

SEQ ID NO: 6814434 - DNA, 59 bp, Homo sapiens
ggtggggtattgggtagttgttctgtgaaggtacagaagagcacctttagtatgttacc

SEQ ID NO: 6814435 - DNA, 66 bp, Homo sapiens
ccagcatttgagcacttgagcagttgatgtggcaggaggcacacagctgaccaccctgctccctgg

SEQ ID NO: 6814436 - DNA, 76 bp, Homo sapiens
gcccaaatgaaatttgagaagtttggtttaaacatggaaacatggaaaagctaattgtacttctcacagatgtggc

SEQ ID NO: 6814437 - DNA, 69 bp, Homo sapiens
gcagaaacagctttagaggataatagtcattattatgattgtcaatctatcctagagctgctattctgc

SEQ ID NO: 6814438 - DNA, 71 bp, Homo sapiens
ccagcagaggttggaacagttcttagttattaacatctaatggctgttttgtgacttctcaagtgcgttgg

SEQ ID NO: 6814439 - DNA, 60 bp, Homo sapiens
gggaaggctgaacgttaccatgctagatttaactattggcatgaatattttggtctttcc

SEQ ID NO: 6814440 - DNA, 92 bp, Homo sapiens
tttacttattgtataagatcatattgtaactttattgtgtagccatatgtcaaaagagaatttacaatgcgtgactttacagtgttattaaa

SEQ ID NO: 6814441 - DNA, 80 bp, Homo sapiens
gacaaaatatatttagcactggattaatcaaagtggggactatctcaaggattaaatatccaagtttatttatatttgtc

SEQ ID NO: 6814442 - DNA, 63 bp, Homo sapiens
actttttctgcagtgttaacaatgtcatcttcattggtggtatcgtgttggcactcagtaagt

SEQ ID NO: 6814443 - DNA, 77 bp, Homo sapiens
tgagggagctggctcctccgaggatggccttcccctacagagtgacagcaggccgaggacgagccagcatctcctca

SEQ ID NO: 6814444 - DNA, 73 bp, Homo sapiens
ttgtccctgctgtcccctgagcctggacaatctctgtcctcctgatatgcttagtgacagcctttagggccag

SEQ ID NO: 6814445 - DNA, 57 bp, Homo sapiens
atcagcaggcatattaactgaacaaagcacttgcttttttctgatgccaatgctgat

SEQ ID NO: 6814446 - DNA, 83 bp, Homo sapiens
attttccagttcaattcttcaagtgctttggagataggtattactatctttatgcacataaagaaactgagactttggagaat

SEQ ID NO: 6814447 - DNA, 63 bp, Homo sapiens
tggtaccctgtggccagccagccaaattgaaactgaagtggtaattgatatcatggggtatca

SEQ ID NO: 6814448 - DNA, 69 bp, Homo sapiens
gcaggaatgtgcttgtcttggaaacttgtggaccaaaatatgttcatccttaagaaaagcacatcctgc

SEQ ID NO: 6814449 - DNA, 60 bp, Homo sapiens
ctgaagcaggaggggaggcgctgggagcacgcagggttgggcctccaccccaggcttcag

SEQ ID NO: 6814450 - DNA, 59 bp, Homo sapiens
acttatgggaataatcaccaaggcccacaaaggagacctgggccttggggtcccaaagt

SEQ ID NO: 6814451 - DNA, 63 bp, Homo sapiens
gtggttgggtggggatttagttgcaatttgtcctagattcttctaggtctttagccttatcac

SEQ ID NO: 6814452 - DNA, 57 bp, Homo sapiens
acagcagggcatgagaggcaggcaagtgagcattactgcctgagctctgcctcctgt

SEQ ID NO: 6814453 - DNA, 59 bp, Homo sapiens
cacttgtagaggcattattccaaaggagttcacaggttcctatgtaaaccctgcaggtg

SEQ ID NO: 6814454 - DNA, 90 bp, Homo sapiens
aagagcaaatggaaatgagaaaaagattttcttcaggctattaaattacagacttttggagatggtctgttctcatattcctatgtcctt

SEQ ID NO: 6814455 - DNA, 126 bp, Homo sapiens
tcttttcttctctttggtgctggactctgccagccaaaatttatgacccattttccttctgcttaattgttgttataaatctgctgtgcagaacccagttgtaaatttatcacagactggattgga

SEQ ID NO: 6814456 - DNA, 94 bp, Homo sapiens
cctgcacatgtgtgcacgggcagggttgtatgtgagaatatgtatgtgtgtatgtatgcatttacaaatccaggagtgtgcacacatgtgcagg

SEQ ID NO: 6814457 - DNA, 73 bp, Homo sapiens
tagtgtccttagagtctccagaggcatccctaacccagaatcttttgactgtcctctggagagaaaggcagta

SEQ ID NO: 6814458 - DNA, 108 bp, Homo sapiens
tattctgtttatgcacttactgctagtggagatggctggcaggtagatgaaaccatcttcatttagctggcagaagccttctaaaactgctcagaagtcgatagaata

SEQ ID NO: 6814459 - DNA, 77 bp, Homo sapiens
atacagtagtcgtcttattttgacagaagagaataaaaagaggatttttatggtcaagtcagggcagaaaactgtat

SEQ ID NO: 6814460 - DNA, 83 bp, Homo sapiens
gatctttctttaagctgctgtgtggtgaaactcagtataaaacaagtttaaaaataactaagaattagcacacagtaagggtc

SEQ ID NO: 6814461 - DNA, 56 bp, Homo sapiens
tttggagccttgggggctttgaggatttcctgctcttcatttcttggggttccaag

SEQ ID NO: 6814462 - DNA, 59 bp, Homo sapiens
tctgccttggatttgttggcccaggtcccatgggtgctgtgggccatggccaagtgaga

SEQ ID NO: 6814463 - DNA, 77 bp, Homo sapiens
ctggctgcacaaacatggaagcagcatctgcttggcttctggtgaggcctcagaaagcttttattcatggcagaagg

SEQ ID NO: 6814464 - DNA, 110 bp, Homo sapiens
gtattgtgtagggtactcagaaaagacctgtggtagctctaaatcctcattacccaacaggatggcaaagatagtttcatgggttctctctgatttcttacttccagtac

SEQ ID NO: 6814465 - DNA, 66 bp, Homo sapiens
ggcagtcccagaatcctcactctatcaatttttaaccaattgtagaccaaagtctgggattttgct

SEQ ID NO: 6814466 - DNA, 63 bp, Homo sapiens
cccagtcttttccttcatacaattcagtggttggactgagctgtcaggaatggaaagcctggg

SEQ ID NO: 6814467 - DNA, 57 bp, Homo sapiens
tgccaggaacctgttcttgttcactgcttatccccaaacctagagcagtacctggta

SEQ ID NO: 6814468 - DNA, 66 bp, Homo sapiens
gggctcaccaggcagcactttccttgcagggctccctgtggattgccatggctgctaggagagctt

SEQ ID NO: 6814469 - DNA, 57 bp, Homo sapiens
ctgctctctgggcctccctttccaagggtcaggcaccttagatggggcccaggacag

SEQ ID NO: 6814470 - DNA, 83 bp, Homo sapiens
atgacagcagagtctgggttcaagtcctgactcaatcattttgcacttgatgtcaggcaagatacttaacatttctgcttcat

SEQ ID NO: 6814471 - DNA, 107 bp, Homo sapiens
tctgtactatttgttgacggacatttagctgttttgcatttttatctattgtgaataatgctagaatgaatagtcttataaatgactcctaagacaaataggcaaga

SEQ ID NO: 6814472 - DNA, 71 bp, Homo sapiens
gcacagctagacggtagccaaatgaggatttgaattcaggtggtctaactctctacagtgctaagctgtgc

SEQ ID NO: 6814473 - DNA, 108 bp, Homo sapiens
attttgactatttaaatcaacatttgattccatcctctactacagatctatatatgaaagatatcggagtagaggatggggttaaatattgacttaccaagtcaaaat

SEQ ID NO: 6814474 - DNA, 61 bp, Homo sapiens
tagggaggcagcgtagcaaggctagtatttgctattttatgctggtcaccctgtcttcttg

SEQ ID NO: 6814475 - DNA, 112 bp, Homo sapiens
gtgatgtcagcagggttcagggctcctttggacagcatggccccgagagcctggcaggccctggggtaggaggcagctgtgcccaaggctagtgtgatctgactggcgtcat

SEQ ID NO: 6814476 - DNA, 80 bp, Homo sapiens
ttcttcctctgatattactctgatttagtaaatgtaccaacagaatgcagtatttactagggagagatttagagtaagaa

SEQ ID NO: 6814477 - DNA, 66 bp, Homo sapiens
tgattgctgcagttttgtaagggataaattactatttatatacttgatttaactgagcatatatca

SEQ ID NO: 6814478 - DNA, 77 bp, Homo sapiens
tccaataataaaatccatttttgcaaagttgttcaactttttctttgggatacatttctagaagtggaattgttggg

SEQ ID NO: 6814479 - DNA, 58 bp, Homo sapiens
gcagggggtgggaagtctagaatccatcccagagggtgattcgatccccatcccgtgt

SEQ ID NO: 6814480 - DNA, 55 bp, Homo sapiens
tatggtagccactagcaatatatagctgctatatccttgagacgtggctactgtg

SEQ ID NO: 6814481 - DNA, 67 bp, Homo sapiens
ggcggtgtctggagatcagggggcccgggcagcgcaagtctgtctgccctgctgatctcacccctcc

SEQ ID NO: 6814482 - DNA, 89 bp, Homo sapiens
aggaaacatgagctctagtcctgatatcactgttgagtaggcccatgaggtttttccagtgaattagtctgttttggcttcattttcct

SEQ ID NO: 6814483 - DNA, 63 bp, Homo sapiens
ggtgctggagggggttgttggtgccatcgttgcagacctactcacatctgcctccatagcacc

SEQ ID NO: 6814484 - DNA, 78 bp, Homo sapiens
gtcgcggagccagggactcccagggtagctccgtccactaagggcggctggaggctggggagtcccggcgacggcggc

SEQ ID NO: 6814485 - DNA, 85 bp, Homo sapiens
gaaccagaagactgagtgccagcctcctagttgagatgagatcactgtgacagcatctggagagctggcagcccagcctctgttc

SEQ ID NO: 6814486 - DNA, 56 bp, Homo sapiens
tcataaattagctgtctttgaactcaaatattagtctaaagtatgctaatatgtga

SEQ ID NO: 6814487 - DNA, 76 bp, Homo sapiens
cagggcaccgtctccctcagagctccagtcccgagagctgacagcagcctgggctctaagggagcaccgtctcctg

SEQ ID NO: 6814488 - DNA, 65 bp, Homo sapiens
gtcagccactctcagacagtcccaccctatggcctgaaagggtggtggccaggtaggtggttgac

SEQ ID NO: 6814489 - DNA, 98 bp, Homo sapiens
gaaatcatcttaagtgcatatcttcttcctcatttatacatacaaagagctgtatggcaatgcataggaaggaaatggcacaggaaatgaacattttc

SEQ ID NO: 6814490 - DNA, 63 bp, Homo sapiens
ccctaatgaggtgttctatcagtcagggtccccccaggaaacagatgacatactcacttaggg

SEQ ID NO: 6814491 - DNA, 89 bp, Homo sapiens
cctatctgaactactgtattgttggctcttttgtctgaagcccattatttagccagaagcctaaatagtgcaccaggtaaaggaaaagg

SEQ ID NO: 6814492 - DNA, 61 bp, Homo sapiens
gctttatggattgtaaactgcataggaaattctatgtttgaagagtttgagatcctagggc

SEQ ID NO: 6814493 - DNA, 83 bp, Homo sapiens
aggatgtcgcaaagtctgggtggccttcagtccatgaaagagaacacatctgttctatctcaggctgaggtcatctgcatcct

SEQ ID NO: 6814494 - DNA, 59 bp, Homo sapiens
actcgaagagattaagtgatttaaaggtcaagaccacataaatctctgtattcttcagt

SEQ ID NO: 6814495 - DNA, 83 bp, Homo sapiens
agatgctgatatgatatttaagctgatcatttctgattggtagggccaacaattgaacagatgagttaaatacctcagaatct

SEQ ID NO: 6814496 - DNA, 110 bp, Homo sapiens
ctgcctacccattttctttctacccaggttctgccaaggaggacctgaaggctgagcatcagaggctccaggatcctttggccacttcttaagagagagacaggagacag

SEQ ID NO: 6814497 - DNA, 64 bp, Homo sapiens
cagttcctggcacacagtaggcaccaatatgtgatagctattgctgctgctgttgctgctgctg

SEQ ID NO: 6814498 - DNA, 79 bp, Homo sapiens
cttcctcacccacacctccgtatatcactaagtgagcaaggatgagagtgatatataatgaggtgagggatgttggaag

SEQ ID NO: 6814499 - DNA, 77 bp, Homo sapiens
ccgggtcggcggcgggcttggctccagggcccaggaggaactgctgctgctcttcaccatggcctcgctgcacccgg

SEQ ID NO: 6814500 - DNA, 86 bp, Homo sapiens
gctgaggtgggcagggctgtggacactttggtgatgggcagggctcagggcacttcgggggtggacatggctctgggcactttggc

SEQ ID NO: 6814501 - DNA, 81 bp, Homo sapiens
gagagatcatggtcagcagaggagtgtcttgcccagcaattaaatacttgggcatagaaataacttctgtcacttctactc

SEQ ID NO: 6814502 - DNA, 64 bp, Homo sapiens
tttggaatgaaatcaactaggagacaccatggggaatcgttgtcctgagtctgatttctctgag

SEQ ID NO: 6814503 - DNA, 78 bp, Homo sapiens
tgttccctgggttattttggtctagtgggagtctgtcaattctagggcatttggaccaaaatagccaacagcgggaca

SEQ ID NO: 6814504 - DNA, 73 bp, Homo sapiens
ctgcttggcttggggacagatctggaggggcaggcgggcatggagcgtgtgccagaggtcccctgccaggagg

SEQ ID NO: 6814505 - DNA, 81 bp, Homo sapiens
actgcatgtttaattaaagaacagccctcctctatcttccccagatagaggagggctgttcttcagtcgaagatatggagt

SEQ ID NO: 6814506 - DNA, 56 bp, Homo sapiens
gggacaggtcctcaatctgcaaaatggaagacagctgtgtcagtagagcctgtccc

SEQ ID NO: 6814507 - DNA, 64 bp, Homo sapiens
gtgggaagacatgtgtacatatcgcagcggcagcgggcttcagcgatattattcatgagctggc

SEQ ID NO: 6814508 - DNA, 73 bp, Homo sapiens
ctggagggggcggccggggtcggtctagttccggttacaaactggacagaaaaggccactggagtctcgctag

SEQ ID NO: 6814509 - DNA, 72 bp, Homo sapiens
tgcgtcaggccctgttgggggattacaaacatcaactacatgcacgtaaacatcgacccaacaggggaggca

SEQ ID NO: 6814510 - DNA, 92 bp, Homo sapiens
aaaggagttcatattttttacatttgaagacgacagtggaaatttctctttctaggtgattgtcttcagatacgaaaataatgtgcttgttt

SEQ ID NO: 6814511 - DNA, 68 bp, Homo sapiens
aagtgatttagaggaatagaattagaatgtggggtttctgtattccagtcctatcctcttttccactt

SEQ ID NO: 6814512 - DNA, 70 bp, Homo sapiens
actgttccttcagtgctgttgtaagctcattgtgaagtcagagctttggaaatgtgtactgatgggcagt

SEQ ID NO: 6814513 - DNA, 57 bp, Homo sapiens
agcagaggtttgttggaaacctgaattctatcagtcatttcaaactgcacctttgct

SEQ ID NO: 6814514 - DNA, 77 bp, Homo sapiens
gagtggtttgggttttgttgctgttcatgtgtatcttttaaacattaaggacccacgcacaggaaccccagccgctc

SEQ ID NO: 6814515 - DNA, 83 bp, Homo sapiens
ggtaaataaggcagtcactggaatgttcctctccaaattgtcagaacagaggagttttccagcctgattttctttcctccacc

SEQ ID NO: 6814516 - DNA, 55 bp, Homo sapiens
gtgtgtggcatgtcctattttgtttaaagaatgagctccagggctgcttgcacat

SEQ ID NO: 6814517 - DNA, 67 bp, Homo sapiens
ggttgtcatggtgactgccgctcaaactctccattggacagagcagcagattgtctccatggtgatc

SEQ ID NO: 6814518 - DNA, 55 bp, Homo sapiens
gtctgggattttggtacatgctaggcaaagggcactcaatctaaaatccctgggc

SEQ ID NO: 6814519 - DNA, 89 bp, Homo sapiens
cagtggtagcagcgggacctctgcacctgcctcctctggcctgcaaggaaaggggagacacgggtgctgaggacccctcaatctccctg

SEQ ID NO: 6814520 - DNA, 57 bp, Homo sapiens
gagctttgtagcaggaaggaaggggaaatactgcaaaatccattaagctcagagctc

SEQ ID NO: 6814521 - DNA, 57 bp, Homo sapiens
cctgtctggccttccacggggggcattcaggatggacctgtctggaagagctgcagg

SEQ ID NO: 6814522 - DNA, 90 bp, Homo sapiens
tacaaatataaacacaatgtgtacacctgtctttacacatacatacaagtgtatgtgaatgaaatgtgtgtgcgtgtgtgtgtgtgtgta

SEQ ID NO: 6814523 - DNA, 62 bp, Homo sapiens
agaaagaacgcacttgtgctgcagaaaccttgaaacaatcaaaggcacaaatgcctcttttt

SEQ ID NO: 6814524 - DNA, 76 bp, Homo sapiens
agctgaggtggaggcagctctggataggaatttgggagatctgaaaactggactcagtgctgccattcccttggct

SEQ ID NO: 6814525 - DNA, 78 bp, Homo sapiens
ggaagaagaagagcaaggagtcaatgcttctgttaaacataaattaccagaataaaaactcctatgtctctctcgtcc

SEQ ID NO: 6814526 - DNA, 73 bp, Homo sapiens
acatgaaatgaaaggctcaccacttcataggctttaaggaaattcttggccaggtgtggtgcctcactcatgt

SEQ ID NO: 6814527 - DNA, 63 bp, Homo sapiens
acttccgttatgtaccatagggaaattttggttttggtttctttgtagtagcataatcatagt

SEQ ID NO: 6814528 - DNA, 59 bp, Homo sapiens
gtagttactgtttgttcaatttgctttgttcaggaagtatctcaaaaacagtaatctgc

SEQ ID NO: 6814529 - DNA, 78 bp, Homo sapiens
gctcacagatgctgtgggtcaggacttaaagcagaatatagcaggaatggcttttctctgttccacagtgtctggagt

SEQ ID NO: 6814530 - DNA, 73 bp, Homo sapiens
ttcccagaatctttggaagagcaaaaactctcatcttcaaagacaattgcttaaaattttccaaggattggag

SEQ ID NO: 6814531 - DNA, 65 bp, Homo sapiens
gaagagtgtctgcacataggatctcaaaaactattttgaatcagtgaattgtgtagatgtttttt

SEQ ID NO: 6814532 - DNA, 71 bp, Homo sapiens
gcccctccccgctggctgccctgggtctccctttgttgatatgactacccacagctgcacagaggaggtgc

SEQ ID NO: 6814533 - DNA, 103 bp, Homo sapiens
caggggggtttggggttggtgcaatggtgagggcagccagggaagttcctaggcctattgtcttctgccagtgcccctgctaatcgctgagaaaactcccctg

SEQ ID NO: 6814534 - DNA, 60 bp, Homo sapiens
tttacaggtggtaaaaatattgttggttgacataccaataagttaaacctaacttgtaaa

SEQ ID NO: 6814535 - DNA, 95 bp, Homo sapiens
gagtttgaagccagcctcatcttaggagatggtcctctagggatggctaacagtatccctattgtcctttcctgaaggaggacttctttcaattc

SEQ ID NO: 6814536 - DNA, 63 bp, Homo sapiens
ggctataaatctacccagcattggaaggccccagaatgaattgggtggaattaaacattggcc

SEQ ID NO: 6814537 - DNA, 66 bp, Homo sapiens
atgtggcccaatatgttaacatgatgagtaagtaagttctatctattgaggtgttgaggttgacat

SEQ ID NO: 6814538 - DNA, 56 bp, Homo sapiens
tgctctatatgtctgttttgagtaatgggtcatttcagaacatcattcttagagca

SEQ ID NO: 6814539 - DNA, 109 bp, Homo sapiens
aagcaattctcctgcctcagcctccagagtagctgggattacaggcatgcgccaccatgccctgctaatttcgtacttttagtagagatggggtttctccatgttggtt

SEQ ID NO: 6814540 - DNA, 63 bp, Homo sapiens
tccaagaacatgaacctcttctaactccttccagcatggcaagagttgagtcttcatcttggg

SEQ ID NO: 6814541 - DNA, 83 bp, Homo sapiens
tcccagactacccaaccctgtcggacccactgctgctgtttatataaagagcccagggagttgattagcatttgggtctggga

SEQ ID NO: 6814542 - DNA, 64 bp, Homo sapiens
gaaattgccagatctagtagatgcggcaccttttactgctatgagtagtgggtttggtggtttc

SEQ ID NO: 6814543 - DNA, 75 bp, Homo sapiens
agggtactgttttagtcatatatcataatgcaatttcagaatgtttattgattgtatgattgaaatatttacttt

SEQ ID NO: 6814544 - DNA, 75 bp, Homo sapiens
ggccattactgcagtagtttttgactctagatatgcttcagtgtcacctagagagcttttaaaaatactgatgcc

SEQ ID NO: 6814545 - DNA, 95 bp, Homo sapiens
gcagggtgtgaggggaggtggccagggcacctggtgttcagcaggttgatgactctggcccaggtctctctgagccctctaatgctgtatcctgc

SEQ ID NO: 6814546 - DNA, 82 bp, Homo sapiens
tgagccagatataaatggatgtggtagaaactgtacaataataaaagttagtattactaaaagacatctattcatatgctca

SEQ ID NO: 6814547 - DNA, 64 bp, Homo sapiens
gtacaatagcagttttccctttatctgcctaaggaatctacaagttggaagattggctatgtgc

SEQ ID NO: 6814548 - DNA, 68 bp, Homo sapiens
gcatatttaagccattagacatgcaggaatgttaacattattatgcgttattgtgtctggctatgtgt

SEQ ID NO: 6814549 - DNA, 79 bp, Homo sapiens
gggatcttgttaaaatgcagatttggattctcatggtctggagtggagcctgaaaagtctgcatttctcacaagctccc

SEQ ID NO: 6814550 - DNA, 64 bp, Homo sapiens
ctttgatttctattcagatgtagatctgctgagagcctgatcctgcagccattagaggtcaagg

SEQ ID NO: 6814551 - DNA, 120 bp, Homo sapiens
ctgatttgtgtggtcatccttagcacctttctggatttgtgatcgtgcgtgatgaatcttataaatggttcaatatttccatgattcaaaatgaaagtgctaaggcaaacgcaaaagcag

SEQ ID NO: 6814552 - DNA, 76 bp, Homo sapiens
ggttaattatagtgtctgtagaaccttaactgctgtaagctttccagcagactccacagacgtgttattagttgcc

SEQ ID NO: 6814553 - DNA, 60 bp, Homo sapiens
atccagcagtgtggtcacctttcacacagtgtgcaaggtcttaggagcatggtgctggat

SEQ ID NO: 6814554 - DNA, 77 bp, Homo sapiens
ggagattggagggtgaggggaagggagacgccagggtatttcttcctctgtctctctgcccccattgctctggcttc

SEQ ID NO: 6814555 - DNA, 57 bp, Homo sapiens
gaagttcaactgccatgcttgggagtaagcaattgtcatgcttggcagtgagcattc

SEQ ID NO: 6814556 - DNA, 57 bp, Homo sapiens
caagaaggtgtgctttatattgcttatgaagcccattttgaagcaataccatttttg

SEQ ID NO: 6814557 - DNA, 73 bp, Homo sapiens
gtggagcagcaagcactcaaaggctcacttgggtgggacttcttagcagtctttcctgcttgactgttcttac

SEQ ID NO: 6814558 - DNA, 62 bp, Homo sapiens
tatatggtaggtacaacagcaggcagagtcacatttttgccatctgtgcattttaaaatatg

SEQ ID NO: 6814559 - DNA, 82 bp, Homo sapiens
gcttcgccatatctcgttcggggacactttggggttgggggttttctgctgactgtgttccagggcgcgaaggtggtgtcgc

SEQ ID NO: 6814560 - DNA, 63 bp, Homo sapiens
ggagtgcagtggcgtgagctcggctcactgcaagctctgcctcccatgttcatgccattctcc

SEQ ID NO: 6814561 - DNA, 58 bp, Homo sapiens
actgtggtggctctggaacctgacaacccatgtccaaatccaggctcctccacttagt

SEQ ID NO: 6814562 - DNA, 86 bp, Homo sapiens
agtgatttcctcagggtctcacgtagattaagtctatgattcccggtaatcataaactcactagtttatgtgatgtaggaagcact

SEQ ID NO: 6814563 - DNA, 56 bp, Homo sapiens
gagctgagtagaggctgctcccttcaggacaaggtgtacggtctccaactcagttc

SEQ ID NO: 6814564 - DNA, 61 bp, Homo sapiens
ttccacaggtttcagactgttctcctagaaataactggcaatgcaacctgaaccttggtaa

SEQ ID NO: 6814565 - DNA, 86 bp, Homo sapiens
gaagaggagaataacagagaagggtggcttcctatagcagagataaagctttgggggtcgccaaatttcatgccatctatcacttc

SEQ ID NO: 6814566 - DNA, 79 bp, Homo sapiens
ggaaactaacgagatcattattagtgaatgataggccatgtctggtcccttgagttgaattaatggtggtctggtttct

SEQ ID NO: 6814567 - DNA, 77 bp, Homo sapiens
gaggaggatgaaaattgacagcggaagtactttcaaacagatctccagttaatgtgctcgctgataatttcctcttt

SEQ ID NO: 6814568 - DNA, 58 bp, Homo sapiens
gccgtccacgtgacccaagaaggcccgcccccgggaccgcctctatggcattgccggc

SEQ ID NO: 6814569 - DNA, 65 bp, Homo sapiens
ctctttagcttaattaaataatcagtccagcctagatggactgatgagaactaggcctggatgag

SEQ ID NO: 6814570 - DNA, 93 bp, Homo sapiens
acctctctttccataaatgtataatgcgcctcagaaaacagagagccccaactctactttggcttctgtgggcgtttaccaaggaaaattggt

SEQ ID NO: 6814571 - DNA, 58 bp, Homo sapiens
atttaaccaaataaaagcagactcactaagtgtcaagtgggtttacagttggttgaat

SEQ ID NO: 6814572 - DNA, 88 bp, Homo sapiens
aataacaagaatcatgtctatcttagtcaccacattgggtctctaatggtgcacatttgaagagggcatgttattctgaaaaaatatt

SEQ ID NO: 6814573 - DNA, 106 bp, Homo sapiens
ctccaagcacagcagtgagatgctctttcctttctctttctttcccgactcttccactgaagtaggaattgaagtgtatctccatagcaagactctgaagcaggag

SEQ ID NO: 6814574 - DNA, 66 bp, Homo sapiens
agaagttaaagcatatggaaatatgatattgagatgcaaaatcaaaagacatgtgttttaactttt

SEQ ID NO: 6814575 - DNA, 65 bp, Homo sapiens
tgttatgccccaggaggtgccatccatagagaacacagtgtgagtggtggcccctggggtttgca

SEQ ID NO: 6814576 - DNA, 130 bp, Homo sapiens
tcccacagctcctcaacagcctgcctaagcccggtggcagctcgggcctccctctcccgggccctcaatcttgcctccccgggaagggcggcccagtgccccatcaggagcaggttggggaggtgacctg

SEQ ID NO: 6814577 - DNA, 60 bp, Homo sapiens
tgcttctggaaacagtggctgttaggaaggctgccaccctactgtgtttccagaaaagca

SEQ ID NO: 6814578 - DNA, 62 bp, Homo sapiens
gctgtggtctgtgagctccaaagtcagcaatctttgcagcagatgctttcatggacaatggc

SEQ ID NO: 6814579 - DNA, 58 bp, Homo sapiens
gaatagtgcttttgtacataggatttttaataagaattcctatgactgagtaatgttt

SEQ ID NO: 6814580 - DNA, 68 bp, Homo sapiens
gggtctgcagctgcaagattctcaaatcagaacattagctcctctccgagtctgcagctgcatgaccc

SEQ ID NO: 6814581 - DNA, 91 bp, Homo sapiens
ggagaaagatcatcagttatttttaagctataaaatcaaccatagaatttgtagactgaaggaacttagatgaacctcaagctttttcttc

SEQ ID NO: 6814582 - DNA, 88 bp, Homo sapiens
ggaggtttgagaagtaacaggcatgtgaatgacctatgagaatgggcatgaaatttgaaggtctttgcatcgcttgttatttaccacc

SEQ ID NO: 6814583 - DNA, 86 bp, Homo sapiens
gggaggctctcttctcattctctgccattgcggtggatggtaacactacttaagaggtagggaactttaaaagaaagagagttccc

SEQ ID NO: 6814584 - DNA, 55 bp, Homo sapiens
tgcatgtctttagcatttgttacctcccacgtgggtataatgttaagaacatgtg

SEQ ID NO: 6814585 - DNA, 70 bp, Homo sapiens
taaaagggaaacagccactcaaagggccgaagtgatcctacttggcgttagtattgctgaatcccattta

SEQ ID NO: 6814586 - DNA, 77 bp, Homo sapiens
ttggggctgctggaagcatgcgatgaaggatgtgtatgaacgtgctttataaactatgatgcatccagcaggtctaa

SEQ ID NO: 6814587 - DNA, 116 bp, Homo sapiens
gtggcttaaacaacagaaatttattgtctcagagttttagaggccagaagtctgaaatcgagatattgacagggttgcctctgagtgctccgaagagaaactctgttccaggctac

SEQ ID NO: 6814588 - DNA, 105 bp, Homo sapiens
ccggagacttactactacctcaaccaggtcgggggagcccttgtggtgcggcggggaggcctgcccagaggaggatctcggcccggaggtctgaggagtagccgg

SEQ ID NO: 6814589 - DNA, 67 bp, Homo sapiens
gagtatagtgcagggaaggccaatctgaaaccacagataaatcacagttctctgtattaagaaactc

SEQ ID NO: 6814590 - DNA, 77 bp, Homo sapiens
ggagcctctccacagctcaggctcagagtaggccctcagcttcagctctgaagggtgagctgttcgagagaggaccc

SEQ ID NO: 6814591 - DNA, 76 bp, Homo sapiens
gtggccttgagaatgtccctaggcagcttaagatgcaaatttactgctggtactttgggagccttctgtaggccac

SEQ ID NO: 6814592 - DNA, 58 bp, Homo sapiens
tgcaagggtgtttgagctgcccattaatctacaggaaagtttagaccaagcctttcca

SEQ ID NO: 6814593 - DNA, 97 bp, Homo sapiens
tgaggacaaaggggaagcagcaggcatggctgcattggaatgggttctggaagaatctatcttttgagtctgctttgcgtttctgccttgagcttca

SEQ ID NO: 6814594 - DNA, 84 bp, Homo sapiens
taccagaaggagagaaattgaggtagcaagcagtacacatttactattctgtttccctgcctgcctattttttaaaacttggta

SEQ ID NO: 6814595 - DNA, 55 bp, Homo sapiens
gcctgttccttagtggcttcaccgctgtattgtcagtccccacagggcaaggggc

SEQ ID NO: 6814596 - DNA, 72 bp, Homo sapiens
gttggtgcaaaagtaattgcaggttttgccattaaaagtaatggcaaagactgcaattacttttgcaccaac

SEQ ID NO: 6814597 - DNA, 55 bp, Homo sapiens
gctgtgtgtttatttgttagggcctaaaattatctttttgagtaaagcacatggt

SEQ ID NO: 6814598 - DNA, 85 bp, Homo sapiens
ttgtttctgtgtattctgctaagtgatttctacacatttccttttagtgaagtgggcttcccttaagccagagagctagaggcag

SEQ ID NO: 6814599 - DNA, 75 bp, Homo sapiens
tccggagccaggtctaggagtctgaaagtatctccaaggaactctcaggatttctcagaaaacaacagctccaga

SEQ ID NO: 6814600 - DNA, 73 bp, Homo sapiens
ggtggacaaggagatgtgcacatcggagagctttgggagctctttggaaggtgtgcactttctcccttctccc

SEQ ID NO: 6814601 - DNA, 84 bp, Homo sapiens
tgagctggctcattaattactaagcacaatgcaatgtgatatttgcagatcgtttgtgtgcttgttaatttattcagtcattca

SEQ ID NO: 6814602 - DNA, 66 bp, Homo sapiens
agaggtttaactggcttatggttctgcaagctatacaagcatgccactagcacctgttcaacttct

SEQ ID NO: 6814603 - DNA, 93 bp, Homo sapiens
gggcaaacacgtttattccatgtatatatactgaattcctactatgcaccttcaacaataaaggcttttggtatataggagtatactgagccc

SEQ ID NO: 6814604 - DNA, 76 bp, Homo sapiens
gggctggtggaggggaaagtgtgaggctgcgctctaagagatgcaggcgcctcggcccttcccgcctccgtcaccc

SEQ ID NO: 6814605 - DNA, 88 bp, Homo sapiens
ggtgatcgggttcccagacctgtctataaaagtgaatacactgtgggctggattcacttttatagataggtctgggaacccaatcacc

SEQ ID NO: 6814606 - DNA, 58 bp, Homo sapiens
gaaagaatcagaagtctcaaacagcctcttttgagtcctgtttgtacttgattttttt

SEQ ID NO: 6814607 - DNA, 68 bp, Homo sapiens
aggaagtagataactaaagaaagggattaaagtattaaatttagtttctttccttagtcattcatcct

SEQ ID NO: 6814608 - DNA, 81 bp, Homo sapiens
tgtgtatgaaagtgttttgtaaacagaaaagtatatacaagtgtaggacatttatttttgtttcaaaacatgtatcacaca

SEQ ID NO: 6814609 - DNA, 79 bp, Homo sapiens
ctccacctggtctctcccttgacctgtggggattatggggactatggggattacaattcaagatgagattcaggtgggg

SEQ ID NO: 6814610 - DNA, 63 bp, Homo sapiens
ggccttggctcctgcagggagttggagagaagaatgtgctcagtgctcaggggagccgaggct

SEQ ID NO: 6814611 - DNA, 64 bp, Homo sapiens
agaatacagtaggagcctgggcatctgttgactttttctgccttgctcactttcactgtatttt

SEQ ID NO: 6814612 - DNA, 90 bp, Homo sapiens
ggagacaagctgtatagattcgtctcctgcctggtttcaccttgaaaaaaggaaaccagataagggaggctgaaaataaatcctgttttc

SEQ ID NO: 6814613 - DNA, 74 bp, Homo sapiens
gcttgattaattgccaagctaaggctagtgaatgaaagttcaattagaattatgcttgctaatgaaatccaagt

SEQ ID NO: 6814614 - DNA, 91 bp, Homo sapiens
tgctcccagtgggtgccacctctgatgggcacagggtggcagagctggtgctgtgaccatgctgagctctcagatgctgcacccagaagca

SEQ ID NO: 6814615 - DNA, 69 bp, Homo sapiens
gcaatgtttccgtgagcatccttgagcatgtatacatgaatgcttgtgctattatttcatgggagaggc

SEQ ID NO: 6814616 - DNA, 56 bp, Homo sapiens
tccttgcatttaaaggcgtagggccccacagcagagggtaagccggaaagcgagga

SEQ ID NO: 6814617 - DNA, 82 bp, Homo sapiens
gcgcaggcctacaggtgaatggctctagaatacccctcaggcaggccacttcctgttctagaagctttctgaggcactttgc

SEQ ID NO: 6814618 - DNA, 79 bp, Homo sapiens
caaccttcccagggcaataggaaccagatctgtctcccaagctccagacaagtccatcctactgccttctggatggttg

SEQ ID NO: 6814619 - DNA, 70 bp, Homo sapiens
ggttgcccctctccttgcagatggctgcctaatcctccaggagccattttccaagggcgagatggcgagc

SEQ ID NO: 6814620 - DNA, 71 bp, Homo sapiens
ggaagcagcatgctctggtacacatgggaatgagttggaacacaggtgtgtctaggctcatgcttgcttct

SEQ ID NO: 6814621 - DNA, 68 bp, Homo sapiens
agttctaagtaaatattttatatagttcctcagtagtgttgaatgagaagatgttttgctttagaact

SEQ ID NO: 6814622 - DNA, 66 bp, Homo sapiens
aggaaataaggaagtcacaagaatcgctaggagcctattttaggtgattctaaggggctgcctcct

SEQ ID NO: 6814623 - DNA, 76 bp, Homo sapiens
ttaggtatcgatttgtataaaagctgagtgtgatttgtgattacacttgtaattatataacgcgaaatttacctaa

SEQ ID NO: 6814624 - DNA, 62 bp, Homo sapiens
ggaggctggcccggttcgaagctggctgctccagggcactaaagctggagaagggcccttcc

SEQ ID NO: 6814625 - DNA, 62 bp, Homo sapiens
tgaccttgcactgtagcctgggatctggcattttcttgccagccctggagatgtgggaggca

SEQ ID NO: 6814626 - DNA, 59 bp, Homo sapiens
cctgggcacaggggagcagagtcacttaagccaatggggactgggctgacttgtgctgg

SEQ ID NO: 6814627 - DNA, 83 bp, Homo sapiens
ttagctcattttcctcatcgataaaatgtgggataatgaggacacattctccacagcattattagaaggatcaaatggactaa

SEQ ID NO: 6814628 - DNA, 60 bp, Homo sapiens
ccaagttaaggctttgggaacttgccctaactggcccaatacctaaagtttgaaccctgg

SEQ ID NO: 6814629 - DNA, 67 bp, Homo sapiens
gatgttccttaaaaaaagattgatggtggatgccgggcttcgggtaccatttatcattttgaatatt

SEQ ID NO: 6814630 - DNA, 57 bp, Homo sapiens
agctctgagtagagttgagttatgcttagacttgtgtataaagctctgagtagagtt

SEQ ID NO: 6814631 - DNA, 84 bp, Homo sapiens
gaggccaaagatgctgctctaggctgctccgtgaattccaggacttctgagaagcaccttctggacagcgtctttactgccctc

SEQ ID NO: 6814632 - DNA, 117 bp, Homo sapiens
tcactaatacttatcatatggatttacaccaagactttcatttggtcagtccgatgtcacatgtaatgtttatattggtctgcttaagtggatttctggaccatattaagtatttga

SEQ ID NO: 6814633 - DNA, 65 bp, Homo sapiens
gctggacatggaaatcggcttgctccattggtggtggggcatagagaggttcatgtcagcccagc

SEQ ID NO: 6814634 - DNA, 59 bp, Homo sapiens
cttcagcttctcctaaatgtcccataaactgtgataatcattagggcagaagcaggaag

SEQ ID NO: 6814635 - DNA, 72 bp, Homo sapiens
ctccccagtccctctctgtgcctttcacagtgcaactgtagcctaatgaatctacaggagtgagtgggtggg

SEQ ID NO: 6814636 - DNA, 124 bp, Homo sapiens
gacccctgctgcagaaagggccacgacagattacagtgagcccctgaggacatctttgaggttggggcctctgagctcaggtctcaggaggtgtctgctggtggcctgatgggctgcgagggtc

SEQ ID NO: 6814637 - DNA, 55 bp, Homo sapiens
ggtgcccagagccaggaatgagccgcctgtggtgattcctgtgtgtctggagtcc

SEQ ID NO: 6814638 - DNA, 63 bp, Homo sapiens
aaattattataggcagagctgaatttaagtgttcagaagaatctttctctgtctctagaattt

SEQ ID NO: 6814639 - DNA, 63 bp, Homo sapiens
gattgaaagactgtttgggagatggtttttcactctctgtctctctccatatagtctttaatt

SEQ ID NO: 6814640 - DNA, 76 bp, Homo sapiens
ctctggaacacagacagggctgaactgagcttgtgagacttcaggtcttgaggaccggccagcccttgggccagag

SEQ ID NO: 6814641 - DNA, 86 bp, Homo sapiens
gggaaggctgtgacttcagctctgaactcgagggcgtcgttagaaccctgagtggccaggcagctgtgggaagttggggccttgcc

SEQ ID NO: 6814642 - DNA, 78 bp, Homo sapiens
gagagtcaaatagatacattccccaggagtaggatgaagggtagttatctcgggttgtaagtatctattaagattttc

SEQ ID NO: 6814643 - DNA, 58 bp, Homo sapiens
gccccatagaagctcagaccagaagtcccttgggagggcctgaccttactactggggt

SEQ ID NO: 6814644 - DNA, 78 bp, Homo sapiens
gggatagtgggttttcaggcatgtactttacctgttagtttagggagctgaaggcaaaacatgttacacctctgtctc

SEQ ID NO: 6814645 - DNA, 62 bp, Homo sapiens
ttgttcttggcttggaactaagtgggagcattctttattctactttgtcatgctaagagtga

SEQ ID NO: 6814646 - DNA, 91 bp, Homo sapiens
gggtgtgaaagtaaagataacttattgactgatcagagagggaactcattttcttccacgtatttgtcatattttgtcatattttaacccc

SEQ ID NO: 6814647 - DNA, 63 bp, Homo sapiens
ttgaaactccctctccatcagattctgtgtgcccaaagaactgtccttggaggagagtttcaa

SEQ ID NO: 6814648 - DNA, 88 bp, Homo sapiens
atttctgccttgaaattttgctacagttggtggaaaaaatgcactcaaacccatatttccatgctgttgttagagagggggcaggaat

SEQ ID NO: 6814649 - DNA, 83 bp, Homo sapiens
gtgagatgggagttgagacattttgccccagatacattaatttagtcataacaagtaacagggcacagtccagccccatccac

SEQ ID NO: 6814650 - DNA, 70 bp, Homo sapiens
gtgtcatgttaacagaggacacatcaaactctctccatgatagtattgacctctttgtgagcaatggcat

SEQ ID NO: 6814651 - DNA, 58 bp, Homo sapiens
cttgggacagttggacatcttagctgctccccagcccctgcaatgtccatgttccagg

SEQ ID NO: 6814652 - DNA, 69 bp, Homo sapiens
tggaagagtgtcactgaatttatgcatgttctaaagacaggattttcatatgaaagtagacactttcca

SEQ ID NO: 6814653 - DNA, 61 bp, Homo sapiens
ctggtcatgcagaggcctcaccagtcattttattgctattcccaggcctctgtgtgcccag

SEQ ID NO: 6814654 - DNA, 62 bp, Homo sapiens
cctggcatctgagcctggcctgaacaattcagaaacctcatttcatcagtcttggagtcagg

SEQ ID NO: 6814655 - DNA, 71 bp, Homo sapiens
ttcctggttgtcctgatgtagtgaccctcccctgcctctccccgggaagaaggtgctacacagggcaggaa

SEQ ID NO: 6814656 - DNA, 59 bp, Homo sapiens
aaattgtgcatccttggcatatcactttaaaggtgcgatcattcattgatgcacaattt

SEQ ID NO: 6814657 - DNA, 71 bp, Homo sapiens
cataaagaggtgcagtttgcttgtattttgaactctcgtgtctagtgcagcaacaaactgccctccttgtg

SEQ ID NO: 6814658 - DNA, 77 bp, Homo sapiens
cagcgactagttagacaggaggcagcagcttctcaagaaattccttcacagctgccatctcctgaggacaggagctg

SEQ ID NO: 6814659 - DNA, 57 bp, Homo sapiens
agagactggcttctaaaatggcaagaaatccatttagtcataaaagaaacagtttct

SEQ ID NO: 6814660 - DNA, 116 bp, Homo sapiens
cttctggaaatggatgtgatgtgtatttcttgagactcgtcttccacaggctttgaactttgcagctggtgcagacaggggcttaggaaaggacaagtctgtgtccctgtcagagg

SEQ ID NO: 6814661 - DNA, 89 bp, Homo sapiens
gctccataaaactactaggtggaattcattggacttttcctaaagggtaggcaccaggagaatcacgttagaagtcctatttgtgtggc

SEQ ID NO: 6814662 - DNA, 81 bp, Homo sapiens
ggtcaggagcagccttggagagcgccgctgatgtcctcttcccccggatccctgcctccatccccgggcgggctcttcacc

SEQ ID NO: 6814663 - DNA, 76 bp, Homo sapiens
ctgtgggaggggtatgatagggaggtgaaattcttactgaatttcagcaagactctattggtcattcttccttcag

SEQ ID NO: 6814664 - DNA, 56 bp, Homo sapiens
tagtgtttgaaaggtgtgtcagtgagtcggccatgtctccatgtgtttcagacctg

SEQ ID NO: 6814665 - DNA, 61 bp, Homo sapiens
gagactttttaatcactaggaatgctttcacatttgcattttcggtttaagaaaaagtttc

SEQ ID NO: 6814666 - DNA, 95 bp, Homo sapiens
atgccacacggtcaggccactcaacccttatggtgtggcacggataagcatatgctgcaccccctaaataaattgactggcttgtccctgggtat

SEQ ID NO: 6814667 - DNA, 64 bp, Homo sapiens
gtgtgcagtgagcaaaagatcttaaatttgatttcaagttgcatatctcagcatgctgacacac

SEQ ID NO: 6814668 - DNA, 81 bp, Homo sapiens
ggggccccgggtggtgggagtgatcagaagaacctgccgaagagcacaccccctctggtctgatggtcccaccaccgcccc

SEQ ID NO: 6814669 - DNA, 58 bp, Homo sapiens
gcccaggaggtcgaagctgcagtgagctgagattttgccactgcactccagcctgggc

SEQ ID NO: 6814670 - DNA, 73 bp, Homo sapiens
ggctaacgtgtactcgggcgattcagagcaaggtattatttaccctgctgacgtcaatgagaacatattatcc

SEQ ID NO: 6814671 - DNA, 77 bp, Homo sapiens
ggcctcccctgcaggcatgtgatgtttggctccagaggccttctcctctgggcttttccatgcctgtgaactgggcc

SEQ ID NO: 6814672 - DNA, 59 bp, Homo sapiens
tttggtctctgtgcatcctcctagcacaccttaatggcacatgatgtatggaggctaaa

SEQ ID NO: 6814673 - DNA, 57 bp, Homo sapiens
ctaccccttcctagctatagtcagtaaatggagcccctaagcaaggagcaggggtag

SEQ ID NO: 6814674 - DNA, 75 bp, Homo sapiens
cattgtggtttcttttgtgaggtacaagcacaaagcataatgtgtcccaacccctcagagaggcagagccacatg

SEQ ID NO: 6814675 - DNA, 89 bp, Homo sapiens
ggagttttgctcttgttgcccaggctggagtgcaatggcacaatcttggctcaccgcaacctctgcctcccaggttcaagcgattctcc

SEQ ID NO: 6814676 - DNA, 68 bp, Homo sapiens
tcaggctaatacagaagtgtattaaaatggccggatgccaatttagttcatcttttgtgaaatcctga

SEQ ID NO: 6814677 - DNA, 78 bp, Homo sapiens
cagcagtttgaattctcctttgtaattctcatccaggcaagtcactcttttttcctggtataaatgatcagatcgctg

SEQ ID NO: 6814678 - DNA, 111 bp, Homo sapiens
gtttcagtttaggactgaccagcttttttctgtaggcttacgcggcttctgtgtctccaaactactcttagagctgtttgtctagagagtgactggcaggattactgagat

SEQ ID NO: 6814679 - DNA, 66 bp, Homo sapiens
tgagctgcattctctttatcattaatgcctgcatttaaaggcccatggtaaagacaaatgaaatca

SEQ ID NO: 6814680 - DNA, 82 bp, Homo sapiens
gctacctgaacttcccatgtacagactggctctctagattagctcagtgcaacgttgtgcattcaaggtgaatgttcagagc

SEQ ID NO: 6814681 - DNA, 78 bp, Homo sapiens
ctttgaggtagccacagatagagacttacatgttcatggctagttactgaatttgtatggaactacttttactcaaag

SEQ ID NO: 6814682 - DNA, 74 bp, Homo sapiens
tgtgaccaaactgttctctgtgggattctgatttaattcatggcatatctgaaagagaaaagttattaatcaca

SEQ ID NO: 6814683 - DNA, 113 bp, Homo sapiens
cagtatgagggcaaggctcagtgtctcattcattatgtatccttatgacttagctcagagcctggcacatcagaggtacttaatgaatggatatgcaacccaagcctttgctg

SEQ ID NO: 6814684 - DNA, 63 bp, Homo sapiens
tgcatatcagaattcaagagtgagatttgggcttgaaaatcacctatttgagattgatatgca

SEQ ID NO: 6814685 - DNA, 99 bp, Homo sapiens
gaacaaatgttgtggattctttttcaattgccattgctgtcttggttaaaacaaaagtgtgtaatgtgttttgaaaaacagtatttaaagtattttctc

SEQ ID NO: 6814686 - DNA, 76 bp, Homo sapiens
tggtctgggtgcggtgcatttctgtggcatggagagcctgggctcagtccctgggggagtcaccagcatccaacta

SEQ ID NO: 6814687 - DNA, 77 bp, Homo sapiens
ccccaaactttggacggcggggcggggcccgagcccaggccatccgcggcgctgtccccgcgagtccagagctgggg

SEQ ID NO: 6814688 - DNA, 106 bp, Homo sapiens
ggctagggaggagggcaggctccccagctggggcaacgcaccagctccttgaagctgttctgtggctcggccagctgctgaagcctctcctcctgctctggaagcc

SEQ ID NO: 6814689 - DNA, 80 bp, Homo sapiens
gcccagtaagaagggcctgtgctgtgccaagctcccaggcttgggatcatgagcacatgccagcccttctctttttgggt

SEQ ID NO: 6814690 - DNA, 91 bp, Homo sapiens
gggtagggggtggctgagaacaggaccccaaacacttctgcttccactacttcccctgtaaatgagggggtcctttctctccttcctgccc

SEQ ID NO: 6814691 - DNA, 56 bp, Homo sapiens
gctgaggccagtttaatgaggactcattgactttcttcattgggcctgcctgcagc

SEQ ID NO: 6814692 - DNA, 56 bp, Homo sapiens
gaagtctgagtgggggccaggctctcgggggcctgggtcatctccactcaggcatc

SEQ ID NO: 6814693 - DNA, 87 bp, Homo sapiens
gctgccttctccagggtgtgcaggggatcaggttgcagcaccagcagagcaggaactgggctgcctgcccccacaccctcaggcagc

SEQ ID NO: 6814694 - DNA, 86 bp, Homo sapiens
tagtctttccattgctgactatacatttagcatttgttgaaagtaacaacaaatctagagaactgtggggcagcctggagagactg

SEQ ID NO: 6814695 - DNA, 74 bp, Homo sapiens
actcttccaaggttatcagctgtggttctgtgataatatttacaagccttgaagctgtaatctattggtcatgt

SEQ ID NO: 6814696 - DNA, 57 bp, Homo sapiens
cattattaattcagcacatgcttatagggtgcctgctatgtgccagaaatagtagtg

SEQ ID NO: 6814697 - DNA, 122 bp, Homo sapiens
cttcctgtaacagacctagagaaccagcctcattacagccaggaagcatataatgaacttgtgctgcatatatggtcctgagtgaggcatagtgggagccctcaggtcaatcagacacagag

SEQ ID NO: 6814698 - DNA, 73 bp, Homo sapiens
atgccttctgtcccagatgtctggaactccctggacacgtagggatttctgtgtgtctggccacagaagtcat

SEQ ID NO: 6814699 - DNA, 59 bp, Homo sapiens
aggcctcggcccactgctgcggtggccccaaaacaccgcgtggcctgtggctgaggcct

SEQ ID NO: 6814700 - DNA, 64 bp, Homo sapiens
ttcttttcctcatctgtaaaatgggggaaacaataatattaatccatgagtttgaggaaaagag

SEQ ID NO: 6814701 - DNA, 75 bp, Homo sapiens
agctccagacagcttttttttggctaatagagtaggggtgcaattccatatttcaccagtaggaggctgtcagct

SEQ ID NO: 6814702 - DNA, 126 bp, Homo sapiens
tcagtgcatcattagttaaatgaacaaattagttaaaactctgtatttgctgtgggtttcaaaaattacctggacagtaattagagttacaaagagttctaaaacaaaagttgatgagaataatga

SEQ ID NO: 6814703 - DNA, 56 bp, Homo sapiens
tagaagtttcaaaagacttcattttatcatgatgggttctattttgcaaacttctg

SEQ ID NO: 6814704 - DNA, 61 bp, Homo sapiens
catggtcaccaggccagcctggggcacgccagcagctccgatgctggcagatgtggccgtg

SEQ ID NO: 6814705 - DNA, 74 bp, Homo sapiens
gttgaaattctcatttatggaattagtttaggatgtgaatttatgcattcagaattggaacgtgaagattcagc

SEQ ID NO: 6814706 - DNA, 124 bp, Homo sapiens
aaccgaccttattactacactattgccttcccgtggtgtttttggggcagaggaggtgaatcagatacatatccacctgcagacaaggacaaagagggagcatagaaatatgaaaagtttggtt

SEQ ID NO: 6814707 - DNA, 83 bp, Homo sapiens
catgtatattaggaaaggaagatgaggtgctgcttagtgtaccttgtgactaagtatatctcttctcctaattctaacacatg

SEQ ID NO: 6814708 - DNA, 55 bp, Homo sapiens
ttcttcaaaatccagcatgattcaagatactgatggattttgggtatttgaagag

SEQ ID NO: 6814709 - DNA, 78 bp, Homo sapiens
acagctcttagcaatgtatgattaaaataggtttaagcttgatatcttagtatatgcatagcataggaaaaatgctgt

SEQ ID NO: 6814710 - DNA, 67 bp, Homo sapiens
tgatctgttatacaacaagtaacagggccttgtcagtgcattgttttcttgtatatagcctcggtca

SEQ ID NO: 6814711 - DNA, 61 bp, Homo sapiens
gtttgagaaccattgaagggagaggcttttattcttttacttctccctgcccatctcagat

SEQ ID NO: 6814712 - DNA, 108 bp, Homo sapiens
ggcggtacttgaggggttagccacgggtgccagaaattctccaggctggcgggcaggggggtccttgctgttgtgggagactggggcctgtgtgcccccaggaccacc

SEQ ID NO: 6814713 - DNA, 66 bp, Homo sapiens
tgaaaggtaaaggagtaaatcagtcctctcacttttaagctgcctcctattaaaatttacctttca

SEQ ID NO: 6814714 - DNA, 84 bp, Homo sapiens
tatgaaatatgcagagaaagtgtagacaggctcccagctggttttgctattctacattctctcttctttagcatacttttcatg

SEQ ID NO: 6814715 - DNA, 59 bp, Homo sapiens
ggataagatgttgtccaaatccacattgacagtaagttttggacatgagtctttaatct

SEQ ID NO: 6814716 - DNA, 82 bp, Homo sapiens
ggagcaagggcagcccttctgggagggcatgctgctgttcataatatgagagtggggtcctgtcaagggttgttgtttttcc

SEQ ID NO: 6814717 - DNA, 73 bp, Homo sapiens
ttaagctcttgccctagtgcctggtgcacagttaagtgttcaagtgtcagctggttcatagtcaagagattga

SEQ ID NO: 6814718 - DNA, 57 bp, Homo sapiens
tcaaacaccatctgaccttatgtcaatcatctgcttcattaggtttatggtatttga

SEQ ID NO: 6814719 - DNA, 92 bp, Homo sapiens
gactttagacctcatggtttatttggcattctgtgatcttaaaaatagattatttttcacttcaggatagaaaggccatggagttaggagtc

SEQ ID NO: 6814720 - DNA, 62 bp, Homo sapiens
tcgaaagatgagcaagctgtccagctttgttctcagagccagtcttacgctcgtttttccga

SEQ ID NO: 6814721 - DNA, 63 bp, Homo sapiens
gtctctaaggacaaaattcaattcgctaaatactagcaagcagaattctgtcctctagaagat

SEQ ID NO: 6814722 - DNA, 80 bp, Homo sapiens
gggattcggatttggtgattgaccctggctgtgttgcctactgcttactgctgagagcaatcccaaaccccgcaggtccc

SEQ ID NO: 6814723 - DNA, 92 bp, Homo sapiens
aagacagggtggaacaggcaatactttggggtttctttgtcatgaatttttttccaaagtataagattctgtctgtagtactaccttaactt

SEQ ID NO: 6814724 - DNA, 63 bp, Homo sapiens
tttaggtgtgtttggattgagaaggagagcatcaactctgtcattatcagtgacgcccctgaa

SEQ ID NO: 6814725 - DNA, 62 bp, Homo sapiens
aggaagccacgagtggcacgggtctgctgtttttgaaggagacggtgcagtcctggtttcct

SEQ ID NO: 6814726 - DNA, 61 bp, Homo sapiens
gcctctgaattgagataggatcagtctcaaattcttgagataaattcattaattcaccggc

SEQ ID NO: 6814727 - DNA, 83 bp, Homo sapiens
ggctcatggttgtcatcccaagactttggaaggctgaggcaggaggattgcttcagcacagaagtttgagaacagcctgggct

SEQ ID NO: 6814728 - DNA, 95 bp, Homo sapiens
aaagtaggatgtattcagggctagtcagaggaagtttcaccagtgactacttagttaactcctgctgaccagtaaatgaatgagggtcctatttt

SEQ ID NO: 6814729 - DNA, 56 bp, Homo sapiens
aactgatttcaagttcagtttctcacaaaacagagattgaaagtcaacaatcagtt

SEQ ID NO: 6814730 - DNA, 86 bp, Homo sapiens
agggggtagagacaaagtcagctctctgaggggtctgggaccaccctttgctcctgtcccaagcagggctggccatgactcccctt

SEQ ID NO: 6814731 - DNA, 62 bp, Homo sapiens
ttccaaagcatttgaattttggaaatgtaacatatatgtttccatgcagtagagcttaggga

SEQ ID NO: 6814732 - DNA, 67 bp, Homo sapiens
cagtatttggtaattggctacctcaaccattgacatttactgagtgtctgccacatgccaagtattg

SEQ ID NO: 6814733 - DNA, 55 bp, Homo sapiens
cttttgtccttccttggtagtcaccagacagaatgcttcagaggaaaggcaaaag

SEQ ID NO: 6814734 - DNA, 63 bp, Homo sapiens
ggcagagagtaaggcaggctcactcggggtgttgacccaggtgagccctacctgctcatctcc

SEQ ID NO: 6814735 - DNA, 119 bp, Homo sapiens
ggacagtttagactttgcctggtaggaaggtggtgggagagacagtggcccctcatgatccctttgggctgcagtttcttggatgccaatttctcatgtctggcctggttccactgtcc

SEQ ID NO: 6814736 - DNA, 62 bp, Homo sapiens
ccatcccccatctggtagggcatagtgttaagctgcctgcctggagacagatggaggagtgg

SEQ ID NO: 6814737 - DNA, 57 bp, Homo sapiens
ttactcctgtagtatgaggcaggtattacattttctgctttatagacaaggaagtag

SEQ ID NO: 6814738 - DNA, 65 bp, Homo sapiens
tgtgtcctaccatgaattcactccatgctagccacattggcctgtatggctattccttggacaca

SEQ ID NO: 6814739 - DNA, 91 bp, Homo sapiens
cgcggagcctcatgggggttggagtccccaaggtttcctttgtgcgcagtattggcggggccttggactaccactcccacaaggcaccgcg

SEQ ID NO: 6814740 - DNA, 58 bp, Homo sapiens
gttagttgtatggcaccaacagcctgctggcaaacagtatgtgcaaatacttgctgac

SEQ ID NO: 6814741 - DNA, 89 bp, Homo sapiens
ttggttttagttttttgttgggtagaacggaaaacacagggcaagatcctaaagccccacagttcctcatccaggaaagcgaaaaccaa

SEQ ID NO: 6814742 - DNA, 70 bp, Homo sapiens
gtagtgtggggatcgtgtaagtataagtaccaatcacatgtgtacatgtctacatgcatttttgcattac

SEQ ID NO: 6814743 - DNA, 84 bp, Homo sapiens
ccacactgggcaatatgcactgtaatttttaacaaataataggaaactgttaatgtgttcacaggaaatacagttttgtcttgg

SEQ ID NO: 6814744 - DNA, 85 bp, Homo sapiens
attttttccatcagacatttttatatttgtgctgagataatgcttcaaatgtttcaacacaacagagaaatgctgtggaaaaaat

SEQ ID NO: 6814745 - DNA, 75 bp, Homo sapiens
agatcagtcccaagatctgccattgtatgagcaaagcttcttctgcttctgagttgcaggacttgggaatggtct

SEQ ID NO: 6814746 - DNA, 57 bp, Homo sapiens
agtgagatttgggttgtttaacatgtggtttaaaaccatagtctcccagtccttatt

SEQ ID NO: 6814747 - DNA, 56 bp, Homo sapiens
agaactgtgtcacatggccactcctagctgcaagggaggccaggaaatgtagttct

SEQ ID NO: 6814748 - DNA, 62 bp, Homo sapiens
gctaatttttaaaaatgtgttggcatagtcttaaactatccaaggagtttttgaaatatagc

SEQ ID NO: 6814749 - DNA, 63 bp, Homo sapiens
agattggtttcccacatagctgtatgacattcacttccatccgcaatgtgagagaaccagttt

SEQ ID NO: 6814750 - DNA, 64 bp, Homo sapiens
gttgtgaatagtgccgcaataaacatatgtgtgcatgtgtctttatagtagcacaatttataat

SEQ ID NO: 6814751 - DNA, 76 bp, Homo sapiens
ccggaaatggctccagcttggcttcacctcccagcgaccaatagggagggagtggagtggggatgcacattgatgg

SEQ ID NO: 6814752 - DNA, 59 bp, Homo sapiens
gcagtaagtccactatatccttctctgtcacatccttagagatgggcgggggcttctgc

SEQ ID NO: 6814753 - DNA, 85 bp, Homo sapiens
gagggacaggcggtatttatacaccaactcctatgagttattacttgggggttgttggaggtgagtgttaatcccctggcacctc

SEQ ID NO: 6814754 - DNA, 61 bp, Homo sapiens
gtattttcatgatttcagaccactgggtcactgtggtgattattggagtgatggcaggtac

SEQ ID NO: 6814755 - DNA, 73 bp, Homo sapiens
gattacagtaaacataatttacctgtaggggaaatatctgctatactggtgtaattgcttgtttgtcgtattc

SEQ ID NO: 6814756 - DNA, 74 bp, Homo sapiens
ctggactctcctctgcgttctgaagcaccagtgccatccaggcagcttcctcacctcagaggtctggattccag

SEQ ID NO: 6814757 - DNA, 81 bp, Homo sapiens
tatttggaaaatgtgctcatttataaaagttacagtgtctttttaaagtttgctgaagtaaatgaagcatatcgtcaagta

SEQ ID NO: 6814758 - DNA, 62 bp, Homo sapiens
gtcacgtggtggagcccgtctccatctccacagtgcagggaggagatgggtatcgcctgggc

SEQ ID NO: 6814759 - DNA, 67 bp, Homo sapiens
tctctgtaggttttaaggagagttaaaatggaaattaacattacacttatctagagccatggagaga

SEQ ID NO: 6814760 - DNA, 69 bp, Homo sapiens
gggggaagaaagggaggataagaatgggtcttctgatttgtcatttggagccttcctgttttatagccc

SEQ ID NO: 6814761 - DNA, 61 bp, Homo sapiens
ttctcttttgttttgaactagctcagaatggaaatatctgatttgttctaggcactgagga

SEQ ID NO: 6814762 - DNA, 73 bp, Homo sapiens
ggaattattgctatcttcatggaaatacagggatcataggtcgcttgtactgaaatgaaggtgcttctatttc

SEQ ID NO: 6814763 - DNA, 63 bp, Homo sapiens
ccagtgttccagagagctgatgtggaccacaggggaagcctctgccttctggaacatccctgg

SEQ ID NO: 6814764 - DNA, 57 bp, Homo sapiens
cctctgcttgcagaatctctcagcagccggacttttgcagaagctgcaggtcagtgg

SEQ ID NO: 6814765 - DNA, 65 bp, Homo sapiens
cactggactgaccacccttcccccttgtgcagttgcgcccaaaggggtggtcagtacccgcagtg

SEQ ID NO: 6814766 - DNA, 63 bp, Homo sapiens
tcatctggggatcataaattgatggagtggcttattctgacttcattaggagttcccaggaga

SEQ ID NO: 6814767 - DNA, 79 bp, Homo sapiens
ttggtcagacaaaggagaatgttccatgaagcccttgttcccgggacccaccttgagcaatcttcaatttgtcagccaa

SEQ ID NO: 6814768 - DNA, 61 bp, Homo sapiens
ggcagtggtggtggggagcgtcatctaggtttctctccagatgagccaacacctccatgcc

SEQ ID NO: 6814769 - DNA, 65 bp, Homo sapiens
tcctctgtggggccaggtggcttgctcagggggaatctgagggagttcctgagcccacctgagga

SEQ ID NO: 6814770 - DNA, 61 bp, Homo sapiens
ggagcagatgagcctcatgactgggccgaggggcccgcatgctctagctcactctggatcc

SEQ ID NO: 6814771 - DNA, 96 bp, Homo sapiens
ggggactcgcgtcaggactgcgattcctttcgcctgccgagctgtagcggcagtgtctgcgggcagaggagcggcggccgtggcagcagcatcccc

SEQ ID NO: 6814772 - DNA, 79 bp, Homo sapiens
tattaggctagtgcaaaagtaattgcgggttttgccattattggcaaattgctgcaattacttatgcaccaaactatta

SEQ ID NO: 6814773 - DNA, 111 bp, Homo sapiens
cagtgtacaggatttcacacgactttcaccagcagctcactagtcacatggaggcagctagcaaacatgggcactgacagtgagcgttagtgaatgaacgcactgcacctg

SEQ ID NO: 6814774 - DNA, 81 bp, Homo sapiens
gagggattgaacctgtttccaggctcattactacgcatattaaggactgaaagaatgaccgaggaaatctttcaattgctt

SEQ ID NO: 6814775 - DNA, 79 bp, Homo sapiens
tggtattatgaggtgtgttcattgcctgcttaataacacattattaggcagggcatggtggctcactcctgtaatccca

SEQ ID NO: 6814776 - DNA, 65 bp, Homo sapiens
gccacacagagccagggaatacagtgaaaagaggtcctggagctgacttcttgggtctgtttggt

SEQ ID NO: 6814777 - DNA, 68 bp, Homo sapiens
ctcacccatttacttgtcttctcccttcttgagctaaaaatctgggtgtgagatatggagggggtggg

SEQ ID NO: 6814778 - DNA, 74 bp, Homo sapiens
gtgtgtgtgtgtgtgtgtgcacgtgcatgtgtgtgtgcacatgtgtgtatgtctgtatgcacacatattttcac

SEQ ID NO: 6814779 - DNA, 77 bp, Homo sapiens
gggagcctagaacacaagatgtgaagctagcatattcatgaaactgtagtgcagcaagtctagtttgtaggctactt

SEQ ID NO: 6814780 - DNA, 62 bp, Homo sapiens
agggattaggtttggcacctgggagcacaagtcctcactcccagatcaatttacttgtccct

SEQ ID NO: 6814781 - DNA, 88 bp, Homo sapiens
agttgctgtgttattacttcagatctttgttaatagatgctcatgcaatcgagtgtatgcatctttgataaatagttgcaaagcctct

SEQ ID NO: 6814782 - DNA, 76 bp, Homo sapiens
aggactctccctgtgttgttttatgttcactactaattcttcaagcaggaactgatgagcagccagggagattcct

SEQ ID NO: 6814783 - DNA, 128 bp, Homo sapiens
ctttcccccggcatctgtctggggactggctctgtgaacagacgactggatggaaggatatggtgcctctccactcagtgtctggtccagggctctgggcccagagggttgaggtggggatggagcag

SEQ ID NO: 6814784 - DNA, 67 bp, Homo sapiens
ggtctcacctccattttgtttcaggctggtaatcaagcaattagcccacaaaatggaggtcctggct

SEQ ID NO: 6814785 - DNA, 55 bp, Homo sapiens
acaccttcattcaaatgggcttgcagattggcttagcctgtgagaggacaggtgt

SEQ ID NO: 6814786 - DNA, 124 bp, Homo sapiens
caatctttcaactagacagcagctgtctctttacgtacgggcatggctgacatagaggactgaattgtctcctgtcagaagcatcctgaggaagggtcagctctcaggtcaagaggagggattg

SEQ ID NO: 6814787 - DNA, 129 bp, Homo sapiens
tttcctcagcaaagggcggagggagtggacgtgggggaagggcaggtgggcatttctggagcaatactgccatcaagaggaactggcttggcaatcccgcgcacccttcgctgtgctcgcctggggagg

SEQ ID NO: 6814788 - DNA, 130 bp, Homo sapiens
gggagcagacagtcagcatccccctctgtgatttcaggccctggtttgattagtagccataaaattttttacgtgtggcactttgagcaaaggtgcaggaaattgtggtcaggaagcctggctgcctctc

SEQ ID NO: 6814789 - DNA, 71 bp, Homo sapiens
tgcatcccgagccctccatggagccaggcatctgtttaaatgtcatgcaagggagggcttgaagggaagca

SEQ ID NO: 6814790 - DNA, 68 bp, Homo sapiens
gtgctgtcatctgatgttcctggtctaacacctaggcagtaggtggaggcaggggatacaggtcacac

SEQ ID NO: 6814791 - DNA, 113 bp, Homo sapiens
tgtggctttcctctttctttctcttcattgaatgttcttgcaaatcattaccaaattgaaaagatttacaagtcattggatgaggaattgatctagaagatattcaaggtaca

SEQ ID NO: 6814792 - DNA, 60 bp, Homo sapiens
ataatattgagtcaggacctgaaagaccttccacctcttcaggtcctgactcaatattat

SEQ ID NO: 6814793 - DNA, 81 bp, Homo sapiens
tttggggacactgatattcttgaaatcatggtttaattttgctcttttaccttgaacacaagaattattgcttgccttaaa

SEQ ID NO: 6814794 - DNA, 57 bp, Homo sapiens
cctttcaggcagaatgtagactgagcgctcctgctactgctgcctgttgctgagagg

SEQ ID NO: 6814795 - DNA, 64 bp, Homo sapiens
gcgaagaggttttagggaagagttagtaaccatacagaggctttgccctggaaaccaatgttgt

SEQ ID NO: 6814796 - DNA, 55 bp, Homo sapiens
tttcatctgagtagcgtcggatgatcatgttatagagatgctcattcaggtggaa

SEQ ID NO: 6814797 - DNA, 76 bp, Homo sapiens
agttccagctgacatgtcctccctctgatgtttctgcagtgttacctctttgaggatggaggtgtgagctatgact

SEQ ID NO: 6814798 - DNA, 128 bp, Homo sapiens
tctttcagaatgctaataccgatactttaatgagaatgaggatttttagatcacttttcttgcaacagaaaagagaacatctgaggatctgaggtcttaaagcaacgaacataaagcaaagtggaggg

SEQ ID NO: 6814799 - DNA, 76 bp, Homo sapiens
acgcgctgagcccctcacgcgccctcctgggccctggcggacccagaggccccattggctgtgcgtctcaaggtgt

SEQ ID NO: 6814800 - DNA, 56 bp, Homo sapiens
agatgctcttgccaaagaagtcatttatgggtatccatgttctgtaatgagcattt

SEQ ID NO: 6814801 - DNA, 69 bp, Homo sapiens
ggagacgatttcaggtttggacataaagaatttgtaattatgttgagatgtccagcctgctgtttctct

SEQ ID NO: 6814802 - DNA, 55 bp, Homo sapiens
tgttttcagtcatatagcaggtgaggcacccagatcagcttgcgggctgaaaata

SEQ ID NO: 6814803 - DNA, 126 bp, Homo sapiens
ttattaaaaagaaccacctttattgggggaatttggagtggtatttgaatcaaatatttccatgtattgtattcattgcttacccaattgaaaagtttagtttctccatgattttctttcaaataa

SEQ ID NO: 6814804 - DNA, 71 bp, Homo sapiens
tgtggggagttggaagttgacagggccaagtcagaaaactacgatcccttgttaactttcctgcccctaca

SEQ ID NO: 6814805 - DNA, 78 bp, Homo sapiens
gtctctaaaacatgttgacttccattaaaataacaccaaaggatgtattgcttggggtacaaggtatttattagggat

SEQ ID NO: 6814806 - DNA, 91 bp, Homo sapiens
gaagggaattgcataaatgttctttcagatttgtaagctagatcaatttgcttagatatttttagataggagcactttataaatatctttc

SEQ ID NO: 6814807 - DNA, 56 bp, Homo sapiens
gagttgggccgcactaggctggacagcggtcaagggctctggggttggcccatctc

SEQ ID NO: 6814808 - DNA, 72 bp, Homo sapiens
gttcacttagctgttggctgtacgtccttaaaaatgacagaaaggtgaccacagctacaagggcaaggaagc

SEQ ID NO: 6814809 - DNA, 110 bp, Homo sapiens
ttctgggggcagggggctgtggtttagctttgaaggatatggttcatggtggaatttaattatgtccttagagactaagagccaagcaaaaccctgtagagttaccagaa

SEQ ID NO: 6814810 - DNA, 81 bp, Homo sapiens
ctgtcatttaaattccaggtgcaggtcttctgaacaaatgcctcctgaggatttctgtgcctggaaaatatctgttaacag

SEQ ID NO: 6814811 - DNA, 76 bp, Homo sapiens
tcccctggtgttggagtctagccaaccttggagtgtgcataggcctccagctagggctggcttacttagcagggga

SEQ ID NO: 6814812 - DNA, 85 bp, Homo sapiens
ggcaggtcctgtgtccatcttttcagattctgtatcccagcacttaggacatagacaaacacgaagatgacaatcaatatttgcc

SEQ ID NO: 6814813 - DNA, 58 bp, Homo sapiens
tatttttactgtttgatgattccctgcttaggagggtttcagtgggaaagtgagagtg

SEQ ID NO: 6814814 - DNA, 77 bp, Homo sapiens
ggattgccgatgcctgggcaccactcaaaccaattaaatcattcttactggaggtggggccctggcactggtatttt

SEQ ID NO: 6814815 - DNA, 61 bp, Homo sapiens
tcaaaggtggtttttgagcaatgcagtgatgtgggcaaagcattgtttcaagattaactgg

SEQ ID NO: 6814816 - DNA, 71 bp, Homo sapiens
ttagggcgcagtgaattggatgatgcctgaccacattggtgaaggcagattttctttactcagtgtactga

SEQ ID NO: 6814817 - DNA, 71 bp, Homo sapiens
ttttcactcaatcaggtattctcatgtagatagcaaaaatggaaaaactgaagatatctgtgggatggaga

SEQ ID NO: 6814818 - DNA, 125 bp, Homo sapiens
gggaattcaatccattttggctgctttaatggagctcctggggcttagacactattgaaaggcaattactgactttcagttgttttagctctgtgagttcattgctagccccctcccttattccc

SEQ ID NO: 6814819 - DNA, 81 bp, Homo sapiens
tgtgtgatgcgtaggttctctggcctaacaatccatggtccttttcactttggttaaaggacagagccctagtttcataca

SEQ ID NO: 6814820 - DNA, 71 bp, Homo sapiens
atggctgatttcatgctatcaatgttgtatcactgaatgcagagttgagcagaagtacaggaacataccat

SEQ ID NO: 6814821 - DNA, 61 bp, Homo sapiens
tacaagataagaattggcaaggaccattgggtatgaccttcccatcctcttattttctgta

SEQ ID NO: 6814822 - DNA, 83 bp, Homo sapiens
tcttgtatgcctgcaatatcagattcaacacattggtcttgataaagaattatgtttatttatttgtgttgtatgggccaaga

SEQ ID NO: 6814823 - DNA, 68 bp, Homo sapiens
gctgcctgctcacccggcctggcagactctgcatctgctccacttcacaggccggggaggctggcagc

SEQ ID NO: 6814824 - DNA, 95 bp, Homo sapiens
acccagtgatataggaagcccagaatgattcagcgacagttcagcttcaggggaactgtgactgtgtcttctgggcaagtgttctttccttgggt

SEQ ID NO: 6814825 - DNA, 82 bp, Homo sapiens
ccttatttaaatgttatgttaatgttataaattcttggttttatatatgaaacctggacttgtaatgataactgacttgggg

SEQ ID NO: 6814826 - DNA, 66 bp, Homo sapiens
gcccatgcgccctggagcagatggactgtgggtacacgagcctctgaactcttgggcagcatgggc

SEQ ID NO: 6814827 - DNA, 85 bp, Homo sapiens
tgtttcactaatgagttaatgtgttgccctttattctgtggcctatttcttctcccagtaacaattgacacttcattgtgaggca

SEQ ID NO: 6814828 - DNA, 68 bp, Homo sapiens
ctgctggaggaaatctcaccgcgccggggcagccttcgccaccggcaggacctcatttccttctgcag

SEQ ID NO: 6814829 - DNA, 56 bp, Homo sapiens
gggcatggtgagggatatgaagtatacaagacataatttctgctctcaaaatgctc

SEQ ID NO: 6814830 - DNA, 64 bp, Homo sapiens
gggctccagccactggctgaggcatcagtaagttggttcttcccctcgccggtgctgcaggccc

SEQ ID NO: 6814831 - DNA, 86 bp, Homo sapiens
ggtgggtgtaaatgaggttaaggaaagtacatgttttgactccacagcagaaagaagtcatttatatgtctttccttcatcccacc

SEQ ID NO: 6814832 - DNA, 123 bp, Homo sapiens
tgtgaaagcattcagtatcatcatcaattttgcagtattccctagaagcagttggtgctgttcagttttcttactgttacatcatggcttcatgctgcaattatacatgaactaggtttcaca

SEQ ID NO: 6814833 - DNA, 58 bp, Homo sapiens
cagggaggagcagcctgctctagcccactttgctctcaggattgaatgcttctccctg

SEQ ID NO: 6814834 - DNA, 69 bp, Homo sapiens
tgcactttgcaggcatggaaaccttgttccacacattgcctggtgccctgtccagcgctgcaaggtgca

SEQ ID NO: 6814835 - DNA, 56 bp, Homo sapiens
gtggcagagcaggagacaggaccaggcatcctggcgtttgtctgaactcctgccac

SEQ ID NO: 6814836 - DNA, 87 bp, Homo sapiens
gaaggatttattttacttactatgtggcttgctgaagcaatgtcaagtttgattctgtaagtcatattgttattctggtagtctttc

SEQ ID NO: 6814837 - DNA, 62 bp, Homo sapiens
ctcaaaatttggggtcccatggtcattttacacaggtaaaaattatggagtatcccaaagag

SEQ ID NO: 6814838 - DNA, 89 bp, Homo sapiens
ggggaggcattcctcaccccacacaccctgggagctgcagagactgcaatttcactaatgatgtggggaagagaggaaaaggctagccc

SEQ ID NO: 6814839 - DNA, 55 bp, Homo sapiens
tgattccatggtcaattccaggtctccatttacacctagaatggccaggagctca

SEQ ID NO: 6814840 - DNA, 59 bp, Homo sapiens
gtatcctgggcccaaggcattatgcttgctttgtgcagtgggatgtgggccctggatat

SEQ ID NO: 6814841 - DNA, 81 bp, Homo sapiens
gacacgctgaccacaggcctctaacagccatctttcaacatgcatgccgtggttgtttatcctgtggtcagacgacatgtc

SEQ ID NO: 6814842 - DNA, 66 bp, Homo sapiens
cagcatgtccaaatttttcacatgtagaatatgatcactctgtttccatggaggaattggatgctg

SEQ ID NO: 6814843 - DNA, 67 bp, Homo sapiens
ggcccttctggaggacactggccccatttttctcttggtcccattgttctgcccaggacccagggtt

SEQ ID NO: 6814844 - DNA, 66 bp, Homo sapiens
agttgtttcatagcatatacgtgtgtatgtataaacacatacatatgtatatttgtcagattcact

SEQ ID NO: 6814845 - DNA, 81 bp, Homo sapiens
agcacagtgattggcagatagcaagtgaaggaggggcaaggctgccaccacttctggcttctggtgaaattttactggact

SEQ ID NO: 6814846 - DNA, 62 bp, Homo sapiens
gtctagatgacatattttagactactgttatcaaattgagtgatttaggataaagtctggac

SEQ ID NO: 6814847 - DNA, 64 bp, Homo sapiens
ggagtataaagtgtagggagcattttcaaattttatttattgacaactttgcattttattctcc

SEQ ID NO: 6814848 - DNA, 68 bp, Homo sapiens
gtttctatggtattacagcattccatatttctgcaagtgttaataggaatttgtaatgcttggataac

SEQ ID NO: 6814849 - DNA, 93 bp, Homo sapiens
tcataaagctcttccaaatgtaagttcatattttgttctcacacacaagaagtgagaacaaaatatgaacttgcatttggaagagctttatga

SEQ ID NO: 6814850 - DNA, 74 bp, Homo sapiens
gggttgctgatgtcagttagtgggttactctcagccctctcctccagggcagctagccctctagcccacaaccc

SEQ ID NO: 6814851 - DNA, 75 bp, Homo sapiens
tgtgtgtaaagagaagagcacagtattgatactagttaggcaaacagtaaatggtggtttttatcattactcata

SEQ ID NO: 6814852 - DNA, 57 bp, Homo sapiens
cctgtgccctgccaggctggtgcctggatgctctagggcccagaggagggcagcagg

SEQ ID NO: 6814853 - DNA, 60 bp, Homo sapiens
aataaatcccatttatgcctagtgttccattactggaatgctaagcatgtgggagttatt

SEQ ID NO: 6814854 - DNA, 108 bp, Homo sapiens
caccatgacctgtgttaatgaagttaattgaatttaagatcaataatggttaattattgcaatttgacattcagagataaatggctttaagacagagaagtatgtgtg

SEQ ID NO: 6814855 - DNA, 78 bp, Homo sapiens
agagtaagtagtcagacataccccatgcattactattcataaagtcgtggtggtggttgggctattttctgcaactct

SEQ ID NO: 6814856 - DNA, 67 bp, Homo sapiens
actcagtaaatgtttagcatcagttgtcttaattgatacttgaggttgtataaatattttgatgagt

SEQ ID NO: 6814857 - DNA, 87 bp, Homo sapiens
gaagagtcccaaccaaaagtcggctgctctctggtaaagatggatggtcttttcctctgcagagcagttagaatgtgttagctcttt

SEQ ID NO: 6814858 - DNA, 67 bp, Homo sapiens
gaggcttagtctctaggcagggtcctggagtgccgctccagagtccctgctcaggggtctgattctc

SEQ ID NO: 6814859 - DNA, 55 bp, Homo sapiens
ttctgtgaacattactacagtgaatggtttttctctgagaaacatgttcaaagaa

SEQ ID NO: 6814860 - DNA, 55 bp, Homo sapiens
gctgtggaatggctgccagctcccttcctgggagaggctgggtggggtccacagc

SEQ ID NO: 6814861 - DNA, 98 bp, Homo sapiens
ccgtcattcattgaacagatgttttatgcttcagatgagggtttttagtacctgagaccaacattgactaatagaactttttgtaatgattgaaatgg

SEQ ID NO: 6814862 - DNA, 56 bp, Homo sapiens
cagcagaaaatgtgggtgatttcattatctgggattgctttgtcatatttctgctg

SEQ ID NO: 6814863 - DNA, 73 bp, Homo sapiens
cagtgggttagatggacttcctggactaaagcacagctggaaagtaccagatggtccagagtctagccccatg

SEQ ID NO: 6814864 - DNA, 55 bp, Homo sapiens
cccctcaaaaatgcctggtccctctgcataaaggagaacatggcaggtggagggg

SEQ ID NO: 6814865 - DNA, 130 bp, Homo sapiens
ggcttgaaatttggagactgctccatgtgtgaggccagtctcattgggaccagctctccagtctgaagtaggaagctgaagatgccagtgggagtgcttaggtggaacgctctctcccaggattcacgcc

SEQ ID NO: 6814866 - DNA, 64 bp, Homo sapiens
tgtatcctttagatgatctcttggacattgagctagtgtctacgaaaatatcttaagaattaca

SEQ ID NO: 6814867 - DNA, 55 bp, Homo sapiens
cttccagagaagcactacgggtgaggtcagacttctccttgcttttcggtggaag

SEQ ID NO: 6814868 - DNA, 74 bp, Homo sapiens
gtcttatagtgattattattgctattgttactattataattgtggtttcaagtaataaatagacattatattgc

SEQ ID NO: 6814869 - DNA, 83 bp, Homo sapiens
cccttggcattgtgacttgggctggctgcacttggctggggaacaattctggaaccaacatgccagttgtccaacaccaaggg

SEQ ID NO: 6814870 - DNA, 79 bp, Homo sapiens
ctgaaagcgtaggttgggactcaagccagggaaccttcgcagctcacctgggtttctcttcccactcttgtgttttcag

SEQ ID NO: 6814871 - DNA, 64 bp, Homo sapiens
ggaaggcaagtgctccttgggtctgtttggtgtcgtccctgggcctggaatatacttggctttc

SEQ ID NO: 6814872 - DNA, 73 bp, Homo sapiens
cctagaaagtcttgtagtgagtttcctgctctttcttttaaaagcaggaacctaatgaaggctcacctctagg

SEQ ID NO: 6814873 - DNA, 65 bp, Homo sapiens
gagacagcaggtgcaggtgcggccgctttagccctgagcaggctctgccgctgcttgcaggtctc

SEQ ID NO: 6814874 - DNA, 67 bp, Homo sapiens
cagccttcacaaagcaaatgtgctttgtgcacttccttgccagagcagatgtggccttggtggactg

SEQ ID NO: 6814875 - DNA, 79 bp, Homo sapiens
gggtgaagggaggggccatgcttgcaggggccagtgaccgaggcccgccgttggaactgatggccttcatcccgagccc

SEQ ID NO: 6814876 - DNA, 87 bp, Homo sapiens
taggtatgttttgcgtttattccaagacagcaggctttattttcctgtaaacatatcagactttcttgaatgaatgagaataacctg

SEQ ID NO: 6814877 - DNA, 78 bp, Homo sapiens
gcgtcgggaagccaggccaggtggtcatgcttgctgagtcatttagctgcaactgtccttgccttgtttcctgatagt

SEQ ID NO: 6814878 - DNA, 86 bp, Homo sapiens
gtagcccagcacagcagagtgtgagatagccacccctgacagccacctggtatttcctcattctgctttgcactggattatgttac

SEQ ID NO: 6814879 - DNA, 65 bp, Homo sapiens
gcttgagcatatgcatttccaattggcacagcaattgccggcatgtaaatggatactgcttttgt

SEQ ID NO: 6814880 - DNA, 76 bp, Homo sapiens
ccaccagactaatggctctttgaggacagaaggcatgccatgttcttctctgggcccttaacagttaccgtggtgg

SEQ ID NO: 6814881 - DNA, 94 bp, Homo sapiens
ggcttttcaatggtggatggtttctggtgggtgttaacatgtaatacaaacatcttcatacttggtgcccactccagacacctatcctcatgcc

SEQ ID NO: 6814882 - DNA, 55 bp, Homo sapiens
cctccagccttcctgaagagccaggctggttctcctactcactcaaggcttgagg

SEQ ID NO: 6814883 - DNA, 60 bp, Homo sapiens
tgctgtggctggaataataaatgtgagcatttatcatcattaaacatccagcctatggta

SEQ ID NO: 6814884 - DNA, 83 bp, Homo sapiens
aacgtggtgtttaaatttgtattccttttccgtaaaatacaaatgctgtgggaaaataatacatacttataggcatctatgtt

SEQ ID NO: 6814885 - DNA, 70 bp, Homo sapiens
cacatacctgatcaagctacttgtcttcgtttccttctatttaggaaagaaggaccagagctgatctgtg

SEQ ID NO: 6814886 - DNA, 63 bp, Homo sapiens
gtctggctgctgcttgactgctggctatgctaatgagcaacctgccaccacaggcaagccgat

SEQ ID NO: 6814887 - DNA, 109 bp, Homo sapiens
ggtgaggcgacagctgcttctgcatgaagtgcttcattacaggcgtgggcaaccatccgccccaagaggctgctttgatgacaggagcaaaattactgaaggcgtcact

SEQ ID NO: 6814888 - DNA, 56 bp, Homo sapiens
ctggaggcccctaaacccacctcattgcttttggaaaccctggaaggggtctccgg

SEQ ID NO: 6814889 - DNA, 75 bp, Homo sapiens
tttacggactcagctctttttcacacaacatgctgccaacccaagtcttgtatgtgtgcagcagagttttgtaaa

SEQ ID NO: 6814890 - DNA, 56 bp, Homo sapiens
tatttattgaagttcaagctgtagaaatctgacagctttgaggactttaaaagata

SEQ ID NO: 6814891 - DNA, 89 bp, Homo sapiens
ctataatgagtaaaagagacctaaagtacccagcatatggcagggctctgtcaatgttagttcttttggtttttgaactacagaaatag

SEQ ID NO: 6814892 - DNA, 89 bp, Homo sapiens
ttttctagaatggagaacttcaggattattcaagttcaaattcagaatgtgaatacagtgaggtctatgagaatcatttttgcagaaga

SEQ ID NO: 6814893 - DNA, 78 bp, Homo sapiens
actttaatagaattacgatcatttctaaaataaagtaattgtgatcactatatgctaaggaggtcgtagtctaaaggt

SEQ ID NO: 6814894 - DNA, 90 bp, Homo sapiens
ctaactttgctgactcagggaacattttaattacaataaacatccttccacttaatgtattttgggagtttctttcagcaaatgtattag

SEQ ID NO: 6814895 - DNA, 67 bp, Homo sapiens
cagtatgtctgttccttttcggcatcacttaaacaccctggactgccaaagaaaggaggcaacactg

SEQ ID NO: 6814896 - DNA, 72 bp, Homo sapiens
caaggggaaactgtagtttgctgacatttaatatatgctattaaattcagtcatatttataatttccttgtg

SEQ ID NO: 6814897 - DNA, 55 bp, Homo sapiens
agatttcttctcgactgacactgtggagaagccgctgtgccagcagaagaaagct

SEQ ID NO: 6814898 - DNA, 57 bp, Homo sapiens
cattatgcattagttcttgttggttgtataaccatgcatcaaagctaatatatgatg

SEQ ID NO: 6814899 - DNA, 96 bp, Homo sapiens
ttttgtcattaatatggctttggtggccagtgggaatgggctcaactcttaaggaaagttagacgccaaagccacaggccatccaatgagacgaaa

SEQ ID NO: 6814900 - DNA, 80 bp, Homo sapiens
ctgtgcctccagccgcttgcttgggagtggggagggtgctggtggggctgcccgcaccatccccgggctctggcgcacag

SEQ ID NO: 6814901 - DNA, 71 bp, Homo sapiens
agtgtcatctggaaggacgtgtgctcaaccctgaacctgttttcatgtgggtcctcgtcttccaaggcact

SEQ ID NO: 6814902 - DNA, 65 bp, Homo sapiens
aatgaagtcttcatctgatgctctgaacagagaaactttagaggtttagagtgaggactgacatt

SEQ ID NO: 6814903 - DNA, 82 bp, Homo sapiens
tttctatttgttgtcaggttacaaaacagttaaattaaattttctaaacagaaaagaaactgttgcgtgacagcgataggga

SEQ ID NO: 6814904 - DNA, 66 bp, Homo sapiens
tcatgcataatggtgacaaccttacacttcagattcttagaggcggttaaaaacttatatgcatgg

SEQ ID NO: 6814905 - DNA, 82 bp, Homo sapiens
tcctccgcagcatatgtcagtgccccataacaaggtgctcaataaatgctcttcagattgcactgagcaagttgtgagtgga

SEQ ID NO: 6814906 - DNA, 65 bp, Homo sapiens
gccagggacactccctcctggtgtcaattccagacacctggcacacactggggagtgtcctgggt

SEQ ID NO: 6814907 - DNA, 65 bp, Homo sapiens
tgagaattctgggtctagggttgtatctgtaaagggaggcagcccacaggacacaggaagtatca

SEQ ID NO: 6814908 - DNA, 63 bp, Homo sapiens
gccaggccactccagtggctcagaagcaggcgcccaacaaggttactggagtgagcctgtagc

SEQ ID NO: 6814909 - DNA, 84 bp, Homo sapiens
cctgggagtttgttagtaatgcagcatctccaacccatcccagattaactttgtcagaatctgcattttaacaaaacccccagg

SEQ ID NO: 6814910 - DNA, 129 bp, Homo sapiens
tcttctcttccctgtgctcccctacacagcagcctccctcccgggctctggggcagccagccgcaggagggatagtctgggaggggctgccattgctgttcacttggggaggacgtcagaggactcaga

SEQ ID NO: 6814911 - DNA, 59 bp, Homo sapiens
tggatatgggccatggaaaaaaagtgaatctggaaaatttcattcatggcctctatcca

SEQ ID NO: 6814912 - DNA, 72 bp, Homo sapiens
aagtttatcaacatgtgagaactcaggaaatactgttcctgcaagtttttcctgattttacagaatgagctt

SEQ ID NO: 6814913 - DNA, 80 bp, Homo sapiens
gtaagggcacctgttttagcttggtcacctcctttgaacctaaaacagaggccagccatatctacagcaagtgtccccac

SEQ ID NO: 6814914 - DNA, 61 bp, Homo sapiens
cccactcttccctgcttttggagtctagccctaagctgaggcaggattctggggacctggg

SEQ ID NO: 6814915 - DNA, 71 bp, Homo sapiens
tgcagtggctcacacttgtaattcctggcccaggtgggaggatcacttgaggccaggagttcaaggctgca

SEQ ID NO: 6814916 - DNA, 59 bp, Homo sapiens
tctctgggtgatggcagggcacccgtggatgatgcagccttggagaagtcactcaggga

SEQ ID NO: 6814917 - DNA, 63 bp, Homo sapiens
gggggacaggctgagacttgagcttgtatctcctgggccagctgcaacatctgcttgtccctc

SEQ ID NO: 6814918 - DNA, 71 bp, Homo sapiens
tcccgacattgcaatgaaattagcctgtaatgctttcaacgcccttgcagatcagctttcattgtcaggga

SEQ ID NO: 6814919 - DNA, 61 bp, Homo sapiens
gaaatacgtgttatacaggctcagggactattccctgttcctggttcctgcatgatgtttc

SEQ ID NO: 6814920 - DNA, 55 bp, Homo sapiens
ttgagaaatacttttgtagcctaaggaagaaggtggagcaagggatatttttcag

SEQ ID NO: 6814921 - DNA, 74 bp, Homo sapiens
ggcacctgcagatggcttctcgctggcacctgtcatgctctgcagacgtgcctggaaaagaagcttatgttgcc

SEQ ID NO: 6814922 - DNA, 58 bp, Homo sapiens
ttctgaacaggagaaaggtttctttgaagtttttcaaagactttgcttttatttagaa

SEQ ID NO: 6814923 - DNA, 55 bp, Homo sapiens
gtacaggacatagacagagtagagcttctaatatttactttgctataaattgtat

SEQ ID NO: 6814924 - DNA, 80 bp, Homo sapiens
taggcttattgttcattgccccctgtgtaaaaagtctcatttgagaaatttatagtataggtaatgccaagaaagaccta

SEQ ID NO: 6814925 - DNA, 59 bp, Homo sapiens
gagcagtgaaatcacaactttagttttgatgcccatgattcgtgtgtatttcactcctc

SEQ ID NO: 6814926 - DNA, 65 bp, Homo sapiens
cagtcagtgttgaagccttctttggtcttccaagatccacaattgaggactgcacactctgattg

SEQ ID NO: 6814927 - DNA, 58 bp, Homo sapiens
ccactagaatgaggagcataaggtggccacgtggctgtcacagcttccagtttagtgg

SEQ ID NO: 6814928 - DNA, 76 bp, Homo sapiens
gcctctgtcctaaacctgttaatagagcgatgcgttactggttttggttagcaagttttaacattttagaagaggt

SEQ ID NO: 6814929 - DNA, 60 bp, Homo sapiens
tccagaatcttcggtaactggaagacaagttgtagtctaccaacagctgaaattcatgga

SEQ ID NO: 6814930 - DNA, 87 bp, Homo sapiens
tgtgacctaattatttaactcctttggagagacccctttgaatatgtgtctcgtcaaacatcagatgttgttggtagtgaggtcaca

SEQ ID NO: 6814931 - DNA, 79 bp, Homo sapiens
atgatagagaaaccaggcaagaactactgtctcgtcgcaacttgaggagacaatatttcttgcctggtttccctatcat

SEQ ID NO: 6814932 - DNA, 60 bp, Homo sapiens
ttctgagaaactgctttgtgaggtgtgcattcatctcacagagttaaaagtttctttgga

SEQ ID NO: 6814933 - DNA, 94 bp, Homo sapiens
tgcatcaggatctctggtgtgtttgttgaaggtgcagaatcccagaaggcaaagtccttccacctgcatttttaacaaggctaattctgatgca

SEQ ID NO: 6814934 - DNA, 72 bp, Homo sapiens
ggacaggggaagatgccaagggagatagcaagtttgggcaaagtcctccagggggatcttcagcctgattcc

SEQ ID NO: 6814935 - DNA, 59 bp, Homo sapiens
aaatgctgagtgtttagagatcaaaggcttccttaatggatgtctgaatctcagcattt

SEQ ID NO: 6814936 - DNA, 112 bp, Homo sapiens
catagaatctatttaagtcaccttagagagtcttctttaggccatttatagaaaacatgaatgaagcccaggggagagtctctgcagtgaaaaatgctgaagtgggctcttg

SEQ ID NO: 6814937 - DNA, 71 bp, Homo sapiens
gcaacttctactttcagtgttaatgttatgtcaaagaagtgagggtattaatatgagaaagtggcagaagc

SEQ ID NO: 6814938 - DNA, 77 bp, Homo sapiens
agtcagggagaggcatcatagggaaagctaatatttccaagagtctctattaacctttggtgttttttcctgtaact

SEQ ID NO: 6814939 - DNA, 56 bp, Homo sapiens
aggcattgatttaaacatctctcttcctttaaggaagactcatggaatggatgctt

SEQ ID NO: 6814940 - DNA, 62 bp, Homo sapiens
cactagacgtgtgtttttggccttgcttgtcactgcaagctgttatgtaaatatgtttagtg

SEQ ID NO: 6814941 - DNA, 74 bp, Homo sapiens
catccagctttttcatacacattcttattacttttgtgtcatcaaaagacttgggagcagtatgctgctggatg

SEQ ID NO: 6814942 - DNA, 66 bp, Homo sapiens
gggtgcctggtcccattgcggctgcctctgtgcctgcatgggacagacccatgggccaggtcacct

SEQ ID NO: 6814943 - DNA, 65 bp, Homo sapiens
gcagcagcggggcccctgcgcgcggcgcccaccgtctcctcctcgcgccgggctcgcggtgttgc

SEQ ID NO: 6814944 - DNA, 58 bp, Homo sapiens
accaagcccaccatcaatggagtgagcaagtaaactcctctgatggaggagggctggt

SEQ ID NO: 6814945 - DNA, 87 bp, Homo sapiens
cctgccttggcctcccaaagtgctgggattccaggcgtgagccaccacgcccggtctccatagtttttaagagcgccgttaggctgg

SEQ ID NO: 6814946 - DNA, 77 bp, Homo sapiens
gaatccatactttgattttaggaaatccatgaaaggggaaaaaatgtccctatgtcctggagcagaggcaaggagtc

SEQ ID NO: 6814947 - DNA, 59 bp, Homo sapiens
tgtcagttcaattatagtaattcaactaaatgagttattctacagtcattgaagtgata

SEQ ID NO: 6814948 - DNA, 65 bp, Homo sapiens
ccctggaggcggcacgcgtcaagaagtgacacgatgtgctgcttctggcagtgcagccaccaggg

SEQ ID NO: 6814949 - DNA, 73 bp, Homo sapiens
ggctgtctgcccggcttcaggagatacagtccagcctccttggtgactgtgtgaggctgggtgagtcactgcc

SEQ ID NO: 6814950 - DNA, 109 bp, Homo sapiens
gctcaggcaatgccccaggggcctttctggtgactcccagctgctctcttgggagggtcccacgaaaaggaaaggcagtgccaggagagccccttggggcagctgtagc

SEQ ID NO: 6814951 - DNA, 59 bp, Homo sapiens
gcctcatttatccatctgtgaggggactggctcagctcctcgcaggagggagatgatgc

SEQ ID NO: 6814952 - DNA, 80 bp, Homo sapiens
ctgggactccctttcttgtgggcagatggggccagatgttcaggtcaggcttctgccacgagagggaagtggggtcccag

SEQ ID NO: 6814953 - DNA, 61 bp, Homo sapiens
gcctcccaggttggagttcagtggtacaatcatggctcactgtagcctcaacctttcaggc

SEQ ID NO: 6814954 - DNA, 59 bp, Homo sapiens
ctgggctgcttgctgaaggggtggggctgactgacaaaactttggtgggggtagcccag

SEQ ID NO: 6814955 - DNA, 56 bp, Homo sapiens
gagctaggattgtgccactgcactccatcctgggtgacagagcaagatcttatctc

SEQ ID NO: 6814956 - DNA, 77 bp, Homo sapiens
ccagattagggagagactaggggacttggggtctttctatgtgactctgagaatccctggactttcttagagaatgg

SEQ ID NO: 6814957 - DNA, 61 bp, Homo sapiens
ttggcttcccagagcttacgctgactcatttgagaaacagaaaaagtgactggcaggccaa

SEQ ID NO: 6814958 - DNA, 58 bp, Homo sapiens
atatttttcttctagctttggtgagtgaattattaattgccattgtaaagaaaaatgt

SEQ ID NO: 6814959 - DNA, 58 bp, Homo sapiens
tttagtttcctaggctgtattgttgcttattcagcaaactaggtcacaggaggcggga

SEQ ID NO: 6814960 - DNA, 81 bp, Homo sapiens
cggtcgttatagaacattcttgggtagctctgtaaggtcagttggcagagtacgatgaactcgtggaattctctgcgatcg

SEQ ID NO: 6814961 - DNA, 95 bp, Homo sapiens
gtcattagtaattcagtacaaatatttgttgtttgttggattgacacataacatgcattgacaaatatttgttgtttgttggattgacacatgac

SEQ ID NO: 6814962 - DNA, 89 bp, Homo sapiens
ggtgtttagagctggagacaaggagaccagcatttgtcaagcactttctaagccccagactctgtgctccttgctttctctgcattacc

SEQ ID NO: 6814963 - DNA, 78 bp, Homo sapiens
tccctttttaatccacagtaggaacaagttgtcgattcctagattgggtttttgctctctgctgtgcacagattggga

SEQ ID NO: 6814964 - DNA, 71 bp, Homo sapiens
ctggcttgggtctacctgcctttgtactctgcagacacacaaaccatgtatagggcatgtttctccaccag

SEQ ID NO: 6814965 - DNA, 73 bp, Homo sapiens
gacagaggcaccagccccgctagcctgggaggcagcctggtacccaggagggaggagggtgggggcctgggtc

SEQ ID NO: 6814966 - DNA, 55 bp, Homo sapiens
gcagctgctcccttttacagtggggggaacgtacacagagaagggagtaagttgc

SEQ ID NO: 6814967 - DNA, 103 bp, Homo sapiens
agaactgccaacgcgggctccttggcaaccagagctcaccatctgcccaggcaaccagggagggcacagagggcagtgagcctctgccaggatggacagttct

SEQ ID NO: 6814968 - DNA, 64 bp, Homo sapiens
ggtgccttatctgcaccctccccctcctgtcccctgaggagggacagagtgcagaggggcctcc

SEQ ID NO: 6814969 - DNA, 64 bp, Homo sapiens
tggatgtagacctttctttgtgattaacagcttttctagtcactcaatgaaaagtcactgtcca

SEQ ID NO: 6814970 - DNA, 94 bp, Homo sapiens
cagcaggtgagatcggcactggctccaaggaagaggttttccatgcagatgtggaaactgccaaaagaccttggatgtgagctgccacctgctg

SEQ ID NO: 6814971 - DNA, 63 bp, Homo sapiens
cttgccaggatcagagtcacagggtggtggaacaaaccacttatgtgtgcttttcttggtaag

SEQ ID NO: 6814972 - DNA, 76 bp, Homo sapiens
ttctggaagtgttcacattacaaggccatatttgaataaccccattacaacggcctaataaatgtgaaggtcagaa

SEQ ID NO: 6814973 - DNA, 73 bp, Homo sapiens
gggttaaaatgaaaaacatcttataccagaggttgaatcttcatgggaattagagatgctttttattcaaccc

SEQ ID NO: 6814974 - DNA, 59 bp, Homo sapiens
cttggacattatcaagtctaatgtcctcattttatggatagggaaattgatgtcccgag

SEQ ID NO: 6814975 - DNA, 67 bp, Homo sapiens
taggtgtgacatttcaccaagctcgtgactcatgtcattgtcaccaagcttttctgttttatatcta

SEQ ID NO: 6814976 - DNA, 92 bp, Homo sapiens
ctaattaccctgcagcagtgagggcattcagtgctgggacctttcccaggctctgagcctcactctttcaatgtgcgctgccggtctattag

SEQ ID NO: 6814977 - DNA, 69 bp, Homo sapiens
ggggccttgtccagggagacaactgtgagggctggagtaatcagggagggcttcctggaggagagcctc

SEQ ID NO: 6814978 - DNA, 78 bp, Homo sapiens
gtggttgcattcctgccacaggccactgtggccctcttgttggcgggtccagtagttggtggccgtggagagcaccat

SEQ ID NO: 6814979 - DNA, 55 bp, Homo sapiens
gggaaggaaagacccattttgtatctgatcccgagtttgcagttgagtccttccc

SEQ ID NO: 6814980 - DNA, 61 bp, Homo sapiens
tctggcaaggcacagggtttgcaatttgattcacagtcactgtctgcccctgtttaccaga

SEQ ID NO: 6814981 - DNA, 57 bp, Homo sapiens
agatgctgcagcctggactggaagccagagtgactcatcagcccagggtgagcatct

SEQ ID NO: 6814982 - DNA, 78 bp, Homo sapiens
aggtaaattcgcacaggctccctctgtgaaggtcattgcttctttcaatgtcacagaaggaccttgtttcatttacct

SEQ ID NO: 6814983 - DNA, 56 bp, Homo sapiens
agctcttggcaagactctcccaatttatggggctttgggagacacagccttgagct

SEQ ID NO: 6814984 - DNA, 82 bp, Homo sapiens
ccttatctgtcatggctacctttagcacccatggaatctgctgggtcatatgattacgggccagggctgctcatacagcagg

SEQ ID NO: 6814985 - DNA, 56 bp, Homo sapiens
atttcaggatagcctagttttgctttgtgtatttgcatgcaagttatcctagagat

SEQ ID NO: 6814986 - DNA, 74 bp, Homo sapiens
tcactgtgcatcctcaggtctagggacagattattccaagaagattctgctaaatagatttggcaatgcagtga

SEQ ID NO: 6814987 - DNA, 61 bp, Homo sapiens
aggggtattgaaagttcacagggcccttcctctattcttcctgtattaacttttgcacctt

SEQ ID NO: 6814988 - DNA, 60 bp, Homo sapiens
gcaaatgtttttgagtgtttactgtgtagcagtcagagtaggcacttaaccaatgttagc

SEQ ID NO: 6814989 - DNA, 113 bp, Homo sapiens
gataattaatactgaaagcttagcacagtgcatggcaagtggcatagaatagccaaaacggctgctgttgttactgtgtggttactgtgcttgttcttgtcgctattgatttc

SEQ ID NO: 6814990 - DNA, 76 bp, Homo sapiens
ctggggactttggttctccatgtggcctaaatttccacatagtatggtggctgggttccatgggtgaaatccccag

SEQ ID NO: 6814991 - DNA, 77 bp, Homo sapiens
ctcttctaaccaggatagaagtctcttttctctttcatataaaactaggataggaattgagatgctatttgggagag

SEQ ID NO: 6814992 - DNA, 60 bp, Homo sapiens
ggttcacaggtccgactgctggtcacagttatccgtggctgtcggtcatcctagtgagct

SEQ ID NO: 6814993 - DNA, 55 bp, Homo sapiens
aatcacacttatcctcaatagccatatttatggcttcctgtgtaatgaggtgatt

SEQ ID NO: 6814994 - DNA, 64 bp, Homo sapiens
gggcagtgtctgcaaatgaacaatccataccctttcagaatccttgatcatttttgcactgctt

SEQ ID NO: 6814995 - DNA, 67 bp, Homo sapiens
tctagttgctgtagaacatgttctagagagccctcttatgctcaccatgttcactgggtcaattaga

SEQ ID NO: 6814996 - DNA, 78 bp, Homo sapiens
ggatagccagtatggtggcaggtcccattggagcagcagcaataggttggttgtgggtcctgctacatcaggctgttt

SEQ ID NO: 6814997 - DNA, 89 bp, Homo sapiens
agtttgctgctcatgtagaagggattttaaaggtgctaaaagacatcaatctgaaatgtttcctagctataaagctcttccagcagact

SEQ ID NO: 6814998 - DNA, 67 bp, Homo sapiens
gtttccaatgagagttactctcctgcaagtgcctccagcacttaagcagcatgcattcagtggagat

SEQ ID NO: 6814999 - DNA, 61 bp, Homo sapiens
tcctatttaggagccctctctgcttagttttgtagaggctctcatggctccagaatagcga

SEQ ID NO: 6815000 - DNA, 57 bp, Homo sapiens
acagcagacagtcggcttcctgggatcaagggaattttctgagcctgctctgctagt

SEQ ID NO: 6815001 - DNA, 71 bp, Homo sapiens
tgcccgtctgcctgctagtggctgcctcggctcaccagtgggcaccaggaggtggcagccaggcagaggca

SEQ ID NO: 6815002 - DNA, 80 bp, Homo sapiens
gcagctttgtgaaatgtttcaaaatagtcggggctattcgtcctatcctgtattatttttcaattttacagttttcttgc

SEQ ID NO: 6815003 - DNA, 75 bp, Homo sapiens
taactgccgactgatctgcctgtatgtagcttgccccatccaatctattctctacagtagacagcaaggtcttta

SEQ ID NO: 6815004 - DNA, 68 bp, Homo sapiens
tgacttatctcatttaatcatcacatataatcctgggaggtcagtgtgatttatgcatggggaagtca

SEQ ID NO: 6815005 - DNA, 56 bp, Homo sapiens
gctgtcgtgagagacaacacagcgatatctcatatgttgcaagctttcaagatagc

SEQ ID NO: 6815006 - DNA, 90 bp, Homo sapiens
agtgccgcatgcccccagattacatttgtggagtgaaggctttgatctctgcttcctacatgtgtctgcgaggattggtactatggtact

SEQ ID NO: 6815007 - DNA, 64 bp, Homo sapiens
cttctgcgggtcctccatgtgatgatgtccaattgggcagcacacggtggtgccctggcagggg

SEQ ID NO: 6815008 - DNA, 55 bp, Homo sapiens
agggctgacacaccttatcctccagaaagatttggaccatttggtgagtcaccct

SEQ ID NO: 6815009 - DNA, 69 bp, Homo sapiens
tattaacattttccaaagcatctgagtgtgcatgtgtgtgcatgcacatgtggctttatgtatataata

SEQ ID NO: 6815010 - DNA, 81 bp, Homo sapiens
gtcccctgacgaggactggggctctagccaggcctggggcggagcctggggtctggacggctgcaggaagcgggagggggc

SEQ ID NO: 6815011 - DNA, 65 bp, Homo sapiens
cttgaacgtggccatgcacagaaaaatcccaatttgggatgcatctcccacagccgtgcttcaag

SEQ ID NO: 6815012 - DNA, 64 bp, Homo sapiens
gatctgtgtgacccaaggacactctctgttcaccactccagcagggagctgggccacactgatc

SEQ ID NO: 6815013 - DNA, 66 bp, Homo sapiens
gcacctcaggacttccaaaacacagcatggcagttgaaaactgtcttggagttggaagtgtggtgt

SEQ ID NO: 6815014 - DNA, 81 bp, Homo sapiens
gcccgctgccctttgcagctctaggtggaagcacaagcttgctaggctcggcacgctcagagctgcaggaaggcggtcagc

SEQ ID NO: 6815015 - DNA, 67 bp, Homo sapiens
ctttcaaatgaagcagcaccattttagagcaaggaaactggcttttgtgtgttctatcacctggaag

SEQ ID NO: 6815016 - DNA, 71 bp, Homo sapiens
agaggcctggtttgtgtttcctggaaagggagtgtcgttacagctctcctggggagcacacacacgcctct

SEQ ID NO: 6815017 - DNA, 74 bp, Homo sapiens
gtacacaggcagagctgaagatagatggatatacatattccaattgcaaggtttcagctccgcctgcatggtac

SEQ ID NO: 6815018 - DNA, 74 bp, Homo sapiens
gacttgtcacaggaaagggtgtaagggtgcagctccctgaccctgcaaatatatcctgtgcacaaaattcagtc

SEQ ID NO: 6815019 - DNA, 66 bp, Homo sapiens
gcttctgtatttattgtccttttgactctgctgaagatttgagtacttaaaggcatatatagaagt

SEQ ID NO: 6815020 - DNA, 67 bp, Homo sapiens
gtcatgccaatagtgaattattagatctttttcttagagctgtcagatgatacactgttgtcatgac

SEQ ID NO: 6815021 - DNA, 117 bp, Homo sapiens
ccagctgatgctgtgtacctccctgtgcctgtggaatgggagtgagaagacctcacggctgggtcttctttgtgtctattcctaggtctatattttacaggagcatggctcaggtgg

SEQ ID NO: 6815022 - DNA, 63 bp, Homo sapiens
cggagggacctggaagtttggtgatccttgaaatagtgggggtgctgtccttggtcctgactg

SEQ ID NO: 6815023 - DNA, 66 bp, Homo sapiens
gggggcggtccggagatagtgcctctcagccagggttgctgggggtgactatctcgggaatcccct

SEQ ID NO: 6815024 - DNA, 64 bp, Homo sapiens
gccatctggagagtgaaatactagtctaccatatgcctatataacaccatgttctacagatggc

SEQ ID NO: 6815025 - DNA, 65 bp, Homo sapiens
gatatctgttcatgaaacttaactgttggggcttagacttctactgtaagttttggagctatatt

SEQ ID NO: 6815026 - DNA, 65 bp, Homo sapiens
agggctggagggtactagtttatgctcttttttcttatgttaaattttttttgcccttctgcctt

SEQ ID NO: 6815027 - DNA, 67 bp, Homo sapiens
gatcttatggtggatgctggaatagcacatgcagaggaagtatgttatttcaaaattcccttggatt

SEQ ID NO: 6815028 - DNA, 55 bp, Homo sapiens
ttaacattgtccttagcagatttctaatttttggtttgttcaggggcaaagttaa

SEQ ID NO: 6815029 - DNA, 58 bp, Homo sapiens
gctcagagcagatggtactcagagtaagatggagctgggagtgactggggctctgagc

SEQ ID NO: 6815030 - DNA, 91 bp, Homo sapiens
cagacactagaagttaaagggggctacagtgtggggttgggctcagaaagagcaacacacaggtaagcctctttcaaaacattagtctttg

SEQ ID NO: 6815031 - DNA, 66 bp, Homo sapiens
tgattaactaatgggtatgaggatgagttaagctccatgcttgtcccattgccctatagtgcctca

SEQ ID NO: 6815032 - DNA, 84 bp, Homo sapiens
gcagaggacagcccatcccacctcaatctgaagctccggaatgactgggaacaggaaaggagggatgctagggatagtccctgt

SEQ ID NO: 6815033 - DNA, 59 bp, Homo sapiens
tgttctgtacctgtcctggggcacctcgccgcccaccagctggaccacggtggggaaca

SEQ ID NO: 6815034 - DNA, 65 bp, Homo sapiens
ggacccttggcttctgcagatttaacctttcttattttgtggtttgtgtaaagtccgtgggtgcc

SEQ ID NO: 6815035 - DNA, 59 bp, Homo sapiens
ggcaggctagcactgatgtccttctaatttgttaggtggaaaggttgaactagcatgtc

SEQ ID NO: 6815036 - DNA, 59 bp, Homo sapiens
gctggagcgttgcctcggtttgaacaagcgcaaaaagaaggacggcagcagctccgtgc

SEQ ID NO: 6815037 - DNA, 96 bp, Homo sapiens
gcttgtttctagaactctggccattgtgacccagggcctgattgtcaccatgccactgtactcaacaatagttttcaggtttttagatacttctgc

SEQ ID NO: 6815038 - DNA, 60 bp, Homo sapiens
aggttagattgtatgtggtcattcttttaataagaatggataagaacaaatatctgacct

SEQ ID NO: 6815039 - DNA, 57 bp, Homo sapiens
ctctgccttggcaaccacagctttagttttagagaaagcccttgaacaagggcagag

SEQ ID NO: 6815040 - DNA, 68 bp, Homo sapiens
ttctgtatattgtaaagactcaacaccttactaactggctttgtgagtaactctacatatgtacagga

SEQ ID NO: 6815041 - DNA, 64 bp, Homo sapiens
ccagcactgagtggagaatcaatttgagcctgggaaggcccggccatccatctccctttgctgg

SEQ ID NO: 6815042 - DNA, 90 bp, Homo sapiens
agtttgcacaatcaccattagttaacttctttctgtaatcagaaatgacacaggaagagagataataatagactgggaattttgtagact

SEQ ID NO: 6815043 - DNA, 130 bp, Homo sapiens
tcttaccttgttccttgtgtttttcggattcagctgctggatgcttgattttgaggtgttaccatgctactgcctccatctgtatctgtctgggagaaaagcaatagtgaagatgagaaagaagggagga

SEQ ID NO: 6815044 - DNA, 90 bp, Homo sapiens
catgaagcaaatatctatgcaataccttctgaaaataatggatcagtaccttatttaatggaggtcattgttagaattttgcattttatg

SEQ ID NO: 6815045 - DNA, 57 bp, Homo sapiens
catcacagagtgtccccagtgaagctctcctgagaaagcacaaggacgcgctgtgtg

SEQ ID NO: 6815046 - DNA, 112 bp, Homo sapiens
gggtcccagaacagggtccatgaagaggaatgtatttccctgcaaattgaggcacggttgcagttgctggaaggacataatcaacgatggcatcctggtttctctgcctccc

SEQ ID NO: 6815047 - DNA, 81 bp, Homo sapiens
gagtaaagtctgttgtgctctatagagatctaatcgtcagatcaagatgatggggttgattgtaagctcaacttctctctc

SEQ ID NO: 6815048 - DNA, 61 bp, Homo sapiens
ttcagatatattcatttgcagtgcctttggctgttaagcaaatagcacagtgatatttgaa

SEQ ID NO: 6815049 - DNA, 66 bp, Homo sapiens
ttgccactgcttccctgtgcaccagacataccagggagcattttacagtctggaagcagggggcaa

SEQ ID NO: 6815050 - DNA, 60 bp, Homo sapiens
gcggcgttggagcgggctttggtttctgtttgaagcccggcgtcggctccggacgcgcgc

SEQ ID NO: 6815051 - DNA, 77 bp, Homo sapiens
gaacgagttacatcaactccacatggctgtcagtgtgaactttctaaaacacacatcactgctgccggagactcgtc

SEQ ID NO: 6815052 - DNA, 64 bp, Homo sapiens
gcgcctctacccacctgagacatgcaggggggcacctgtcttccttcccagtggggagaggtgt

SEQ ID NO: 6815053 - DNA, 89 bp, Homo sapiens
ttgagttggtacttgaaaaaacatgctactgaacaagtccatggatggggcccctacaggacttatcagtagcgaggtctaatattcag

SEQ ID NO: 6815054 - DNA, 88 bp, Homo sapiens
gtccagtgtgaggtgcagctggtggagtctgggggaggtgtggtacggcctggggggtccctgagactctcctgtgcagcctctggat

SEQ ID NO: 6815055 - DNA, 73 bp, Homo sapiens
tcatctgcacccatgctcttgtctcaggactgcgtccaaagaagcctgagtcaagatgtatggtaaagggtga

SEQ ID NO: 6815056 - DNA, 56 bp, Homo sapiens
ggggagcaggctgggctgtctgggaacatttgccctgtaatatcagtttgcttctt

SEQ ID NO: 6815057 - DNA, 74 bp, Homo sapiens
gagcaccaaggccagttcaccaagggcaaaatccctacttgtgtccttcctgttgaagggcttctgtgatactc

SEQ ID NO: 6815058 - DNA, 63 bp, Homo sapiens
ccactagctatacattatgttgaatcacttgatactgaaagcatattgtatgtctatatgtgg

SEQ ID NO: 6815059 - DNA, 67 bp, Homo sapiens
ttctcctagttgttgaattagttgactgtgtcgcagtgaaagatattagtcagagttcaccagagaa

SEQ ID NO: 6815060 - DNA, 68 bp, Homo sapiens
tctctgcagaaaatggagttctaagtatagtaacaatttagttacatagttacttccatttccagaga

SEQ ID NO: 6815061 - DNA, 66 bp, Homo sapiens
agatgcttatttttctctatcccctgttaggctctacgttccacaatggcagagaaatgtccatct

SEQ ID NO: 6815062 - DNA, 72 bp, Homo sapiens
ttccagccctgcctggctaaactcaagtcgctcaactcctgattgactcatagtctaggtatttggtaggaa

SEQ ID NO: 6815063 - DNA, 70 bp, Homo sapiens
gccttaggtggttgtctgctttcctaaggactcccatttccagtattaaagagagaatcatcatcaaggc

SEQ ID NO: 6815064 - DNA, 106 bp, Homo sapiens
gaggctcccagtgttcccagctgagaacaaagttgaaagtttgcctggagctccatgccactccccgcctgggccactgctttgttttcttctaatgtttttcctc

SEQ ID NO: 6815065 - DNA, 55 bp, Homo sapiens
gtacacatagacaaaacctggctttagttcctaaagctattgctgtttattgtac

SEQ ID NO: 6815066 - DNA, 58 bp, Homo sapiens
tcaaagcatttggttctgaagactctgaggtgcagagctcttttgatgaaggtagtga

SEQ ID NO: 6815067 - DNA, 77 bp, Homo sapiens
gcaacaaggcagggggaggctcccagctaatccagacttgaatctcagctgtgggtgggagcgccctgtctggaggc

SEQ ID NO: 6815068 - DNA, 62 bp, Homo sapiens
tcccagtagccttctcaagacaaagttgcctttgtgtaactacaactgggaggctttggtga

SEQ ID NO: 6815069 - DNA, 76 bp, Homo sapiens
tctggcagaagtgatgacatcgctgaaaccactcctaggttcaggagcccgaagtgatttcacgcttagggctaga

SEQ ID NO: 6815070 - DNA, 60 bp, Homo sapiens
tttcataccatttcagtaaaaacttaggaaaaagcaattgttccactgagaggtttgaga

SEQ ID NO: 6815071 - DNA, 62 bp, Homo sapiens
atctgtcactattggccagaacaagcaacattacttctctctgtttgatggtggagccaggt

SEQ ID NO: 6815072 - DNA, 130 bp, Homo sapiens
gaataccaggattctgaagcaatgagagtgggattgggagagagagctcatgttgaagaagaaataactcaccagttcacatgggctccttttcaagggtttttctttatataaacaatttgcctggttc

SEQ ID NO: 6815073 - DNA, 107 bp, Homo sapiens
aatcattggacacttgcctgttgataaggcgatgccttgcacttcgtcctttattcctgaaggagcaggagcaatggcctatcagaaatggccaggtatcttggatt

SEQ ID NO: 6815074 - DNA, 69 bp, Homo sapiens
gctttatgagtgaggcaggataacctggtagagaaattaggtgttttttccttccttctctcaaaaggc

SEQ ID NO: 6815075 - DNA, 69 bp, Homo sapiens
gaaactttggctaaaagccagaaataagcactagcatttatttgtgtctctgtcttagcccaagtgatc

SEQ ID NO: 6815076 - DNA, 83 bp, Homo sapiens
ttaaaagctgtgtgttcaataatgtgatatgtattgatacattttggcaagtgaaatcataatataaacataacagttcttga

SEQ ID NO: 6815077 - DNA, 122 bp, Homo sapiens
gcctggtccacagttttcccatgtctcaccttaaagcagaggtgatatgacttactattcaggtacgtagtcttgttacgctttttgcaaaaggaattcagatatcgaccctactcccaggc

SEQ ID NO: 6815078 - DNA, 84 bp, Homo sapiens
gaagcagggcgttctcattcttcagctcctcgatctggcggacacgacggaggtcaagggagctgagggccagcgccttgcatc

SEQ ID NO: 6815079 - DNA, 92 bp, Homo sapiens
aggcttagagctaattagtctgttatctggtagagcactaatgtacatggctgatttaatatacagattaacagatttaaagcttttaccct

SEQ ID NO: 6815080 - DNA, 87 bp, Homo sapiens
tcttatacctcaaatccaacatcccttcctagcacttggtgtgggggaccccaggccaagtgctgggacaggtgtgcaggtacaagg

SEQ ID NO: 6815081 - DNA, 56 bp, Homo sapiens
ctcttgtggtggtttgttccttaactacatgtgtggctagacaaatcatccaaggg

SEQ ID NO: 6815082 - DNA, 64 bp, Homo sapiens
gggtatggagacaaattttttagtgaccatacatttgttacaatgctgtttgtttctactgccc

SEQ ID NO: 6815083 - DNA, 65 bp, Homo sapiens
gcagattaagaagtatgcctcatgtatggtgaacattaaatcgatgctgacttcttgttatctgt

SEQ ID NO: 6815084 - DNA, 67 bp, Homo sapiens
aataagaatgcttaacatgttttaaaaattctttttattcttttgaaacgtgcagggtaattttatt

SEQ ID NO: 6815085 - DNA, 75 bp, Homo sapiens
cattccattcttgctttctagaaggcacagccaccccagtatctggtccaggcacccttctagagtaatggaatg

SEQ ID NO: 6815086 - DNA, 100 bp, Homo sapiens
gctattaccataaatcttccatgaacatttgtttagaagtctttatatgcacataagcattgaaagtttttcttagataaatacttatgagtggaatggc

SEQ ID NO: 6815087 - DNA, 64 bp, Homo sapiens
agaaaccaggcccattttcagccagtctgaggaggaaagaggtccctgaagaggcctggggttt

SEQ ID NO: 6815088 - DNA, 65 bp, Homo sapiens
gccatgaaggccagcagagtgaaggcagccattttgccttcatagagtgtaggcctttgcagggc

SEQ ID NO: 6815089 - DNA, 67 bp, Homo sapiens
ctttgggcttattgattacaaagcttcttcattacttctgtggagctgcagatcaataggctcacag

SEQ ID NO: 6815090 - DNA, 123 bp, Homo sapiens
gagttccacagcatgtctcactcagaaaaaccaattcttgactgctggtctctaggaacagttgggatccaagaaccagtttaagatttgggtttcatgcctgactcatggaactgatgactc

SEQ ID NO: 6815091 - DNA, 127 bp, Homo sapiens
tagatttgaattggtgaatgaataaattgggtcttggagaaaggaaagggcttgaatgagttctttcagaataggccttttcttttctcaaaagtaccagcaatagcttcccattttttcagaactg

SEQ ID NO: 6815092 - DNA, 111 bp, Homo sapiens
ccgaccgcggtcagtgcctgaggctggggaacgcgctggcccgcgccgaccgcctcccggtggccctgggcgcgttctgtgtcgccctgcggctcgaggcgctgcggccgg

SEQ ID NO: 6815093 - DNA, 83 bp, Homo sapiens
tatcgcataattaaacaggcaagatttactcctttgggcatctaccagaacatatttaaatgttgtctttgaattgtgctgta

SEQ ID NO: 6815094 - DNA, 66 bp, Homo sapiens
aagaggaggatgctttacagctggattcattcattcatttaaccatttatgaagcatccacttttt

SEQ ID NO: 6815095 - DNA, 67 bp, Homo sapiens
gtatttggaaaggacatgtaagtataattatctcagtaagaagcttacaaattgtcttttaaaatac

SEQ ID NO: 6815096 - DNA, 61 bp, Homo sapiens
cgccagcagagaggaggagggaaccacagcctggcaaggcttggacactccctgtgctgtg

SEQ ID NO: 6815097 - DNA, 73 bp, Homo sapiens
tcctcctcattcttcgtgttgaatttcacccttttctgaggatatctgagtctctgcactaaggagaggtgga

SEQ ID NO: 6815098 - DNA, 76 bp, Homo sapiens
agttataaggcttgatatttacagtctttatagaagtaaaggaccccatgtaattatcaaatagtcctaggtagct

SEQ ID NO: 6815099 - DNA, 87 bp, Homo sapiens
tctaatggcattgcttccagacaaggtcaaattaaatgttcaatttagacattcttcagctttgtcaggcaagcaatgtgaattaga

SEQ ID NO: 6815100 - DNA, 56 bp, Homo sapiens
agatacaaaggcctacagagcaatgcccactgccctgtgaatggggcctttgttct

SEQ ID NO: 6815101 - DNA, 85 bp, Homo sapiens
gatggcagtttttatcctgccgagtacagccatagaaaattgagatcatttctctgctgtgttggcagctgagaaaatggccatt

SEQ ID NO: 6815102 - DNA, 65 bp, Homo sapiens
ttagtgaggaaagatttttaaagagctcattcaacatagttctttgaaaagatattcctccttaa

SEQ ID NO: 6815103 - DNA, 126 bp, Homo sapiens
gggggaggagagttaatcaggctgacaaggaagacaagacgcagcacagctgaaatgcaccctcacccactgtgaagccttgaactgcaaaccccgtcaccagcagagctgactactctttccccc

SEQ ID NO: 6815104 - DNA, 56 bp, Homo sapiens
agggtcaagaataaagattacagattatatttacttgatacttgtgtcttgacctt

SEQ ID NO: 6815105 - DNA, 82 bp, Homo sapiens
ctgagaccctgccaaggatggccccgattccaggcagctgataaaagcgagctcttcagggtcactttaggcatttcctcag

SEQ ID NO: 6815106 - DNA, 71 bp, Homo sapiens
tgtctgttttgttgattgctgtagccctggcatcttgggcagtgccagcacctgttagcattaaatacata

SEQ ID NO: 6815107 - DNA, 93 bp, Homo sapiens
tagcagttttaaaagtagttatagtatacttaaagtctattaccttttcataaggaatcatctgtatgctagtaattgtcagtgagagtgctg

SEQ ID NO: 6815108 - DNA, 57 bp, Homo sapiens
agggaaagggaaaggatgggtgttgcacctcagctgtcatcttacagtcctttcttt

SEQ ID NO: 6815109 - DNA, 83 bp, Homo sapiens
agcagcaccttgacagagactctatcgtatctcaagtggggaaatttaaggaaggctacgtgtagagtttgggggcagttgtt

SEQ ID NO: 6815110 - DNA, 99 bp, Homo sapiens
tgcttatatatagtttaagaaagtacagtttcgtatggaagaccagattttactggtctcacacattgtgctttaattgaactgccaaccaataatgca

SEQ ID NO: 6815111 - DNA, 86 bp, Homo sapiens
caggaaaggtctcaaagggaaacgcagtgtcaagtgtcaggctggcctccctgtgtttctctttcctctgggatcttggcattctg

SEQ ID NO: 6815112 - DNA, 58 bp, Homo sapiens
tgccatgagtgctatatgtgaagagatattaagtctcatttgtaattagttctcagca

SEQ ID NO: 6815113 - DNA, 100 bp, Homo sapiens
ttaatgttaaaagctacaaggagagactataccagtactctaggaatacattaaaagggatacttgagtatagtcgcttcacaaagtcttacctcattaa

SEQ ID NO: 6815114 - DNA, 94 bp, Homo sapiens
gggaggggcagaggagtgggggcagagcctctctcggagaagtccacctccgggagcccccagcccccagccccagctcactctgtgcccttcc

SEQ ID NO: 6815115 - DNA, 63 bp, Homo sapiens
ggactgtgagaaaataaactgttgcttaagccatcagtctatggtgttttgttaaagcagtcc

SEQ ID NO: 6815116 - DNA, 71 bp, Homo sapiens
gctaggtagtgtcagaaccaagctggaaccaggggatctggctctgggcttggattggctctgctgttggc

SEQ ID NO: 6815117 - DNA, 69 bp, Homo sapiens
actgcatgctttacatgacatggcacagcttccacgccagcagcttcaatcatgtaaagcgaatgcagt

SEQ ID NO: 6815118 - DNA, 61 bp, Homo sapiens
gcatccttcctgctgggcctggctcagaagagaaagtcatgtcagacccggggaagggagc

SEQ ID NO: 6815119 - DNA, 68 bp, Homo sapiens
ggccggggactggagtagaggccggtgctcaccagagtctcaccaaagtcgcttctgtcgtccgtgcc

SEQ ID NO: 6815120 - DNA, 69 bp, Homo sapiens
agacaaagagttgcacatctagggttggaaatgacgcctcttgacccacaatctggaactcgtttgttt

SEQ ID NO: 6815121 - DNA, 63 bp, Homo sapiens
tgcttattgattaatacttttgacgtttattttcatcgttaaggtgtttgttttcagaaagca

SEQ ID NO: 6815122 - DNA, 66 bp, Homo sapiens
tgtcttctttgtcatcttaggttcattggctgcggctcctgtagcaaaagatagattaacaagaca

SEQ ID NO: 6815123 - DNA, 62 bp, Homo sapiens
tgttctttttcatctgcccggggaagccagatcttcctctgccccagatgaaatttagagca

SEQ ID NO: 6815124 - DNA, 79 bp, Homo sapiens
atagtgtgaaaatgtcaaagcctggaatacacaatttaaagttgctttctagaaagtttgtactgattttcacttctat

SEQ ID NO: 6815125 - DNA, 65 bp, Homo sapiens
gctctgctgacagctgggacagggtgggcacttggcttcccagaagtctgagctgttgcagcagc

SEQ ID NO: 6815126 - DNA, 130 bp, Homo sapiens
ttgcatcatactccatggattgatataccacagtttggccataggttatttattatattttgtaattacaaagaatgtggcattgaataaccttggactttgtattgttggccatctgtcttccaggtaa

SEQ ID NO: 6815127 - DNA, 63 bp, Homo sapiens
ttctgagagtgccagaagttctcataaaatagttaatctgctgtaagctctggcatacttgaa

SEQ ID NO: 6815128 - DNA, 66 bp, Homo sapiens
ttctcagagtgaaaaagtaattcaacttagcaatgttgctaaacaagaaacattttctgttgagaa

SEQ ID NO: 6815129 - DNA, 80 bp, Homo sapiens
ggacatcctgctcttgggttttctggaagcctgggattaagaagaccagaagggcttccagtcctcagaggctggattcc

SEQ ID NO: 6815130 - DNA, 71 bp, Homo sapiens
tatgacctggcaatattaacagtacttatctcatagaaatgtagtactgggtatgtttctggccagtcata

SEQ ID NO: 6815131 - DNA, 56 bp, Homo sapiens
ttattatttccatttctcagagtaagaaattgaggctctgagagtctgagtgatga

SEQ ID NO: 6815132 - DNA, 70 bp, Homo sapiens
tcagcactcttagtttgtctcagcaactggatagctctgtgcaggtacttgacaacttgggctctgctga

SEQ ID NO: 6815133 - DNA, 65 bp, Homo sapiens
gctgccctgagaaatagcatcatttttgggttttggtagaaatgaaagcagtgcttcaaagcagc

SEQ ID NO: 6815134 - DNA, 72 bp, Homo sapiens
gcatccttctcaggggagcttgcctggtcacccctctactcccagaggggtgaccagagaagctctggatgc

SEQ ID NO: 6815135 - DNA, 78 bp, Homo sapiens
catgtgtgaggtgacatctcattgtggttttgacttgcatttcctaatgactaatgatgttgagtaccttctcatatg

SEQ ID NO: 6815136 - DNA, 57 bp, Homo sapiens
ccacagagatggtctggcaggtggagtgcagctccacacgggccgtggactctgtgg

SEQ ID NO: 6815137 - DNA, 77 bp, Homo sapiens
ctcacattcaggtggcatgttagattcactgctgactattgctttgtttcacagtagccatttcatgagtttgtgag

SEQ ID NO: 6815138 - DNA, 75 bp, Homo sapiens
gtgcacataggtcataggtagaataataaaactctagtgtcataattattttatgtgcggcctgatttaatgcat

SEQ ID NO: 6815139 - DNA, 74 bp, Homo sapiens
ttcttaatcttgttattcttcatacagacaagtcctgttctttaggatttggggaagaaaacactaagtaggaa

SEQ ID NO: 6815140 - DNA, 64 bp, Homo sapiens
ttgtgagcaccagaggttgttctctctaatcctttcaagatggtcctctccctggtgtgcacag

SEQ ID NO: 6815141 - DNA, 62 bp, Homo sapiens
cctctgtctcctgccagtgcctctgataggccaaacccaattagaaggcaggagacaaaagg

SEQ ID NO: 6815142 - DNA, 55 bp, Homo sapiens
agtgtcaaatcagcatctgggtcttgagaaatgcctagaagtggacatttgcatt

SEQ ID NO: 6815143 - DNA, 60 bp, Homo sapiens
actcaatgggaagaagggcctctccagtgttcccattgctgcaggcccccttcctggagt

SEQ ID NO: 6815144 - DNA, 76 bp, Homo sapiens
gctgaaactcttcattcaagtatgcaaatgatactcaatttgtaagattcacttggaagaaataaagaggtatagc

SEQ ID NO: 6815145 - DNA, 60 bp, Homo sapiens
gacgggctctgcacaggccttggtcagcctcttgcaggcgcaacctgacagagccacgtc

SEQ ID NO: 6815146 - DNA, 58 bp, Homo sapiens
caagggagctgtcaacccacatggtcatccaatttctgtggcagagagagcttccttg

SEQ ID NO: 6815147 - DNA, 92 bp, Homo sapiens
ttttaatcttatttctccatccagagtcatggctagaataaggaagagagacagcatttggtactgactcacagtggagaaagaggtagaga

SEQ ID NO: 6815148 - DNA, 73 bp, Homo sapiens
tgtgctctgacagtaagaccttaccagcctgctgctctcattcctgtaggttgatatagatgctgtctggcca

SEQ ID NO: 6815149 - DNA, 55 bp, Homo sapiens
tgctttatgttatcagaagggtggtgtgataaaacaaggctggttgcataaggca

SEQ ID NO: 6815150 - DNA, 62 bp, Homo sapiens
attcaagagatgcgaattaaaattttgctttgatttcaagatattgattcaatttcttgagt

SEQ ID NO: 6815151 - DNA, 77 bp, Homo sapiens
tggtacggattttcagagacatctggacttgccttctctgcacagtctcagaatgtccttgagacattgtcgtacca

SEQ ID NO: 6815152 - DNA, 129 bp, Homo sapiens
gcctgtctcgacgagccgctcacccaagcccagcctaaccaatgtgcagactactgtacacattgagagcctcctgaacaggtagtctgaacactgggttggcggggccggctatccatcctgcagaac

SEQ ID NO: 6815153 - DNA, 125 bp, Homo sapiens
gaaaaatgactccagaatctttaaatctgctctactgtatagatggagttgatttttaaaagttgaaaaatattataagatgattttatttacagtaagttgacttaggattggacttatttttt

SEQ ID NO: 6815154 - DNA, 60 bp, Homo sapiens
tgtcctcatcttttccagaaatatcccataaagctggattaagaggatgatgtgaggaca

SEQ ID NO: 6815155 - DNA, 130 bp, Homo sapiens
gtttgtagctctctggaccgggaaaatgcctgtcattaaggtggcccattcatagtatgacctatgtctgcttcaaaatgagctgggccatccagtgatcttggcattctgagcttagaaatacaaagac

SEQ ID NO: 6815156 - DNA, 69 bp, Homo sapiens
tggtcttcaatttttggtatgatggaaagtctattattctctttttatatatggcaaaattgaggctca

SEQ ID NO: 6815157 - DNA, 79 bp, Homo sapiens
gcagttactcagaatgttcatctacaaggcattgttaggcctttatgataattactgtggatagaattatagtgatggt

SEQ ID NO: 6815158 - DNA, 57 bp, Homo sapiens
ggacagacagcatggaaccatagctctacacacactagcatggctccagtgtcttcc

SEQ ID NO: 6815159 - DNA, 76 bp, Homo sapiens
tggtggcatgtgtgctattctcttatattcatgttctattgggatttggttatgatgagcagaatggcagccaaca

SEQ ID NO: 6815160 - DNA, 89 bp, Homo sapiens
ctgactccccgttgatgtgggtgatgaggtccccagcccgcaggcccgcctcctgggcggggcttccgtcctccacactctgggggcag

SEQ ID NO: 6815161 - DNA, 57 bp, Homo sapiens
tggtggaggcgctgctggccaggctcaggctgctgcgaggtcggctcccctccatca

SEQ ID NO: 6815162 - DNA, 63 bp, Homo sapiens
tttcctgttcaggaaagttgtgttctacaaagaaaaggttggaagacaccccctgacagggaa

SEQ ID NO: 6815163 - DNA, 77 bp, Homo sapiens
ccctttgccttgtctgtcccacagcttcccgagaactatagaaatttcaaggaacagcagggatgacatggccaggg

SEQ ID NO: 6815164 - DNA, 70 bp, Homo sapiens
aagccaaaggctccagtgacctctgggaagagagagcccttcaaggtcattccagccattcccctggctt

SEQ ID NO: 6815165 - DNA, 66 bp, Homo sapiens
tctcagtactgcttgtgggagcagaaattaatgtcctgtttttagctagcctgtgtgtacttggga

SEQ ID NO: 6815166 - DNA, 71 bp, Homo sapiens
taagggatgtggaggaaggcattccaggcacagaaaattgcccttcctgtctgaattccacatcgttcttg

SEQ ID NO: 6815167 - DNA, 61 bp, Homo sapiens
gagtttagtttggcttaaactgattttacaagagaaatctggatttaggttcattgaactc

SEQ ID NO: 6815168 - DNA, 55 bp, Homo sapiens
gcagagggggtacttcggccctgggtctaccctctggctcccagctctcctttgc

SEQ ID NO: 6815169 - DNA, 94 bp, Homo sapiens
atctttaatcttaaataatcattagtttagcaaatatttctgttgatggttttcactggaacagagcttgctgatatgattgtaagtgtaggat

SEQ ID NO: 6815170 - DNA, 111 bp, Homo sapiens
tcttagtctttggagttaaactgcctgggtaagcactaatattgatcaatttaacagaattaacctcatttgttgctgttacctgaggggaggagagtgacaagacaaaga

SEQ ID NO: 6815171 - DNA, 87 bp, Homo sapiens
ttgtatttccccatatattattctagaatgcagttatgtctttgcttgacttgtattttaaataattgtcacatggaggttgtgtaa

SEQ ID NO: 6815172 - DNA, 66 bp, Homo sapiens
catcaagatattttagaacattcactctggctacagagggagaaatggatcagaggggtcagggtg

SEQ ID NO: 6815173 - DNA, 80 bp, Homo sapiens
tggggcctttaagagctgattaagtcatgagggttgagcccttatgaatgggattagttcccttataaaagaggcctcca

SEQ ID NO: 6815174 - DNA, 55 bp, Homo sapiens
ggtggttcacacctgtaactccaacactttgggaggctaaggtgggaggatcgct

SEQ ID NO: 6815175 - DNA, 65 bp, Homo sapiens
ttaagtaacttgtccaaatgagcaggtcatagaacaagctgtgcaactctgggcaagtcacttaa

SEQ ID NO: 6815176 - DNA, 85 bp, Homo sapiens
taagccagtctgaaattcagcatacattgcaccctggtagtatcactttggttgtattcccacaatgtgtgcttcatcttactta

SEQ ID NO: 6815177 - DNA, 76 bp, Homo sapiens
ggtacttgtccaaggtcacctgtctgggaagtggtttggcatggtctagaatctgggatttctgactcttagtgcc

SEQ ID NO: 6815178 - DNA, 108 bp, Homo sapiens
ggcctcttaataaattcaacttttcattgtgtggtgttattcttcttcaagaaatggattagaaatgttaccatacagagctagaagtcatgaattaattaggaagcc

SEQ ID NO: 6815179 - DNA, 68 bp, Homo sapiens
tctcaggcccctgagtttctctatgaccttcagcagcatagtcaggcttagcagcaggggcctgcaga

SEQ ID NO: 6815180 - DNA, 95 bp, Homo sapiens
gcccaataaataatacgcaattcttatgttttattgttattcattagccatggattatggcttatgaataacagtaggtggattatttgaatggc

SEQ ID NO: 6815181 - DNA, 129 bp, Homo sapiens
tgccttcctgagcatgtgattgtactctagttggctcatgatacccaagtacctagaaatatttttgaagctatgtgtctgtatgtgtgtctgggtatgtgttagggttaagaaatgttaaggaataca

SEQ ID NO: 6815182 - DNA, 85 bp, Homo sapiens
atagatcaaggaactgcagctttctaatagggcctcaaggagattttgacaatccctgttagaagtgaacagtttgttgaggtgt

SEQ ID NO: 6815183 - DNA, 65 bp, Homo sapiens
tctgggtgcccagcgaagtggctgtgctgaccttggccagtctcacagctgtcagctgacctagg

SEQ ID NO: 6815184 - DNA, 95 bp, Homo sapiens
ccctgggacatctctcttagcatgctgatatttggctgcttctctgataatgggagcagcattctctggtatggggtgctgtggaagacctaggg

SEQ ID NO: 6815185 - DNA, 63 bp, Homo sapiens
cagctttctggttacagtcttcagataattattgcatttcctgagataataactgcaaggctg

SEQ ID NO: 6815186 - DNA, 72 bp, Homo sapiens
gtgtttgtcttacacactcaacttgattggtcttgatgtttagctaagcaattgtatgtgagaaataaatac

SEQ ID NO: 6815187 - DNA, 99 bp, Homo sapiens
gccaaatttatgtacttcggaattattaaaatagaggatgtcatgctaggattgatccattctgcaggcaaaatattcatttttcagggtttctttggc

SEQ ID NO: 6815188 - DNA, 86 bp, Homo sapiens
tggaaactcgtgggaaatcattacagtgtttatatgtctcccttgtcggacggcgttatcctgtgatattttaccagtgttttcca

SEQ ID NO: 6815189 - DNA, 57 bp, Homo sapiens
tctctcctggattaagctgcctcagacctgagtgcagcaagtgaattccaagagaga

SEQ ID NO: 6815190 - DNA, 101 bp, Homo sapiens
tctggtgttgcacaaggcgattgttatcgctgaaagtctccttgcattcagcacagctatagggcttttctgcggtgtgaatggcctgatgtcgcatcaga

SEQ ID NO: 6815191 - DNA, 124 bp, Homo sapiens
agaagtacagaatcaggcattagattctcataggagtgctacccctattgtgaactgtgcatgcgagggatgtaggttgcaagttccttatgagaatctaatgcctgatgatctgtcactgtct

SEQ ID NO: 6815192 - DNA, 81 bp, Homo sapiens
aagctttgttggaaaagacagaattctagaatgttatgacgataaatcacattgttggaaattgtctttctctaaaagttt

SEQ ID NO: 6815193 - DNA, 84 bp, Homo sapiens
ctgttcctctgtcgtttagccagttgcccagagtagaaaggacaacttacttttcaagcagctggttattttactgaggggaag

SEQ ID NO: 6815194 - DNA, 58 bp, Homo sapiens
aaggcttgttatgatataaaatacaaatattttgggaaagagtaatataataagcctt

SEQ ID NO: 6815195 - DNA, 55 bp, Homo sapiens
ctgggctcagcaggccaaggccaggactaaggatgaggcctagctgtgggctcag

SEQ ID NO: 6815196 - DNA, 121 bp, Homo sapiens
tgggaactgcagtcatttgaaaagatagcaatcaagcatctctttcagagccctgttcatctttcagtggctttgcttctccagatgcttttgctccttcaattatctctgccttctccca

SEQ ID NO: 6815197 - DNA, 77 bp, Homo sapiens
cctagctacaaaattctctactgtttggtgctcagtaaaatagcagagtagcatcatggaaatagcatagctattgg

SEQ ID NO: 6815198 - DNA, 83 bp, Homo sapiens
ggaggccaagggaacagcatgtaagaagctactaacacaaaaaagagcttggagtagcctctcagcgtagcccctcagccttc

SEQ ID NO: 6815199 - DNA, 58 bp, Homo sapiens
ggcctctcggatgcatctggagtgttctggggctgggcaccaggcctcctgggaggtc

SEQ ID NO: 6815200 - DNA, 79 bp, Homo sapiens
ggtgcctgtaatcccagctactcgggaggctgagccaggagaatcgcttgacctcgggaggtggaggttgcagtgagcc

SEQ ID NO: 6815201 - DNA, 77 bp, Homo sapiens
ccgtcttcacctcctttctggggcttcagcacctgcaaggatgcttaggctggagaaacaggaggaggaagaggagg

SEQ ID NO: 6815202 - DNA, 80 bp, Homo sapiens
ttccaaaggtgctactgtgttcctcactttcagaaatactctaagttgaggagatgacagttctgtattttgacatggaa

SEQ ID NO: 6815203 - DNA, 67 bp, Homo sapiens
gctgaaaactgaggaacaaggaaggattctgagaggtcatctaatatctttcctgttttcagacagc

SEQ ID NO: 6815204 - DNA, 57 bp, Homo sapiens
gtggcctgccgtgtggtatggggctaggggacgccatcatgcggcatgtcaggcctc

SEQ ID NO: 6815205 - DNA, 59 bp, Homo sapiens
catggtttggagttagttccatgttctgggttcaaattctagctaactcactaactatg

SEQ ID NO: 6815206 - DNA, 74 bp, Homo sapiens
ccagaaagagctgttgtctgcttactgttcccatcttagcaggaggcagtatgactacaaacagcttttcctgg

SEQ ID NO: 6815207 - DNA, 114 bp, Homo sapiens
gcaaggtgtggtggcgcatgcctgtaatcatcccagctactctggaggctgaggcaggagaactgcttgaacctgggaggtggatgttgcggtgagccaagatcgtgccactgc

SEQ ID NO: 6815208 - DNA, 67 bp, Homo sapiens
ttggaaatagagccttgaaaggggcaattaaggtaaaatgaggccctcagaatgggctctaatccaa

SEQ ID NO: 6815209 - DNA, 102 bp, Homo sapiens
acacctaaggtactgacagcttgtataatgtacttgtatttggttgaattgtgtccaccaaaaagatatgttgaagccctcacacccagtacctcagaatgt

SEQ ID NO: 6815210 - DNA, 59 bp, Homo sapiens
gcagagtctgggcagcctccatccactggcttgcacaactgctgcccagggctctacgc

SEQ ID NO: 6815211 - DNA, 66 bp, Homo sapiens
ggtctctggcagcactaggtactgagctgtgggagcagtgttgtatgggatgactgctttagtacc

SEQ ID NO: 6815212 - DNA, 60 bp, Homo sapiens
ggcgcggcggtcagcgtgggagaggctgcaggccctgcacgcctctgcagctgccgggcc

SEQ ID NO: 6815213 - DNA, 64 bp, Homo sapiens
tattgcagtgtttcagtgctttttctctcccctggagataaaactgagcctgaacattctggta

SEQ ID NO: 6815214 - DNA, 67 bp, Homo sapiens
agtagatcagagtgggtctggcatgagcatgttaataaatgatttttgccatttctttctgagagct

SEQ ID NO: 6815215 - DNA, 115 bp, Homo sapiens
gcactaaatttttctccttcctcacagcttgggctttatcatgggtctggtgcctccaaaatggacctggccatggtacggagcagcggtggcacctggtggaagattctggtgc

SEQ ID NO: 6815216 - DNA, 78 bp, Homo sapiens
aggaagctccagaggatgcaggtgagggccaggcccagggcagagaccctcttgcctgtctcctggtttgatgctcct

SEQ ID NO: 6815217 - DNA, 71 bp, Homo sapiens
ggagttgtcacaggaaagggtgcaagggtgcagctccccaaccctgcacatatatcctgtgaacaaaattc

SEQ ID NO: 6815218 - DNA, 91 bp, Homo sapiens
gttcagggttatggtcagacagaaagatgagtatggcaagatcatttccttattatccttttgtttactttatctataaatgccactgaac

SEQ ID NO: 6815219 - DNA, 68 bp, Homo sapiens
tacaaaggcccttcggcttcctcagccccgctcagtgagtgttgtgaaggtcagcgaggggcctggta

SEQ ID NO: 6815220 - DNA, 70 bp, Homo sapiens
tgttgtgggtatttctagaaccaaaagccatcctggagattgggtggaggttctgggtgataccgaggca

SEQ ID NO: 6815221 - DNA, 72 bp, Homo sapiens
ctgggctgtcccagggcggcaggtcctttgcctcatgatgcaccccgttctgccgtgctgggctcagcctag

SEQ ID NO: 6815222 - DNA, 69 bp, Homo sapiens
tgtctggcactaaggttacagaaatgggtaaaacatgagcccagtccctgtggaacttagtgggagaca

SEQ ID NO: 6815223 - DNA, 76 bp, Homo sapiens
cccagattttcactccccatgttttctctcctagtcactcaactgcaggtgaaaattatgaggatgtatttctggg

SEQ ID NO: 6815224 - DNA, 83 bp, Homo sapiens
acccctcacccccagggcccagcagcatttcagtggattaaaggatcctgcttcacccaactttgggattgggggtcaggcgt

SEQ ID NO: 6815225 - DNA, 66 bp, Homo sapiens
gctgctgtgccccatctgcagatttccatttttaagatgcttcgggaattctcgcaggccagtagt

SEQ ID NO: 6815226 - DNA, 59 bp, Homo sapiens
gaaatgtgtgacaagtttcaatttcccgagaaggacattgattctattccacagatttt

SEQ ID NO: 6815227 - DNA, 85 bp, Homo sapiens
gacctgacatcctcccaaggttgggccctgctctgagttgctgtggggacacaactcctgaggtcccctgtggtagtatgtggtt

SEQ ID NO: 6815228 - DNA, 130 bp, Homo sapiens
agggaattttagctctgtagtcatcacatgcctgaacagagagtctacatatcttaaatgtagatccgaatcattgctcttttatcccgctaaatgctgattgcaaagaaatatttgggcattgttgact

SEQ ID NO: 6815229 - DNA, 126 bp, Homo sapiens
gttcaagatgcataaaacttaatgggaaaacttttaaagcctgaatttcagtacagaaaaacctttggaatgttctctacttgagattttaatgctgcttagaaatttctttaggacatctagaac

SEQ ID NO: 6815230 - DNA, 68 bp, Homo sapiens
ggtctgttctgttttgttttctcagacatgagatttgctgaatgagaaaactcaaagacagatcagct

SEQ ID NO: 6815231 - DNA, 99 bp, Homo sapiens
gaggcaggagaatggcatgaacccgggaggcggagcttgcagtgagccgagattacgccactgtactccagcctcggtgacagaacgagactccgtctc

SEQ ID NO: 6815232 - DNA, 80 bp, Homo sapiens
catatcacgtgatcacagatcccagcttaggtgcagtcattcgagccactgagcctgctgttctgtttagtgaacatatg

SEQ ID NO: 6815233 - DNA, 107 bp, Homo sapiens
ttcttaaccccaggtgaccactaatctgttctccatttttatgatttcatcatttcaagaatgttgtagaaatggagaacagattaatggttgccaggggataagga

SEQ ID NO: 6815234 - DNA, 58 bp, Homo sapiens
atatacactcaccatggtatttctgatgctttttgatggtactgtcttgagtgtgtgt

SEQ ID NO: 6815235 - DNA, 57 bp, Homo sapiens
agtgggcttttttccgttccatgtacttcatatggaaaagaattcaaaggctcctct

SEQ ID NO: 6815236 - DNA, 86 bp, Homo sapiens
gcccagtgcagggatggcagcaggagaaggtgccctcatgcaggagctgtgggcagctcctcctgtcatctgtctttgcccagggc

SEQ ID NO: 6815237 - DNA, 80 bp, Homo sapiens
aagaaccttttgatcaggttgctgtggtgtattagatccactattataaaaccatgctcctgatttagtgaggatttctt

SEQ ID NO: 6815238 - DNA, 74 bp, Homo sapiens
tgggagtgggggcagcatctcactttggttatatgtatgtccaaggtctttggagatagactgcatgacttcca

SEQ ID NO: 6815239 - DNA, 67 bp, Homo sapiens
tgatgatccaccaggtcaagttggttagttatgttagtaacataatactgtaacttggtgggtctca

SEQ ID NO: 6815240 - DNA, 99 bp, Homo sapiens
gaggcaggagaattgcttgaacgcaggaggcggaggttgcagtgagctgagacagcgccactgcactccagcctgggcaacagagtgagactccgtctc

SEQ ID NO: 6815241 - DNA, 75 bp, Homo sapiens
gttagcagacctccagggtctttgctgccctggtgacaaagggcacagcacagtggacccaggagacctgaaaat

SEQ ID NO: 6815242 - DNA, 75 bp, Homo sapiens
gcaagcctagagcctcatcctcaggacgactgctgggaatctctgcagggcccttggggttgaacagctgcttgc

SEQ ID NO: 6815243 - DNA, 82 bp, Homo sapiens
gattcatacaggctttgctcttaggggcaccaaataagatccaatacccaattaaatgagagtacagtctggttgtgacatc

SEQ ID NO: 6815244 - DNA, 96 bp, Homo sapiens
agcaggtgtctatttgaaaactttctagaccaagaggaccaggctagtacaaggcctttaggtttctcagagggtcccttggagtaggcatttgct

SEQ ID NO: 6815245 - DNA, 130 bp, Homo sapiens
tttagggcccagacaaagctctgctcttcagtacaagaggccacctgccctcccaatggacagtcctctattgggagggcaggtggcctcttgtactaaagagggtagggctgtgtctaagtcacttctg

SEQ ID NO: 6815246 - DNA, 68 bp, Homo sapiens
aggtcaccttctcctctttcggtgatggtttaaattttcttgaaagcatgagatggacataatgactt

SEQ ID NO: 6815247 - DNA, 58 bp, Homo sapiens
cacaagtaccagggattgccggaaccttcaggaggactttgggcttttactggacgtg

SEQ ID NO: 6815248 - DNA, 55 bp, Homo sapiens
ggcaaatgtacaaatatacttgtcttctgagacaccagtgtcctagtcatttgcc

SEQ ID NO: 6815249 - DNA, 64 bp, Homo sapiens
gccttactttttccactaatcattgtactgcagaaaggcaaagaatagtgagaagatgtattgc

SEQ ID NO: 6815250 - DNA, 83 bp, Homo sapiens
tcgcctaggctgtaggtaccctctcccctctttccttttactttatagaggtctatagaagggtagggacttatccaaggtga

SEQ ID NO: 6815251 - DNA, 59 bp, Homo sapiens
caagaatatatatggagtggagaattgagctttagaaatgccatttcatatgtattgtg

SEQ ID NO: 6815252 - DNA, 59 bp, Homo sapiens
gacaggctgatcagggctgggatggtggacacgcatcctctttaccctgatcactggtt

SEQ ID NO: 6815253 - DNA, 104 bp, Homo sapiens
gcagaataactgtcatttctacctcacagcattgtcacaaggctgcaatgaagtatgctggtgtgctttgtgatatgctgtgtctaaatttcagtcgttagtgt

SEQ ID NO: 6815254 - DNA, 59 bp, Homo sapiens
acttagatacttcttttaagggggtcccttcactctttttgaacaggagtatctatagt

SEQ ID NO: 6815255 - DNA, 61 bp, Homo sapiens
aagcttaagtctccttttatgatgacgcagagaagaaatggtagaggtgggatttgggttt

SEQ ID NO: 6815256 - DNA, 89 bp, Homo sapiens
ggaggttttactttgtcacccaggctgatgtgcagcggtgtgatcacagctcactgcagtcatcatctccctggctcaagtgaacctcc

SEQ ID NO: 6815257 - DNA, 64 bp, Homo sapiens
gctgccagcgtcagacctggggcttaccgaggacctggggtcagggacgctgtgctttcccagc

SEQ ID NO: 6815258 - DNA, 61 bp, Homo sapiens
tacagtgctttttggtggagaaggggcatgtgatcagtgtctctgtagagacagcactgtg

SEQ ID NO: 6815259 - DNA, 84 bp, Homo sapiens
aggaaggcatcagaggacctagttgggcaggggcctggggaagtagacctgcttgaatgactagctcctgctggcctagctcct

SEQ ID NO: 6815260 - DNA, 82 bp, Homo sapiens
tgaggacacagtgggatatcagggcccagtctgtgcatctctcattccagggaggccggggccctgaatccactgtccctta

SEQ ID NO: 6815261 - DNA, 63 bp, Homo sapiens
cctcaggcaggaaactgtcccgagctccctttggggagagccagacagtgcttctgagtgagg

SEQ ID NO: 6815262 - DNA, 63 bp, Homo sapiens
ggtcagaaggattctgggaaatgttaaataaccttgcctgtggagagtaccttttttttggcc

SEQ ID NO: 6815263 - DNA, 56 bp, Homo sapiens
tcccatttatttgctgctatagtctcataatgatacaagcagttatatgcatggga

SEQ ID NO: 6815264 - DNA, 55 bp, Homo sapiens
ggaaatcatctgattggctttctggcctatgcttccttcagttggactgatttct

SEQ ID NO: 6815265 - DNA, 59 bp, Homo sapiens
tcagggctagggaagttgagtgatgggttttttccaactgcttcttttctggcccatga

SEQ ID NO: 6815266 - DNA, 69 bp, Homo sapiens
gcttggtgtctgaaaatatgattttgcctggagaggatccaaggctgtcatctttgcaggcagcatggc

SEQ ID NO: 6815267 - DNA, 55 bp, Homo sapiens
acgggcagacagagctactcgcttcctaatttggatgagacttttgtttgctggt

SEQ ID NO: 6815268 - DNA, 113 bp, Homo sapiens
ggaggagtttcacgggtagtgctacagagggggagggcaagagaccagagatctaggtcaaccatccggcttatcctgctttgttcagagcagatccttgttgaaatgacttt

SEQ ID NO: 6815269 - DNA, 59 bp, Homo sapiens
ctcttccacctccttcaggagaattaaatgaatcaagactttggaaagacggggaagag

SEQ ID NO: 6815270 - DNA, 61 bp, Homo sapiens
agcctggggtttcagtttgcacccaagcaatagccacaaagtaagttgagattgccaggct

SEQ ID NO: 6815271 - DNA, 64 bp, Homo sapiens
ggcatctccaaaacatgaactcaactcccaagagctgtggtgatgttcattttatggcgatgcc

SEQ ID NO: 6815272 - DNA, 90 bp, Homo sapiens
caggatcttttccctgtccctggcagctgtcctttcagtggagattctctttctgggacatggtgctgtctttataggtaggaagaactg

SEQ ID NO: 6815273 - DNA, 69 bp, Homo sapiens
acacataggacatgctacataaataggtgtgtgcatgtacacgtgtgtgtgtgtgtgtgtttaattggt

SEQ ID NO: 6815274 - DNA, 78 bp, Homo sapiens
aaggtacagataatccaagtagttttcaaggttgtagagaatgccatttgagtaattttttggttttatttctacctt

SEQ ID NO: 6815275 - DNA, 72 bp, Homo sapiens
tgtctttaaaattaaacacatcggtcataactttaatgaaggtgtaaaagtgtttttagttttaaacaggca

SEQ ID NO: 6815276 - DNA, 77 bp, Homo sapiens
ctgaactgacaaagtctttcctttagtttctgctaggtcagacttggtgctaaatggaggagagtttgtcagtatag

SEQ ID NO: 6815277 - DNA, 67 bp, Homo sapiens
cttgtttatcctgccccagcctggaatttggcctcttacaaaatcccagctacaaaaggaaaacagg

SEQ ID NO: 6815278 - DNA, 87 bp, Homo sapiens
ggagcaaggccaggccctagggcttttgggcctgttcttcccgaggggcagcctaatcatgtcctcctggatctaatggccttgccc

SEQ ID NO: 6815279 - DNA, 57 bp, Homo sapiens
agcagctacttaacccatgacaaacctgccaaaacagagaggtcaaagtggctgact

SEQ ID NO: 6815280 - DNA, 63 bp, Homo sapiens
cggtgggcgggagcaagtaggggcactgggcggcccagagccagcccactgttcccgacaccg

SEQ ID NO: 6815281 - DNA, 115 bp, Homo sapiens
tcccacactaactggtgttctggggtgcacagcacatgaattgatgccaagtgctctcagatgtactaggaggaggtgcttggctccatttttggtgccctcagaggctgtggga

SEQ ID NO: 6815282 - DNA, 60 bp, Homo sapiens
atgcagatgaatcattgaggctgaatcatgttaacaataagcgttcaatgattaatgcat

SEQ ID NO: 6815283 - DNA, 64 bp, Homo sapiens
atgtgattaggcttcaggaacttgagatggagagataatccaggtgaacccagtctaatcatat

SEQ ID NO: 6815284 - DNA, 57 bp, Homo sapiens
tagaagctcaggaataggcatagaggtaagggattcctctattaatccagagctctg

SEQ ID NO: 6815285 - DNA, 68 bp, Homo sapiens
atgctcctcgagtgtctcacagacaagaaaactaattccttgggtataggtcaggcacgtgagagcat

SEQ ID NO: 6815286 - DNA, 56 bp, Homo sapiens
agcaggaggccaggtatgctttatccctgtgggtgcaagcccgtctgccacctgct

SEQ ID NO: 6815287 - DNA, 64 bp, Homo sapiens
agttttctagtatataactagatcttcctacaactaggaagattttacggagtattagggtatt

SEQ ID NO: 6815288 - DNA, 60 bp, Homo sapiens
ttcatgcttttaccgctgttaatcaactgtggggttcacagtatagtggcaggaaatgaa

SEQ ID NO: 6815289 - DNA, 58 bp, Homo sapiens
cttatttcctgacatggaaagatatttccagcatttttctatgttctaagggaaaagg

SEQ ID NO: 6815290 - DNA, 66 bp, Homo sapiens
cgtgccctgcgcaagtgctgctacggctactgcattgacctgctggagcggctggcggaggacacg

SEQ ID NO: 6815291 - DNA, 112 bp, Homo sapiens
tgggacaggcagttcatattaaggagtctgcatttttctctcagaagggcaatgggaagacttcggagagttggaagtagcagaaggacctgatatgacttgtgtgttacta

SEQ ID NO: 6815292 - DNA, 73 bp, Homo sapiens
ctttaggtgaacttcagatgggtagcaggcatccaccaggcagcttctgggcagttggaaatttcacctgaag

SEQ ID NO: 6815293 - DNA, 58 bp, Homo sapiens
gcccaggctggagtgcagtggcctgatgtcagctcactgcaccctcaaactcctgggc

SEQ ID NO: 6815294 - DNA, 61 bp, Homo sapiens
cttcctggcaactggctgcaggtgaggagggggacctgactcctggcactcagtgtggaag

SEQ ID NO: 6815295 - DNA, 55 bp, Homo sapiens
tgtaggccccattcctcaaagattgtaattcagtaagtttgaaggatggcctgga

SEQ ID NO: 6815296 - DNA, 65 bp, Homo sapiens
cttggtttgttattaagatccatgaaaaacctaatgtgtttcacaaatgtctttaacttgccagg

SEQ ID NO: 6815297 - DNA, 72 bp, Homo sapiens
tcctgatctgacttcacgcccatgccacagaactgtccccactgctttatgtggtgcgtgagctcggcagga

SEQ ID NO: 6815298 - DNA, 63 bp, Homo sapiens
ttggacaacggcaaaggaatgtagagattttggatcaaagcctcacagttttctgtagtccaa

SEQ ID NO: 6815299 - DNA, 66 bp, Homo sapiens
gttgttgaagcagatggtctggtcattgcctggactctccaaacagtaggccttctgctttaaaac

SEQ ID NO: 6815300 - DNA, 69 bp, Homo sapiens
gctgagaaggtcccgagataccaggctgactggaagctcccacacagcccatttctgggacctgagggc

SEQ ID NO: 6815301 - DNA, 55 bp, Homo sapiens
gccgtggggcgcccagccggagcctctgtcctctgcctgttcccgattccatggc

SEQ ID NO: 6815302 - DNA, 55 bp, Homo sapiens
ctgtggcttctaggtccccgatgtagaccaacaaatgacctgagcagagctatag

SEQ ID NO: 6815303 - DNA, 115 bp, Homo sapiens
cctgaatatggtccggtgggtctgctcctgctcctcccggttgatgatgcaggagaacagcccgaaggactcggcactggaggagcgggagcggccactcatgaagatgttcagg

SEQ ID NO: 6815304 - DNA, 74 bp, Homo sapiens
ttcttcagtcctttcaatggtgaccttttatggaggcaacaacaaagaatgtcaccagaagaaggagggaagaa

SEQ ID NO: 6815305 - DNA, 66 bp, Homo sapiens
gtgatcacagtattttagatgtgtctcttctgattgtaagacacatacccacaaggtctgtgaagc

SEQ ID NO: 6815306 - DNA, 56 bp, Homo sapiens
tggattattgagctgcttggaaagcaatagttgctgcctgtggctcttgtaattca

SEQ ID NO: 6815307 - DNA, 59 bp, Homo sapiens
tagatagatggcataaacagcatgactattctgtcctttctagtctttgctatctgcta

SEQ ID NO: 6815308 - DNA, 56 bp, Homo sapiens
gcagagattgtaatgatacctgatcagtcagtcaagttgtgttacagtctcattgc

SEQ ID NO: 6815309 - DNA, 130 bp, Homo sapiens
aagcagaatgtaacacacacaaaaaattcttcaacaatcctttattaagtgcctacaataaagtgcctcacatattgtaggcacttaataaaggattgttggagaattttttgggtgtaacattctattt

SEQ ID NO: 6815310 - DNA, 78 bp, Homo sapiens
ccctgctcaggaattctgaattaaggaggctttgaatgaacgaggctctactgaatttaaattccagatggggcaggg

SEQ ID NO: 6815311 - DNA, 65 bp, Homo sapiens
gtaccagcacattgatcagagacgcttgctgctgctagatgttttattctgtgtgttctttgtac

SEQ ID NO: 6815312 - DNA, 68 bp, Homo sapiens
tccataggaaatccatagaataaaattgcaggaaaagttatccagcaacaatctatggctcctacgga

SEQ ID NO: 6815313 - DNA, 103 bp, Homo sapiens
aatgctccctctttccctcactacttggatgtctcagcttgagctgcattttgaaaatgaagaaagagataaagacagcctagcaggaggaaggaaaggcatt

SEQ ID NO: 6815314 - DNA, 73 bp, Homo sapiens
acaagggcagagaccttgcaagtcttatacatcccttaaatgtatgagatattcccagcgtctacaaccttgt

SEQ ID NO: 6815315 - DNA, 65 bp, Homo sapiens
atgagatgcaatgtgacacactaccttgtggcattcttcccacaaatgtgtagcatatgcctcat

SEQ ID NO: 6815316 - DNA, 64 bp, Homo sapiens
gcttgaacccaggaggttgcagtgagctaagattgagccactgcactccagtgtgggtgatagc

SEQ ID NO: 6815317 - DNA, 55 bp, Homo sapiens
ttctgagagagcctctcatgtttccatagaaacccacacagagaatctctaagaa

SEQ ID NO: 6815318 - DNA, 97 bp, Homo sapiens
ggaaactgcccactcttgtaagatgttgctcagcgttcttgggacccaggaattcactgctccaaaggccctgagttcactttcaaggcttggttct

SEQ ID NO: 6815319 - DNA, 63 bp, Homo sapiens
cacaaggtctgtcaaactgtcagtgagagtttttacctctgactgcctgactttgacctgatg

SEQ ID NO: 6815320 - DNA, 102 bp, Homo sapiens
ttatatttctcagaatgaaagtgttgattttatagtgcattagagtttgttttcataacctgctttgctctttagatttaatattttctcactagtttataa

SEQ ID NO: 6815321 - DNA, 80 bp, Homo sapiens
cttaaatagcaaaatgtagacatatggtgaaacattttaaccacttctggttgaaactcagtatggtttagctaaatgag

SEQ ID NO: 6815322 - DNA, 78 bp, Homo sapiens
ctaaatctcccaaactcatttcttcatctacagtcacctccctgtatccctgaacacctgggtattgggagatgttgg

SEQ ID NO: 6815323 - DNA, 95 bp, Homo sapiens
atagtaatacacaatttaaatggtttaattatgtttaatgttccacagaacaatgaaactgtatatagactgtatgcttgatattggtattctat

SEQ ID NO: 6815324 - DNA, 61 bp, Homo sapiens
tcagctgggggccttacggaactccagggtgctggaggccccgttggtctccatttgcagg

SEQ ID NO: 6815325 - DNA, 63 bp, Homo sapiens
tagtgagtgctcagctgtgcacagtgtctccttaatgaatcacatgcaagccgagcatcgcta

SEQ ID NO: 6815326 - DNA, 74 bp, Homo sapiens
cagcggggcggcggggcctgtctgtgctgagcatccccagctccagggcaggtgctgggctctgagccccactg

SEQ ID NO: 6815327 - DNA, 62 bp, Homo sapiens
ttaggaccacattgagagtcattaacaaaaagggacaagttaaaactataaatgtggcttaa

SEQ ID NO: 6815328 - DNA, 73 bp, Homo sapiens
tccagccggttaatgagggggatgggaaagtgtttgtacacgacgtctttctcttcaatgacaatcaggcgga

SEQ ID NO: 6815329 - DNA, 73 bp, Homo sapiens
gcattcctgctctgccaagtcctctttcttcacaacacagctgggaggagaatgaatggggagaagagaatgt

SEQ ID NO: 6815330 - DNA, 58 bp, Homo sapiens
caaccagttggcaaccagcagttggactgccaattgtggaaattttgtggactgtctg

SEQ ID NO: 6815331 - DNA, 60 bp, Homo sapiens
agccctcccagtgcctccagagcagcaggggaatgtggtggggtgggtaagggagatgct

SEQ ID NO: 6815332 - DNA, 63 bp, Homo sapiens
gcatggccatagccttatagcaggacctttcataacagtccttttatcccctaattggcctgc

SEQ ID NO: 6815333 - DNA, 86 bp, Homo sapiens
gctggcgcgaggtccctgagtcagcggcgctcccgcccgcgcgaatcgctccgccccagcccgcgggctcggctcctcgcacctgc

SEQ ID NO: 6815334 - DNA, 86 bp, Homo sapiens
gggggagatctctagggcgcacgccgtgccccacttcccccttacgggaaaggctttccagcgcgcggacccaggagactctcacc

SEQ ID NO: 6815335 - DNA, 81 bp, Homo sapiens
ggagtagctggctggaggaatcacagaaggcttcctggaggaagtggctttgagcttctgccatctccatgcagctactcc

SEQ ID NO: 6815336 - DNA, 60 bp, Homo sapiens
ggcggcggcccgggaccgagcaccagcacgtaagccagctccaggcccacggccgcggcc

SEQ ID NO: 6815337 - DNA, 70 bp, Homo sapiens
acacacgtgctcacacatatgcatgtgcttgctcacacctgtgtgtacacacatcgtttgtcatgtgtgt

SEQ ID NO: 6815338 - DNA, 55 bp, Homo sapiens
gtgattctgcctggaaggtcctggagtcacaggacttaaaaccagacagcgtcat

SEQ ID NO: 6815339 - DNA, 61 bp, Homo sapiens
cacagagattagaattagactaaattaaatcaaagtctcctatttgatctgattctctgtg

SEQ ID NO: 6815340 - DNA, 58 bp, Homo sapiens
aggaatgtctgagaaagaggcactggactgcctgccttgaaaaactcagctgtctcct

SEQ ID NO: 6815341 - DNA, 74 bp, Homo sapiens
tgtctcctgggatgctgtggggttgaccctggatagcattcacggtcattagctcatggtgttcttgggagaca

SEQ ID NO: 6815342 - DNA, 69 bp, Homo sapiens
ggtgactattggttcttgctgctgacaaaaaatattcctcagctcaaaccagccagaactagtgtttct

SEQ ID NO: 6815343 - DNA, 63 bp, Homo sapiens
gctcctgtaaataactttcattttttaatatgcttacagaaagaaggtgtatttgagtggagc

SEQ ID NO: 6815344 - DNA, 69 bp, Homo sapiens
ggcagggcttgcgtttaaattaaagtaagcctgattccaaggccctgctcttctgactcaagctttgtc

SEQ ID NO: 6815345 - DNA, 59 bp, Homo sapiens
gacatgccaagcttcagctgaaactcaagcctcatgcagttttctctgcttggaatgtt

SEQ ID NO: 6815346 - DNA, 70 bp, Homo sapiens
ctgggcaaagatatgaattatttatccagttctaacaacgaactggcttgaagtagattcaaatccccag

SEQ ID NO: 6815347 - DNA, 80 bp, Homo sapiens
ctaagggttaattgactttgttgttccttgtctaaagagactttgttcaaggaatagtaaatgaatacatggaccctagg

SEQ ID NO: 6815348 - DNA, 77 bp, Homo sapiens
agtgctatcgagttctaatgctggctctccttatttcacagtggcaattagcacagcttttaggtggaaatggcact

SEQ ID NO: 6815349 - DNA, 61 bp, Homo sapiens
tcatctctgttagtaggatataaacagtttaagttgttagatattcattaataggagaaga

SEQ ID NO: 6815350 - DNA, 62 bp, Homo sapiens
gatgcctcagcatacgtgataaaaaagattacccccaatgatgtcatgtttttccaggcatc

SEQ ID NO: 6815351 - DNA, 64 bp, Homo sapiens
gctgttggcagggctgcattccttctggatgctccagggaggatctgctccttgtcttttatgc

SEQ ID NO: 6815352 - DNA, 87 bp, Homo sapiens
tcagcaagttcctaagctgtggccctggatcccttcactccatactcttcagggaggtgtcaaaggtggtcaagcttgggaggctga

SEQ ID NO: 6815353 - DNA, 68 bp, Homo sapiens
gcttgaacccaggaggcagaagttgtagtgagccgagactgtgccattgcactcctgcctgggcaagc

SEQ ID NO: 6815354 - DNA, 101 bp, Homo sapiens
tgaggcaggagaatcacttgaactcaggaggcggaggttgcagtgagctgagatggtgccgctgcactccagcctgtgcaacagagtgagactctgtctca

SEQ ID NO: 6815355 - DNA, 73 bp, Homo sapiens
gcctccacctccccagcactaccagaagccagaaaaacatgtttggccagactgaggtgctgggaaggagagc

SEQ ID NO: 6815356 - DNA, 63 bp, Homo sapiens
ttcttgttttcctgtttcttgcaagcccttgacaaatggcagctaggggcagggaattcagaa

SEQ ID NO: 6815357 - DNA, 80 bp, Homo sapiens
aatatcagggaactgtacaggagacgtctgtgcactacccctccgaagaacccaatggtgcacctgtagtccctgatatt

SEQ ID NO: 6815358 - DNA, 63 bp, Homo sapiens
tggcactgcactttaagatttagctcgtgtttgattcaagattaagttttacagtgtttgtca

SEQ ID NO: 6815359 - DNA, 57 bp, Homo sapiens
gtagataactcattttgtatatccattcatcagtaaatggacatttgagttgtttat

SEQ ID NO: 6815360 - DNA, 58 bp, Homo sapiens
gatgcctgaatgatcagtcagattctcatctggaaatctgaaattcaatcagggagtc

SEQ ID NO: 6815361 - DNA, 66 bp, Homo sapiens
tgagggaccctgcagagctgaatgtcggtgaaagtgatgctcagctggtgccagggtccaagctca

SEQ ID NO: 6815362 - DNA, 77 bp, Homo sapiens
agcagctttaaaccctccagcctcagatgacggtactggtactttggtattgaagcatcttggtggattaaggttct

SEQ ID NO: 6815363 - DNA, 68 bp, Homo sapiens
tctgggagcagatgttgaatagaataagtatagtacctcaagatatttgctaaatgtttgtttccaga

SEQ ID NO: 6815364 - DNA, 70 bp, Homo sapiens
gtgtctttaacaaggactaaggaacagctgattcattcatgcattgaactgtttttaagtcctaagatgc

SEQ ID NO: 6815365 - DNA, 119 bp, Homo sapiens
gtatattaaagggaatgcataagattcaaatgagggtgcatttagcatgtagagggaatgatcgattccactatatgcctgtgcagtctttgtaattttcaaaatttcattcaatgtgc

SEQ ID NO: 6815366 - DNA, 60 bp, Homo sapiens
tagagcagagttctgccaattctggttcgaatgaaacaggcaatttaggactcttttctg

SEQ ID NO: 6815367 - DNA, 91 bp, Homo sapiens
ctagaactcccttttatgtcatatatacatgtgtgcatgcatgcatatgtgtgtctatgtatacatgtgtatataccatgctctaatctag

SEQ ID NO: 6815368 - DNA, 63 bp, Homo sapiens
gtcttgggcacctttctatattcagtggctcagaatacctagctcacagagggtgcttaatac

SEQ ID NO: 6815369 - DNA, 84 bp, Homo sapiens
ttctctataatacaatgctatgcaatggcacatgacatgattgcagtgccatgatgcagagcaatgtcttgcggtctcagagaa

SEQ ID NO: 6815370 - DNA, 61 bp, Homo sapiens
gctgatcttcatgcactagtggcctctggattggctggtatacagtgcatggggggacagc

SEQ ID NO: 6815371 - DNA, 73 bp, Homo sapiens
ccagccgggcctataccttgagcagggcggcccccacgacaggacaggagcagccctgagggtgccaagctgg

SEQ ID NO: 6815372 - DNA, 102 bp, Homo sapiens
tgattttgttcctagaagggagagtattttcaaattcagcagaaaagtcaggagtgaagatttgctgtcatggaggtaacttcctctctagtaattggatta

SEQ ID NO: 6815373 - DNA, 62 bp, Homo sapiens
tgtggagtggtctgaaggctcccatggcctttccttgctggggtcttcaggatgacttgata

SEQ ID NO: 6815374 - DNA, 96 bp, Homo sapiens
tggtaaactgtgtgaatactctaaaattagctcttggcagtgcttcttaaggtatagcacggtagttaagaggatgttaggggcacacgcatacta

SEQ ID NO: 6815375 - DNA, 74 bp, Homo sapiens
cctataaatcattcaagcccatatgtgtgcatgcatatgacacatcaaatgccatatatggttgattttctagg

SEQ ID NO: 6815376 - DNA, 71 bp, Homo sapiens
ctacccgggtccgccgtcccctaggaaagagctccgacgattggagctttgggggccggggatgggggtgg

SEQ ID NO: 6815377 - DNA, 58 bp, Homo sapiens
gcccacagtacgaggctcaggcatgtaataattaacatagccttggtacctctgtggc

SEQ ID NO: 6815378 - DNA, 62 bp, Homo sapiens
ccaatcagttagaaggaagagaatattaagctcaaatattccccttctgcctacgctgaagg

SEQ ID NO: 6815379 - DNA, 118 bp, Homo sapiens
aagaacctaaaagttatatcaataatgggagcttagctgtaaaattttttttagactggaagtatacctaagaaaattttactggtgtttcctttggattgtgggagtataggttttt

SEQ ID NO: 6815380 - DNA, 58 bp, Homo sapiens
ctgaggtgctagggtccctgctggccaaccctgccatccagagactgggcaccagcag

SEQ ID NO: 6815381 - DNA, 56 bp, Homo sapiens
gactgggtcccacagcctgctggggtgagcccaggatggctggagggccttttgtc

SEQ ID NO: 6815382 - DNA, 58 bp, Homo sapiens
ggccagaggacctctcatagcccttttaggttgtggatggaccttccttctgttggcc

SEQ ID NO: 6815383 - DNA, 70 bp, Homo sapiens
ctcacaaaaattttatcttcattcctatctacaccaaaagggtgcagagattggaagatgaatttgagag

SEQ ID NO: 6815384 - DNA, 74 bp, Homo sapiens
acacatatataagagcattctggctttttacagcagactttaaaatttgaaggccagacttgagtgtatgttgt

SEQ ID NO: 6815385 - DNA, 72 bp, Homo sapiens
gtggttgaggacatgctgaataactatatgaatctattttcttttatatggaataagtatgttaagtgccac

SEQ ID NO: 6815386 - DNA, 61 bp, Homo sapiens
gcctttgaatgcaggacatacagaagtgacatctcactgctggatgtgctgattcactggc

SEQ ID NO: 6815387 - DNA, 76 bp, Homo sapiens
tagtacagtggagagcaaagaatacaggccttggatttacacatccaggatcatatcttggctctgccacttatta

SEQ ID NO: 6815388 - DNA, 78 bp, Homo sapiens
gcacagacttcgaatataactatttctgagctttgaggacttgagcaagaaatgttacagttgttatttgaaaagtgc

SEQ ID NO: 6815389 - DNA, 78 bp, Homo sapiens
agtggtctgcagtttggaaaatgtgcctctgggatttcagtttgttctatagagttgtgcccatgactgcagatctct

SEQ ID NO: 6815390 - DNA, 94 bp, Homo sapiens
aaggggcccctttctttcatacctgttaaaatggctattataaaaaaagatggaagacaagtgttagcatggctgtggagaaaagggaaccctt

SEQ ID NO: 6815391 - DNA, 122 bp, Homo sapiens
agaggagaagaatggggcacaaggcggttaagtaacttgcttagagtcacacagctggtggcagagctgagcagtctgactcaagctagtgctcctgaccactgcatagtgacccttcctct

SEQ ID NO: 6815392 - DNA, 69 bp, Homo sapiens
actgaaaaacttgctgcttgcttacagaatgaatagaagtgaatgtactagaagctgtaatttttcagt

SEQ ID NO: 6815393 - DNA, 66 bp, Homo sapiens
cctaagcacagttcttagagttacattcaggagggaggaatgtaacctgactgctttgctctcagg

SEQ ID NO: 6815394 - DNA, 75 bp, Homo sapiens
agataacatgatttgctatttagatatcagagatagaaatgcgtaggctgggatcaaagtggaaatcaattatct

SEQ ID NO: 6815395 - DNA, 62 bp, Homo sapiens
ggcccctggcagtctgcctcttcactgtagctggctgcaagtgtagagaagagttgctggcc

SEQ ID NO: 6815396 - DNA, 90 bp, Homo sapiens
gaactatttggtcatggcacagatgttctgattattacaggaattgtgtccttaattaaatttgtactctagtgccaattcaaaaagttt

SEQ ID NO: 6815397 - DNA, 77 bp, Homo sapiens
ggatgtcctagtttacatgcagaaaatcaatgttcctgggctcttgtgggactctgagaagcctgtaaagggcgtcc

SEQ ID NO: 6815398 - DNA, 56 bp, Homo sapiens
ctgtggcacatgtggcaaggccttcagtcagggaccaagcctagtcgtgcacacag

SEQ ID NO: 6815399 - DNA, 81 bp, Homo sapiens
acactgttctagttaaagtatgtattagccaaaatcataaactaagtatgcttcaccataaattaactgggtgtttagtgt

SEQ ID NO: 6815400 - DNA, 96 bp, Homo sapiens
gggctctccagcacacctggatgtggaggtgtgatgcagagtggtggctgctcgtgacactcatttcacccctttctgtgcaggtgccagaagccc

SEQ ID NO: 6815401 - DNA, 88 bp, Homo sapiens
gggccaggctaagggtggctcagttccatcatctggaggtcagacacactgtccagaggcagaactgaagccctctcggcccctaccc

SEQ ID NO: 6815402 - DNA, 69 bp, Homo sapiens
gggaagggacttgtttaaggtcatatggaaaatttcctggctaggcctggagcaggtcttcagattccc

SEQ ID NO: 6815403 - DNA, 119 bp, Homo sapiens
aggaaaggggacatatgtttggcttccttcaaggcagtattcaaagaagcctgtaggcagtgagttacaggagtttaagaaatatttcctaagggaaactatgaaggtctttatttcct

SEQ ID NO: 6815404 - DNA, 69 bp, Homo sapiens
ggtttgccttcctgcccagcttctgtgacccagggggcagctggacggctgggcaggggtctggggacc

SEQ ID NO: 6815405 - DNA, 67 bp, Homo sapiens
tgctaaaagtcttgatccagatgaaaactccgaattgttctggcattgcattaaggctttgatagta

SEQ ID NO: 6815406 - DNA, 91 bp, Homo sapiens
aaagaggtggtgtacagaaaggccactgcaagggaaggttggcttattttaaacttctctgaagtgacctgttcatggattcattctcttt

SEQ ID NO: 6815407 - DNA, 75 bp, Homo sapiens
tatgaggtctaaagaatatagaggtctctaggattgaacttaatttactgtctgtacttcttgcaaggcttcatg

SEQ ID NO: 6815408 - DNA, 79 bp, Homo sapiens
acctaaaatcttctctctgctgctccagcagcaccaacctgctctccccagtggcacagcagagagcagacctttgtgt

SEQ ID NO: 6815409 - DNA, 65 bp, Homo sapiens
ggtgcttttgttgtggttttagtatcagcactatagaacagatacactgactgggacagaagacc

SEQ ID NO: 6815410 - DNA, 64 bp, Homo sapiens
agggctgcaatggtagtgactcccccagggctgcctcagcccgcatctcgctaaagatagccct

SEQ ID NO: 6815411 - DNA, 65 bp, Homo sapiens
gtggctggaactggggatgtttacaatgctgttcactgtggtttaatttccatttccttggtcac

SEQ ID NO: 6815412 - DNA, 67 bp, Homo sapiens
aggaggcattctgacagtaatcagtttgctgctaagcagcactggtttttggcggaagtattctcct

SEQ ID NO: 6815413 - DNA, 103 bp, Homo sapiens
agaggaagaggctggagcgcaggaggtagctggtgctgggctcctagtcttggcagaggagcccaaagcacttggctgccctgcgtgtcactcatctcccttt

SEQ ID NO: 6815414 - DNA, 64 bp, Homo sapiens
gacatgatttactaaaatttgtttagtgtaattcattatgcaagttatatagatgaatcatgtc

SEQ ID NO: 6815415 - DNA, 70 bp, Homo sapiens
ccactgcttcttaatacctattttctaccagtaccatgaaagtacaatggtgaactgttgagaagcatgg

SEQ ID NO: 6815416 - DNA, 59 bp, Homo sapiens
cttattgcctctgcggagctgtacatcaaaatattttggtgccccctagaggtaatcag

SEQ ID NO: 6815417 - DNA, 57 bp, Homo sapiens
aagggagagaggtcaaggtggggactcccgcaagcccaccctggccgactgcccctt

SEQ ID NO: 6815418 - DNA, 85 bp, Homo sapiens
atgcaagtttttacagattgaggtttttaatatccagttttgctttgtgtatggatgttttagagcatagtttgtaatcatgtat

SEQ ID NO: 6815419 - DNA, 94 bp, Homo sapiens
acttacaataggattaagtttggataaactcactgtaagttgaaagtgaattttcaacttacaataggtttatggggacaacactgtcataagt

SEQ ID NO: 6815420 - DNA, 73 bp, Homo sapiens
cttcacatataaatacaacatgtgttaaaggactaaatttctagtgtcacagtttgtactttatagtttgaag

SEQ ID NO: 6815421 - DNA, 111 bp, Homo sapiens
ttacctctcttgatctggtctgatactgttggtttaaaatgctgatttgggattattcttagccaaagtagccaaagcacagcattgtgttgactgtattttgggaggtaa

SEQ ID NO: 6815422 - DNA, 67 bp, Homo sapiens
gggctttctgagtcaaacactgaaaagctgaacattttcagtctttaaaagctcaggaactgggccc

SEQ ID NO: 6815423 - DNA, 59 bp, Homo sapiens
ggtcatgtgccaggtagtgagctgagagtggcagaaaggaggctgcgtgggatgtgacc

SEQ ID NO: 6815424 - DNA, 56 bp, Homo sapiens
gaggcaacaatgatggtgtgtatcaaagcagtgatattaaaccagctttgttcttc

SEQ ID NO: 6815425 - DNA, 90 bp, Homo sapiens
ctctacctgcctggcaggactgttgtaagaaataaatgaaatcatatatgtaaagtattcataaaagtacctgacagagtagaaaaagag

SEQ ID NO: 6815426 - DNA, 56 bp, Homo sapiens
gtgaataaagggagttttcaaattatgaatatatgatactccaaaactttgttcat

SEQ ID NO: 6815427 - DNA, 75 bp, Homo sapiens
cacctaactattccattccatagtagaaaatgggacaccattccatagtagaaaatgggacaggctagtttggtg

SEQ ID NO: 6815428 - DNA, 101 bp, Homo sapiens
gcttccattactcacagagaactaggtggttataaattcaaggctgttggctatgaatatccatgatcagcatttcgattaggcctttggggcaatgtagt

SEQ ID NO: 6815429 - DNA, 75 bp, Homo sapiens
ggatgtatttctttccattatagtcagcgaaatatgacatacacttcaactggctgagaaaaaagagctatatcc

SEQ ID NO: 6815430 - DNA, 63 bp, Homo sapiens
tgctcaatacttaagcttaattctacttttacttgctaaggtggaatgtagcaagtgttgtca

SEQ ID NO: 6815431 - DNA, 80 bp, Homo sapiens
gttacttctgagttgttttgctttttttggacatggactttcaacttctaattcataatgacaaacatactcagtgtgat

SEQ ID NO: 6815432 - DNA, 113 bp, Homo sapiens
cccctggagagcttgtgaaaatacaaattgccgggccctgacctcagagtttctgattcagtagctctggggtggggcctgggaatttccatttctaacaagtttccaggtgg

SEQ ID NO: 6815433 - DNA, 55 bp, Homo sapiens
gtcagtctcctgccttttggacactatatgcatgcccaggtggcagggaatttac

SEQ ID NO: 6815434 - DNA, 91 bp, Homo sapiens
tgtaaactgtgttctggaattctggctatggtatgtatcaagctacataaacaacatgccatctcgtctctccacgtaacacagaggtaca

SEQ ID NO: 6815435 - DNA, 115 bp, Homo sapiens
agggttgaagtagattttttccacaaggaagatgatgagcactggagtcaaagggatgcagttcaaatcccagctctgttgctttcttcctgtgtgattttggatgagtgaccct

SEQ ID NO: 6815436 - DNA, 56 bp, Homo sapiens
tgggccagttggtgactacaaactatcttgggcctgtcctcactcttcctggctca

SEQ ID NO: 6815437 - DNA, 69 bp, Homo sapiens
gtggcaaggagcatgaaaagtccataaacagaatgattatataccactgcttcatgcccaatttgctac

SEQ ID NO: 6815438 - DNA, 72 bp, Homo sapiens
tttgtaaaaaggtaaatttatagttgaattatttgtataggtaagtcttatgtgatttatctttcttgcaaa

SEQ ID NO: 6815439 - DNA, 73 bp, Homo sapiens
ccctacctcaccccattcttcatggtttcctgtgatccacagattgaagtccagaatggcttggtgctttggg

SEQ ID NO: 6815440 - DNA, 60 bp, Homo sapiens
tttcttgtaaagtcaatgatttctcctggagtgattttattccttcattggcataagaaa

SEQ ID NO: 6815441 - DNA, 82 bp, Homo sapiens
acttgggttgactcatacctgcctgacccaaagcacatccttctgggctgaaagggcactggtaggtttggacagctcaggt

SEQ ID NO: 6815442 - DNA, 85 bp, Homo sapiens
tagcttcttgctgtttgtgctcttcaagggattatcagagttgagccccacatctggagcagcattcatccagcagtcgaggcta

SEQ ID NO: 6815443 - DNA, 58 bp, Homo sapiens
agtggggaagattttgcagtcattcagtcattcaatgactacatcatggtcacctact

SEQ ID NO: 6815444 - DNA, 57 bp, Homo sapiens
caggggcctggctgtctaggaagggttcagaaggcacacccaagactcaggcccctg

SEQ ID NO: 6815445 - DNA, 75 bp, Homo sapiens
atgaaatggtgcataggaatgtgatttataaatgctaaagggtggcataaatggacgtttttgttatcattacat

SEQ ID NO: 6815446 - DNA, 73 bp, Homo sapiens
cccagcgtcatcacggcaagcatctcctcactcaccagccttggagtcggacttgttttgtggtgggctgagg

SEQ ID NO: 6815447 - DNA, 59 bp, Homo sapiens
acagtgctatcaatagctagaagttaaattaaatccttcattgctagtgagcttactgt

SEQ ID NO: 6815448 - DNA, 55 bp, Homo sapiens
cttaaaatattgccgaattgttctgaaataaagtgacttttggtaatatattaag

SEQ ID NO: 6815449 - DNA, 66 bp, Homo sapiens
ccctgcactggaaccagccttctgtgattccggctgccacacgcaggagctcgtttccaggctggg

SEQ ID NO: 6815450 - DNA, 83 bp, Homo sapiens
gtgaataagcaatgttttggtgagaaagtttatctggcaaaagataggatagacatttgaatgtgaaatgattgcttattcac

SEQ ID NO: 6815451 - DNA, 61 bp, Homo sapiens
tatccattatgttggctagtctacatccctgcaggtgaaggatgcttttcagtgatggatg

SEQ ID NO: 6815452 - DNA, 64 bp, Homo sapiens
gtggtgactcacagaatctctgataagtctggaaatccaggcttggaggttctgtagccagcac

SEQ ID NO: 6815453 - DNA, 130 bp, Homo sapiens
gcatcctcatcctgagcgtagcagctgcaaggggccttacacagaacggataatcaatattcattgtaggttgaatgatggtgtgttcttgccttttccagtccgttttgttcgttagagaaaaggatgc

SEQ ID NO: 6815454 - DNA, 85 bp, Homo sapiens
cctacccgcatgtggtgccgagttccagccgccctgagtccccaaggcccagcctggagcttgttgtgcactcagtgggggaagg

SEQ ID NO: 6815455 - DNA, 79 bp, Homo sapiens
gcggggaccacgtggaggggcctggtcagcaagtggcaaggacgcggcgcaaagccaggctttctaatgtacaatccgc

SEQ ID NO: 6815456 - DNA, 59 bp, Homo sapiens
ttccagtccagggctgtttccacgacgcacagtctgtggtcttagcgtttggtttggaa

SEQ ID NO: 6815457 - DNA, 76 bp, Homo sapiens
aaatgggttccactgggttacagtccaagtgcctgagggtggtatcctttccgaaggcagtaagccaaatccattt

SEQ ID NO: 6815458 - DNA, 57 bp, Homo sapiens
gccagagctgagtgaggttcttcataacacccaagaacgaatgcttcagctctaggc

SEQ ID NO: 6815459 - DNA, 67 bp, Homo sapiens
aattagctaggaaattttgtgtctctttcaatcaattattctttgaggccaaagactccagctaatt

SEQ ID NO: 6815460 - DNA, 57 bp, Homo sapiens
tgttgggcagaggccaggaggatgctccatggtatctgacaaaccctgtgcccagca

SEQ ID NO: 6815461 - DNA, 89 bp, Homo sapiens
cataattgcctttgtatttttctccccttatccccaactgacagtgttttaattaaaagttgaggggagagaacataaggaagtctgtg

SEQ ID NO: 6815462 - DNA, 60 bp, Homo sapiens
gtgtgtgtgcgtgtgtgcgtgtgtgtgtgtgtgtgtgtgtgtgcacccatgtatgcatgc

SEQ ID NO: 6815463 - DNA, 69 bp, Homo sapiens
taggctctttctagttcttacatgatgtgagtctatataatgcacatttgaaggaattagcattgccta

SEQ ID NO: 6815464 - DNA, 65 bp, Homo sapiens
tttctgcgttttgacatttcggggcaatgtcctgagcagcccccaaatgataacaatgacaggaa

SEQ ID NO: 6815465 - DNA, 88 bp, Homo sapiens
ggagtctcgctctgtcacccaggctggagagcagcagcgcaattgtggctcactgcaagctcagcctcccgggttcaagcgattctcc

SEQ ID NO: 6815466 - DNA, 72 bp, Homo sapiens
tggctacagtggcatatcaaatttagcttaaagtaataaaagaaacatgaaatttcttatgccctatagtta

SEQ ID NO: 6815467 - DNA, 74 bp, Homo sapiens
cgggcaggagccagacaggctagagcgggctgcaagttccggggcccggctggaagcctgatggttagagcctg

SEQ ID NO: 6815468 - DNA, 81 bp, Homo sapiens
aggaaatgtcaaattgtcttctgaagttattgtacaaatttgtcaccccaccggcagtgtataaactttaacatagttcct

SEQ ID NO: 6815469 - DNA, 56 bp, Homo sapiens
ctggcctttagccccagtgtctcttcaaaggaagagacgcttttataaagactcag

SEQ ID NO: 6815470 - DNA, 57 bp, Homo sapiens
catgcatgtttatagggtgcttcctgacacccaggaggcactcaggaaatgtgagtg

SEQ ID NO: 6815471 - DNA, 90 bp, Homo sapiens
agatctttacagaaattatttagaaatcgattgaaacgggttactttaagattttcaattttatttctaaagagtggtaggtgaaattct

SEQ ID NO: 6815472 - DNA, 96 bp, Homo sapiens
caggtcagtggtgctgagaggcttctgtttcttaaaggtgctcttctagttgattgtaaggggcactgccagaagactttcagcttgaatggcttg

SEQ ID NO: 6815473 - DNA, 75 bp, Homo sapiens
gcagctctgtttcaaagtcagaaaaggaggctcagctgttgtttttgcttcaagctgatttagagacgagaatgc

SEQ ID NO: 6815474 - DNA, 67 bp, Homo sapiens
gtgagtcaagcagaaacgtggaatataagtacatccccacttccacgaagtcccgaagcttgattac

SEQ ID NO: 6815475 - DNA, 75 bp, Homo sapiens
atcaaaagttttgcagataagagcgtggacactttatacattttccatgcaatttctgtaaaaccaacatttgat

SEQ ID NO: 6815476 - DNA, 123 bp, Homo sapiens
tgcacacacgcaagctttctttagtctagaaagcacattgctaggctcttcctcaggaaatgctgattcctgtctaagggaagatgcaatgtctgctataaagaatatatgtatgtgtgtgta

SEQ ID NO: 6815477 - DNA, 65 bp, Homo sapiens
gagtgtgacctcatcttaactggaacccatctgcaaagatcctatttccaaagaagttcacattt

SEQ ID NO: 6815478 - DNA, 84 bp, Homo sapiens
ggatgctttatgttctggcatttttgtcttcttttctgaagtgaacatacaagatggcatacatttccaaagcagatcaattcc

SEQ ID NO: 6815479 - DNA, 73 bp, Homo sapiens
ttttatttcccagagattggcttgctggacatttgtatgatgatgcactctgcttatactctggagaataaga

SEQ ID NO: 6815480 - DNA, 63 bp, Homo sapiens
caccgtaggtgcttaataaatgtatcagagaacagggaagatttttattgagcacgtactgtg

SEQ ID NO: 6815481 - DNA, 81 bp, Homo sapiens
tcattagcaccacaggagagagttgtagtagcctttgattaatctataatctaccactattgcaatattctttgttaatgg

SEQ ID NO: 6815482 - DNA, 71 bp, Homo sapiens
gctgcctccaagaggtgtgagccctctgtctcggggatgaacaagcagagtctgggctacctcttgacagc

SEQ ID NO: 6815483 - DNA, 55 bp, Homo sapiens
gtgaggcttgtctcagatggggggctcatctcttcctgactacacggcactgcac

SEQ ID NO: 6815484 - DNA, 63 bp, Homo sapiens
ccctgtacagctcatttgtaaaacggaggcgtctacatctgtcctgttgggttgttgcaaggg

SEQ ID NO: 6815485 - DNA, 63 bp, Homo sapiens
tgaaatggtccatcctaaagaagttggacagtcttagttcatttcccactggactataattca

SEQ ID NO: 6815486 - DNA, 74 bp, Homo sapiens
gggaaccaaatggaaagagcagaagctttatccagaaggtcttgggcttctgctcttttggtgctgggaagcct

SEQ ID NO: 6815487 - DNA, 63 bp, Homo sapiens
ccctttaaggtctgattttcagcagggcagagagacttcttttgaaagttaggatttagctgg

SEQ ID NO: 6815488 - DNA, 75 bp, Homo sapiens
caatatttctctcagacatggaagagagagttgaccataaaatttggtggtccttttattttggagaaataggtg

SEQ ID NO: 6815489 - DNA, 76 bp, Homo sapiens
gaaagggaaaagtaagatttatgctataaactctaggtcattatgagctaatgatttaatgtagtatttcccatgc

SEQ ID NO: 6815490 - DNA, 109 bp, Homo sapiens
tataaagtagcttgtaaagacaagtaattggacccagaaggtggcctctgtcacaatctaagcaagtgatggcctggctggttcagtaccctttgcaccctgcttttta

SEQ ID NO: 6815491 - DNA, 116 bp, Homo sapiens
gaatgaacaaaatacttaagaatagaaagaacagatgtgtggtgcatttttatttcaaaatcaccattgaaaaacaggtttgatttttgcttgtttgaaagttggttggcttattc

SEQ ID NO: 6815492 - DNA, 55 bp, Homo sapiens
ccagaggtggtgggtgctacaggagagggactccagcaagcttctcatcctttgg

SEQ ID NO: 6815493 - DNA, 95 bp, Homo sapiens
tgttttaatttgtatacataattgcctaataatcatcctggttcacctctgaacagtttgctttaagaggcactggtgttatataaaaatataca

SEQ ID NO: 6815494 - DNA, 86 bp, Homo sapiens
gtctttgaaggtgatgatttatgaagtgaccacattgaatcttctcttggaataagtgtttatggaatcttagttatctcaaagat

SEQ ID NO: 6815495 - DNA, 59 bp, Homo sapiens
ttctctggcctgaggcgaggcccctcagcaggaaggggcccttggttggggccatagga

SEQ ID NO: 6815496 - DNA, 75 bp, Homo sapiens
atgcaagctttagcaaagcccaaagtgactgaaaagagagttataataatgtggcctttgttgatagctatgcat

SEQ ID NO: 6815497 - DNA, 74 bp, Homo sapiens
ttccacggacaactgctgacaagtgaccagtggggatggacaccaccatggcatttgcagagttgaaaatggaa

SEQ ID NO: 6815498 - DNA, 93 bp, Homo sapiens
gaagtacttagtgaaagaaaccacatgccttcaaatgctcatatatatgtatgtaaagcatacattggtatgtggttttggttcattttcttc

SEQ ID NO: 6815499 - DNA, 67 bp, Homo sapiens
gtataaaggatttgacttttcctctccagctgtctggagaacagcacaggaagtgtatctttcatgc

SEQ ID NO: 6815500 - DNA, 98 bp, Homo sapiens
atttggagaggttatagtaggaattgctaaccaattcaaaatgtgccattttgaatcagaagttggcagtgttatttataatagtgacccatttgaat

SEQ ID NO: 6815501 - DNA, 84 bp, Homo sapiens
attattaggttggtgtgaaagtaattgcgagtttcaacattactttaatggcataaactgcaattacttttgcaccctaataat

SEQ ID NO: 6815502 - DNA, 73 bp, Homo sapiens
ggcaagatgggtaaagtctccccaaccttaagctgacccttggctcactctgggcggggcttttcactctgcc

SEQ ID NO: 6815503 - DNA, 82 bp, Homo sapiens
aaagatgaacaaaatcacagtttcaagtaatgcaccctagatgtggattgctgggaaactgtgaaaaacagagtcattcttt

SEQ ID NO: 6815504 - DNA, 119 bp, Homo sapiens
ggggtgagtggggagggaagtaagtgccccaggctgttaacataagtctcacttaacaagagctcaggaagagacataaagggcaggtgcctgggggcatcttccttcctcctctctcc

SEQ ID NO: 6815505 - DNA, 93 bp, Homo sapiens
aggcccaggtgaggagaaatggtgggctgagtctcatcggaaagcactgtttcctgggactcagtcccattcagagtctgtctccctggacct

SEQ ID NO: 6815506 - DNA, 66 bp, Homo sapiens
gccccgacatggattattttgtgcctaatttttgcatctggttttggccaagaaagttctgtgggc

SEQ ID NO: 6815507 - DNA, 72 bp, Homo sapiens
cctctcagcacttgagctttcatgtaagagttctagctgctctaacactgccatgctggagtcacatggagg

SEQ ID NO: 6815508 - DNA, 71 bp, Homo sapiens
gccttcctctacaacaccaggcacggagtggctgaaccattgctaggccctggcttgagctcagggaaggc

SEQ ID NO: 6815509 - DNA, 60 bp, Homo sapiens
gtgtttttctctcagcctgtagaaacttgctcattgagttttagagttgggagaagttac

SEQ ID NO: 6815510 - DNA, 74 bp, Homo sapiens
agtcatcatggaaaatgttgtttagtcacagaaagggaaaagctagatttagcaatgtgcactctatgatgtct

SEQ ID NO: 6815511 - DNA, 74 bp, Homo sapiens
agtgtcctttatttctccttgacgtttctctaatagtatctgcacagtggactaataggagaaaacaagtcact

SEQ ID NO: 6815512 - DNA, 65 bp, Homo sapiens
ggatgtttctcactgtttctctatggagcccagggacaggccagtgaggaaagagtgggacatct

SEQ ID NO: 6815513 - DNA, 62 bp, Homo sapiens
ccacagggataggaatggggcttgggctgggaggtgccagggtccatattcctgttcctggg

SEQ ID NO: 6815514 - DNA, 120 bp, Homo sapiens
cagcaaatggaggaggtggttcttggatgtcagactttcctggagggaggccaggctgcggtagcccagttgtaatgctttcctctgaggtgttggcatcagggcttgcttccactgctg

SEQ ID NO: 6815515 - DNA, 94 bp, Homo sapiens
ggacaggttcaaacacagactctgggcccaccctcagagtttctgattcagtactgtggggtgaggcccaagaatctgcatttctgacaagtcc

SEQ ID NO: 6815516 - DNA, 68 bp, Homo sapiens
ccagcttcttacgagctggtacttttaataatttactagagtgtccttgaggttcctaggaatgctgg

SEQ ID NO: 6815517 - DNA, 62 bp, Homo sapiens
cagtatgcagttgaaaataagcttattattaaactatgcatttatttttagcaaacatgctg

SEQ ID NO: 6815518 - DNA, 83 bp, Homo sapiens
cttctgccagagaatcagcagaatcttcctacacctgtttggtggcaagggtcagggacgttctgcagcatagatggcaggag

SEQ ID NO: 6815519 - DNA, 101 bp, Homo sapiens
tgcagtgtacaacgtttagtacattctaaactgtatgccctgatatctagtggatatgcagtgaatgtttgtcaaatggctaaaattttgcatgatatgca

SEQ ID NO: 6815520 - DNA, 67 bp, Homo sapiens
ctgaaagtataaagggccctaaggaaggcacacagaaaatattctgggggttcatttgtgcattcag

SEQ ID NO: 6815521 - DNA, 60 bp, Homo sapiens
aggaaatgtttagcatccacttttaaaagcatgaggagaggggagagctaagcaattcct

SEQ ID NO: 6815522 - DNA, 130 bp, Homo sapiens
acaggttgatcataccaaatacaaaaatcccagaatccaaaacgttttgagtacccacataatgctaaaaggaaatgctcattggagcattttggattttggattttctcatttgggatgttcaacccgt

SEQ ID NO: 6815523 - DNA, 72 bp, Homo sapiens
ctcctctacacagcaggtcttgttgctgctgactgacatgtcctgggagcacatggtcctgctctaggggag

SEQ ID NO: 6815524 - DNA, 75 bp, Homo sapiens
gtgcctgaggctgtgtgtccctctggacacaggcaacctgtctttgtgctatgattggacagaatagctgggcac

SEQ ID NO: 6815525 - DNA, 82 bp, Homo sapiens
ggccacctctggcaccactgagtctgcagttagttctcacccaccacgccctgcctgacctcagtgtctgcttcaggctgcc

SEQ ID NO: 6815526 - DNA, 59 bp, Homo sapiens
gagggcgcggctgcccacctgacgaacctggcctgtgtcagagtggtggttttgccttc

SEQ ID NO: 6815527 - DNA, 62 bp, Homo sapiens
tgggagttatagcaagaaaacacaagaattacctaggtaagtgagttcttgctagattttca

SEQ ID NO: 6815528 - DNA, 79 bp, Homo sapiens
gatcagatgggaacatatatatgggctctttcaggtgcattgaggcatcagaaatgtttatatgtggtgtcaactggtt

SEQ ID NO: 6815529 - DNA, 61 bp, Homo sapiens
actctcagggctccagggaaagaggacacagtataatgtgcccctggggccactagggagt

SEQ ID NO: 6815530 - DNA, 76 bp, Homo sapiens
tctgttcctgtgtgtgaatctgtgtgtgtgtgtgtgtgtgcgcgcgcgcatgtgcgttgattgcagtgggaaatga

SEQ ID NO: 6815531 - DNA, 78 bp, Homo sapiens
tatgagatcatattctgttcttgatctgtatattatgaaatatttatctcacaattcaagaagagagatgaaagtatg

SEQ ID NO: 6815532 - DNA, 81 bp, Homo sapiens
tttttaccgtattctaatcagtttaactgtcaagagccacctgtggctagtggctaccaaattggacagagtggttttaga

SEQ ID NO: 6815533 - DNA, 55 bp, Homo sapiens
gggctcctgtttgagaaaaagcccgaagaatggttcatttccaagaagagagctc

SEQ ID NO: 6815534 - DNA, 78 bp, Homo sapiens
gggcctggggggtgtggggagggccagacctgttaacaagcttcttcccagcctcacccgccttcaactccccagccc

SEQ ID NO: 6815535 - DNA, 67 bp, Homo sapiens
ggtcttctctggactttttgtggattctggaggggccaaagtcaagtgaaaaggtccaggcgagact

SEQ ID NO: 6815536 - DNA, 86 bp, Homo sapiens
ctgagaatggggagcatgtggggtgagcagggggactgcccagagatctgcagctgctgctcctcctcactgctccacacactcag

SEQ ID NO: 6815537 - DNA, 57 bp, Homo sapiens
cagagctgggcatggtgaaaggcggcaagttactgcttccttccccttcagcctctg

SEQ ID NO: 6815538 - DNA, 80 bp, Homo sapiens
acatctatgtagatacacacatatagtggtgaagccatcttcaaatagagacccgtgtgtgtgtgtgtgtgtgtgtgtgt

SEQ ID NO: 6815539 - DNA, 67 bp, Homo sapiens
gcacctctttctcactttgttagttctggcctcacgttagtaacttgaagttgcagaaagtacttgc

SEQ ID NO: 6815540 - DNA, 65 bp, Homo sapiens
tggccctggtggcacagcctgctacacgccgaggctgtgtgtcacagcctgctgctccagggcca

SEQ ID NO: 6815541 - DNA, 59 bp, Homo sapiens
gtgtcacctcttctgcgtccctgggaggcaaagcaccctgggctcagagcaggtagcac

SEQ ID NO: 6815542 - DNA, 55 bp, Homo sapiens
ctgcattccttccagacacaagacctagaatacataggctggagaaaggaatcag

SEQ ID NO: 6815543 - DNA, 65 bp, Homo sapiens
tcaagcagggtttatgcatggagccctcatacagagggctgaccttcagatactctgacacttga

SEQ ID NO: 6815544 - DNA, 120 bp, Homo sapiens
gactagtaggcaatttaaataagtgcacagtcttgtaagagagaattgcaaattattgcaatgctctaataattgcaatatgatccttacaagaaaaatgcacatttgatggcaatagtc

SEQ ID NO: 6815545 - DNA, 57 bp, Homo sapiens
tccatacccagcatttcctgagcttctaccctgtgccaggctctgctgggtgctggg

SEQ ID NO: 6815546 - DNA, 90 bp, Homo sapiens
ttatcacttaattgtttccacttatcttttaagagagaaatttatttagcatctttctctcttttgggtaggaggtcacagagcagatga

SEQ ID NO: 6815547 - DNA, 89 bp, Homo sapiens
gtgcagtggctcaatctcagctctgcctcctgggttcaagcgattctcttgccttggcctacttagtagctgggattacaagcatgcac

SEQ ID NO: 6815548 - DNA, 56 bp, Homo sapiens
gcgatccgggccgctgctgctgggtcggaccccccgggctcagcccggcccctcgc

SEQ ID NO: 6815549 - DNA, 81 bp, Homo sapiens
cagttccacaaggtactggcacaagaagagtcgtggaagactgacctggccatggcttctcatgtcccagctcaggacctg

SEQ ID NO: 6815550 - DNA, 83 bp, Homo sapiens
gtttcagaaacacttgtagagaagtttgtttcatttcctgcttttactttgtagcattgcaaacttctttaagtttttgaaac

SEQ ID NO: 6815551 - DNA, 77 bp, Homo sapiens
gctttactcgaaatttactaaggtgtttcttttgtggttcttgtaatctacaatccaacagtgtttttgagtagagc

SEQ ID NO: 6815552 - DNA, 75 bp, Homo sapiens
tcagaatagaggtgtcactttgggaagtaagtaacccagagatctagcttctcatgaaatctctagctatgttga

SEQ ID NO: 6815553 - DNA, 86 bp, Homo sapiens
atgtggtgatggtgggaacagaattagagtttaataaagtttatctagtttatctgtcatttcccatatccaaaacttcaccatat

SEQ ID NO: 6815554 - DNA, 62 bp, Homo sapiens
tagggccatgtctgtcttgttcacttgtatatgcccagggcccagcacagagcttggctcta

SEQ ID NO: 6815555 - DNA, 105 bp, Homo sapiens
ctgtttaaagttgatttcgggtgaaactggaagcacaaaattgtgggcacatttaactaacaattcagtgacctaattacttacagaattcaacttctgcctcag

SEQ ID NO: 6815556 - DNA, 118 bp, Homo sapiens
tgaagcaacattttaggtcttcattgatttgctttgcaatttccttcatagatgactggaacataaatcttcagttagggccagttcaaagttttcctgactcaaaatattgcattca

SEQ ID NO: 6815557 - DNA, 56 bp, Homo sapiens
cagttggctcaccttatctgtaggttctacatccatggccaagaaattgccgactg

SEQ ID NO: 6815558 - DNA, 78 bp, Homo sapiens
tctaattactcatcttttcattaattctttggataaaaacttattggccaaagtgtgggagaagaggtaggaataaga

SEQ ID NO: 6815559 - DNA, 71 bp, Homo sapiens
ttcttctcaggaacagctgacctgacaatggggcctttctctcaacttgtcatttagttctttcggaagaa

SEQ ID NO: 6815560 - DNA, 109 bp, Homo sapiens
aagcatgttgcaaaataacttggtgtctatgattcagtttatgtaaaataataaatgtatgtaggaatacgtgtgttgaaagatgtacatcaatttgctaacaatggtt

SEQ ID NO: 6815561 - DNA, 76 bp, Homo sapiens
gcctaggaagataggttttatgtctgggttagatagcgctgtctagagctggagtagaatgtgctggttcctgggc

SEQ ID NO: 6815562 - DNA, 103 bp, Homo sapiens
gtgggaggggttgggaccagccttctgctgccctgggtgctggggatcccggggctttccaggtgctcggcctccaaggtgcgcggtcctcagctccacccgc

SEQ ID NO: 6815563 - DNA, 99 bp, Homo sapiens
agccccgggagcctcacacagctggggagaggccaaggatctcgcagtcactagccaggctcaggatcaggggcctttccttggctgggcactggggct

SEQ ID NO: 6815564 - DNA, 73 bp, Homo sapiens
gcatttgatgaaagagttctcagaaacgtgggtctaaatttgattctagtcctgagggcatctgttcaattgc

SEQ ID NO: 6815565 - DNA, 76 bp, Homo sapiens
gctaagttttggggggtggaggtggtctctttgtccctgaagggattcatccttaccagtccccggttcaaagagc

SEQ ID NO: 6815566 - DNA, 87 bp, Homo sapiens
gatgttatttgttatgttatcatgtttgttatacgatgttatttgctacattttgttatttgttacgtgatgatttttaagaatatc

SEQ ID NO: 6815567 - DNA, 117 bp, Homo sapiens
tgaggaaactgaggctcagagagggtaaattgcctaaggtcagacagctataaacagatggaactggagtttgaaccaggaacaattagctctttattccaaacctcattttcttta

SEQ ID NO: 6815568 - DNA, 70 bp, Homo sapiens
caggagtgagagagctagattcacatgggatgaatacaccagtcccctggcttaaaaacctcatatcctg

SEQ ID NO: 6815569 - DNA, 58 bp, Homo sapiens
tgtctgagctttatgatggaagagaccacaccagtcttgttcagtcatattctcaaca

SEQ ID NO: 6815570 - DNA, 77 bp, Homo sapiens
ggaggggggcagaagtagtgcccctgacatctggtgggtcataggtgctcagtcgttatttatttttgctctcctcc

SEQ ID NO: 6815571 - DNA, 104 bp, Homo sapiens
attatcctccgcacatagcaagaaatctagaagtcagtggatgctgagtacatatttactgactattctttgggaacttggtatgtgctaggaattggggtgat

SEQ ID NO: 6815572 - DNA, 82 bp, Homo sapiens
gcctggcggcagcgcggcctgcgccgcgtagggcacgtaggcgggcgcgcagctggcgggcagagccgccatgctcgagggc

SEQ ID NO: 6815573 - DNA, 60 bp, Homo sapiens
caatttttacattggcgtatcataatgaatatctaaatattatgatacaggtgaaaattg

SEQ ID NO: 6815574 - DNA, 72 bp, Homo sapiens
tttgggagactttgacgaaagagtcattaagttcatttgcttcatttgttttccaagtcaaagaatcccaaa

SEQ ID NO: 6815575 - DNA, 70 bp, Homo sapiens
tagatcaggctgcttagatagaatcaaatattgtttaacattttgcaagttatctagctagtctgagata

SEQ ID NO: 6815576 - DNA, 59 bp, Homo sapiens
gtcgaggcaggcaggcggaggataggaaggccccactgtcttgcggtttctgcctcagc

SEQ ID NO: 6815577 - DNA, 129 bp, Homo sapiens
ggcactgaatagaaaactgaacaacctttgctattgtgaatagtgccgcaataaacatacgtgtgcatgtgtctttatagcagcatgatttataatcctttgggtgtatacccagtaattcatctaccc

SEQ ID NO: 6815578 - DNA, 93 bp, Homo sapiens
ggattaagtgaggtgatgcacaagatggtttccagatgctgggtgccaggctcagcactttgcatccattcttaattacatttcattaaatct

SEQ ID NO: 6815579 - DNA, 65 bp, Homo sapiens
agctatgtcaaacacaacaccagtggttttatttacagccaggaaaccagtgtgtttcacgtgct

SEQ ID NO: 6815580 - DNA, 99 bp, Homo sapiens
ctaagggccatgcttgggatagtcttgcagtgcttctttggttgtaaagtgattcagagaaatccagtagtgaagaatttgttctacttggcctcttgg

SEQ ID NO: 6815581 - DNA, 55 bp, Homo sapiens
tccatgtcttcatgtgtctaacttccaaggagggggctaacagcacagacatgga

SEQ ID NO: 6815582 - DNA, 68 bp, Homo sapiens
gggagccccaggagtcacctgcccaaagtcaccctggggtgattggcaagggcagggactgggctgct

SEQ ID NO: 6815583 - DNA, 58 bp, Homo sapiens
aggtataagtctcatttctgttaccttgaccaagttatttaacatgggtcttatacct

SEQ ID NO: 6815584 - DNA, 64 bp, Homo sapiens
ccaaaatgaaaatactcaaagcagtgtaattccaacctgaatgagtggatttttcatttcttgg

SEQ ID NO: 6815585 - DNA, 94 bp, Homo sapiens
tgactcctccaggtcttggagtaggtcattgggtggatcctctatttccttacgtgggccactggatggctcctccatgtcttggagtagatca

SEQ ID NO: 6815586 - DNA, 60 bp, Homo sapiens
cacagaaatattgtgtcccttgttatgaggcactgagaaggacacaacatcatttctgtg

SEQ ID NO: 6815587 - DNA, 69 bp, Homo sapiens
caggttctggagatgcagagataaaaggcaggcccctgctcaggcatcatgcggtctccagggtacctg

SEQ ID NO: 6815588 - DNA, 130 bp, Homo sapiens
agtagaattttgaagacaaatattggctggttctttttctgagggctgactgcttagctgtggtcactgtgtgatgtgatagaaaggtagtggactttgaggaagacagatttgggctctagtttctatt

SEQ ID NO: 6815589 - DNA, 68 bp, Homo sapiens
ttggtgttgaagtgctgagtattgatgcagaagggattttgcagcatgcatagacactgcaatagcaa

SEQ ID NO: 6815590 - DNA, 61 bp, Homo sapiens
ctgataaggaatcccattatatggaaaatataatccaccaaaatgagattccttatgatag

SEQ ID NO: 6815591 - DNA, 61 bp, Homo sapiens
tgatgccctgagccaccaatgccatttcccagcaggactagtaggcatggctggggcagca

SEQ ID NO: 6815592 - DNA, 62 bp, Homo sapiens
attaattgatgtctaccacatgcctggggctctgctaggcataattcagacatcaacttagt

SEQ ID NO: 6815593 - DNA, 116 bp, Homo sapiens
ttcattataaagttatcataaagttatctagaaaagcatagcaaaggactttgtaaaagtaggttagctcatttacaaagagtgttcttttccagttttttagcaatgacaatgaa

SEQ ID NO: 6815594 - DNA, 65 bp, Homo sapiens
ttgaatggcacaagagtaaactgttgtattacttcacacagcagagctattcttgtgcaatttga

SEQ ID NO: 6815595 - DNA, 91 bp, Homo sapiens
caaaaatgattaaagtgagctgtgtagccctgtaaccatggaacagatttcctgtacaatgttcatagctttggcaaagtaattattattg

SEQ ID NO: 6815596 - DNA, 55 bp, Homo sapiens
caggagtggagtggtcaggtaaagctggcctcgccaaactgagcactttatcctg

SEQ ID NO: 6815597 - DNA, 73 bp, Homo sapiens
cagatttagacctgtggtttcagaaaaatttttggagcaaatttaaacatgtttggcactataggtaaatttg

SEQ ID NO: 6815598 - DNA, 110 bp, Homo sapiens
agggtttttctattttgatcctctaatgaagctgctttctatgactatagaatccccttcctcacttttttcatctggaagcaggctactcatgattaaaagtcgaccct

SEQ ID NO: 6815599 - DNA, 58 bp, Homo sapiens
gtggcagagtgcggttctgaccctgcttgtcctagtctttgagctgctattctgctac

SEQ ID NO: 6815600 - DNA, 89 bp, Homo sapiens
ggaagagtaattcatagccctcctttgttcatgctgcctttgaggtatccattagacatccaaggagaggcatggagttacaagagtct

SEQ ID NO: 6815601 - DNA, 73 bp, Homo sapiens
ggccagaaaagactagtgaaacatcaaactctctttgaagaacggtttgtcactcattgtctttattgtagct

SEQ ID NO: 6815602 - DNA, 66 bp, Homo sapiens
tcttgagacagtatctttgttggctctgaatcttataaaagctaataaaaactacttgtctctgga

SEQ ID NO: 6815603 - DNA, 78 bp, Homo sapiens
agtcagaagttgcagatgagtactgggataccttcactttcttcagacagaacccaataatgcaactccacttctgct

SEQ ID NO: 6815604 - DNA, 75 bp, Homo sapiens
tttcaatcactttgaaactaaaattcattaagcataaccagattgcttttgtgggttgtttcaaggacattgaga

SEQ ID NO: 6815605 - DNA, 57 bp, Homo sapiens
ctctgtgtggtatgattgtcatttcccttttagagatgaggaaactgaaacacagag

SEQ ID NO: 6815606 - DNA, 59 bp, Homo sapiens
gtgtgccaactatattaatattgagctcaaggaagtacttattatattagctggcatat

SEQ ID NO: 6815607 - DNA, 58 bp, Homo sapiens
tgctatgaggcttttttgatgaagtttaaaaagcttcttcaataaattcccataagca

SEQ ID NO: 6815608 - DNA, 56 bp, Homo sapiens
gaggtcgggaaagggggccccgcagcagccccttggcttcccttctcccttgcctc

SEQ ID NO: 6815609 - DNA, 71 bp, Homo sapiens
ttttcatgacaaactacctacagatgttcagattagtatatccagtgggcatcctggtgtttcagtgagga

SEQ ID NO: 6815610 - DNA, 98 bp, Homo sapiens
taggggcggtatttggggggctgaggagagcttttttggtctacattgtggagcagaaatggcctcttgtcacagcccttagtactcaagagccttta

SEQ ID NO: 6815611 - DNA, 60 bp, Homo sapiens
ataagtggcttttctttcgtgagggtactcaattttcacatttatttcaaagttacttat

SEQ ID NO: 6815612 - DNA, 69 bp, Homo sapiens
aatgcataataaggagcaaaatgtatggaatcatccaaatgcttgctcttgattattttctaccgcatt

SEQ ID NO: 6815613 - DNA, 82 bp, Homo sapiens
gtggaatggaacagtcagcatgcctgaattcatggttaacaaactgatcagatacattaaaatgatgattgttttatgccac

SEQ ID NO: 6815614 - DNA, 72 bp, Homo sapiens
ttggaatattcaatcagctatggttgcttatgaggaacaccttggaagtaacaatgctgttgaattgtttga

SEQ ID NO: 6815615 - DNA, 62 bp, Homo sapiens
aaggttgtcagatttaagagggattaaattctctacgaattctctagaaatcgaataacctt

SEQ ID NO: 6815616 - DNA, 60 bp, Homo sapiens
catagtgactcatgcctataatcccagcactttgggaggccgagttgggcagatcacttg

SEQ ID NO: 6815617 - DNA, 78 bp, Homo sapiens
ctacttttaaataccaaacttcctgagcagtctaattgctgctctttggaacaagaagaaatggctatttaaaagaag

SEQ ID NO: 6815618 - DNA, 100 bp, Homo sapiens
cttattctgtggagaatgcttatgtttatgaagtacccataggtgacttctttacctctggtatttgcacagatatttttattctcaagatacgaatgag

SEQ ID NO: 6815619 - DNA, 94 bp, Homo sapiens
aaacttgcaaaacaattatatataaaatcagatatggatatatgtgtgcattgtgcattgacaatgtatttgtatctgtataagtggcaggttt

SEQ ID NO: 6815620 - DNA, 55 bp, Homo sapiens
tgtgaaatgctatttccatgagtagaagaaaaatgaatggaaaagcatttttaca

SEQ ID NO: 6815621 - DNA, 64 bp, Homo sapiens
gcataggcttgtccatcctcttttgccaccaaagtgtggttgcccaagagggaaagtgctatgc

SEQ ID NO: 6815622 - DNA, 129 bp, Homo sapiens
ttagaatcacccagagggagcttttaaaaagtattggtacccaggcccctcctcaaactgagaaaactgaggactctgtgggtgagcctggacatggatggctttaccaagctctccagatgagtctaa

SEQ ID NO: 6815623 - DNA, 100 bp, Homo sapiens
ggatctaaacactcatttttctaggtttacaatactgcatgaatcactgctatgctacagtaacatttaggaaaggaaaagattgagtatttaatgatct

SEQ ID NO: 6815624 - DNA, 72 bp, Homo sapiens
tgtgatgggatccagatgtggctccatcccacgaaggcaagtgatgaaagcagtaaatgggtcccatgcaca

SEQ ID NO: 6815625 - DNA, 57 bp, Homo sapiens
accagagatggggcttctctgtgggatgacctgatggattcagttctttctttaggt

SEQ ID NO: 6815626 - DNA, 103 bp, Homo sapiens
cctagctttcaattgtgtgaaaatctacttgtttgaatctctctagagtcaagattagagggcctgggcagaagttaaaggaggcagatttctaacaattagg

SEQ ID NO: 6815627 - DNA, 65 bp, Homo sapiens
atccctggacggcgcctccccacggatgcgggaagcacaagtgggaaatgaggctgtccaaggat

SEQ ID NO: 6815628 - DNA, 65 bp, Homo sapiens
gcattagaactaagatgtccagggtgtggaatgtaacaggcgcctagggacctgagttcaaatgc

SEQ ID NO: 6815629 - DNA, 65 bp, Homo sapiens
ctgcctcttcgcccagcctttgattccccctcctttgtcggatagtgtctgcggcggggaggcgg

SEQ ID NO: 6815630 - DNA, 66 bp, Homo sapiens
tcagcagtcctccaggatcaagaaactactcatcctaaaagctcgagatcactgggaactgcgtga

SEQ ID NO: 6815631 - DNA, 59 bp, Homo sapiens
atttcgggtgtgtgcatgtgagcatgcatattactcacacatacacatttacctgaaat

SEQ ID NO: 6815632 - DNA, 73 bp, Homo sapiens
ctgagctgatctccacacagggtcgcctgcggcgtgcaccagctggccacactgctgatggagctggattcag

SEQ ID NO: 6815633 - DNA, 66 bp, Homo sapiens
tccaaatatagatgagttgtaatgtctggcatttttgacagtcagcctttacaattaaatcttgga

SEQ ID NO: 6815634 - DNA, 60 bp, Homo sapiens
agaatctctggggatggacctgggagatgtatattttttaacaagtcccctagaggttct

SEQ ID NO: 6815635 - DNA, 80 bp, Homo sapiens
ggaaccttctgccttttaaagccagtgttattttggtctctgttaaagtagctaaaccagtatgtgaaggcaggggttct

SEQ ID NO: 6815636 - DNA, 76 bp, Homo sapiens
ggcctcagggaatcagactctgcagccagtcagtgtcagagctgcactctgctgttcacagactctgctctgggtc

SEQ ID NO: 6815637 - DNA, 73 bp, Homo sapiens
ggcggatgtctttgagggagagtcccatagtgcagccaggtataaacggtgacttttccccaaggccatttcc

SEQ ID NO: 6815638 - DNA, 101 bp, Homo sapiens
cagagtagtacatttgcgaatgagattttttggcttttttcacttagtaggaacccttgtgtgtggaaaactgagaaaattgctttctgctgtacactctg

SEQ ID NO: 6815639 - DNA, 56 bp, Homo sapiens
cttcctccgaagaagttgctggcaggaccaaggccagggcttggaagagagagaag

SEQ ID NO: 6815640 - DNA, 72 bp, Homo sapiens
tcctgcatggcttacagaggctgcagaggctgtggggcatgctggagaaatactctgtgtgtcagtgaagga

SEQ ID NO: 6815641 - DNA, 64 bp, Homo sapiens
aaaatccaagttccacatggaccccttaagtggggcaatcacagtgataggacatatggatttt

SEQ ID NO: 6815642 - DNA, 77 bp, Homo sapiens
cagccccggccctgtcctggctgtctccgggcctttgttgttcgagtttcgccttaggactgaaggggcctttgttg

SEQ ID NO: 6815643 - DNA, 56 bp, Homo sapiens
acagttcaagtcttagacaacaagggtgtatcctgttgtgctcagggttgagctgt

SEQ ID NO: 6815644 - DNA, 77 bp, Homo sapiens
catttagcagtaagcaactgagcttgccaatgttaacaaagttattaggcaagaacaatatgttggctgggaaaatg

SEQ ID NO: 6815645 - DNA, 61 bp, Homo sapiens
tccctactgttagggactcagctagcatccagtgttcttaaggtctttaggcagatagaga

SEQ ID NO: 6815646 - DNA, 58 bp, Homo sapiens
ctgactctgcccttcagggcacgctgagaaatggtgtgtgagggactagcatgatcag

SEQ ID NO: 6815647 - DNA, 58 bp, Homo sapiens
tgatgggaaaatgaggcctggggatggccaggaacttgcctgaggttttttccaatta

SEQ ID NO: 6815648 - DNA, 64 bp, Homo sapiens
gtaagtgctgtatatgcaagaggaagagatagtagtcagttcttctctctttattagccacttc

SEQ ID NO: 6815649 - DNA, 82 bp, Homo sapiens
tctagagcttgaagttttgtaacttaataatggtgtatctacctgtcttctacactgaattgcaattttcttaaggtctagg

SEQ ID NO: 6815650 - DNA, 84 bp, Homo sapiens
gactagcagctgtagaacttgttgtaagaaaatatgataattacaaagattgacatgtgctatgacaacagtcctttgctaatc

SEQ ID NO: 6815651 - DNA, 69 bp, Homo sapiens
ttcagcagtttctgagaagcaaaggtaacatatccttccaaagtccccatctttccaggagatgctgag

SEQ ID NO: 6815652 - DNA, 71 bp, Homo sapiens
tggtgttgctgttttcaaggcattctgggagaaacaccttcacagttgattgaaacacagctgccacacca

SEQ ID NO: 6815653 - DNA, 59 bp, Homo sapiens
ggatgtctggtctatttcaagtatactggccctggccaggacacatgggctgagactcc

SEQ ID NO: 6815654 - DNA, 72 bp, Homo sapiens
gtgttcagccctttccaatttgatttattaaaagtttcctttcataatccaagaggggaagagtggaattac

SEQ ID NO: 6815655 - DNA, 77 bp, Homo sapiens
ggtgcacagattgatgtattatgaagacaataaaggactgtctcataatgaacaatatatcaatagcctgtgacatc

SEQ ID NO: 6815656 - DNA, 73 bp, Homo sapiens
gaaagggcgatggctgtgggatatgtgactgacaggggctgcacgactcgtctgtcacctatggctgctcttc

SEQ ID NO: 6815657 - DNA, 58 bp, Homo sapiens
tggccttctttgtgaatcaaggcaaagtccacattcagcctgtctgcaatggaggtca

SEQ ID NO: 6815658 - DNA, 58 bp, Homo sapiens
ctggagtggccggtgctgtggcccacacattagggagtctgctctggctcacctccag

SEQ ID NO: 6815659 - DNA, 84 bp, Homo sapiens
ctcctccttcttcctttctctgagaagggttcccgggaaagtcttctgggaacctttgtgaagggagaggagggcccgggggag

SEQ ID NO: 6815660 - DNA, 97 bp, Homo sapiens
gaaacactttcatccattcagagactttaacaatgggtatgaaagcaatgttcatgatttcatatttctttaaggactttgtcattgaaagtgtttc

SEQ ID NO: 6815661 - DNA, 60 bp, Homo sapiens
accacgtggcaggcatcgccataaacccttcggtagtggcagaggctctgtgatgttggt

SEQ ID NO: 6815662 - DNA, 58 bp, Homo sapiens
tggtggtgtatttttcatttttggaactacttgtgttggaattttatgaacactacca

SEQ ID NO: 6815663 - DNA, 76 bp, Homo sapiens
acagttatttgcaggatgggcattggttggatttttcttgaattaatgaaatctgtattgctcatacttgaattgt

SEQ ID NO: 6815664 - DNA, 78 bp, Homo sapiens
gagggactctgatgctgtactaagttatgtcttgttgctaagacataaaacagtcagcgaaacaatacaatgtccttc

SEQ ID NO: 6815665 - DNA, 68 bp, Homo sapiens
cgctccgacgctgggggccaggggaccggaccttctgggaggggtctgggctcccagggtcggcggtg

SEQ ID NO: 6815666 - DNA, 62 bp, Homo sapiens
ggttgacctacatggactacatcagtgggcagcatggcctctggcttccagtgggttcaacc

SEQ ID NO: 6815667 - DNA, 97 bp, Homo sapiens
gttaactatattgcaatatcttaaatgcatgatagacataaagccaagtgtcacttaatgtcgggcatgcattctgagaaatgcatcactaggcaac

SEQ ID NO: 6815668 - DNA, 67 bp, Homo sapiens
agttcagaacaattcctttataacaaaagtcttgaccatttgttgtgaggttgaattgtgttggcct

SEQ ID NO: 6815669 - DNA, 95 bp, Homo sapiens
atagattcagcctttcccagccacaggtgtagccctcaacctccccttgccctccctgggtagaggctcctagcctgtggctggtgctgttctgt

SEQ ID NO: 6815670 - DNA, 72 bp, Homo sapiens
agacatacacattatagagagtataatagggttgtatacacacctacatatacctatataatgtgtgtgtct

SEQ ID NO: 6815671 - DNA, 60 bp, Homo sapiens
tggactctggaattgtactgctgggttagaatcccagctctcgcacttactagctgttca

SEQ ID NO: 6815672 - DNA, 80 bp, Homo sapiens
gagtatgttggtaattgagagaattaaattactgtgtgattactatactaaatagtttaattcctcattgggacatattc

SEQ ID NO: 6815673 - DNA, 82 bp, Homo sapiens
ctgtgcctttgaaatatcaagttattagtgaccaacaaataaagtaggatactcagacttgaatctcaagagaaaggtagag

SEQ ID NO: 6815674 - DNA, 77 bp, Homo sapiens
ctggcctgagggtttaaatgactgttcctcaaggacttatacaatagtcatttggagcaccttattaaagaagtcag

SEQ ID NO: 6815675 - DNA, 70 bp, Homo sapiens
gccctccagttttagaagatactgttacaaaatccaaatgtgagataatacttcttagctggaacagggt

SEQ ID NO: 6815676 - DNA, 130 bp, Homo sapiens
gaaggtcaccgtgagggtgagggctcctgctggaacccgtgtctctctgggcacaagggccagggcactcctggcccagctcagggtgggcggggtgttggtggagcctctgcccctcttccaggtacac

SEQ ID NO: 6815677 - DNA, 67 bp, Homo sapiens
atataaatatttgagggcaatagggtggactatagtggtttgaattctggctctcaaaaacatatgt

SEQ ID NO: 6815678 - DNA, 91 bp, Homo sapiens
gtttgagtgagttcatttatttataccattgccttgttccagaaaggatttcaggcaactggttaagtaaattgtccaagatcacccagac

SEQ ID NO: 6815679 - DNA, 58 bp, Homo sapiens
tgacagtggctgaaaacgtgatcatcatcctattggtgctgcaaaatcggccactgca

SEQ ID NO: 6815680 - DNA, 55 bp, Homo sapiens
attttgtgaattatctacaggacttcttcattctcatgtggagggttctcagaat

SEQ ID NO: 6815681 - DNA, 79 bp, Homo sapiens
atgatgtttttgagatctgtgcatgttagttaatgtagatcagtccatcctctgtaattgctgtatagattgtcatcat

SEQ ID NO: 6815682 - DNA, 79 bp, Homo sapiens
cttaggtatctgtctccagtgtccagtggtctttctactcctccatgaggactttatctggggtgaaggattacctgag

SEQ ID NO: 6815683 - DNA, 55 bp, Homo sapiens
gtcctggcttagttcgctgtaacttccctatatgactccactgtgcagccaggac

SEQ ID NO: 6815684 - DNA, 78 bp, Homo sapiens
tcattgaactcgccattggcagaagctctgttcttgctggaggccgcagtagctgtctagccttatggggactggtga

SEQ ID NO: 6815685 - DNA, 70 bp, Homo sapiens
tgtactctgaggatgctgacttccagatagccatttttgggttaagggaagttcaagtctcctgagtata

SEQ ID NO: 6815686 - DNA, 64 bp, Homo sapiens
gctggggcactgggggtcaggaccagacccatccatgttcctaggcctccctggagcacccagc

SEQ ID NO: 6815687 - DNA, 58 bp, Homo sapiens
cctacggaggacaggttagccacagtggatatgtatgtgatgcttttgtcctcgtggg

SEQ ID NO: 6815688 - DNA, 64 bp, Homo sapiens
tctaggaagaacatctaattacaggtagtaattacaggtagtaattagatgttgattcctgaga

SEQ ID NO: 6815689 - DNA, 58 bp, Homo sapiens
ttcctgtcctttggattgtctcaactgtgaagagagaaatatcccaaaagacaaggaa

SEQ ID NO: 6815690 - DNA, 74 bp, Homo sapiens
tgtctctctaagacattactggaatctgactgtaattgggtgactgttggcaaagacctaggatgagggagacg

SEQ ID NO: 6815691 - DNA, 104 bp, Homo sapiens
ttgctttgaagtgaggtaaactgtagttcagaatctgttcccagcattttctggccatgtgctgtctctgagccttagtttctgcactcataaaattaaagtaa

SEQ ID NO: 6815692 - DNA, 60 bp, Homo sapiens
aatgtttgaactttgcatatttgacatagttcctggtaggaatagcacagctcaaacatt

SEQ ID NO: 6815693 - DNA, 72 bp, Homo sapiens
tgggtatattgcatgatgctcaagtttggagtatagatggtcccatcacccagatagtgagcatagtaccca

SEQ ID NO: 6815694 - DNA, 73 bp, Homo sapiens
tggcactaatagagtcattattattgttctcacagattagatggcagagccagtgatgaagactctggagcca

SEQ ID NO: 6815695 - DNA, 82 bp, Homo sapiens
agttaatggggccttggctatatgaaagcttcctattttagcctcttaaaattggatgcacatttagaaaaggctcttagct

SEQ ID NO: 6815696 - DNA, 105 bp, Homo sapiens
tagctaacatttgtaggatactttatagattatggcaatgaataccccagctctctttcatttgccttgtgatttgtaagtactctgactacatgcactgtgcta

SEQ ID NO: 6815697 - DNA, 98 bp, Homo sapiens
taccattcctcatgagttaattattaggttggtgcaaaagtatttgcggtttttgctaattacttctgcaccaaccttaataatttacatgataggta

SEQ ID NO: 6815698 - DNA, 62 bp, Homo sapiens
ttgtgaatagtgccgcaataaacatacgtgtgcatgtgtctttgtagcagcatgatttataa

SEQ ID NO: 6815699 - DNA, 83 bp, Homo sapiens
taaacatgccttggttttactgtatatatgtatgtgtgtatgtattttttatatatgacagaatgtgtgtgtatgtgtgttta

SEQ ID NO: 6815700 - DNA, 55 bp, Homo sapiens
ctggaggattagtctgatgctcaccagccctggaggtgtccagaggagtccccag

SEQ ID NO: 6815701 - DNA, 62 bp, Homo sapiens
tctttgtactttctggctgtcctaactccggcatccatcgttccaaaagaagtgtgcaggga

SEQ ID NO: 6815702 - DNA, 74 bp, Homo sapiens
gcatgggtcaccagcagtctggatgcccttcttcctcaaggtggctggtccaggctgcagcctgctgcccctgc

SEQ ID NO: 6815703 - DNA, 65 bp, Homo sapiens
gtgctgcctcagacttgataattgggttcatcaacagagccttgaaaagtttgggtagagaccac

SEQ ID NO: 6815704 - DNA, 104 bp, Homo sapiens
cactgcctgtggccccttctctggagggctgcccggccagcagcaaccaactgacccggggccatgtggcaccctccccggaggccaaggggccacagccagtg

SEQ ID NO: 6815705 - DNA, 60 bp, Homo sapiens
gtttccaggcccctccctagacctactgaatcagaaactctggggatgggacccagaaat

SEQ ID NO: 6815706 - DNA, 81 bp, Homo sapiens
ctctggctggcaagtagaacacaagataagccttgaggaaactaagaatagaggaaatttgtgtctacttcctatctaggg

SEQ ID NO: 6815707 - DNA, 85 bp, Homo sapiens
caaagcctcagcccacctggtgtggggctctagggcaagcatacctgtcagaattagcccgaaccaggtggaaatggtggctttg

SEQ ID NO: 6815708 - DNA, 55 bp, Homo sapiens
gcagagggctggacgcaggttggaaggtctcacctcccacagcgccagctcctgt

SEQ ID NO: 6815709 - DNA, 67 bp, Homo sapiens
tggattctattttgctctttttcttcttgtcatttcagatattgaggaaacagagcaggcaatttca

SEQ ID NO: 6815710 - DNA, 70 bp, Homo sapiens
gtgggatgaggtttgttcaagagccatataaaattaaaagttaggactttttggacagacgcattgacac

SEQ ID NO: 6815711 - DNA, 59 bp, Homo sapiens
ggaagtggccccttgagaataccaggctgtaactggtggtcattgaaggagccgttttc

SEQ ID NO: 6815712 - DNA, 126 bp, Homo sapiens
atgagacaagacaggagaggagatgctggcgcgacactgtggccaggactgcagggggcgaggagccgggccggtccagtcccgcgcagcctgggcactgtgcgtctggggtccttctgacaacat

SEQ ID NO: 6815713 - DNA, 100 bp, Homo sapiens
gcaccacagtgatccctaggaatgcagacgtgaagaagacagggatgctgcctgcaaagggctccctgcaggtgtctctgtctagcgttcctctgggtgt

SEQ ID NO: 6815714 - DNA, 58 bp, Homo sapiens
agagggcatacagggaagtgggggagctgatcacagctctttactctgcaatgattct

SEQ ID NO: 6815715 - DNA, 61 bp, Homo sapiens
ggcaccattaaagagatcctggggactgcccagtctgtgggctgtaatgttgatggccgcc

SEQ ID NO: 6815716 - DNA, 79 bp, Homo sapiens
acatttgatgatggtactgtatttgaataagaaaacactaaatattttaatcaagtcaaccatcatgtgcaacagaagt

SEQ ID NO: 6815717 - DNA, 87 bp, Homo sapiens
taaaacgaaggcaggttctatcaaacagccattaatatactatgtgccattttatattgagactgtttgtctgttttttaaattttg

SEQ ID NO: 6815718 - DNA, 88 bp, Homo sapiens
taactaggaaatcagtttctatcatttgagcacctagataccctgtgccaagcactgtgctaggtgtttagatgtgctgtcttgttta

SEQ ID NO: 6815719 - DNA, 56 bp, Homo sapiens
cagcctttgggattgggattgagatgggcaatccctcttcctttcccttgagggtg

SEQ ID NO: 6815720 - DNA, 58 bp, Homo sapiens
tcccacagggcttctctgtacagagtgagtgcctcgtacttgagaagtctcctgggga

SEQ ID NO: 6815721 - DNA, 56 bp, Homo sapiens
tctgtttcctcttgtgtaaagtgaacgtaattcctcctccataggatggagataga

SEQ ID NO: 6815722 - DNA, 60 bp, Homo sapiens
gggaagggccatgcctctactttctaagacagagggacacaaggggcgaggtgcctctcc

SEQ ID NO: 6815723 - DNA, 57 bp, Homo sapiens
ttcttagcttattttacatgaaatccagtctgctgtgatgtctgtataggtaaagaa

SEQ ID NO: 6815724 - DNA, 60 bp, Homo sapiens
ggggtcctcggagcctgggtctttccctccctgtccagcgaccccaggccccagtatctc

SEQ ID NO: 6815725 - DNA, 125 bp, Homo sapiens
ttaaaattatatgggagctcattaaaaaatatatatgccaggatgcctcccaggagtgagcctgattgaataagcctgggaaggtcttagcatctatattttaacaagctcaccaataattctga

SEQ ID NO: 6815726 - DNA, 88 bp, Homo sapiens
cttaaaaagggaaacactcaatttagtaattcggttgcctagatgaaatcgagtggctattgatccgtgatgtttctagatttttaag

SEQ ID NO: 6815727 - DNA, 83 bp, Homo sapiens
ggccccaggcagtgctgcaggcgcctgcggtccctgctgaccccgtgtcaccactgccggcgcctgcggtccctcctggcccc

SEQ ID NO: 6815728 - DNA, 77 bp, Homo sapiens
ccctgaagtcttcctgaggcctcaaggctggctcataggattctgccttggccctagcctcaggcaaggctgcaggg

SEQ ID NO: 6815729 - DNA, 59 bp, Homo sapiens
aggcctgaaggaagatgagctgatggcattcccagcttactaccactccttgggggcct

SEQ ID NO: 6815730 - DNA, 71 bp, Homo sapiens
gcacgtccatgtgaagagaccaccaaacaggctttgtgtgagcaacaaggctgtttatttcacctgggtgc

SEQ ID NO: 6815731 - DNA, 61 bp, Homo sapiens
cctcagaagaagtggaattgatgctccctttaccttctaagcatcaaactgctctttgagg

SEQ ID NO: 6815732 - DNA, 70 bp, Homo sapiens
gcagctacaagacagcctgaaatgtacccaccctgacctgggtgagccacaggagttgtctgttggatgc

SEQ ID NO: 6815733 - DNA, 100 bp, Homo sapiens
ctgttcagtcagtgcccttgcaggccaggtgctctgtggaatatcacccctgctcatgggtctcctgtgcctgggaggccagccgtttctggctgagcag

SEQ ID NO: 6815734 - DNA, 67 bp, Homo sapiens
agtaagtttctattttcatgtctgtttcttccactaggaagagcaccttgaggacaggaattgagct

SEQ ID NO: 6815735 - DNA, 65 bp, Homo sapiens
gggtattatttctcacaaagttgcttatcccaacaaggattacattttgatgagaaagatcatct

SEQ ID NO: 6815736 - DNA, 77 bp, Homo sapiens
tgagcaatagtctttcaaaacgctctgtatgcaaataattgctttgtcacagatcgtttttgagctacttattgtca

SEQ ID NO: 6815737 - DNA, 62 bp, Homo sapiens
gacttattcagattggtttaagctagttagacttaaaactgctgcccaaactgaatactgtt

SEQ ID NO: 6815738 - DNA, 72 bp, Homo sapiens
agaaatcatcaacatactgctcaggcatttaattttggtgctttgaatactgatgtgtgtttggtgtgttct

SEQ ID NO: 6815739 - DNA, 83 bp, Homo sapiens
gcaaatccttattgatcagttttctctgtacaggcccagtgtaggtggacaggggacacagagaaactggagaaggatcctgc

SEQ ID NO: 6815740 - DNA, 104 bp, Homo sapiens
agtcaaaacagtaaggcactagaattagctgggcagattcctgaagcagattcaggtggataagagtttagttaatgtatagtattgcctctgtttaagaggct

SEQ ID NO: 6815741 - DNA, 62 bp, Homo sapiens
ggtggatctggctgtgtcctggcctgggtcagctttgccagtaaaacaaaggccatgttccc

SEQ ID NO: 6815742 - DNA, 88 bp, Homo sapiens
cttcctgggcctggcatggcctgtaagacggagaggtcactccaggtcctctctcctctccctggcaggaccctgtgggcacaggaag

SEQ ID NO: 6815743 - DNA, 57 bp, Homo sapiens
tgattgtaatgtgaataagccatgtcttcatagccctgggtcattcacattgcttca

SEQ ID NO: 6815744 - DNA, 75 bp, Homo sapiens
gccttttaaccctccccaagaggtcgtgcctctgagccccaaagctgaaggcccctcttgggggtgggtgcgggc

SEQ ID NO: 6815745 - DNA, 58 bp, Homo sapiens
tcccagaagcctctgcccccgggagatgtaagaggagctggaggcagagccagaggga

SEQ ID NO: 6815746 - DNA, 62 bp, Homo sapiens
caggaaggggaggagggggtgggatattatgatgcagctcacattgaacactctctttcctg

SEQ ID NO: 6815747 - DNA, 80 bp, Homo sapiens
ttgatttagctatttattcccactgtgaaatgagggtaatggtacctgtttcatagagttgtgaattttaaataaattaa

SEQ ID NO: 6815748 - DNA, 86 bp, Homo sapiens
tgaggtcccactgtcaccggctcactgacgaggaagctgagattcagcaaggtccagcactcgcccagggcttgtacagggcctca

SEQ ID NO: 6815749 - DNA, 67 bp, Homo sapiens
ttctagttgctctcctttaaacctggagactgagaagtcaaggtggtattttggaaagcagctggag

SEQ ID NO: 6815750 - DNA, 57 bp, Homo sapiens
taaaggcactgcgtccctcaaattcagagttagagggtgacatgtagttgatcttta

SEQ ID NO: 6815751 - DNA, 65 bp, Homo sapiens
gctgtcgctggaaatatttctgtagagtaagttgctaaactttcagagagaaaccagtgggaagc

SEQ ID NO: 6815752 - DNA, 55 bp, Homo sapiens
tccaggtccctggaatttatgagtaggttactatatatggcaaaagggactttga

SEQ ID NO: 6815753 - DNA, 63 bp, Homo sapiens
agtctccctagagttttctggttaatttagcacttaattgaaaatataattctaggagaaact

SEQ ID NO: 6815754 - DNA, 60 bp, Homo sapiens
gctgctgggcaccccctgagctctcagtaaatggagctattggggttatgcccgctcagc

SEQ ID NO: 6815755 - DNA, 64 bp, Homo sapiens
attggaggatgcttagcagcatccctggtctctaccaatcagatgcagttagtatacttccagt

SEQ ID NO: 6815756 - DNA, 94 bp, Homo sapiens
cattcttattaaatgctctatgctaatattagcttctttgactattttatttcaggtttttaagttttattggctatagcacttcttgagggtg

SEQ ID NO: 6815757 - DNA, 76 bp, Homo sapiens
tcctggacaatacttaatgctttttcctaagtgttttttatagcaagggtagggaatgagttaaattgtgcctgga

SEQ ID NO: 6815758 - DNA, 76 bp, Homo sapiens
gttgctaatatttttagaaatcacgaggtttcacatgaaaaccctgatctctggtttcccctgagaaattggcaac

SEQ ID NO: 6815759 - DNA, 64 bp, Homo sapiens
ttggacagcacagacatagaatatttccctcatcttggagttctgttggatagtgctgctctag

SEQ ID NO: 6815760 - DNA, 66 bp, Homo sapiens
ggtggacttgagatggaccgaggttcctgcattgttctgccgtgaacctctctcatcttctccacc

SEQ ID NO: 6815761 - DNA, 78 bp, Homo sapiens
cttgagctctagggaagaaaggcacagaccatggaaggtcacaccgtctccactgctccttcctccctgaagctcaag

SEQ ID NO: 6815762 - DNA, 64 bp, Homo sapiens
ctgtgtccctgtgcagaaatgtcacatggagtcctgtcatgtcacatgagagcgcagcacacag

SEQ ID NO: 6815763 - DNA, 86 bp, Homo sapiens
acaaacatcatggggtgaccatgagcatttaatggaatactatacatataaagctcttggaacactacctggtctatgatgcatgt

SEQ ID NO: 6815764 - DNA, 130 bp, Homo sapiens
ctgggaaggtgagcagttcatcttaacacaatggttcactgaaataaaagtggggttcttacagtaacaaagatgaaaacatttatatttagtggggaattagttatctctgtcatagcctacccctttg

SEQ ID NO: 6815765 - DNA, 65 bp, Homo sapiens
tgctgcgtgtctccttggggcagaccatttatcacaggtctaagccaggactgagagacgctgca

SEQ ID NO: 6815766 - DNA, 66 bp, Homo sapiens
ctgccagagtcttctgaccctgtgacagaagatttctgtgtgtgctccatggggaagactctgcag

SEQ ID NO: 6815767 - DNA, 86 bp, Homo sapiens
tggagcccctgccacaggagggccgtttgtgtgcctttatcccatcaaggcagcagcaggagctgctctcctgacgaggttctcca

SEQ ID NO: 6815768 - DNA, 88 bp, Homo sapiens
tcaaatcttatataatcggccataaatggtcagatattggtaatttcttgtggctgaactaatgtgctgtttggtataagaactttga

SEQ ID NO: 6815769 - DNA, 89 bp, Homo sapiens
actagcctggagatttagattccatttaattctgctggattgccatttctgctgtcagtctacaatcttaaatgaactagttccttagt

SEQ ID NO: 6815770 - DNA, 76 bp, Homo sapiens
ttctttttcactctagccatgatttcattaatcttttggtccagaatgaaatagttggctgtagagggaaaaagga

SEQ ID NO: 6815771 - DNA, 58 bp, Homo sapiens
cccctggagaatttcaacagagtggtccatagaccacttgaatcaaattcttaggtgg

SEQ ID NO: 6815772 - DNA, 59 bp, Homo sapiens
taagtagtttgtagccccatagtacaagtatgacttggcatggagttgagaattactta

SEQ ID NO: 6815773 - DNA, 61 bp, Homo sapiens
gcaaagttacagatggggttgcaataaacaggtgtggattcaacttcgtgtgtgtgtgtgt

SEQ ID NO: 6815774 - DNA, 87 bp, Homo sapiens
gacatatttactcctgccatttactcgtgcttcattgaatttcttcattttgacattcagagcactgggtagaattcacgttgtgtc

SEQ ID NO: 6815775 - DNA, 58 bp, Homo sapiens
gctttgaggtgctgaagatatcatgacagtgatcgagtttgtccacagccctcacagc

SEQ ID NO: 6815776 - DNA, 61 bp, Homo sapiens
acgggctgggacggggaagctctgtgggaaacactctaccttctcttcttctcttaaccgt

SEQ ID NO: 6815777 - DNA, 94 bp, Homo sapiens
tccatatgaattttagaatcagactgttaatttcaattaaaaatcctgctgggattttggttgggattgcattgaatttatagatcaatttgga

SEQ ID NO: 6815778 - DNA, 62 bp, Homo sapiens
ttctcagtgcaagtgactgatcaagggatatggatgctgtgggagaagctagcacaggaggg

SEQ ID NO: 6815779 - DNA, 68 bp, Homo sapiens
cctggtgttgggaggtgttccagtgttggtatgggaatcattcgatggcgccagcaccgcccagtagg

SEQ ID NO: 6815780 - DNA, 68 bp, Homo sapiens
tataatctgtcattttgtatctacatgggtagctccctatatctacagataactgaatgcagactgta

SEQ ID NO: 6815781 - DNA, 65 bp, Homo sapiens
ggcctttaagcaattgaaaagaaatatctggcacaagctctgagaaacttattgtttaaatggcc

SEQ ID NO: 6815782 - DNA, 68 bp, Homo sapiens
cttatcttctccagtgcttctgcacagtaaatggaatcactatctgtgttacactttgagaagataag

SEQ ID NO: 6815783 - DNA, 64 bp, Homo sapiens
gcatgatagctaactcccctcactggaagtactcagaatcccaggggagatggctgttgagtgc

SEQ ID NO: 6815784 - DNA, 71 bp, Homo sapiens
ttcccatctgagcaggagatgcccctggtgactttctgttcactggctgatcacctgcctcaggccgggaa

SEQ ID NO: 6815785 - DNA, 94 bp, Homo sapiens
ttttcaatcactgtttagatgttgaagagaaatatccataaggaggtttgatttgtccttacagatatttctcttcaacaacagtgattgaaag

SEQ ID NO: 6815786 - DNA, 84 bp, Homo sapiens
gagctgcattcaatggaggatgagaaacgtgcggaggctggctctctaagcatccaaacacctctccccctttgatgttagctc

SEQ ID NO: 6815787 - DNA, 66 bp, Homo sapiens
ggtgcagtgggccggaggccaggggagcccgtgtaggggaaccgcctggcctctgttcagtgtgcc

SEQ ID NO: 6815788 - DNA, 78 bp, Homo sapiens
tggctgcctgcctctgattcacaagactcctcagaatatttatatgagcatgggctttctcagagttctcaggagcca

SEQ ID NO: 6815789 - DNA, 77 bp, Homo sapiens
caacttgagcaattgcacagagcctggtaccgagaagggtcctctgcttggttttatgttctgctgttgccatcttg

SEQ ID NO: 6815790 - DNA, 76 bp, Homo sapiens
ccaggcactgacctgggcattacaggtgcagtggggacaagtgggccagtcctgcctaaggtggttgacagcctgg

SEQ ID NO: 6815791 - DNA, 60 bp, Homo sapiens
taggtctgataggagtttaactttgcacaattgtttggaaaaactgtctgtcagtatcta

SEQ ID NO: 6815792 - DNA, 62 bp, Homo sapiens
gagaggagccctgaggtgaaggactgggaaaatgtacagaaaatctcacatcagctcctagc

SEQ ID NO: 6815793 - DNA, 129 bp, Homo sapiens
cattttaaccagttcccctgactccagcctttctgctcattttattgcatacacaaatgtcaggttaacctgcagcacagttgtagtaaacagacaaaggcttgcgatgtctccacactgcccaggatg

SEQ ID NO: 6815794 - DNA, 57 bp, Homo sapiens
taatagttgtgactttgtaaagcttttaaatctgctttccccagagtctagctttta

SEQ ID NO: 6815795 - DNA, 126 bp, Homo sapiens
taggcttgagagaatggttattgttttttcaataattgctttgtatcttcagtttgtctttccataaaatgggaatgtaatcatggaatgctagcaatacaaaatttgaaggcttctacaggtcta

SEQ ID NO: 6815796 - DNA, 68 bp, Homo sapiens
gccagaggacttgggggctgaatgtgagggtggtaagaggaacagtcagggtgtcccgggtttctggc

SEQ ID NO: 6815797 - DNA, 72 bp, Homo sapiens
ggtgattaggaggtgaatgaggttggtgcctttataaaagagacttgaaggagcttgttcgccttcctcacc

SEQ ID NO: 6815798 - DNA, 65 bp, Homo sapiens
gttcagtggctgcagggaccgagggctccttccttccaaagcccttcctcctcgcctgtcagaat

SEQ ID NO: 6815799 - DNA, 66 bp, Homo sapiens
tgcccaagagctagaaattggttagaaactggttgagccaggatttgcacctaagtctatctggca

SEQ ID NO: 6815800 - DNA, 85 bp, Homo sapiens
ttaaataaggtaactgttgccaacacttggtgcttactattaccaaacactgtcctaactgctttgcacagatgagcttatttaa

SEQ ID NO: 6815801 - DNA, 63 bp, Homo sapiens
gcctgttgggtttctcagggtgcgccttcctaagtgagggtcagcggattggctcagacaggc

SEQ ID NO: 6815802 - DNA, 69 bp, Homo sapiens
aggccttgagagagttggaagggctagctacaaccatggtgttctgcccaccacactttatctgaccct

SEQ ID NO: 6815803 - DNA, 64 bp, Homo sapiens
caggaggtgctggtcccctcgagcagaaaaatagttcagttccagaggcctgggcacactcctg

SEQ ID NO: 6815804 - DNA, 70 bp, Homo sapiens
tctcagtgtctgttttcctcctggtttctgcccctgagagtgaagttgggggcagggagggatactgagg

SEQ ID NO: 6815805 - DNA, 71 bp, Homo sapiens
cccattagaaagctgttgaagtaattcagccatgagacgacagtggcctgaaataaagtagcagaagtggg

SEQ ID NO: 6815806 - DNA, 82 bp, Homo sapiens
tgtgcatgtgtgtggtttgcattatgattttgtgtgattataaagatacgtttgtgcaagagattcaaaccataaaggcata

SEQ ID NO: 6815807 - DNA, 59 bp, Homo sapiens
gcacttctggcctggcctgtgttcagctgagaaatgctgccaggcaggtagaggagtgt

SEQ ID NO: 6815808 - DNA, 63 bp, Homo sapiens
acaaggcactttatgaagaggaaaagagctgaacaaaaggtgttctcttcaggaggtccatgt

SEQ ID NO: 6815809 - DNA, 59 bp, Homo sapiens
gagggggtggtggccttaggagctgaacttagatcttctgctccaaatacttttccctt

SEQ ID NO: 6815810 - DNA, 101 bp, Homo sapiens
tggggatgggcatcccacttgtgaattgggcagtccacagtcccagagctaatgagcttaggttggatgaggctgggttaggcaggtaggaaccaaaacca

SEQ ID NO: 6815811 - DNA, 83 bp, Homo sapiens
gcctctgacaactctggggagggagagcaactggtcagatccccaaagacttggccttatttccacagaatgattttctaggc

SEQ ID NO: 6815812 - DNA, 71 bp, Homo sapiens
cagagcaataagccaggtgtttgtgttgcgggacatgaggagtaacaacacactgagtcttgggtgctttg

SEQ ID NO: 6815813 - DNA, 57 bp, Homo sapiens
ggctattgatgagatctctgcactcctatttttattgcagcactgttcacaatagcc

SEQ ID NO: 6815814 - DNA, 86 bp, Homo sapiens
tgttcctgcaagcacctggcacggctagcttccctcctccctggctgcaggattgtgaggtggttgtgcacggagctgcaggacca

SEQ ID NO: 6815815 - DNA, 70 bp, Homo sapiens
gatgctttccaaagtgttgagttcagtccagggcagcttccctgttctgttaattaaactttgggacatt

SEQ ID NO: 6815816 - DNA, 79 bp, Homo sapiens
gtcccccgcatggccagtttgtttactgatggttttcatttggcagaatcaggaagacagcctggcttgatgtcatgac

SEQ ID NO: 6815817 - DNA, 63 bp, Homo sapiens
ttccagaatcttgtttcttgtgtgtttctggttaggagaggccacaagagagattctcctgaa

SEQ ID NO: 6815818 - DNA, 65 bp, Homo sapiens
ttgaggtttaagtgtcatagtgtatttgaagaacttagtaacatggctggcaccttaaatttcag

SEQ ID NO: 6815819 - DNA, 74 bp, Homo sapiens
agctgagaaacctgaatatgcttcaatgacacaaaattatttctactgccatcttcaggtgttttccatcagct

SEQ ID NO: 6815820 - DNA, 59 bp, Homo sapiens
cagccacaggaaacagagacagcctccttgttgaggaagctgttcccaatcctgggctg

SEQ ID NO: 6815821 - DNA, 88 bp, Homo sapiens
atggcttctgcacctcttaataactttctaaagtcaaattggtataagagcagttgtatctggaaagggttagggggaaaaaggctat

SEQ ID NO: 6815822 - DNA, 65 bp, Homo sapiens
acagagagggagtgataaatcctatgggcaaggacatacactcatatgtcactcacctcctttgt

SEQ ID NO: 6815823 - DNA, 60 bp, Homo sapiens
gtctccatcctgacccttagtgtggagttgttccacatttgacccatggagggtagaggc

SEQ ID NO: 6815824 - DNA, 91 bp, Homo sapiens
tggagcgagagtgatgtctgtagtgaagaatttggcgccatcttgagaaggtcaaagtgattcttcgattaaatgccttacttatcgccta

SEQ ID NO: 6815825 - DNA, 66 bp, Homo sapiens
gctggagtgaagagaaggctgctggtgcctgaattcttggctctagaaactccatctcactacagc

SEQ ID NO: 6815826 - DNA, 78 bp, Homo sapiens
ttcactgtccattaagggacctcagctggcatggaacattgctttcctatttcagctgcctttgactgggatattgaa

SEQ ID NO: 6815827 - DNA, 55 bp, Homo sapiens
tgagcactgggtgttttctgtggttttcctctttggggaaaatactctgggctca

SEQ ID NO: 6815828 - DNA, 58 bp, Homo sapiens
ggaatctgccagcttcccactatgggaaaatctgccactgtggaagctggcagatttt

SEQ ID NO: 6815829 - DNA, 84 bp, Homo sapiens
gatcccgggacctgaaactggagtccgggtgtttataagagcaaggctaaatttcagttattgaaacaggtccaggctgggatc

SEQ ID NO: 6815830 - DNA, 57 bp, Homo sapiens
tagttctgtttatatttggtgtccacgtatattaagaaattcaaatgtacagaacta

SEQ ID NO: 6815831 - DNA, 77 bp, Homo sapiens
gttaattagttcctttttaagtcgttgtggtaaatttggctgtatgcatcttacgttttgaaagggatgggattaac

SEQ ID NO: 6815832 - DNA, 55 bp, Homo sapiens
ttactaagtccctgggtccaaggcagctctgcagagcctagggtcacttcagtga

SEQ ID NO: 6815833 - DNA, 55 bp, Homo sapiens
tcatctgtggctgcttttgtgctccaactgcagagctaagtagttgccacagaga

SEQ ID NO: 6815834 - DNA, 68 bp, Homo sapiens
tgaaggcagaaagggatgtgagtggggaaatgaggagtttattctcacagtcatttactttgccatca

SEQ ID NO: 6815835 - DNA, 68 bp, Homo sapiens
aaggttatgggagagctgacactgagacctgaacttcctgagtacctattcagtgctcctatgtcctt

SEQ ID NO: 6815836 - DNA, 67 bp, Homo sapiens
ttgcaagatgactttcccaaaggttgtattcctacattcctacaagcttattaagttatctgtgcaa

SEQ ID NO: 6815837 - DNA, 56 bp, Homo sapiens
tcccaagtgtttaaaaatggaaatgcattacttctgtgcagctcagacatttgggg

SEQ ID NO: 6815838 - DNA, 77 bp, Homo sapiens
gggcaaaggcttggctctggttgccctgtgactttgagtgaaggttattgggtgcctcaggccctgcttacctgctt

SEQ ID NO: 6815839 - DNA, 66 bp, Homo sapiens
ttgctaagagcttcatgccaggaggtttaagacctatgtcttatgactcagcgtgagcaagagcag

SEQ ID NO: 6815840 - DNA, 124 bp, Homo sapiens
accacagggctaggggtgagggttgaggttagtaggtcagcttcacccatcaactgtggaggctttttgggtccaggctgtatctcactcacactttcatgcccagggctggccttggcctggt

SEQ ID NO: 6815841 - DNA, 81 bp, Homo sapiens
tgagcaggttaggagcagttgggctctaggaagtttaaggatagcactgatttccagcctaaaggctttgtatttgagtca

SEQ ID NO: 6815842 - DNA, 57 bp, Homo sapiens
ttgaaatgcagattccaatccatacacctagggagggggttgtgttctatatttcaa

SEQ ID NO: 6815843 - DNA, 58 bp, Homo sapiens
cctggaatagtctgttctcttctgtctttgttgtcagtggctggacagactttcctgg

SEQ ID NO: 6815844 - DNA, 83 bp, Homo sapiens
ggcagcaactatttggtagtcctgataagattataggatcataatctaggaaacaggattataaaatcttaacaagttgagct

SEQ ID NO: 6815845 - DNA, 78 bp, Homo sapiens
aggagtggcaggttgggttcttatggaagtgggtaaggaatcagaactatggaaactcaacatttgttcctcattcct

SEQ ID NO: 6815846 - DNA, 71 bp, Homo sapiens
gcagggtatgggggaggtgctaccgagctcccaagtgctctccaggaacaccaccctcccagcacctatgc

SEQ ID NO: 6815847 - DNA, 100 bp, Homo sapiens
aggcctcgagggagggatgtctcaggccccattcctcttgggacagctgagtggtctctgagggtgggagctggtttgaggcttcttccgcagctggctt

SEQ ID NO: 6815848 - DNA, 59 bp, Homo sapiens
gccatcctgtccaatcccgctctcatttagaaaggtttccattggagcagaaaggtggt

SEQ ID NO: 6815849 - DNA, 70 bp, Homo sapiens
gcttctgggggttgctgtgcacatgaatgtttgctattgttccaggcgcacgtcggccttaagaaatagc

SEQ ID NO: 6815850 - DNA, 70 bp, Homo sapiens
ctctgaggtcctacagtgaccctctctggcaagacaagaccccagaacatattaaggtaggaccccagag

SEQ ID NO: 6815851 - DNA, 82 bp, Homo sapiens
tggaagctgaggcaagtaattcaaagctgtggctcaaagaaattgacagggccaggctgtgggtgatttactgtggcatcca

SEQ ID NO: 6815852 - DNA, 78 bp, Homo sapiens
tatttttatatgaatatgatgtatgggtccagctttggaatatttggacacaataacagatgcttcagcataaaaata

SEQ ID NO: 6815853 - DNA, 87 bp, Homo sapiens
tatttaaacaacagtttaggtatttgtagcatgtagctgtgataaaaatcatgacagtggttacaaatagctggattttgataaata

SEQ ID NO: 6815854 - DNA, 57 bp, Homo sapiens
atcatgtcttcagctatttgtattttaacgagtaatttcaatggtctgagacatgat

SEQ ID NO: 6815855 - DNA, 108 bp, Homo sapiens
cagaataccttcttccttgcgatttatgtggacagacataatcctaatttctcaggcaagtaaattgatattagatttgtctcagtgataccaagatgataatttctg

SEQ ID NO: 6815856 - DNA, 92 bp, Homo sapiens
agagagaacatgcaatgtgattccatttatatgaagttcagaaataagcaaaactaatcaatgtggatggaagtcagatagcagttgtttct

SEQ ID NO: 6815857 - DNA, 59 bp, Homo sapiens
cagctggcagaacctgcatccatgtctccaggtgagactgcctcggagctgccaggctg

SEQ ID NO: 6815858 - DNA, 83 bp, Homo sapiens
tattcagattctatatcatattaataagaattgaaccttgaaagtaacatctgttattctattaatgtgattgtgtgtgaatg

SEQ ID NO: 6815859 - DNA, 58 bp, Homo sapiens
gccctgggccccgaactgctgaggctccatgaggtccagctgtgcctggcccaggagc

SEQ ID NO: 6815860 - DNA, 55 bp, Homo sapiens
gagcccagctgtccttggcaaacaccccacagaggaggcgagggcttgctggctc

SEQ ID NO: 6815861 - DNA, 57 bp, Homo sapiens
gggtgtatacatgtgtgttcacgcatgtgtgcatgtgtgtttgtggtgtgtatacct

SEQ ID NO: 6815862 - DNA, 58 bp, Homo sapiens
tgcacgtatggcagtggagcccccataagcctgggcccttgagtggccatgatgtgca

SEQ ID NO: 6815863 - DNA, 67 bp, Homo sapiens
ctagttgaaattaagagagagtttgatgctaatatgtagacaaatattccttgattggattaattag

SEQ ID NO: 6815864 - DNA, 70 bp, Homo sapiens
gatggagacagtttctgggcgttcacaggtaagctgatactttgagattctcggagattagtgttctatc

SEQ ID NO: 6815865 - DNA, 57 bp, Homo sapiens
attgtgatgggaccctcgtttatctggctgcaggagatgaaagcttcccatcacagt

SEQ ID NO: 6815866 - DNA, 126 bp, Homo sapiens
tccactgccagttaaccagaggagcataacatgtgggagctgctgggtaacatttccaaaatacttagcattagtcagatatgtttttagaattatgtatccattttggctgaaggaaaatgtgga

SEQ ID NO: 6815867 - DNA, 59 bp, Homo sapiens
ttaggctctatcagttatttgtgttgtgcaaagcactgcattaaatgctagggacctaa

SEQ ID NO: 6815868 - DNA, 94 bp, Homo sapiens
agcagagcctcagattcatataaattcagaactcagaaatcttggagaacatcaaggcactgattctcagagttactgtcgtgaggaaactgtt

SEQ ID NO: 6815869 - DNA, 130 bp, Homo sapiens
gtcgcctttgtgcccggcggcggggtggggaggtcagcgccgggccgggccgcggccgccggggaggggctggaggaccggcctcggacaaagcggcggccccgccccgccatgccccgggggttggaac

SEQ ID NO: 6815870 - DNA, 89 bp, Homo sapiens
ggtgcataacatttccattcttgccatgaagctcagagctagccttttctgtgcataaatggacatggattatatgtgttatagcaacc

SEQ ID NO: 6815871 - DNA, 111 bp, Homo sapiens
tgggcaaaagatcttcatctgctataggtgcattccaaggcactttagaaacaaagctatggatcaagggagggcttgtggaaatggtagatgtgggttttagactgccca

SEQ ID NO: 6815872 - DNA, 100 bp, Homo sapiens
ttttacaatgcaccgttcagttttctatatgagttgtggcttagtcacagtatttcactgtgacagcttagcttaagaaaaagaaaggtgcaggagaaaa

SEQ ID NO: 6815873 - DNA, 103 bp, Homo sapiens
ttggaaaatgtgagatgttgctgcataatgacaataatcattaactttaggtttattctggggttaatgaattattatagtgcagtgaaaaattattctccaa

SEQ ID NO: 6815874 - DNA, 68 bp, Homo sapiens
gggacgcggctcggcgggtgcgccccgggggcatgtccgcgcgctaccgccagggctgcagtggtccc

SEQ ID NO: 6815875 - DNA, 90 bp, Homo sapiens
catggcccacactttgggtgatgcctaggggccctggaggccaccgcctggtcccaggccccagggcttgtcagtctattggtggatatg

SEQ ID NO: 6815876 - DNA, 94 bp, Homo sapiens
acagtatcctgttttctacagtctgggtctcagccccttgggaccgctcttccaagctcaaagacaccagaatctgttgagcaactgaaccagt

SEQ ID NO: 6815877 - DNA, 62 bp, Homo sapiens
gcagttctcagccaggcggcaggcggagcccagcagcgggtgcctgtccttggctgcactgt

SEQ ID NO: 6815878 - DNA, 65 bp, Homo sapiens
tgtgccctttgtgtctggctggggtggaaagccatgctgccatccacagtcagaacgggcctaca

SEQ ID NO: 6815879 - DNA, 65 bp, Homo sapiens
tttcacagctgggatggataggggatatatgtgtatgtgtgtacatatctatcctagatttgaag

SEQ ID NO: 6815880 - DNA, 67 bp, Homo sapiens
caagatgacaagatttagagtctgctaaattgcaaagcttggtaggattttctcaatcttattcttg

SEQ ID NO: 6815881 - DNA, 63 bp, Homo sapiens
acagaggagatgaggagcagaggactgggggtgaagagttctgtgctcaagttctgcctctgt

SEQ ID NO: 6815882 - DNA, 124 bp, Homo sapiens
ggcagcccccgccagcccaccagcaggctatgtcagggccgctcactgcttctttctggacactgctgagcagagctgcctgttgcatagcaactgcccgggcatatttgtagggggctggacc

SEQ ID NO: 6815883 - DNA, 61 bp, Homo sapiens
cagaagaaagtggggagacaagaggctgctcttgttacttgatttctttgctttatttctg

SEQ ID NO: 6815884 - DNA, 127 bp, Homo sapiens
tcagtgatcatgagaaacgggagggcccaatgaaagagactggggcattttggccaggggagtagagagaccctccacagctcctcagcctctttcactgatttctttcaccttttatgaatgctgg

SEQ ID NO: 6815885 - DNA, 66 bp, Homo sapiens
ttctaagtgccagggacacttcttgtagcattgaggcagttaagagaagagcctggtattccagag

SEQ ID NO: 6815886 - DNA, 70 bp, Homo sapiens
cagtctccaaagaatagaggtgacattcctaaattgggaataatgttatgtcattcttctacttagtctg

SEQ ID NO: 6815887 - DNA, 106 bp, Homo sapiens
cagagaaggatgcagtcagttcaagctgtttttgactgatgtttcagattgtggtctagtaaacaggtctgaaaatagctacttttttaaagactgtaaattcctg

SEQ ID NO: 6815888 - DNA, 81 bp, Homo sapiens
ccagcaggagtccagcttggcctctcccatactgtccaggcagatgttggagggaagaaaagaggcctggcctcctgttgg

SEQ ID NO: 6815889 - DNA, 58 bp, Homo sapiens
gtctagttatctttgattatatgcataatattgatgacatattgcaaggaagctggat

SEQ ID NO: 6815890 - DNA, 99 bp, Homo sapiens
aaaacacaaatagaaagcttcaaattagtggaataataatgatcaatgaaactgaaaatattactgaattattaatttgtgttgtgtctgttttgtttt

SEQ ID NO: 6815891 - DNA, 57 bp, Homo sapiens
ggtgaggaattggggactgaccacaatgaaggcaaggaggcccaggtttccatcacc

SEQ ID NO: 6815892 - DNA, 75 bp, Homo sapiens
ctgtaaagataagaagatactgagtttgactgtgtctctgctcaccgtacaaactctttatatttcatattccag

SEQ ID NO: 6815893 - DNA, 56 bp, Homo sapiens
tcactgatttgcccttatcctgcctaccctctggtggtggtattcagtaacagtga

SEQ ID NO: 6815894 - DNA, 56 bp, Homo sapiens
ctgccttgagttcaaattctgagttagtcattttcagtagtgcaactttaaggcag

SEQ ID NO: 6815895 - DNA, 91 bp, Homo sapiens
actaattagctgctttaatatgaactttggtaagaaattttctttccattcttgcagaaataagtttaaatgaaggctctaggcttctagt

SEQ ID NO: 6815896 - DNA, 83 bp, Homo sapiens
gaaatgaatgaaaattataagaaacaaggcaaattttgagggtatcatttatcatgatatcttgtttttcatgcatccatttc

SEQ ID NO: 6815897 - DNA, 62 bp, Homo sapiens
ctgcgcctcggtgagccggtccccagccctgtttcccctggggccctgatctgtgagcgcag

SEQ ID NO: 6815898 - DNA, 82 bp, Homo sapiens
gatgggacagtgctccacgcttggcaagacttttggtatctatgactccttgggctctaaatgccagtgacactgtctggtc

SEQ ID NO: 6815899 - DNA, 70 bp, Homo sapiens
ttattggggagagggctgtgagggccaggaaccaggcaggtcactgcatagtccatcttgaattcagtga

SEQ ID NO: 6815900 - DNA, 56 bp, Homo sapiens
gcctggctaattttggtatttttagtaaagatggggttttgccatgttggccaggc

SEQ ID NO: 6815901 - DNA, 66 bp, Homo sapiens
atagaatttgagaagatgtgagagtgaagtaatatagacagctttgtacattttctcagagtttat

SEQ ID NO: 6815902 - DNA, 67 bp, Homo sapiens
ttcttaagtttgaagtttctggccgaaggctctagatgctgccttagcaagaggctcgatactagaa

SEQ ID NO: 6815903 - DNA, 56 bp, Homo sapiens
tacttttattctcgccttctttctgttgggaaactgaggcaggggatgattaagta

SEQ ID NO: 6815904 - DNA, 130 bp, Homo sapiens
cccagcaaaaatcttgtggcattttattggctgtgtttgggtcacatgcccacctttgaaccagtcactgaggtcaggggtatgtgatgtcctgattgggttaggcttgggccacctgattcatcctggg

SEQ ID NO: 6815905 - DNA, 130 bp, Homo sapiens
tatcaaggctctcttttttgctcagcagtaatctgattctctagctgtgataaactgctctgcctttggccttctagtttagccatttaggaattggattattgtctcataaaacagaggggcaatgata

SEQ ID NO: 6815906 - DNA, 74 bp, Homo sapiens
tcttgctaaagtttttgctatatggaattggtcattctagagatgtcagttacctagcacaagaattgcaaaga

SEQ ID NO: 6815907 - DNA, 77 bp, Homo sapiens
ctttgagtgctgggatgtcaggggctttaggagaattgggacaatatattggtcatcatccctggtcagtaccaaag

SEQ ID NO: 6815908 - DNA, 77 bp, Homo sapiens
ggttcactgagtgcagttgattgacttaagtacctgcaacaacatgcaaggtactcagtggacttcaaatttgaact

SEQ ID NO: 6815909 - DNA, 70 bp, Homo sapiens
tcaggatctaaagttagaaagcccataaagataggacacttgtctgccatgctaacttcagtatcctaga

SEQ ID NO: 6815910 - DNA, 87 bp, Homo sapiens
ttgggggcagggtaagcaatgtctgaccgttttgcccaggcgtgtctcaaactcctgggctcaaggcatcttacctctgcctcccaa

SEQ ID NO: 6815911 - DNA, 61 bp, Homo sapiens
ccaggtgcttctgctcagcttcctactgggaccaatgaagcaatggagcgaaggtacaggg

SEQ ID NO: 6815912 - DNA, 62 bp, Homo sapiens
tctgtggacacaggagagagaactgctgggaacggatccccagccagtcctgtttctacagg

SEQ ID NO: 6815913 - DNA, 112 bp, Homo sapiens
ggagataaatatttcaataattttcattgacagttgtttcaaatacgttttatactttttcaacatgtaacttttgtgatctgtcgatttttgtggaaatgttaaactcttc

SEQ ID NO: 6815914 - DNA, 80 bp, Homo sapiens
ctgccagactgggttgatctcagccctaaggtaactatgaagctcccttaggttatgataaatttagttattattggcag

SEQ ID NO: 6815915 - DNA, 63 bp, Homo sapiens
tcagccacaccacttccttatggctctcggtctccttagcagccgtattatggtggtttctga

SEQ ID NO: 6815916 - DNA, 66 bp, Homo sapiens
agttctaaaggtattttgcagagatagttactctgactggtatctgcaagtttatcacttgggatt

SEQ ID NO: 6815917 - DNA, 66 bp, Homo sapiens
taggaatatgcagggtaagttaggaagaatttaaatatgttggttactattatcttgctgtttcta

SEQ ID NO: 6815918 - DNA, 82 bp, Homo sapiens
cagcagccagttaacatttagagtgaaggccaagcgtaaaacaagaaatgacccttggcccactctcagaatgtggcgaatg

SEQ ID NO: 6815919 - DNA, 81 bp, Homo sapiens
gcagagtaaatggtattcatgtgtctattcagtgaatcaacaaatacgtactgagcacctgctaaatgacagttactgtgc

SEQ ID NO: 6815920 - DNA, 67 bp, Homo sapiens
tgtgtgttgataggcattcattggagaaaatttgtgtttcctcttatacagtgtttattaaaatata

SEQ ID NO: 6815921 - DNA, 57 bp, Homo sapiens
aatgacctccaggtaaatgcacaagaaagtcctgatgcctttaaaaaggaagtcatt

SEQ ID NO: 6815922 - DNA, 67 bp, Homo sapiens
aagtggcaggagagcacagtaaatgttggaggcagacagcctggccttgaatctggctttgccactt

SEQ ID NO: 6815923 - DNA, 67 bp, Homo sapiens
cttcctgttgtgtgtgtctcatcctgtttcatgatggctccatgaggcacatcacagccaatggcag

SEQ ID NO: 6815924 - DNA, 56 bp, Homo sapiens
cagcttagcagctggaggtaccatggacattcattccttcttcatctcctgagctg

SEQ ID NO: 6815925 - DNA, 69 bp, Homo sapiens
gctgtttgaccttagaacgtgacacaagaagagcaatactggctcctccaatttcttaaggagggcagc

SEQ ID NO: 6815926 - DNA, 67 bp, Homo sapiens
atcctctctcccataccagtcttgccttctaggcaccaccattggatctgtagggacttcagaggat

SEQ ID NO: 6815927 - DNA, 67 bp, Homo sapiens
gcctagagctcctcccagggtagcactggtctctgctccagtgcctagaggtgaagagctatctggc

SEQ ID NO: 6815928 - DNA, 59 bp, Homo sapiens
ggatggaggggtggtggaagtcagcccgtgaactctcccccattgccctcatagtatct

SEQ ID NO: 6815929 - DNA, 58 bp, Homo sapiens
gcctaggaagctgagattgcagtgagccatgatcatgacactgccctccagcctgggc

SEQ ID NO: 6815930 - DNA, 58 bp, Homo sapiens
gggatttctccttcctttaaacatgcaacaggcacttgaaggaaagagggaacatccc

SEQ ID NO: 6815931 - DNA, 59 bp, Homo sapiens
ggtggggtattgggtagttgttctgtgaaggtacagaagagcacatttagtatgttacc

SEQ ID NO: 6815932 - DNA, 62 bp, Homo sapiens
aatctgaggctggcacgggaggtgtcagtagagacataggcacactgtcccatcctcaggtt

SEQ ID NO: 6815933 - DNA, 55 bp, Homo sapiens
aaagtcagaaattgtgtaaagtggtagcccattcaactttgcatttcctgatttt

SEQ ID NO: 6815934 - DNA, 64 bp, Homo sapiens
tgatttcatttgagtttatagttgctgctcattatgttcagcatctgctttattaaatgaatca

SEQ ID NO: 6815935 - DNA, 64 bp, Homo sapiens
gcagtcctgggcacagccctgggggccaggagacgcctccatcagccgtgggcccaggcgctgc

SEQ ID NO: 6815936 - DNA, 63 bp, Homo sapiens
tccatttgatcaacattgtacagttgtagggagatggctgtgtacaggaactgatcagatgga

SEQ ID NO: 6815937 - DNA, 92 bp, Homo sapiens
aggaaatcagaagctctgcctgtcagcagcttaagattaatatatgggtttggcaagaaaatgtgattgacaggcactgctattgtcagcct

SEQ ID NO: 6815938 - DNA, 96 bp, Homo sapiens
ctgctcagtgtgcagactgagggccagcagcctcagcatgactgggagctcactagcagttcaggccggctgactcagaacccacattctagcaag

SEQ ID NO: 6815939 - DNA, 113 bp, Homo sapiens
tgtatcaagacagaaaatgaactggataagagttttacttcctagaccttctggtctgaaatgcagggagagaactctgtctttatgccagtttatttaacttaaatgaaaca

SEQ ID NO: 6815940 - DNA, 73 bp, Homo sapiens
ggttggttcttccaggaggcttggcgggaggatctgtcctggcctctctcccggcttccggtggtcactggcc

SEQ ID NO: 6815941 - DNA, 58 bp, Homo sapiens
tccagggaagagcagaggctacaacacagaggtgtgagagagcctggttttcctagga

SEQ ID NO: 6815942 - DNA, 108 bp, Homo sapiens
tccctggaagtataggcaatgattcaattaaatatttagtcatttggaatcgattgaaatttccaaggttactggtggtttataatttcatttctgtataaccagaga

SEQ ID NO: 6815943 - DNA, 59 bp, Homo sapiens
ggtgccccgagcgcgtgccggacgctggtgttggctctggcggccatgctcgtggtgcc

SEQ ID NO: 6815944 - DNA, 107 bp, Homo sapiens
aggaagtatggaggctgctctgtgactccctcttcctctcttccccgctctatgtgtgggaatgacgaggaagaggaaaggagtaagaggcctggctcattcttcct

SEQ ID NO: 6815945 - DNA, 100 bp, Homo sapiens
gctctcctcaggattggggtctggagtgggtgggaagccagaagaagagagcccctccactctgctgaggccttcccactccccagagcctccggagggc

SEQ ID NO: 6815946 - DNA, 89 bp, Homo sapiens
ggaacaggtccttggtttcaggagcagggtctgttaccacctcagggtgtgaccttggacatgcctcccgtctcttctgggcctgtttc

SEQ ID NO: 6815947 - DNA, 62 bp, Homo sapiens
ttggggctaactttctgagggtagttgttttaggacgattggcagcagggagttggccgcaa

SEQ ID NO: 6815948 - DNA, 92 bp, Homo sapiens
ctctttgacctcagtttccccatgtgtaagatgggcataaagatgactgtcctgcctatttacttcacagttgaatatagagttcagatgag

SEQ ID NO: 6815949 - DNA, 56 bp, Homo sapiens
cggtggctcaggcccccagcagggctccacctgggcaccgtggggccggggcaccg

SEQ ID NO: 6815950 - DNA, 82 bp, Homo sapiens
gaagcaccagctgcactggtttgttgaaattcagtaatgggttaaaccgtgatgagacaacagcttgtgctgctttgccttc

SEQ ID NO: 6815951 - DNA, 55 bp, Homo sapiens
ctccagtgcactggtcttttcagacctgcctcctggaatatccagatgcctgggg

SEQ ID NO: 6815952 - DNA, 60 bp, Homo sapiens
gtgggtgtttatgtattatgatgtgtatttgaatacaactatcaacgaataagcattcat

SEQ ID NO: 6815953 - DNA, 87 bp, Homo sapiens
tgactactgttctaggggacataatatgaaaagtcttttagctgtgacattttatggtttttctattgtaagtctcctatagtggca

SEQ ID NO: 6815954 - DNA, 68 bp, Homo sapiens
attcttactccatagaatgaatacaaaaaagaagatgtatgtgaagagttttctgtggagttaagagt

SEQ ID NO: 6815955 - DNA, 57 bp, Homo sapiens
gtgagtttccatagagatgatgacagtgtacagagtcatctctaaatggtctttcac

SEQ ID NO: 6815956 - DNA, 64 bp, Homo sapiens
tttctcatgctttcttagtactacatttccaaccctgagatggagtgttataggagcagggaaa

SEQ ID NO: 6815957 - DNA, 61 bp, Homo sapiens
ggtgctgtgtgagcattactggctgaccgactctaccccggtcacccatgatcacatcacc

SEQ ID NO: 6815958 - DNA, 79 bp, Homo sapiens
gataaacataaggtcattttttttagcttttttttaaaatgaagagatggctgatataaagataagctttatggatatc

SEQ ID NO: 6815959 - DNA, 55 bp, Homo sapiens
cagggccctaagatacacatcagaaacaaacgtcctcattgtgtcttgggccctg

SEQ ID NO: 6815960 - DNA, 73 bp, Homo sapiens
gcacagctggacatgtcggatagaatgagttcatcccttcaaagatgagcttaaagccgccatctagtagtgt

SEQ ID NO: 6815961 - DNA, 60 bp, Homo sapiens
tctcctgcctttgcatcctgggccagcatctccctggtctcagcctgtgaagagcagagg

SEQ ID NO: 6815962 - DNA, 117 bp, Homo sapiens
cccaccagctttcccttcctttctctccctttcacttaactagcccagcctaatagaggcagtgaaggacaggcaggtgaggggcagacaggacaaggaaggtggaggctggcaggg

SEQ ID NO: 6815963 - DNA, 67 bp, Homo sapiens
gacagaagttgaggctggctcaaaggaaaaggggaaagcattggccgaagccagtccaagttctgtc

SEQ ID NO: 6815964 - DNA, 78 bp, Homo sapiens
caatcaggcttgcatagaaaccataaaggagctcgtcaggctgctggagtgagtggtttcttatgaacagcctcattg

SEQ ID NO: 6815965 - DNA, 98 bp, Homo sapiens
gtgtacctttccacacttcattatattccagctgacagttcaaaatgaaaaacacttggggacaagtgtcatctgaacatgcagcctgtgagttacac

SEQ ID NO: 6815966 - DNA, 58 bp, Homo sapiens
ttcccaggtggcacatagcagcacagaagccatctgctgcttgcatccaccctggggg

SEQ ID NO: 6815967 - DNA, 76 bp, Homo sapiens
attggggttggaagcggggagggtgagcccgggctgcccccctaggccggagctggcccccggccctctccccagt

SEQ ID NO: 6815968 - DNA, 83 bp, Homo sapiens
ctctggggccaggtggaaatggctttcctaggggatggggtggctccaactcaggctagtcagacccctgcggggcccctgag

SEQ ID NO: 6815969 - DNA, 55 bp, Homo sapiens
cttctttaccagggccaatgtcatgtcaggaaggtattgtgccaagggtcagaag

SEQ ID NO: 6815970 - DNA, 59 bp, Homo sapiens
tgagcaccatctgtttgtgtgccaagttctgtgcacactgctttaaacagatggtctca

SEQ ID NO: 6815971 - DNA, 81 bp, Homo sapiens
gcggcaaagactgagacagctccgctgcccgctgaactccatcctcccggcggtcgggcggcggcagctgcggtcggtcgc

SEQ ID NO: 6815972 - DNA, 63 bp, Homo sapiens
taatgtctatgggccagataatgtccataaatttgacattttcagtatctagtctagacatta

SEQ ID NO: 6815973 - DNA, 73 bp, Homo sapiens
agttatggtagcttaatttgcctggtgatattgattttctgctgccagctgtgctgtattaagctctatacct

SEQ ID NO: 6815974 - DNA, 56 bp, Homo sapiens
aatacatgggatgctaagagatcaaaagaagaattattcttagtagagcatgtatt

SEQ ID NO: 6815975 - DNA, 69 bp, Homo sapiens
ccaccttcttggccacacccacctagaggagagcttctttcctgagccgagggtgggcatgggagctgg

SEQ ID NO: 6815976 - DNA, 87 bp, Homo sapiens
gcatttcatcttgtttctcatctgtatggcacatatttttgggatagctccagtctatgtaaacgtctacattaaccagagaaatgc

SEQ ID NO: 6815977 - DNA, 93 bp, Homo sapiens
gtgcccctccctgtccattctcctcaattccactgtctgaaggatggactggggtaaggtgaggaggtgccattgttaacaggttggtggcac

SEQ ID NO: 6815978 - DNA, 93 bp, Homo sapiens
ttaggaacaatttggtgctaggtactttgatcggttgctgacaaatatgctaaaagtggtcaatcctagtaaaaacccagaatagttctctaa

SEQ ID NO: 6815979 - DNA, 57 bp, Homo sapiens
cctctcggcagcccatcttgtcaggaaagatcagatctaggacaggcagccgagggg

SEQ ID NO: 6815980 - DNA, 63 bp, Homo sapiens
tgtgcatgaggcagttcaagtccccaccatcctgggacttggtctaactagtgcttctgcaca

SEQ ID NO: 6815981 - DNA, 91 bp, Homo sapiens
tcatttgacatgtcttttaaagtctaataatcatgtataaaaaagataacggttcgctgcatctgttacctttaggagtatgtacaagtgg

SEQ ID NO: 6815982 - DNA, 79 bp, Homo sapiens
tgctttacgtgaggtggtacaatattaactcaaaatagaccacgatgagttaagaatacacatcataattcctagagca

SEQ ID NO: 6815983 - DNA, 100 bp, Homo sapiens
atgaccggcaaccactgaagacaagaaaacactggggaagcactgaaacccacagccttctcagcatttatttttcttcaaattggaatcagctcaccat

SEQ ID NO: 6815984 - DNA, 81 bp, Homo sapiens
tccacttttaaaaacctggttcaactgacattgatgacctccacaagttacaaaagaaccacggtgataaaaagttctgga

SEQ ID NO: 6815985 - DNA, 80 bp, Homo sapiens
ggaagcatagggcattattaactggaggaaaagtgatgacttttccctttttgttcattcttaataaattatgtgctttc

SEQ ID NO: 6815986 - DNA, 127 bp, Homo sapiens
tccttcccccagccacccgccccaagtttcacccctcgccactgcccttgtcaaatatcaccctggcttggaaaggtggagaagaagggaagagtgaggggatgaagtgtttaagctgtggggatga

SEQ ID NO: 6815987 - DNA, 72 bp, Homo sapiens
aggactttcttctccactggccatttcctctgttacggagactaacaaattgccagggagttaaagagtctt

SEQ ID NO: 6815988 - DNA, 60 bp, Homo sapiens
tgcctctctcagcttgctgcaactgtctttcccaatggatacctgccacagagaaaggta

SEQ ID NO: 6815989 - DNA, 64 bp, Homo sapiens
aggaggaagcagagtggggtagtggggaatccaggcccagaaccccaggcatcgcattcctctt

SEQ ID NO: 6815990 - DNA, 64 bp, Homo sapiens
cagagcaatacttggaaagtcacatacatatcagcaagaaatgtgtcaattttcaaatgctttg

SEQ ID NO: 6815991 - DNA, 77 bp, Homo sapiens
ggaacaaagtttctactaggatgtcttgaacacaaatagctctttcattgtgtataagcctagtgaaatttcattcc

SEQ ID NO: 6815992 - DNA, 59 bp, Homo sapiens
tttgtaacctaaagcaccagatttcctttctgcattaccagtgtgcgtttaggtgcaaa

SEQ ID NO: 6815993 - DNA, 72 bp, Homo sapiens
tggcattctgcaaggggagaattagaagctaggtgctgccagttgaatgaatcattctatgtatatgtgcca

SEQ ID NO: 6815994 - DNA, 80 bp, Homo sapiens
gagttgtgcagctagtgctgtgagtgctgtttctgtatcagggcacagatttcccactccatgtattggctcctaagctt

SEQ ID NO: 6815995 - DNA, 104 bp, Homo sapiens
gtaattccagtatgttttcagaagcacagtgagtgatgcagttgcctgcagttgtgacttgtagacatattgtatttacttaaaaggctgcttcttggcattac

SEQ ID NO: 6815996 - DNA, 56 bp, Homo sapiens
atgacagtttcacgtcctccagggtttaaacctcatggagactttgagcctgttgt

SEQ ID NO: 6815997 - DNA, 55 bp, Homo sapiens
ttaccacacttatttacattgggtctcaaaacctaattgctatttaatgtggtga

SEQ ID NO: 6815998 - DNA, 67 bp, Homo sapiens
tgccagcacttgggggagattccgggtcatatgctaatggctcaggataattttcccaaagcaggca

SEQ ID NO: 6815999 - DNA, 61 bp, Homo sapiens
ggatgtagattagtggcaaagctgggttggtgcacctggcttcccagacaatactgcttcc

SEQ ID NO: 6816000 - DNA, 58 bp, Homo sapiens
gctgcagagcaagttctctgttgttggcaaataaagccatagcagagatgactccagc

SEQ ID NO: 6816001 - DNA, 80 bp, Homo sapiens
cagggctgctgctgccagcgacacctcagaaagcatagcctcggcttcctgccccatgtgtccctggaagctgtaccctg

SEQ ID NO: 6816002 - DNA, 74 bp, Homo sapiens
gacgtctgcctctcgggacacttgggactcgattccacagctccagaaaacccaggaaacccgaaggcgacctc

SEQ ID NO: 6816003 - DNA, 91 bp, Homo sapiens
gtgggaatgagccacactaagcacagggagcagcatgggcaaaggcccagaaggctgggcacactctgctccagctttggttcattcccac

SEQ ID NO: 6816004 - DNA, 57 bp, Homo sapiens
ctgtcctccagacgacagtccccgcagcgtgtggcaggggctggcgcatggggaaag

SEQ ID NO: 6816005 - DNA, 55 bp, Homo sapiens
gcattagacccaaggtattttgttgatgttaacattttctgccaatgtctaatgc

SEQ ID NO: 6816006 - DNA, 73 bp, Homo sapiens
tatttatagagtagattattaaccgcagtggtgctcattccagggccctgccgggtattttgtgctatggatg

SEQ ID NO: 6816007 - DNA, 62 bp, Homo sapiens
cactctggggatgcaaggagaggtgagaattacagccatttttgcaataatctcccacagtg

SEQ ID NO: 6816008 - DNA, 66 bp, Homo sapiens
gtgcagaatattagtatcagttatacctcaataaaaggggtcagtgtatgtattgataagctgtat

SEQ ID NO: 6816009 - DNA, 57 bp, Homo sapiens
acctgaattttggatgagctgtccaagcagacagtatgtaatatctagagttgaggt

SEQ ID NO: 6816010 - DNA, 74 bp, Homo sapiens
tgccccctctgaggtgagcccagctggccctttaagaagctggggccactgctggcgccgcttggagatgggca

SEQ ID NO: 6816011 - DNA, 80 bp, Homo sapiens
ctatgtatgtatttagtgcttgttttaaaaatattataggattatagatatttatttttgagcattaagtgaaaacatgg

SEQ ID NO: 6816012 - DNA, 67 bp, Homo sapiens
tggccagaacgggaagctgaaattctgaaacaagcaaaatttttcacaatttcccttcatcaggcca

SEQ ID NO: 6816013 - DNA, 61 bp, Homo sapiens
gggtgaagggtctatctctctgcctttgtcttgcattacaggggctctgagaattccaccc

SEQ ID NO: 6816014 - DNA, 90 bp, Homo sapiens
ccagaaccctttatataaagacagccctcttcccagatgcctcagcctgaaggactgcttgcctgtgaggagggtgagtctaggaactgg

SEQ ID NO: 6816015 - DNA, 78 bp, Homo sapiens
attgtggctgtctaggaaagtttagtactttttctctttaaggcaaaaactggtaactattccccagattaacacaat

SEQ ID NO: 6816016 - DNA, 77 bp, Homo sapiens
ctgttgccaagttgatttttctggctcagccgggaggctgctccctggctctgttctaaattaataaggccaatcag

SEQ ID NO: 6816017 - DNA, 72 bp, Homo sapiens
tggaaaatttttgtgacttctatagagtctgtaaccaagaacagtatacctaagaaatccagagatttccca

SEQ ID NO: 6816018 - DNA, 76 bp, Homo sapiens
cattcttcagtttgtactgaattcaatttaagaagttgtggaggctgttggattattcaatatagtctgaaaaatg

SEQ ID NO: 6816019 - DNA, 65 bp, Homo sapiens
tccggccaggcacagtggcccacgtggacttgtaggggaggctgaggcaggatggcctggctggg

SEQ ID NO: 6816020 - DNA, 88 bp, Homo sapiens
tgtagttgcttttttaaaaatatagcgggtccatagaaaattatcattttcatttgctgtttactgtgttttgattaaaaagcaaaca

SEQ ID NO: 6816021 - DNA, 66 bp, Homo sapiens
tgtggggctcacccacaggaggtgcttagtgaatatttactcatcagactccagggtgggcgagca

SEQ ID NO: 6816022 - DNA, 71 bp, Homo sapiens
tagtactagatgttgggagagtagcatatttcttacagcttcatgctgcaatctctaaagcacctggacta

SEQ ID NO: 6816023 - DNA, 85 bp, Homo sapiens
agcaaaagtggattctgggagagttctatactctataggtctatcaagatttagtttctgtttaagttctcccagaattcatgct

SEQ ID NO: 6816024 - DNA, 115 bp, Homo sapiens
tcatatagttcatctgcttctgctttttgctttatgttttatcatgttcattttcccgtgtcaacaaatgtgtatatgaaacatgatgtgtaagggctgaatagtcactatgtga

SEQ ID NO: 6816025 - DNA, 96 bp, Homo sapiens
ggaggatggccaagttcagactttcgtgttatgttgcctagatgtaagaactaagcaaggagaaagtctgatagagctacagatggtcaatcttcc

SEQ ID NO: 6816026 - DNA, 68 bp, Homo sapiens
gaggcgggtagatcacttgaggccaggagttggagaccagcttggccaacatggtgaaaccccgtctc

SEQ ID NO: 6816027 - DNA, 63 bp, Homo sapiens
ctctagagtacgggctggcatgcctcttttctgtttcagcgtgttggcagcagtgctctgggg

SEQ ID NO: 6816028 - DNA, 59 bp, Homo sapiens
cctggatggtcccatgagcagctggagtccctaaatccagcatcctagtggtctccagg

SEQ ID NO: 6816029 - DNA, 55 bp, Homo sapiens
acttagctttgtttaacacagggagttcccttaacttgctgtcctcagagtaagt

SEQ ID NO: 6816030 - DNA, 60 bp, Homo sapiens
aatagaggaagaaacctgattgttcgtccagggtcagaatatcaggattcttgctttgtt

SEQ ID NO: 6816031 - DNA, 61 bp, Homo sapiens
ttggtccctgctaaatctgactgaaaactgtacagtacacagaaattgtgtagggattcaa

SEQ ID NO: 6816032 - DNA, 63 bp, Homo sapiens
gcaaactggctatgggaatcttgcagccagattgtaagataaagctaaccttacacagtttgc

SEQ ID NO: 6816033 - DNA, 55 bp, Homo sapiens
tacatctgcccctggtttcaataattcactttgttccaagtctggggcatgtgtg

SEQ ID NO: 6816034 - DNA, 71 bp, Homo sapiens
gagaggcagaggcctgaaaccgtctagagccatgtggggagctgggtgtgtattcaggccagttgcttttc

SEQ ID NO: 6816035 - DNA, 65 bp, Homo sapiens
ggcagagagttgccttatttgacctcagctgagaacatgcatgtcaggcaactcaagtttttgcc

SEQ ID NO: 6816036 - DNA, 61 bp, Homo sapiens
agctgccttttgagaaagctcaattacttttgaacaacctaatcatttccaaagggcagct

SEQ ID NO: 6816037 - DNA, 106 bp, Homo sapiens
caagtttcagagcatggcttggctctagtctgcctggctgggctgctcatggggacaaggctggtgtcagaggagtcaggtgagctgggtcatgcctcgaatcatg

SEQ ID NO: 6816038 - DNA, 62 bp, Homo sapiens
ccctccaggctgacgcagctatttacgttcagagtgaaatgggctgtgtggctgggattggg

SEQ ID NO: 6816039 - DNA, 63 bp, Homo sapiens
ggcttgagagactcatttgccaagtggttcgcggccttatggcaaagtaattgggtttctccc

SEQ ID NO: 6816040 - DNA, 72 bp, Homo sapiens
ttatcctcccaaaaaaggtatgttgaagtcctaactcccagtacttcagaatatgaccttatttggagatag

SEQ ID NO: 6816041 - DNA, 87 bp, Homo sapiens
cttttccattgacacaggcaaacacagaaagtagggataatgcaaaaggcaacctactttcctgtgtctgtgtattcagtaaaaagg

SEQ ID NO: 6816042 - DNA, 71 bp, Homo sapiens
gcactcagtagacatactcatgccatggtcaactctcatatctatgccgtagaggcagtcatgctacctgc

SEQ ID NO: 6816043 - DNA, 55 bp, Homo sapiens
gaacctctcagcagccatgatccttataggacttagtgagctatttagaggtatc

SEQ ID NO: 6816044 - DNA, 92 bp, Homo sapiens
gacctcactgaagaggtgacatttaagcagcaatttgaaggagaactgcttttaggattttaagaactctttagtgaatttgtttaatcgtc

SEQ ID NO: 6816045 - DNA, 66 bp, Homo sapiens
tttcttttacagtgtggctattcttcttcaataggctgatggtgcagctactctctgtgagaggaa

SEQ ID NO: 6816046 - DNA, 98 bp, Homo sapiens
ttctgaaaaacattttgcctattgtagcttctatacaacttcagcactgcaataaagccagttctcgggtgagtatggcagccagttgcaaaacagga

SEQ ID NO: 6816047 - DNA, 78 bp, Homo sapiens
tgggaatctagatttttacaattctctaccagtgtttctaaaagctgctggcctgggttgaaaacagctgagttccca

SEQ ID NO: 6816048 - DNA, 68 bp, Homo sapiens
cagggcccagccctctgctcactgtcccaccagctacatccccggagaccgtgctgggctgggctctg

SEQ ID NO: 6816049 - DNA, 60 bp, Homo sapiens
ggctctagagactctagagaaaatgtggaagatacagggctcagaggcatctgttgggct

SEQ ID NO: 6816050 - DNA, 98 bp, Homo sapiens
gagtctgcaaagttagttaaagaaagtcatccttaggcattgggaaaattcaattttcatcacaggtcctgatgacatttcctttaaacgccagattc

SEQ ID NO: 6816051 - DNA, 68 bp, Homo sapiens
cacagaggtttgggcattttactgcagctttccctgctgagttagtgtaaccacaaccatattccgtg

SEQ ID NO: 6816052 - DNA, 61 bp, Homo sapiens
tgaggctgatgaaagttgaaagactggttaattttctcctccttctcttgcttcagcttca

SEQ ID NO: 6816053 - DNA, 77 bp, Homo sapiens
cattttgaatttccaggagaggaaacctgattggtcacactagtatccagttttccgtcttggataaatcagcaatg

SEQ ID NO: 6816054 - DNA, 67 bp, Homo sapiens
gtcaggaatggtttctcaagcaagagaaacctgagttatgtcttgaaatgagaagccatggtttgat

SEQ ID NO: 6816055 - DNA, 76 bp, Homo sapiens
gacaagagtctccctggggtaacattagagggtcagcaggcctgcattccttatgaagaccctaggagagaatgtt

SEQ ID NO: 6816056 - DNA, 58 bp, Homo sapiens
tcgactgaatgtcagcccaggttgtaggtggcagtgagcagctgggctgtcacagtga

SEQ ID NO: 6816057 - DNA, 87 bp, Homo sapiens
gttaggattcatcaggaagacacaagaataatgatgaaggttggaaaaataattttccagattgtttttgtcttttcatttcctgac

SEQ ID NO: 6816058 - DNA, 55 bp, Homo sapiens
cctaaacagaacaaagaggcagaggatggcaaatctgcttcttgtttgatttggg

SEQ ID NO: 6816059 - DNA, 71 bp, Homo sapiens
agctccagggaaagagtggatcagtagttcaaatatacttattcctttctgtctttactctggacatagct

SEQ ID NO: 6816060 - DNA, 72 bp, Homo sapiens
gctggcccaggctcagttctgtggtgagcctcaggggagactcaccgctgggggctgagtgcagggtccagc

SEQ ID NO: 6816061 - DNA, 88 bp, Homo sapiens
gagatttctcagaccactgatgccatctcacctttgagatgcttacaagatcattctagctcagcaggtgggacaggttctgagtctt

SEQ ID NO: 6816062 - DNA, 79 bp, Homo sapiens
gagcctaggacaatggaggaccatcctggtttcaccagatcactactaggggaaccagggggccttccttcccacactc

SEQ ID NO: 6816063 - DNA, 86 bp, Homo sapiens
tgtgcttctatgtgcgtgtattggtctgtgttaatgtatttaaatacaagtttatttgattagaacactaaacgtttaggaagcca

SEQ ID NO: 6816064 - DNA, 59 bp, Homo sapiens
cagtgcttttcaaagttctatgtgcacataaatgcttgaggattttgttgaagtttctg

SEQ ID NO: 6816065 - DNA, 99 bp, Homo sapiens
tacactcgcctatgaatgactatgaccctttcatccctgaagacagtgcaaaagagggctgattcagggcaaagggcagagtttgagggtagaagtgta

SEQ ID NO: 6816066 - DNA, 97 bp, Homo sapiens
gtttgcattataatggagaaatgtttctagttgtatgtcactgacactatgttgaaacagtggccactgacttggaaatcacttcagatatgcagat

SEQ ID NO: 6816067 - DNA, 59 bp, Homo sapiens
ggccaaatgaaggcaatgggacttgataagaacaatcacaagaacccctctatctggcc

SEQ ID NO: 6816068 - DNA, 64 bp, Homo sapiens
gctgaagaagctgcagcctggaggggaagtgcctcaccaaaggccacacagtgaattctttagc

SEQ ID NO: 6816069 - DNA, 68 bp, Homo sapiens
atctgctagctgtgtgtgaatttggcctagtttcagttttaactgggttagtttgaccagcagcagat

SEQ ID NO: 6816070 - DNA, 57 bp, Homo sapiens
tgtcctttgggagggcacagctcttggcagacaattggttgtgacctgccagaggca

SEQ ID NO: 6816071 - DNA, 83 bp, Homo sapiens
catgctgtccccagtcttgtccattccatgctgctgtgttacaaactctcagaggtagtttgcaggggaggaaggggaatatg

SEQ ID NO: 6816072 - DNA, 82 bp, Homo sapiens
ttctccataacacagtgtcctcagaaacacagcaaaaattatacctgctgaattgaatttgcaggatagttgtgattgagaa

SEQ ID NO: 6816073 - DNA, 85 bp, Homo sapiens
ttccaatttcagttttttgttggctgagagcaacccattttatttgggactttcagtctttacaaggttgcttctactttgagaa

SEQ ID NO: 6816074 - DNA, 82 bp, Homo sapiens
gagtaaacaacaaatgaattccttgatctcccggtgctcaaaggaagcaaggctcggtcagggtgattcccagttggtactc

SEQ ID NO: 6816075 - DNA, 66 bp, Homo sapiens
ccagtcttttctgcaaaatctaagttagagtaggaggctctgacaggattttttcaggcaagatgg

SEQ ID NO: 6816076 - DNA, 75 bp, Homo sapiens
caggagaggctccatggaggagtatggacttgggagaaggctccatcttgatgggcccatggggatctactcctg

SEQ ID NO: 6816077 - DNA, 73 bp, Homo sapiens
gtgtgaagcaatctctgggggtggagctgaggaatctgcattattaacagtttcctgggagattcttacacac

SEQ ID NO: 6816078 - DNA, 129 bp, Homo sapiens
cttatgtagcacttagaacataattatttgtttatatgtgtgccactcttactgagaagtgagctcctctgagtagcggctatgtgtaacttatccattatttcttattacagtgtttagtcaaaaaag

SEQ ID NO: 6816079 - DNA, 81 bp, Homo sapiens
gagaggtacacgagatgccctgaggaatgtcacgctccaattcagagtttcccagcattttgggcactgctgtactctctt

SEQ ID NO: 6816080 - DNA, 60 bp, Homo sapiens
atattggggataattgtgctgccctaactagaagaaaaagccataagttgtctccattat

SEQ ID NO: 6816081 - DNA, 93 bp, Homo sapiens
gtgacttcattgcttcgtgtcagatcagaggttcctcgctctgaagggaaaggcaaacacttttgatctgactatgggaggcggggagaatac

SEQ ID NO: 6816082 - DNA, 74 bp, Homo sapiens
atgagcactctgacacatgaacttgatctaaatgagtaatggatacatgatcactgtattataatgaggctcat

SEQ ID NO: 6816083 - DNA, 64 bp, Homo sapiens
ttgtgtcatgttccattgaaaagtttctggatatcagaaagaaagtcaacctgatatgatgcaa

SEQ ID NO: 6816084 - DNA, 77 bp, Homo sapiens
cttctgcctgcctccttccccaagtcgtctaggccacagacttcaggcttagacatggagaaggagccagtgggaag

SEQ ID NO: 6816085 - DNA, 89 bp, Homo sapiens
ttgcttagcttctccatctcagctacctcatctgttaaacggggctgagggcagcctcgtggggttgtagagaggactaaattaggcaa

SEQ ID NO: 6816086 - DNA, 63 bp, Homo sapiens
tcagttcttaataccatgtggttgccagctatgtagggaaactcagacatgtataaagactga

SEQ ID NO: 6816087 - DNA, 67 bp, Homo sapiens
tccttacatgcttccttatacatatttgctagtgtttccctaagctagctatatggaagtggtagga

SEQ ID NO: 6816088 - DNA, 88 bp, Homo sapiens
agggacattaaagataattaattttgttcattcagtcagttctcatactaggattgagtaatataaagttcatgatcattgattcctt

SEQ ID NO: 6816089 - DNA, 70 bp, Homo sapiens
gcgctgccggggcccgcccgggcgtcaggcctcctcgttcggctccgcccccagggcctcgagcatgcgc

SEQ ID NO: 6816090 - DNA, 69 bp, Homo sapiens
catcttacccatctggtttttgagtctggacaagctcctctccagctcctctacccgatgcgtatcatg

SEQ ID NO: 6816091 - DNA, 62 bp, Homo sapiens
tctaggcctggcacctggctccctcgttccttcttcaccagtgagcagctgtagggcaagga

SEQ ID NO: 6816092 - DNA, 91 bp, Homo sapiens
aggctcagaaaatttaagtagaaagtccagtgaaatagaatgcaagtggtgaaattgaattcgtacacaggattgcagatcttcagagcct

SEQ ID NO: 6816093 - DNA, 129 bp, Homo sapiens
gtatgccgcttccaggaagaagctttaagagccatttcatatttcaccatgttttccccatgcctctgagattatggagagtatgtgttgagaaagagtcttctgttagctgggttcctaagtggtaat

SEQ ID NO: 6816094 - DNA, 106 bp, Homo sapiens
tcgcgggtgtttgttctggaaacgttgacttagggcttgaccgcgtcctgaaaccgtggcactcaggcccagagtcacggatccatgtaaaggatttttcccgtga

SEQ ID NO: 6816095 - DNA, 55 bp, Homo sapiens
cactgcaggcccttacttggggcaacagtacttgtcctgtgaggacctgtcagtg

SEQ ID NO: 6816096 - DNA, 66 bp, Homo sapiens
gtcttctggaagagagccagctaatgaattaccagatgaacagcttttggctcacttatcaaggac

SEQ ID NO: 6816097 - DNA, 87 bp, Homo sapiens
aaagttccaaacaactgcatgtgtttctgctgggttaccttgggaaaagaactttagtgtacatcatcagttctgaatggtaacttt

SEQ ID NO: 6816098 - DNA, 86 bp, Homo sapiens
gagggaaagtttcagaatccctgcttgtcttcaaatgtctccttttgcctccacatttgcttgattaggatatggaattttctttc

SEQ ID NO: 6816099 - DNA, 81 bp, Homo sapiens
actaccctgggtgtctgtgcttgttacaatggaggccgatccctcagccacaccaggagcagatatggacataagggaagt

SEQ ID NO: 6816100 - DNA, 77 bp, Homo sapiens
ggctgatgaatatgagactgagagcctgaccccttcattgtcaagtaatgtaaaaggcttcatccatatttattgcc

SEQ ID NO: 6816101 - DNA, 58 bp, Homo sapiens
tcccatacctagggcttttcccaccactcaagctcaggggaagtccatgggtttggga

SEQ ID NO: 6816102 - DNA, 74 bp, Homo sapiens
ggggctaatactccagcagctgacaccagtcccagctctgctgctgggatgcggggtggctgcaggccagtccc

SEQ ID NO: 6816103 - DNA, 79 bp, Homo sapiens
gtcattctcctgccatctgctgttgatctaatggtgagtacatgacccaagatggatcagtcagactgaaggggacgac

SEQ ID NO: 6816104 - DNA, 59 bp, Homo sapiens
acatgcccaccttcatcagatggaaaccacacacttgtttattctgcagggggccgtgt

SEQ ID NO: 6816105 - DNA, 76 bp, Homo sapiens
cctttacagctgctggcaagcttgaaactggcatcacaccaaactctagaactaagcagaagccagtagcaaaagg

SEQ ID NO: 6816106 - DNA, 85 bp, Homo sapiens
gaggcagctattctgttcttggctgtgcctctggcagcacatgcaaaatgggcagtaacagtggcagtcacaggtaagtagcctt

SEQ ID NO: 6816107 - DNA, 109 bp, Homo sapiens
taaagataataaaggtatagttaacaatgatcgtacacacattgtagattccattacagtattaaattgagcaatagtgtttgcagcaaactatgggctttattcttta

SEQ ID NO: 6816108 - DNA, 84 bp, Homo sapiens
atgatgagttaacacatagttggagtaaaatgactgcagtggagtgctggagcaggcttgtcccagcttttgagaactgattat

SEQ ID NO: 6816109 - DNA, 67 bp, Homo sapiens
ctgttgttccatcctactgtggccttttgaaagtatgaaggtgaaaatagaccagtatggataacag

SEQ ID NO: 6816110 - DNA, 129 bp, Homo sapiens
cgtcaccgtcagccttcggtacttgaagagtggttatccctgctgtgttcgcttaatttatgacgaatcatacagggacatccagtttttcagtatcaaatactgctttggaaggcttcccggacagcg

SEQ ID NO: 6816111 - DNA, 84 bp, Homo sapiens
ttaagaaagtgtaaagttttatgggaagatgtgcaattaattcaaccacttgcagtcctaaatatatagctggatacttcttaa

SEQ ID NO: 6816112 - DNA, 86 bp, Homo sapiens
tgcacacacgctcgagtctatttatagacagatcctaatgatatgtattgcattctgaacgtaaatgtgaaatgtgtgtgtgtgca

SEQ ID NO: 6816113 - DNA, 89 bp, Homo sapiens
ttcttgaatcgaatatatgtgtgtcttagcattggaaggccaaatatctagctttccagtttctaagtacagttgagtcccattaagaa

SEQ ID NO: 6816114 - DNA, 124 bp, Homo sapiens
gagagaaagacagagggagaccaagggacagagagtgaatatgacattgcagaccctacaagaaggatagttgtgttctttcctgttgacttttgtcttcccattccaatatgtacgttctctt

SEQ ID NO: 6816115 - DNA, 130 bp, Homo sapiens
tgaaatgaaggtgataagttagaagaccattgcaaatcccaactttctttcaaggcttgggcaaggatgattttgctggaggtggtgagaaaaggttgatttgggagacatttgggattaaagcctggag

SEQ ID NO: 6816116 - DNA, 72 bp, Homo sapiens
tgtcattttagtgcatcactcaatttagcatgtagaataatgttctctggtgaatgatgcagtataatgata

SEQ ID NO: 6816117 - DNA, 90 bp, Homo sapiens
ggagttcaaactggatgtctaatttttcagcctaaggaactcatgaaaaactcttatcagaagtggctagaataattgacttcattctcc

SEQ ID NO: 6816118 - DNA, 77 bp, Homo sapiens
aagtccattctactgacttctccacagtgcttagaaagaccaattctaggctcttctggaaggttgtttgatggctt

SEQ ID NO: 6816119 - DNA, 57 bp, Homo sapiens
gaagccaagtgcaaatgccttaaaagtaattctaggcatagctgttaatttggtttc

SEQ ID NO: 6816120 - DNA, 60 bp, Homo sapiens
tggcctaggccttcataggcatggaagcttctgctttcagcctctttggagccttagcca

SEQ ID NO: 6816121 - DNA, 129 bp, Homo sapiens
atattttgttatagtaacccatgctgaccaagacaggtagatcaactggggagggaagggacaaccatctaactttcctttcccccatatttattgtctccttttagtctcatgtgacagaatctaaat

SEQ ID NO: 6816122 - DNA, 73 bp, Homo sapiens
atgtcagcctctgaggtcacagatttcaagagaagctttagatattttgccatctgacttcatgggcaggtgt

SEQ ID NO: 6816123 - DNA, 78 bp, Homo sapiens
gttcttctctgacatgcctaagacttttctctgttattgacaaatatcaaggtggtaggctatatcagtaagaggaac

SEQ ID NO: 6816124 - DNA, 78 bp, Homo sapiens
ggctgatgcagcacaactttctttcacagaagtatcttgcagaatacagtatgagatacagaaaggctgcattgagtc

SEQ ID NO: 6816125 - DNA, 97 bp, Homo sapiens
cttcccactggagctgctgagctgataggctgtgagcctggggctgctggggctctagaggacagcctgctcgagagtgaagctagcacaggggaag

SEQ ID NO: 6816126 - DNA, 58 bp, Homo sapiens
cattgctgttaattgtctctaggtgtgttatttagatcctttggagactgcagcaatg

SEQ ID NO: 6816127 - DNA, 76 bp, Homo sapiens
gcccttcctgcaggacagccatctggttgttgggaccaacagggacagatttaggcttagtccaagcaagaatggc

SEQ ID NO: 6816128 - DNA, 95 bp, Homo sapiens
gtcagtccctcatctatgcggttgtgcatctgggatactttatttttgatgagcatttggttgcagatgtggaactcgtgcctatgggggagggc

SEQ ID NO: 6816129 - DNA, 74 bp, Homo sapiens
gtggcgatggtgttcctgtgctggatggtcagtggttgttgacatgtagttagaaaataggtagcaagttccac

SEQ ID NO: 6816130 - DNA, 83 bp, Homo sapiens
tccttgggtgatcctactcagtttatgatttcaagttggcaggacttgctttgtttatggatgagtggcctgtcagtcaagga

SEQ ID NO: 6816131 - DNA, 61 bp, Homo sapiens
gctagatgctgggaaggctgctgggtcttagttgtctccagctcctcttcccagtgtcagc

SEQ ID NO: 6816132 - DNA, 71 bp, Homo sapiens
ggctctggagacatgtggagaggctgctggaggcagaaattcagaaattctagaaccatgacttcagggcc

SEQ ID NO: 6816133 - DNA, 86 bp, Homo sapiens
gggcctgcagtggcttctgtgtccccacactgtatttgaggatgggcatcaccacttcaaattctgggggaagagccccttggccc

SEQ ID NO: 6816134 - DNA, 72 bp, Homo sapiens
tgagataagtgatacataaaaagacaaaacactttaaatgggtgaattgtacagtatgtgaattatatctca

SEQ ID NO: 6816135 - DNA, 61 bp, Homo sapiens
tgcactccagcaccttcccgcagcccaccgcctcctcgggccagaagggagctggaatgca

SEQ ID NO: 6816136 - DNA, 101 bp, Homo sapiens
aatatccttcacttcacatattacgaggcctcagaaatagagtaaaattgactgtcaatcctagctttatatgaggtggtaagtgaagaaagaaggggatt

SEQ ID NO: 6816137 - DNA, 93 bp, Homo sapiens
gccaggcctgagcaggtcctttctgggcaggaagtgccaagtgtgggtctctctttgctctgcccacgtcttgcccagaagctcagttttggc

SEQ ID NO: 6816138 - DNA, 73 bp, Homo sapiens
gcagaacttttcagcaaagaaatgtcagtgagaggcagattaaaagggtctctaactatttctttctttttgc

SEQ ID NO: 6816139 - DNA, 58 bp, Homo sapiens
agcttttctatgtattatatccaggaaatatttctggaagggtacataggaaactgct

SEQ ID NO: 6816140 - DNA, 129 bp, Homo sapiens
gaattttgttatagaagcccgaacgaatcaggacagagatcagaacttctctgatgtattggaataatcttcagtgaaactggagtctgagcttgtgtcctggacttagtgtcagggctgggacttttc

SEQ ID NO: 6816141 - DNA, 75 bp, Homo sapiens
gtctgaggcagctgttcctggttggtgggaagctttcttccatacagtgactcaggaatccaagctccttttgac

SEQ ID NO: 6816142 - DNA, 81 bp, Homo sapiens
ctcccttggtggaacaacacgtctctgacactttcaatttaaagactcacatgtgttttctcaccaacaagccctagggag

SEQ ID NO: 6816143 - DNA, 66 bp, Homo sapiens
tgggtctctgtgcccccatttccgtttcagagctgttgggcttatgtgtgggaggtcagagagcca

SEQ ID NO: 6816144 - DNA, 82 bp, Homo sapiens
ggccgcagccgcccacccccgcccacgtggatgttaaccgtcgtggcatagctgagccgcctggctgggggaggtggtggct

SEQ ID NO: 6816145 - DNA, 66 bp, Homo sapiens
gagttttctaaactgtgaaatgctatccaaatgtcaggaactgttacatagttatagatcttgctc

SEQ ID NO: 6816146 - DNA, 106 bp, Homo sapiens
ttccttcctttcctgagggtgtccaggcttcacgtctgccctcattgccaggtaggtgcagggacacctttgtgaagctcctgggcctttagggaagacagaggag

SEQ ID NO: 6816147 - DNA, 75 bp, Homo sapiens
gctatttcttccttgttcactggttgtctgttttatctctaatgtggagaactgaatagaccagacaagaatggt

SEQ ID NO: 6816148 - DNA, 68 bp, Homo sapiens
aggcaaggccatttctgtttcctgcctttctcctcccaggggcatgagaggctcagaggcctggtcct

SEQ ID NO: 6816149 - DNA, 61 bp, Homo sapiens
gctgctgtccttcaagtctgcgttgccaaggtaactggggatttggaagggacagccaagt

SEQ ID NO: 6816150 - DNA, 56 bp, Homo sapiens
tcccctccaactccaactatggttctgaggaccagaatgggagctgtggagggaga

SEQ ID NO: 6816151 - DNA, 69 bp, Homo sapiens
tgggacatgatgattactcccatttgatagatgaagaacatgaatcagagagggtaatcaatttgccca

SEQ ID NO: 6816152 - DNA, 72 bp, Homo sapiens
ggtgtggctctagttctcctgaaatgtttggtcttgaactagaagcaatgtaggggagacttggccttagcc

SEQ ID NO: 6816153 - DNA, 76 bp, Homo sapiens
gcacatgctgtttctcaaattatttcagcttaaaatgtttaatatgccaaggtgccatattttggaatagcatgtc

SEQ ID NO: 6816154 - DNA, 76 bp, Homo sapiens
tcaaatcagagataccatgtcactttaacaaattagtgttactgcatttggttttaatagtgacatcctgatttga

SEQ ID NO: 6816155 - DNA, 58 bp, Homo sapiens
aggctgcagtgcaggtaggattgtcatgctgattaaaacctggacacacttgcagctt

SEQ ID NO: 6816156 - DNA, 62 bp, Homo sapiens
gttagccaacctcttcaccgagtccctctgcacctcgagggaccctgggaggctggcgcagc

SEQ ID NO: 6816157 - DNA, 106 bp, Homo sapiens
ggctgcagctcccagcgagatcaatgaggaagacaagtgatttctgcatttccaactcaggtaccttgttcatctcattgggactggttggacagggtgggcagcc

SEQ ID NO: 6816158 - DNA, 64 bp, Homo sapiens
ctgggcactggggctccagaggtgagtaaatccctgctggccactctggccctcagcagtctgg

SEQ ID NO: 6816159 - DNA, 55 bp, Homo sapiens
aggcacagtggccctgtttgggtgatctcacctggaatgcagtcacactgggctt

SEQ ID NO: 6816160 - DNA, 114 bp, Homo sapiens
ggctttaattagggcttcttggcctcgtcagtcctggggttggtcggggtaatccagttagagtcccagcctttcatctcagctggccggcctctcgggggccctgtcagagcc

SEQ ID NO: 6816161 - DNA, 86 bp, Homo sapiens
gtacatctgtaaacaccatgttagagtgaccctctgagaataattagttgaaattttattactgtgtgtttattaggttgttttgc

SEQ ID NO: 6816162 - DNA, 58 bp, Homo sapiens
tcacatgccctgtatttaccagtgaccatctaggctctggaaatacagaggtaaatga

SEQ ID NO: 6816163 - DNA, 83 bp, Homo sapiens
ggtcaggtatacatagctttatggtcaattgcttctggcacacaccaccaaggattggtctggaagcatgatgcattttgatc

SEQ ID NO: 6816164 - DNA, 60 bp, Homo sapiens
acaggcactgtcaagtcatgaagatgtgagtttcttcctagccctgacagcagtggctgt

SEQ ID NO: 6816165 - DNA, 55 bp, Homo sapiens
gagaagttcattactctgcccaggaccacacacctggatagtggcagagcttctt

SEQ ID NO: 6816166 - DNA, 59 bp, Homo sapiens
ggaaatcttttgatgtttttttcctttctcctgaaatgatgaggcatgagagggtttct

SEQ ID NO: 6816167 - DNA, 77 bp, Homo sapiens
ggctgccgaggatgggaaatcagggtgaaagttgaggctgagctgcaagatttggttttctatcctctgcaatggcc

SEQ ID NO: 6816168 - DNA, 79 bp, Homo sapiens
ttatccactctcccattcatgcatttaatatttattaaccacctagtattaagcaaaatgtatggaaagaagtggatgg

SEQ ID NO: 6816169 - DNA, 66 bp, Homo sapiens
gcagttgtccacgggcccttccaagttaaacattactcatggcgacaagagcccgcagggcagtgc

SEQ ID NO: 6816170 - DNA, 105 bp, Homo sapiens
ggtgagatcttaaaaggccaatgaaagtcatagatgctacaattttgtactctctttaaggggtcgatgtaagtatttacgaatgccactgtgggatgactcact

SEQ ID NO: 6816171 - DNA, 58 bp, Homo sapiens
gcaaataagaagcagaatgttctaccctatcaatagtaacaatctgtttgttgtctgt

SEQ ID NO: 6816172 - DNA, 72 bp, Homo sapiens
ttatgcaaatattcaagacttttccatcatttatgataacagtgttgggaaagctaggatattcaagtataa

SEQ ID NO: 6816173 - DNA, 57 bp, Homo sapiens
gaggagtgacattaaggtattacatcctatgtgtatacatgctttatgttatttctt

SEQ ID NO: 6816174 - DNA, 129 bp, Homo sapiens
taaagttttattggaacacagttatagccatgcttatttgtttatgccttgtttatgattgctcctggctacaacaacagagttgagtagttgctataaaaattgtgtgacccacaatgtcaaaaagta

SEQ ID NO: 6816175 - DNA, 80 bp, Homo sapiens
tgttaataagctggaacatcttgaggaagtcactaaagtgcattagtttctgtatctataagatgttcatagcaataaca

SEQ ID NO: 6816176 - DNA, 79 bp, Homo sapiens
ggcgggggccacgtggccctgccccgcccctgctggcttcggttcctgagcagagctgcagtggcctgctttccccgcc

SEQ ID NO: 6816177 - DNA, 57 bp, Homo sapiens
aaatcagtttctgtgaagaacacaggttaatgcctgtaaagatcaagtgactgattt

SEQ ID NO: 6816178 - DNA, 92 bp, Homo sapiens
tcctgtcgtaggtaccaggtaccttacacttggctgtattccctctagcacgatagacttggtaacaaggtactttctgaacctgaacagga

SEQ ID NO: 6816179 - DNA, 79 bp, Homo sapiens
tttcatctcaaaaggctatttcctgtgaatcaactcaaattcaaatgggtctgtttaggcaaaatagctacagatgaag

SEQ ID NO: 6816180 - DNA, 82 bp, Homo sapiens
gcgatactcacatgtggctagtagctaccatattgggcagcataactctagaacactgggaagttactaaccattttattgc

SEQ ID NO: 6816181 - DNA, 55 bp, Homo sapiens
ccactgccctcactgtggttctcagcagctggggacgcagaaagagtggcagcgg

SEQ ID NO: 6816182 - DNA, 121 bp, Homo sapiens
aaagaaatgtttaccattacatgtcactgaggctttgtggttatttattatgtaggattgttatggaaagagctatctgatagataccatgaggcaaatatgtaagaatgaaaattacttt

SEQ ID NO: 6816183 - DNA, 96 bp, Homo sapiens
agtgtgggtattgaggcttaaagcaaattttatttgaatcttgattccggcacttgtgtattccagtaatgtgactttgagccaggtatttacact

SEQ ID NO: 6816184 - DNA, 87 bp, Homo sapiens
tataatgacctttaatttatttggaaacatctcagaaaatataaagttttgtataaggagtttaccagagttctgaagattattatg

SEQ ID NO: 6816185 - DNA, 64 bp, Homo sapiens
aatttttccattgctcagccagtatcgtgtctatcacaaaataaaggcagagtagggaggaatt

SEQ ID NO: 6816186 - DNA, 73 bp, Homo sapiens
tggttgggggtccctcccttggtctccctctcggttcattgctgccttctggggaagggagggcctccagtca

SEQ ID NO: 6816187 - DNA, 87 bp, Homo sapiens
ggactggtgggagcttcatggagctgtagggagcagtggtcaagtgttctactgactcaagttccatcagcagtttcccagtagtcc

SEQ ID NO: 6816188 - DNA, 127 bp, Homo sapiens
ccagcccttagggggcctgaggcttgcgggaccagtgctgttgggcccagagagagaacccctttcctctgcagtgttggcgagcccactgtgtcctgtctggctctgtgccccccagcaggcttgg

SEQ ID NO: 6816189 - DNA, 70 bp, Homo sapiens
tccaagactttagttgtaaacacatctattgagaaatcattggaaatgctacaagttagacttcttgtga

SEQ ID NO: 6816190 - DNA, 86 bp, Homo sapiens
agtgaagaatggaatgcaatggaataggctgctctttaaagtcagacaggtctgagtttgaatccttgttctaccattctctaact

SEQ ID NO: 6816191 - DNA, 80 bp, Homo sapiens
ggattgactggagaactagacccatttttgtgcacagaaatatctgagtatctagatagtttagccatctttcgttttcc

SEQ ID NO: 6816192 - DNA, 129 bp, Homo sapiens
tccacagcagccccatacaacatttttgtggactaagggtgatcttagccagtgaaagacttttggtcttatcagtctcctggctgtgtcagtcctgagagcatttggtggtggtggtggtggggtggg

SEQ ID NO: 6816193 - DNA, 55 bp, Homo sapiens
aatgtgccctgagagtgaggaggacagctgcatcttctggactctaaggtatatt

SEQ ID NO: 6816194 - DNA, 65 bp, Homo sapiens
gtactcagtcagattcaacctagctgtcttaagtctcctccacagccctacgtgaaactgagtac

SEQ ID NO: 6816195 - DNA, 75 bp, Homo sapiens
gccctaagatgcatccaaagctttgggtaggaatgggagggtcactctttccttcccaagtagctgctgcatggc

SEQ ID NO: 6816196 - DNA, 56 bp, Homo sapiens
gcagacagactgcagtgattttagggaaagattgactggaatcagtgactgactgc

SEQ ID NO: 6816197 - DNA, 80 bp, Homo sapiens
agcagaaaagatgaaagtgaagctaggacaggtagagatgggattacctttctttcctcctagcatcttttttaagggtt

SEQ ID NO: 6816198 - DNA, 76 bp, Homo sapiens
gtgtgcatatgtgtgtgtgcatatgtgcatgtgtgtttttgtaggcatgtatatgtgcacatgtgtgtggctatac

SEQ ID NO: 6816199 - DNA, 110 bp, Homo sapiens
aatgacatgtaagtatctgctgtggttgaaatagcctgtctccagagtcccaggggtctgctttgtgattctcactctagtgcttgccattaactacagtctatgtcatt

SEQ ID NO: 6816200 - DNA, 61 bp, Homo sapiens
gctgtgatatactcccaagaggattccttatgaggtatccttattcatgagtgcatttagc

SEQ ID NO: 6816201 - DNA, 77 bp, Homo sapiens
gatatttgctaaacctgatagattttcagaatcatgcttgccataattctataagatgatcaaggtcagtggacatc

SEQ ID NO: 6816202 - DNA, 58 bp, Homo sapiens
gagaggccaaaatccctgccccattgcccccagctggcagggtggggttggttttctc

SEQ ID NO: 6816203 - DNA, 78 bp, Homo sapiens
gggctttgagaccagcctgctatgtcccctcagatctggcctctgaggcccctgggcaggatggcattttcactgcct

SEQ ID NO: 6816204 - DNA, 56 bp, Homo sapiens
taccatatgaaacatgagaaatggagagctatagttttaccctgatgtttctggta

SEQ ID NO: 6816205 - DNA, 90 bp, Homo sapiens
ctggaacctcactcactggaagaggaagccagctggaccttgcctgcagggtgcagctgggtctgccctggctaggtgttgagggcccag

SEQ ID NO: 6816206 - DNA, 68 bp, Homo sapiens
acattacaattgcattgtcacaaataatttgccttgcattttatttgtgtgtgtgcatttgcatgtgt

SEQ ID NO: 6816207 - DNA, 76 bp, Homo sapiens
acttgtgcaaaatcagtgtctcaagggatattctgctatttggattctggacaatgagaaactggtgggaacaagt

SEQ ID NO: 6816208 - DNA, 81 bp, Homo sapiens
ttctagaatattatataaatggaattatgcaacatgcatactttgtataaggcatctctcagttagcagagtgttctggaa

SEQ ID NO: 6816209 - DNA, 58 bp, Homo sapiens
tgagatggagtctcactctgtcacccaggctggagtgcagtagtgtgatctccgctca

SEQ ID NO: 6816210 - DNA, 63 bp, Homo sapiens
tgtaagtggaaggaggccacagagaagtttgcttctctttagagcctttcctcccgacttgca

SEQ ID NO: 6816211 - DNA, 74 bp, Homo sapiens
atattctagccaaagtgtgagccaggagggggataagatgtgcctattcccattgttcattttcggtagagtgt

SEQ ID NO: 6816212 - DNA, 73 bp, Homo sapiens
agttgattttcatagtgacccacagtatacagagaaaaaggtatatacacaggaatctgtgaaaattatggct

SEQ ID NO: 6816213 - DNA, 67 bp, Homo sapiens
tccaagactttgaacagtgtatcagtaatctcggaagaaattcagtatttatatacagttcattgga

SEQ ID NO: 6816214 - DNA, 79 bp, Homo sapiens
taaggaaagaggaggcaggaagtctatgggaagatcctggaaaatctcttgaaatggatgtcactgtctctgggttttg

SEQ ID NO: 6816215 - DNA, 76 bp, Homo sapiens
gctgtgttaaccaccaccgtaatttacccattagcatcaggaataataatgagtttgtctgagtggtaacaacagc

SEQ ID NO: 6816216 - DNA, 72 bp, Homo sapiens
tcaggcctcagcagcccacaggtaaaagtgttgtttcatcaagattaatagtgggcttttgacagtgcctgg

SEQ ID NO: 6816217 - DNA, 101 bp, Homo sapiens
ggatatgcagacatgtaggaggtctaaccggctgctgaaaacttggaccctcagggcctgactacagaggctggatggacttgcctactgtgtgcaggtcc

SEQ ID NO: 6816218 - DNA, 71 bp, Homo sapiens
ttggagctcagagaggttgaacaacttgctcaaggccacccagcttgcaagtgggacctgtctgattccaa

SEQ ID NO: 6816219 - DNA, 76 bp, Homo sapiens
attcctgaaatgtgagctccggcaggtggaagtctttgtgtgacttaccctgtaaggtgttcccagactccggaat

SEQ ID NO: 6816220 - DNA, 79 bp, Homo sapiens
gatcctaactatgtttcaaagtcagccatctggctatctcatgatatgtcagttgctttttgaatgctagttcccaatc

SEQ ID NO: 6816221 - DNA, 68 bp, Homo sapiens
ggtgcctggacacagggggatgtgtggacggcttgggcagaccagcctccggcctctggtgcaggccc

SEQ ID NO: 6816222 - DNA, 61 bp, Homo sapiens
cagtcattttatttgaaaattaggcgtctcctcggcaccctcatttattgagaaatgactg

SEQ ID NO: 6816223 - DNA, 90 bp, Homo sapiens
agtaagtatttgaaaaattgattaatgttagggtctgagtttatgtatcatattcagaattctacaatagatcaggtaacaaatactgct

SEQ ID NO: 6816224 - DNA, 78 bp, Homo sapiens
tcacctgggagtttcttagacagacattatctctgactccacccagacctactgaatcaaagagtgttccctaggtga

SEQ ID NO: 6816225 - DNA, 61 bp, Homo sapiens
gaggatacattgaggcagtagctggaggtctagagatttcatcccacctcagtgtgccctt

SEQ ID NO: 6816226 - DNA, 79 bp, Homo sapiens
tctatctatcctgtttatctatctagagatgtcacaacagggtggcatctcaggacaggaaaaaagggactagaataga

SEQ ID NO: 6816227 - DNA, 83 bp, Homo sapiens
gagaaatatgatgccaaattgctacaactgccggtgccaccaccaccaatgcattcggtgttcagtttgctatcataatcctc

SEQ ID NO: 6816228 - DNA, 80 bp, Homo sapiens
tcagatatttgggcaagtggcatgaccatggattatttcactggttttcttcctcgtagcccttgctctccagctattga

SEQ ID NO: 6816229 - DNA, 83 bp, Homo sapiens
gtacattgtctttgaaatgtcagcaggagtaacattttttgaagtcatggaatttatgtttgcattttcaaagatggcagtgc

SEQ ID NO: 6816230 - DNA, 56 bp, Homo sapiens
tcctctgaggtggcttccccgagcctgcgggcagggcgtgcagccccctcagagga

SEQ ID NO: 6816231 - DNA, 70 bp, Homo sapiens
acaggcagctactgtgtgtcagccactgtgccagccctggaaatacaggaatgccacacagcctgcttgt

SEQ ID NO: 6816232 - DNA, 81 bp, Homo sapiens
gtcttacaaaggcttcaagttctgaaatagaagtgtctttctgggttaagcttcccagaggcactcttgttttgcctagac

SEQ ID NO: 6816233 - DNA, 82 bp, Homo sapiens
ggagaattttagtttggttaatattaggaaaagaatgaaacaatcttttatcctacatttagctcttataagaattcagtcc

SEQ ID NO: 6816234 - DNA, 93 bp, Homo sapiens
ccactgaaattgttcaaatgccttgcctgctacaactttgttcaaaaacagttttcaaacatgtgatcagagctaggcaactatttcaggtgg

SEQ ID NO: 6816235 - DNA, 56 bp, Homo sapiens
gccttagcagtttgcctggcacagccagagctgtgcatggcagatgctgttatagc

SEQ ID NO: 6816236 - DNA, 63 bp, Homo sapiens
aggtagtatggattccctctctctactgtttcttaatgtaggggggaaaaaactggattgcct

SEQ ID NO: 6816237 - DNA, 86 bp, Homo sapiens
gctcccacccgtgcctcagtgtcctcctctgagggatggatgtgtctctgcaagtagatgacagtgaggttaccatggggaggggc

SEQ ID NO: 6816238 - DNA, 113 bp, Homo sapiens
tctttgccattgctgtgctagaaactggtggtgaatgcagagtatggtgcacctcagtgtgtgtttatgcagcgtttcaccacccactgttccttgtcagtaattgaaagaga

SEQ ID NO: 6816239 - DNA, 80 bp, Homo sapiens
agtcaagtatgacaccattgctagaagctttctataacccaatgtaagagatgcagggtacatggaatcatgatttgact

SEQ ID NO: 6816240 - DNA, 65 bp, Homo sapiens
atttgttaaaggtaggatgggggtgttaaaaaattaataagccataatttctgcctttaggaagt

SEQ ID NO: 6816241 - DNA, 79 bp, Homo sapiens
gggtgtgtatgtgtgtgtgcatatatacatatataatttgtgtatatacatacacacatgaaaatagtgggaaacaccc

SEQ ID NO: 6816242 - DNA, 65 bp, Homo sapiens
gtgcctggggttgagctatgaagcagatcttattgttcctttttagctccccagccccacagtat

SEQ ID NO: 6816243 - DNA, 124 bp, Homo sapiens
tcatttaaatgttgaagtagctacaagctcaaagttatcaactgcaacattattcagaattgcaaatatgaagagtgaaagtagagaaaatgcttgagaaaattgtgatacagcaactgaatga

SEQ ID NO: 6816244 - DNA, 68 bp, Homo sapiens
tggtgaagtcttgggagaggctggcagttgaggctgggctcaactacctccttcttctaggctgacca

SEQ ID NO: 6816245 - DNA, 59 bp, Homo sapiens
ttcgtgtttgaggcaggtaagagatgtaaaaaacttttacaaagcagttccaacacgaa

SEQ ID NO: 6816246 - DNA, 62 bp, Homo sapiens
gggttaggttctagaggcacaatgatgaataaggttacttgatctgtcttagagcttgaccc

SEQ ID NO: 6816247 - DNA, 99 bp, Homo sapiens
ttctatcacgttttgcaaatcttacatataaagctgactcatgaaactttaatattgaagtttgagttaggcattatagctaggttgggtatgaaagag

SEQ ID NO: 6816248 - DNA, 60 bp, Homo sapiens
tcctcagggcggcctccgtcttaggttagaagataaaaagatctgatgccaccctgaggg

SEQ ID NO: 6816249 - DNA, 56 bp, Homo sapiens
agctctcttgacttcagtttcctcatctgaaaaatgaggagctgaattagagggtt

SEQ ID NO: 6816250 - DNA, 56 bp, Homo sapiens
gctcaccttcgtccagcagccgctcgaggtggttgaagatcccgcagaagttgggc

SEQ ID NO: 6816251 - DNA, 74 bp, Homo sapiens
ttagtgtatgcttagccagagattttatagctataatatcagcacagatttatagggtataagtgatatactga

SEQ ID NO: 6816252 - DNA, 67 bp, Homo sapiens
aggcagggtccacacctgggaaagattaaggtgccatctgtcccagacataagtggacatacctcct

SEQ ID NO: 6816253 - DNA, 56 bp, Homo sapiens
gagaggagaagcctgcgcttcagctcgtgggcctttttctgtagcttctccttctc

SEQ ID NO: 6816254 - DNA, 75 bp, Homo sapiens
tatcacttcttttgtgattcttcagttacttcaggccatctggatgtatacgtgcaggtcacaggggatatgatg

SEQ ID NO: 6816255 - DNA, 70 bp, Homo sapiens
gtgctggcagtggcagtgatggtagcagtcctggtgctgttagtggtggccgtttgtctgctgctagcac

SEQ ID NO: 6816256 - DNA, 61 bp, Homo sapiens
ccgggggcagggtaaaccgaggtaagtagctctgtgttactgcctgctactatgcccacgg

SEQ ID NO: 6816257 - DNA, 85 bp, Homo sapiens
agagcaatatttttggtgcaggagctgactcatcagattagcagcctctcaagattgatgatgtttctgccttgcctattcctct

SEQ ID NO: 6816258 - DNA, 91 bp, Homo sapiens
actcttgttttggatgtatagttttagaaaatactcactttaaaaatgtattggatggatagtggtgaaggctgtacaacgaaacaaatgt

SEQ ID NO: 6816259 - DNA, 64 bp, Homo sapiens
gaagcctccaattgcgcttctgagggctgcgaagactgccctcaacagagcagagggaggcttt

SEQ ID NO: 6816260 - DNA, 89 bp, Homo sapiens
gatggctcatggttcttctggattttggatatcaggctaataatgctgtattattttgatgccaccaaaatcctgttacctgggaaatc

SEQ ID NO: 6816261 - DNA, 55 bp, Homo sapiens
ggtcctcaatcccaacaaggcacccagaaagctagcctgtctggtcctgggggcc

SEQ ID NO: 6816262 - DNA, 107 bp, Homo sapiens
ggtgatggagctgcacttggccagtggaaagaggaggaactctcaagcctgtgtctggattttcaggctcctcctcttcctctccatacacggttcctgttttcact

SEQ ID NO: 6816263 - DNA, 83 bp, Homo sapiens
acaggtgtctctgcctcggccttggcatgtacagtcggtttgaagctctgctgctcgccacggcccaggggagctatgcctgt

SEQ ID NO: 6816264 - DNA, 94 bp, Homo sapiens
gttggagtctcactctgtcacctaggctggagtgcagtgacacgatcttgactcactgcaacctccacctcccaggttcaagtgattctcctgc

SEQ ID NO: 6816265 - DNA, 70 bp, Homo sapiens
caggtctgcctcactcacttctgactccataaaagctcccataagatggaaggagaaaggggcagagatg

SEQ ID NO: 6816266 - DNA, 60 bp, Homo sapiens
cagggttcttttatgaaaaggccttagaagcacaaaggttctgttttaaaagagctcctg

SEQ ID NO: 6816267 - DNA, 57 bp, Homo sapiens
tagcttacagtgaccctgcagattttgtattatataagactgcctcacttaagtctg

SEQ ID NO: 6816268 - DNA, 65 bp, Homo sapiens
gaagaggattcatgtgcaagagaagacattggatgagatttgtaatctcagcataagaacccttc

SEQ ID NO: 6816269 - DNA, 83 bp, Homo sapiens
agcgtgcaggtgccggcggccgcctttttgggctccgggacccccgggagtgggagcggcagtcggggacgcctcaactcgtt

SEQ ID NO: 6816270 - DNA, 61 bp, Homo sapiens
gcatctgaaggtctccacactccacatccctgaagggatgctgtgtggccacctccatggc

SEQ ID NO: 6816271 - DNA, 74 bp, Homo sapiens
tgatattttttgttgccaggaattaatgctagtaggttacctgcttggctaaaaatggcaagaggaggatagca

SEQ ID NO: 6816272 - DNA, 79 bp, Homo sapiens
agattagagtgagagataaggtcagagacataaagggcattataggccattgtcagggctttggcttttactcttgtct

SEQ ID NO: 6816273 - DNA, 64 bp, Homo sapiens
caaatgtgaactctgtactctctgacagtcgcaaggaagactgtcaaatcaggtatcactattg

SEQ ID NO: 6816274 - DNA, 67 bp, Homo sapiens
cacagagcccttgggaagtgcagggactctggcttcaagccacctgtttcgcttgcccagctttgtg

SEQ ID NO: 6816275 - DNA, 59 bp, Homo sapiens
ccaggatctgggtccatgggacccctaccttatcaactgtccccatacccaggccctgg

SEQ ID NO: 6816276 - DNA, 97 bp, Homo sapiens
cagcgtggaggggactggccccagagagcccttctgtgtcactgtgggagcaggcacaagggtggtctctggagctggctcaatggaagaccacctg

SEQ ID NO: 6816277 - DNA, 72 bp, Homo sapiens
tagtagtgtgcatctttcttccttcttctgcttgctggagcttagatacaaggcagagatgtgcactcgctg

SEQ ID NO: 6816278 - DNA, 78 bp, Homo sapiens
gttttatattttatcagtagtgatttctgagacctattcattctatctctgaaatctacgattagtgaaaatgaaaac

SEQ ID NO: 6816279 - DNA, 91 bp, Homo sapiens
cacctttaatctggcttggatcaggcaataatatctcagatttcaagggtagagtgctttaggtgtttggctgaactctagacttaaggtg

SEQ ID NO: 6816280 - DNA, 75 bp, Homo sapiens
ctgactcaagtaagaaacagaattggaatttgaggtaggatatcccagccccacattttgtattttttgagtcgg

SEQ ID NO: 6816281 - DNA, 56 bp, Homo sapiens
gaagcttctggcatttctcaaagggaggggaagtctgggagaggagccagaatttt

SEQ ID NO: 6816282 - DNA, 126 bp, Homo sapiens
gagggaagacatcagtgatgggaggtttggcagacaactgagcctctgcccatccaccatcaggctgttgccgagcaggaatgcaggtcaactgttgtcagatcttccaaattttctttttctttt

SEQ ID NO: 6816283 - DNA, 76 bp, Homo sapiens
gcccccatggaggctccttcaaagcacctggctcctctcaggagagcaaagggttacggaggaggctccaggaggc

SEQ ID NO: 6816284 - DNA, 55 bp, Homo sapiens
ctatactctttcttcagccaagtgctcagaggtagaggagctgaagtgagtatag

SEQ ID NO: 6816285 - DNA, 64 bp, Homo sapiens
gagcaacactgtgatcttgagaaaggtttttaaaatccacctcactttcgctgtgtgaatgctt

SEQ ID NO: 6816286 - DNA, 64 bp, Homo sapiens
ccggcttgtttagacttttcaaaaggccactccttgggcttagaaaggatgtgaacagagctgg

SEQ ID NO: 6816287 - DNA, 56 bp, Homo sapiens
gggcaggtggcagggtctctggttcctgggttgggcctcccgctctgtccctgctc

SEQ ID NO: 6816288 - DNA, 57 bp, Homo sapiens
gaagcctggttcgctggccacctcccgctggggcgttggcccaggctgccaggtttc

SEQ ID NO: 6816289 - DNA, 113 bp, Homo sapiens
tctgttgcaaacctaaagtcaaaatttcttgaatgctaagggccttacaaagatgaattggtgcttccctgaatctaaggcactcattcaaggagataagcagtgcacacagg

SEQ ID NO: 6816290 - DNA, 58 bp, Homo sapiens
cccctttctcccgcgtctggcccgccccgctgtgtgaggcttgcgtgggaggaggggg

SEQ ID NO: 6816291 - DNA, 78 bp, Homo sapiens
ctgattaatatttgtaaggtgtttaccgcagtttctggcacatgataagcactatataagtatttgttaaataattag

SEQ ID NO: 6816292 - DNA, 86 bp, Homo sapiens
gccagcaatagactgtttttattgttatggctttgtagtatgtcttaatagctatttgggcaatttcaaaatagtttatttatggt

SEQ ID NO: 6816293 - DNA, 60 bp, Homo sapiens
caaccccaggctggaggagtctctgtggacaccagagaccattgctaggctggcggattg

SEQ ID NO: 6816294 - DNA, 72 bp, Homo sapiens
ggagcacacaacttggattcctcatatgcacaggtcacaatacggtttgtgctcctgtgagaatctagttcc

SEQ ID NO: 6816295 - DNA, 89 bp, Homo sapiens
gccaactatattctcctaaacaagactgtgaatgttgaataaatcctgcatagaggcagggttaatttggaattcattctggagatggc

SEQ ID NO: 6816296 - DNA, 68 bp, Homo sapiens
ttctgtgattagttgtctggctgtgttatcttttgtgcacggtctactgcccaaatcaatattcggaa

SEQ ID NO: 6816297 - DNA, 75 bp, Homo sapiens
ctatcatgatctccagaacatttataaacgatgaaaccttatctcttgcaatagtttctggtaggaatatgatag

SEQ ID NO: 6816298 - DNA, 124 bp, Homo sapiens
gtgtgtaggggctggacttggggagtgtgagctgtaaggatgggtgtattttgtcctccaagtgtggcaggaaggagggagatgcccatcctggcattaccattttctgcagccagatacatgc

SEQ ID NO: 6816299 - DNA, 124 bp, Homo sapiens
ctgttcctggcttccccttccaggaggggacgtttgcaggtctgggggtcctggtgactaagctgttagctccactccctgcctgtttccgtcctcacagccctgggagggccccggtggacag

SEQ ID NO: 6816300 - DNA, 88 bp, Homo sapiens
tgactttgaatcggctggacctagactagctcatagatctagaacaagtattggcagtctagtgtccttgggcccctttgatcagtca

SEQ ID NO: 6816301 - DNA, 66 bp, Homo sapiens
gtatttatcaactggtgtgtgtggcctcagtccttcagaggtgacctgtcacattttgatgaatgc

SEQ ID NO: 6816302 - DNA, 62 bp, Homo sapiens
caatggtgcagctcagttgaaatgcagggttgtacacaggccctgctcagagctgtccattg

SEQ ID NO: 6816303 - DNA, 83 bp, Homo sapiens
ggtggaggctatgcatgtgtgagagcaagaggtatatggaatttctctgtaccttcctcttaatttcgctgtgaacctaaacc

SEQ ID NO: 6816304 - DNA, 82 bp, Homo sapiens
cttcagagatgagacttgcagatactgtaaaatttcagtatggtcatgctgttgagaaacatatctcaggctcactgtggag

SEQ ID NO: 6816305 - DNA, 66 bp, Homo sapiens
tcttccaggtccttcttgagaagacatgaataactctgcactgtctttttccataacttgagagga

SEQ ID NO: 6816306 - DNA, 61 bp, Homo sapiens
ggcaattgtcgttgacatccttcactgtaaacggttggagtgatgttgatacaatgtggcc

SEQ ID NO: 6816307 - DNA, 75 bp, Homo sapiens
gccaggggctgggacagagccaagctcctgcaatcggctgactgtttgggtccctctgtcccactgcccaagggc

SEQ ID NO: 6816308 - DNA, 65 bp, Homo sapiens
gaaagaaacctagaaggaagggtctctttgtaaatagatggattctaaacctctggtttcggttc

SEQ ID NO: 6816309 - DNA, 82 bp, Homo sapiens
gcattacttgtttcactggcaggtttctctagaaatatcctggaaaaatagcttctcttgtccctgaggtgagtaaaattgc

SEQ ID NO: 6816310 - DNA, 72 bp, Homo sapiens
ggggagacagatggaacacagaaaggagagcaatgagttttatcctgctgtgtttccaatcagattttcccc

SEQ ID NO: 6816311 - DNA, 95 bp, Homo sapiens
ttgggtcggcctctttggctctcaccgatggctctggagacggccagggtcccgttgactctccagcagtccatgtgagacacaaagccacccaa

SEQ ID NO: 6816312 - DNA, 55 bp, Homo sapiens
actgctctctttgcaggggctagggcagtgcctggctcaaagccaagggggttgt

SEQ ID NO: 6816313 - DNA, 57 bp, Homo sapiens
aaatggctaagcaggggttctgactcagatctgtcagcatctacagctttgctattt

SEQ ID NO: 6816314 - DNA, 127 bp, Homo sapiens
ttcacaatgaactttgattcaggatagtgttttatttgtcacattgaatatgatttattctaaaccttttaatggagaaatcttgctcattgtgacaatcatagccttcttatgtcttttccatgga

SEQ ID NO: 6816315 - DNA, 59 bp, Homo sapiens
gtctgccctcacgccagctgggctctgcctgccttgggggctcttgtgagggagcagat

SEQ ID NO: 6816316 - DNA, 61 bp, Homo sapiens
gtgtgaaagagaataaaaccagtggaggtaaaccccagctctctcagttctgctttcatgc

SEQ ID NO: 6816317 - DNA, 76 bp, Homo sapiens
attacagtgaatgaatggctgtgcataagtcctagaatgccaatctggatgggcacattgttactcttactgtgat

SEQ ID NO: 6816318 - DNA, 94 bp, Homo sapiens
gccagctgggagcttgttagaaatgtagactctcaggccctatcccagacctactgaatttgaatctgtgttttaacaaaacccccagctgagt

SEQ ID NO: 6816319 - DNA, 72 bp, Homo sapiens
agtttcttccaagctgtatgttcctagaggttatcacaaagactcctctagtggcaactggcttgcagaact

SEQ ID NO: 6816320 - DNA, 69 bp, Homo sapiens
tgctagtgatctgtttctagaattgctctctgctcactagaggttcagacgcataataggcactcagta

SEQ ID NO: 6816321 - DNA, 71 bp, Homo sapiens
tcagaaaatctttgtattttaaaattttctcatctcaaaagaggaaatgtcatagaaatataaggctctga

SEQ ID NO: 6816322 - DNA, 64 bp, Homo sapiens
tgcaaagcagcacccagagccatgtctgcagccgctgcagcgtgggagagggggctgttgagca

SEQ ID NO: 6816323 - DNA, 57 bp, Homo sapiens
gcctgttgggtaacagagttcactgtctgtctcgctgcactgttgttcccagcaggt

SEQ ID NO: 6816324 - DNA, 65 bp, Homo sapiens
gggggtgctgaagatgtcatggtgcgatgttgggatttctgcagtgtttatgttcagtgaccctc

SEQ ID NO: 6816325 - DNA, 61 bp, Homo sapiens
agccaccttcacatggtctatctttagtacaatttaatgaatggaggcccttggaggtgct

SEQ ID NO: 6816326 - DNA, 61 bp, Homo sapiens
gctcactggtaggcggccctggaagtcaaagatctgctgctccagcgctgccaccagttgc

SEQ ID NO: 6816327 - DNA, 100 bp, Homo sapiens
ggatgtacagtaagtgggtctttcggggggacagcctggagtgggaggagctctcggtcccctcttctaggacgtccttgtgggtccccttgcggagtcc

SEQ ID NO: 6816328 - DNA, 57 bp, Homo sapiens
tgaacatttatgatgcaatacctactggttagcaggttttgctgaatggatgcttca

SEQ ID NO: 6816329 - DNA, 107 bp, Homo sapiens
cactttccagtccatggttaaatacagtataatgactgaccagctgtatcttgacttttacagcaggaattaacatataagcgtgtttggctatacctgagaaattg

SEQ ID NO: 6816330 - DNA, 58 bp, Homo sapiens
agctctgagaaagttagaaagtgtagggaaatacactttctaactttgctcttaggct

SEQ ID NO: 6816331 - DNA, 55 bp, Homo sapiens
gtgctggcccggctgcctggtcattggggaatgacatagaggccaaggctaatgc

SEQ ID NO: 6816332 - DNA, 85 bp, Homo sapiens
gcctgaggcacagagtgctcacagctggcaggctcttctctgctctcacagttgtggtacctggttaacaagaatgcatttgggc

SEQ ID NO: 6816333 - DNA, 55 bp, Homo sapiens
gctgaggtggagattgcagtgagctgagatcgcaccattgcactccagcctgggc

SEQ ID NO: 6816334 - DNA, 80 bp, Homo sapiens
cgatgttgctaggtagagtgtaaaccacatagtgagagtgaaaaattctttggctacttgatattctgaagcaaatattg

SEQ ID NO: 6816335 - DNA, 62 bp, Homo sapiens
atcaggcagtatatactctttgaggggagttgacttctttcagttagtataattgttttgat

SEQ ID NO: 6816336 - DNA, 93 bp, Homo sapiens
aagatgaaaatacggtaaaatatgtacacacacaagtcccattccccaagaattgattaagtggaatgagtatttgttttcccatttcacctt

SEQ ID NO: 6816337 - DNA, 59 bp, Homo sapiens
ggcagcagctcagtctctcagtaggttaacaagaatttactgagtatcagttgtatgcc

SEQ ID NO: 6816338 - DNA, 57 bp, Homo sapiens
gtttcagattcttcctcaggaacaaatgttaattttatgggagaagaacactggaac

SEQ ID NO: 6816339 - DNA, 97 bp, Homo sapiens
taccacctacagcctccccagacctccaccgctatgttaggtcccagggctgggtcccagctgccctgtggggagggttgtcagggctgtagaggtg

SEQ ID NO: 6816340 - DNA, 63 bp, Homo sapiens
gggacgggcagtccaaggggtctaggaactggtatcgttaataacctccagagtgtttgttcc

SEQ ID NO: 6816341 - DNA, 56 bp, Homo sapiens
ttgaggactgctaagcatttgagtaattttataactaaatgctgagaagtccttaa

SEQ ID NO: 6816342 - DNA, 59 bp, Homo sapiens
ggagcctgcgggagctcccattccccacccttgaagggccagcttcacctgaaggcttc

SEQ ID NO: 6816343 - DNA, 76 bp, Homo sapiens
tttgagtggtttatgcttcctgattggactctgactaatatgttaggaagggtcccaggagataaacccacacaga

SEQ ID NO: 6816344 - DNA, 55 bp, Homo sapiens
ttcttgctgggcatcagaagacttaaacctaagctgtctgtcatctctgcgggag

SEQ ID NO: 6816345 - DNA, 76 bp, Homo sapiens
ccctgggtgagtgtccaaggtcagcgagagtcacttgtggaggggacggaagatgacctggctgatctggccaggg

SEQ ID NO: 6816346 - DNA, 68 bp, Homo sapiens
taaattagacctcattacctagccagttgggctgcccggctctcctgcacataatgaggtctgattta

SEQ ID NO: 6816347 - DNA, 55 bp, Homo sapiens
atgtgtattgagcacctactgcatgccagccctgtgctgaggactcaatatacat

SEQ ID NO: 6816348 - DNA, 72 bp, Homo sapiens
tatctgtgaccatggcttttgagtctcaagacccaaattaaaaggtgttttgaggagcacatggcagagatg

SEQ ID NO: 6816349 - DNA, 80 bp, Homo sapiens
agtgcagagaatggttgtaggtgagatcttgatgcataacacaaaaaaagctatccaaatatattttattcactgtcgct

SEQ ID NO: 6816350 - DNA, 80 bp, Homo sapiens
gagagagacagtccaagagagataaaatggcctttgttcctttgaaaacatcatttcaccttcttggttctgaatttttc

SEQ ID NO: 6816351 - DNA, 65 bp, Homo sapiens
tgaggaaaattagtcctgaaacgtgtgattgtataaattgctgtctctgaactgggttttcttta

SEQ ID NO: 6816352 - DNA, 61 bp, Homo sapiens
attctttcaagaagctggaagtctgtgtgagggaacaggcttcaaggttcttggcaggaat

SEQ ID NO: 6816353 - DNA, 65 bp, Homo sapiens
gtgatttatgggctgactaatggtaaactgatttgtgcatgtgccagaagtcagctcaggaatac

SEQ ID NO: 6816354 - DNA, 63 bp, Homo sapiens
gccttgcttcatggacaatttacagcagctgtctgaagcacagttgcttctggaatgcaaggc

SEQ ID NO: 6816355 - DNA, 71 bp, Homo sapiens
tgtgccttcttctttgaggaagaaagaacttcctgttctgatgtataggtttcttcaaagaagaaggcaca

SEQ ID NO: 6816356 - DNA, 55 bp, Homo sapiens
tggattgataaaatgggatgttgagtggaaattttccaattctattatcattcca

SEQ ID NO: 6816357 - DNA, 73 bp, Homo sapiens
gcaggtttctgattgctctgtttctgatgctgtccaaagttacagagccagtcagtcagaaactctctcctgt

SEQ ID NO: 6816358 - DNA, 67 bp, Homo sapiens
ttggccaagtggttaatctccatcttccaatccctcccggaggttggaccaatatcacatggctcaa

SEQ ID NO: 6816359 - DNA, 87 bp, Homo sapiens
ttgactccatagtgtgaaagattgtcaacaacagcattttctatttgtactgtttaagatagtgttggtggtctcttcatttgtcag

SEQ ID NO: 6816360 - DNA, 67 bp, Homo sapiens
tattttattaaattttgggaatgaaacagtgccacagtgtggtccatgtacagagtttgataaagtg

SEQ ID NO: 6816361 - DNA, 56 bp, Homo sapiens
taccctttcctagaaatatatacttactgcactctgagtacttgctgggaagggtg

SEQ ID NO: 6816362 - DNA, 64 bp, Homo sapiens
gtgtgcagatgtgatgctgggctctgggacctgatagcacaagcccaatagttccactgcatac

SEQ ID NO: 6816363 - DNA, 59 bp, Homo sapiens
ccgtttggtacttagagattctctttatgcacttaaaaggcatcattagtaccaagtgg

SEQ ID NO: 6816364 - DNA, 116 bp, Homo sapiens
ttatttaatctttattaaattaaattctttatttgtaaggcagggccagtaaaaccataaatattactggctctgctttacaaacagggaagcacatgttccaagaagttaaatga

SEQ ID NO: 6816365 - DNA, 62 bp, Homo sapiens
ggaatgtggtgttcaatccatggtattctgaacccaccatggacagctgacactcacattcc

SEQ ID NO: 6816366 - DNA, 55 bp, Homo sapiens
ttgttttgatagctggtaactttgaactaaagggacattactgttatcaaaacag

SEQ ID NO: 6816367 - DNA, 73 bp, Homo sapiens
cagtaaatcagacctcaccggagcggattagtgataaaaatgcatcttgttccgaccgtggggtttgatcctg

SEQ ID NO: 6816368 - DNA, 67 bp, Homo sapiens
ccccaaacaggctgcagaggcctttcatggtcaaaaagacttggatttaggattttcagcagagggg

SEQ ID NO: 6816369 - DNA, 56 bp, Homo sapiens
tatatattacaaaagaggaaggatttcacatgaatgtcctactcttttaatatgtg

SEQ ID NO: 6816370 - DNA, 64 bp, Homo sapiens
cattctgagaaacttctttgtgatatgtgcattcatctcacagagttaaaagtttcttttgatg

SEQ ID NO: 6816371 - DNA, 59 bp, Homo sapiens
ttgaagcaaggcgaatcttgtgtgttccggactgaactgcaagtttgttcatgctttgg

SEQ ID NO: 6816372 - DNA, 59 bp, Homo sapiens
tccatccaggccagcagtaatcacggcaactgggctggcagctgctggctctggctgga

SEQ ID NO: 6816373 - DNA, 75 bp, Homo sapiens
tgtggtgactctatccttgtgtgcacaaacaggccacagcagtttagatcctaagcacagggacagatcatcaca

SEQ ID NO: 6816374 - DNA, 108 bp, Homo sapiens
gctgtgcccaagacttaactccccaggcccagctttatcaagtctgagctgagttttccttactaatttgaaacaggcagccagggaaggaaagtcatgaaataaagc

SEQ ID NO: 6816375 - DNA, 89 bp, Homo sapiens
tggggctcaggggctagggaacaagatgcccaggggacacctgcgtgggactcctggctcctctgctcacctagctgccccaagcccca

SEQ ID NO: 6816376 - DNA, 73 bp, Homo sapiens
tggtcccaattacaaggctagcagaatacttatgaggccttctggtctctttgcttgcctttagtcaggacca

SEQ ID NO: 6816377 - DNA, 61 bp, Homo sapiens
acccttgtagagttaagtgaggaaaacaaaattaatccacatagaaaacttagcagggagt

SEQ ID NO: 6816378 - DNA, 80 bp, Homo sapiens
agagctagagggatgtaaggaatatagcatctgttgaatgagtaataaagccttattgattttaccttccatctagctct

SEQ ID NO: 6816379 - DNA, 97 bp, Homo sapiens
actttttcagcctcagcttagtcaattataaataggcgataataatatctaccactgccagttttctgaggattaagtatgggaaaaatgtaaaagt

SEQ ID NO: 6816380 - DNA, 60 bp, Homo sapiens
gatgatttgaccaaagtcttctatgtctttagctagaacaacatggaaggtcaaactatc

SEQ ID NO: 6816381 - DNA, 70 bp, Homo sapiens
tattggtcttcttatgtttgtcttattgatttattgatttatgagagctctatatatagtaagactatta

SEQ ID NO: 6816382 - DNA, 57 bp, Homo sapiens
aggactgtcactggcaggttaaatgagaacttattcacccagcacagtggcagcact

SEQ ID NO: 6816383 - DNA, 80 bp, Homo sapiens
tgccagccttattcagaccttggattcttttcagaagtgaaaaagggaacactcaaggtctattgaatcggagcgtggca

SEQ ID NO: 6816384 - DNA, 68 bp, Homo sapiens
ctggaacctgtctggtcagggaagacccatttcaggccatgaggtcaacactgtgaccaacaggccag

SEQ ID NO: 6816385 - DNA, 82 bp, Homo sapiens
gtggccctggctttacacatccactgcctgtgagcagcttcatgcccctggaagccaggcagggagtagacccatgttccac

SEQ ID NO: 6816386 - DNA, 69 bp, Homo sapiens
tgaaatggaacctctggggccctacagttgttcatttcctggggggtgacaagtagaggttgcacttca

SEQ ID NO: 6816387 - DNA, 62 bp, Homo sapiens
catgattccaagctcagcgcaggggcctccctctctcctcctgccagctggtcccaattatg

SEQ ID NO: 6816388 - DNA, 80 bp, Homo sapiens
gcctcggcattctggtgcctggctggaggttgggggttgcactcctgcagacctcagtcaggtctcctctgttcttaggc

SEQ ID NO: 6816389 - DNA, 84 bp, Homo sapiens
gtgaagtttgattgacctgcatactaagtaaatctgccaccttagcctcactagtatcatgttggaattaatcaaactgtccac

SEQ ID NO: 6816390 - DNA, 66 bp, Homo sapiens
gaatatatgccaaaatgttacatttctttcggaaaatgggaagaggaagcattatggcatactgtc

SEQ ID NO: 6816391 - DNA, 56 bp, Homo sapiens
tccaccctaagcattacagatggcttatagctgtccacggggttggtagaggtggg

SEQ ID NO: 6816392 - DNA, 55 bp, Homo sapiens
ctcttaagtttctccacctttgcagagtgctgtgaaggctgagacaactcaggag

SEQ ID NO: 6816393 - DNA, 72 bp, Homo sapiens
ggtccagtttggtcatgtgcccacccctgaacaaatcactgtggccagcggtgtggaatgtgaggattggcc

SEQ ID NO: 6816394 - DNA, 100 bp, Homo sapiens
gtcccccaattagcattatccaagcacagcagagccttgcttgaagaaagaagctttaggcagaattcattgtgctgctgaggattgtgagaggggtgac

SEQ ID NO: 6816395 - DNA, 59 bp, Homo sapiens
cttacagtacttctaatatgattgtactagcaagacatgctatagagaagtgatgtagg

SEQ ID NO: 6816396 - DNA, 84 bp, Homo sapiens
cagttgtttcaggccaggttttcttttcactttatttctaagggctccttcaaggctgaaaacgagatggcaataagatagctg

SEQ ID NO: 6816397 - DNA, 68 bp, Homo sapiens
ctacctgattctcattttcttgttcactcataattctctttgaagtaaacaatgtatgaggacaggag

SEQ ID NO: 6816398 - DNA, 113 bp, Homo sapiens
cctgggcacatctgcttcctccatgttcactagcactggcgtggctgctgggctggccccagctgaccatgtttccagtggtggtggtgacaggggcctggcaggtggtcagg

SEQ ID NO: 6816399 - DNA, 73 bp, Homo sapiens
ggcagaaggatcgcttgagcccaggaattcgagactgcactctaccctgggtgacagagtgagaccttgtgtc

SEQ ID NO: 6816400 - DNA, 95 bp, Homo sapiens
ttatttcatcaaagatgtttttaaactgggagaataacttattgtattggatttgatgcattagaacctataaaaagcatctttgcgacagataa

SEQ ID NO: 6816401 - DNA, 55 bp, Homo sapiens
attagctccaccatttggccctgaaattcccccaagggccagaggtactactgat

SEQ ID NO: 6816402 - DNA, 67 bp, Homo sapiens
gagagtgagggagacgctcaagacagattctcatattttaatatctgaagcaatatcccctcacttc

SEQ ID NO: 6816403 - DNA, 82 bp, Homo sapiens
tcccctgttcctcagctcctcacgagtcttgaaaaataacaggctatcttttcagtactggagggagcagagcacatttgga

SEQ ID NO: 6816404 - DNA, 86 bp, Homo sapiens
attgcattttataattatctctactcttagggtcatatgtctattgtgtgtgtatgtgtggtggaaataatatatactcttgcaat

SEQ ID NO: 6816405 - DNA, 81 bp, Homo sapiens
ccttgctgcccctgctgcagagagctttccatcctccgcaccgcgtggtcaggctgctctgcggcgtgcgggacagcgagg

SEQ ID NO: 6816406 - DNA, 72 bp, Homo sapiens
gtggatgaggtcgagtcacttgttgcctttggctaatgcataggggcacgagtagagctctagaatcaccat

SEQ ID NO: 6816407 - DNA, 106 bp, Homo sapiens
gagcaaactgtccagatgcctgtgtggtctgcgcattaaggtattttgtaattctctatgatccaagctgaccacatatggtttctgatacttacagggagtgttc

SEQ ID NO: 6816408 - DNA, 58 bp, Homo sapiens
gggggtttctgggctgagcagaaatttgtttcttaatcatatttttccagcaaccccc

SEQ ID NO: 6816409 - DNA, 99 bp, Homo sapiens
gtttaaagggccctgtgtgaagaaaatggctgaggttttcccaaaataaaagatgtttggaaatggctgtagttatgaagtttcgctcacctaatgaat

SEQ ID NO: 6816410 - DNA, 130 bp, Homo sapiens
acggaaatgtgattgaatacattataaagtgataatacagaatttgcccttttcatattgtaagcaagatgagtttatggaaggatttcttgtctatcactttaggtaaagaaaaacatcttttttctgt

SEQ ID NO: 6816411 - DNA, 67 bp, Homo sapiens
tgagcttgctgaaagtcccaaatctcatgaagtaaaatctttcatgattgattctctgcaggtatca

SEQ ID NO: 6816412 - DNA, 111 bp, Homo sapiens
gactagccaaaagctgaaaggttgcgttttttgtaaagtgttgacagaattacccaagcaaaactcagcactattccaatgatccaatttcttttttttttttttttagtt

SEQ ID NO: 6816413 - DNA, 72 bp, Homo sapiens
caagtttccagagagagggaaaatactgatgtgagctacatatttgtctctgcactttactcagggaatttg

SEQ ID NO: 6816414 - DNA, 62 bp, Homo sapiens
gaagcagacatcacctgctggcagcaggcagtatcctctcagtcagccttgatgtccccttc

SEQ ID NO: 6816415 - DNA, 60 bp, Homo sapiens
ccattttgaggggggtagggtcaagctctgcaacttgacaaagcctcatccttcagaagg

SEQ ID NO: 6816416 - DNA, 57 bp, Homo sapiens
agctgcagggtttcgccagttgtgcaatacagccagccataatacgaacccagcact

SEQ ID NO: 6816417 - DNA, 64 bp, Homo sapiens
tgcatcgagggtattttatttgctggaacactaatgaccagtactagaacactaattgatagca

SEQ ID NO: 6816418 - DNA, 90 bp, Homo sapiens
tcttttatctgatgagatgactagaggagggatggccaaataaggtttatctggggtcccaactctgattgattggaattggctgaagga

SEQ ID NO: 6816419 - DNA, 64 bp, Homo sapiens
ctcctgcttctcaactggcactctgacacaccctcagaaagtcagagtactgggagaacagaag

SEQ ID NO: 6816420 - DNA, 99 bp, Homo sapiens
gtgtcccttcttcccggtgggggcagtgggacagatgctaggagaacacttggagctggcctcctgacacagtccacacttgcttccctggagggtcac

SEQ ID NO: 6816421 - DNA, 81 bp, Homo sapiens
tctaatcaactctgctgttccttattctcagctcaaaatgggaacatagagtttgatagagaggaaccgggagaagagaga

SEQ ID NO: 6816422 - DNA, 79 bp, Homo sapiens
ttcccctggatcctccaccaataaagctgatgaagctacttgctgccactggctcaatggtgcagggagccgaggggga

SEQ ID NO: 6816423 - DNA, 67 bp, Homo sapiens
tggttttcattctataatatctcattaactgctctgtactgagtgggactgctatgacagaagacca

SEQ ID NO: 6816424 - DNA, 64 bp, Homo sapiens
tcatctttctttatggaaatacatggtttggagcccctggttttgtttcacaaagagagcgtga

SEQ ID NO: 6816425 - DNA, 84 bp, Homo sapiens
gacaagatggttagtgaattcctaataggaagacctggtgatactatctctttccagatgttgggggtcaggtagctataggtc

SEQ ID NO: 6816426 - DNA, 74 bp, Homo sapiens
gctggagagtagtaagcagttagtggcaaaggggtttataaagaaaccctgtggactctctagtgctgtccagt

SEQ ID NO: 6816427 - DNA, 77 bp, Homo sapiens
ttatgagggcagcattgcctttctccagttacatcatcgactccctaaagctgagattccccagtgtgtcctcataa

SEQ ID NO: 6816428 - DNA, 62 bp, Homo sapiens
gaatggtattttcttcagagtcctagcttaggatgctgcaaagacctctgagaatgccagtc

SEQ ID NO: 6816429 - DNA, 57 bp, Homo sapiens
ggtctaatgttatcactactctgcctttcagtggagactgtgactaacatttagttc

SEQ ID NO: 6816430 - DNA, 57 bp, Homo sapiens
taatcacatcagggtaaatggggtatccatcacctcaagcatttatcctttgtgtta

SEQ ID NO: 6816431 - DNA, 55 bp, Homo sapiens
cagtgagtgggatagctgggattcgaacctgggtctctgaacttccactgcgctg

SEQ ID NO: 6816432 - DNA, 65 bp, Homo sapiens
gccagcaagccaggtctgtggctttgacaggagcaaacacagccctgagctgctctctgcatggc

SEQ ID NO: 6816433 - DNA, 77 bp, Homo sapiens
gtcatgttcagcagcctagaagctctaccaaccccatcctttggatttttatggaggcttcattgcatagacatgat

SEQ ID NO: 6816434 - DNA, 70 bp, Homo sapiens
aactctgttaatatactaaaatccactgaattgtacacatcaaaagagtggattttatggtatatgagtt

SEQ ID NO: 6816435 - DNA, 79 bp, Homo sapiens
cctggccgcatctgcccctgggctggtctggcttagtcaggagggcagcccttggcccagggcacagacacatgcctgg

SEQ ID NO: 6816436 - DNA, 81 bp, Homo sapiens
atttgtttgattctgagtaacatgtattggaaggccaagtctatctgcatgccttttcaggtgttattctgacagaggagt

SEQ ID NO: 6816437 - DNA, 130 bp, Homo sapiens
gtaagacacaattttagagtgtgtatctaggttgtagaagatttactgagttccaactgctttgggcaagcactggattgggaaagtacttcacatatattactccatatcactttcaaaacaactttac

SEQ ID NO: 6816438 - DNA, 81 bp, Homo sapiens
gggttggtctggatagttcacaatggctttacctaagtgggtggcatgatggtgaggattgctggaagactgggctaagct

SEQ ID NO: 6816439 - DNA, 88 bp, Homo sapiens
tccgagacagagtcaagtgcataagtggggttgaaggttggtatctgtctgcttcacttgcatttttcaagcatgattgtgttgagga

SEQ ID NO: 6816440 - DNA, 92 bp, Homo sapiens
ttttagaagaaaagtctccctttaagaccattatatatgatgagatattgtctgggttatagttagtaggtcattaaagggattgtctgaaa

SEQ ID NO: 6816441 - DNA, 66 bp, Homo sapiens
ggccaccctagctgtcatttcagttccttgatactcagggaaacttgggcatggttatgggaggcc

SEQ ID NO: 6816442 - DNA, 76 bp, Homo sapiens
acataagccagattctcaacttacgtaattctatgggaattcacagagttatattggttgagaatttggcttaagt

SEQ ID NO: 6816443 - DNA, 57 bp, Homo sapiens
gcaaatgcaggaaattatgctttttatttctatgatgagctcattcctgcattttgc

SEQ ID NO: 6816444 - DNA, 72 bp, Homo sapiens
gctggagccttctgctctgttgaagagtggaccccctcaagggactgtgaaggcagagctggggcctccagc

SEQ ID NO: 6816445 - DNA, 70 bp, Homo sapiens
ggaaagaggctcaaggtgggccagttttcatcatttctccttcaggctgcccaagcgtctgcctttctcc

SEQ ID NO: 6816446 - DNA, 62 bp, Homo sapiens
ggagcatctccagggtgtcccactccctgggatgtcactgggcatggacacctggagtctcc

SEQ ID NO: 6816447 - DNA, 67 bp, Homo sapiens
aacaagtgatcagacactgaagtcaggaagcctgagtcatagacttcagacttatggcacaattgtt

SEQ ID NO: 6816448 - DNA, 73 bp, Homo sapiens
tgtgaatgaatgtcctttggggaaagaaagtccttatcttttatcagattctccaagggatttctgccttaca

SEQ ID NO: 6816449 - DNA, 85 bp, Homo sapiens
cagtgtgtgattgtgggaggaattagaatgggataagatatcaacacatcatattcttttccttctttccccctagtcatttttg

SEQ ID NO: 6816450 - DNA, 65 bp, Homo sapiens
ggaggacaagttgtggagaagagggtgacctttaacacacccctacattcccaaacttggtctct

SEQ ID NO: 6816451 - DNA, 66 bp, Homo sapiens
ctgtactatttgttcactatgaagaggttggggaatgatcactgacctctaagtaacagagaatgg

SEQ ID NO: 6816452 - DNA, 55 bp, Homo sapiens
gacttttctaaataccgctctggaggtcaaagtcatttccaaagccagagaagtt

SEQ ID NO: 6816453 - DNA, 61 bp, Homo sapiens
acatttgataattataaagacatatgattctgtgaaaatagagtgtctgtaaatcacgtgt

SEQ ID NO: 6816454 - DNA, 65 bp, Homo sapiens
cttctgggacttgtagtctcggcgctggtcggggcccgcagcctccgcactgcgagtcctaggag

SEQ ID NO: 6816455 - DNA, 77 bp, Homo sapiens
ttgtttcctacggtgacttttattcaattgaatttaaaaccccagatgaaagtgaatacatgtcactcagcaggcaa

SEQ ID NO: 6816456 - DNA, 55 bp, Homo sapiens
gttattctgccaaacttccacaagaagaagagaattgtgaaagcagtagaatgac

SEQ ID NO: 6816457 - DNA, 58 bp, Homo sapiens
gctcttggaatgctttattttggaattcatcttccatcagtggagcagcccaagcagc

SEQ ID NO: 6816458 - DNA, 65 bp, Homo sapiens
acttggattatagtttttgtctttttaatcaaattatagaaaaatgacataaagctatgctaggt

SEQ ID NO: 6816459 - DNA, 62 bp, Homo sapiens
gccggccaggtggagagaggcttggagtattacacttgcatatatccctccacatggaaggc

SEQ ID NO: 6816460 - DNA, 77 bp, Homo sapiens
ggcctctggatctggcatttagacccacagcaacagcttgtgtttgctcagggctaagaatgcaggactcagacacc

SEQ ID NO: 6816461 - DNA, 83 bp, Homo sapiens
ccttaaactgctctggagctcttcctttcaggaggccagctaatgttgacctgtctctgaaagagagcagccaggcatgaagg

SEQ ID NO: 6816462 - DNA, 68 bp, Homo sapiens
cctgaaaaacaagcaaacaaacactatttctgggcttgcagaaaattatgtgcttgcttgtttccagg

SEQ ID NO: 6816463 - DNA, 60 bp, Homo sapiens
cattcagtggagtattattcagccacaaaaaggagtgaagtactgatacacactgcaatg

SEQ ID NO: 6816464 - DNA, 78 bp, Homo sapiens
gaaaatgggctcagagtttgaaataatttttagggttatgtttgtaaaacttaaattctagcttcctgtcacattttc

SEQ ID NO: 6816465 - DNA, 86 bp, Homo sapiens
gaccatgtatcaacgtctccatgtcaccttgtcactgtgtaatgtttctgtgtgacagggtgtttgtgagactatgtatctgtgtt

SEQ ID NO: 6816466 - DNA, 84 bp, Homo sapiens
ccagaggctgcacccagtgctcccgctgccgctgtgaagcactgcccacaggagggagcgggcagccagctggggctgccatgg

SEQ ID NO: 6816467 - DNA, 78 bp, Homo sapiens
ggagacagcctaacccctgtacaagctcttggtgacagtttgtgggtgtctttgaaaagcttgacagaggctttctct

SEQ ID NO: 6816468 - DNA, 81 bp, Homo sapiens
catttttggttgttacagttgggggtaggggatggggagggatacatgctcctgatatctaatgtgtagaagccaaagatg

SEQ ID NO: 6816469 - DNA, 71 bp, Homo sapiens
tgatagctcttttgcaaagtgactattatatgatgtgttcattatgttcatgcttatgcagaatgcaatta

SEQ ID NO: 6816470 - DNA, 65 bp, Homo sapiens
tcaggctgttgctctgaacaggtcttgccaaaatagcgagtgcccatcggagacaacttgtttga

SEQ ID NO: 6816471 - DNA, 69 bp, Homo sapiens
cctccagatgtgcctccgtttcgtgccagtagacagatctaaaagggagccagcagggtgacactgagg

SEQ ID NO: 6816472 - DNA, 59 bp, Homo sapiens
ttcacaagtctggaatatgctacctctagaacccaaagtggcctaccagacattgtgag

SEQ ID NO: 6816473 - DNA, 55 bp, Homo sapiens
agcagggtcccggcttgtgttcaggattttgaaacatttgtaaggtgattttgtt

SEQ ID NO: 6816474 - DNA, 58 bp, Homo sapiens
gtctgcctgggacgctgggagtgtgtgagcagatttggtgccagaggcccgggcaggc

SEQ ID NO: 6816475 - DNA, 65 bp, Homo sapiens
tctgccaggtggggagaggccaggcccgcctctgcccccaggcctgcctgccccgccctggcaga

SEQ ID NO: 6816476 - DNA, 64 bp, Homo sapiens
tcttaaactgactattacggccacgaattttattaagaacttttgctgtagtggtttcttaagg

SEQ ID NO: 6816477 - DNA, 60 bp, Homo sapiens
tcttttatattaacaaatgtgagagctccaaaagaactaaacatttgtggatctgagaga

SEQ ID NO: 6816478 - DNA, 67 bp, Homo sapiens
acaggaagtgctggcacttacacaggctggagtgaagatgtcaaatgaggatgtcagcatttttggt

SEQ ID NO: 6816479 - DNA, 66 bp, Homo sapiens
tgtggctcctgggctgtcggcgctctgccaggcatgacggggtgcaccatgcgctcggggcccgca

SEQ ID NO: 6816480 - DNA, 61 bp, Homo sapiens
tcctgagcaacacagctaagtggcattccccacccctgctcttagcaaaagttcctcagga

SEQ ID NO: 6816481 - DNA, 58 bp, Homo sapiens
ggctgtgcctcttctgccactggactttttgttcagctaggaatggagatgcttagcc

SEQ ID NO: 6816482 - DNA, 107 bp, Homo sapiens
gggcctgaggttccttctagctttaactttctttgcatctaagtttcgtagctcaagcatctggaattccaggtgagagaaggtatggtagattgaactgttggccc

SEQ ID NO: 6816483 - DNA, 63 bp, Homo sapiens
gggactcagcaaacaagggattcttcaaaagttgtcctcccaaatccctcttcctagagtccc

SEQ ID NO: 6816484 - DNA, 69 bp, Homo sapiens
ccactccaaggagtgcatgactcagagtaagctccttaccctgctagctagcatctctattggaagtgg

SEQ ID NO: 6816485 - DNA, 71 bp, Homo sapiens
tttcttggtctcactagccacatttccaatgttcaatggccacatgtggctagtggacacagtattagaaa

SEQ ID NO: 6816486 - DNA, 106 bp, Homo sapiens
tccactgagggtgaagtgtccactggacttctcttcaaagacaggctttctctgtgtcttccagagagtctataaaacatttaaacaccaggaagaatcggtagga

SEQ ID NO: 6816487 - DNA, 57 bp, Homo sapiens
tgtatctctatctatctatctatctatatctgcatagaaaagggcaggagggataca

SEQ ID NO: 6816488 - DNA, 57 bp, Homo sapiens
gttcaagatccagcacaacagtgataggacttccatcagttgatagagatcttgagc

SEQ ID NO: 6816489 - DNA, 76 bp, Homo sapiens
cccatgtccttctctggggcccagaaattccatctgctgctcctgtggtcctctgggctcagggaaaccccgtggg

SEQ ID NO: 6816490 - DNA, 67 bp, Homo sapiens
cactgttgaagatacttcctctagcaattaaacacctgaaaaagatgatgtgtgtcttcagctagtg

SEQ ID NO: 6816491 - DNA, 60 bp, Homo sapiens
tacatttgcctccaccaaaggtgtcaatcaagataacattaatttattggagcagatgtg

SEQ ID NO: 6816492 - DNA, 77 bp, Homo sapiens
gcagagcccagaggtgggagcctggtcacatgcacagttgcattacttgtccacgcccacttccggcctgggcctgc

SEQ ID NO: 6816493 - DNA, 63 bp, Homo sapiens
tcattcagagagaatgttccaggtgagaagagccaagcaccaaacatggggccctttgaatga

SEQ ID NO: 6816494 - DNA, 55 bp, Homo sapiens
ttatccaggtctgcttttcctgcctaggctagattagaaatggcagaatggatag

SEQ ID NO: 6816495 - DNA, 62 bp, Homo sapiens
agatggggtccatgagggtagtcagaggattctgagattcccataccctcagggcctcattt

SEQ ID NO: 6816496 - DNA, 63 bp, Homo sapiens
ggggcgtggtaggggcagcagtgccagccagagccctggggaggcagggctgcccctccctct

SEQ ID NO: 6816497 - DNA, 64 bp, Homo sapiens
ttgaactttgtgtataccttgtcctggtaaatttaatggacatctcatttatacagaagttcag

SEQ ID NO: 6816498 - DNA, 57 bp, Homo sapiens
cttctgtgctaaatgcaaaacctttgtaattccggatgtgagtcttttgcacaggag

SEQ ID NO: 6816499 - DNA, 63 bp, Homo sapiens
agcaaaagattgctgagtagtcactttcatcccaactgttgctgctatcacactctttctgct

SEQ ID NO: 6816500 - DNA, 83 bp, Homo sapiens
cagctgaaatgtgccatctgggacctactaatgcttgttgaactttactggatctcagaagctgggtctcagaagctcagatg

SEQ ID NO: 6816501 - DNA, 79 bp, Homo sapiens
ggcccaaagttatactatcaaagtgatgcctatctccaatagataggcattattagatgatgttatagatctttaatcc

SEQ ID NO: 6816502 - DNA, 65 bp, Homo sapiens
ctgccaggcagcagcgaggatggtgaccgagaaggtggggaccacgtcctggtggctgttggcag

SEQ ID NO: 6816503 - DNA, 72 bp, Homo sapiens
ccgccgatgtctgggtgaggtctactgggctccccaaggaggacagtaccttttacctaagacgtcgggagg

SEQ ID NO: 6816504 - DNA, 75 bp, Homo sapiens
tcagaatcacagtagacttctcaagagcatcatgagatgctaaatgatgttagagtcacaactgtaatactctga

SEQ ID NO: 6816505 - DNA, 80 bp, Homo sapiens
ccctcttggtgtaacacatccagattttggataaattataacattgttttttaatgcaatttctggtctgcagtaaaggg

SEQ ID NO: 6816506 - DNA, 59 bp, Homo sapiens
gggcaggagaggcagccaggtaggaggacccaccccctgaagcagttccctctctgccc

SEQ ID NO: 6816507 - DNA, 110 bp, Homo sapiens
atcagtgggtttatattttagaaaatattcagatgaaaggaactctgaccaactgtgtgaaaatctaggagtggaatcagactcctgcattttaataaagccctactggt

SEQ ID NO: 6816508 - DNA, 56 bp, Homo sapiens
tccgtctctaaaaagggcagtgggagggaattgcgctgctcttttcagagatgaga

SEQ ID NO: 6816509 - DNA, 55 bp, Homo sapiens
atcaggtttttcaccctgtcagaggacagcctctgacagtaccaccaaatctgat

SEQ ID NO: 6816510 - DNA, 76 bp, Homo sapiens
catggtttgtaacccaatactccccagcttgtccttcagaacatgggcaatttggagttctgggttaataaaagtg

SEQ ID NO: 6816511 - DNA, 57 bp, Homo sapiens
agtgaggaagggggcgatgcccgggagggctctgggagagtaaccaattccttcact

SEQ ID NO: 6816512 - DNA, 106 bp, Homo sapiens
ctgaaagaaccaccgctgtagcctctcatggcagtctggaaaatgccagggggaagccgactgcacagatggccagaggcagctgcatgctcccgatttctttcag

SEQ ID NO: 6816513 - DNA, 71 bp, Homo sapiens
ccaagtctgtggaattgatgcttagtgtcaaaacagtccagatcactttggtaccaattcagcgtcgctgg

SEQ ID NO: 6816514 - DNA, 66 bp, Homo sapiens
gctaaggcccagcttttcacttccacacgcttgctgcgcgatgtggggataatactggtacctagc

SEQ ID NO: 6816515 - DNA, 65 bp, Homo sapiens
gtggtatttatgacagtgcccgtctctgggcagctgggctttgggggcgtgtcatggagggccac

SEQ ID NO: 6816516 - DNA, 76 bp, Homo sapiens
ttgcttgaacccaggagatggaggttgtggtgagccaagatcacgctactgcactccagcctgggtgaagaagcaa

SEQ ID NO: 6816517 - DNA, 89 bp, Homo sapiens
gtgttaggaagtgctaagagaacatcatttgcaaaggggatgagaaaccccttttatcttggcctgtttcttttaagcagttcttccac

SEQ ID NO: 6816518 - DNA, 76 bp, Homo sapiens
tggagaagagtttatgatataacatgtttagtgataaaagcaggacaaaaaactgttcgtattatagaatactcca

SEQ ID NO: 6816519 - DNA, 93 bp, Homo sapiens
tctttcctaccccctagctccactccttatgccagacggttccaaaactaaggccagctgactgagtggggatgtggagctgatgaagaaaga

SEQ ID NO: 6816520 - DNA, 67 bp, Homo sapiens
ttaagctgactttaatagcttctgtgctttgtaaagaaagcaagaaagtgtggagagcctagcttaa

SEQ ID NO: 6816521 - DNA, 84 bp, Homo sapiens
tagaggttgtgtaaagttttgagagttaggcggaatcaggtagcctctgattaagttgcattttaatatttcatacaatttttg

SEQ ID NO: 6816522 - DNA, 57 bp, Homo sapiens
cttatcatctcctgctgtggttataattgtacatttgtctctcctggagatggtaag

SEQ ID NO: 6816523 - DNA, 77 bp, Homo sapiens
gaaaataaacaagggctaactctccacccagacaatgagtggcttacttaatggagatttagcacttacgtattttc

SEQ ID NO: 6816524 - DNA, 75 bp, Homo sapiens
caaaacttatgccaggtcccatccccagagatcctgatttaatgggtctggggtgcagcctggacataaggtttg

SEQ ID NO: 6816525 - DNA, 60 bp, Homo sapiens
tgggaggatctggctcaggccttctagtcacaaaaggcctcaaatgtagcctttttccca

SEQ ID NO: 6816526 - DNA, 86 bp, Homo sapiens
ccttccattggctaagtgtaaagctgtatatgtgccagttatctcaagatgggcatatattcatcagcttttcttaaaattaaagg

SEQ ID NO: 6816527 - DNA, 70 bp, Homo sapiens
cctcagtgttaggttctcagcttctgagagtgctgtcatctgtggtctccaaagcttaggactactgagg

SEQ ID NO: 6816528 - DNA, 56 bp, Homo sapiens
agagggttgtatgaattctcatggaacatcaagtccaatagtttatttagccttct

SEQ ID NO: 6816529 - DNA, 56 bp, Homo sapiens
ccagcttgtttgaagctcgtcaggatgttccttgcagaccccgcttagccagctgg

SEQ ID NO: 6816530 - DNA, 87 bp, Homo sapiens
agaacaagactttgatggaggttgcactctagtggaatatattatgactcataaatgaagtgcacaccttagtacaaagtaaattct

SEQ ID NO: 6816531 - DNA, 64 bp, Homo sapiens
agtaattagtcagtggtgcttaaagtttcaggactttgtaaacttttgcatactgcttgttact

SEQ ID NO: 6816532 - DNA, 82 bp, Homo sapiens
agggagagacttcttaatggcaaaggattttatgtttatctttatcatgaaaaactttaatccataaagtagaatgttcctt

SEQ ID NO: 6816533 - DNA, 84 bp, Homo sapiens
tgcatggtctagaagggaggctgtggttctggtgacatccactcggacccacagattcttcattctatgggggtgaccagagca

SEQ ID NO: 6816534 - DNA, 56 bp, Homo sapiens
accgagggtatgtgtttaagatggtcaacaattacatcagcatgttctcctccggt

SEQ ID NO: 6816535 - DNA, 61 bp, Homo sapiens
ttggagtcatatggaattcacatcaaaaaaggtgctcatttggtttaccgtattattccaa

SEQ ID NO: 6816536 - DNA, 74 bp, Homo sapiens
acaatctcattggccctgaattaatcaaatacccatcaatgaacaaatggatcgtggtcagggaatgaggttgt

SEQ ID NO: 6816537 - DNA, 71 bp, Homo sapiens
tcagacttcctgcacccgccctcagccttaccgtgctgcagagctccggcggcggcgggggcagtgtccga

SEQ ID NO: 6816538 - DNA, 75 bp, Homo sapiens
cctctctgctgaggtggttttagagaagacttagtggacagtcaatattttcaacatcacctagcagttctgagg

SEQ ID NO: 6816539 - DNA, 113 bp, Homo sapiens
tgattacatggagtgagcccatgcaatttttttaaagctaatgtttacgttcctatcaagtaggaaatgaggtaagttataagttcattctgtgggctaactaaatatattca

SEQ ID NO: 6816540 - DNA, 58 bp, Homo sapiens
gagagagctctggctgggtgaccttgctctggcagggtggtcagggaggggctttctc

SEQ ID NO: 6816541 - DNA, 86 bp, Homo sapiens
catgtaagaaatgtgactatcctgagaccaccacactgtacaaaatacaagctatatatggaggtcctgcaggatggcacatcatg

SEQ ID NO: 6816542 - DNA, 89 bp, Homo sapiens
gactggcagtgggaagaacagttgggaggtgagccctttcttcctgggcacagagctgggctatttctcagcttcttggatagtcagtc

SEQ ID NO: 6816543 - DNA, 69 bp, Homo sapiens
ttgatgattatttggccaagcaacttccaaaaccttggtatttggaatagcttgctaatgttttcttaa

SEQ ID NO: 6816544 - DNA, 121 bp, Homo sapiens
agagtttcaccatattggccaggctggtctcgaactcctgacctcgtgatctgccagccttggcttcccaaagtgctgggattacaggcatgagccaccacgcccggccgccaagaactct

SEQ ID NO: 6816545 - DNA, 83 bp, Homo sapiens
gaagacagtggtagtgatgatgatgttagagacagtgataatgatattgatgattctgatcatcatcatggtggtagtgattc

SEQ ID NO: 6816546 - DNA, 59 bp, Homo sapiens
ggttttaccagtctgttgttgcagagtgctgggtgtattttgctttagctgactgttcc

SEQ ID NO: 6816547 - DNA, 63 bp, Homo sapiens
tccattctcattcccccaggcactccagtaaatgcaatacagatgtggcaggatgagggcgga

SEQ ID NO: 6816548 - DNA, 60 bp, Homo sapiens
atatgacagcggattcacatatcctaaacctttgataattatgtgattcagttgccgtgt

SEQ ID NO: 6816549 - DNA, 79 bp, Homo sapiens
agtgccacttcacctgctttagacaactgctgggacatgcagtgatccacagaccagtatctgcagcaggacagtgcct

SEQ ID NO: 6816550 - DNA, 105 bp, Homo sapiens
caggtctatggtggcagggccagctggcaggagagtcagggcttggcagcttcttctgcaagatgcatctgtgcttcctgccactaccaagccacctggctcctg

SEQ ID NO: 6816551 - DNA, 72 bp, Homo sapiens
tgtctactgaagcatgcttatatgtcttgtgtcttctgctgcacttgagcattaggtgtgtttcagaggata

SEQ ID NO: 6816552 - DNA, 130 bp, Homo sapiens
gcaaatgaaggttgagggcccaggaatctgcctttttcaggctccctgcaggccagtgagaaacctcagcttcagggtcgcagagcctgcagaggccaagaggctgaggccagaggtcccccaaagcagc

SEQ ID NO: 6816553 - DNA, 94 bp, Homo sapiens
gcaatccaaatttatcaagaaattctgttcagatagcttatttgtaggttagctgtctaaatcaggacaaatttccatgtggatgctgtattgc

SEQ ID NO: 6816554 - DNA, 63 bp, Homo sapiens
ggaaatgtatgtattaagcacctggcaggcacagaaaggtgctttcactgatgtatcatttcc

SEQ ID NO: 6816555 - DNA, 58 bp, Homo sapiens
gccaccatggccggctaattttgtatttttagtagagatgaggcttctccatgttggt

SEQ ID NO: 6816556 - DNA, 122 bp, Homo sapiens
atgcctgtcttgttggtgaaatcattaggaagcaatgcattattaaagagtttttcagacacagagggtttggaattgctattgataacaaatgttgctaatgttttcctgcaaaattgcat

SEQ ID NO: 6816557 - DNA, 70 bp, Homo sapiens
gttaatatcaggaagaacacgtgaaatggagaatttcagggctaacatttcttgttttgtttctgaaaac

SEQ ID NO: 6816558 - DNA, 120 bp, Homo sapiens
tgctacataacaacctctctgaacctcggttttctcctgtattcagaattcgtcctactctctgaagtaagtgcttgaatgaagggatgaccgaagggccctgagagcttggaaagagca

SEQ ID NO: 6816559 - DNA, 94 bp, Homo sapiens
aagaaaaatgatggacagcttttgtgtatgtatgcttgtacatttatctgtttttagtattatacataaaacaatcatgttggttaatgttctt

SEQ ID NO: 6816560 - DNA, 60 bp, Homo sapiens
ggctcagaggccagcaggtagaagacaatctcagtcaaattcatatttttgccctgggcc

SEQ ID NO: 6816561 - DNA, 67 bp, Homo sapiens
agtgttttggaggaaaaggaaggataaggtgtatatcatgtcttgtggattctatttcccagaacct

SEQ ID NO: 6816562 - DNA, 67 bp, Homo sapiens
cccagagccttgagttcaagtgctggctatgctcctcattagccagttgtgggatcttaagtatggg

SEQ ID NO: 6816563 - DNA, 63 bp, Homo sapiens
gtatagataagctaacccaagccctttaataagattagagaaggtaagtagcttgtcatgtac

SEQ ID NO: 6816564 - DNA, 77 bp, Homo sapiens
gaagagagtattccttagtgccctgtctggcaacttctggacagaccaggaggccttggggcttagagcacttcttc

SEQ ID NO: 6816565 - DNA, 71 bp, Homo sapiens
aagataaacaaaggagagactttggtttctcattcagcatgaaagaagcttggaagtcttcctttcatctt

SEQ ID NO: 6816566 - DNA, 56 bp, Homo sapiens
ggtgtggggaggttctgcttctctgagtagtggagacagtggagcccactcacagc

SEQ ID NO: 6816567 - DNA, 66 bp, Homo sapiens
tggcagaatgaagactggggcctcagggtttcccccatctttccacctttcccacttcattttcca

SEQ ID NO: 6816568 - DNA, 130 bp, Homo sapiens
tccccacagcagccctcccttctgatgagggactcagcctgactccttggatctgggaggttcttcacctccaggcccatggagcagagctgagccgctcaagtttccaggctgggaaaatcctgtccag

SEQ ID NO: 6816569 - DNA, 56 bp, Homo sapiens
ggaattgtgattcaggctgctcctttccctggtccccagcccttgatttacaatcc

SEQ ID NO: 6816570 - DNA, 70 bp, Homo sapiens
gtttggactggaaagttctttgcggtggggctgtcctgtacattgtaagaggctttgcagcattccagac

SEQ ID NO: 6816571 - DNA, 100 bp, Homo sapiens
aggaaaatactgggtggttacttcacacttcagtccatagaggcccttatagcaatgcctcagtgggagcaggagagtgacatatctcctagttgttcct

SEQ ID NO: 6816572 - DNA, 113 bp, Homo sapiens
gtagagtgtgcctgactggtggtggaggacctgtctttatacctcctgaggatctggagaggaggtgtctctgaggtgagggtcagcactcctcccagcacaaacacacctgc

SEQ ID NO: 6816573 - DNA, 93 bp, Homo sapiens
gtagctaacagttattgagtagttaccatgtgccaggagctatctttagtttttgacatggaataactcatttgatgactataaacatgctac

SEQ ID NO: 6816574 - DNA, 84 bp, Homo sapiens
ggttatggcaaatggcctttgagatgaaagggaggccgaggccggcagttcatttagaacaggagtggccatctgtcaatagct

SEQ ID NO: 6816575 - DNA, 61 bp, Homo sapiens
tgagtgtctgtggggcatggacatgacctggatattaggatgtcagcgatcagagaactca

SEQ ID NO: 6816576 - DNA, 70 bp, Homo sapiens
gggtttcaccatgatggctaggctggttttgaactcccgacttcaaatgatctgcctgcctcagcctccc

SEQ ID NO: 6816577 - DNA, 62 bp, Homo sapiens
atgactccagtttatgtgaatgtttgagggaccccaaacattgcaaataagcttgcagtgat

SEQ ID NO: 6816578 - DNA, 126 bp, Homo sapiens
gttaattactggacccaaggaagtaccaaaaattgtggggctgaatactctggctgctgtgactcaaattccttggaattcacccttaattttcttggatttttcttttggttaaaaaaaattgac

SEQ ID NO: 6816579 - DNA, 55 bp, Homo sapiens
atgctttacccacaccaggatgctaaattgtgacagggtgtgtgggtaaaggcat

SEQ ID NO: 6816580 - DNA, 56 bp, Homo sapiens
gtgctccaaatcttggccaaggaagaaagagagactggatctgtgatctggggcac

SEQ ID NO: 6816581 - DNA, 61 bp, Homo sapiens
actaagaagtagcattatcattttaccgaaaaaaggtgcaggagataatggtgcttagagt

SEQ ID NO: 6816582 - DNA, 85 bp, Homo sapiens
ggaaagcagcagaggtcagaaaggtacaagccgctaaattagaaagaccagtcctgaatgcctaaatttgcctcatttgcttttc

SEQ ID NO: 6816583 - DNA, 68 bp, Homo sapiens
caccccagcttctcaggatagaattgggagccccaaatccctgccctggtttgtagaagcctggggtg

SEQ ID NO: 6816584 - DNA, 57 bp, Homo sapiens
gtcacatggttttcatggcattagttcagctccaagtgtcagaaataagcatgtgat

SEQ ID NO: 6816585 - DNA, 61 bp, Homo sapiens
ctcataagttaagtgcctaatgtttagtcttatcgctgattgtacagacacttagtatgag

SEQ ID NO: 6816586 - DNA, 82 bp, Homo sapiens
tcgataatagtaaaatgcagtaaaataggaggtaatgtgccttgagtatttattaccttggattttgatgtaactaatttga

SEQ ID NO: 6816587 - DNA, 75 bp, Homo sapiens
agagtcgctgagagagcagatgtgtgccaggatgctgttcccgcagccacctggacctctgcctgtactgactct

SEQ ID NO: 6816588 - DNA, 61 bp, Homo sapiens
attgtatatatacatgttccttcatagcattaggctgtgaaggaatgtgtatatatacaat

SEQ ID NO: 6816589 - DNA, 63 bp, Homo sapiens
aaagcattattctgtggaaaaagtgagcattctattttaactgaattcacaggaaatgtcttt

SEQ ID NO: 6816590 - DNA, 79 bp, Homo sapiens
gggcagctgctggagggaggcaggacacaatgctggagtgtagcagaggccacagccctgctccctcctagccttgccc

SEQ ID NO: 6816591 - DNA, 72 bp, Homo sapiens
ccccaggaacctgcaagacagacttgacggatacttactgctgtgtctgggtggctgctttcagctctgggg

SEQ ID NO: 6816592 - DNA, 61 bp, Homo sapiens
tttagcagagcatatgatatccttgtgggcaagatgaaggagtatgatatagtctggtaga

SEQ ID NO: 6816593 - DNA, 56 bp, Homo sapiens
catgcactctttgagaaggatgtattagaatggttactccttcctgaaagggcatg

SEQ ID NO: 6816594 - DNA, 58 bp, Homo sapiens
gccaggaaggaccgtccagatcaggcctgcctggttccaggatggatctttcccaggc

SEQ ID NO: 6816595 - DNA, 84 bp, Homo sapiens
cccttcgcctctacactctctaacagggctctccagactcgaaagccacagtgagaagccctaagagaatagagcttcaaaggg

SEQ ID NO: 6816596 - DNA, 55 bp, Homo sapiens
ctgatgaatggctcctgagtggcccagtttaaggtccactcagctgtattctcag

SEQ ID NO: 6816597 - DNA, 77 bp, Homo sapiens
gaataccaagtgaatgatgtgaagtgtaaaccaaccattgttgtgtttcatgttactgtcatacacttgtttccttc

SEQ ID NO: 6816598 - DNA, 59 bp, Homo sapiens
gtacaaccagatcctctaagtcatcatgttattcatctgaccccagggctggtctgtgc

SEQ ID NO: 6816599 - DNA, 130 bp, Homo sapiens
aggcagggacacaacctctctgggcctctatgctgttctctctcgaatgagagcgctgcactacacaagctgcagtgacacggagagacagcatggcagagctaagacgcagcaggcgtgtggccctcct

SEQ ID NO: 6816600 - DNA, 62 bp, Homo sapiens
gacatatgtgtacatggagattggggctcaatagagatctggaattctgataagcatgtgtt

SEQ ID NO: 6816601 - DNA, 89 bp, Homo sapiens
tccaggaagtcagcctggctaaattctcccatgggctgatagagctgccaggggtttggctcagactggaactcaagatgcttcctggg

SEQ ID NO: 6816602 - DNA, 60 bp, Homo sapiens
tggtgagatagagaagttaagtaaatgcatttacattatgtagatttctctgtttttcca

SEQ ID NO: 6816603 - DNA, 61 bp, Homo sapiens
tggaagagacctcatgagttgtgccgtccatcaccttggcataacatcatggctctttcca

SEQ ID NO: 6816604 - DNA, 81 bp, Homo sapiens
tgagtgcttactatgctttaaccctcttatatttgtaatccatcataatatgcagcatgatgaagtaagtacttgcattca

SEQ ID NO: 6816605 - DNA, 65 bp, Homo sapiens
taataagaggattaattgtcttacctagcaagaatcccagaggtaaggcagtttcaattttgtta

SEQ ID NO: 6816606 - DNA, 83 bp, Homo sapiens
cattacttaccacctctttgatttgaggcaagttacgaaccactccatttttctcttctgtaaagtggtggcactgattgatg

SEQ ID NO: 6816607 - DNA, 69 bp, Homo sapiens
ggccattgtcagcatttaaggagtaaggagcccactcatgcttccctgtattctttgatgctataggct

SEQ ID NO: 6816608 - DNA, 63 bp, Homo sapiens
accccatggttaaccaagcctgagaagagagcccagtttttaaggatggaaaggactaggggt

SEQ ID NO: 6816609 - DNA, 82 bp, Homo sapiens
ggtgttgcttctgtgtgtttatgtctgggtgtttacatgtgtctgtatgtgagtgtctggtcatggcaggcagctgtagccc

SEQ ID NO: 6816610 - DNA, 61 bp, Homo sapiens
ggcagtgttgagccagctgggggctggaccctgctgtctgttctgagcactcatcactgtc

SEQ ID NO: 6816611 - DNA, 73 bp, Homo sapiens
ttccccctgtagaatgagtaagccacaaggtcataactctttctttggtttatttcttcctatgagaatggaa

SEQ ID NO: 6816612 - DNA, 66 bp, Homo sapiens
taaacctgcagagcaagtaacatcctcctcatttttagatgaggaagttaacactctgaaagttta

SEQ ID NO: 6816613 - DNA, 129 bp, Homo sapiens
gaagataagtcattttttttctgatcttacacagataatagcattatcatcaaaactcaatcatagatgtactgatccagtgctgtggctgttaagcccttcaatataataagatgattaatataaatc

SEQ ID NO: 6816614 - DNA, 82 bp, Homo sapiens
ggcagacaaccctgggacttccgagttgagcgagccagtaaattcagtttagctgaaagcagttttaggttagttttttgtc

SEQ ID NO: 6816615 - DNA, 108 bp, Homo sapiens
gttgtttgtttcataggtcagattcaagcaatgccctggtatattaatagacttatgaatgctaatattttcaagggcattatttgaagacatattttttcagattac

SEQ ID NO: 6816616 - DNA, 56 bp, Homo sapiens
tctagatcagtgcctgaaggaataaccagatgggctcttgggagcacaggtttaga

SEQ ID NO: 6816617 - DNA, 111 bp, Homo sapiens
gaccttgttgtaggctacagacaactggagagtaatctctgtgttaactcatctctagctgaccagaaggtgctattttagctgactgtgggataatggtgacaagatgtc

SEQ ID NO: 6816618 - DNA, 55 bp, Homo sapiens
gcttagctcatgaactgtaggcccttctctggccctggtagtaaatgagtagagc

SEQ ID NO: 6816619 - DNA, 80 bp, Homo sapiens
ctcgggttccttgacaaaaattctattgtcatgacattgttcagtttatacatggagaatttttgccattgatttctggg

SEQ ID NO: 6816620 - DNA, 59 bp, Homo sapiens
tccctagactgagagcatgtcagggctagaaggaaccttacagagcctcattttagaga

SEQ ID NO: 6816621 - DNA, 59 bp, Homo sapiens
agctggcagctctcaggggtacgtgagtccaggctgatctcatccttggggctgctgct

SEQ ID NO: 6816622 - DNA, 56 bp, Homo sapiens
gagcacggagtaaggaattccttctgaagactggatttggattctgctgcctgctc

SEQ ID NO: 6816623 - DNA, 89 bp, Homo sapiens
ccacctgattttgtaagtaaaattgtattggaaaacactcctgcttgggtgttgtctatagcagtgtttgcactataatggtagagtgg

SEQ ID NO: 6816624 - DNA, 84 bp, Homo sapiens
aaagattccagctcagttcttcaagtgcttcggttcttattaaatttgtggaatatgcacacgtagaagaacttgactttcttt

SEQ ID NO: 6816625 - DNA, 70 bp, Homo sapiens
ggtatgggggaggccggcagctcgcccctgagctcaactggctggcagggctgatggcttccctcacacc

SEQ ID NO: 6816626 - DNA, 68 bp, Homo sapiens
gcccctgaaaatcccagattgtgttgtttcctgtactaggaaacattgatattgggaaagaaaggggt

SEQ ID NO: 6816627 - DNA, 58 bp, Homo sapiens
ccggcgggcagcggcagtgagcccagcgaggtggtctcggtgcgccagtgtccgttgg

SEQ ID NO: 6816628 - DNA, 74 bp, Homo sapiens
gaatcacaaccctgcttggccccacttctataagtttggctttggaaactttatgccaagaggcttttgaattc

SEQ ID NO: 6816629 - DNA, 79 bp, Homo sapiens
gctgggtgaccagagctaggcaggggtttcttcatgttgaaatgaaacagtcctctttatttagtctcagggctccagc

SEQ ID NO: 6816630 - DNA, 57 bp, Homo sapiens
tttcttcacagatattgtgcttccatcattttggactacaagttcatgttgaaggaa

SEQ ID NO: 6816631 - DNA, 101 bp, Homo sapiens
tgaggcaggagaatggcgtgaaccctggaggcggagcttgcagtgagccgagatggcgccactgcactccagcctaggggacagagcgagactccgtctca

SEQ ID NO: 6816632 - DNA, 67 bp, Homo sapiens
gagtttaaaggtgcccatttggggtaggcatatagttgaatgagaaagtgggacacctaagagattt

SEQ ID NO: 6816633 - DNA, 82 bp, Homo sapiens
ggaaggaagttagtacactgaatactagttttcctggcttttagcctgaggcaaagcacattaggtggcactcattccaacc

SEQ ID NO: 6816634 - DNA, 60 bp, Homo sapiens
catgctttggccaatgagaagtgcatggatgtgatacttgtcatgaggactagacgcttg

SEQ ID NO: 6816635 - DNA, 66 bp, Homo sapiens
tactgaggctgggttaagcatctccaagacctaaaaagatgtaatattttaattcagtcttcagtg

SEQ ID NO: 6816636 - DNA, 79 bp, Homo sapiens
gtttaaatcatttgtgcatagtaacagaattgagtgtcaaaatcaagtctgttggattctacgcccaaagctcttaggc

SEQ ID NO: 6816637 - DNA, 56 bp, Homo sapiens
cttgcttggagaagagatcagtaaagtatctggttatgctctgtccacaggacaag

SEQ ID NO: 6816638 - DNA, 81 bp, Homo sapiens
tgggtatttttaggaaatccagatgagcaatcatactttttatcagagtaccttatcttgggtcttataaaaaaatactca

SEQ ID NO: 6816639 - DNA, 62 bp, Homo sapiens
aggagccatggaggtgaggcgggcaagccacagaataatccctcttcacctccactgctgct

SEQ ID NO: 6816640 - DNA, 90 bp, Homo sapiens
gctgaatgggcttggaaatgctccccacccagtcctggaaggcatgtccaccaacgtcttcctggaggggacagcatgggcccaacaagc

SEQ ID NO: 6816641 - DNA, 62 bp, Homo sapiens
tggcagggtgggcttcagccccaccagtagctaaggtcccggttccaagcccacccgtgtca

SEQ ID NO: 6816642 - DNA, 55 bp, Homo sapiens
agatatttcactgaatctatctctctaaggttgagagtaggcaaaggaaagatct

SEQ ID NO: 6816643 - DNA, 63 bp, Homo sapiens
ctacctccaggtaacttgagaacatgagaagcccttttgttgttctcttttgcctaactgtag

SEQ ID NO: 6816644 - DNA, 56 bp, Homo sapiens
cccaggctggagcgcagtggggcgatcttggttcactgcaacctccgcctcccggg

SEQ ID NO: 6816645 - DNA, 55 bp, Homo sapiens
ctctgtcagagtgttgtccccatcatgtggcctcaggcatccttctgacccagag

SEQ ID NO: 6816646 - DNA, 65 bp, Homo sapiens
gtggtattattttacagagatgcttagaataccgtttctttatctgtggtaaataacattgccat

SEQ ID NO: 6816647 - DNA, 60 bp, Homo sapiens
tgaaatgcattctaacacttgtgttaaaaaaagtgaacacttggtggaacgtgtatttta

SEQ ID NO: 6816648 - DNA, 94 bp, Homo sapiens
tgcaggtgtgcacatgtgtgcttgcacgcacatatttgtgcactcctgtgtgtatacatgtgtgcttgtgtatgcatatgtgtgcattcctgca

SEQ ID NO: 6816649 - DNA, 75 bp, Homo sapiens
tagcatatggtagaaatcattcccaaacccatatcttctgagtatgaggttcagaaaggttgaatgttgtatcta

SEQ ID NO: 6816650 - DNA, 82 bp, Homo sapiens
atgtttcctaagggggagccatgcaatatgttgatctattaacagatattatggtttctccttaggcttctgatgcaaacat

SEQ ID NO: 6816651 - DNA, 56 bp, Homo sapiens
tctacattccttttataatatctgtctttcaagattgttgtaagggttgaatgaga

SEQ ID NO: 6816652 - DNA, 105 bp, Homo sapiens
agatttattttcattatttttttaagtcagggagtaagacctttaccagaaattatccccccagcagactttttctgggtctattcctactgtgaatcaagattt

SEQ ID NO: 6816653 - DNA, 71 bp, Homo sapiens
atcatcactgtgttcagttcatgatgcctatggagttctactggtgtcagtgacctagcacggtgctagat

SEQ ID NO: 6816654 - DNA, 61 bp, Homo sapiens
gaactagcccactgcaaatgttggctgcagtattctaaaaagccagcacagggagcagttc

SEQ ID NO: 6816655 - DNA, 94 bp, Homo sapiens
aaattctggcttataaccttggctcctggcaatgtaactttaggcaaatcacttcaagttttttcatcaggaaaatgtgggttgttgagaattt

SEQ ID NO: 6816656 - DNA, 69 bp, Homo sapiens
tgtcatctctgaccaagagaattggtagaatagaaataatctatttctcacgtggtctaggacttgaca

SEQ ID NO: 6816657 - DNA, 70 bp, Homo sapiens
ggtgtcctggggcccgggcttggcccttgttgcagaagggttgaggagccgggcctgggccctgcgcacc

SEQ ID NO: 6816658 - DNA, 69 bp, Homo sapiens
ccagccctgcatgtgcttctgctgatccgtcactgtgtggtcacaccccaagtacattcgatggggtgg

SEQ ID NO: 6816659 - DNA, 62 bp, Homo sapiens
ggagatgctgtggtccagtaattgtgtaggtgggtgaaaatacaatagcaggagcagttccc

SEQ ID NO: 6816660 - DNA, 59 bp, Homo sapiens
gctggccatggggagtgaggaggaaagctgtgcccctcgaaaggaagccccgggcctgc

SEQ ID NO: 6816661 - DNA, 70 bp, Homo sapiens
tggcttcaggagcacctggctttcctctagttcagagcccccaggtcggagtgtattcactgaatagcca

SEQ ID NO: 6816662 - DNA, 110 bp, Homo sapiens
gcttttccctttgcatcggcctggggccctggggcctgatttgcagcatcaacagcttttccactgctgtgtgtcagcccaagggccttgtcactgtgagagggtaacgt

SEQ ID NO: 6816663 - DNA, 94 bp, Homo sapiens
gtaatttgagtgagatgtgtaatcaggggtgaagtccaatttttgtttacctattttaaattgcaactctatacaaattttattttcaagttgc

SEQ ID NO: 6816664 - DNA, 67 bp, Homo sapiens
ctatgttaatacactatatgatcacatatgttagcaagaggtatggaatcgggagtgttgacgtcag

SEQ ID NO: 6816665 - DNA, 81 bp, Homo sapiens
gatactcgaaggagaggttgtccgtgttgtcttctctttatttatgatgaaacatacacgggaaacctcttttttagtatc

SEQ ID NO: 6816666 - DNA, 60 bp, Homo sapiens
cagaattgagagaggctgttctctgggcacacttgctttatgtggtcttttcaattgctg

SEQ ID NO: 6816667 - DNA, 75 bp, Homo sapiens
caagaaagtatttacattaacatctccatggtctctttgaccctcttgcaggtgtgagtgaagtgcttggctctg

SEQ ID NO: 6816668 - DNA, 60 bp, Homo sapiens
taagaccatacatttccacagattgctttgcctgctgtataatgagagtgtgtgctcttg

SEQ ID NO: 6816669 - DNA, 69 bp, Homo sapiens
tcagtagaaaggggtcaggcatgttctgctctgtccagcagacacagggcaatgctttgacctcactga

SEQ ID NO: 6816670 - DNA, 66 bp, Homo sapiens
agtctggagtgattatgtgggaagtatgaaacatgcctcaacccacaatggtcttactacccgatt

SEQ ID NO: 6816671 - DNA, 55 bp, Homo sapiens
ttagacttgtaaatcagtaggaagcacctagctgactcacactggaaaagtctga

SEQ ID NO: 6816672 - DNA, 128 bp, Homo sapiens
aagagggatttcaagggatatgaacgtgaaaggttttagataatgctcaagcaattgcatagcaattatacattgaacaatctagattctagacctttctgtccaatcccttttctgttatccttctt

SEQ ID NO: 6816673 - DNA, 66 bp, Homo sapiens
ctctggcacactccttccaggtcctttctgctgcaggcagttaccaaggacagagtgtgcaaagag

SEQ ID NO: 6816674 - DNA, 82 bp, Homo sapiens
tagttctatagttgttcagataaggaactgttggtgatgactagaatgacaacagaaggctttgtggagtagacgagaactg

SEQ ID NO: 6816675 - DNA, 58 bp, Homo sapiens
accctgaactggggctcaggagattgaggtttttgtcccagctctgcctccagttggt

SEQ ID NO: 6816676 - DNA, 76 bp, Homo sapiens
tcacttaaacccaggaggccaaggttgcagtgagcagagataatgccactgcactccatcctgggcaacaaagtga

SEQ ID NO: 6816677 - DNA, 92 bp, Homo sapiens
agttgttctgagaagggcttggagatgtggccctaaagccccgatggatgaggaggttcatatttgtcatctgccttagttcagagaagact

SEQ ID NO: 6816678 - DNA, 62 bp, Homo sapiens
tgttacacattaacaggcagctaatgcagtctctgttcgcatttttatcctcgtgtgtggca

SEQ ID NO: 6816679 - DNA, 87 bp, Homo sapiens
ctctgggcttttgctaggctgtaacccctgccaggaaggctcagcccctgtccctggctacctcgccttgttcttcaaagtccagag

SEQ ID NO: 6816680 - DNA, 88 bp, Homo sapiens
aatatcaggaggtggggctcactggggccatcttgaaggtagtagccagctttcaagatggcaccagtgagtgccacctcttgatatt

SEQ ID NO: 6816681 - DNA, 62 bp, Homo sapiens
gtgagagttcagtgtttctagtagtgaagaaattctctacttcccaagtcatttaacatcac

SEQ ID NO: 6816682 - DNA, 82 bp, Homo sapiens
gcacaagcctggctccacctggcagctgttggccacggctcccagtccacatggcacacctgcctggcaggcctggctgtgc

SEQ ID NO: 6816683 - DNA, 72 bp, Homo sapiens
gcctctgggctccctgctccttcaccgacccaggctcctcagctgaagggtgtgttgggggcagggggtggc

SEQ ID NO: 6816684 - DNA, 75 bp, Homo sapiens
aggtaaacaagagtccagaacttcagctagttttttggacacatagaactatcactttttggtttttgtttgctt

SEQ ID NO: 6816685 - DNA, 84 bp, Homo sapiens
gcccgtctttataccagccctacttcttgggtggcaaggactccccttctgtttcaagtagggcttatagggaatgtcctgggc

SEQ ID NO: 6816686 - DNA, 87 bp, Homo sapiens
aggctggtgctgacatttgggttccctgacagcgatgctgccaaaatcagtgatgcagattagggaatctgccaggccctcaagcct

SEQ ID NO: 6816687 - DNA, 62 bp, Homo sapiens
ggcccagtgtcaccaacaggacactctctgacccctgagtgcgccctgtagtgacttgtgtc

SEQ ID NO: 6816688 - DNA, 61 bp, Homo sapiens
gtttgcattccaatttaggggacacaaaaatccctgtcctcatcaccattgcaatgtaaac

SEQ ID NO: 6816689 - DNA, 70 bp, Homo sapiens
ctcacatgtaaaaggaacatgcatgctacctgtagctacggccagactgtgtgtgtgtttctgcatgtag

SEQ ID NO: 6816690 - DNA, 71 bp, Homo sapiens
gatgggaaacaaaccttccctatacgtcttcatcttattatcactgaagagtgtgtgtgtttattcctatt

SEQ ID NO: 6816691 - DNA, 74 bp, Homo sapiens
aatgcagccaagaacatttgtgtaccagtttttgagttttcagttgtttgagtttcagatgttttcagttcatt

SEQ ID NO: 6816692 - DNA, 112 bp, Homo sapiens
cctccctctatccatatgtttggcatcagttacgcaaaacaggtggacgccaagtagcattctctctttccaccctgatgttttggcattgtctacacatggcctctggagg

SEQ ID NO: 6816693 - DNA, 56 bp, Homo sapiens
tcacccagaaaagacagcagatgggatgccatgccttgcctgttcttcctggttga

SEQ ID NO: 6816694 - DNA, 56 bp, Homo sapiens
agggcaaatacaaagtagtttagtatgtttttaactaaactaaaggtgtttggttt

SEQ ID NO: 6816695 - DNA, 96 bp, Homo sapiens
gcctgcgggggtaggttctgcagcagcccggccagaggatgcaggctgtgtactgcggctggcagggtgggctttgcttttctgcatctcacaggc

SEQ ID NO: 6816696 - DNA, 99 bp, Homo sapiens
ggtaagtgtagccagttttgacaattacattttgaatggctgattacatgttttacagctgtttaaatttaagtgtttcaatttggatgcttagttacc

SEQ ID NO: 6816697 - DNA, 120 bp, Homo sapiens
tggaatgctaggatatgtaggatccatagggcaaatagttcttctgaaatgtcttatctgtgacatttgatgacatttggttgagctgttgtcaaacctttagcaatctagagcattcca

SEQ ID NO: 6816698 - DNA, 76 bp, Homo sapiens
tgtgttctctagaggttcagaccaagaattgcgttttgaagactgagagctgggcctgacacttactagggacaca

SEQ ID NO: 6816699 - DNA, 65 bp, Homo sapiens
tggtggattattttgtctggcagatgatctataatggtcttattgccattccaaataatttccta

SEQ ID NO: 6816700 - DNA, 62 bp, Homo sapiens
gggtttccagacactgcctgcctcagcttcagcttagcccttgggcgggtggactggagccc

SEQ ID NO: 6816701 - DNA, 123 bp, Homo sapiens
gctgactctgtgtggcgagtgtaagacgagagtgggaaagatggggctgcagaggtccatgtggctgtttcacaagggccctgcagtccacactgttgttgggattttagtcctcagagcagc

SEQ ID NO: 6816702 - DNA, 73 bp, Homo sapiens
gcagatggcagcccaggctgggtgcaagtacagttagtgaagccagccattgccagggttaatccacttctgc

SEQ ID NO: 6816703 - DNA, 86 bp, Homo sapiens
taggtcagataaagatggtctacagagagaaatgaagcagactttttctgtttcatttacatctgtaggtactcttgccccaccta

SEQ ID NO: 6816704 - DNA, 79 bp, Homo sapiens
ccaattcctagagaaaggcatccttggcttcattcccaaaggcaggatgaagccaagggtgcgtttcttcaggaattgg

SEQ ID NO: 6816705 - DNA, 60 bp, Homo sapiens
tggtgcagagcagtgtcagagcaacgtggtttgctctgctctggagtggcttgtgcacca

SEQ ID NO: 6816706 - DNA, 59 bp, Homo sapiens
agcctttgatatgccaggctggaaaaagaacaagactagcattggcattcacagaagct

SEQ ID NO: 6816707 - DNA, 85 bp, Homo sapiens
agtatctcacaggatcaagacttttatgctgccctgctcttatgtttgaagcatcagagtcattgcaagtagaaggttgggtatt

SEQ ID NO: 6816708 - DNA, 58 bp, Homo sapiens
tgacgtgaaggctgaagttcacaaggatatgtgagcaagcttgttcacctccatgtta

SEQ ID NO: 6816709 - DNA, 97 bp, Homo sapiens
gggatatttggcactgtctgtagacatttttggttgtcacaactgggtgggaggcaaggtgctacagacagtgagtgtgtaagaggccaggaatcct

SEQ ID NO: 6816710 - DNA, 62 bp, Homo sapiens
ctccagggagctttcccaggaccctggttccattagtcaccccaggctctgagctcctggag

SEQ ID NO: 6816711 - DNA, 58 bp, Homo sapiens
ctgcagcaagagaagtgctgactgttaatgtgtacactaggcacttctcttagctcag

SEQ ID NO: 6816712 - DNA, 56 bp, Homo sapiens
ttggaagaaggtactgtatatatacatatatatgtatgtttcatatcttcatttgg

SEQ ID NO: 6816713 - DNA, 80 bp, Homo sapiens
ggcagggccttttaaagtgtctgcctcagctcagagaggctgtggaacctgtcagagctcacacagcactgggctccgcc

SEQ ID NO: 6816714 - DNA, 55 bp, Homo sapiens
ggtggttcacgcctataatcccagcactttgggaggccaaggcaggtggatcact

SEQ ID NO: 6816715 - DNA, 67 bp, Homo sapiens
gagctgtctctttgggccttttgattttcctatttgaaaatccacaacggttccaaacgagtagctc

SEQ ID NO: 6816716 - DNA, 126 bp, Homo sapiens
aggaagggccttgggaaaggagatttatgttctgcaaaacagtgccaaggacacctattactggcaggtgtgaggacttctagtggtactgtgaacaccaacaaatcactttctgagggacttcct

SEQ ID NO: 6816717 - DNA, 68 bp, Homo sapiens
actgctgccttgctctgtaaaatctctgggaggaataggacttagaggtgatgggtatggcatgtggt

SEQ ID NO: 6816718 - DNA, 76 bp, Homo sapiens
ggctcctgggaaggctgtgccagaagaactggaggattctgatagcctggaagttctgggccagcccccaggtgtc

SEQ ID NO: 6816719 - DNA, 69 bp, Homo sapiens
tccattttgtcatatcacacaattttgtcaggtattcaggcaaggattggctgattgacatcagctggg

SEQ ID NO: 6816720 - DNA, 78 bp, Homo sapiens
cagaaagggacttgtgtctgtgtttttgttaactatgcacatcgatttgactgagagacatagcacagtttttcgctg

SEQ ID NO: 6816721 - DNA, 126 bp, Homo sapiens
taccattatatttggtatgttgtggaatagttcggacagtagataacatttttgcatgttaatacataaaaaaagtttcaactgccaactctttgtcacacaccaaacctgattatttacctggta

SEQ ID NO: 6816722 - DNA, 59 bp, Homo sapiens
cagcgtccattgttcccttttcccagagccaagagctgggtagagctgcaaggacactg

SEQ ID NO: 6816723 - DNA, 65 bp, Homo sapiens
tgctggacagggcacggcccatctgtttatgtactgtgtgtggctgcttttgccctatcgcagca

SEQ ID NO: 6816724 - DNA, 67 bp, Homo sapiens
ggtttgctttgggaggttgtctgggagattgctgaagttttgatatacacacctccaaagcaggacc

SEQ ID NO: 6816725 - DNA, 88 bp, Homo sapiens
tataaaatctgcactatttctatagttcttcaggctgctaatattcagagtgcttagcagtcacagtgctaacatagatggttttata

SEQ ID NO: 6816726 - DNA, 55 bp, Homo sapiens
attagaacaaagccaccaggtgaaaggaactatccatcccggactttgttctaat

SEQ ID NO: 6816727 - DNA, 98 bp, Homo sapiens
tctctttctatgtccagttttatatcttccattggttgaagcttttgctggtgatcagatgtcagagatgtggaattgtcaacgagaatgggaggaga

SEQ ID NO: 6816728 - DNA, 55 bp, Homo sapiens
cccaagacctgggactagagtgctctcacttccacaggagtccctaggtcctggg

SEQ ID NO: 6816729 - DNA, 76 bp, Homo sapiens
gaattcgaccacagcagtgcaagaggagagtaaccccctctttcctcatttgcagtgtgtgtatgactaagaattc

SEQ ID NO: 6816730 - DNA, 59 bp, Homo sapiens
gggcatcttgtagccttcacttcaagtcctcatctgtaggaaagcggggatacatgccc

SEQ ID NO: 6816731 - DNA, 86 bp, Homo sapiens
gattatggttggctgatttagaaattccaaaagtattttaaacattaaagactgagaaacaattctggaagtcaaatttcataatc

SEQ ID NO: 6816732 - DNA, 92 bp, Homo sapiens
aggggctggagagacatctaaggaggaaggatggagagaggagggagggttctcctcctgcctttgcttcttgttgtctccccattgcccct

SEQ ID NO: 6816733 - DNA, 74 bp, Homo sapiens
ctgtcatttccttcctgctgctcctctccccagagtctaatggagtctccttgaggcagctgaaggagtgacag

SEQ ID NO: 6816734 - DNA, 81 bp, Homo sapiens
ggatctgtttctctgcttcgtagaccagaaatttagttttgtagggtgctcagagctgattggatccagagagactgactc

SEQ ID NO: 6816735 - DNA, 117 bp, Homo sapiens
tagacttggcctttaaaatgttttttaaattgaatgattaagtggtgatgaaccagaaaaaataccttgaaattgatcccatttattaattagtttgcacatgtaaaggtctttcta

SEQ ID NO: 6816736 - DNA, 77 bp, Homo sapiens
gctgaagcctgtggataggggcatccaactggggcactcatcccctatcagatcgtcttccttctacacgtctcagt

SEQ ID NO: 6816737 - DNA, 63 bp, Homo sapiens
tgctggcttttcctaaactgggaagtatagatccacaaactacttcatcagcaaagcacagca

SEQ ID NO: 6816738 - DNA, 109 bp, Homo sapiens
gttaaaggactgttattgtacttgatcttatagaatgtttttatatgtgtttataaggactatatataattttcaagcttttctaagatgaggaagtaaagtcactaac

SEQ ID NO: 6816739 - DNA, 77 bp, Homo sapiens
caagaaatggctgtgtgcttctccccatttctcagacgagaaaattgaggcatgagaaaaacaacaaaaccatcttg

SEQ ID NO: 6816740 - DNA, 93 bp, Homo sapiens
ccagcagttgaggtgacagcacactgggcttgttacgttgcaggaatagtaagggactgtgtggccagagcccagtgtgtccggggaggatgg

SEQ ID NO: 6816741 - DNA, 63 bp, Homo sapiens
taccgtacacattaactacagttataacaaactacggaataagcggtagtggtgtaaacggtg

SEQ ID NO: 6816742 - DNA, 66 bp, Homo sapiens
tatagttactgttttctagcaggtgagctctttcacaagatggtaaagctagagaaggttactatg

SEQ ID NO: 6816743 - DNA, 78 bp, Homo sapiens
gctgcgctcagccctgcagtgcggaggtggcaacaggttcccatttgtcctgttgctggcgctgcgggcgctgtgggc

SEQ ID NO: 6816744 - DNA, 76 bp, Homo sapiens
gggggcaggaggcctggctggggagatccagaggcctatggccggctctcctcttcagttcaaggcctccgtctcc

SEQ ID NO: 6816745 - DNA, 73 bp, Homo sapiens
gttatattactatatttaattagttgctggatgggatatctaaatttataactggttaaatttatgttgtgac

SEQ ID NO: 6816746 - DNA, 109 bp, Homo sapiens
tgtcaactttatggatgtacattacctgtgttcaatgacttcatctttccttttaaggaaagatcattgtcttgtagcaacgaggtgagaaagtcaggaaagcttgaca

SEQ ID NO: 6816747 - DNA, 86 bp, Homo sapiens
cattgatctgaagttattcaaagcctgagttggggaagagagaatttccttccttggtacagagtagctttcacatcatatcgatg

SEQ ID NO: 6816748 - DNA, 67 bp, Homo sapiens
gatgaggctcttaatttgaaaagaatatgagaattaatgcttgagtttaattggagcctgaatcatc

SEQ ID NO: 6816749 - DNA, 89 bp, Homo sapiens
gggtcagagcacagacattttctgtattgcctgtagaaactagcacagtacaggcaccccctaagtgcaaaagaagtccttgctgaccc

SEQ ID NO: 6816750 - DNA, 55 bp, Homo sapiens
taactacccttacattcctcaggaaataatgtcttgaggtacaatgggtcagtta

SEQ ID NO: 6816751 - DNA, 78 bp, Homo sapiens
aagagagggatgttctggggttgagagacaatgggccttttctaccatgcttgaaaaccccatgaatagtcttctgtt

SEQ ID NO: 6816752 - DNA, 76 bp, Homo sapiens
tgtgctacaactttagcaatgttagtatatgtctcgttacactggacttaattagctcttgttctagttctagcca

SEQ ID NO: 6816753 - DNA, 82 bp, Homo sapiens
cttaagaccattctgatgcatcatactgtttacactcaaagctttgtagctaagatgtttacagtatggagaatgttttaag

SEQ ID NO: 6816754 - DNA, 65 bp, Homo sapiens
ccgtgaaggcttttagctctgaaaacactgacatctcttttcagaggcctaagaggtttacatgg

SEQ ID NO: 6816755 - DNA, 73 bp, Homo sapiens
tcctctgttgcttctcagggcctgatgcagtcttagatcatgagtgcccagcctgagaaaggagtttggaggg

SEQ ID NO: 6816756 - DNA, 56 bp, Homo sapiens
gaggaggggccggcacgcagtccttgaaagtgggggctgttgcccgccgcctcttc

SEQ ID NO: 6816757 - DNA, 69 bp, Homo sapiens
ggaaccttcatactgtttaccatatggctatactaatttacattcccaccgatagtgtgcaagtgttcc

SEQ ID NO: 6816758 - DNA, 95 bp, Homo sapiens
aagagaatagtcaagtgcatctttgcagaacgatgaagatgtgattcaaggttatttttctcatgattgccaagaagtagctgatgacttctctt

SEQ ID NO: 6816759 - DNA, 76 bp, Homo sapiens
cacatagccacttggatctgggtttagagagagaaagtgactctggagtctaaagaaccaaaaatgtgtgtgtgtg

SEQ ID NO: 6816760 - DNA, 61 bp, Homo sapiens
gatgctgagaggtggagggaacccttaagctttggacaattctctcctcctctctgccttc

SEQ ID NO: 6816761 - DNA, 62 bp, Homo sapiens
gcaagtaattctgcaagaaaccagtggcgccgacaggaaattggagtgcaggatctgtttgc

SEQ ID NO: 6816762 - DNA, 73 bp, Homo sapiens
aggccttaatgacatcataggtgaagtcatagttgactcttctctttccttcctgggatgtcattggctgcct

SEQ ID NO: 6816763 - DNA, 72 bp, Homo sapiens
ggcaggcttctggaacactgcaatgctttgttcctcaacctgtgtgccagtcatccagatgtgtagcttgtc

SEQ ID NO: 6816764 - DNA, 58 bp, Homo sapiens
aacctaatcaccttgtgaaggccctgcctctccacatcattacaatggtgattaggtt

SEQ ID NO: 6816765 - DNA, 58 bp, Homo sapiens
gggaaacaggaaaacagcacaatagcaaaatccttttggctataagatttcctgtccc

SEQ ID NO: 6816766 - DNA, 87 bp, Homo sapiens
catcttccttcaatttaaaacttttgggtggtatagcagtacagatgttaaatattttctgtgtatgactccagagggtaggggatg

SEQ ID NO: 6816767 - DNA, 59 bp, Homo sapiens
gaagcctttcgtgcacctcacctgaaagacggtcccactcgaggtgggctaggggtttc

SEQ ID NO: 6816768 - DNA, 59 bp, Homo sapiens
ggcatggctgttggggatagagttatgattacaattcaggtcttgtctgttagcctgct

SEQ ID NO: 6816769 - DNA, 66 bp, Homo sapiens
cttggggctgtcactctggcatgcgtaggtaaagaaccacagatcggagctggcaggaacctcagg

SEQ ID NO: 6816770 - DNA, 101 bp, Homo sapiens
gatatgctgacccctgtttctttctgtgctctgactttctcctggtgccacccattggccaaaccagaagctggagcacaaggaggctggttgagtagctc

SEQ ID NO: 6816771 - DNA, 70 bp, Homo sapiens
ggaaacccagtactgttttccatagtggctgcaccatttggcattcccaccaacaatgtacagggtttcc

SEQ ID NO: 6816772 - DNA, 66 bp, Homo sapiens
gcacgccagctcctgcaggcctcgttttgaagccgaggtctcaactgcagggagcagatggcgtgt

SEQ ID NO: 6816773 - DNA, 55 bp, Homo sapiens
ggggctctgcctctcccacgcctctgaatatgacatcaggctgggcagagccacc

SEQ ID NO: 6816774 - DNA, 58 bp, Homo sapiens
gttctctctgcttccaagatggtgcccttcctgccccatcttcacatagcagaaggac

SEQ ID NO: 6816775 - DNA, 70 bp, Homo sapiens
ggatcattgggcagggaaaggacaggcagagggcttttttatgccatcttttcccttctccatcccctcc

SEQ ID NO: 6816776 - DNA, 61 bp, Homo sapiens
agttttctcacatcaaaaatgaggataatagttctgacctcattaggttgttgagagaatt

SEQ ID NO: 6816777 - DNA, 73 bp, Homo sapiens
gctgtgccaaacaccctgcgtaggaaatggacctgctctgggtctggatattcaccagggccttgggcacagt

SEQ ID NO: 6816778 - DNA, 93 bp, Homo sapiens
aggcaaatgagaggggcatggggagagaagggctgagctgggcggcagtgcactggggcctcctccatgctctgtcttctgtagtgtttgcct

SEQ ID NO: 6816779 - DNA, 76 bp, Homo sapiens
tgcagggtgccaagcaatgattggaacatgaaagctattcaatgcatatcagtgattgtttgctcttcattctgca

SEQ ID NO: 6816780 - DNA, 104 bp, Homo sapiens
ggggagggagagagcagtcttgttgggtcgtgaattctgttttggttccagggaaatagggtttccattacatatggtgcaacaggatatttcctccacgctcc

SEQ ID NO: 6816781 - DNA, 83 bp, Homo sapiens
tgtgtctaaagtttaggtttgggggttagggagatgtaaaagtgttcacactccagacacagacactatgacttcaggacata

SEQ ID NO: 6816782 - DNA, 128 bp, Homo sapiens
ggcggccgcccttctccgcttactgttcccggctccccgcaggccgggtgctcgcagccgggctggctatgcctcgcctggcagcccagagcgccgctccccgggaacagcacacaaaggcagcctcc

SEQ ID NO: 6816783 - DNA, 122 bp, Homo sapiens
tgagtggtcgccaatgtttcagctcctcttctgagtaccagggacgtgggtagaactttgatcctatcttatccttacaggatattgagaggagaggagagaagttgacatggcaccaccca

SEQ ID NO: 6816784 - DNA, 64 bp, Homo sapiens
taactgcatgcttttatatctgtttaaaagtgatttcaattaggcaggttagaagatacagttg

SEQ ID NO: 6816785 - DNA, 74 bp, Homo sapiens
tatcagcagagaaatagatgcaaagagacaagcctttatttggctacttatttgcccatgtttctttattatta

SEQ ID NO: 6816786 - DNA, 82 bp, Homo sapiens
gaaaccaagcagtctaacttcacagcctggaaccacaaaccactgtgtagcatccggcttctggagtgaggttgatggtttc

SEQ ID NO: 6816787 - DNA, 72 bp, Homo sapiens
tgtggcagaaggggcccaaggatgtcagacctgagactcgggtacctggcagctctgagtcccttcttcatg

SEQ ID NO: 6816788 - DNA, 68 bp, Homo sapiens
gcaagagatagtacaaagaagaatccatcccaaaaggggagctgtgaaatctttgtacaagtctctgc

SEQ ID NO: 6816789 - DNA, 76 bp, Homo sapiens
ggggcaggaggcaggtgcattttgagctcttcctaaagtggactcctttgctttgcacttctcgagctttctcccc

SEQ ID NO: 6816790 - DNA, 58 bp, Homo sapiens
agaatctgtcctctcagcagccactttgttgagttgtagaggaaagggaatggattct

SEQ ID NO: 6816791 - DNA, 70 bp, Homo sapiens
ggagccgattaccaagcgtgtttaggaaatgctgcctctgtaagggcacattacacgcagtaattgcccc

SEQ ID NO: 6816792 - DNA, 76 bp, Homo sapiens
attgcgatttgtctgttattgttctcatgatcatactagaagtatgtattttggggaggaagacaacaaaagtagt

SEQ ID NO: 6816793 - DNA, 109 bp, Homo sapiens
gctattcactgtatctgtaatatacgctgtctaatgtatctgtaagggttaaatcaagtttctagcacatacataatagatagaagctattattcacccaggtgaaagc

SEQ ID NO: 6816794 - DNA, 130 bp, Homo sapiens
ttctttttccaactgtgctaatagttattgggggaaattcagccagatattgggcggaattcacccccaatatttcacgtaggttgttttcattttccctaaatgttggctggtctgagaaataaaggga

SEQ ID NO: 6816795 - DNA, 91 bp, Homo sapiens
gactctaggtctggactttaaggccaggctgtggtcggcagaagctgtggaagtctgtgatcacatctgggctgaagcagaagcctttgtc

SEQ ID NO: 6816796 - DNA, 55 bp, Homo sapiens
cccagttaattgggtgggtctcgggttcaactcatccgctgccctttgacttggg

SEQ ID NO: 6816797 - DNA, 63 bp, Homo sapiens
gtgagttcccggatctgttccatccaaacactgtggaagcaagagacggatccgcgggaccgc

SEQ ID NO: 6816798 - DNA, 81 bp, Homo sapiens
caagattgatgtctttcttatggtctgttggctaatcccagtatgaatggccagttcagctagaagaaacaaacagtcttg

SEQ ID NO: 6816799 - DNA, 89 bp, Homo sapiens
gctgaattcgcgcgctgtctggagccactgctgctgctggggccacgtcgggtggcagctgctgcaagtggtgctaacacgtgagcagc

SEQ ID NO: 6816800 - DNA, 72 bp, Homo sapiens
aggtctcagttacaatgggccccgggcgctctgtaacaagctgcagctgtcccattgctcattagctttcct

SEQ ID NO: 6816801 - DNA, 56 bp, Homo sapiens
gtatatctaaatatgctgatcacttgcgttgagcagtgaagtgaacttagatatat

SEQ ID NO: 6816802 - DNA, 56 bp, Homo sapiens
tgtgtgcagctgaaaagcgctgtcctgagctgagggtgagcgcgcgcgcgcacaca

SEQ ID NO: 6816803 - DNA, 70 bp, Homo sapiens
cattttctgagtttttaagagtgaaatgtcatgatatctatgattcaaattaagttaattcagcaaaatg

SEQ ID NO: 6816804 - DNA, 58 bp, Homo sapiens
gtgcatagcaagcgttcccaagccactggcagtgtgaccttgctacgttgctgtgaac

SEQ ID NO: 6816805 - DNA, 83 bp, Homo sapiens
acaggcgggatgggaggcaggctcagaaccggaaacttccaagttcctgttccctcactgtctcctgtctaactacacaatgt

SEQ ID NO: 6816806 - DNA, 63 bp, Homo sapiens
gccaagagagaagtaaagcacactgagataaatctagtgtttcacagcactttttctctaggc

SEQ ID NO: 6816807 - DNA, 81 bp, Homo sapiens
tggagacctgggtgtgggtcaagcaaccaggtaatctgagttttggcactttggaaagcttgatctgacgctccttttcta

SEQ ID NO: 6816808 - DNA, 83 bp, Homo sapiens
ggagagcaaggctggtggtggtgaagtcactcagccagagaagccagagtgtaacctatttcctggtaccaggctttctctcc

SEQ ID NO: 6816809 - DNA, 129 bp, Homo sapiens
gtattattttattgtcacatatatatctcagttaatgccgacatgattgttcttgctgttgtaacctgaattaggaattttcacagttgggtattgatcattcatgtaattgtatgatgaaggaaatac

SEQ ID NO: 6816810 - DNA, 108 bp, Homo sapiens
gcccctttctacactcacttccctggaacccgtgatcctgactcccctcctcccggaccccaagcatccaggacgtgtacggtataaggggaagttgtagtgggaggc

SEQ ID NO: 6816811 - DNA, 70 bp, Homo sapiens
tggggaggggctcaggggaagtgtccagagccgggaacacaggcctggaagccattgcagccactgacca

SEQ ID NO: 6816812 - DNA, 111 bp, Homo sapiens
tgtccggtaacattcttttagcatttgtaatgtttattttaaaattggaaagaaattatgaggcctttaatgttaaatttgtagatgtttttgagaatgttaacctgggca

SEQ ID NO: 6816813 - DNA, 92 bp, Homo sapiens
ccagaagtggcagtgctggttgatcacagtcaggctgggggcctgtgtacagttaccctttctgcaggacttgagtcagcattggcttctgg

SEQ ID NO: 6816814 - DNA, 87 bp, Homo sapiens
aagggccaaagcatgctttccctgggtggttttatgcctgtcatgaacaccgtaagacagctaatccccctagattctttgtacttt

SEQ ID NO: 6816815 - DNA, 75 bp, Homo sapiens
ctccttcagagcctccaaataagagtcaagcatggtcaacatcttgatttcagccttgtgatatctgaagcagag

SEQ ID NO: 6816816 - DNA, 85 bp, Homo sapiens
gctcttatcagatcatgaaggaattaaggtaaggagtaggaaaaatgtccattacaactacctttattgagtcgttaataagagc

SEQ ID NO: 6816817 - DNA, 64 bp, Homo sapiens
ttaggtaggaaatgagtagcttagtatactggaaggctgatagagcacttaattttctttctaa

SEQ ID NO: 6816818 - DNA, 67 bp, Homo sapiens
gctgtacagcaggaggtgagtagcaggtgagcattactatctgagctccgcctcctgtcagatcagc

SEQ ID NO: 6816819 - DNA, 66 bp, Homo sapiens
tgggtttcaaagtggacagttagtctcattgttacatgtggtgacattgatcattgtgaaatctca

SEQ ID NO: 6816820 - DNA, 81 bp, Homo sapiens
gacagaggttagagagctactgccttgctgttgcctccagccacatgcactctcactgtgctcttctacgtgacctctctc

SEQ ID NO: 6816821 - DNA, 70 bp, Homo sapiens
ggtggatggcaagcacatgagctattcatgctcatttctgggtgttatggatggaatgtgtgtgtccacc

SEQ ID NO: 6816822 - DNA, 66 bp, Homo sapiens
gtgtgtgtgtgtgtgtgtgtgtactacattgaaaaaaaatgcagtgccaaacagtacataacatat

SEQ ID NO: 6816823 - DNA, 81 bp, Homo sapiens
ttgatattcatgagcatctctatagtgactgtgcctggcaggtatagcatgtgtggtggtgaaatggggctgacatgtcaa

SEQ ID NO: 6816824 - DNA, 75 bp, Homo sapiens
ggtgcaggttatagggcactccagattcttgctctggcgtgttctggcaagagtgaggagtgtctctagcctacc

SEQ ID NO: 6816825 - DNA, 55 bp, Homo sapiens
gggacctgccaaggccacccagccaccctccctgggcggcccctccagcaggccc

SEQ ID NO: 6816826 - DNA, 65 bp, Homo sapiens
tgacatcctgaagtcagtcatttgagggcttccaactccagcagaaaattgcccttcaggggtca

SEQ ID NO: 6816827 - DNA, 73 bp, Homo sapiens
gggaggcagagatcctgagaggaggtcaggaagtgctaaggacaagctcctcatctttcaggatttagctcct

SEQ ID NO: 6816828 - DNA, 72 bp, Homo sapiens
cagtattttactgctcaaagctctaggtagcttccttctttagggaaagatatttgagctgtaaaatatctg

SEQ ID NO: 6816829 - DNA, 58 bp, Homo sapiens
tgcccacataaaactttagagaactgccttttttgttctctagagcatgtgctgggca

SEQ ID NO: 6816830 - DNA, 64 bp, Homo sapiens
tcttctatcaggaggaaatttccattgttaacactagcaggacaatttccacttggtaaggaga

SEQ ID NO: 6816831 - DNA, 56 bp, Homo sapiens
acagtccttgtgtggaacattatgaaatcataaacggcagtgttcacaatgactgt

SEQ ID NO: 6816832 - DNA, 56 bp, Homo sapiens
cctactgcccttcagtccagcacaatttctggtttctggtactcgagtggcagggg

SEQ ID NO: 6816833 - DNA, 57 bp, Homo sapiens
gctgaaggatttagttctttgcttacttaaagaaaggtagctgaacaatctttcagt

SEQ ID NO: 6816834 - DNA, 56 bp, Homo sapiens
gtctgtgtctgttttcggtcactgaaaacagtgactgaaaggatcctagcagagac

SEQ ID NO: 6816835 - DNA, 71 bp, Homo sapiens
cctcaccacagagcctgtccagcccacccgaggcgctccctgcctctggccagctcaggctgtgtgtgggg

SEQ ID NO: 6816836 - DNA, 57 bp, Homo sapiens
taaggcaaagaaccatagtaatgtccctgacactagactagatggttttgtgtcttg

SEQ ID NO: 6816837 - DNA, 71 bp, Homo sapiens
gtgacaaggggcttacctggggaggtcagtttgatttgaaattatccaagagtaagaggactctttgtgac

SEQ ID NO: 6816838 - DNA, 73 bp, Homo sapiens
catatgttgaagtcctctcccctcagttcctcagtgtacgactgtatttgaagacagggtctttaacgaggtg

SEQ ID NO: 6816839 - DNA, 72 bp, Homo sapiens
gccatgcggatatctagggaatagcactctaggtatgggaacagcagtgcaaactccctgaggtggcagggc

SEQ ID NO: 6816840 - DNA, 67 bp, Homo sapiens
cattgcctgctggctgcttcctgggatggaaccactttattgtccccagggagcccacaggacaatg

SEQ ID NO: 6816841 - DNA, 55 bp, Homo sapiens
gtgaccttatttggaaatagggtcatgtagacatgattagctcaggtgaggtcat

SEQ ID NO: 6816842 - DNA, 82 bp, Homo sapiens
ttcttgcccagattctctcttgaggttattaagctgttagccagggctccagacatctcaagaagattcagctgggaaagaa

SEQ ID NO: 6816843 - DNA, 107 bp, Homo sapiens
gagtattggtgttggtcccagagatgctcagggtttgcatcctacttctggcatttacttgatgcatgatcttgagtattttcacttttttgacactcattatactt

SEQ ID NO: 6816844 - DNA, 56 bp, Homo sapiens
ctgggcagctaccaccactgcttgtgcccccaaccccagcatggtggcttgcccag

SEQ ID NO: 6816845 - DNA, 91 bp, Homo sapiens
catgaagctaccagttggagcagagtagctgctcagagaccatgtgctctccagactctgacagttctcactcattaacaggagcttcctg

SEQ ID NO: 6816846 - DNA, 67 bp, Homo sapiens
gcccgtggtgcttgtggagctggtgctgcttgcgcagcttgtagaaggccacgagcatcaccgcggc

SEQ ID NO: 6816847 - DNA, 71 bp, Homo sapiens
tcacatttgccagtgtaatttcagggctgcttttggagtagacattaaattacactgaagagtgaatgaga

SEQ ID NO: 6816848 - DNA, 85 bp, Homo sapiens
cctgcgtgtgcactaaagtcatcatttcttttcaaatccaccaagtgttttgaataaataatggtcaacttggctgtcacttagg

SEQ ID NO: 6816849 - DNA, 55 bp, Homo sapiens
cccggggctgtgctcttgagctcagccagcctgccgagcagagcagggccgtggg

SEQ ID NO: 6816850 - DNA, 67 bp, Homo sapiens
cccagttatcacagtttcttctttgtccatcgttttccataacggaagaagctatacataatttggg

SEQ ID NO: 6816851 - DNA, 94 bp, Homo sapiens
ggacggggtcacgcaggttgccgtggaggacatctgtcgggggggatgccagactcgactgccaggtgagctccaggccttgagtgtctcctct

SEQ ID NO: 6816852 - DNA, 56 bp, Homo sapiens
ccaggggctctgagtgggccaggagggggcagtcctggactggctcagcaccctgg

SEQ ID NO: 6816853 - DNA, 70 bp, Homo sapiens
gtgtctggagcaatataaatgttgggtagatgcgtttaaatatctacagtcaagttatattgctagacac

SEQ ID NO: 6816854 - DNA, 58 bp, Homo sapiens
gtgttagtttgctaaggataatggccttgagttccatccatgtccttgcaaaagacat

SEQ ID NO: 6816855 - DNA, 95 bp, Homo sapiens
cagacggagtcgcactctatcacccaggctggagtgcagtgacacgatctctgttcactgcaacctccgcctcccgggttcaagcgattcccctg

SEQ ID NO: 6816856 - DNA, 58 bp, Homo sapiens
agcactagacatgtaagtgagcctctaggtgatcctagcccttagatgtttagttgct

SEQ ID NO: 6816857 - DNA, 64 bp, Homo sapiens
tgaatctcagaggaatctgtacttgaaatgtgtgtctaattttcagttcctcctctgaggctta

SEQ ID NO: 6816858 - DNA, 129 bp, Homo sapiens
ggctggggcgggggacgcggcgggcagtggctgggttgcaaagcgctggctgcagtcaggtttggagcagtagtgaaaagcagcccagccaagactctgcccctcctgggccctctcccagctccagcc

SEQ ID NO: 6816859 - DNA, 66 bp, Homo sapiens
ggtttatatgtcttgcatttttcaaacttctgtctgaatgtttgaactgtcaacgacattaggacc

SEQ ID NO: 6816860 - DNA, 89 bp, Homo sapiens
gacacatccagaggcgtggaaggctttgaccgaacagtggggtccccaagccttttccaggtctgtggcctgccgttcatatgtgtgtc

SEQ ID NO: 6816861 - DNA, 62 bp, Homo sapiens
gcagttttattggttgaaatctggcacaggtaccactggactaagactgccagtagggctgt

SEQ ID NO: 6816862 - DNA, 58 bp, Homo sapiens
tgttttcgtgcagacttctcactcagttcttgttttggtggggagttgagcacgagca

SEQ ID NO: 6816863 - DNA, 62 bp, Homo sapiens
gggggctggactgatggaccacaagggaatggagccctgggataccagacaccagattcccc

SEQ ID NO: 6816864 - DNA, 77 bp, Homo sapiens
acctctccagttttcttttcttttctgtggaggagaatattctctggtaactcagaagaaaggaatgaagatgaggt

SEQ ID NO: 6816865 - DNA, 58 bp, Homo sapiens
cttttgggtgcctgtgaagcgtgcctacgtcgtggcccttgcccaggcctcccaaaag

SEQ ID NO: 6816866 - DNA, 66 bp, Homo sapiens
ccacaatgggctgggaccatcaggtcgtctgccacaagtgcccacagaacctctcccagcccctgg

SEQ ID NO: 6816867 - DNA, 63 bp, Homo sapiens
gagagaatgagaactaatacccaggattgcgaatcacagcaggcttgacagttttcatctttt

SEQ ID NO: 6816868 - DNA, 57 bp, Homo sapiens
ctgttcctctggcatatggagaaacttgagatgagcatctttgtgtcagatggacag

SEQ ID NO: 6816869 - DNA, 67 bp, Homo sapiens
aaatgcctgaatggtatttggttctgttgtgaattgagacagagttaataaatattatttggtgttt

SEQ ID NO: 6816870 - DNA, 56 bp, Homo sapiens
agtagggtttttcagcctcaatattatcaacatttggggctggataattctttgct

SEQ ID NO: 6816871 - DNA, 61 bp, Homo sapiens
gatgggatcttgctatattgcccaggctggtctcaaattcctgggctcaagcaatcctttc

SEQ ID NO: 6816872 - DNA, 79 bp, Homo sapiens
tcactgtagagtctgtttccacaaaccactcccggccctggcttaggttgggttctccaggaaacagactctgagatga

SEQ ID NO: 6816873 - DNA, 129 bp, Homo sapiens
ggcaaagcacaggtgagagagattggggtccagaccctgcaggatgagtccccttgcccttgatgggcctggcctgtggcagtggaggaccctgtgtctgatcctcacaccctgcaccagtgccacgcc

SEQ ID NO: 6816874 - DNA, 73 bp, Homo sapiens
ggtgctgacattcagagtctggcaggcagtccagagaggtgggaaacagctggactctggggtcagctcaacc

SEQ ID NO: 6816875 - DNA, 82 bp, Homo sapiens
aatattcattagtttgtggaagatggtagagaattgttccaagaagaccattattgccagctattacaacatattggatatt

SEQ ID NO: 6816876 - DNA, 69 bp, Homo sapiens
tattgagctacgtgtggttattgagttacatttatgacttctgtgttttactatatgtatttctcaata

SEQ ID NO: 6816877 - DNA, 56 bp, Homo sapiens
agctcaccagctgcgttggagggctctgtcttccacccccagacagctggtgacct

SEQ ID NO: 6816878 - DNA, 85 bp, Homo sapiens
tggtgtgacttcactggtgcagagaaccattgcaagactttgcctgaagaaaattttcagtggtatctttgtaaaagtcacccca

SEQ ID NO: 6816879 - DNA, 55 bp, Homo sapiens
actttacccgcactcagacacaggcgaccttgaagcagttctcggtgtgtagagt

SEQ ID NO: 6816880 - DNA, 71 bp, Homo sapiens
tttcacctatgttacaaatcctacaggtaggtgtccaacagggccagcctgagccttctgtagcaatgaaa

SEQ ID NO: 6816881 - DNA, 70 bp, Homo sapiens
gattttgaggtgacacaatttactccatatcactggaattgtaactggagttgtgtcatctttgtaaatt

SEQ ID NO: 6816882 - DNA, 96 bp, Homo sapiens
atcttcaggccgacaacctcatctttggtgagctgcgagtgaggactgcggtgcggctccttagccggagcagctcatctagtagttcctgaaggt

SEQ ID NO: 6816883 - DNA, 59 bp, Homo sapiens
tcctgttttagtcttccacgcctggctcttgatatgccaagtggagaagaaaagctgga

SEQ ID NO: 6816884 - DNA, 57 bp, Homo sapiens
agacctggaagttcaagagaaagagatgagttcttgtctctacccctccccaggtct

SEQ ID NO: 6816885 - DNA, 56 bp, Homo sapiens
aagtgacctcatggtttctcctgatacgaaacactgggaagggcaccatgtcactt

SEQ ID NO: 6816886 - DNA, 84 bp, Homo sapiens
tattaggttggtgcaaaagtaattgcggtttttgccattacttttagtgccaaaaatcgcaattacttttgtaccaacttagta

SEQ ID NO: 6816887 - DNA, 73 bp, Homo sapiens
tgtgtggaaggaagtgattttcatgtcaaggtacgtcaaatcaggttgataggaaaacactcctttgattaca

SEQ ID NO: 6816888 - DNA, 62 bp, Homo sapiens
ggtgcagatttgaaacataatattcctttaagaaaaggaagcttagatttccagatctctcc

SEQ ID NO: 6816889 - DNA, 76 bp, Homo sapiens
acaaagggagacaggaagtctgaaggagggagaacaaagttgcttcttcttctctctgcttcctgtttctttttgt

SEQ ID NO: 6816890 - DNA, 106 bp, Homo sapiens
aatgtctaagaatcaatgtttgaattacagatgaatttatggatggaacacttttgttttcaaacatatcttcattactagttatgagctagaggtctggggcatt

SEQ ID NO: 6816891 - DNA, 58 bp, Homo sapiens
aagtttatgttggtaagatatcccagttgttaatgggattcagtggcaagataatctt

SEQ ID NO: 6816892 - DNA, 60 bp, Homo sapiens
tctctcctctcttggcctcagttaccctcactgcaaaatgggtgcaaaggtgaggagaga

SEQ ID NO: 6816893 - DNA, 62 bp, Homo sapiens
ttctcagagcactgctgacaaagacaacagcctccaggcattgcagacagccgctcggggaa

SEQ ID NO: 6816894 - DNA, 57 bp, Homo sapiens
tgcatctgtgctccctcttctaggtaacagcctccgaacaggtaaacgcagattgta

SEQ ID NO: 6816895 - DNA, 69 bp, Homo sapiens
tgtctgcctttcattgttctacccagcatccggtttggacttgactgagggcagtgatgaaggtgaaca

SEQ ID NO: 6816896 - DNA, 63 bp, Homo sapiens
ccaacctctgccctcagctctagggatacgattgctctcttggagctgacagtcagagggagg

SEQ ID NO: 6816897 - DNA, 109 bp, Homo sapiens
gcatcgatattacctaggagcttgttagaaatgcagaatctcaggtcccacttttaatttgctgagttagaatctacattttaacaagatgcccaggtgatttacatgc

SEQ ID NO: 6816898 - DNA, 73 bp, Homo sapiens
ttgcaaaagccagccagtgccagtcttatcaaagcagagtttctaagaaatattagttggttttaaaatgcaa

SEQ ID NO: 6816899 - DNA, 103 bp, Homo sapiens
tcatttgtttatacatgtgtggtactgttaatgttttgtcatacttgtatgtttatataacacacagtagtgtggaaaaacatgctatatttttgaaacttga

SEQ ID NO: 6816900 - DNA, 57 bp, Homo sapiens
gcccagtctccaggagactctcagatcatggttctaatgtcactcctggcactgggc

SEQ ID NO: 6816901 - DNA, 101 bp, Homo sapiens
agattcagaccacagcattaatgaggcaaggatcaggtaagggtcaggcaaatgacccttaaaatgctacttgacttcttggggctttgggatctttatct

SEQ ID NO: 6816902 - DNA, 87 bp, Homo sapiens
tataggatttggctgcttgattaggttgacactgatacatttagttgtggcaagtgaaccaagtcaagccattagccaaatcctgtg

SEQ ID NO: 6816903 - DNA, 56 bp, Homo sapiens
gcaccagcctgagcctcttgcagcacagagcagctggaagagagaagtgctggagc

SEQ ID NO: 6816904 - DNA, 56 bp, Homo sapiens
tgccctgcagcccttcaaaggctgagcgctgtgctgtgcgggaaaggctgctggta

SEQ ID NO: 6816905 - DNA, 62 bp, Homo sapiens
ggaatggtttagcaaggtgttttttcctttgtttataaggagagagattgctaaaccactcc

SEQ ID NO: 6816906 - DNA, 76 bp, Homo sapiens
aaatttccctgaaggcatatattctaaacaggacagcaagaatctgtctttaaataaagtgttttgagggcggttt

SEQ ID NO: 6816907 - DNA, 91 bp, Homo sapiens
gtagtgataggtcagaatgaaatagcctgttggatgtgtaatatgtagagtctacattatttaggcctattgtattcttatctgtatatac

SEQ ID NO: 6816908 - DNA, 59 bp, Homo sapiens
cggctgagcagtgctgatggaacaggttattctttcttcatacaccttttgctgagctg

SEQ ID NO: 6816909 - DNA, 59 bp, Homo sapiens
ttggtgctctctatgacatgaacccaatcataagccaggggacaaagggagcccaccaa

SEQ ID NO: 6816910 - DNA, 70 bp, Homo sapiens
gcctcagtgggcccttgtcacactgatttgaggaaaggctttggaaggtggatgatggggccttctgagc

SEQ ID NO: 6816911 - DNA, 73 bp, Homo sapiens
ttcctgggctgcagagagcaccttgctcgtcagaatttgctgctgtcccatggctttttgtatggcccaggaa

SEQ ID NO: 6816912 - DNA, 62 bp, Homo sapiens
cctttctgtcttttgaggatgtccttcactgaagtacaaggacatttacaaggatttctagg

SEQ ID NO: 6816913 - DNA, 74 bp, Homo sapiens
ccaactggagctgagacttgaggttaggttcaagtgtaagcttcctttccctcacagcctcggagccttcttgg

SEQ ID NO: 6816914 - DNA, 57 bp, Homo sapiens
tgcgctgctccgccttgtccatatgcgcaggcaagtggcagttcaggaagcagagca

SEQ ID NO: 6816915 - DNA, 58 bp, Homo sapiens
tgacccagctaaccctaccctggatgcctgagccctccccacctggttagctgggtca

SEQ ID NO: 6816916 - DNA, 55 bp, Homo sapiens
gaagtgatgtttcagtgtcaactaaagctgatgtctgatgttgtgacatcacttc

SEQ ID NO: 6816917 - DNA, 57 bp, Homo sapiens
gcgggcaggcagccctggggatgggcagccccgctctttcttgggccgtgtgctggt

SEQ ID NO: 6816918 - DNA, 129 bp, Homo sapiens
aggtctgaaacatttttcttgccccattcactggctacagttcagaaatgtctttgcaaaatcctaggactttgtgaaacacatttgaaagccactgagctggaacatctcttgataatatcagagcct

SEQ ID NO: 6816919 - DNA, 56 bp, Homo sapiens
tttgggcctgaccggtgtctctggctaactttctgctgccaggtcttgggtccagg

SEQ ID NO: 6816920 - DNA, 57 bp, Homo sapiens
aaacactgcgtggtggcaactctgttagtgagcgccattctaaattatgctgtgttt

SEQ ID NO: 6816921 - DNA, 78 bp, Homo sapiens
cagatatttcattgtgatgcttttatcactttgaatctttaaattatgattattggtagaagcatgcatgcagctctg

SEQ ID NO: 6816922 - DNA, 96 bp, Homo sapiens
tgatttataaatacataagggtaaatgcgattgactgatggaacctattttgttttcagtaaaacatggcatttagatcttatgaattcagaatta

SEQ ID NO: 6816923 - DNA, 98 bp, Homo sapiens
gggaatatgatcttatttggaaatagggtctttgcagatgtaatcaagttaagatgaggtcattagtgtggaccctaatttaataagactagtgtcct

SEQ ID NO: 6816924 - DNA, 84 bp, Homo sapiens
ggtacgttgcaacaagcagcaagtttatttctatcagtgtttgtacagattttttaaatctgttgcttttttctcacatgtacc

SEQ ID NO: 6816925 - DNA, 79 bp, Homo sapiens
agatacagctaaagtatgtgatggtgcatggtgagcactcaaatagccacaggtattatcggtgctgcatcctgtattt

SEQ ID NO: 6816926 - DNA, 56 bp, Homo sapiens
caggcagggagccactgtataatttgtgaggcaatttgcagaaggcttcctgtttg

SEQ ID NO: 6816927 - DNA, 70 bp, Homo sapiens
aggaaagaagagttctgcatgactatgggtcacacttaactctatcaaacacttggaactcatttttctt

SEQ ID NO: 6816928 - DNA, 89 bp, Homo sapiens
gtggaactgctcccaccagattagtcctgggcttttgtcaggccaggcctggcaggtccagctggactcaactccagggtgtgtttggc

SEQ ID NO: 6816929 - DNA, 62 bp, Homo sapiens
ggagcgcagcactggggccactggagttaatgcagactcctcccgctcccatgccgtcatcc

SEQ ID NO: 6816930 - DNA, 73 bp, Homo sapiens
ccgtgcgtgcctcgcgtgaaagctccgccttccgtcagacggacgtgggtcgggactccgcctcgcacgtggg

SEQ ID NO: 6816931 - DNA, 74 bp, Homo sapiens
atacgatgatgtccagtgatgccaagatgaaattttattatttcaccgtgtttttgttcctggaagtcaagtat

SEQ ID NO: 6816932 - DNA, 73 bp, Homo sapiens
ctggaagtgttgtaagtttaatgtcaattgcatacatttatttaatttcaatagcttgcataatgctgcccag

SEQ ID NO: 6816933 - DNA, 67 bp, Homo sapiens
gctgtagtgttgtctaaatgaatgctaaagtctccaagctttagcttttaagtcataacctcacagc

SEQ ID NO: 6816934 - DNA, 92 bp, Homo sapiens
attttttctgttttccttgaaagcccagggcatacaaccagggacagatcatttttccccatgcttctcagctcaaggcaaacagcaaaaat

SEQ ID NO: 6816935 - DNA, 57 bp, Homo sapiens
tctaaggaaggacaccctggctgtccagtatttcctgtgtctgccagacctcctgga

SEQ ID NO: 6816936 - DNA, 70 bp, Homo sapiens
gacatctcttttgtctttttacaccgtgctctttaacaaagaacataaacagaaggacagaagaattgtc

SEQ ID NO: 6816937 - DNA, 130 bp, Homo sapiens
gtgcttgagactagaggcttgtaattcaggtccatcttgttcccatagtgaccgatgctgacctcgaaatggatcagctctttaaagttgggcatcatggtacaggaaaggaagatgacgcacagcccat

SEQ ID NO: 6816938 - DNA, 94 bp, Homo sapiens
tagagttattacccctggaggtcataagtgtatagatgtgtattcacatgagtttccatcactaggttatgctgccttgagggtaagaagtctg

SEQ ID NO: 6816939 - DNA, 76 bp, Homo sapiens
ctaagcactaagtagcaaacacagagggcctaatcacatggaccaatatcccttctgatgttctcttatgctgtag

SEQ ID NO: 6816940 - DNA, 59 bp, Homo sapiens
gggtgatttgcaaaataagtgtacctaagggatgcggtgtgaagagtgataggtcaccc

SEQ ID NO: 6816941 - DNA, 57 bp, Homo sapiens
gggctggcatcagttgccgagaggtggaaggagtacctctctgcagtttgttagctc

SEQ ID NO: 6816942 - DNA, 68 bp, Homo sapiens
ccacagtggcccagttgagaatgaatgatgcccttcaatgcacagtcaggccgagatgggccttgtgg

SEQ ID NO: 6816943 - DNA, 92 bp, Homo sapiens
tgattaatttcccatgttctaacaatgagaaacctaatacagggaggaagagtgggttttgcagggttaggcatatctgagggagatttaca

SEQ ID NO: 6816944 - DNA, 65 bp, Homo sapiens
gttcccacgcctcctctccagcgtgactagtggctgaggatgcggaggagaggaggctgaggagc

SEQ ID NO: 6816945 - DNA, 55 bp, Homo sapiens
agcattttctgagagtatagatctcatgaatcagatttgctgtgcagatgatgct

SEQ ID NO: 6816946 - DNA, 73 bp, Homo sapiens
ttttcttatgtgcagctatatgttgtcccactgatgtgtagggctagagtgatagcagtggatgtggagaaag

SEQ ID NO: 6816947 - DNA, 68 bp, Homo sapiens
ggcagggagggagtcgggaactgtgggtctgtggtatgcggcttgcaaacctgtttctctcacctgtc

SEQ ID NO: 6816948 - DNA, 59 bp, Homo sapiens
gggccatgagtaaactggaaagccaggaaaggcactcggcaggcaggtcttcatggccc

SEQ ID NO: 6816949 - DNA, 86 bp, Homo sapiens
gctctgagctgagtggagaccccacttctacatgcagcttccattatgagcacccaggaagtggggttctctcactgtgccggggt

SEQ ID NO: 6816950 - DNA, 57 bp, Homo sapiens
agcctcacaattcagaaaccaagtagctcccagttgaccttgcttgggttgtgagct

SEQ ID NO: 6816951 - DNA, 60 bp, Homo sapiens
gctggccatatattttgctgttgtagttgttttaaacaaacagaaaactgtgaggtcagt

SEQ ID NO: 6816952 - DNA, 94 bp, Homo sapiens
gataagcccccaataaacatgggctaattctttgattgttttgaggaaaagaaagacaatctgaatgtgaatggcatatgtttattaggttgtc

SEQ ID NO: 6816953 - DNA, 55 bp, Homo sapiens
aaggaactgctgatgtggtgacatattagtcatcgcgcctctagagcagtttctt

SEQ ID NO: 6816954 - DNA, 67 bp, Homo sapiens
tactgagaattctagtctgacagtgctacattgtgtagcacattgttgaccagaaggaattttagtg

SEQ ID NO: 6816955 - DNA, 56 bp, Homo sapiens
gcagggtctagaacgcccacatgtgcggaactggggaatagagctggagaccctgc

SEQ ID NO: 6816956 - DNA, 79 bp, Homo sapiens
gatcgggggggtaagacaaaggggtccttggatgggggcacctgtgagcagggacccctttgtctgagctccccgggtc

SEQ ID NO: 6816957 - DNA, 105 bp, Homo sapiens
tctcctaaggcacattaaagaacccaaattccattttgtgactattctgagcagtttttggagagcatactataatggaggtggggtgatttaatcactttgaga

SEQ ID NO: 6816958 - DNA, 66 bp, Homo sapiens
cctgtttccattctgagtcttatgtcttttggaaaagagttctaatatttcagatggtaaatatgg

SEQ ID NO: 6816959 - DNA, 73 bp, Homo sapiens
tctttcctaggtgatatgcaattaaactgaagtcttccttctcctttggacttgtgcatatatctatgaaaga

SEQ ID NO: 6816960 - DNA, 75 bp, Homo sapiens
taactttcccacgctgagcccatggaggactaatatccacaaatctttaattgtactccctgtgggaaaatgtta

SEQ ID NO: 6816961 - DNA, 91 bp, Homo sapiens
gttttgcatgtggctcccagggtgtgaggttctgcagaacagtagcctgctgttcccttgaccccagaccctggtgctttcattgctctgc

SEQ ID NO: 6816962 - DNA, 100 bp, Homo sapiens
gaggggaggcgccggccgccgcccgatgagcccccgggccccagtcaggagaggtcggggccctcccggcgtgctgggctcgccggcggcgtttccttcc

SEQ ID NO: 6816963 - DNA, 66 bp, Homo sapiens
gggatgattctcatgttccctgagaatgtcaaggaatggcaattgagggaacatgagaatcatctt

SEQ ID NO: 6816964 - DNA, 73 bp, Homo sapiens
gcctttagaatgctgtatatcttagctaatgagaatgatctaatctcacactgagaggtgacagcgtgctggc

SEQ ID NO: 6816965 - DNA, 69 bp, Homo sapiens
tcaggcctctggaggtggcagtgtccccacagtcccgcagaaaaacacagagacacttttgaggctgga

SEQ ID NO: 6816966 - DNA, 64 bp, Homo sapiens
acatagctggtgaacacgcacctgtgcttccttccctgtacaggtgttgactcacaggccctgt

SEQ ID NO: 6816967 - DNA, 55 bp, Homo sapiens
atacatggaagatgcttagcacatgcctggtgcagagtacactcttactatgtgt

SEQ ID NO: 6816968 - DNA, 102 bp, Homo sapiens
ccgccagctgcatcagatccctccagggcctcattgtcagtcctgtaatcttttcatccgtgataggatgggccgtgggcccttgtgggtgaagctcggcgg

SEQ ID NO: 6816969 - DNA, 61 bp, Homo sapiens
ccaccctcccgtcagcccctgggctccacagaccccagcaggcatgttgggaggaatgtgg

SEQ ID NO: 6816970 - DNA, 71 bp, Homo sapiens
cctgcctctgtgctattcatccactcacccatcactaaatattccctgagtgcctacggcacaggcgcagg

SEQ ID NO: 6816971 - DNA, 57 bp, Homo sapiens
tagcaaagttaaatggcttttgtttctgagagtcttctcaaagcatttaatttgcta

SEQ ID NO: 6816972 - DNA, 86 bp, Homo sapiens
gacaatgaatgaagtcttgacaactggcagatatataaatctgtatgaaaagattagtatatattcatcagttaggctattctgtc

SEQ ID NO: 6816973 - DNA, 66 bp, Homo sapiens
gtgattatttttaatgcctttctagacaagcctgcaaacttctacagggtattcaagggtagttgc

SEQ ID NO: 6816974 - DNA, 60 bp, Homo sapiens
atctttagagtcatctgagtgtcaacacactctatttatgacactcgtaattttagaggt

SEQ ID NO: 6816975 - DNA, 55 bp, Homo sapiens
ccggcggattgtcattggtgtccagcacgctgacggtgaccttgcagtgtgccgg

SEQ ID NO: 6816976 - DNA, 75 bp, Homo sapiens
ttcttgaaataggttcttcaggagctgtttataaattgagttgtggttaaatatatgagggagctatttgaagaa

SEQ ID NO: 6816977 - DNA, 69 bp, Homo sapiens
actgtctcccagtaagcctgagaaacaccacctccccagcttggacggtcacaggcatattggtgtagt

SEQ ID NO: 6816978 - DNA, 98 bp, Homo sapiens
cagttgggcctccagatgccaggtctttgttctgcatcctcagcccgcctcaggtctcagctgaggagcgagaactctgctggaaggccacacagctg

SEQ ID NO: 6816979 - DNA, 60 bp, Homo sapiens
gtgacagtgaatctagacagacagcctggaaaggaagttgctttattgatttattttcat

SEQ ID NO: 6816980 - DNA, 76 bp, Homo sapiens
taaaacagttttattgaggcataattgacatagtgcacatggcacatactcagtgtgttcaattggataggttttg

SEQ ID NO: 6816981 - DNA, 82 bp, Homo sapiens
tgagtcattctgtccgcttgtttgttagagcccctttaatggtggaagttctctgatacatgttgtgatacaaagaccctca

SEQ ID NO: 6816982 - DNA, 81 bp, Homo sapiens
cattagagacctggtgatagctgtcctacacagctaataaaagccacgtggggctactactataatcaggagctgctgatg

SEQ ID NO: 6816983 - DNA, 69 bp, Homo sapiens
ggagcagcactgattagcggttcccacaagcgtatagccatctgcaggctcccctggtgggtttgttcc

SEQ ID NO: 6816984 - DNA, 73 bp, Homo sapiens
tcatatataatgacagcagcgggccacagatgtcacgtgcttagtgctcaccgcctctgctgtcttattgtga

SEQ ID NO: 6816985 - DNA, 60 bp, Homo sapiens
ggagatcttcacgctgcggtcgctggaactagcctcagcatcttcagcatggggaaagcc

SEQ ID NO: 6816986 - DNA, 55 bp, Homo sapiens
taggaatgctttcaaaaatgtgcagtggtaaaactgccagattgaaggtttctta

SEQ ID NO: 6816987 - DNA, 62 bp, Homo sapiens
tgaagtgcggtaactgttctcatagcagcatggatgcacaaagagggcaggcacccatttca

SEQ ID NO: 6816988 - DNA, 65 bp, Homo sapiens
tggtaggataactgggcttgactttaaagacttctaacttcaaggtgccacagttcttttagcca

SEQ ID NO: 6816989 - DNA, 72 bp, Homo sapiens
agttgttgcttctgctggtgttttgtgaggctgcaaagaaaccctcacaaaatatcagcagaagcaacaact

SEQ ID NO: 6816990 - DNA, 82 bp, Homo sapiens
gacatgtctaaactttcttcttgagtaaccagattttcccttacagtcttttgtcacttaagagaactcataggcaatcgtc

SEQ ID NO: 6816991 - DNA, 65 bp, Homo sapiens
tgaaatggagtgtattcctgcctttgttcacctgtcacgtagctgggaacttcactctctattca

SEQ ID NO: 6816992 - DNA, 70 bp, Homo sapiens
gcaaaacaccttcatgtctgccttttcaagtgatgctcacagctctatttgatcagccaggcagttttgt

SEQ ID NO: 6816993 - DNA, 104 bp, Homo sapiens
ctgaggcaggagaatcacttgaacccaggaggtggaggttgcagtgagccgagattgtgccactgcactccagccttggcaacaagagcgaagctccgtctcag

SEQ ID NO: 6816994 - DNA, 83 bp, Homo sapiens
tgaagggagggcggcagaagacactccctctcggttcatgcaaatcgctgggggaacttcagccaatagtcactggctcttca

SEQ ID NO: 6816995 - DNA, 60 bp, Homo sapiens
gccttgctgtgatgctcacattgaaaatatgaatttgttccaatgtgactatcagggagc

SEQ ID NO: 6816996 - DNA, 73 bp, Homo sapiens
agactgtttacagaagagaaagaattcagggtaatttttgttctgaggttctgttttccttctggtctagttt

SEQ ID NO: 6816997 - DNA, 65 bp, Homo sapiens
cttctctgagtgtgcttaataggggcaagaacatattgtccatttatacgccctcactgcaggag

SEQ ID NO: 6816998 - DNA, 55 bp, Homo sapiens
ctgagaaaggacctcaaacagggaaagccaacaccctgaaccaaggctttctcag

SEQ ID NO: 6816999 - DNA, 71 bp, Homo sapiens
tgctacgctttccctgcttgtggcctccataggacacacacatggatgccaggagatggagcagagtggca

SEQ ID NO: 6817000 - DNA, 79 bp, Homo sapiens
aataaagctgaaatagtacattaggcattttgagtcataaggaacagacaatggctaagtaacctgttaggcatttatt

SEQ ID NO: 6817001 - DNA, 59 bp, Homo sapiens
tcaaataggcttgtagtgactggactggcaacccaatcattaccgtaatgtttatttga

SEQ ID NO: 6817002 - DNA, 107 bp, Homo sapiens
aatccaaacacaaaggctttagtgctcatccagatgggggtttcagatgttatcaagttaatctggtctctctgttccctgggtgacattttctcacgtgttgggtt

SEQ ID NO: 6817003 - DNA, 61 bp, Homo sapiens
gcccagctccagagccagaaacacttggatttgaatcctgggtctgctactggagctctgc

SEQ ID NO: 6817004 - DNA, 71 bp, Homo sapiens
tgtagatgtcctgtggtgtgtctcacaaatgcacatgcacatgcatgcgaacacacacacaaacacgcaca

SEQ ID NO: 6817005 - DNA, 72 bp, Homo sapiens
ttgttttttgagatggagtctcactctgtcacccaggctggagtgcagtggtacaatttcggctcactacaa

SEQ ID NO: 6817006 - DNA, 68 bp, Homo sapiens
tgtattaaggcccattctatgaagcagtaattgagaaatgattggttacacagactggtgcttataca

SEQ ID NO: 6817007 - DNA, 129 bp, Homo sapiens
tcttaaaatcctatctctgataaacctcttaaatgcagtttttacaaaataagctatataataagtgtggtcatgttttaaaaatattgtaaatgtggggattttcagcatagctgggccatcatgaga

SEQ ID NO: 6817008 - DNA, 63 bp, Homo sapiens
taatgcaacagctgctagtgatcatgtgattgatacatttttaaaggcagatgttgagtatta

SEQ ID NO: 6817009 - DNA, 61 bp, Homo sapiens
atgaagcttctcaactggtggaatgctgccagaggatttcaacagagtttgaaggcaacat

SEQ ID NO: 6817010 - DNA, 62 bp, Homo sapiens
ccacagtttcttcatctataaagtgggactcatgagggtgcctccttataatgatgatgtgg

SEQ ID NO: 6817011 - DNA, 85 bp, Homo sapiens
tctgagaaacaacgaagaggccattgcagctcagggtgatgactgccctaatgcaagtcgacattcagggtgcagtgggagcagg

SEQ ID NO: 6817012 - DNA, 83 bp, Homo sapiens
ctgacctccaaaagggaggggctgccctggtgtcagggcctagggcgtacagatggctccacaaggcagctcctccaggtcag

SEQ ID NO: 6817013 - DNA, 100 bp, Homo sapiens
gccccactctgggctgccctgttcttcttcatgctgttgctgcttggtctcgacagccagatttgcatggggctctgggacagggagccaggagaggggc

SEQ ID NO: 6817014 - DNA, 66 bp, Homo sapiens
gagaagatgatttcagctttggatatgtcaagttggtgctagatattcaagtggaattattctctt

SEQ ID NO: 6817015 - DNA, 71 bp, Homo sapiens
agagcagcccctccaggcccaagactgatgagtctcagccatgaggcccagcctggggtgtgggggccttt

SEQ ID NO: 6817016 - DNA, 81 bp, Homo sapiens
catcacttgagaacttgctaaaaatgcagaatcttggtccctgaatcagaatctgctttttaacaagatccctaggtgatg

SEQ ID NO: 6817017 - DNA, 67 bp, Homo sapiens
gagcaccctgctggtttctcctgtgatacatgacaccttcaacaaatgggccagccaggcgttgctc

SEQ ID NO: 6817018 - DNA, 66 bp, Homo sapiens
tttcttttctcatggacccttcatgatgtatcctttttccatctgccaatgccatgagaagagaaa

SEQ ID NO: 6817019 - DNA, 101 bp, Homo sapiens
tgaggcacaatccattcatttattctttgtctttgcaattgagttaacaatgtggtaattaacactgattgtagagacacttagataagatgtgttactca

SEQ ID NO: 6817020 - DNA, 56 bp, Homo sapiens
ggctggcttgcggagtcacagatgttcactgtgccccttctctgtgtgcccaggcc

SEQ ID NO: 6817021 - DNA, 80 bp, Homo sapiens
tagggattaatgatgttttaataggtaaatattgttttattaacagcaattacatttattgagcattcactgtttctcta

SEQ ID NO: 6817022 - DNA, 87 bp, Homo sapiens
ggagaattgcttgaacccggcaggcggagttgcagtgagtcgagattgtgctactgcactccagccttgccaacagagtgagactcc

SEQ ID NO: 6817023 - DNA, 67 bp, Homo sapiens
gacaaggccttaagaacaaaactatttggatccactgaaataaatggtctctaagggtcttctagtc

SEQ ID NO: 6817024 - DNA, 85 bp, Homo sapiens
tgaaatacagtgtgtgttctttgatgtgtgtagagaaagaattgtgttcaggcaagtttaaagaacccatgaattgtaaaaatca

SEQ ID NO: 6817025 - DNA, 86 bp, Homo sapiens
tgcccagcaggcagagactgatgttagatcctgtacccagctgctgctgggagaagggacagactcagcttctgactgcaggggca

SEQ ID NO: 6817026 - DNA, 78 bp, Homo sapiens
ttgtttttggtgcatttgaaagtaacttgcagacctctgtacacaaccctgcaaacacttcaacgtgcatcttatcag

SEQ ID NO: 6817027 - DNA, 88 bp, Homo sapiens
gtttctagctaatttctaacaagttcccgaggaccacagttgaagaacctttgccctatggtattgtggagcaagaaatggaagaaac

SEQ ID NO: 6817028 - DNA, 82 bp, Homo sapiens
ctgcaaggtcctgtgttattttttatgctttcaaacctaaccatgttaggtcaggtttttaggagtgacctcagactttcag

SEQ ID NO: 6817029 - DNA, 60 bp, Homo sapiens
gggttcctggagccatgtcttgactgctcccgagcagatccataatggtttctggaagcc

SEQ ID NO: 6817030 - DNA, 78 bp, Homo sapiens
ctcgcacccctcttctgtgctctgctgttggggccttataaatagctccaaggactggacacacaggttggaggtggg

SEQ ID NO: 6817031 - DNA, 64 bp, Homo sapiens
ggtgtcgtaaaagggccgcagtggcagcgtcctggccgacggctagtagcccattttggatacc

SEQ ID NO: 6817032 - DNA, 65 bp, Homo sapiens
gcctgctctgttcccccatcatctcaatcctcctcctaatggcttggcaggcggggcagggctgc

SEQ ID NO: 6817033 - DNA, 72 bp, Homo sapiens
tcctttttcacagactgtgagtgatttcaatagtatatgaaaactatgactcagaggctggaaatcaaaggg

SEQ ID NO: 6817034 - DNA, 63 bp, Homo sapiens
ccgtgtgcatatgtgtgtatacaaacacgcatgcatgcctggatggacatacgtatgcacagg

SEQ ID NO: 6817035 - DNA, 58 bp, Homo sapiens
ggctggtcagggtattggaggccaaattagaggtggctgggttatttatggccaagcc

SEQ ID NO: 6817036 - DNA, 76 bp, Homo sapiens
ctcatgattcgactgagaatttacatttttggtgaaaatcccactgaagagttctgctcttctcagtgagcatgag

SEQ ID NO: 6817037 - DNA, 88 bp, Homo sapiens
ttcacagcctgagtcttagtttttcatccaaaaagggtggttaacacttatttcatggagttgagaaggctaagatgacagaggtgaa

SEQ ID NO: 6817038 - DNA, 126 bp, Homo sapiens
ggtggagagaagaaggcatatgtttgactggctcctgattacgatgttttggatgttgccaaaaaattggtatcatctaaattgagtccagctggctagttctaaatatacgtgtatcttttcacc

SEQ ID NO: 6817039 - DNA, 81 bp, Homo sapiens
tattcatactaaatttgtcaatgacacttgctttagtgcacttaagttcaaggtgacgttgaaaatttggagaagtggata

SEQ ID NO: 6817040 - DNA, 74 bp, Homo sapiens
gtagacacttatttagtgtgtttatgcagacatagatttaaaaatgtataaccacattattatgggttctttac

SEQ ID NO: 6817041 - DNA, 122 bp, Homo sapiens
gtctcttcatcttgctcagcttcagtttcctcatccataaaattgtatcatcatgtcttacaaatatgatttcagtaatgaggatgaaggagatcaggcacctatggcgtcatggagaagac

SEQ ID NO: 6817042 - DNA, 55 bp, Homo sapiens
ttgtgtgtagactcagccattgtatataggccatggtccagccagctgcacagga

SEQ ID NO: 6817043 - DNA, 69 bp, Homo sapiens
ctccctgtactagaattatgccttgctgtccacaatcatgtgacttgcacacatataatttaggtggag

SEQ ID NO: 6817044 - DNA, 66 bp, Homo sapiens
gctggaagtggtctatggcccagccactttgttcttgcaggtgtgctctgtgatggactaatcagt

SEQ ID NO: 6817045 - DNA, 127 bp, Homo sapiens
gctgggctgggctgagctgggctgagctgggctgggctaagctggactgggctgggctgagctggactgggctgggctgagctagacttggctgagctgggctgggctgggctgggctgagctgggc

SEQ ID NO: 6817046 - DNA, 71 bp, Homo sapiens
ctggatcttgagcttgctggccttcagctacaccatcaatcctggtttttagatcaccaagctcagactag

SEQ ID NO: 6817047 - DNA, 78 bp, Homo sapiens
tgggatcttgaaaagcactaatttctaggagcatctatcctgagatttgaaacttgcttcataaagttcaagatctca

SEQ ID NO: 6817048 - DNA, 66 bp, Homo sapiens
cttttcttcatattttatggcagatagttgggattttgactttgccattgcaaatacacagaaagg

SEQ ID NO: 6817049 - DNA, 90 bp, Homo sapiens
gtttcctcagtcataaaatttgtggattagattagatgatctttaagatcatttctgcctcatgtattttatgattctatgtgtggtgac

SEQ ID NO: 6817050 - DNA, 79 bp, Homo sapiens
gtgcctcaccccatcagaaggccagagggtagcccaagctagaaggaggttgcccaggccttgcctgagccctgaccac

SEQ ID NO: 6817051 - DNA, 98 bp, Homo sapiens
tggctgagcagctgcagctaggaatggcagcagccgggggtcccagccctggttccccccagccctgcccttccaaaggctgaccagctagctggcca

SEQ ID NO: 6817052 - DNA, 75 bp, Homo sapiens
cactccttctttgatgtggttaattatgacctcttggggtacataccaaccttatcaaaatccatctgggtagtg

SEQ ID NO: 6817053 - DNA, 78 bp, Homo sapiens
agcagtcagcccggccaggaacagagtatattccctgccgatgcacacttgtgtctgtcctcggttgatgcctctgct

SEQ ID NO: 6817054 - DNA, 72 bp, Homo sapiens
gtgtatttgtttacagtcctttttgcttttaacctgagggtagaaagtcaaaacactgtgtttaagagacgc

SEQ ID NO: 6817055 - DNA, 68 bp, Homo sapiens
gacccaggtcagcacttggaggtgcaagggaggtccccgatgcgcctcctgctgcctgccctgaggtc

SEQ ID NO: 6817056 - DNA, 81 bp, Homo sapiens
aggaagctgggaaactgacattgatatttatacaatccatcaatctttttcatgtttcaccagttttataagaacggtcct

SEQ ID NO: 6817057 - DNA, 86 bp, Homo sapiens
ggagccggatgtcgtgaaatccatgggctcctcctctgactgtggcttgtgagccagagcctgtggatttaacctcttctggttcc

SEQ ID NO: 6817058 - DNA, 76 bp, Homo sapiens
tttctagaagttagtccagtgtttgaattcaataggtgactaattgttgaatgaatactgcactttctctttgaaa

SEQ ID NO: 6817059 - DNA, 66 bp, Homo sapiens
gctcatggcctcggagaaaggcagctccacctcccaggaggggagctgagctctgagccacgacgc

SEQ ID NO: 6817060 - DNA, 59 bp, Homo sapiens
ttcaagtctggagatctggaacttcttcctgaagctccatgtttagccagataattgag

SEQ ID NO: 6817061 - DNA, 63 bp, Homo sapiens
tatcatttcacacttgttaggatggcttttataaaaagacaagagataacaagtgtgtggata

SEQ ID NO: 6817062 - DNA, 97 bp, Homo sapiens
catacataacaacaggtagttctcagctgttcccttggtgccagacatacattttatctaaagagacagcagacagaactacctgctgcttcctgtg

SEQ ID NO: 6817063 - DNA, 71 bp, Homo sapiens
ctattgtaaaggataactttcaagaattgtttttaacaatttgaattgttgttattttctgtttacagtag

SEQ ID NO: 6817064 - DNA, 80 bp, Homo sapiens
aggggctacagaaaggcataggacaaatcagtgatgttgaaccacatcttactaagatgctttgcttgctgtggcactct

SEQ ID NO: 6817065 - DNA, 63 bp, Homo sapiens
gctggccccaagtcccatggctagtggcgagactgtaactggccatgaacttgggatctcagc

SEQ ID NO: 6817066 - DNA, 102 bp, Homo sapiens
gtcaggtgagtatgagggagatgggctgattcgatgggggtagagaggcgggccacgtgagctctgccctggggtcagcctccattcatcactttctctgac

SEQ ID NO: 6817067 - DNA, 68 bp, Homo sapiens
tagatagaggccaggacacttaagtaagaaggtctacctttcctgttttaaagtcatggttgcatcta

SEQ ID NO: 6817068 - DNA, 66 bp, Homo sapiens
tgcaggtggaagcagcagactcagcataggtctcactgccctgaccgtcagctgtcttccatttca

SEQ ID NO: 6817069 - DNA, 93 bp, Homo sapiens
gagcaggagaaagggcgccacctctacctggccggccttcccggcagaagccgccgagctaagccctggagaggtcggcgcctggactacatc

SEQ ID NO: 6817070 - DNA, 72 bp, Homo sapiens
tactgctcctggccagcacagggcccttgggtgaattagaagttatcctcgggcacctggctagtgacagtg

SEQ ID NO: 6817071 - DNA, 104 bp, Homo sapiens
gggaggcccagtcaaggctccaggcagccaggtcttccctgtgtcaacaaggggaaggaaagcagcttggccctgtctggggcatcctgagaaaggggttttcc

SEQ ID NO: 6817072 - DNA, 67 bp, Homo sapiens
ggagagtctgctggccacagtgatggcacattcatggaaagcatgcaactgagccagtgacttctcc

SEQ ID NO: 6817073 - DNA, 58 bp, Homo sapiens
gataacattttgaagtgctagtaacaagtacttggaaaatggtgttcaaattgttgtt

SEQ ID NO: 6817074 - DNA, 64 bp, Homo sapiens
gaatgtcttcaaaactagactgatgtggaaaaaacacctttctcttctagttttgagagacttc

SEQ ID NO: 6817075 - DNA, 65 bp, Homo sapiens
agggagagtcaattctgctgtgtggccaaacctctccaccacgctccatggcacagtctttccct

SEQ ID NO: 6817076 - DNA, 62 bp, Homo sapiens
tccaggtgggctgcacccaggctggacgttattccgacctcggtgaagggagtccggctggg

SEQ ID NO: 6817077 - DNA, 103 bp, Homo sapiens
gttatatataactgtatatatacataactacatacatatacatgcagttgtgtatttatatagtgtgtgtgtgtgtgtgtgtgtgtgtgtgtgtgtgtgtgac

SEQ ID NO: 6817078 - DNA, 75 bp, Homo sapiens
ggcagcctcctagttctctgccagtcgctgaaggacacccaggacagttattgagtgcagagcagggctgctgct

SEQ ID NO: 6817079 - DNA, 60 bp, Homo sapiens
catgagaaggggtggagttagaacacaggtaaatatactcccagcccttaggaactcatg

SEQ ID NO: 6817080 - DNA, 68 bp, Homo sapiens
taaagtgacatttttgtacaaagtcagtgcagatgctgtctgccttgataataaaaatggtcacttta

SEQ ID NO: 6817081 - DNA, 103 bp, Homo sapiens
ggaggagtgtgcaggcatggccaggcacctctggctgagggcagggcagggccttagccaggggagcagcttgtccacttactgccagccttgttcacgcccc

SEQ ID NO: 6817082 - DNA, 69 bp, Homo sapiens
ggagaaagagggggacttgaagagtgagatgtagacatctgagcctatttcaaattcctctgagcctcc

SEQ ID NO: 6817083 - DNA, 72 bp, Homo sapiens
ccattctcacagtgatgtcttatgacaggtacgcagcaatctgtcaaccacttcattatgagactattatgg

SEQ ID NO: 6817084 - DNA, 62 bp, Homo sapiens
aggagcttctgcttagataggaatgctgagaaccatcagaatcttttctctgcaggattcct

SEQ ID NO: 6817085 - DNA, 128 bp, Homo sapiens
ggctgcctggactcactgggctgggctgcagggtgaggtcagcatttgctgtgagctcatctgagctgggagctcccagcagagctggccactgctctggccaccttgtgcaggagctggaggaagtc

SEQ ID NO: 6817086 - DNA, 56 bp, Homo sapiens
gcctggctgccggccttggcaatattcccaatgcgttcctgaggcttcgccagtgt

SEQ ID NO: 6817087 - DNA, 67 bp, Homo sapiens
atcagtttcgaatgatgtttggaatatagcagatactcagaaatattgtttgaatggatttactgat

SEQ ID NO: 6817088 - DNA, 110 bp, Homo sapiens
cttcctagaagcaaaagagccaggaaagcattggtaggatttgaacccagataagtgtgactccaaggccacatgcattccacttagttttacttgtcttcatcaggaag

SEQ ID NO: 6817089 - DNA, 62 bp, Homo sapiens
gctgcctggagctcagcctgccgccctcaccgtggaggctacgctagatgcccaggaccagt

SEQ ID NO: 6817090 - DNA, 68 bp, Homo sapiens
ctggagctgtttgtggacatcttaagagaaatggtccccttggaaggtgccaagaagaataggttcag

SEQ ID NO: 6817091 - DNA, 61 bp, Homo sapiens
gtggaggctgctggcaggcgtggacgtctcagatgtctgatccttcaggagccccctccac

SEQ ID NO: 6817092 - DNA, 80 bp, Homo sapiens
agagagaggttaatgcagaattgctaagtatctgatcaggatttgaaagcaggggtttgcaattctgtagaccttgcact

SEQ ID NO: 6817093 - DNA, 91 bp, Homo sapiens
tcttgcatttttgtgaagtatgcattgctgctttcaaaacaatttcgaaaatttttatgaaagagaatgtgtatcttttggggagaaaaga

SEQ ID NO: 6817094 - DNA, 58 bp, Homo sapiens
gcatttgaaatgcaagaaagtgactggtatggcagccctccctgtgcatttcaaatgt

SEQ ID NO: 6817095 - DNA, 79 bp, Homo sapiens
ggggggtcggggggaggaatggaggcttctgggggttgctctggaccaggaagcctttttctttgacccttgtcccctc

SEQ ID NO: 6817096 - DNA, 55 bp, Homo sapiens
gtgagagctgctagactgttatatttcgggggtcttgcagggtagcttttcttac

SEQ ID NO: 6817097 - DNA, 78 bp, Homo sapiens
gggcggataccctgggtgacccgtgagcgtccgcgcccggcgcgcgcctgcgcagtcgcttttcgagagtttccgccc

SEQ ID NO: 6817098 - DNA, 77 bp, Homo sapiens
tataatatattgctggaggggcctctgatagcttctagatcaggatttatacagtgcctcttccattagatgttatg

SEQ ID NO: 6817099 - DNA, 74 bp, Homo sapiens
cagggcttaggaaagccttgcccgtcactgggaccagcaacaccgctttcccactctgcagggctttggctttg

SEQ ID NO: 6817100 - DNA, 58 bp, Homo sapiens
agtgaccttgaatatctcctgaggaagaggaacttgaaaaaggaatattcaaggtgct

SEQ ID NO: 6817101 - DNA, 57 bp, Homo sapiens
ctgtggctgtcctacctggtagcccagctcacatgagactgacccaggacaccacgg

SEQ ID NO: 6817102 - DNA, 106 bp, Homo sapiens
ccattgtaatgtcttgtgtatgccttaatttatgtctaacataatggttttgtattgtgagacaattgcatcagggcacttacacgattaaaaagagatttaatgg

SEQ ID NO: 6817103 - DNA, 78 bp, Homo sapiens
agattgaggcacagggcagagccaggatttcaaccattacagtctaattccagagtttgtgcccttgagccttatgct

SEQ ID NO: 6817104 - DNA, 79 bp, Homo sapiens
tgagtactcacaagatctggttgtgtggcacttcccttcccccctctctttgccctgcacctgccatgtgagatactta

SEQ ID NO: 6817105 - DNA, 59 bp, Homo sapiens
tacagggacaagatgtttagaaatgtgtacttggttttcctcagactctgtcccatgta

SEQ ID NO: 6817106 - DNA, 82 bp, Homo sapiens
ccaatgtccacgattctttattttcattgcctttactttaatggttattagaagtgaaggattgtttttctgacttaattgg

SEQ ID NO: 6817107 - DNA, 57 bp, Homo sapiens
tgcctacctggattggctgaagcacaaaggacaaattttagaggacacagggaggca

SEQ ID NO: 6817108 - DNA, 93 bp, Homo sapiens
tcttaaacaaatttggttaacaagcatttcattctgactgatcagtgggtattgatcagtggggacgagaagtttagctaaccatttataagg

SEQ ID NO: 6817109 - DNA, 76 bp, Homo sapiens
gggttggggcaaactgagacacgaactatgatttggccaaaagtcattttgccagtcttcagggaatgctccgctc

SEQ ID NO: 6817110 - DNA, 65 bp, Homo sapiens
gggaaagaaatgtatgtttctttatatttaatgcaactgcactaagaaatgtatcattcttttcc

SEQ ID NO: 6817111 - DNA, 71 bp, Homo sapiens
agtcagatttcctcctacgcttatcactttatatgtggaaaatggagtaaaagagtaggaggaataaggct

SEQ ID NO: 6817112 - DNA, 85 bp, Homo sapiens
gcgagatggttttgttgggagacaattctcttgtgatctctcacatttctgcaagtctaattttctgaacaaagccattatcagc

SEQ ID NO: 6817113 - DNA, 67 bp, Homo sapiens
gtcatccacagaatcgctagtggagcatctgatacgcaggtgctccgtgatggactgtgacgatggc

SEQ ID NO: 6817114 - DNA, 65 bp, Homo sapiens
cagcacttctctgtgaaaggaaagaactgacaccatgtgtgttaggtgtccttacagggatactg

SEQ ID NO: 6817115 - DNA, 68 bp, Homo sapiens
taccatgtgcagccacagaggagggatgcaggttcacccctaagtgtccaaattgtggtgataaggta

SEQ ID NO: 6817116 - DNA, 58 bp, Homo sapiens
acccaggatagagtgctgcagtgtgatctcggctcactgcaacctctgcctcctgggt

SEQ ID NO: 6817117 - DNA, 63 bp, Homo sapiens
ccaaagacagacttgactagagcctcgtgtccccagagggcctcactggaagttagtctttgg

SEQ ID NO: 6817118 - DNA, 55 bp, Homo sapiens
ggctgatcctgagcaggcagtgaggtgggtgtcactgtcacatgggggttatgcc

SEQ ID NO: 6817119 - DNA, 68 bp, Homo sapiens
tccacatccattgcttgactttttaaagagactctctgtcttgatttaagttcctggggtgggtggga

SEQ ID NO: 6817120 - DNA, 58 bp, Homo sapiens
gtcctgagggcccaggcattctggattccaagcctagccttgtctggggcctcgggat

SEQ ID NO: 6817121 - DNA, 76 bp, Homo sapiens
tgttaaatgcagtctcaggctggcctgggagccactcagaccgtccacaggcaagatccagaggctgctgtctgca

SEQ ID NO: 6817122 - DNA, 93 bp, Homo sapiens
gagggtataaaggacttcagtttctaaagatgttcctaaatgctccgtggcatctgcagcaggatgtcgggagctggaatccactgtgctctc

SEQ ID NO: 6817123 - DNA, 64 bp, Homo sapiens
ctgaggcatgttacaggacataggaggagggacagccaccctgaatgtcctgttgctgccccag

SEQ ID NO: 6817124 - DNA, 56 bp, Homo sapiens
aagaagctactgtcactatcaggtagattccttgatggtgtaagactgtatttctt

SEQ ID NO: 6817125 - DNA, 108 bp, Homo sapiens
gtaacccccttcttcctctccaacctggctcatgcagaaccctgatcacagccagtggtgggcactgagctaggagggaaacgaaggcagggtgtggaggggggttat

SEQ ID NO: 6817126 - DNA, 55 bp, Homo sapiens
ggtggctcacgtctgtaatcccagcactttgggagtccaaggcaggcggatcacc

SEQ ID NO: 6817127 - DNA, 124 bp, Homo sapiens
cttccaaaagtctccttctggtgatgacttctcttgccctgtggggcctccagccagtaagaatagcggcaaatctgggggcttcatggggttgtgggcttagagctgggaacgggacaggaag

SEQ ID NO: 6817128 - DNA, 60 bp, Homo sapiens
gctgtgagcagtgtaagtactgggagtattgtcagtgtaaatgtttacattgctcgcagt

SEQ ID NO: 6817129 - DNA, 71 bp, Homo sapiens
tggttctggaggagagcctggtgtgaactacaaacaagccactgtgaataccaatgaatccctgagaatca

SEQ ID NO: 6817130 - DNA, 63 bp, Homo sapiens
atgaggaatggaatgccacttctgatattaggttacaaagactgtggcttccatctctctcat

SEQ ID NO: 6817131 - DNA, 78 bp, Homo sapiens
ggcaccctcttccccaacattctgcagctgggaggggccttgtggtcccatcacatggagagtgaagggcagggtgcc

SEQ ID NO: 6817132 - DNA, 66 bp, Homo sapiens
cctctgagagaaggccttcagctcagcagtgtgctcatgtgacaagggcttattcttagcaacagg

SEQ ID NO: 6817133 - DNA, 87 bp, Homo sapiens
acttttgcaattttttttcaaagttttggggtcttgcaaacacattgctacagctcctgccagggccttggaagaaaccttagaagt

SEQ ID NO: 6817134 - DNA, 126 bp, Homo sapiens
aggtttctgttgatgtattattgttgctatcatgtctattttacggtatctatttattgcaggccactcaattctttgtaataatgtaggatgataaatgagtgtgttaataaccaactagaacct

SEQ ID NO: 6817135 - DNA, 77 bp, Homo sapiens
gctggataatagtggaggcctgttgtgtgcattgtaggatatttagtagcatttctggcctctactcactagatagc

SEQ ID NO: 6817136 - DNA, 70 bp, Homo sapiens
gatgtggggtgggctgagttaggcctgaaatatgggcctccaggctgagtcctgccctctccaccacatc

SEQ ID NO: 6817137 - DNA, 128 bp, Homo sapiens
gtcagcactttaggcctctttacctcctgtcgttcctgagtgactctagaaagtttcttgagagcactgggcgagaggctgggaagtcacaggaaagaagcagagaggaggctggcctgcaggctgat

SEQ ID NO: 6817138 - DNA, 72 bp, Homo sapiens
gattgcttcaaactgagcttcaagtggcagctgtgagtgctgcacataaaaggtagcagtttgaaagtgatt

SEQ ID NO: 6817139 - DNA, 72 bp, Homo sapiens
acaatgtagttgtcatgagacaatagactatttgacttagcaagtcttcagttatattgccaagtatattgt

SEQ ID NO: 6817140 - DNA, 97 bp, Homo sapiens
taacacacctctacccaggttggagatctgtctatggcagtgcagaaattttcccagtcattacaagatttccaatttgaatgtattggtgatgttg

SEQ ID NO: 6817141 - DNA, 85 bp, Homo sapiens
acacctgtatgttgaggcacctcccagcaccatcagggagcatcttatgtttcttttgctgagaggggcacaagcccacaggtgt

SEQ ID NO: 6817142 - DNA, 58 bp, Homo sapiens
ctcacaggagtcataattacagtggaggcggcataccattgtagtgagagttctggag

SEQ ID NO: 6817143 - DNA, 76 bp, Homo sapiens
tctggaggctggaagtctgagagcaaggcattagcagggctggtttctcctgaggcctctcttcttggcttgtaga

SEQ ID NO: 6817144 - DNA, 62 bp, Homo sapiens
gcagagacaacaagtttaactattttctttccatctgatggttggactggtttggttttggc

SEQ ID NO: 6817145 - DNA, 67 bp, Homo sapiens
gggcttaatgtttgcatcagtttcccttgttctgtaagtcacatagggttggtgcacacatgggccc

SEQ ID NO: 6817146 - DNA, 74 bp, Homo sapiens
tgtcaacaatgtagctgcagatgataatgctggcattttattcatgaggaattatcaatgcaggttactggaca

SEQ ID NO: 6817147 - DNA, 70 bp, Homo sapiens
ggaggggtttgcaggggtggaggctgtcctgtgcattacagtatatttagcaacatccttggcctctgcc

SEQ ID NO: 6817148 - DNA, 69 bp, Homo sapiens
tctagccacctccctaacccttttggctccctaggatcaggggcctgggaatctaggcgagtggcctga

SEQ ID NO: 6817149 - DNA, 84 bp, Homo sapiens
aaaagagtctttggcttacatttacgtatattcaaagttcccttagtatagcaggggtgctgaataatgtgtaatgtctctttt

SEQ ID NO: 6817150 - DNA, 105 bp, Homo sapiens
cacagtgccactgtgttacataaaagcttgagccatgtaggagctttcttgtcattcagaacactgcagctctagcttttgacctcagatactttgttttctgtg

SEQ ID NO: 6817151 - DNA, 75 bp, Homo sapiens
tctaacagccaggggacactcctgcttgggctgagacttgtgcagctctagtaggaatgtccctctgtgcttaga

SEQ ID NO: 6817152 - DNA, 55 bp, Homo sapiens
aggtacataggaaagtggagctggaagtttcccacagctttgttccatattgcct

SEQ ID NO: 6817153 - DNA, 55 bp, Homo sapiens
ggctgtggggtcctgtggtgtgtggggagctgtcacatccagggtcctcactgcc

SEQ ID NO: 6817154 - DNA, 86 bp, Homo sapiens
gcatcctacactgagacccgaatacttccaagtgcagttttaacaatgcattattgtctggaggatttgttggttgtgaaggatgc

SEQ ID NO: 6817155 - DNA, 60 bp, Homo sapiens
tccaaacatctatcagcattttttactggatcactggaagatgcctttggcatttttgga

SEQ ID NO: 6817156 - DNA, 60 bp, Homo sapiens
agggaaactagactgcctttctgttccttctaagtgaggccttctcagtgtggtttcctt

SEQ ID NO: 6817157 - DNA, 61 bp, Homo sapiens
gccagtgcagaggtgcaagcatgtttgagacagctgatagttacctctgtccagaactggc

SEQ ID NO: 6817158 - DNA, 63 bp, Homo sapiens
tctctgtagacctgaccagcacgctgtctgtctccttgcggtccatggcaaggtctgcggggg

SEQ ID NO: 6817159 - DNA, 103 bp, Homo sapiens
cagtgtctcccctaaagtgagctccatacacatttatttggcctctttgtgattacatcgggataaatgagtgttatgcaggttccagtatagttttccactg

SEQ ID NO: 6817160 - DNA, 56 bp, Homo sapiens
ttgccttgttattctctcagaacggtccattctttcattgagagcattcgaggcaa

SEQ ID NO: 6817161 - DNA, 56 bp, Homo sapiens
gctggtcagggagggcacccatcagtagggtttatgggggtctcccctgcacctgt

SEQ ID NO: 6817162 - DNA, 84 bp, Homo sapiens
agctccagtttaacagttaagcagtcctgatatcagctacatcagaaatgataccagacatgtttgattcgatgatgggcagct

SEQ ID NO: 6817163 - DNA, 68 bp, Homo sapiens
cctttctttacggcacttataagacttaattaccaacggcaaagtcctttgaggccttggatgaaagg

SEQ ID NO: 6817164 - DNA, 79 bp, Homo sapiens
ggatgctttaatgggagtggcttggaaatcaaagacttcttatcaatgaaaatgactctggtcactccctccaagcact

SEQ ID NO: 6817165 - DNA, 71 bp, Homo sapiens
gctcccacaggtattctggccatgcgggcttggcactaattcaggagtctgtggctgagtcctgttggagt

SEQ ID NO: 6817166 - DNA, 82 bp, Homo sapiens
tgctcagataccaggccaacaaccatttgacatcactcaatttccgtatctgtcaagtctagttgctggcttttctctagca

SEQ ID NO: 6817167 - DNA, 58 bp, Homo sapiens
gcttctgtcctgctgtgccaagtgctggggcagacgcaggcacagagtggacagcggc

SEQ ID NO: 6817168 - DNA, 112 bp, Homo sapiens
atatcttcctcagagaaatgtctattcaagtcatttgctcatattttatttgggttgtcgttttgttgttgagtcgtagacattctttggatattaaacctttggcagatat

SEQ ID NO: 6817169 - DNA, 59 bp, Homo sapiens
aggaccgctctctgagaaacaaggacctagaggtccaggtcatcttggagagctgttct

SEQ ID NO: 6817170 - DNA, 126 bp, Homo sapiens
atgtaaagcacgagtaaatagaaatggtttacaggctgtaaagtaagaggtaagttaagtattcaattttaagttggcttcgttactttaaatgtgaactcccttcacctttcctatgcttgatat

SEQ ID NO: 6817171 - DNA, 123 bp, Homo sapiens
acctcaggcagcggctgtggcagtaagcccctcgggtgcgcacgcgctctgacctcttcccactgcctcgctggttgtcccttcgcggcgcgcgcccaggggccgttatacccctgcaacggt

SEQ ID NO: 6817172 - DNA, 61 bp, Homo sapiens
gtgtgctcagctcatttggataagcacgtggaataccttagttcagatggaaagagtatgc

SEQ ID NO: 6817173 - DNA, 71 bp, Homo sapiens
gatagcacaaagatgtcagtttgaaataacactttcataaaatgtttggtcaatggcatctttgaaatgtc

SEQ ID NO: 6817174 - DNA, 64 bp, Homo sapiens
gcttccaagcggtagatagcatttttctctcctacagcatgtttctctgatggcccttggaagc

SEQ ID NO: 6817175 - DNA, 76 bp, Homo sapiens
cccttatacttcgaaagttcagttgaaaagatcttgaagtcaatgtccagcatgacacattctcaccagtagaggg

SEQ ID NO: 6817176 - DNA, 60 bp, Homo sapiens
ttgtgagagtttaccttgaccaagcaccctcatgtcaatgtgctcatttgggcctcacaa

SEQ ID NO: 6817177 - DNA, 82 bp, Homo sapiens
tcagctgcttcccgctgctctacccatgcatctgtcttgctggacgttgcaggagagccggcccgatgcatcctcgtgctga

SEQ ID NO: 6817178 - DNA, 72 bp, Homo sapiens
ctggcagctgtgcttcattctttctgaggaagtaaaaaccacaaggaaatagaatgaagctacagaggctgg

SEQ ID NO: 6817179 - DNA, 71 bp, Homo sapiens
agggagggcctctgtgggtgctcacccttggagagggtctgtcaaaaaaaggccccagggaggctctccct

SEQ ID NO: 6817180 - DNA, 56 bp, Homo sapiens
ggaggaggcagatgtaggagaagaggacttctggctgctccttagctgcccctgcc

SEQ ID NO: 6817181 - DNA, 65 bp, Homo sapiens
tcctctaagacagggtctattcttagtcccattttgtggctgaggaaaccaatgctcagagagga

SEQ ID NO: 6817182 - DNA, 86 bp, Homo sapiens
gccccaacagtcttatctactcctgaatatatctagctagatttcacagactagtaggagataaaatcagagaggtaacttggggt

SEQ ID NO: 6817183 - DNA, 86 bp, Homo sapiens
gggaaggcggacagggctgtaagaggtttggaggctggtggccgtgttgtttgggtccttgtgtctctatggccctgcccctttcc

SEQ ID NO: 6817184 - DNA, 80 bp, Homo sapiens
acaatgatcagaattaaagtgccctatgtaaagcatttttcaggaagagggtagaggcattgcttaatttcagattttgt

SEQ ID NO: 6817185 - DNA, 59 bp, Homo sapiens
agcagagtatgatggaaagtctttggtgtaagaaaaacccatctgtgctcatatttgct

SEQ ID NO: 6817186 - DNA, 87 bp, Homo sapiens
gcccatgtgtctgagcagctggagaaataccacccttgatccactccctgggatggggttggaacctccactcagccaccagtgggc

SEQ ID NO: 6817187 - DNA, 99 bp, Homo sapiens
aattgctatgctggaagacaggtatcattatccacattgtaaaaataaattacaccaaatatgtgaggtatctaggtcttcgtcagttatacagtagtt

SEQ ID NO: 6817188 - DNA, 64 bp, Homo sapiens
gcagtgttcttgctgaggagtctgggcatgagcagatgctccaggccttctgaggacactctgc

SEQ ID NO: 6817189 - DNA, 61 bp, Homo sapiens
gtttcaaataggtttcagcaaagtaatttaattagaatttgaatgaacgcttatttgaagc

SEQ ID NO: 6817190 - DNA, 77 bp, Homo sapiens
agtggtcagctgtgttcagtgctactgagttgtcaaataagatgaagaatgaagagcccactgaatttagcaacact

SEQ ID NO: 6817191 - DNA, 65 bp, Homo sapiens
agaatttatccaggcttaatgggagccacctcaactgggagggtgttcctttccctgggaagtct

SEQ ID NO: 6817192 - DNA, 67 bp, Homo sapiens
ctctactcttctgcgctgccctgggagccacgaggtgctgctgggcctagcaacagaggagtcagag

SEQ ID NO: 6817193 - DNA, 59 bp, Homo sapiens
gggctgcagagggaggggctcgcagccagttgttctagctgctttccgtctgcagcacc

SEQ ID NO: 6817194 - DNA, 80 bp, Homo sapiens
cttacaagctttgccacattcttcacatttgcagggtttctctcccgtatgaattctcttgtgtatagtaaggtttgaag

SEQ ID NO: 6817195 - DNA, 59 bp, Homo sapiens
gtgagaggaaagatatatacttctgggtttgcaattttaaagatgtttcttttcctcac

SEQ ID NO: 6817196 - DNA, 87 bp, Homo sapiens
gtgcaacttaccaagcaactgccttcaatatttaacggctttcatatgaaagaggctagaggatgcaggattgtttgtaagttgtac

SEQ ID NO: 6817197 - DNA, 94 bp, Homo sapiens
gaggacttagattcaaatgatactgtttttagtcttgtttgttattgaatccttggataaaacagtatgattacctctagaatttaaagtcttc

SEQ ID NO: 6817198 - DNA, 74 bp, Homo sapiens
tgtagttaccagcctttgcatcccccatctgctcaagcaaattgaagagaagaggcaagtggttggcttctgca

SEQ ID NO: 6817199 - DNA, 65 bp, Homo sapiens
gtgctgggttccctgcctggccactctgaggtcagtaatgcaggtgggcaggtggcagcctggcc

SEQ ID NO: 6817200 - DNA, 64 bp, Homo sapiens
gcaaattaggttatgttggttgattgcagtgttcacagcttctaacatgtccctgattctttgt

SEQ ID NO: 6817201 - DNA, 86 bp, Homo sapiens
ttctaatgtatccccaaggctagcaagcagtagtcattcaactaacaattgtttgactagagctgcagcctaagcagtatgttgaa

SEQ ID NO: 6817202 - DNA, 87 bp, Homo sapiens
ttctctaagcaatctgtagaagatactctgagattgtgtgactatcctttttctcagtgtgttttctctcagaggatgctgcctgaa

SEQ ID NO: 6817203 - DNA, 77 bp, Homo sapiens
aggttgaggtggagaaggaggagggggctgctgtggcgggggcagaggcggcatccccacttcctcctgcccggcct

SEQ ID NO: 6817204 - DNA, 91 bp, Homo sapiens
acagtaatgactagaaaaacaattcagttttaggactggaaatgtcaaagcactctatcagcctttggatggtttttctatttcttactgt

SEQ ID NO: 6817205 - DNA, 105 bp, Homo sapiens
tagaatttatttcttgtaatagtaaccaattaaactagttaccagttggagagcatgttccagcacttaagttaattgaactgttgcaaacgaaatatgattcta

SEQ ID NO: 6817206 - DNA, 82 bp, Homo sapiens
gatctaagcttatcttaatctctgttggctttttatttatagatgaagaaactggaatatagagagcttaagtgtttagatc

SEQ ID NO: 6817207 - DNA, 76 bp, Homo sapiens
tagtggtgtcctttttgaatagagaccttatgttttgacgtagtcaaatccattctgttttaaaagtttatctcta

SEQ ID NO: 6817208 - DNA, 65 bp, Homo sapiens
tatgggcttcgtgggactgtcagttgggggaccctgccctctcttggccaagatacgagcacata

SEQ ID NO: 6817209 - DNA, 130 bp, Homo sapiens
gcccagaggatgctgggcgaggccaagtgaggcaggtctggcctcgggcacccccatcccctggcctggatggcacccctctgccaggcagcccgcggctctcgttccagaccaatgtcatccgcacggc

SEQ ID NO: 6817210 - DNA, 62 bp, Homo sapiens
tgcacatgaggagaccaaggcctgatgtttgaactcagccccaattctccccattcagtgta

SEQ ID NO: 6817211 - DNA, 59 bp, Homo sapiens
agagtaatgatgattgcatgtattttatactaaagatgtagatgtttggttattactct

SEQ ID NO: 6817212 - DNA, 117 bp, Homo sapiens
ccaggacagtggtcaggaacaggagcccggcacatgcagggttaaccctgtctctcttcactgccgctcagggtgccctgccaggatgtgccatctccatggtgaccgctgtcctgg

SEQ ID NO: 6817213 - DNA, 57 bp, Homo sapiens
gcaaacaaggacatacatcctgtgctcatacagccatgcaccatgtatggggtttgt

SEQ ID NO: 6817214 - DNA, 84 bp, Homo sapiens
tctcccaagagctgccactgagggtgcacagtgcaacagatagctctttcctgtgtccttttagttgctgtggccctggtgaga

SEQ ID NO: 6817215 - DNA, 56 bp, Homo sapiens
gtgctctgggtaaagacccactaccttgatagttgttcatctggaacccagagcgc

SEQ ID NO: 6817216 - DNA, 55 bp, Homo sapiens
ggcattactccaagtatttttggaagtcaactttcagaattgtctggggaatgtt

SEQ ID NO: 6817217 - DNA, 82 bp, Homo sapiens
ggacgccagccatctgcatgggtaataacacagggagcttccacatatagcacccacgtgttccaggcatggttctaagtcc

SEQ ID NO: 6817218 - DNA, 69 bp, Homo sapiens
actgtgactttgttctaatagtatctctctggctgaatgttgagaataaactagagctaggtcaagggt

SEQ ID NO: 6817219 - DNA, 118 bp, Homo sapiens
gctggcgcgctggcaggggcagacagatcagtgggcctggaggaggtgcccagatgggctggtgatcatttctgcccatctcctttggtctacttccaaccccccatccttggcaagc

SEQ ID NO: 6817220 - DNA, 80 bp, Homo sapiens
gcagattgcatttcattgggcaggaaagttgcttggtctctcggggctatttggccaagctgcccacaggtgcccactgc

SEQ ID NO: 6817221 - DNA, 63 bp, Homo sapiens
tgagaatgtatgtgcacgcatgtacatgcaagtacacgtgtgtgtttgtgcagtgcataatta

SEQ ID NO: 6817222 - DNA, 67 bp, Homo sapiens
gttataacgagaaatttgtctgttccatgggtacacttgcccatgcagtaaatgttctagtttgtac

SEQ ID NO: 6817223 - DNA, 58 bp, Homo sapiens
ggcgacgcatgtattgggattaacatgtaataaacttccttaatccatatgctttgcc

SEQ ID NO: 6817224 - DNA, 84 bp, Homo sapiens
actctactttcttgtttcttaagattgctttctctaaattgcgcttccatgagagctgtgttaagaacaggccacaagcagagt

SEQ ID NO: 6817225 - DNA, 78 bp, Homo sapiens
gaggtctcactatatatattgcattggctggtcttgagctcctgtgctcaagctgtcctcctgcaatattgggattac

SEQ ID NO: 6817226 - DNA, 93 bp, Homo sapiens
gagaccgtaatcactgagcagtggctgaagatgttcctggaaaccattctagccagaagccaaactgtgaatcaggaagatacgggacacctc

SEQ ID NO: 6817227 - DNA, 60 bp, Homo sapiens
aggcttctggtactctctctagggcctgttctcattctcttcagtgattgcagaaagcct

SEQ ID NO: 6817228 - DNA, 104 bp, Homo sapiens
gccctcgcccggcttgctgggagttgtagtctcttaactgctctaagccagtggcttgcagggctacaggactacaactcccaggatgcgccgggcgtgggggc

SEQ ID NO: 6817229 - DNA, 81 bp, Homo sapiens
tcctgtgcaccaggcccaccgcatgctcctgtgccatccccgctctgccaggtgctgtgcattgggccaacaggcacgggg

SEQ ID NO: 6817230 - DNA, 72 bp, Homo sapiens
tcagctatatggtcagtaacattctagatgtgaagtttctatctgggtctcagagtgaccatgtgtagctga

SEQ ID NO: 6817231 - DNA, 82 bp, Homo sapiens
cagtgtggcccgctccaagcttgatgggaccagaaatcctacaaaaaagcccttggtcccagtttgcttgagtgtcgtgctg

SEQ ID NO: 6817232 - DNA, 93 bp, Homo sapiens
ctccccattccctgagagcagggtctttctctccctctctgaagactaagccagagtaatgagactcacctttgctctgcagtaggtgaggag

SEQ ID NO: 6817233 - DNA, 58 bp, Homo sapiens
gggctcacccaactctggaaaatcatctgatgaagcctcagaggctgggggaatgccc

SEQ ID NO: 6817234 - DNA, 76 bp, Homo sapiens
aggatatgaagtttagaactataagagtgaggaatcttctctttctgactcttgcagttctaaactttatacacct

SEQ ID NO: 6817235 - DNA, 82 bp, Homo sapiens
cactgagtatgaaagaagataaaagctgtgtgttattaaaatattctgcattgacttttatttcctgtagatgtaatcagtg

SEQ ID NO: 6817236 - DNA, 93 bp, Homo sapiens
gaaaaatagtttaatttctgtagctgtgttcattttgcatatgttaaacggatgtaacatgcacccagggcattgcttcagagactatttttt

SEQ ID NO: 6817237 - DNA, 73 bp, Homo sapiens
tctgactatgatgtgtagtccacaattctggcaacatagcttgcctagaaatattttacagtcaaggttttga

SEQ ID NO: 6817238 - DNA, 60 bp, Homo sapiens
cttggaaagaatatatgatgcttttattactcatttgcaacatacagagttctatccaag

SEQ ID NO: 6817239 - DNA, 70 bp, Homo sapiens
ctgtctgggaagccatgtttctaggaggtcaaaattgtggtgtctgcagaagccatggccttgctcgcag

SEQ ID NO: 6817240 - DNA, 129 bp, Homo sapiens
gcagctggcacctcatcccccgctgcactaaatcgacacttctggaagtagcagcttcggagtgactgacgagagccattgcttgcccaagtgtcaatttagtgcagcaggggatggagtagcagctgc

SEQ ID NO: 6817241 - DNA, 75 bp, Homo sapiens
gggaccatctgagctgggtcttgacagctgcgtaggagtttgcagctggagatgagtgacgtgccccatggtccc

SEQ ID NO: 6817242 - DNA, 65 bp, Homo sapiens
cctgtccaaggaagggacatctcggcattgttgggctgctcagaatgtctgttctttctggcagg

SEQ ID NO: 6817243 - DNA, 58 bp, Homo sapiens
caggtgtcatcagagacaatggaagctgcagatgagcagttaaaccagatgacagttg

SEQ ID NO: 6817244 - DNA, 91 bp, Homo sapiens
gcctggaatccctctgtcgggcatctgttagagtctgtggatggcactctgtagtcgttatagatgcacccaggggaagattctctcaggc

SEQ ID NO: 6817245 - DNA, 67 bp, Homo sapiens
actaatccttaaggcttcagcattcaaaacatgtggcaaactgtttcatgaagtctggatatctagt

SEQ ID NO: 6817246 - DNA, 55 bp, Homo sapiens
agaaaccagggcttaccagtgcctaagatcacagagctggtaagaggaaggttct

SEQ ID NO: 6817247 - DNA, 66 bp, Homo sapiens
tcagcagcagctcagcatgtttactgcttaatcacttcatgcccaagaacacgtgggctgtactga

SEQ ID NO: 6817248 - DNA, 65 bp, Homo sapiens
agggagcattttgaaaattggagctttgacaaaactcccagggctttagatcctggtgtctctct

SEQ ID NO: 6817249 - DNA, 56 bp, Homo sapiens
tttgccattatgaaatgtacttggctagtgaggcctatacacttgtaatgagcaga

SEQ ID NO: 6817250 - DNA, 78 bp, Homo sapiens
gctactttgtcatctcacctttctctcagcactggcaagtcaggttctgcagctgaaaggactgaatgactcttgagt

SEQ ID NO: 6817251 - DNA, 59 bp, Homo sapiens
ttctaaaagatccatgggcagtcatggcagcctcatcctctgtcctgatcttttcagaa

SEQ ID NO: 6817252 - DNA, 56 bp, Homo sapiens
ccaggactcaatgaccacagggcctcagtctttctggcctccattgtatctcctgg

SEQ ID NO: 6817253 - DNA, 88 bp, Homo sapiens
gccagcagcgccctcccagccgtgggattctgagcaaagccccgccccgctgggcctcagtttccccggcctgggcgggcgcgttggc

SEQ ID NO: 6817254 - DNA, 56 bp, Homo sapiens
tcactgtgtccattgttatcacacccagtgagccaaaatatcagtgcatacagtga

SEQ ID NO: 6817255 - DNA, 61 bp, Homo sapiens
gctgagtaataactgtttgataaaggaagcatcacaacttccatctacaattattctcagt

SEQ ID NO: 6817256 - DNA, 85 bp, Homo sapiens
gcttgtgtcttagaggagctgacacccaacagcaaactaaaataaactccctaagtcagccatgtcgcttctcaggactataggc

SEQ ID NO: 6817257 - DNA, 55 bp, Homo sapiens
gtcagtctttataccattggtagcacaggcttgcacagtggtttccgattcagac

SEQ ID NO: 6817258 - DNA, 85 bp, Homo sapiens
cagttcctcctgagacatctctgctggtcacgtgttttgccttggatgtctctatggaagaccacagaggtgtgggagagagctg

SEQ ID NO: 6817259 - DNA, 60 bp, Homo sapiens
ctgtacaagtccttcatcagggaaaaacattgagtattccctgattaaggacttgtacag

SEQ ID NO: 6817260 - DNA, 71 bp, Homo sapiens
gggcgtccgggctgctgctgcggagggcaaggccgcccggccgctctctgggcgggagctaagaggcgccc

SEQ ID NO: 6817261 - DNA, 67 bp, Homo sapiens
ttcagagtttacagaaataagctgtatggttcattttcatgcctgcttgccaataaacatatctgag

SEQ ID NO: 6817262 - DNA, 63 bp, Homo sapiens
ggccagagaatatgccttacgtaattttggttctttatgttttctcaggtttgttttatggcc

SEQ ID NO: 6817263 - DNA, 66 bp, Homo sapiens
gtgcaactttagaccccaagtagctagagaaaagtttctctaggtgcctgtcgtctctggttacat

SEQ ID NO: 6817264 - DNA, 86 bp, Homo sapiens
tgctttataattattctttaaacatatatgttttatacagccttctaaataagtaatgtttgacaatgtgttgaaagggaaaagca

SEQ ID NO: 6817265 - DNA, 61 bp, Homo sapiens
ctcattattaccttttcttgcctactcaaaggatgctttcaggcagctggggtagttggag

SEQ ID NO: 6817266 - DNA, 73 bp, Homo sapiens
atctgtctggttggagaatcactgcaagccaaggcgtggcattggccaatggtgattcccggcctcctcaggt

SEQ ID NO: 6817267 - DNA, 56 bp, Homo sapiens
aatgagctagacctgcttcctcctctaccattaaggagctcacagtctaggtcatt

SEQ ID NO: 6817268 - DNA, 79 bp, Homo sapiens
gaaaagataattatttatttccaagactgagtttcagaaactcactggaatttcactggaaaagataattatttgtttc

SEQ ID NO: 6817269 - DNA, 70 bp, Homo sapiens
cttcttgtttaactagagcagtgttggaaaaataatttaacagaaattttagttagggggctacgggagg

SEQ ID NO: 6817270 - DNA, 92 bp, Homo sapiens
gaagtgatccttaaagctgcagtgaattcgctaactggatgacataccagagtggtgagatttctgcctgaagaagtgaagggtccaacgtc

SEQ ID NO: 6817271 - DNA, 58 bp, Homo sapiens
cccgaaggcggaggttgcagtgagccaagattgtgccaccattgcacaccagcctggg

SEQ ID NO: 6817272 - DNA, 81 bp, Homo sapiens
gggaggcagaggcagaggccggctggctccagccgtggtaccgcacggctgccaccctcggacttccgtcttgagtctcct

SEQ ID NO: 6817273 - DNA, 73 bp, Homo sapiens
aaagaagtgaggtggctagggaggcactctcaggaatgagaaggaccttcaccctggcctccttgttgccttt

SEQ ID NO: 6817274 - DNA, 79 bp, Homo sapiens
gtttcagcccaggtggagtgtgtggggattgggggttagaagcagtccccatggaaaacccacctagggaacaggaagc

SEQ ID NO: 6817275 - DNA, 56 bp, Homo sapiens
ggataacatttttaagaccaagtgctattttagcatgagcttaagggtgtatgttt

SEQ ID NO: 6817276 - DNA, 96 bp, Homo sapiens
gcttgcatgatcgccccattaggcagacaacgtagccggagatcacaaatcaggcccttggctgtagttgctagtgtgtggaggtgcagagcaggt

SEQ ID NO: 6817277 - DNA, 77 bp, Homo sapiens
gccaatggaatgtctcttgttgttgattttttaccatttagctttctaagtcataagtcaacaaaggagaagtgagc

SEQ ID NO: 6817278 - DNA, 78 bp, Homo sapiens
tatataattgttctgaagtgtttagaattaaaggggcatgatttctgcaacactcaaatggttcataacaattatgta

SEQ ID NO: 6817279 - DNA, 86 bp, Homo sapiens
ggccaccaggagcagtggtggtgtgttagagtgcagaggatgcttgcactcgccctggaacatctccgccagctcctgccgtggcc

SEQ ID NO: 6817280 - DNA, 63 bp, Homo sapiens
ggcatcaggatctgtcttgcttctgtaaatatttaaacactgggaggattatttttggtagct

SEQ ID NO: 6817281 - DNA, 84 bp, Homo sapiens
ttaaggaaaaaacttaacagcagtcagtgaatatttaaaggatggccatattatatatcttatggattgctttagtttccttga

SEQ ID NO: 6817282 - DNA, 56 bp, Homo sapiens
cccatccttcctgtctgagaagcgaaaacaaatgtacaatcagcagtaatggtggg

SEQ ID NO: 6817283 - DNA, 61 bp, Homo sapiens
gcctgaagggagagagaatagcctatggaaagacacagaggtaggcagcttgacccttggt

SEQ ID NO: 6817284 - DNA, 81 bp, Homo sapiens
ctttacatgattggatcaccatttttgtttcatttatttaaccaagagatggaatagaggtgctgatattattaggtgaag

SEQ ID NO: 6817285 - DNA, 59 bp, Homo sapiens
gcccaggggcgggtaaaaggcctccgggagcgcggggcccggacccagcctctgcaggt

SEQ ID NO: 6817286 - DNA, 77 bp, Homo sapiens
cagagggctccagcccactgcctctgtggtagccgctggctctcagaagtagcacgtgggcaggagtctctcctctg

SEQ ID NO: 6817287 - DNA, 73 bp, Homo sapiens
ataataacttcataccagtaaatcaatcagaaataaaatgaaactgaatgagttattaggtgtaagtgattat

SEQ ID NO: 6817288 - DNA, 71 bp, Homo sapiens
gtcagagctctgcagccagggagagaagaaaatgcctcattgttcggctccctgagctggagagactgcac

SEQ ID NO: 6817289 - DNA, 58 bp, Homo sapiens
tgtgggtccctaaacacatcccaatactggtgatgggtgctgctttagggggtcagca

SEQ ID NO: 6817290 - DNA, 60 bp, Homo sapiens
tcacttccttgcagctgtagaattcatggggactgtgtctttaaggccagcaggaggtga

SEQ ID NO: 6817291 - DNA, 60 bp, Homo sapiens
aggtgcagtggtgtggcaaagggcttcacaactaggtttatttgtgacaccattgtttct

SEQ ID NO: 6817292 - DNA, 55 bp, Homo sapiens
ttgatggccaccaccctcatgacatcatagatgacatcaacagtggtgctgtgga

SEQ ID NO: 6817293 - DNA, 97 bp, Homo sapiens
tgagtgtcatgctcataattattacttgataaacaattactgttaaataatcaaattaatagatgggtttaataagtggtatgttagtagatgctta

SEQ ID NO: 6817294 - DNA, 71 bp, Homo sapiens
gcaactccagaatcctagggtcagcggctgggctggccgttgatgattgaactgggattcttgtgacttgc

SEQ ID NO: 6817295 - DNA, 93 bp, Homo sapiens
ggtttcattcacttttgttcaacatcacttccaccttcccttgtgcttcaataagataatgggtgaggtgatagagcaaaaatgtccctggcc

SEQ ID NO: 6817296 - DNA, 101 bp, Homo sapiens
gtgtgtacacgtgtgtgtgtgcacgtgtatgtacccatgaaagatgtacatgagtaggtgggtgcatgtgagcacgtgcatgtgcaggcgaatgaacgcat

SEQ ID NO: 6817297 - DNA, 62 bp, Homo sapiens
cctgcgggaatggtttctatctccgtctgcgtttacgagtggtggtcagccctttctggagg

SEQ ID NO: 6817298 - DNA, 74 bp, Homo sapiens
gagaagtggtagctccaggctgtctgaacccagaacactgaagttcagaatatggctaggagtgctatgcactc

SEQ ID NO: 6817299 - DNA, 88 bp, Homo sapiens
gcacttgctctgggaaatggctacttgtcaaaataatgacggattcaaatctcaatggcgtgtagtcacatttccatagtaaatatgc

SEQ ID NO: 6817300 - DNA, 66 bp, Homo sapiens
gagtctactagctactcattcaaattctgaggataggattaggagggagaggcaagtaataacatc

SEQ ID NO: 6817301 - DNA, 55 bp, Homo sapiens
gcagggcttgaatcaaggaagtcttgataagggacttcacactctcaaccactgc

SEQ ID NO: 6817302 - DNA, 55 bp, Homo sapiens
accccagggctctaggaaaaaagaagtgattcagattccatagcaccctgtgggt

SEQ ID NO: 6817303 - DNA, 89 bp, Homo sapiens
gccctctgcctctggacccctgccttggccctagttcatggctcctctctgttggactgggatggccgaggctatagcccaggcggggc

SEQ ID NO: 6817304 - DNA, 58 bp, Homo sapiens
ggcaccctgatggccagattgtggagtgaagctctaagccagtgggccacagggagcc

SEQ ID NO: 6817305 - DNA, 92 bp, Homo sapiens
gagtacttgcatcaagttcacagcagcttgtctgttctttaagttcacaaactgacttaagggaaacttcatagctgctgctgtaagtactt

SEQ ID NO: 6817306 - DNA, 61 bp, Homo sapiens
aatggatctttgtaagacttcatcgccttgacaggaagtgaggtcctaatagacatcgatt

SEQ ID NO: 6817307 - DNA, 66 bp, Homo sapiens
attccaactcgatgctctcttgggtgtggggaagccccaagcaggatggaggttgagttacagaat

SEQ ID NO: 6817308 - DNA, 89 bp, Homo sapiens
agcaagtcaacacagatggagtttagcatccccagccctggagtttccactcagttcttgggctgctaggaccctgcattgtgcttgtt

SEQ ID NO: 6817309 - DNA, 83 bp, Homo sapiens
atatctgcatgcatagaatgaagaggctgaactgcatgatgtctaagtcttcacccagctctacgtttctatgaatcaggtat

SEQ ID NO: 6817310 - DNA, 57 bp, Homo sapiens
actcatggtgaacatgtctacttccctaaataaatagtttgtaagttcattatgagt

SEQ ID NO: 6817311 - DNA, 73 bp, Homo sapiens
cagatagttgagatcttttctttgtgaggtgacctaaatctttatttctgcagtgaatgactcaatagttctg

SEQ ID NO: 6817312 - DNA, 119 bp, Homo sapiens
ctgggagaagctcagaggctgtttaggaatccagatctagactgtcctggggccctacccagtgaaatttgtctcagtgtgattgatgggttttatacactgtcttgagcctttcctgg

SEQ ID NO: 6817313 - DNA, 68 bp, Homo sapiens
tgctaactctcctaaaggactatctacagggacctttcctatagaaaatccagtgtggggagaaggta

SEQ ID NO: 6817314 - DNA, 85 bp, Homo sapiens
attttctatcaccttttggataggagttgggcttttagagtaaacattttcatgagcctctgcttatgcaaaggtaatagaagat

SEQ ID NO: 6817315 - DNA, 93 bp, Homo sapiens
tctagaaggtgaagtaattcagccaaggtcacactgctagagagagacctaaatcagctctagacatcttggctgcaattaacactctcctga

SEQ ID NO: 6817316 - DNA, 129 bp, Homo sapiens
gaagcctgcaggggtggcgtgggaggggaaagaaaagatgaactgtcttcacccatggctagatccagaggctgaatgatgtcatcatgtctctctttcccttatcttggtcactcatctctgcttttc

SEQ ID NO: 6817317 - DNA, 103 bp, Homo sapiens
gctacatgatttccaatggtactgagtctaacattaacattaggtttaaacattaacttttgtagatcaagaatgtccacttgtccttggaaaattatttagc

SEQ ID NO: 6817318 - DNA, 55 bp, Homo sapiens
tttcctgagtcagagacaccagccaagccatgcccagattcctgactcagagaaa

SEQ ID NO: 6817319 - DNA, 77 bp, Homo sapiens
tatgtaatgttgtctcaagttatttgtgttttcatgctttacaattaattccaagttgagacatgcaaagatacata

SEQ ID NO: 6817320 - DNA, 64 bp, Homo sapiens
tcttggcagggctttgagcagagacttgtgtgtcaacaggatcatgctggctgccctgttgaga

SEQ ID NO: 6817321 - DNA, 85 bp, Homo sapiens
gtggcctggaactgatggaagatgtggttagagggagtcagtctgcctctgagtcatgcgcataggacttcagtcagcaagctgc

SEQ ID NO: 6817322 - DNA, 114 bp, Homo sapiens
tgttgcatgcatcttcatgtctccctttcatgaggcaggagctcagatgacatctcaggtgtgacgtcatgtgatgtcatgtgtgttctgtgagagggacatgaaaagccaaca

SEQ ID NO: 6817323 - DNA, 78 bp, Homo sapiens
agtttgaggagaactggtgttagtccttcttgggaattttggtagaattcagcagtgcagacacccagtcctcagatt

SEQ ID NO: 6817324 - DNA, 71 bp, Homo sapiens
tcgctcctgtcctccggagcgggctgtgcggaggcagccgggagaacagtcggctccgaggacaagagtga

SEQ ID NO: 6817325 - DNA, 87 bp, Homo sapiens
aagaggatgattatttgtgtaagatgcaatatggtagtaaaacttgcaatactttagtttgtattttatatttgggttattttgctt

SEQ ID NO: 6817326 - DNA, 56 bp, Homo sapiens
gatgtcggtgcaggagctgaaggtgagtggagtgctgccaagaatatgcccgactc

SEQ ID NO: 6817327 - DNA, 76 bp, Homo sapiens
gcagggctgagtcatatagccttcccacggctgcatattgtgtgaaaggacagggattatgactgacagcccctgc

SEQ ID NO: 6817328 - DNA, 80 bp, Homo sapiens
tacttgaaagtattcaatcccagaaagaaactggaatttacccttctgtttctagtttttgatgagaatgaatcttggta

SEQ ID NO: 6817329 - DNA, 69 bp, Homo sapiens
tggagtgtaagccattggagagaccagagattacactttttaaaaatctcctaaaatggcctgcctgca

SEQ ID NO: 6817330 - DNA, 78 bp, Homo sapiens
cctgcccattattcctttgaacttggggatattaggagaaagcaatgtatcctggcaagcagaggagaactgaacagg

SEQ ID NO: 6817331 - DNA, 65 bp, Homo sapiens
gtcatataacccactgctttggttctttagagaaaacgctgaggcccagagagtaggttagtgat

SEQ ID NO: 6817332 - DNA, 90 bp, Homo sapiens
gctcttgaagaaggattatgtgcagaacctgggcttcacttctgtttttgaaggggccccagctacacatgaggagaacttttccagagt

SEQ ID NO: 6817333 - DNA, 73 bp, Homo sapiens
tgcaagacacattgcttcctgtctggtttatactctctacagtgagtcaggcataggtaggatgtttctagta

SEQ ID NO: 6817334 - DNA, 56 bp, Homo sapiens
agggacttgggcaccaaggaaactccatcttttccaaaggaggctgccaagttcct

SEQ ID NO: 6817335 - DNA, 56 bp, Homo sapiens
ctgaggtgggagaggagaaagagagagagagtcctttaagtcctcttttatattag

SEQ ID NO: 6817336 - DNA, 63 bp, Homo sapiens
gatgtgcctctcttcatacatttgtcattcttgaacgattgtaaaatgaagtgactgcatatc

SEQ ID NO: 6817337 - DNA, 79 bp, Homo sapiens
tgtatatagaatacacagggaaagtttgagaagtgaaggactgacccctccaactgccgttctgtctattttatactca

SEQ ID NO: 6817338 - DNA, 109 bp, Homo sapiens
gtaacaaatggcctatgtgaactgaactgagctggtgaatatcagttaagaaaaggcagtcactgtgtgtttgtctagcacaggcagcatgtaggaccctgtaggttat

SEQ ID NO: 6817339 - DNA, 129 bp, Homo sapiens
ctcagcagggcccactgaggcttggtgaagcgccggcagggctcaggggccccaagctggtccaggggtatggtggccctcagccaggcccccgagtcgttggtggaggcctcagtgtggttggcaggg

SEQ ID NO: 6817340 - DNA, 84 bp, Homo sapiens
ggagatctcaagaaactgtagcaatgggtagaatggtgtgatgtttttaccaagaaattcgttacttagattttttccccctcc

SEQ ID NO: 6817341 - DNA, 73 bp, Homo sapiens
tcaagaggctagccggctcactaattagaccttgcaacactggttctttttagcttagcatggctgcttagga

SEQ ID NO: 6817342 - DNA, 76 bp, Homo sapiens
tcttagtttatttgttatgtttcattatgaaaagatattcatgcttattatagaaaatgtgggaaatgaaaggaga

SEQ ID NO: 6817343 - DNA, 80 bp, Homo sapiens
cgttagtggtggcttagatctattactgaatgagccctgtattcagaaatagaaaatttgattaaacgcttcatctaacg

SEQ ID NO: 6817344 - DNA, 89 bp, Homo sapiens
gggcaaggcattttacagatagatgataatggctttcagtgtttctcaaattggctcaaagcccatactgtgtaaattgctaaaagccc

SEQ ID NO: 6817345 - DNA, 67 bp, Homo sapiens
gagatggggtcttgctatgttgtccaggcttatctcaaacactggcttcaggcaatcctcccatctc

SEQ ID NO: 6817346 - DNA, 59 bp, Homo sapiens
gggagatgactcagtgacctcgaggccaccactaggctgtgggtgggtgggtgtctctc

SEQ ID NO: 6817347 - DNA, 70 bp, Homo sapiens
tggagaagcagttacagttttgaagcagggctttatttgatcctgtctcaaagcagtattggattcttta

SEQ ID NO: 6817348 - DNA, 72 bp, Homo sapiens
cggatgctaggctgtgtttcagaccctgttcacactctctttgtccatgggcccagacacagtcttgtgctg

SEQ ID NO: 6817349 - DNA, 68 bp, Homo sapiens
tctggaagtacttttgttgcctgcagcactagctcacctggcactgtgacagcaagagtgaggttaga

SEQ ID NO: 6817350 - DNA, 71 bp, Homo sapiens
gagataaggccttcccatggattattttgttccatctttgcaacaggcctatagggaaggcgctccatttc

SEQ ID NO: 6817351 - DNA, 60 bp, Homo sapiens
ttgcagatgtccacatcacacttcatgatggagttgaaggtggtcttgtggatgctgcaa

SEQ ID NO: 6817352 - DNA, 87 bp, Homo sapiens
gtccttcccagagctgctccagtgagctggccatcctcagaggagaaagggaggagccagagcactggggagccctggcagaggcac

SEQ ID NO: 6817353 - DNA, 64 bp, Homo sapiens
ccaaggcacactctgcaaggttgatctcagaaagaaatataatggtgtctgcagaggtacctgg

SEQ ID NO: 6817354 - DNA, 63 bp, Homo sapiens
agagtgtgaggtcctgggaactggaattcctgtcttcaggcagagtcagggggccccacctct

SEQ ID NO: 6817355 - DNA, 100 bp, Homo sapiens
ttcttctgggacagtaaaaccattttgagtttggaccaaaagatgaatacttttggtcatagcattcaaaatggaatgaatactgttccttccagaagga

SEQ ID NO: 6817356 - DNA, 82 bp, Homo sapiens
accactggcaaaacagttacgagcgcagaccttggggtcagacttgggtttgaatcctggctgtatgacttgccagctgtgt

SEQ ID NO: 6817357 - DNA, 56 bp, Homo sapiens
cctggctctgaggtatgcctggagcttgagtttgcagaggtgtacctggagcttgg

SEQ ID NO: 6817358 - DNA, 73 bp, Homo sapiens
cacaagtgattgtttttataaataggatctcctcaatattagtgatcctatattaagaaagatagtacatgtg

SEQ ID NO: 6817359 - DNA, 58 bp, Homo sapiens
tgagtggagatcgtgccactgcactccagcctgggtgacagagcaagactccgtctca

SEQ ID NO: 6817360 - DNA, 58 bp, Homo sapiens
gccacctcccaggacgaggctgtcgtgtcagtcccccagccccgctctcccaggtggc

SEQ ID NO: 6817361 - DNA, 116 bp, Homo sapiens
ctttgaatgcaatagagagaggcagatatcatgtatgaaaaagcagttgaaagatatagaaaataaattgagaactttcaacataatgcctgctaggatttctgaagagaatgaag

SEQ ID NO: 6817362 - DNA, 77 bp, Homo sapiens
gtcatctctttacttttgctgacacctgaataatcaaaaggtagaagaaagagtgagcaaaagtaaacatggttgat

SEQ ID NO: 6817363 - DNA, 55 bp, Homo sapiens
cctgagggcgtaattaacagtgtctttggagggactgtttgtgctgtcttcatgg

SEQ ID NO: 6817364 - DNA, 68 bp, Homo sapiens
gtggtgctgattgatacaactcaatccaatgcatatttattgggcatctactgtgtgataggcatcat

SEQ ID NO: 6817365 - DNA, 67 bp, Homo sapiens
agaaggccaggaaattatccctatgacgaactgatgatgtccaataggagactgttcttggcttcct

SEQ ID NO: 6817366 - DNA, 56 bp, Homo sapiens
agccaggaaaagagccttcactagaaactaactatgcaggaccttgatcctggact

SEQ ID NO: 6817367 - DNA, 111 bp, Homo sapiens
tacgtgccaggatcgcaaaccctttctctcagcaggaaagcatgcaagtcaaatgccatcataatcactttgtgtttccctgcagagggaaaggagggctccttgcatgtg

SEQ ID NO: 6817368 - DNA, 62 bp, Homo sapiens
ggcctggcttccaatctctgccaaaaacatgaatattgttcacagatatcagaagcacagcc

SEQ ID NO: 6817369 - DNA, 93 bp, Homo sapiens
actcttcacagtacctgctgcacttcaccactgtcctggtttgcctggtagaaaagagacagggtgggtgattaggttgacaaagtcgagggt

SEQ ID NO: 6817370 - DNA, 72 bp, Homo sapiens
gtgcctaaaggtagtctgctggtgtacttttacaaatagcaccattaacagaattttacatgcttaggtcac

SEQ ID NO: 6817371 - DNA, 85 bp, Homo sapiens
gagaatcacttgaacctggaggcagaggttgcagtgagccgagattgtgccactgcactccagcctgggtgacagagtgagtctc

SEQ ID NO: 6817372 - DNA, 58 bp, Homo sapiens
acccaggcgggagtgcagtggggtaaccttggctcactacaacctccgcctcctgggt

SEQ ID NO: 6817373 - DNA, 71 bp, Homo sapiens
aggctgaagttatctttttgttcatcattcactaaagtttgacctgaaacatgagttaaaagtaactgcct

SEQ ID NO: 6817374 - DNA, 56 bp, Homo sapiens
ctggcaagcgtgccactcctaggccagctccgggctaggctggcactcctggccag

SEQ ID NO: 6817375 - DNA, 61 bp, Homo sapiens
tagattatgagtagaatgcaaggccataaattgtatctgctgcaggctacttctgactcta

SEQ ID NO: 6817376 - DNA, 61 bp, Homo sapiens
gagtgtatggaaggaagagatttttagtaaaatcatgaaatcttttccaaaccatccactt

SEQ ID NO: 6817377 - DNA, 57 bp, Homo sapiens
attggtagtcctggatgcctctaggtggcagttcaagtggcatccagaactaccagt

SEQ ID NO: 6817378 - DNA, 75 bp, Homo sapiens
ggtgaaggaacactgtggttccatagcacaggctgactgctgtcaggtgggaagcacaagtgtttgcctcaaacc

SEQ ID NO: 6817379 - DNA, 61 bp, Homo sapiens
ggttagagtcactggggaaagagggctccttcctcccctctgcatcccatataattctccc

SEQ ID NO: 6817380 - DNA, 55 bp, Homo sapiens
ttgagatgcacttttgcacttgttacccaggctgagtgcaatggcgcaatctcgg

SEQ ID NO: 6817381 - DNA, 115 bp, Homo sapiens
gtggatatgggactgtcaactgtgaagggtttcactcagatgctaaagatggaattacacggtaactcgagttttaggtctggctctgcatacagttacatggttttaggtctgc

SEQ ID NO: 6817382 - DNA, 76 bp, Homo sapiens
tgatgacttgtatgttatagatttgtgattacattaaaacttaaaatttcacaaatctataatatgcaggtcatca

SEQ ID NO: 6817383 - DNA, 75 bp, Homo sapiens
gagcctctgtggcagggctctgctgtagtcctagtggtagccattggaacagtgggccttgcctgtgcagggttc

SEQ ID NO: 6817384 - DNA, 58 bp, Homo sapiens
ttcacacagcaactgtatgaattggttcctaccattatctgcattttgctgatgtgga

SEQ ID NO: 6817385 - DNA, 58 bp, Homo sapiens
atcctgtgtgccacctgcctgctgaaaaccctttgtggctctgtgtcacatacaggat

SEQ ID NO: 6817386 - DNA, 92 bp, Homo sapiens
gcctgactcttggcaagtgcttgatgaatgatcaatattattattactattgttgttattattactaagtcttcctaagaagagtcatgggc

SEQ ID NO: 6817387 - DNA, 76 bp, Homo sapiens
gcagcatgagctatacaaagtagagtggaattatcttcattgatttgaacacaatacttttgtagcctaatgttgc

SEQ ID NO: 6817388 - DNA, 83 bp, Homo sapiens
tgatagttggagctgcagtctacctggatttttatttaaccaagtgagtagatccaagactgtcctatagcttcaatcattca

SEQ ID NO: 6817389 - DNA, 79 bp, Homo sapiens
tttgaacaagttttcctttattgagtaccaacccatgtaatggtaacctggactttaataaaagggaaatgagtttgaa

SEQ ID NO: 6817390 - DNA, 62 bp, Homo sapiens
tgctgccttctaggcgtgccctgtgattagtttctcataggacggagagtcagggggcagca

SEQ ID NO: 6817391 - DNA, 62 bp, Homo sapiens
ttcaatgctcagtcctaccttggctcccattaaacatttggtgctctgtggattgagttgaa

SEQ ID NO: 6817392 - DNA, 116 bp, Homo sapiens
taggcaactcgcaaaaacttggtttccaatggtttaaagagtatgactttgactttaagcttggttcaaagtcatgatgaaccaccgtaaactgtttctccttctgcgagtgcttg

SEQ ID NO: 6817393 - DNA, 57 bp, Homo sapiens
ccaggttgctggctcttggcagcccgaagctgaactccgagctgagagtagcactgg

SEQ ID NO: 6817394 - DNA, 71 bp, Homo sapiens
ccagcattattcaccaagaatgatttcagtcactacaacttagtgcactaaagtgttggagaatgaggcgg

SEQ ID NO: 6817395 - DNA, 62 bp, Homo sapiens
attcagctctgaatcagcagactctcatttctctgagtcagttcctcatgatcaggctgagt

SEQ ID NO: 6817396 - DNA, 112 bp, Homo sapiens
ggcctgtgagtctccagatgaaaggtgggtttagatctacacatctcctgtttcagggcagtgagctgttttggacccatctctagtagaagtttcttggagctctccagcc

SEQ ID NO: 6817397 - DNA, 103 bp, Homo sapiens
gggatggtttatgtctgctcctcggccctgggagggaacccgcacaagagttgctaagcagctggtggagcctttctgttttaagccaggacactattgtctc

SEQ ID NO: 6817398 - DNA, 66 bp, Homo sapiens
aggttttggctctgcaggtttgcacccagctctgtggtgtatgccctcacaggtcacccaggacct

SEQ ID NO: 6817399 - DNA, 72 bp, Homo sapiens
ccagatgtggttttctgattatttgtagatatttttccccccaaacaaagagaatcaggcaaccaaatgtgg

SEQ ID NO: 6817400 - DNA, 70 bp, Homo sapiens
catttgttggttgctgtcttatccatgggtatgttccctttgttcctgactcagcgatgctcagcaaatg

SEQ ID NO: 6817401 - DNA, 96 bp, Homo sapiens
tatttgctagaacatagacacagtgttgacatcaaatagatatcttttttccaagaggttaagagaatgatgatcactggtttatcccttcaaata

SEQ ID NO: 6817402 - DNA, 67 bp, Homo sapiens
cctcaccacatgttaacttcctacagtgagttccagaattctctaagatggaaacatgtaggagagg

SEQ ID NO: 6817403 - DNA, 67 bp, Homo sapiens
tctgctttattacactagccaacctaggtgccacctggagtaataggaatctactgagtgaaggaga

SEQ ID NO: 6817404 - DNA, 63 bp, Homo sapiens
gagtttaacagccctccctccatcctgggcaccttaattccaggaagagacaggtctgtactc

SEQ ID NO: 6817405 - DNA, 84 bp, Homo sapiens
ggttccagcagctcaggctgcttcccattggttctcacacagtgtgcttctctgggtagagcaggctggggcttcagttgaacc

SEQ ID NO: 6817406 - DNA, 57 bp, Homo sapiens
tgtggaggcatttgcctcttctggtctccttacacaggctaggcatgtgctaccaca

SEQ ID NO: 6817407 - DNA, 92 bp, Homo sapiens
tcagcttcatggggaaaatggactgtttagaacacggaaatactgagccaaatgctacagcaatggttctaagagtcaagtctcagagctgg

SEQ ID NO: 6817408 - DNA, 59 bp, Homo sapiens
gggcactgggctgtggggtggagggacagtatcgtaaatcagagatggctccagtgctc

SEQ ID NO: 6817409 - DNA, 70 bp, Homo sapiens
gtgcatacatgtgtgtgcatacatgtgtgtgcacgtgtgtgtacacgtgtgtgtgcacgtgtgtatgcac

SEQ ID NO: 6817410 - DNA, 75 bp, Homo sapiens
ttttagcctataaaatggcatcagctccaaagttctctcctgatgctttgaagctaggctgtgcatatgctagaa

SEQ ID NO: 6817411 - DNA, 129 bp, Homo sapiens
gggactactagactgtatacttctgtatacaatttaggctgtatatactgtatacagtttgtgactactagactgtatacttctgtatacaatttagactgtgtatactgtatacaatttgtgactact

SEQ ID NO: 6817412 - DNA, 125 bp, Homo sapiens
ctgattaaggttttatagaggatctggggtggggttttaggctgctgcaaattgacctaagccaatttggtcatgcaaaactattaggctctttttgggaaacttctgtagcctccagtaattag

SEQ ID NO: 6817413 - DNA, 55 bp, Homo sapiens
aacctattctgtaagacatgacttgtaaacaaactctaagccttgcagatgggtt

SEQ ID NO: 6817414 - DNA, 80 bp, Homo sapiens
ggctccacgcttcttcagtggccagctggttgtcagaaacataaacgtaactaccagtcccaaggaggaagcagtctgcc

SEQ ID NO: 6817415 - DNA, 74 bp, Homo sapiens
gcataaatgatgaaccgcttcatggtgcctgtagaggcctcttgcagagcaccctgcagtggtatggtttgtgt

SEQ ID NO: 6817416 - DNA, 74 bp, Homo sapiens
ccattcatagcatatgcttttagctctgatgagaacagtgctgttcttcagatcctacaagtctgcaagattgg

SEQ ID NO: 6817417 - DNA, 72 bp, Homo sapiens
tacccaggacagaacttgctggacagcagatggccatgccgatcctctgaaacagtggttcttcactgggta

SEQ ID NO: 6817418 - DNA, 130 bp, Homo sapiens
aatgctttgaaatgtgacctgcaggataagtactgaaagaggctagatttcttttcagtgtgaactcaaaccatcattgcctcaggcctttcttcagagcttcaaagttctgcaagtcactatcacatct

SEQ ID NO: 6817419 - DNA, 65 bp, Homo sapiens
cttcatgaagacctcacagtggaaataggtgattttggtctagccacagtgaaatcttgatggag

SEQ ID NO: 6817420 - DNA, 76 bp, Homo sapiens
tttgctagctgctgtggattcagagatgaaaagacatagttccttttattcacagaatttacaggagtgatacaaa

SEQ ID NO: 6817421 - DNA, 104 bp, Homo sapiens
aagatccctggtaaatctgttttgtaatgttgagtgaaattccctcaagagattctgttcatatatctgcaaagcagtatttaccaccaacaaatagggatttt

SEQ ID NO: 6817422 - DNA, 112 bp, Homo sapiens
actcctggttaattctaagctattaccttcttaggccattgatttttataagttttaacttggatttttaatattatcagtaggtaaaggtcatactgtataagactaaagt

SEQ ID NO: 6817423 - DNA, 63 bp, Homo sapiens
tgaatggtgattggtgcttctccaaagacttgaagattgagaggcaaatagatagtccataca

SEQ ID NO: 6817424 - DNA, 91 bp, Homo sapiens
cagcgtggcgtaccttgggcacactgaatctgctattgggtacaacttcaaaaccaaagccagggacagtgtgcatgcgtgtgaaatgctg

SEQ ID NO: 6817425 - DNA, 65 bp, Homo sapiens
caggtgagttttcctccttggttgtctaatttaacattccaaaatgggaagaaaaccagcatctg

SEQ ID NO: 6817426 - DNA, 59 bp, Homo sapiens
gtggtgcatccttgagtaagcttcataattcatgtgcaaagcttggtttggatgatcac

SEQ ID NO: 6817427 - DNA, 56 bp, Homo sapiens
ttgatttattgagtgcttagtatgtgccagacactttgccaagctctttagatcga

SEQ ID NO: 6817428 - DNA, 55 bp, Homo sapiens
ttttttttcctctgaagtccttgtcctttattgggcaaggggtgagggaagcaga

SEQ ID NO: 6817429 - DNA, 73 bp, Homo sapiens
tggaggcagagaagggacaggaaagaaggtggccaatgactctgtggccttgctgtgcctttgtctgcctcca

SEQ ID NO: 6817430 - DNA, 56 bp, Homo sapiens
ttggacgctaaactctgtgagcgtgaagttcacgcctcatttatttttgtgtccaa

SEQ ID NO: 6817431 - DNA, 55 bp, Homo sapiens
atggcacctgaggaggcatctggaggttggggcccctgctctcccttctccccat

SEQ ID NO: 6817432 - DNA, 76 bp, Homo sapiens
gtcaaaagatgggtaatgtgcctgtgtatgtgttcatcagaccctgacgcacctgcccggggacattcctttagac

SEQ ID NO: 6817433 - DNA, 57 bp, Homo sapiens
ggaggctctacaggcacttctgaaacatgctcggacatggagtgtcagggcccttcc

SEQ ID NO: 6817434 - DNA, 67 bp, Homo sapiens
aattacatagaacttcgatgtcttttgtttcatcatcattgggcattttagttgctatggaataatt

SEQ ID NO: 6817435 - DNA, 67 bp, Homo sapiens
ataaattgcttctacacatccctcttgctttttaatggaaagaaaaggggtggagtagatctcttat

SEQ ID NO: 6817436 - DNA, 81 bp, Homo sapiens
gccaaggctggggctgggcgtgccctagtcatgaccccagtacactggggaagctgagaggcagccagaccctcccttggc

SEQ ID NO: 6817437 - DNA, 119 bp, Homo sapiens
gcaataaatattattaggctagtgcccctctgtacatattcaagcacttctagaagataagttcctggaagcagcattaatgagttagcggtggctacatatgccgtggtgatagctgc

SEQ ID NO: 6817438 - DNA, 99 bp, Homo sapiens
ggcatatataaaattaaacggtacctgatcgatttttttcatctttagaattgatgtcagctcccaaggataagagagtctgaattgtacttgtatgtc

SEQ ID NO: 6817439 - DNA, 78 bp, Homo sapiens
ggggggcagttttccactggacagctactccatgtcatcttgagtcagctggtgccactcagtcaaagaccgtccctt

SEQ ID NO: 6817440 - DNA, 60 bp, Homo sapiens
cagtactttgcatcattccactgccttctgtcctaattgtttatgatgcaaagtcagctg

SEQ ID NO: 6817441 - DNA, 67 bp, Homo sapiens
cttctctgttcttatgtttgagagtccttgatatacaggtggcatttacaccatgggactggataag

SEQ ID NO: 6817442 - DNA, 112 bp, Homo sapiens
gggagctgaaggctgacatgacagaggctgcagtgacaggggacgatggttggcatgtggcaggcatgtggctagtcctctgcggcagccaggtagggtcacctccagcccc

SEQ ID NO: 6817443 - DNA, 130 bp, Homo sapiens
gcccccaaagagtgctgaatttttgttgcacatgcttaaaaatgcagagagtaatgctgaactcaagggtttagatgtagattctctggtcattgagtataaccgagtaaacaaagcacctaagatgcgc

SEQ ID NO: 6817444 - DNA, 124 bp, Homo sapiens
ggggaccctgggggctcaggatccagcaaggggcggcaggagtaaaggaggaaggaatgacaggtgcaaataccttcccaccaaagcccttgttgccctctggctcctccccagagttgtcccc

SEQ ID NO: 6817445 - DNA, 77 bp, Homo sapiens
gaagaaacaacaggtgttggagtgtgaaaaattatttcaaaacattgactattttttatagattccattgtttcttt

SEQ ID NO: 6817446 - DNA, 65 bp, Homo sapiens
ggaagtaggtagtttccccaatttatagctgaggcaactgagctcagggaaattcacttgcttcc

SEQ ID NO: 6817447 - DNA, 90 bp, Homo sapiens
tcagaagaccaggcagctgggcagactgcagtggttacttgtagacttgtaaacaacttctgggctgtccaaaactgcctagttttgtga

SEQ ID NO: 6817448 - DNA, 88 bp, Homo sapiens
tgatccatgtatgtgagctttgagatcattccaccaatgacacaaaaaggagagtgattatcaactagcttaggtaccgcaatggtca

SEQ ID NO: 6817449 - DNA, 65 bp, Homo sapiens
atagccagctactgcaaattccaatcccagaatcacattgctcccatagtggatcatctggctgt

SEQ ID NO: 6817450 - DNA, 83 bp, Homo sapiens
tgtatcaacaaactttaattgtgtgttaggccgaattcctatgtgaaattggtaacacaggcattaaagtttacaagagtgca

SEQ ID NO: 6817451 - DNA, 60 bp, Homo sapiens
ctaatgtcgctgaatagggggatgtcatgatgaaattctggcctatcacagtgattctag

SEQ ID NO: 6817452 - DNA, 100 bp, Homo sapiens
catggttctaatgagggtattctttattgtcatttgaagtaaaaatgcatttttcatgaggctgtattaatttgaccataaatatcttcttatttccatg

SEQ ID NO: 6817453 - DNA, 77 bp, Homo sapiens
acttgcttttgtctactagtcttctgctattccctggtttccaaataacactgatgagacagtagtataatgcaagt

SEQ ID NO: 6817454 - DNA, 76 bp, Homo sapiens
ctaagagaaaggtgcacttcttgctagtctttgtagtgtgaaaacttcaggacatagatggtaggagtatccttag

SEQ ID NO: 6817455 - DNA, 102 bp, Homo sapiens
ggcgcttcttggggctgggacaatagtgtgtggtctctcccttgttgcccggagaaagcaaggacagaagcccacacaggggtcttttgggtcatgaggccc

SEQ ID NO: 6817456 - DNA, 99 bp, Homo sapiens
gtttattgaccatattttcttgaaagagccctggttgaaaataactgtccccagtacaacagttgttatcagaaaggtctccctttgaatatgataaac

SEQ ID NO: 6817457 - DNA, 84 bp, Homo sapiens
actcaggcacttgatatcaagattattagggtcatgattgtgtttaagaccctaagacctcttgatgcttttacaagaatgggt

SEQ ID NO: 6817458 - DNA, 55 bp, Homo sapiens
gatcacatagacattagctccatttgtaattcttggactgtgtggaagtgtgatt

SEQ ID NO: 6817459 - DNA, 61 bp, Homo sapiens
ggaaagaccagaattatggactcaggaggcaacaaagtgagccctttctctctggctttct

SEQ ID NO: 6817460 - DNA, 110 bp, Homo sapiens
aagccctgcccaagaagccacaacccagccccagtacaggctccttagatttatctgcagcaaggatttagggacaagggtctggggttgaggcttctagggctgagctt

SEQ ID NO: 6817461 - DNA, 72 bp, Homo sapiens
taggtcctttggtgggggctgatgtaactgccagactgtggggcagcttaacgctcctaccagatgacactg

SEQ ID NO: 6817462 - DNA, 104 bp, Homo sapiens
ttttgaaatttcattttaatgtcaaatcagttttatcagagggaatcctgattagttgcagttgtttgtttggggatatttattgactttaaaagaaaacaaaa

SEQ ID NO: 6817463 - DNA, 73 bp, Homo sapiens
tgaaggcttagctggtttctcagcttcatgtttaacaggcccaaaatcaagctgttggctggctgagctctta

SEQ ID NO: 6817464 - DNA, 62 bp, Homo sapiens
cctgaccttcaagtctgttcttgctcatacctttcttaaagaaacacagtcttgtgggcagg

SEQ ID NO: 6817465 - DNA, 78 bp, Homo sapiens
gattcacaaataacaggtgcagagactccgccacctgcctccgtgggacatcgctctgtcacttttatttactgaatc

SEQ ID NO: 6817466 - DNA, 56 bp, Homo sapiens
caaatgttgactaagagggtttaagaactaagaggagaccctctagtttttgtttg

SEQ ID NO: 6817467 - DNA, 58 bp, Homo sapiens
tcatgtgttgcactgaggacctgccaccttatgtggtgtttttgccaaaaatgcatga

SEQ ID NO: 6817468 - DNA, 90 bp, Homo sapiens
ttggtggagtttattaaaatgtagatacctgcaaaatctgaatctctaagagcactgccagataatctgcatttgaacaagctcctccag

SEQ ID NO: 6817469 - DNA, 57 bp, Homo sapiens
gccaggaatgaaaggtcagggttggagacctcatgagtctgggttttcatttgaggt

SEQ ID NO: 6817470 - DNA, 66 bp, Homo sapiens
ccttggcttaggtcactggacctccaggactcacctggtgctgggcaccagtgcctgcaggagagg

SEQ ID NO: 6817471 - DNA, 55 bp, Homo sapiens
catgccttctctgtagtcccagctattcaggaagctgaggcaggagaatggcatg

SEQ ID NO: 6817472 - DNA, 63 bp, Homo sapiens
cttgtattgcagaataaaaagcaagtggcctagaattaggtaacttacatcattctgcacaag

SEQ ID NO: 6817473 - DNA, 89 bp, Homo sapiens
ctgatcagtgaaattgtgtcctgatttgacacaattaaacctctgctggccagattctgtcacaggaccccataattcattgtacttag

SEQ ID NO: 6817474 - DNA, 78 bp, Homo sapiens
gtgggtgatcagcaggtctcagcagctccttggctcctatactcctagaggagctggtgataccgtgggatgccctgc

SEQ ID NO: 6817475 - DNA, 67 bp, Homo sapiens
tcatagagttaagtgaaatgtaataatgaaactaatctcacagtttggttacacttctgctttgtga

SEQ ID NO: 6817476 - DNA, 67 bp, Homo sapiens
ggctccagggccagttctggagactcaagagtggcaacgttcctctccagcaaactggctatgagct

SEQ ID NO: 6817477 - DNA, 93 bp, Homo sapiens
cagaaaacctgactcaaatgggctttggccagtaggagctgtattggctcatattgctggtggtctaaggtggggtggcttccgggttgattg

SEQ ID NO: 6817478 - DNA, 67 bp, Homo sapiens
actgtccttccagggagcaggcagtgtgcactctcaggctgtgcattttggagggcctgttcgcagt

SEQ ID NO: 6817479 - DNA, 63 bp, Homo sapiens
ttttcttctcctccaagctcaggaggacgaatgcaattgtcttctgtgcaagagggagggaaa

SEQ ID NO: 6817480 - DNA, 58 bp, Homo sapiens
gccctctgccacaggacgccagcctcggcctcagagctgccggctgctgcagagaggt

SEQ ID NO: 6817481 - DNA, 68 bp, Homo sapiens
ggctcagtaagtcaggttcattttccattatttatggcgtattaataaatctggcatttgtctgagcc

SEQ ID NO: 6817482 - DNA, 64 bp, Homo sapiens
tggtggtaaaggcagcatttgaatccaggtccatttggctttggaatgtgctgttatagcagca

SEQ ID NO: 6817483 - DNA, 69 bp, Homo sapiens
atgagcactactaattagtttccataatattttctagaaatttgggagttgctagtgagttaagttcat

SEQ ID NO: 6817484 - DNA, 74 bp, Homo sapiens
gtctggacttaggggcagggactacaagagagaggactaccctctccttctgtagtccctgtccctaaggtggc

SEQ ID NO: 6817485 - DNA, 61 bp, Homo sapiens
agctgcagagaaaagaggctgggtttaatgctccaggtctcctcatattctgcctctagct

SEQ ID NO: 6817486 - DNA, 72 bp, Homo sapiens
ctgaggggcaaagcttgtatagggaaagataaatccgtggtgggttctggtttctgacaagtctgaactcag

SEQ ID NO: 6817487 - DNA, 76 bp, Homo sapiens
ttgaaaaatctctggactaatattctggctgcaacacacaggaaattgtgccctaacattgtccggaaaatatcaa

SEQ ID NO: 6817488 - DNA, 73 bp, Homo sapiens
ggcgtgctctagccttatagattttgctgccttttcaaagcagctcaaatcccagcgggctcctgagaatgtc

SEQ ID NO: 6817489 - DNA, 88 bp, Homo sapiens
caactactgtgctcatgtctcatctcccaattcatcacaaagccatatccttgctttaagatggcagatgagcttgttcatagagttg

SEQ ID NO: 6817490 - DNA, 66 bp, Homo sapiens
ttctataaggttttcttttgttcccttagaattcattggagggatgcagtaaaaactgtagtagaa

SEQ ID NO: 6817491 - DNA, 75 bp, Homo sapiens
tgagcaattaacaaatgtagctgtgatagcttctgcccagaagtcaagtccataattatttgcttacttgtctca

SEQ ID NO: 6817492 - DNA, 61 bp, Homo sapiens
ctgtgtctctacctccccatccctggctttttccctgaggatgtggtggtgagccatttag

SEQ ID NO: 6817493 - DNA, 62 bp, Homo sapiens
gtgttgactgaatgaatgaatgaagtggactggacattcagagattgttattcagacaacat

SEQ ID NO: 6817494 - DNA, 80 bp, Homo sapiens
gtgtgaagacagcacaggaccaaggaagctgtagtcttcagggagtacacagttcatggtggctggtggtggatgcacac

SEQ ID NO: 6817495 - DNA, 58 bp, Homo sapiens
cgaacatttttcaaagatgtgtgaatttataatttattatgtggatgaaagatgttcg

SEQ ID NO: 6817496 - DNA, 61 bp, Homo sapiens
aaggcatacctgaatgtttgtgggtggtgcaacttttactaactttcaggatactgctctt

SEQ ID NO: 6817497 - DNA, 81 bp, Homo sapiens
acaaaatgccaccttgtgtattttttgatactaacttgccttgtaagtacacactatgtattgtacacagtggcgtgatgt

SEQ ID NO: 6817498 - DNA, 75 bp, Homo sapiens
ggaggtggcatctaaacttgcatcattgtctttattcctttaatgcatagttgatgaggttgggtatccattccc

SEQ ID NO: 6817499 - DNA, 68 bp, Homo sapiens
aatccctggtgtgtctttttgtgtgtcccaatttccccttcttataaggacaccagtcacactggatt

SEQ ID NO: 6817500 - DNA, 55 bp, Homo sapiens
gggcagtgggaccaggcaccagacaagctgcccagtgccctgttcccacatgccc

SEQ ID NO: 6817501 - DNA, 56 bp, Homo sapiens
tctctcaaagtaaggtgtatacattatcctgttagtgttgcagttgtttttgagga

SEQ ID NO: 6817502 - DNA, 58 bp, Homo sapiens
ggaagcaggaggctggggtaaagatggagccgccttcccttccctcctgcctgcttcc

SEQ ID NO: 6817503 - DNA, 56 bp, Homo sapiens
gaagcataggatactcaaagtttggcaaaagctcaggaattgagatcctaggtttt

SEQ ID NO: 6817504 - DNA, 55 bp, Homo sapiens
ctttgtagaagcagggtgccctctgtgcccaagggagccactgctctctgctaag

SEQ ID NO: 6817505 - DNA, 59 bp, Homo sapiens
gcgcaggacgcccagttgcctttttccacctattcgggctcattctagggatcctgtgt

SEQ ID NO: 6817506 - DNA, 75 bp, Homo sapiens
atctcttggttacattggcagttttgatctggttttaatcaagatttcctggatgtaattcccataagaagagat

SEQ ID NO: 6817507 - DNA, 84 bp, Homo sapiens
tcattattatcactacttaatgtgaacagctatcttgtcagtgtatacatatactgattcaaagctgttggcttaatataatga

SEQ ID NO: 6817508 - DNA, 72 bp, Homo sapiens
tgaggctttattctggatccagagctgctatctggggcccagagcagcaggtgcttctggatcttgcactca

SEQ ID NO: 6817509 - DNA, 55 bp, Homo sapiens
gacacagggctgaggacacaagtaaagattgtctggctcagtttcagtcctggtt

SEQ ID NO: 6817510 - DNA, 70 bp, Homo sapiens
cctagtgtcttaatgaagtagattatacatttttatgaaccataatcagaattcatgaaagataactagg

SEQ ID NO: 6817511 - DNA, 82 bp, Homo sapiens
gggctttggagatgtaggcaggtggaggagtgaaggcccaaggatggctcttcagcccttccctgttttcatcagccagcct

SEQ ID NO: 6817512 - DNA, 95 bp, Homo sapiens
tgtgaatggacattatgtatgggaagaggcatggaaagtagtcatttcactttctttgttgtactttcctacagtcagcatgtttttcattcata

SEQ ID NO: 6817513 - DNA, 88 bp, Homo sapiens
accccagcaggacttcattgtagcttgactaattatatttgcaatgagtatatttccagatgaggttacattttgaggtactgggggt

SEQ ID NO: 6817514 - DNA, 62 bp, Homo sapiens
agaatctttctgaatgactgtgtttcccttcaaggtgggttggatagcatgcagaagaatct

SEQ ID NO: 6817515 - DNA, 84 bp, Homo sapiens
atgctattggctccttctaacatgtctttacattctcagatatttgatggcagacagtttgaaggcccaacaaaaatgtggtat

SEQ ID NO: 6817516 - DNA, 91 bp, Homo sapiens
cacagttctgatggctggaagtccaagatcaaggtttggtttcccctgaggcctctctccttggcttgcacacggccaccttattgctgtg

SEQ ID NO: 6817517 - DNA, 106 bp, Homo sapiens
tcagaagtaagattactaggatataagaagagtgagatgagcttaagactgtggatagatttcgctgcatctcaatcagtatctgaattcaagaatgtacttttga

SEQ ID NO: 6817518 - DNA, 71 bp, Homo sapiens
tcctcacaagtctcttaataagtaaatactgatgacatcctcattttacagataaagatgctgagtgggga

SEQ ID NO: 6817519 - DNA, 61 bp, Homo sapiens
gcatttcccctgcgagagctgctggagactcttcagagctgcccatgcaagggggttatgc

SEQ ID NO: 6817520 - DNA, 60 bp, Homo sapiens
attagtagcacacagagatcagagagacatcaacctctcctctctgcgaatgctgatagt

SEQ ID NO: 6817521 - DNA, 87 bp, Homo sapiens
tccaactgattttaatttagagaattagaacagtactcagtttgacagattgatgtatttattttctaaatgacccatctgttgtga

SEQ ID NO: 6817522 - DNA, 80 bp, Homo sapiens
ttctaccctctctgcccaagttccttagaggcatacaacaggcactcaaaggaagctccttgatggcgtaagagacagaa

SEQ ID NO: 6817523 - DNA, 67 bp, Homo sapiens
tagctgtttcagtgcagcagaaggcttcctttatgtctatttcaactgcagcattggaacatgtctg

SEQ ID NO: 6817524 - DNA, 79 bp, Homo sapiens
cacatacaaagattttcacagcaacactgtctgcaagagtcaaagctgtagacagcctgctgtggactgaaggtttgtg

SEQ ID NO: 6817525 - DNA, 62 bp, Homo sapiens
cttttcagtttccagctttgtcattctgtggcctttgctgtgacaatgctgggaagggttag

SEQ ID NO: 6817526 - DNA, 65 bp, Homo sapiens
atgtgtatggttgttgtagagagaacagtagaacagatttttctgtccaggcttactatatatat

SEQ ID NO: 6817527 - DNA, 65 bp, Homo sapiens
gaaagtctgcatacaggacatgcacaccagtaacttgatagtgtgttaaatgtcatgtaggagtc

SEQ ID NO: 6817528 - DNA, 67 bp, Homo sapiens
ggtccagatgcaggatgataggcaatggtggtgtgcttttgcttgctgggtcttgcatctgtggatc

SEQ ID NO: 6817529 - DNA, 78 bp, Homo sapiens
aggatggtggacggtgaccaagcatcaccgagcccttactaggtctcgggtaccatgctaggcacttccaccggtgct

SEQ ID NO: 6817530 - DNA, 63 bp, Homo sapiens
ctctgctgctttgccagtggaaatgctcagaagaaggtggaagaccattggcaggcagtggag

SEQ ID NO: 6817531 - DNA, 57 bp, Homo sapiens
ctgtcctgatggtgccactggtgtgtgatggcatcacctgtagcccaatcatggcag

SEQ ID NO: 6817532 - DNA, 57 bp, Homo sapiens
ggtgggagggtctatgatgggtagtgggggtagaggcctgtagatccttgagctacc

SEQ ID NO: 6817533 - DNA, 60 bp, Homo sapiens
tgctcatgacaggtgagtttttaggacctctggtctttcaactttctcttttcatcagca

SEQ ID NO: 6817534 - DNA, 84 bp, Homo sapiens
gagaagagtccactggcagtgagtcccggagaggcccgcctgcagcagcgtggcatcttccgcacccacttcctgctctttctc

SEQ ID NO: 6817535 - DNA, 57 bp, Homo sapiens
gcagcagcagggagtctgacttggtgctggaggacatctcaaggcccctgctcctgc

SEQ ID NO: 6817536 - DNA, 57 bp, Homo sapiens
tgtttccagaaggacaaagaaaagaaatacttttctccccagtctaatctggatata

SEQ ID NO: 6817537 - DNA, 99 bp, Homo sapiens
tctccttcccttgcaacacctgctctggggaagccagatgtcatgttgtgaggacactcaggcagcctccagagaggcccgtgtggcaaggagtggaga

SEQ ID NO: 6817538 - DNA, 68 bp, Homo sapiens
gacacttgccataaatgaaaatactgtcaacatgaatttaaatgaagtattctcatattggtaatgtt

SEQ ID NO: 6817539 - DNA, 58 bp, Homo sapiens
aggtaagtgtctgctggctctaccctaagtacaagggctacaactggctggcactcct

SEQ ID NO: 6817540 - DNA, 72 bp, Homo sapiens
gcttggggaatggccattccagattgctctgaagtgtgtgtctggacaggactatttctaacatgaccaagc

SEQ ID NO: 6817541 - DNA, 70 bp, Homo sapiens
agtggttcttatttatttcggttccttagaacatttttaaattgccttaggagctaattcataagccact

SEQ ID NO: 6817542 - DNA, 105 bp, Homo sapiens
gctgcttccatttgtctgtgtctctgactccatgccctcctcccccatgcagactgcagggagggctgccaggtggagcgggggcgtcccagtgcatggagcagc

SEQ ID NO: 6817543 - DNA, 67 bp, Homo sapiens
gtcaatcacgccaggaggaaaaatagtggcatgatttgttatctgttattccccttgctgtggtgac

SEQ ID NO: 6817544 - DNA, 80 bp, Homo sapiens
ggtagtcagggaaggttccagaagggggcgaggtgcacctgggccaatggccgccctttgccctgttttccctgtctccc

SEQ ID NO: 6817545 - DNA, 55 bp, Homo sapiens
gcttctcccatttcgctgctgagggctcacttgcaggacaacagagtgggaaggc

SEQ ID NO: 6817546 - DNA, 61 bp, Homo sapiens
gtggcacataggatcctgtggctagagtgcttactcatgtgacatgaaactgtgttgctac

SEQ ID NO: 6817547 - DNA, 58 bp, Homo sapiens
gcaggcaggtgagtcaaaacagacgaggaagctctgccttgtcacctcatcagctagc

SEQ ID NO: 6817548 - DNA, 60 bp, Homo sapiens
ggagttcaaaggcctgtggaaaggggagaatgcatgcctctcctaaagtcattgaatttc

SEQ ID NO: 6817549 - DNA, 58 bp, Homo sapiens
gggccaggcagtacagcagtgtgtgacacccctgcagctgctgggcctgccgtggcct

SEQ ID NO: 6817550 - DNA, 65 bp, Homo sapiens
tttaaaaggcagcttcttttgtcttatgtgcccttggctaggaaacaaaggaagtctcttttaag

SEQ ID NO: 6817551 - DNA, 78 bp, Homo sapiens
ggctggcaccttcctgggatgaaagcagcccactgtgctgcatgtgctctgaaaatctcagaagaaagtatgccagcc

SEQ ID NO: 6817552 - DNA, 81 bp, Homo sapiens
agtggttgggaagatggcaagaatggaacaggagagccgtggattcaggctcgtctgagttctagtctcaatcccaccatt

SEQ ID NO: 6817553 - DNA, 66 bp, Homo sapiens
ctttgccattatatcaaaacttaattcatttcagttttctctgaagttttgactaagatggcttgg

SEQ ID NO: 6817554 - DNA, 57 bp, Homo sapiens
acagtgctaatgatgccaagatcaagggtttaatccccttggcctacttagctttgt

SEQ ID NO: 6817555 - DNA, 56 bp, Homo sapiens
gttggtggatgtgggcagagcaggattagttcctttcttctgccctctcttctagc

SEQ ID NO: 6817556 - DNA, 130 bp, Homo sapiens
ccccctagagccattcatctttttatgtatgtgctctgtctctccaattagattataagctcttaagaaaaagacccttgtcttgattgaagagatagaaaaaatatttagaaatgtagctccttcatcg

SEQ ID NO: 6817557 - DNA, 58 bp, Homo sapiens
gtttttggctttagtgccttctgattcaacaccctgggtctagctgagagctaaaaat

SEQ ID NO: 6817558 - DNA, 105 bp, Homo sapiens
ggcttgtgaattgaggggtcaggattgggctaatgagtgggactaccaggcttacttattaccaccaatgccgtcacccctcctaccaccaccatcacaactgcc

SEQ ID NO: 6817559 - DNA, 78 bp, Homo sapiens
gaatttgttacagcagcaacagacagctaatacaaactttatttgtactaaatgtgaaatgctattgtgacaaatatc

SEQ ID NO: 6817560 - DNA, 73 bp, Homo sapiens
gcgggggcagactgggcagttccagtcctgatcattgacattctggtattcctgcccagattttaccacctgc

SEQ ID NO: 6817561 - DNA, 93 bp, Homo sapiens
gtcagaggatgggagttctgggggcgaccagggactgctgggtatagcagcagtcagtatgggtatcgcccatcggtatgacttctccctggc

SEQ ID NO: 6817562 - DNA, 61 bp, Homo sapiens
gcatcatttaattataggggctggtgggttaacgttccacagctctgttcatagatggtgc

SEQ ID NO: 6817563 - DNA, 125 bp, Homo sapiens
ggtcttgggctgctggtggctctctccacggagctaagcagccacctcatctccactcagcatggctgcagtgggtgtcttggctgtgagcggcccctgggagggtgcccaccacgccccatgcc

SEQ ID NO: 6817564 - DNA, 62 bp, Homo sapiens
ttcatttgcaaggtgataaaagaatgaatggaaatttacctatgagcacctctgtaattgag

SEQ ID NO: 6817565 - DNA, 56 bp, Homo sapiens
ctcagatgcatgagttcattaggatagatttatcctagtgaggcatggcacttgag

SEQ ID NO: 6817566 - DNA, 65 bp, Homo sapiens
cagcctctgaaagagtttagtattatagaattcttgagaaataatctgagctatttcatgagctg

SEQ ID NO: 6817567 - DNA, 104 bp, Homo sapiens
gaaggtgggggctctgggcgcctctgggtcttggtggaggtagggatggagcccttccctgtggcacacccaagccctgggaggtcaccagagccctgcgtttc

SEQ ID NO: 6817568 - DNA, 72 bp, Homo sapiens
tgctttgcttctttcatcttccccttgaggctggctcccaaggccatacaatgaaaggggcctgaaaaagca

SEQ ID NO: 6817569 - DNA, 75 bp, Homo sapiens
agggagattaaattatagctgtcgtagtacaaaattctagtaccaggtaccacacagatgctatttagtctctct

SEQ ID NO: 6817570 - DNA, 55 bp, Homo sapiens
gggagcctcccgggatgggggtgaagaggcacaaacccctctgggttttgttccc

SEQ ID NO: 6817571 - DNA, 55 bp, Homo sapiens
gtgtggactctctggtgcacagtaagctgtgagctgtcactaaaggctttcccac

SEQ ID NO: 6817572 - DNA, 78 bp, Homo sapiens
gttgaatatagaaacatcctgctttccatttgcagctcatagtactgcattgtgtggagatgcaggagttgatgcaac

SEQ ID NO: 6817573 - DNA, 130 bp, Homo sapiens
aaactagtcaggtgtatatgaggcatgtggaggaaatgagtgtacactgtaatgtacacattatattctctatgctgtgcatcatttcctccatatcgcacacattataatagaaaataatctgaatgtt

SEQ ID NO: 6817574 - DNA, 62 bp, Homo sapiens
catatatcacagcagtggagtggggtgacatttaagacactgatactctgtgattagatatg

SEQ ID NO: 6817575 - DNA, 65 bp, Homo sapiens
ccgtgtttggggatgtgctgagagtgcggagcctgataaatatccgtccagaagtccctgagcgg

SEQ ID NO: 6817576 - DNA, 69 bp, Homo sapiens
gtgggttcttggctaggccctggggatgcaatggtcaataagttatcctccagccctctaggaaaatgc

SEQ ID NO: 6817577 - DNA, 65 bp, Homo sapiens
atgggaactagaacagaaagtacaggaaagatatcctctctttcttacaacctgatctaactcat

SEQ ID NO: 6817578 - DNA, 93 bp, Homo sapiens
gtggggtaatgggctttgctgcaatatgaaaatctatcaaatgggtaaaatcaatgacattgtatcagagttcatgaaaagtgcctactgcac

SEQ ID NO: 6817579 - DNA, 104 bp, Homo sapiens
gagacattcatggcctcaggttatcagcaagttttatagaacctttaccattttagactctagtgaggctgacggcttgcttgtatctgtaatccccatgtctc

SEQ ID NO: 6817580 - DNA, 82 bp, Homo sapiens
tgaaaagtgcagggtgctctggtatgtctaagaatgaacaaagtctacaattctgtaagatgctggcctcctgcagttttta

SEQ ID NO: 6817581 - DNA, 95 bp, Homo sapiens
gggggtggggtcccaccaggtgaccatttcatgtgaggtaaatggagtcagtcagatgaagtcacttgtcacctgcctctgtgaagcctccccct

SEQ ID NO: 6817582 - DNA, 59 bp, Homo sapiens
ggcagtgtggctgagacagaggctggagtggatcctggggcactgctgggccatctgct

SEQ ID NO: 6817583 - DNA, 64 bp, Homo sapiens
ttctcttcttgattttcactggatagctcctttcaggccgtttataaaagaatcaggaaaagag

SEQ ID NO: 6817584 - DNA, 77 bp, Homo sapiens
tagtcttaaaactgattttaacattgatattagagcaaaatatcagtattagctggataaagtaggtgataagagta

SEQ ID NO: 6817585 - DNA, 79 bp, Homo sapiens
gtgtgtgggttacaggagtgtacgtgagtgtatttgctttgtgagcattcgctgacttgcacatttgggatttgcacac

SEQ ID NO: 6817586 - DNA, 71 bp, Homo sapiens
gtccagcacagttgccattagccacatgtggcttttgagctcttggagtgtggctaatgcaattgaaggac

SEQ ID NO: 6817587 - DNA, 81 bp, Homo sapiens
ctgtagaaacatgtttggatgttctgtaagtgtctataaaaacagatagattgcagacttacttcgagaaatgtgctacag

SEQ ID NO: 6817588 - DNA, 90 bp, Homo sapiens
aggtcacacagctaaatgcgaacacacttgggagttctgagagctttctgcttcagctcttgggttgttttattttcctattgtgcatct

SEQ ID NO: 6817589 - DNA, 79 bp, Homo sapiens
gtcaacaatgctttgagagtgaagatcagaagacaaaaatgacacttaggaacttggcttgcatggctgaaattgtgat

SEQ ID NO: 6817590 - DNA, 78 bp, Homo sapiens
tgtgtggacatggcctcaatgcagctgctgcctgggtgtcttggaggcgcccatcggtgcagagggcacatctatata

SEQ ID NO: 6817591 - DNA, 58 bp, Homo sapiens
cggtcttcagggtatgggaaagggactcttctgtgccttcttggtcccctgggtcctg

SEQ ID NO: 6817592 - DNA, 81 bp, Homo sapiens
accaccctgcgtcctgtgcctggccaaaagctcataaaaccaaaacagggcaatgtccatggaacaggactacaatttggt

SEQ ID NO: 6817593 - DNA, 79 bp, Homo sapiens
gatacccgtctctctgctgctacagactctctagggatgggctctggggaaggctgctggcatgcagctggaccctgtc

SEQ ID NO: 6817594 - DNA, 61 bp, Homo sapiens
gggggtctcatccaacagcctacaaaacccttatttgactctgtccccagtgagcaccccc

SEQ ID NO: 6817595 - DNA, 62 bp, Homo sapiens
ctcacctgcccccttgagattctgattcaactgagctgagctaaggcacaggcaggcttgag

SEQ ID NO: 6817596 - DNA, 106 bp, Homo sapiens
tgttcccatgtcagaagccatctctaggtatcaattaaggtttgggagagagcttgcagccatatctctgctaagattgtgtctagtggtgttggtgatgggaaca

SEQ ID NO: 6817597 - DNA, 63 bp, Homo sapiens
gctgcatattttctgattcagaaggtctgaggtggcatttctgaattcctaggatgttgcggc

SEQ ID NO: 6817598 - DNA, 60 bp, Homo sapiens
gttaaatggggatgagtagatggaactatttgaaagtgccaatatttaacccgattttac

SEQ ID NO: 6817599 - DNA, 62 bp, Homo sapiens
gctcgaggctgcagatgccaccactgttgggagctagcagtgacagggctgctgccttgggt

SEQ ID NO: 6817600 - DNA, 56 bp, Homo sapiens
ccagggaggtggtcggggggcaagcggttttagccccagctttccacttcctctgg

SEQ ID NO: 6817601 - DNA, 66 bp, Homo sapiens
gctgaaaagataatttgagtaaattaatttaggctggagagttagtcatgactcagattattcagc

SEQ ID NO: 6817602 - DNA, 65 bp, Homo sapiens
ggggaggtgtccaagagtcaagaagggggcggagggacaccccatggcctcatttccacctcccc

SEQ ID NO: 6817603 - DNA, 118 bp, Homo sapiens
ctgtgaccacacccccttcccaatatctacttgagcaggcctgcaggtatggccgggctgaggagtcaagctctgcgggctccaagataatgttaaggaagaggaggaagggtaacag

SEQ ID NO: 6817604 - DNA, 84 bp, Homo sapiens
tatcacttgaccttcccatttctgagaagtgcctggtctgccgtgtatagcaaactgcacttacatagaggaggctaggtggta

SEQ ID NO: 6817605 - DNA, 71 bp, Homo sapiens
ctggggacaggagacttacagctacctatgtgtggatgccatccttaggagcctgagtcaagggttcccag

SEQ ID NO: 6817606 - DNA, 78 bp, Homo sapiens
ttcattattcagctggtgattttggatctttacatgtaattatctcagggttctgtgttataatactgttatgatgaa

SEQ ID NO: 6817607 - DNA, 57 bp, Homo sapiens
aggtaggaaagtctccttgtattgaccagcgacaggcgcaagaggatgttctggcct

SEQ ID NO: 6817608 - DNA, 113 bp, Homo sapiens
cttaactagttttcatgttgttcctaattttaactaggacatgcagaatcacttagtgtgagctaagctgtatttagttaaaatgctaagaattatctgggtgcaaaattaag

SEQ ID NO: 6817609 - DNA, 67 bp, Homo sapiens
ttcacgtgtctcggccaaggcgagcatttccacaatgccgtggatgctgcagtcaggccagattgaa

SEQ ID NO: 6817610 - DNA, 105 bp, Homo sapiens
gacctgaccctcggggatccatccacgtggcccacccaagtaatgcaccttttagaatatttgctgaaataactgccacctggtggcatcttctgggtcaatgtc

SEQ ID NO: 6817611 - DNA, 129 bp, Homo sapiens
tgtgcaaggcaagtaagagaaactaaaaggtgtggagggagttaaggatggctggaggcgtaggtagaaactagaccatgcaaggcattgttgtccatgcttaggagtttcagttgcatcctatgagcg

SEQ ID NO: 6817612 - DNA, 95 bp, Homo sapiens
gcctgtgggagggagtgggctctggtggcaacattgctggagtggggaaatctgagttctctagtcctgaccttgccaccagccatctctagggc

SEQ ID NO: 6817613 - DNA, 88 bp, Homo sapiens
cggctctccagcctccatctgatccatgtctcctggacttgtgagcggcgtgctcaggagacaaagggtgcggagaggctgggggccg

SEQ ID NO: 6817614 - DNA, 98 bp, Homo sapiens
gaaaggtgctgttttcagaatctgggataagaccacagatttcctcttactagctggctgatatttgggtctgtccctgagcctcaatttaatctttc

SEQ ID NO: 6817615 - DNA, 78 bp, Homo sapiens
tgggagaacaagattgacggctttgagtgctttaccaagaagatagacaacagggcactcagctcaatttctcagcca

SEQ ID NO: 6817616 - DNA, 82 bp, Homo sapiens
cttgttttattcttgctatctcagatttatccttgaggcctcaggttcaaggcatacatttagaagaggagagtgtaccagg

SEQ ID NO: 6817617 - DNA, 55 bp, Homo sapiens
accagtaagatcctgtacatactgtacatactccaggtccagggtacttcctggt

SEQ ID NO: 6817618 - DNA, 69 bp, Homo sapiens
ggaagggtatcttaaaagttatgggatgctctgggtctagagtcttcttgatcttttcagtgcacatcc

SEQ ID NO: 6817619 - DNA, 58 bp, Homo sapiens
acccaggctagagtgcagtggtatgttctcggctcactgcaacctccgcttcccaggt

SEQ ID NO: 6817620 - DNA, 55 bp, Homo sapiens
tgttaggcccatctctgaaggtctgtcacacccaagggacagctggggcctggca

SEQ ID NO: 6817621 - DNA, 117 bp, Homo sapiens
aagcatgtatgagaaactggtgtttaccattgaaagtagaatgtatgtggagtgagtacttttccatttcactttatgtaccctctttgaattttaaaacatgggcatatattgctt

SEQ ID NO: 6817622 - DNA, 67 bp, Homo sapiens
gggtgaggctgaaggtggcgtacaggaaacatggtgggcacacttctgtggccccttcgccccactc

SEQ ID NO: 6817623 - DNA, 67 bp, Homo sapiens
ttcatagcaatgatgatcgctttggcagattccagcatctaaaagcctgtctggtcatagctatgga

SEQ ID NO: 6817624 - DNA, 82 bp, Homo sapiens
agttctagggtacatgttcacaacgtgcaggtttgttacatatgtatacatgtgctatgttggtgtactgcacccattaact

SEQ ID NO: 6817625 - DNA, 66 bp, Homo sapiens
gggtcacaagttggggcttgggactggtctctcatatgggagtgctgtaggactgagcccttgccc

SEQ ID NO: 6817626 - DNA, 61 bp, Homo sapiens
cggcttctcgggtcggattccgcggtcccaacccttccccatggccgaccctgaggagttg

SEQ ID NO: 6817627 - DNA, 77 bp, Homo sapiens
agctggtggccttaccttggggccctctgtgagccctggatgagtggccccacagtagggcttagagtagaccagct

SEQ ID NO: 6817628 - DNA, 62 bp, Homo sapiens
ggcatgctctttatattgcaatgcaatcagtaagcatagacttgcaatataaagagcatgcc

SEQ ID NO: 6817629 - DNA, 89 bp, Homo sapiens
gacgcctaccaagcagcttaaagtgttgtatctccatttgcatataacctgaatacaaatgcaattcaatgcatattttaagttgtgtc

SEQ ID NO: 6817630 - DNA, 94 bp, Homo sapiens
tcagtaagtgtttgaatggaattggaagtaaaaaagcaaattcattcatacaacaggttttcttaatttgagttccactaataatacttgaaga

SEQ ID NO: 6817631 - DNA, 78 bp, Homo sapiens
gagcagctgcagccatgtttctgctttcatgtcttggggatctcgtgcatgtgtggaggagatgtgctggagaagctc

SEQ ID NO: 6817632 - DNA, 63 bp, Homo sapiens
ggcgtggggcgggtggacacttgcggctgtgttctggaagcaaggtcatttctgttccatccc

SEQ ID NO: 6817633 - DNA, 86 bp, Homo sapiens
tcttacaaaccatttgtttcttctttaaaatgttaaaggtttgtaaggaatgcctttggccgctttatggaggactggagtgggga

SEQ ID NO: 6817634 - DNA, 80 bp, Homo sapiens
taggccccagtctcagttcacgttggtaaagtgagacccattctgccacgtttccctgaggctctttgcttgggcgcctg

SEQ ID NO: 6817635 - DNA, 63 bp, Homo sapiens
tggagacaggtcacatatcctcggtttggaagtggtgccatttgcagtatgtatttgtatcca

SEQ ID NO: 6817636 - DNA, 63 bp, Homo sapiens
tctgctcagtcctcctgcagtgccacaggggtgtggcatgggtggtgtggaggtgctgagaga

SEQ ID NO: 6817637 - DNA, 57 bp, Homo sapiens
ggcagcgttcccagcagaggaagcccaggaactgtggcagtctcactggagggctcc

SEQ ID NO: 6817638 - DNA, 109 bp, Homo sapiens
tctgggttccagccacaggggccagcccaggcagggctcaaggaacctgctttctgggtgtgcaaggtccttgggtcctggccatctgaaccccctctgagagcctaga

SEQ ID NO: 6817639 - DNA, 79 bp, Homo sapiens
ttttgcctgcaatgataagctaatgttataaatactgttataaaagtcaagcaatatgcagcttatcttctagggagaa

SEQ ID NO: 6817640 - DNA, 63 bp, Homo sapiens
tcccaaccccttctcctggctgttccagcctctagcttgagattccaggggatggggagggga

SEQ ID NO: 6817641 - DNA, 60 bp, Homo sapiens
tcctacatagccagaagcaagttcattatgacttagaatattgtacatggttatgcagga

SEQ ID NO: 6817642 - DNA, 56 bp, Homo sapiens
tgatatgttagaatcttgcaagatgttactatcttgccatattattgagcatatta

SEQ ID NO: 6817643 - DNA, 74 bp, Homo sapiens
tcagctctgacattctgtgactctgaacagcttaggggctgttaagagatacagactgacatttagtatcctga

SEQ ID NO: 6817644 - DNA, 55 bp, Homo sapiens
gtcccaggagttgctgggccttgagggacagacacaggcctagcttttttggggc

SEQ ID NO: 6817645 - DNA, 118 bp, Homo sapiens
gtgaattaaagataaataaacattgtgatacaacttaactgtggggaaatttgttttctcattcacttcattttaccttgagtttgcaacaccacagtgttttgtcacattagttcac

SEQ ID NO: 6817646 - DNA, 70 bp, Homo sapiens
atggaggagggcttttgaggctgggagaaatatatggtatttacactggttctcagagctcattttctgt

SEQ ID NO: 6817647 - DNA, 63 bp, Homo sapiens
tcttcatgggcaggaacttggagacggaaccacaagaatggtctcctgagaggctcttggaga

SEQ ID NO: 6817648 - DNA, 58 bp, Homo sapiens
gcttgagttttgggacaaagccttccgtatttcctttgcttgactccaaagcccaggt

SEQ ID NO: 6817649 - DNA, 57 bp, Homo sapiens
actgtccgggacaggcccatccagagacagggaggggatgtgtgggtgtcggggagt

SEQ ID NO: 6817650 - DNA, 55 bp, Homo sapiens
ggctctttggcgggccttgaacttgctggaaaagaccaggcctgcacacagggcc

SEQ ID NO: 6817651 - DNA, 76 bp, Homo sapiens
tcggagccggccctgccctctcggcactcgcggtccggaccaggaaggcggcccgagcaggacgggtgggctgcgg

SEQ ID NO: 6817652 - DNA, 64 bp, Homo sapiens
tttctaaacagtttccaaggaatacaaatgcactacatattggttactaaaaactgtttgggaa

SEQ ID NO: 6817653 - DNA, 84 bp, Homo sapiens
gcacaggtggccaccatggcatgatagtcagtctaaagctctgccaccaaatagctgcatgaccatgagtcaggttgcttgtgt

SEQ ID NO: 6817654 - DNA, 71 bp, Homo sapiens
ggactttacgagtgtgattaaggtaaggaccttgagatgaggagattatcctggattatatatgtgagttt

SEQ ID NO: 6817655 - DNA, 55 bp, Homo sapiens
atgacatgaggcatctttggagagaagaagctgccacaatccgatgcctcctcgt

SEQ ID NO: 6817656 - DNA, 78 bp, Homo sapiens
atgagttttcctctctcttgccagaatgtgaagctttgcatagtgccacgtgggaggtgaggagtgaggaaggaaagt

SEQ ID NO: 6817657 - DNA, 75 bp, Homo sapiens
gagccctggggtgtcggggaggccacatgtagcttgtctaagcatctgaggccctaccctgagccttgcatgctc

SEQ ID NO: 6817658 - DNA, 69 bp, Homo sapiens
cttggagagaacattagcaaaaacagctctgtgtgtggacatgcgttttatcctagtagttctgccaag

SEQ ID NO: 6817659 - DNA, 62 bp, Homo sapiens
ctgggagattgaggccatggtgtgggcgagcccctcacccccatgtggacttagcttcctgg

SEQ ID NO: 6817660 - DNA, 62 bp, Homo sapiens
agctgctggtgctggagcctagtccctatgttcaggctcagggatggttctgcacagtggct

SEQ ID NO: 6817661 - DNA, 72 bp, Homo sapiens
tttaattgtgtagtagtattctgttttattgcgtaaaactacacagaggcatacattgctattcagttacaa

SEQ ID NO: 6817662 - DNA, 62 bp, Homo sapiens
ccagtggtgaatccagggatgtagtggaatctatgtcttactttaatggaattcagcactgg

SEQ ID NO: 6817663 - DNA, 77 bp, Homo sapiens
tctcatgttgaattatcgttcccacaattcccatgtgttgtggaagggatccagtgggaggtaattgaatcatgggg

SEQ ID NO: 6817664 - DNA, 64 bp, Homo sapiens
gactgcaacagcatggctcaatatttgaaatcactacggttaaaagcagtcatattgtgcagtt

SEQ ID NO: 6817665 - DNA, 58 bp, Homo sapiens
gtgtatttcatatattgctgtatgtacatattaatcagccagcaaatattaagtgcat

SEQ ID NO: 6817666 - DNA, 92 bp, Homo sapiens
cagtgcttggagaatagctgggaggcacattcatcacattatgatgttactgacttaaaatgctgcccattcccagcagttttccatatctg

SEQ ID NO: 6817667 - DNA, 120 bp, Homo sapiens
caaggatacatgtgcagatttgtaacataggtatactgcatgacattggggtttgggcaattaataatcccattgcccaggtagtgtacattatacatgataagtactttttaacccttg

SEQ ID NO: 6817668 - DNA, 92 bp, Homo sapiens
ttgcttgtagccaagacagtctagcagtagggttccaggtgacttctgaggcctcgttggctggaacacttgctcttgaagctttcatgtaa

SEQ ID NO: 6817669 - DNA, 77 bp, Homo sapiens
gtgagggactggtctcttcttccaagatggcaccttgttgctgaatcttccagaagggacaaatgttgtgtcctcac

SEQ ID NO: 6817670 - DNA, 65 bp, Homo sapiens
acagaaaattcatggtgaggccaaagccatgacaacacctgtgttgcctcacattgattttctgt

SEQ ID NO: 6817671 - DNA, 56 bp, Homo sapiens
agcatttcttttaatcacagtggtgttactagcagtactgtgtgatctggaaagct

SEQ ID NO: 6817672 - DNA, 112 bp, Homo sapiens
tttgcctctcttctcttttttgtgtaaacaacttctgcactatgggttctgggcactgcttagaagtatattctagatgcagcagtatttacaccgttaggatcttggtaga

SEQ ID NO: 6817673 - DNA, 88 bp, Homo sapiens
gcagtggtgatgtatggggcgtgagagcagcgtttgtggaacacttttttggagagtagggctgtgtttttgctgtcgttaccactgc

SEQ ID NO: 6817674 - DNA, 101 bp, Homo sapiens
agtctggagctcacttcccacaggacgggctaaagagtggtggtccaacaggcaaagatctgaactctagtcctcgttctgccttagggagctgtgtgact

SEQ ID NO: 6817675 - DNA, 82 bp, Homo sapiens
cagctgtgtctctccaggatactgctctctgctgctggaaattcccttgcacaaaagtatgtcatcttttagaaagcagctg

SEQ ID NO: 6817676 - DNA, 65 bp, Homo sapiens
ggttcaaggcatactcctttctcagcctcctgagtagctgggactatagaatgtgccactgtgcc

SEQ ID NO: 6817677 - DNA, 83 bp, Homo sapiens
ggagtggtgctggtggctttgcagttagcctaggattgagcaattgctgcaattgttgctctctgcatcttcggtgttacttc

SEQ ID NO: 6817678 - DNA, 106 bp, Homo sapiens
gtggaagattgggattctagtggcttaaaatgatgtggagtgaaattgttttcaatgaaaatatttatcaaagttatatcatgagtatatctaaccctatgtttac

SEQ ID NO: 6817679 - DNA, 57 bp, Homo sapiens
tcaggaaggctctggccttagagacacagacacagctgtgggcagagcaccacctgg

SEQ ID NO: 6817680 - DNA, 66 bp, Homo sapiens
aggacatcactcgccgcctgtctcgaagtggtgagcgccaccacatcgggcggacactggggtcct

SEQ ID NO: 6817681 - DNA, 101 bp, Homo sapiens
tggctagatagtctctcccttctctgtttgtgatagaatgcaagtggaatttgacaggtgtacttctcaaactagaaactagagagctgctatctcagtca

SEQ ID NO: 6817682 - DNA, 60 bp, Homo sapiens
gcagaggtgtgggaggggccacagggcctgccctcttcggccacagcccagcacttttgt

SEQ ID NO: 6817683 - DNA, 79 bp, Homo sapiens
acaaaggcatatgttcctctgctccatctttactgtttcaggaaagggtagggcccggagacagacagcctggctttgt

SEQ ID NO: 6817684 - DNA, 81 bp, Homo sapiens
cgggcctgacccgcaggaccctgaggagagcgcttcccgacagcgcttcggggaggctcttcaggagcgggaaaaggcctg

SEQ ID NO: 6817685 - DNA, 92 bp, Homo sapiens
gagcaaagagttagcagatgaaaccacaggtgtttttactcagaagaacatgaggggaagacttagtcggttcaatgcttcatttcttcctc

SEQ ID NO: 6817686 - DNA, 55 bp, Homo sapiens
gggttgggcttgtctgggaaactgcttcaatctgaggcctagttaggctcggctc

SEQ ID NO: 6817687 - DNA, 108 bp, Homo sapiens
ttggggattgtttttaaggaattggattctttctaggctgtgagcctttagacttttttattagctaatcacatcttattagagtatctcttccaaagcagtgttcaa

SEQ ID NO: 6817688 - DNA, 84 bp, Homo sapiens
cctgtcctcagtgaggttatccatttaaaccagttataagatctctgttgtgtccctggcaatgggaattgagctgaacccagg

SEQ ID NO: 6817689 - DNA, 66 bp, Homo sapiens
tgtggccctaccctgaagtagctctttcccagggagggagcaggcctgctgcggaggtgggtgaca

SEQ ID NO: 6817690 - DNA, 58 bp, Homo sapiens
tgagttgaaagactgacttctgctgagggaattttaagcagaggaagctggtaactca

SEQ ID NO: 6817691 - DNA, 55 bp, Homo sapiens
caccaccaccatttaatgtttgttaaagcagtgcataatctaaatgggggttgtg

SEQ ID NO: 6817692 - DNA, 83 bp, Homo sapiens
aggtggctaatgtttccatcaaatttgatgaccctctaaattcaggctagagttattacagagtgatgtgacttggtccacct

SEQ ID NO: 6817693 - DNA, 59 bp, Homo sapiens
ggaacagtatcagtagtgccagtggtagtatttgcactggcagaactggtgattgtctc

SEQ ID NO: 6817694 - DNA, 65 bp, Homo sapiens
gtgacaagttcccaggtgatgctgatgttggtagcccaaggctcacattttgggaatgattgcac

SEQ ID NO: 6817695 - DNA, 60 bp, Homo sapiens
cattttgctagttctgtggttttgagcatctttcagcttagattcataatctgtaaaatg

SEQ ID NO: 6817696 - DNA, 60 bp, Homo sapiens
tccattctcaaggtgaagctatgaataagagtgttgtcatttggaagcctgagagtgtga

SEQ ID NO: 6817697 - DNA, 55 bp, Homo sapiens
cccagtacctctgttccctgctacattccctacgtaaggaatatttgtatctggg

SEQ ID NO: 6817698 - DNA, 72 bp, Homo sapiens
gctagtaagcgtagaggttagcacagactctggagacagactatgtaggctcaacttccacaagccttctgc

SEQ ID NO: 6817699 - DNA, 72 bp, Homo sapiens
gttctggacaaagactgtggtttattctttgatcttctgagattagtgccaccactgtctttggccctgagc

SEQ ID NO: 6817700 - DNA, 75 bp, Homo sapiens
gaaatactgagaacagagtttcaaataacatctcataaaggagagtttacaaagctttgttttgttttgtatttc

SEQ ID NO: 6817701 - DNA, 55 bp, Homo sapiens
tcgctacactcttgagtcaatatgcttaatgcgtaagacacattggagtagatga

SEQ ID NO: 6817702 - DNA, 130 bp, Homo sapiens
gaaaagttgctggtgggtagccaggccctgcctgatctcataaattctggtgctgtgagatttcctccatcttcatagtgagtttaatgatgcagtagatttccatgttaccacttttaatttccagttc

SEQ ID NO: 6817703 - DNA, 62 bp, Homo sapiens
tatggctgaggcctccgtggccacgaacaggagtagggctgcgcaaaggaggccaggctgtg

SEQ ID NO: 6817704 - DNA, 76 bp, Homo sapiens
gccactgtcccctagccctactctctaccacgcagatgtttggctgcctgtgggcagagggccagatgacagtggt

SEQ ID NO: 6817705 - DNA, 82 bp, Homo sapiens
gcctttcctcaggagagctcctatgcctcccacacacagctgggccgccgtgtggtctgggaagctgtctctgagcagaggc

SEQ ID NO: 6817706 - DNA, 78 bp, Homo sapiens
gtgaaaaactgcagaatcagtgtctccttaaaagctgtgcgggttttctggcagctccaaaaggaaacactttttcac

SEQ ID NO: 6817707 - DNA, 77 bp, Homo sapiens
tctcattgtgcatcacagaactcatacaggagagaaaccttatgaatgcagagactgtgggaaagcattcagtggga

SEQ ID NO: 6817708 - DNA, 106 bp, Homo sapiens
aaaaaaaaggtattaagaaactaatgcaataagagaattgagcttagttctgtatctattctgaggtctcgctcctgttgcactagttcctgaataaaatgttttt

SEQ ID NO: 6817709 - DNA, 71 bp, Homo sapiens
gagggaggccagggatgcaatgagaggtggggaggaggggctcacattctcctgagttcccaggtctactc

SEQ ID NO: 6817710 - DNA, 58 bp, Homo sapiens
gggcatccacagggatttggcacgggaaatgctatgctctttgttcatgtggatgcct

SEQ ID NO: 6817711 - DNA, 89 bp, Homo sapiens
gtgtttttcactgatttcaaggtttgtctgctcagcatcgttccctatgcggtgttattctggtgggatttttaatcatgagacaacat

SEQ ID NO: 6817712 - DNA, 84 bp, Homo sapiens
gtttcaaaaagaacaattgccccaaagcttggatatagccacagaacttattccgagtcacaggggcaattttttattgcttac

SEQ ID NO: 6817713 - DNA, 101 bp, Homo sapiens
gccctcgtggtcctggggatcggatggaaggtgtctacgcgccttgagatggggatccatctcaagacctttcctctggttttcccagatcccctgggggc

SEQ ID NO: 6817714 - DNA, 60 bp, Homo sapiens
tgtgaataatgccgcaataaacatacgtgtgcatgtgtctttatagcagcatgatttata

SEQ ID NO: 6817715 - DNA, 62 bp, Homo sapiens
tagagtcaatggccattgggtcatgctagctaagaaagcacatgttcttgaagccaactctg

SEQ ID NO: 6817716 - DNA, 78 bp, Homo sapiens
gtatcattgcctaatgctctcagtatggacatcctgttacactaaaccataaaaatcctgagagctgggcagggatac

SEQ ID NO: 6817717 - DNA, 55 bp, Homo sapiens
ggtgctcaaggtgacaggacatgtctttatagatcttgaaatctcaccgagcatc

SEQ ID NO: 6817718 - DNA, 61 bp, Homo sapiens
gccaggcctagagatggcaccatttggaagatacaaatggagatgtctagagggtgctggc

SEQ ID NO: 6817719 - DNA, 71 bp, Homo sapiens
atcacttctctgctacctgcaaagatactaattagcaagtagtgattctaagtaagtgtagtggaggtggt

SEQ ID NO: 6817720 - DNA, 89 bp, Homo sapiens
gggcctggctggaggtgagtcactgaaccccctgcagttgagtccattcctctcggagagcttagtgatgtcctcacagtcagtggcct

SEQ ID NO: 6817721 - DNA, 61 bp, Homo sapiens
gctctgcccaatgtccctacacctggaaatcccaggcagcagaggggtgaggcatgggggc

SEQ ID NO: 6817722 - DNA, 66 bp, Homo sapiens
attgaaactagaaccacttgtatttccttccatgatgccgataggaaccgagaggtctggatcaat

SEQ ID NO: 6817723 - DNA, 67 bp, Homo sapiens
gaagttcctggggttgggggttagtagtgtatgcaaacacagaggcatgaccctgcccttgagcatc

SEQ ID NO: 6817724 - DNA, 126 bp, Homo sapiens
cgaaggcatttaactgtcgcaagcaggaggcaggcctcggagccacagtggattgattccatcctcgaaatggagcctacccaagctgtaggtggcgctcttcctgctttctccagtgtgcttttg

SEQ ID NO: 6817725 - DNA, 72 bp, Homo sapiens
gctcaggtgtgggcctgtatgggtctcagataggcctaggggatctgtctgggacacaggctccacccaagc

SEQ ID NO: 6817726 - DNA, 106 bp, Homo sapiens
acaacttgctggtgaaaaagtgccactcggggaggctgctaacaaggaagttaaatgcttctgccacgagcagtttcttcgctgtatttttcatgagctgtaatgt

SEQ ID NO: 6817727 - DNA, 77 bp, Homo sapiens
ctccctctggcctagctctctgcttgaaagcatcaccacacgttttccaaaccagtgcagtgactggggcatgggag

SEQ ID NO: 6817728 - DNA, 76 bp, Homo sapiens
aaaggctttataagttacagtcagaggttaacagtaatcacatttgtttcctcctctggctttaataaatgctttt

SEQ ID NO: 6817729 - DNA, 105 bp, Homo sapiens
tttttttttcgcctttactgtatgtcagtgacttctcctaatgtcatatcctcctcattctgggggtagcatcaagggaacacgatttacacagagaaataagaa

SEQ ID NO: 6817730 - DNA, 80 bp, Homo sapiens
gaggacagatgttgctgccaatatttttagacagaattcagagacctgctaagaattctgagcagctgagcatttcactc

SEQ ID NO: 6817731 - DNA, 104 bp, Homo sapiens
cacatcgccctctctgcagagctcacacacgaagcccttggcctggcaccgctcgcgttccagcttgatgtgcttggtgaagagcgtgtgagtctcggtgagtg

SEQ ID NO: 6817732 - DNA, 66 bp, Homo sapiens
gttttctcatctcctcaatggtacgagtaatattaaatagtatctgtccaggattcttgagagaac

SEQ ID NO: 6817733 - DNA, 57 bp, Homo sapiens
gagctgatcaatgactgcaacagtgaggtcaggatgtacagttgtttgactcagctc

SEQ ID NO: 6817734 - DNA, 62 bp, Homo sapiens
gaggagtgtgggaattcagtccataaacccttggtttcttctcgcaggactcccagctcctc

SEQ ID NO: 6817735 - DNA, 78 bp, Homo sapiens
gatattgaaaatttaatttagcctcatttttgacatagattttcttgttaaaaaaagggataaaagttttttggtgtt

SEQ ID NO: 6817736 - DNA, 72 bp, Homo sapiens
ttgggggaaggcagctttctgaggctgaagaatttcctgaaggggccacagctggaggctgtctactcccaa

SEQ ID NO: 6817737 - DNA, 55 bp, Homo sapiens
gtttatagatggcagagctaggagtgaaacccaggcagtctgtgatagtgtagat

SEQ ID NO: 6817738 - DNA, 63 bp, Homo sapiens
ggaggttctgatttgtcacaacttaattatacattcttgtgactacagagatccagaatttcc

SEQ ID NO: 6817739 - DNA, 58 bp, Homo sapiens
gtgactcccaacaatataccatcaggctgaaattgtgcctgtggtctggagggagcac

SEQ ID NO: 6817740 - DNA, 69 bp, Homo sapiens
tctgtgggaggaggtgggttaagttgtaaagtattattatacaaagtgagcaacctcttttcccagaga

SEQ ID NO: 6817741 - DNA, 67 bp, Homo sapiens
cccagggctccctgcagcctctgtgtgtggtcagggagccagggcaggggcccccaggggctctggg

SEQ ID NO: 6817742 - DNA, 75 bp, Homo sapiens
gtggccagccagagagagtccctgggcctggaggccagatggcagccaggaatgcagggctctccctggggctgc

SEQ ID NO: 6817743 - DNA, 76 bp, Homo sapiens
tcacttgaacccaggaggcagaagttgcagtgagccgagtttgcgccattgcactcctgcctgggcaacaagagga

SEQ ID NO: 6817744 - DNA, 76 bp, Homo sapiens
gctcctggtctcccaggtgatcccctcgtcctgcactttggaccagggcctcgtgttctgagtggagaccgccagc

SEQ ID NO: 6817745 - DNA, 64 bp, Homo sapiens
atagataatattgagcaggtgagattgttcatctttgaaatcacatgtgctcaattttaattgt

SEQ ID NO: 6817746 - DNA, 129 bp, Homo sapiens
gagtccagaaccagagctcaggagcagagggcagggcggttccttggattcattgtgggagggaggcacctgtttcctgagccccccgagtccagggttgccctctgagtgtgagctagggcaggactc

SEQ ID NO: 6817747 - DNA, 81 bp, Homo sapiens
tgaacagctaaatgcatttcaagactggatctctatttcttactgaaacagtcccctggaagtgggtttagcctatgttca

SEQ ID NO: 6817748 - DNA, 72 bp, Homo sapiens
aagccaggacagcaagaagcgagcagaaccaggaacgcctgtctgacccgtggctctgcctccaagtggctt

SEQ ID NO: 6817749 - DNA, 55 bp, Homo sapiens
tcgaggatctgggaatcttgacagaataaatgtcttaaagaactgaggtcctaga

SEQ ID NO: 6817750 - DNA, 89 bp, Homo sapiens
cggagaaacagaggacaaggtccaactttatttggggccaaacatcacacggttttggcagagtaaggcctgctttcctctgcattttg

SEQ ID NO: 6817751 - DNA, 63 bp, Homo sapiens
gccatatgggataaaccctgtgcctagaaatgtctggagcaggtttaggagtcccttcatggt

SEQ ID NO: 6817752 - DNA, 92 bp, Homo sapiens
tgccagaagggaagatacaaaaatgtgaccacagggtgttggacttccttctcatgcattctgtagagcatttattacccaaattctggaca

SEQ ID NO: 6817753 - DNA, 73 bp, Homo sapiens
agaattagattctgtggattacagatttgtaagtaggaaactgacaaatctgttttatagacttttaatgtct

SEQ ID NO: 6817754 - DNA, 64 bp, Homo sapiens
ggggtacccaaagctcttggattttagactcagaaggcctgggttaaaacctgaactctacccc

SEQ ID NO: 6817755 - DNA, 67 bp, Homo sapiens
gcaaatatgtgaggcaaagtttataggagttaaatatttctaagaatattgctcttaaaaggtttgt

SEQ ID NO: 6817756 - DNA, 116 bp, Homo sapiens
ctgaccttgtgatccacccgcctcggcctcccaaagtgctaggattacaggcctgagccaccgcgcccggcctaatttttgtatttttttgtagagacagggtttcactacgttag

SEQ ID NO: 6817757 - DNA, 65 bp, Homo sapiens
aatccagaaggaaaatattgtttgattcaattgtcacaatatagaatcactttccttcatgggtt

SEQ ID NO: 6817758 - DNA, 62 bp, Homo sapiens
agtggttaagacagcagactttggttttagactgcctagtctcaaatcctgctgttaccact

SEQ ID NO: 6817759 - DNA, 69 bp, Homo sapiens
ttggaggtgagcttctcatgaacagggcttcctgggacctcttatcctgtcttacatgagtcaccccaa

SEQ ID NO: 6817760 - DNA, 77 bp, Homo sapiens
gatttgcaaatcaggtggtcaggcagatgggctgtgggttctatgaacagccatcgccagatcaatgaaatgctttc

SEQ ID NO: 6817761 - DNA, 62 bp, Homo sapiens
ggtgatgcctcagagaaaacttcttccacaaatggccagaagatgtcactgcagacagcacc

SEQ ID NO: 6817762 - DNA, 56 bp, Homo sapiens
gcaaaatattgacattggcgtggaagatgagcccatgcactgttggatatatttgt

SEQ ID NO: 6817763 - DNA, 66 bp, Homo sapiens
gtcatgggtataattttagatgttttctggctctgaagccttgcatttaaatttgaacttcagaac

SEQ ID NO: 6817764 - DNA, 57 bp, Homo sapiens
tctaagcctaggaaatgagtttagggaactttccaagccatctccctgaggtaggga

SEQ ID NO: 6817765 - DNA, 57 bp, Homo sapiens
ccatactctctggcccccaagtgcccctttacctagttcttcaggtcagaaagatgg

SEQ ID NO: 6817766 - DNA, 77 bp, Homo sapiens
ctttcagaaagccatctgctggttcgcatgtgtatgtaatccaggtggaaccagtctctgcaggtgcactttgggag

SEQ ID NO: 6817767 - DNA, 57 bp, Homo sapiens
cattatgtgagtgattaattcaggataacataaacttctggaagtcatttacaggtg

SEQ ID NO: 6817768 - DNA, 83 bp, Homo sapiens
gtgtttttgtatatacaggctgaatacataacatgcaaccaggtggtaataaagaatgttagtgtcactttgtacaaggacat

SEQ ID NO: 6817769 - DNA, 104 bp, Homo sapiens
tagtctttgggaggtaggtgagatttgttttataaaatagcggcttattaatccacagtgtattttatttataaatttttgaatgatttatttttctaggacta

SEQ ID NO: 6817770 - DNA, 85 bp, Homo sapiens
gctctggccccagcgcgctcgatggtttccgcgcggccgccggggctcgcacggtccagtcgccagggggcgcgctagccggcgc

SEQ ID NO: 6817771 - DNA, 71 bp, Homo sapiens
agaactacacaatggaggaaaacatttcactgtagatgtatataggaatgtgctccaattgtctactttct

SEQ ID NO: 6817772 - DNA, 71 bp, Homo sapiens
cgccttatgccggcctgggtcactcaggcaggcggggcgcggccccgtcagctgtgactcaggccccagcg

SEQ ID NO: 6817773 - DNA, 73 bp, Homo sapiens
ggggatgccggcacctgagttcggttgctgcctcatccgtgagccgggctggctcccaggtgttgaagtcctc

SEQ ID NO: 6817774 - DNA, 55 bp, Homo sapiens
gaagcagctgccagagatgtctatgcaaagggacgtttctgggattcagggtttc

SEQ ID NO: 6817775 - DNA, 75 bp, Homo sapiens
ccacttactagctgtgtaagcttggtaagagccatttcttctctctgatctttggtttgcacatgtgtaaagtgg

SEQ ID NO: 6817776 - DNA, 58 bp, Homo sapiens
tctattttgtttccagctctactttcaggtccatccatagagcttggcacagagtaga

SEQ ID NO: 6817777 - DNA, 60 bp, Homo sapiens
caaactcctacaacaccatgcatctctatcctggtagatgtctctgggcagtagggcttg

SEQ ID NO: 6817778 - DNA, 77 bp, Homo sapiens
agaaaatagcctggagctgtcgacccaccgaggcaaggaggactgtttccagaggggaggtggcagcccaggtgtct

SEQ ID NO: 6817779 - DNA, 72 bp, Homo sapiens
gccggtccttgctgggctgttcctgtccatgtgcctggtcacggtgctggggaacctgctcatcatcctggc

SEQ ID NO: 6817780 - DNA, 80 bp, Homo sapiens
tcaggtgggcttgagaactgttgctctaaccaggggatctcaaagggaagtctcaggacagcagcatcagcctcacctga

SEQ ID NO: 6817781 - DNA, 63 bp, Homo sapiens
gacatggtgcttttaatagctgtccttcttttggaagtacagaatcattggaagcacaagatc

SEQ ID NO: 6817782 - DNA, 63 bp, Homo sapiens
ggggaacaggcgtaggtcagggccagtgacctcagggcacttgaggctgggcctgcactcccc

SEQ ID NO: 6817783 - DNA, 59 bp, Homo sapiens
agccatggagcaagagccgaaagccttttatttggaggctggcctatttctttatcgct

SEQ ID NO: 6817784 - DNA, 81 bp, Homo sapiens
acctcggttttagccctgctgtgatgtgaagtattatgaggttataccacatcccagccaagggcattacccgtaagaggt

SEQ ID NO: 6817785 - DNA, 65 bp, Homo sapiens
gctgtggggaagtcataaaaaggatactgtctgcactttgtagattcattcttggtatgaacagc

SEQ ID NO: 6817786 - DNA, 59 bp, Homo sapiens
gagatgcagttttaggggaagggttggatattaggggttcagctttggacttgcatttc

SEQ ID NO: 6817787 - DNA, 58 bp, Homo sapiens
cacctcccaggccaccaggaggcagctcatgatcacaacttggtggctctgggaagtg

SEQ ID NO: 6817788 - DNA, 78 bp, Homo sapiens
ggagttttgctcttgttgcctaggctggagtgcaatggctcaccgcaacctctgcctcccaggttcaagcgattctcc

SEQ ID NO: 6817789 - DNA, 73 bp, Homo sapiens
atcagtttctctcaaggtccttggcatgggatctcaaaagagtctacccataatctggctttgagagagtgat

SEQ ID NO: 6817790 - DNA, 73 bp, Homo sapiens
gaggatggtcagtaaagttctttcttgctgattacacagtaaccagttgaaaagattttattctgaaagactc

SEQ ID NO: 6817791 - DNA, 106 bp, Homo sapiens
gcagccctcttgtctggctgatcaggaagctactgccagcagcctgcagccctgggggcgcacaggtctgctgcagagcatggctttcctcggcccagacggctgt

SEQ ID NO: 6817792 - DNA, 74 bp, Homo sapiens
ctgagcggggccctggggctgaaggtcctccactggagctgcaccctggcgacccggctccaggcccagcagag

SEQ ID NO: 6817793 - DNA, 66 bp, Homo sapiens
ggagtcaccagcccaaagtcaccccgggatgactggcgatgctggggggttggggctgggggaccc

SEQ ID NO: 6817794 - DNA, 65 bp, Homo sapiens
cagctgaagctttcaattatgtcagcctgtggaagtatctaaggtgagtgattgatgggctgctg

SEQ ID NO: 6817795 - DNA, 99 bp, Homo sapiens
taagtgggggttagagtgtggactggcgggacgcaatgggggctgggatgtcactttcatggttcccctatttataacaagtgattcagccctcactta

SEQ ID NO: 6817796 - DNA, 66 bp, Homo sapiens
ggttctagttaaaatgcaaatatgctacctgagacaagtagcagctatgccattttgacatgaatc

SEQ ID NO: 6817797 - DNA, 61 bp, Homo sapiens
agtgttaggaattaatgtagggcaccctcttattgggaatgtcactgtaattgcctacatt

SEQ ID NO: 6817798 - DNA, 83 bp, Homo sapiens
tcatagaaagatgtttgtgacctgcgtaggtggtttctgcatatcgttgctgatttcacttagctaggtttttgttgatatga

SEQ ID NO: 6817799 - DNA, 76 bp, Homo sapiens
tttatttattagccacatgcagactttcatggtttgctttttgttctggatgtttgtgtgtgtggaaatacataaa

SEQ ID NO: 6817800 - DNA, 129 bp, Homo sapiens
ggcaactatttatttaatttggtcaggcaaggcagtcaaagcagacttctcttgcccaaaaatttacatgaaaggactgagttgtctgggttgacagcctagcttggccaagttaaacagctcattgcc

SEQ ID NO: 6817801 - DNA, 70 bp, Homo sapiens
tactcctgctgaatttgagttagctgcctgtcactttaaagtttaagcagctgcaggttcaaaggatgta

SEQ ID NO: 6817802 - DNA, 92 bp, Homo sapiens
tttcatttgacaggagccaaaataggataatagcgccaacagttttttaaatgaagtcctaattatggctcatagtctcacttatgatgaga

SEQ ID NO: 6817803 - DNA, 67 bp, Homo sapiens
ggagtgaagagaagaaaattatctttgtgaatggagttagagaaggttttctatttttaaggactcc

SEQ ID NO: 6817804 - DNA, 93 bp, Homo sapiens
ggaaaagcttcatgttggtagctgatattagcaatgagtgcctccgaaatgtgaatttggaactgcataatgattctgctgcctcttttttcc

SEQ ID NO: 6817805 - DNA, 69 bp, Homo sapiens
ggcacttgaatcttctgagtatttgctccctctcctgtatggtggcattgctgggagattcaaactgct

SEQ ID NO: 6817806 - DNA, 60 bp, Homo sapiens
gaggacctcagaggccagggatctaggggccagtgctccgtgtgcctcaccctctgcctc

SEQ ID NO: 6817807 - DNA, 62 bp, Homo sapiens
tattgctgctggaaccaggaatttgaagtattgcagcttagaaataatggtttcagttaata

SEQ ID NO: 6817808 - DNA, 67 bp, Homo sapiens
ttgagttgcatgctagaattcccattttgggcattggctcagactggggagagtcatgccagcacaa

SEQ ID NO: 6817809 - DNA, 106 bp, Homo sapiens
aatcgtgaataagacctgtgaattatgttacatctagtaaacatttagttaatactagtatttgttgattgatatgaagtgcaggttatctcgttttattgcgatt

SEQ ID NO: 6817810 - DNA, 100 bp, Homo sapiens
gtgccaggcactgggctctgccaggcactgggctctgcagcagtggtaacaggctataaagtgcttctctgtgcctggagacctatacagtgctttgcac

SEQ ID NO: 6817811 - DNA, 81 bp, Homo sapiens
gggtgatttgtactgactttggaatatttctaggctatgtttctttatgctagaaaaagttcagacagttttatttacacc

SEQ ID NO: 6817812 - DNA, 106 bp, Homo sapiens
ttttaaagaacctgccaaacttttccaatgacatttgttttaaagccagtttttataatatttatttgtttttagatccatgtggtagtgtggcaaatctttgaga

SEQ ID NO: 6817813 - DNA, 66 bp, Homo sapiens
tctcttgctgaatttacatttttgtagcccatgacttgggtagcattggtggaattaggcaaagga

SEQ ID NO: 6817814 - DNA, 57 bp, Homo sapiens
tcttagatgaataaaaagttatgtttaaatgcctgtaagggtgactattcactgaga

SEQ ID NO: 6817815 - DNA, 60 bp, Homo sapiens
tggcatatgattcttggcatcccaggctttgggatatatgcatgccaagacaaatagcta

SEQ ID NO: 6817816 - DNA, 69 bp, Homo sapiens
cctctgacggttgtgaggaggattaaatgcttcagtatgtgtgcaagacttcctaagcaataaaagagg

SEQ ID NO: 6817817 - DNA, 73 bp, Homo sapiens
aaaatgggaccatattgtatatactgttcttaacctgctgggttttttgcttaatgcattgtgattctgtttt

SEQ ID NO: 6817818 - DNA, 83 bp, Homo sapiens
aagagtgttcactccataggccctgcagtaatcatggcttacctcatttatgttcacagcaaacctatgaactgggcattctt

SEQ ID NO: 6817819 - DNA, 129 bp, Homo sapiens
ctaaagtgccaggaagacatagggacaattcaaatttgagtttgtgatgagtggctatgatcaaattttgcattattccttagatttaatttatcatctctgtaagcaacaatcttcagggcaagggag

SEQ ID NO: 6817820 - DNA, 115 bp, Homo sapiens
gccgggcagcggcagcatccaacctgctttattcctcctgcctgcagcgccacagcgagcgagcgagcgaggagggggagagagggagtctgtctgcaaagtgctgctccctggt

SEQ ID NO: 6817821 - DNA, 101 bp, Homo sapiens
ggagcctgtcccctttggaggctgccccttcctcagctggctcttgctctatgaaggatatatgctagtagcagggggtacctctcagggctgtgggcttc

SEQ ID NO: 6817822 - DNA, 91 bp, Homo sapiens
tgcctggatgcagcactttatagtagaaagagcattgaactgaaaagccatgtcctgatgcttccactaatgagctgtgttatcctaggca

SEQ ID NO: 6817823 - DNA, 59 bp, Homo sapiens
tgctctggtaactcacttccatctgatgcctgactagaatggaattgggagttagagca

SEQ ID NO: 6817824 - DNA, 88 bp, Homo sapiens
gggtgctgggttcccagggactctctgccttccaaaggacctaccagaaaaacacccgagggaaaggcaggggccctgcccagttccc

SEQ ID NO: 6817825 - DNA, 75 bp, Homo sapiens
taagatacaacgctagaatagccaggagaacatccttagtgaaatatagggagccatggcattttatgtgtctta

SEQ ID NO: 6817826 - DNA, 58 bp, Homo sapiens
agctgagcagcctaagcaaatttccaaaacagaaaggaaagaataggtgtgccatgct

SEQ ID NO: 6817827 - DNA, 93 bp, Homo sapiens
gagcaagaagaatacaaataataccaaggtgttgagccaagaaaaccccgatgctcctgaatcattttggtaatgttcgtttgctccttgttc

SEQ ID NO: 6817828 - DNA, 66 bp, Homo sapiens
gcttctgcgcacgcttcttccctccctattagtcttttctggggaagaggacagaatgggtgaagc

SEQ ID NO: 6817829 - DNA, 63 bp, Homo sapiens
ccttccccacacccacagcctggcccaagcacgcagggcagcaggcttcgctctgtgggcagg

SEQ ID NO: 6817830 - DNA, 78 bp, Homo sapiens
tctgaggagtacagagggctggtgccttggggaaaccagaagccagctggcccaagggcatcaagttctacttctgga

SEQ ID NO: 6817831 - DNA, 119 bp, Homo sapiens
tcccaatgcaagtattaagagctggggccttcggagcatgattaggtcatgagagccccgccttcatgaatggaatcaatgctcttataaaaggcccaagttacattttctggatggga

SEQ ID NO: 6817832 - DNA, 70 bp, Homo sapiens
gtgtaagtgccctgatgcaattgtctcacaatacaaaaccattatgttagacataaattaaggcatacac

SEQ ID NO: 6817833 - DNA, 56 bp, Homo sapiens
cagtacttttcaaccagtatgaacacacttccttcttcctctggttgtctgtactg

SEQ ID NO: 6817834 - DNA, 65 bp, Homo sapiens
agcctgcatttcaaggtctcatattgtagatggaatactgctgcaagtcatggcttttgcaggtt

SEQ ID NO: 6817835 - DNA, 81 bp, Homo sapiens
tgagcttgtgcaatgtgcttcgtgccatgccactggtaagttgtgaaggtggaactgaagccttgacatctgccaagtcca

SEQ ID NO: 6817836 - DNA, 103 bp, Homo sapiens
tccccttggactcctcaccctgtggccagaaggtttaaaagaggggccttaaagcacggcccccctgcttggtcatagagtggtactgagactccaagaggga

SEQ ID NO: 6817837 - DNA, 87 bp, Homo sapiens
actgggtatgactgaggtaagtgaaataagccacgtacagtctcaggctaggatcgggctcatattataacctcagtagtattcagt

SEQ ID NO: 6817838 - DNA, 75 bp, Homo sapiens
gtgccaggcatctttataagactgtagtgagtattagcataattaatcctcgcaataatcctattagttaggcac

SEQ ID NO: 6817839 - DNA, 57 bp, Homo sapiens
gcattgacaaggatgtggagcaactgcaactctcatgcttcacggccaggacaatgc

SEQ ID NO: 6817840 - DNA, 78 bp, Homo sapiens
gctgactccaacagagcccaggttttaccacgtgagcttcaaatgaggaatgaggcctggactctgcatggaaaaagc

SEQ ID NO: 6817841 - DNA, 92 bp, Homo sapiens
gttgtagtgtttatgtgctctcatacctttcatatgcatcttcatttaattcaaaggtcaaatgccagtggtgtggatcaaagctttataat

SEQ ID NO: 6817842 - DNA, 77 bp, Homo sapiens
gcctctgtctgcaagcaggtttgctattttcttttctttagagagggggccagctgcacctgggttcaggcagaggc

SEQ ID NO: 6817843 - DNA, 67 bp, Homo sapiens
ttcagataaactacaaataatttgggggacatattcatactaaaacattaattgttgtttgtctgaa

SEQ ID NO: 6817844 - DNA, 71 bp, Homo sapiens
aggtgatggaatgaacataatgttaaaagtgcccacagtttttggtgctgcacactgttcttcacacattt

SEQ ID NO: 6817845 - DNA, 61 bp, Homo sapiens
gagcttgttttaaaatgcccaccctgttagaacatggcagggccaggtgcggaaacagctc

SEQ ID NO: 6817846 - DNA, 77 bp, Homo sapiens
ctccctgctgtgtgtggggaggacgggcgccttcctgtcacccacaggctctgtgcatcctccccaagcacagtgag

SEQ ID NO: 6817847 - DNA, 84 bp, Homo sapiens
tcaaggtggtctgttcaaggtggctgattaaatttcttgctttggaacattcgacagtgattttttcgagcagaacttctcaga

SEQ ID NO: 6817848 - DNA, 92 bp, Homo sapiens
gaaaactgaagctggacgctggcctccagtcctgtctttgccattagcagccctgggatcttagtgccttcaccagccgagcttcagttttt

SEQ ID NO: 6817849 - DNA, 79 bp, Homo sapiens
tattgatgtaggtttatctattgtaacaaatgtaccactctggtaggggatgtggataatggaggaagctatgtggata

SEQ ID NO: 6817850 - DNA, 89 bp, Homo sapiens
ggcgtgtaggacgctccgggagtccccgggtctgggggccgccatggcaggcagcccaggcagcggggtctccttggagggtatatccc

SEQ ID NO: 6817851 - DNA, 61 bp, Homo sapiens
ctgtctggctttatatttgctattccacaggggtgtcaaaagcaatctgagggccggctag

SEQ ID NO: 6817852 - DNA, 93 bp, Homo sapiens
ggtgactgtgtctttgaatatcccagatggaggctggtcacccttttgtctttgggtgaatagactactcgggaaggcaaggatgcatgcacc

SEQ ID NO: 6817853 - DNA, 72 bp, Homo sapiens
cctcccttctctttcctttcacccccatttcaaaatccaatttgacaaaggctgagaggaaaagaaacgagg

SEQ ID NO: 6817854 - DNA, 58 bp, Homo sapiens
tgctgggcttcaactgcctgagacaccctgagtgagaactacatagctgagcccagta

SEQ ID NO: 6817855 - DNA, 59 bp, Homo sapiens
ccagaatagtttcattgtgccttcttctgagcagagacagtgtaatgtaattgttatgg

SEQ ID NO: 6817856 - DNA, 76 bp, Homo sapiens
atttggaatagggaggctggcatagtctctgttcaagtcacactgatctgctctatcccgtttccctcttccagat

SEQ ID NO: 6817857 - DNA, 75 bp, Homo sapiens
aggccacattgtattgtggaaagttagcatatgccctccaaagcctggtttctttcccagtagatgtgaaagctt

SEQ ID NO: 6817858 - DNA, 56 bp, Homo sapiens
agtgagacagtggactctgcatcatcacaaacatgctgagaaaatcactgcttact

SEQ ID NO: 6817859 - DNA, 75 bp, Homo sapiens
gggcaaacatttctgtcatttcaatatggttaaactctatttaggcaatgtggaggtggcaactataatttgtct

SEQ ID NO: 6817860 - DNA, 93 bp, Homo sapiens
ttcaaagtgtaatgaatggagtgcacagaattaagggagaaatatcagatttgggactgagtttttgcctcgaattctgcgtataactttgag

SEQ ID NO: 6817861 - DNA, 87 bp, Homo sapiens
gcagttcacccaagtgcagagactgcttcttccttctgctcacattttctaacctgcagagtttatttctgacttggctaggactgc

SEQ ID NO: 6817862 - DNA, 65 bp, Homo sapiens
gagtctgggacattagcagggatgaggagagggtcctttccttccttttactgtctccggagctc

SEQ ID NO: 6817863 - DNA, 58 bp, Homo sapiens
ctcttagagtttttaatacattgtgtctccaaacacaggaaaataaaagatctaagag

SEQ ID NO: 6817864 - DNA, 101 bp, Homo sapiens
ggttcctttttgtttctttgaagtggaaaaggatttaaactatttttacgctcctcagtttaattgttttcccaactttacagaagttagaaacatacacc

SEQ ID NO: 6817865 - DNA, 130 bp, Homo sapiens
ggatcgggggaccctgggggctcaggatccagcaaggggcggcaggagtaaaggaggaaggaatgacaggtgcaaataccttcccaccaaagcccttgttgccctctggctcctccccagagttgtcccc

SEQ ID NO: 6817866 - DNA, 55 bp, Homo sapiens
gccctgccagatgtgcttcagtttctcaatgctaaactgcttcccatcttagggc

SEQ ID NO: 6817867 - DNA, 72 bp, Homo sapiens
gccagattagctccccagcttagccctggctgccacattcttgtgacagttgtagaactggagagcatcggc

SEQ ID NO: 6817868 - DNA, 111 bp, Homo sapiens
caatttttgatatcacttcatgtcattttagagagtaagttttcctgttttattaatgtttatatttaagctgaattttctaaaagaattgtgagtgtttttattctattg

SEQ ID NO: 6817869 - DNA, 129 bp, Homo sapiens
gactgggaactatttacaaaaacattaagctgcattggtgaaaaggacttctgaggtcaagtcgcattagggaaataagagcttattcagcgttgactcaggggccttacctttcaggtgtgcatgtgc

SEQ ID NO: 6817870 - DNA, 75 bp, Homo sapiens
ctgcagaccctcgggtgagttggcctttttcgagcaaggagaccatgaaaacataccttctcaggggatctgcag

SEQ ID NO: 6817871 - DNA, 84 bp, Homo sapiens
caggctcgggctgatgtatggtccaggtaaatgcagcttctggttaatacgatgctgtaatggaaaaacattagcatgagattg

SEQ ID NO: 6817872 - DNA, 95 bp, Homo sapiens
ctagttttatgtttactcaaacatgtatttctatgtagtgaagaagagaatacaagttctgggtctatcctgcttagaagtatgtaacatgctag

SEQ ID NO: 6817873 - DNA, 60 bp, Homo sapiens
gtctgctctgtaggtgctctggtgcagggctgagaccccaggcatctaaagagagtagac

SEQ ID NO: 6817874 - DNA, 76 bp, Homo sapiens
cccacagcccagggttcagtgggccctcttgtccatctgggctgggcctggagcccacgagcccctggcctttggg

SEQ ID NO: 6817875 - DNA, 90 bp, Homo sapiens
gggtacattgtctctcacctgctgtccaggagtgccctgtgggactcaccaggaggtacatcttgtgatggatgttgaaacaagaaaccc

SEQ ID NO: 6817876 - DNA, 85 bp, Homo sapiens
ccagctttccccgtgcctcagccactcttcacgttccatctctgctctgtgctgacccggtatggtggtgtggggagagcaatgg

SEQ ID NO: 6817877 - DNA, 58 bp, Homo sapiens
tcaggcacttggaggagttgggtatggggagaaatacagagcacctgtgagagcctgg

SEQ ID NO: 6817878 - DNA, 86 bp, Homo sapiens
gcagacttatctatccaatgttccagggtaaatgttctattattaacattcctgaggaaatacattcatggatatatatgtttagc

SEQ ID NO: 6817879 - DNA, 95 bp, Homo sapiens
aggttggtttgtggagcttgtataaacaagactggccaactttgcacagttgtgagaattagccggattcttgttttgcctttaagagcaatcct

SEQ ID NO: 6817880 - DNA, 89 bp, Homo sapiens
cttaaaagtaatagtcaacatttgagatgcaatggtcagaggatattgtgctgttgccatctaaaatgttactgtttcttacttttaag

SEQ ID NO: 6817881 - DNA, 73 bp, Homo sapiens
tcccaaagtgctgggattacaagcgtgagccaccacgcctggcccaatgcttgtatttttagtagagagggga

SEQ ID NO: 6817882 - DNA, 60 bp, Homo sapiens
ttaaggaaggagtcttaaatgggtgcctactttgtgcacttagactctctttgtctttaa

SEQ ID NO: 6817883 - DNA, 80 bp, Homo sapiens
ggagattgtaaagagcttcctgcccgttctgttacatccacagaacaggatggcgaagctcttactaatacaggttctct

SEQ ID NO: 6817884 - DNA, 130 bp, Homo sapiens
gatgtgttctctgtgggttattttgagggttgggtaagtgtctgatggagcgaaatggtcagagcctagctcttctttcatatttctcctttctgagcacatgaacccacaataccgctggagaacactc

SEQ ID NO: 6817885 - DNA, 85 bp, Homo sapiens
aggtgtcgaagcaaaattacagaatgtaaggtagttaatctggtggacagtgagcactttgtgcatttctgaagccacgatacct

SEQ ID NO: 6817886 - DNA, 70 bp, Homo sapiens
aatgacactgaaatcgaaaaatgtaggacatttcttttaaggttatatacaagagatttcagctgtcatt

SEQ ID NO: 6817887 - DNA, 60 bp, Homo sapiens
aggcacatttctggaggattcatgtagagaaaaatgcctgaactaatgaggaaatggtct

SEQ ID NO: 6817888 - DNA, 69 bp, Homo sapiens
tgacattctcgtctgagctgctttagtgaaatggcctagcacctgaagcaggaacagcgagattgctca

SEQ ID NO: 6817889 - DNA, 64 bp, Homo sapiens
gtcgggctgctcgctgcggaactcgttcaggatgtcgaagaagctctgctcgggcatgccctgc

SEQ ID NO: 6817890 - DNA, 82 bp, Homo sapiens
cacagaagtcaaagtctggatttttaaggtggatctctgagtgatcaatattgctgaggattgaggcttgaatttcatagtg

SEQ ID NO: 6817891 - DNA, 95 bp, Homo sapiens
cccggggcctgctgcctcccacagcgatggctcctcacgtcctcagagccctgttgctcccaggatgaggagccagggacaggaggatgcccggg

SEQ ID NO: 6817892 - DNA, 69 bp, Homo sapiens
ttggggggatctaggggatgggtgaggaatggcccagcccagtcccagccggtgcctgggtcccaacag

SEQ ID NO: 6817893 - DNA, 114 bp, Homo sapiens
agaaatagctataaaaacaaaggttttggcaggcttatggggagacagagtcagagttcagggcctttcaaagatatgtggtctgataacctcccaaacctttgagcttgttct

SEQ ID NO: 6817894 - DNA, 61 bp, Homo sapiens
cttcctttagtgtcatatactttctctgaaacttaacttagaaagtgttctttgggggaag

SEQ ID NO: 6817895 - DNA, 69 bp, Homo sapiens
gacagaaaagcatttcatgtctagaaagcactctaaaatgcttcttagacataaactgttgccactgtc

SEQ ID NO: 6817896 - DNA, 67 bp, Homo sapiens
gctttcctggccctgtccctgcctcgcaagaagcgtgggcccaagcagcggcggccgggtgaagagc

SEQ ID NO: 6817897 - DNA, 75 bp, Homo sapiens
gttaagaatgttttgctggatgttggctaaaatcaaaactgttcttggtcaattaaacagagatcattcccagac

SEQ ID NO: 6817898 - DNA, 60 bp, Homo sapiens
gttcatgagccctgaggatctgttcggtaatggtccaatagaacatcagggctcctggat

SEQ ID NO: 6817899 - DNA, 55 bp, Homo sapiens
ggcttctcccattcttcagggggtctgatgtggaaactgtgttgaagggagagtc

SEQ ID NO: 6817900 - DNA, 59 bp, Homo sapiens
agagctcaagacgctcacagtaaggtctccatgacctgctgtgacatcccttgtgccct

SEQ ID NO: 6817901 - DNA, 60 bp, Homo sapiens
tgaccacagaatctaaatacatgacctggtaggagcatttctgtgtaaagtctgtggtca

SEQ ID NO: 6817902 - DNA, 74 bp, Homo sapiens
cagttctgtacctcagctttgctcccaaccaaccacttccacatgttttgctggtagagctgaggacagctctg

SEQ ID NO: 6817903 - DNA, 62 bp, Homo sapiens
taccttacaagctgtatgttaccactgtcatctgcttgatttgcaagcatccagcttaggtg

SEQ ID NO: 6817904 - DNA, 100 bp, Homo sapiens
aggtgcctgttctctatgtgcctatgtttcctcttctataaagtggtctgaataatacctacttcacagaattgacatgggaatcagagagatggcactt

SEQ ID NO: 6817905 - DNA, 129 bp, Homo sapiens
gttcctttttttttgctgaaacatagtggattcttctactctgcagtggaaagactcagacttcacagatgaggacctgtgttttccttgaatgaggaaccaactagtttagccagcaactgaaggtat

SEQ ID NO: 6817906 - DNA, 82 bp, Homo sapiens
tcctttggtccatttgctcttacattgtgtgcaagagaaacaatgtttctagtcagagagtatatggctcatccttgaagga

SEQ ID NO: 6817907 - DNA, 69 bp, Homo sapiens
tcctatgaaaatttccatcagttatatgggattttaattctgatattcttgaagggagattataaagga

SEQ ID NO: 6817908 - DNA, 74 bp, Homo sapiens
agtttaccattgacctgagtactatagaggaaaatgaatgcttcattttctccagggtctctgttggtaagact

SEQ ID NO: 6817909 - DNA, 102 bp, Homo sapiens
tcataatcaatgcacctgtagcttccagaaagtgtctttgttttactgaaaagccaaccagagaaaaaacatttatctgctgagatgtgtatgtgattttga

SEQ ID NO: 6817910 - DNA, 69 bp, Homo sapiens
agggacctgttgaggccatgacactttagaaaacaatatttcaaatcactttggagcttaatgggccct

SEQ ID NO: 6817911 - DNA, 60 bp, Homo sapiens
ccaggcggctgccagagcaaacacccagcccagggcccctggatttgagcagtgcctcgg

SEQ ID NO: 6817912 - DNA, 78 bp, Homo sapiens
gataggcaagcaggatgaagcccagggagaacgtacggctgcttcccagcatgcattcgcctgctgtctcttcctatc

SEQ ID NO: 6817913 - DNA, 72 bp, Homo sapiens
gaaataaaatgtccaatttctgaggctgctgttaaacctcaaaaaacaggctgcttcaatggataagatttt

SEQ ID NO: 6817914 - DNA, 64 bp, Homo sapiens
gcagttaagtgcacagcagtagagcttggaaaaggtctaggcttaagtcctgaatttatgctgc

SEQ ID NO: 6817915 - DNA, 67 bp, Homo sapiens
gtgctaagattataggcttgagccaccgtgcccatccggcaccagtgtttacctgtgacaaagccac

SEQ ID NO: 6817916 - DNA, 122 bp, Homo sapiens
atattatgcttcattttacatcagtaggatcatataagctccagctaaattcaaaatcttagctcctttctagagtttgctgcagtatatatttcttgggatctaaacttgaagtgtagtat

SEQ ID NO: 6817917 - DNA, 58 bp, Homo sapiens
tttagattagaccactgtactaaacctttgagggttttagtacaatgtatgattcaga

SEQ ID NO: 6817918 - DNA, 56 bp, Homo sapiens
cagttctcctagagtggaccaaaacatggaatcttggttgcattgtagttggactg

SEQ ID NO: 6817919 - DNA, 81 bp, Homo sapiens
agttctagggtacatgtgccaacgtgcaggtttgttacatatgtatacatgtgccatgttggtatgctgcacccattaact

SEQ ID NO: 6817920 - DNA, 83 bp, Homo sapiens
ggcttttccacttagtagctgtggccctgaagtgagccagctttgctgatcttccattacatctgctttcaagtggagaagct

SEQ ID NO: 6817921 - DNA, 82 bp, Homo sapiens
gcaaattgtgaccaaggaatcttagggtctatgtgagtggtcacaggagaacccacagattctcaagctggttgtaaagtgt

SEQ ID NO: 6817922 - DNA, 78 bp, Homo sapiens
ggaaacgatgctgggttataagaataaggggactaatcgcctacttcagtctcattagataactccaccatttagtcc

SEQ ID NO: 6817923 - DNA, 73 bp, Homo sapiens
tctccttctcttccccttagtttcctttaagagtgataaaaatggaaaagggggctgaggtggaggaaggaga

SEQ ID NO: 6817924 - DNA, 84 bp, Homo sapiens
ttttcatcttgtctgttatttctttgccatatctttacgaaatgttcaagattggtcaatgaaatagaaagattgtcttgggaa

SEQ ID NO: 6817925 - DNA, 113 bp, Homo sapiens
ggccgtgggatctgatctagtctttgaggcttgaggaggattataaggcaacttcccttatcctggctctctcaggatgtatttgaaagacaaagtaggtttggtttccggcc

SEQ ID NO: 6817926 - DNA, 58 bp, Homo sapiens
tttctgtacctcctcttgccccatccgtagagtaaggagggctagaccagggcagagg

SEQ ID NO: 6817927 - DNA, 129 bp, Homo sapiens
agccatcatcttagaaagtaagactggaaaaacggagtcagaactgggaatgctgtcccatcagagcttgttggggggcactcacgtgctctgttttgcctgtggagactgctggtaggaatgatgatt

SEQ ID NO: 6817928 - DNA, 76 bp, Homo sapiens
gtactgtatgattctatttatatcaaattctagaatagacagaactaatctaggtataaagaaatcaggacagtgc

SEQ ID NO: 6817929 - DNA, 77 bp, Homo sapiens
ctccagggccgggatctgcatctaaaccctctccaagagaaaggcacgggtgtttaatgcagatgtgggtgttggag

SEQ ID NO: 6817930 - DNA, 65 bp, Homo sapiens
cacaaatagattttgaaaagttgcttccaaaatttttagaagcactgcatttcaagatcagtgtg

SEQ ID NO: 6817931 - DNA, 60 bp, Homo sapiens
tctccttcccctactcagcatccagtctgcctagaaggaaatctgaatgcggggaggaga

SEQ ID NO: 6817932 - DNA, 55 bp, Homo sapiens
ttagcagaggaaggtatgctaggcactgctttctggttcccttgatcattgctaa

SEQ ID NO: 6817933 - DNA, 85 bp, Homo sapiens
taggtgggagactggttcttcagtaaaattaaatgtatgttgttaatatatttcttatgattgaagtaataaaacttccaattta

SEQ ID NO: 6817934 - DNA, 88 bp, Homo sapiens
gagagtgaagtatccatctgccctggggccaaacccaggtctgctagcctgggatatgccggggcaggaactgggaaactgtattttc

SEQ ID NO: 6817935 - DNA, 104 bp, Homo sapiens
gcttgaatttagcacatgtgcatgacagttctacacttaatctgtaattcagcagaatcaggacctgtggctgtcttacatttgggctaatttttcttatgagc

SEQ ID NO: 6817936 - DNA, 103 bp, Homo sapiens
catacttctactctctcctactgaaatggaggttaacactaatgctactcagtgacagcatgacatgttcagccctctattaatcagtaagttagattctatg

SEQ ID NO: 6817937 - DNA, 106 bp, Homo sapiens
ctggaatgtttggtgactgtgatgcttttctcagtgaagtttagaacatgttattgaacatttttctctttccactgagatttcatagacatacagaaatatccag

SEQ ID NO: 6817938 - DNA, 67 bp, Homo sapiens
tagccttattttacttggattctgattgaaatatgttctcctcagaatacaggatgaaacaaagcta

SEQ ID NO: 6817939 - DNA, 58 bp, Homo sapiens
tggaaggctttgctgtccttgctgtgtgtaagatcggagaaggcaaggaaaccttcca

SEQ ID NO: 6817940 - DNA, 90 bp, Homo sapiens
agaacagtgcctggcatatagtaggtgctctgtgtttgataaatttattcaacatttattgagcacctactggatgccagatgcggttct

SEQ ID NO: 6817941 - DNA, 79 bp, Homo sapiens
agggttgtagtgaggagtaagtaatatgtcacacgggttttcccagacatgtctaagtactcaacaaatggcagccact

SEQ ID NO: 6817942 - DNA, 66 bp, Homo sapiens
gctgcccctcgaccaagcgcgtccctaatctctctgctgaaggaacagattgcttggagggccagc

SEQ ID NO: 6817943 - DNA, 75 bp, Homo sapiens
gatacagactttgcttcattttgggtgtgcagatacagagtttgcattgacacatgaagctcaggttgtcttgtc

SEQ ID NO: 6817944 - DNA, 85 bp, Homo sapiens
tagcaagccagaattggaacccagagctcataaaatttgtaggaataagacattttaacatctgggtttttattaggttaagctg

SEQ ID NO: 6817945 - DNA, 112 bp, Homo sapiens
gtgtctgatgcaattcttgtgcccttccttgattttaactggatagtctggaccatttgtgtcttaaaggcagtgttccagcagaaaagaggtagggatgagacatgcacac

SEQ ID NO: 6817946 - DNA, 62 bp, Homo sapiens
ttagaggtgtgaccttgggcaaatcacttaatttgtcattgccttagttagcacatttctaa

SEQ ID NO: 6817947 - DNA, 56 bp, Homo sapiens
aggctgtgagaagtccttcagtaaagaaactgatttaactttctctcatctagctt

SEQ ID NO: 6817948 - DNA, 60 bp, Homo sapiens
ggcagctgtctcattcacacctgatcagagtccacacagaacaggtgcaaattagctgcc

SEQ ID NO: 6817949 - DNA, 130 bp, Homo sapiens
gtataaacttccttttctttagaatggcattcagtgctgcaggcaatagaaaacctgattaacagtgacttctcatatagggatttttgtttgtcatgcacaacaagtgtgggaaaaagaagttcaggac

SEQ ID NO: 6817950 - DNA, 102 bp, Homo sapiens
aggttgatgggagaaatgtgtataataatgtgagctaaagtacattagaaactatagcgtgccattatatacatttgctcatttgatttctcccaatggcct

SEQ ID NO: 6817951 - DNA, 82 bp, Homo sapiens
ttttcatgtggcagtgaccaagaagcctcccagaacatgaaaagcaaggttgtctgagggccttggctcctgcccgtgaaga

SEQ ID NO: 6817952 - DNA, 72 bp, Homo sapiens
gggcctctgggatcgctggtttccccacctctaaagcagagggggcagcggaccagtgacccccaaagtccc

SEQ ID NO: 6817953 - DNA, 78 bp, Homo sapiens
atgatgaagcaaacatagtgaagcaatgacagaatttaggtgatgtgcaaaaattagcttcgctgtaggtttcaacat

SEQ ID NO: 6817954 - DNA, 102 bp, Homo sapiens
ggcttgccttgtaggctcattcatttatttgctccttaggcatattttgacacttgggaccctgggagtagaagaaaaccatgaatgagactgagacaggcc

SEQ ID NO: 6817955 - DNA, 60 bp, Homo sapiens
ggtggggggaggaggcagggaacagtagaagaaagcaatgctatgtccctttcccccatt

SEQ ID NO: 6817956 - DNA, 81 bp, Homo sapiens
cagcgagcggtggaagggggattgggaagcaggtggggtgcccccacactcctgctggctctgttgctcggccacctgctg

SEQ ID NO: 6817957 - DNA, 76 bp, Homo sapiens
gtcccattccatcttgcatttgctaaaatgcatttggaatcacattattatagattatgcaagattggaagacggc

SEQ ID NO: 6817958 - DNA, 64 bp, Homo sapiens
cagggcttaatgtcatattagtttgtgcctccaggaaggaggtggaaagatggctgggaccctg

SEQ ID NO: 6817959 - DNA, 90 bp, Homo sapiens
agtggagtcactctgttgctcaggctggagtgcagtggggcgatctcggctcactgcaacctctgcctccccagttcaagtgattctcct

SEQ ID NO: 6817960 - DNA, 122 bp, Homo sapiens
ggaaactcattgagtcatgcaaatgtaaaggaacagagaagctttactaaagttcagtacaagtgttctgtgtttttcactaggcatcctgtatttttatttgctagacctggcgatcttcc

SEQ ID NO: 6817961 - DNA, 67 bp, Homo sapiens
ttgtttggaatgttgataaacataggcatatagatataaaatgccttgtttacagatatccttatga

SEQ ID NO: 6817962 - DNA, 92 bp, Homo sapiens
cttactactgtgtaagtgagagcaagggttggttttctgacaaagacatctatatgcagagagccagctctctcggcaagacatttcctaag

SEQ ID NO: 6817963 - DNA, 129 bp, Homo sapiens
tgtacaaatgaggaaatagtggcttcataggataaacggttgctcatagttacatggctagctagagttttgctgggatgtgactccaggcagttttgttccagagtcattatttttttcttttctaca

SEQ ID NO: 6817964 - DNA, 122 bp, Homo sapiens
ctgtgtgtgaggctggctggctgctttaggataaatacttccaggtgagtgtgagcacagatgctgctaggcattgtctgggagtaccctggaaggtcaggcccagcgtctcttctccacag

SEQ ID NO: 6817965 - DNA, 130 bp, Homo sapiens
gcatcccatgagcctgctgcggtgacctcctggatgttccacttctctgcagtgccatggggaaacccaagaactcaacatagagtgggatccaatctacgagccattcaggaaacacatagggagcagc

SEQ ID NO: 6817966 - DNA, 82 bp, Homo sapiens
tttctctactacttttcgctactggaacacctgctctttgagggggctggcctcctgctagatggaacctgtgggagagaaa

SEQ ID NO: 6817967 - DNA, 129 bp, Homo sapiens
ggcttcacccccagggaggctgccagacttttggttaaggaccatggctctggggacagtaagtcccacatccgaatctgaggtgagctccccaggccagtcacttggccccttggaacctccttgtcc

SEQ ID NO: 6817968 - DNA, 92 bp, Homo sapiens
tcacctgggggatcttgttaaaatgaatattgattagcaggtctgagattggcctgccattctgcatttataacaagctcccacccaggtga

SEQ ID NO: 6817969 - DNA, 95 bp, Homo sapiens
ggctcccaggaggggtgagctgggcctgtgcctgggtgggattggagatgctctttggacaggatgctggggccccgcctgccttccctggggcc

SEQ ID NO: 6817970 - DNA, 86 bp, Homo sapiens
ctcctccctgccagtgatgtggggaccgtcctggctggccactaccagctgtttgactctctccccacttgctgagaggggctgag

SEQ ID NO: 6817971 - DNA, 60 bp, Homo sapiens
ggtgcttttcttcatggtttttgtagctttgtgttgtgaggttatcatcagttgagcact

SEQ ID NO: 6817972 - DNA, 58 bp, Homo sapiens
ctggtggggagtcctggtctccccacagccttgggtggagacaggagcccccattcag

SEQ ID NO: 6817973 - DNA, 85 bp, Homo sapiens
ttagaaatcagcaccaaactcctgcgatgacttagtctttgcagactgagctcttgactgggagttaagatgacctgagttctga

SEQ ID NO: 6817974 - DNA, 60 bp, Homo sapiens
ttctctaaagagttaggccaagatgtatttgacacataatatgctagacattttggagaa

SEQ ID NO: 6817975 - DNA, 57 bp, Homo sapiens
cagtgactgcttcaccaccagagccgccacccagtgcctggactgggagcagcactg

SEQ ID NO: 6817976 - DNA, 59 bp, Homo sapiens
cctccttctggggccttctgctcagaacctggacaagagctgtgggctcagaggggagg

SEQ ID NO: 6817977 - DNA, 85 bp, Homo sapiens
gaattggagtgaactgtaaaggtgattagaagttgttatcaaaaatcttcataacttggtcctggttgccttgatagcccaattc

SEQ ID NO: 6817978 - DNA, 55 bp, Homo sapiens
ctctctaagaacttgatcttgtccatttcaggacaaacctgaggttcgtagaggg

SEQ ID NO: 6817979 - DNA, 96 bp, Homo sapiens
gggatagagaagactacagtcaacattgatgatgatgattattatatagatagtttgaaaaaagttacagaaatcttgactgtcttttttcctccc

SEQ ID NO: 6817980 - DNA, 77 bp, Homo sapiens
gccaaattaaggaaagtgccatgatttctttggaactaatcattaacaagagacattgttggcctatcctctaatgc

SEQ ID NO: 6817981 - DNA, 61 bp, Homo sapiens
tgattcaattgatggtttcagaaaagcattctggctgctgaatggaaaatggattgaatca

SEQ ID NO: 6817982 - DNA, 78 bp, Homo sapiens
ttttctgtttcctcatttatctgttgggaagctaactgtgaccttagcgtcccagcagataaatgaggaaacagaaaa

SEQ ID NO: 6817983 - DNA, 67 bp, Homo sapiens
ttcctggtgttactaaattgaaatgagccctaaactatagaaaattttaagaaatagtaaccaggag

SEQ ID NO: 6817984 - DNA, 61 bp, Homo sapiens
gctgtctcctgagactgcagtcaccttggcctacacggtggcccctgtctctggggactgc

SEQ ID NO: 6817985 - DNA, 65 bp, Homo sapiens
ctctggaagaccctaagcagtgggccaccaaggggctggccaagccactgctgggtctgcaggag

SEQ ID NO: 6817986 - DNA, 72 bp, Homo sapiens
cacagtttcaataattattcttccagtgtaatgaagtaaatgactaactgaatagatgaagattgaactgtg

SEQ ID NO: 6817987 - DNA, 72 bp, Homo sapiens
ataagatgagcagactgtatcaatgtcagtattgtggttgtgatactgtactgcagttctgcaaaatgttat

SEQ ID NO: 6817988 - DNA, 87 bp, Homo sapiens
ccctgcacccgctgcccggctctgcttcccactcttggctggtgccccgtgggcctttcaggcgatctgggcggaagtaggtcaggg

SEQ ID NO: 6817989 - DNA, 55 bp, Homo sapiens
gaaggtggtatcatgacctcagcagagagagggctctgaagatggtaccagcttt

SEQ ID NO: 6817990 - DNA, 78 bp, Homo sapiens
agggcacatctgctgggaatgggtagagcggggtgggaggagtcctggcaggggagccgttcctatgcaatgggcctt

SEQ ID NO: 6817991 - DNA, 57 bp, Homo sapiens
atcagcagagtttcatcttgggatgatggaaatattctaaaattagattttggtgat

SEQ ID NO: 6817992 - DNA, 87 bp, Homo sapiens
atatcctagaacatgatggctgttattttgggcagtttatttgtaacgttccatgtccaagaatgactcactcttatattaggttgt

SEQ ID NO: 6817993 - DNA, 55 bp, Homo sapiens
agcactagagccaaaatttgggcacatttctgtctgtctccgaagcctacgtgct

SEQ ID NO: 6817994 - DNA, 70 bp, Homo sapiens
agtcttttgctccaggacatgactttcttgctatagggtagggtagatcagctccctgggacaaaaagct

SEQ ID NO: 6817995 - DNA, 61 bp, Homo sapiens
gggtcagggctgcctgggctcagatgcgcccacgcccatgtgcccgagcagcaccttgctc

SEQ ID NO: 6817996 - DNA, 82 bp, Homo sapiens
cgtagtacagggcaatgctgaggctcaagggcaggtgggagtcagctcctaggctgtcagggctccgtttgttctcactacg

SEQ ID NO: 6817997 - DNA, 67 bp, Homo sapiens
cagccagtcgtctttattacagcttctgcagaacacttgcttagactgtgagaagatggctgcgttg

SEQ ID NO: 6817998 - DNA, 75 bp, Homo sapiens
tgagagtttgtatcactccaccagctgagccacccagcttggcagaggcatcagctgagggtgagcagaatctca

SEQ ID NO: 6817999 - DNA, 60 bp, Homo sapiens
ctggtcaaaaattatgcttactgaacgcatgactggttaagttaggcagaattttgccag

SEQ ID NO: 6818000 - DNA, 69 bp, Homo sapiens
gcctgctgtctctgggcaggcagggggctgacaggtcagcaggctgctttggctcagtgacatcagtgc

SEQ ID NO: 6818001 - DNA, 55 bp, Homo sapiens
gccaggagactccattcatttggtctggaatggtccagggagggacacttttggc

SEQ ID NO: 6818002 - DNA, 129 bp, Homo sapiens
gaatgggccataaatactgaggaccatatttgcgtgtttccaaagtgaggggttctgcgtcctatcaaggagatgtaaactactgactacactaccgatgatgctggctttttgctccattgccttttc

SEQ ID NO: 6818003 - DNA, 76 bp, Homo sapiens
gccctgtcaggcagtcacaggggagactgggctgctacacaatgtgcccatctcattactgtgttgctgacagcgc

SEQ ID NO: 6818004 - DNA, 79 bp, Homo sapiens
cttgtccttttgtcacttcttcagctttccttgagttagactcaataaaagaagaggaaggtgaaccacgaataacaag

SEQ ID NO: 6818005 - DNA, 75 bp, Homo sapiens
aatattcatgtatttgtgatagatgaccaaaaacatttaactgatgggatgggcaatgacaaaaatatgaagatt

SEQ ID NO: 6818006 - DNA, 59 bp, Homo sapiens
ggttcttcaatcagctgtacttatgtaaataagaattcaggagtcagttgatggggacc

SEQ ID NO: 6818007 - DNA, 95 bp, Homo sapiens
caccctggagcctgctatgactgtgccagtcagtgggcgggtgagctcaccctgcctcctgtgcgtgactcagggccagatgcagggccggggtg

SEQ ID NO: 6818008 - DNA, 116 bp, Homo sapiens
cacagctattgaatgggagagctggaatttgaacgtaggcagcttgttttctgagctctggcttctaaaacgctttgccatgtttatgttatttcctgtctaatttggaggctttg

SEQ ID NO: 6818009 - DNA, 128 bp, Homo sapiens
aggtggagactgagaaaggaagtcctcagcagtgtcagttcccagagctttggaagaaggaccagcagctctgtccctgggaaccatcaaaaaatgctgttgatgttttctgtgtctgtctgtcacct

SEQ ID NO: 6818010 - DNA, 57 bp, Homo sapiens
ggaatgtgttcttactgtatttgtagctcacgcagtttagtgactttggcacgttct

SEQ ID NO: 6818011 - DNA, 70 bp, Homo sapiens
ctctgagccctgtgcagatggcagctggggcaggcctcctgcagacccaggtgactgacagggcggtgag

SEQ ID NO: 6818012 - DNA, 102 bp, Homo sapiens
ggggatcctgatggtgcaataaagttgtagaaccacctcactaagtgctcccaattccttttacaattctctattattgcaatttaatcctttcacttcccc

SEQ ID NO: 6818013 - DNA, 65 bp, Homo sapiens
ctctgctgacaaaataaaatgctccgttgactcctgaaattggggcagtagctttgtttgtagag

SEQ ID NO: 6818014 - DNA, 61 bp, Homo sapiens
ctggccctaggcaaacacagatttgctttctcacagtatatactagttttgcctgggctag

SEQ ID NO: 6818015 - DNA, 124 bp, Homo sapiens
cagtgagactgctctgtgcccattcatttccctcctgccatttgctggttttctgatctggtttatttaggtttgacatcagccaaatggtgtagcgcgatgtctctgacagatattcttactg

SEQ ID NO: 6818016 - DNA, 69 bp, Homo sapiens
agaacatttggcatgagaatttggtcttgacttcacaatatggccaatattagatcagaccaagtgtct

SEQ ID NO: 6818017 - DNA, 76 bp, Homo sapiens
tgaggtaagtaacgcattcattcattcattcattgcgtcatgtatttagtgagtatttgttgagtgctaggcttca

SEQ ID NO: 6818018 - DNA, 55 bp, Homo sapiens
ggtcagaggaaaggtcagatggcttagagtatgggccatcagcttgcttctggtt

SEQ ID NO: 6818019 - DNA, 56 bp, Homo sapiens
tcctttcttgtgtatcaaatggcagtaatctactacagatgttatacaatgaagga

SEQ ID NO: 6818020 - DNA, 69 bp, Homo sapiens
ctaccagtgagctttctgtgttccagttgcttttaaagttggaagcacttggagggagggttcaagtag

SEQ ID NO: 6818021 - DNA, 55 bp, Homo sapiens
gccgcagttagccgccccctgaagaaagactcctctccagtgtggggactggggc

SEQ ID NO: 6818022 - DNA, 69 bp, Homo sapiens
gaggatgccaaagaagtatcaaagatgccagcactaatattctggctgcaggcagtgcttctgcttctt

SEQ ID NO: 6818023 - DNA, 72 bp, Homo sapiens
ccaaaagtgaagttatctggtgatatttagaaaatgaaatgtttttctgtttattcctaggagctcaaatgg

SEQ ID NO: 6818024 - DNA, 109 bp, Homo sapiens
ggagagtgagggggtggctgctcccctgaggagctccatctctgtccctagctgggccaggtggggcgccctcaggcaggacagggcggagtggaccaggcctctctcc

SEQ ID NO: 6818025 - DNA, 57 bp, Homo sapiens
aggcactgttctcagagcattagatacattatattggtctaatcatgagaacaacct

SEQ ID NO: 6818026 - DNA, 71 bp, Homo sapiens
tgggagttgtgctgtctccggcctcatttgtctccctgcgactgatgtggccttaatgacagcagctcgca

SEQ ID NO: 6818027 - DNA, 78 bp, Homo sapiens
tgggcaatcaggctcggatggaccagctccaagaactgagagtcctggagctggaatttctgggcctcgatctttcca

SEQ ID NO: 6818028 - DNA, 60 bp, Homo sapiens
agacgctgaagttctttcatatcttaattagcagttaattaagtggaggtgctggtgtct

SEQ ID NO: 6818029 - DNA, 73 bp, Homo sapiens
gggcaccccaggattgaagggaacctcagaatcatgtcactgccattctagagtttcaatccaaggggtcccc

SEQ ID NO: 6818030 - DNA, 82 bp, Homo sapiens
gctctgtcgctaggccggagtgcagtggtgcgatctcggttcactgcaacctctgcctcccaggttcaagcgattctcctgc

SEQ ID NO: 6818031 - DNA, 88 bp, Homo sapiens
gtctttctttgcacagatctggtggcaaggaatactttttgtccttccttattgatagtgccacctagtgactctgctgcataaagac

SEQ ID NO: 6818032 - DNA, 63 bp, Homo sapiens
actagatattctttcagcgttgtaactggtgttagaaaccagttgctctcaagaatatcttgt

SEQ ID NO: 6818033 - DNA, 70 bp, Homo sapiens
cattatgtaaatcacgagagctagctgtcatgattgttaggattgttagctcttgtgttttacatatatg

SEQ ID NO: 6818034 - DNA, 77 bp, Homo sapiens
tcagaatgctcagccttgcttctggactggtggtcattcactgagccagggataaaaggagtaatactgagttctgg

SEQ ID NO: 6818035 - DNA, 104 bp, Homo sapiens
caatttcctccctctgagtgggaaggaacttctcttggaaggagttttcttgctttatttcctacaattagagcctcttttctacttgacttaagggttttttg

SEQ ID NO: 6818036 - DNA, 77 bp, Homo sapiens
ctgtggtattttatctgactgtggtatatttaacaaataatgtatgcaaacagttcaggtgacacataatatcagag

SEQ ID NO: 6818037 - DNA, 66 bp, Homo sapiens
ttgtcagtctgtggcattaataaaagtgcaatcatcttgctttattttaaatatgccatgtgagaa

SEQ ID NO: 6818038 - DNA, 58 bp, Homo sapiens
gtacctgagaagttccaggggagcaggctggagaggcacccctgggggtttctggtac

SEQ ID NO: 6818039 - DNA, 74 bp, Homo sapiens
aggactctacaagaaaggaaagaatcagatgtgtgcataaaataatctgtttgtttacacctttttggggtcct

SEQ ID NO: 6818040 - DNA, 122 bp, Homo sapiens
gatttatatcttgaatgcaaataggaatatatgtttaaatagctcttgtagaagaaattcaagaagtggtttcttcttggctttttgtcatatttttctgaatgcaatctgggtaatatatc

SEQ ID NO: 6818041 - DNA, 76 bp, Homo sapiens
gtgtcagggaaccctgggcgggtgttggccgagtcacgtgaagcaaggcagctcctgcccaggaaggctctggggc

SEQ ID NO: 6818042 - DNA, 60 bp, Homo sapiens
ttctgttttatagagatttggcatatttgatatatgttctttggaatttatgaaatagaa

SEQ ID NO: 6818043 - DNA, 67 bp, Homo sapiens
gcttctgttttgcacagacttgaatctggccatatgtttctcttttcaattctggtaagacagatgc

SEQ ID NO: 6818044 - DNA, 70 bp, Homo sapiens
gataagttatgggggcttctgtagagatttctatgagaacatctctaaggaactcccccaaactgaattc

SEQ ID NO: 6818045 - DNA, 100 bp, Homo sapiens
tcttattttgcatctgaaatttgtcattgaaaccacagtatgacttaaaaccacattgtgatccgactgattaatgttcttcagaaactggcagaaaaga

SEQ ID NO: 6818046 - DNA, 56 bp, Homo sapiens
gatgaggcttgatttgcccgagagggattgtttcccccttcttactcaagctcatt

SEQ ID NO: 6818047 - DNA, 84 bp, Homo sapiens
gtttgaaggctgcttgttatagtagagagagaatcttttgatcatatgcagaagctctcattctgttattcatgtagcttggac

SEQ ID NO: 6818048 - DNA, 69 bp, Homo sapiens
tgctaccgaacagattcatctagtggctacatcagcaccttgtgctttcagatatctgtttcaatggca

SEQ ID NO: 6818049 - DNA, 61 bp, Homo sapiens
ggattttaggtgatggagtttagattttactccaggaaatctaacttcatagctgatttcc

SEQ ID NO: 6818050 - DNA, 86 bp, Homo sapiens
cttgccaagtgcatggagcaacagacctatcacagttacagccccacggcactggaagtgtctgtgcccagctctgctgacccaag

SEQ ID NO: 6818051 - DNA, 57 bp, Homo sapiens
gctggccagtgtggtgaccacctgctacctgtggctattgagcacttagtggctagt

SEQ ID NO: 6818052 - DNA, 82 bp, Homo sapiens
gagaataaagaattgagtctatcacttgaaagagagaagagggaaaattatctcagccaggtgaactcagttttgtattttt

SEQ ID NO: 6818053 - DNA, 60 bp, Homo sapiens
ctcaagtcagaaataaaagcatttatagaatttcatggttttaagttttctgaacttgag

SEQ ID NO: 6818054 - DNA, 71 bp, Homo sapiens
tgtttggtagttggggtcgggtttgtagtattgcagtgtgctttaacaagcatgggctttgacatcagaca

SEQ ID NO: 6818055 - DNA, 57 bp, Homo sapiens
ctgccagttagttaccttattacaaatttaccttagatgaggtaattcactaagcag

SEQ ID NO: 6818056 - DNA, 65 bp, Homo sapiens
gcttgaaagctgggaggcggaggttatggtgagccgagatcacgccactgcactccagcccaggc

SEQ ID NO: 6818057 - DNA, 97 bp, Homo sapiens
tgagacagagtctctgtcgcccaggttggagttcagtggcgcgatctcggctcactgcaagctccgcctctcgggttcacgccattctcctgcctca

SEQ ID NO: 6818058 - DNA, 66 bp, Homo sapiens
atgtgtccttatgaaaatactgtcttctgatagcttcagcatacagggttttttatgagaacagat

SEQ ID NO: 6818059 - DNA, 58 bp, Homo sapiens
tcatcgcctcgtgcatcttggctctgaaatgaagttgccccaggtttgcaggcgttgg

SEQ ID NO: 6818060 - DNA, 74 bp, Homo sapiens
ttgtgacttggaagtcatcatcatgtgtatcataattgaagttatgtcaatgaatgagattaccaatgtgatgg

SEQ ID NO: 6818061 - DNA, 68 bp, Homo sapiens
attatcattataatggtatagttgtgcagttataataataattacagtcttatggttatgatgatagt

SEQ ID NO: 6818062 - DNA, 55 bp, Homo sapiens
gagctattgacaagccttttggccacagatgtggaaggaggcctgcagatagttc

SEQ ID NO: 6818063 - DNA, 126 bp, Homo sapiens
tatcaacaacagcaaatatcattcattattgtttggaggacagaactatttttatattctttaattaaaaatggctttgacattttcaaattcagagggaagttgataatttagtgctgtatgata

SEQ ID NO: 6818064 - DNA, 73 bp, Homo sapiens
tagagtccgtccatcagcagtaactgttcttactcaaccttgataaaagctttgccagatgagttgggctctg

SEQ ID NO: 6818065 - DNA, 77 bp, Homo sapiens
cacaaatgactgaaacgactgttcagagtgtccccgccagctgagcagtagtttcaaaacaagaaaagtcatctgtg

SEQ ID NO: 6818066 - DNA, 125 bp, Homo sapiens
gggataaagtgtggagaaggtttccagaggttcttaaacactgccttggtgggtcaaggacagagcagaaacttgaacccctagttttaagacacactcagtctggttttctcccaccttttccc

SEQ ID NO: 6818067 - DNA, 73 bp, Homo sapiens
cttcgactctgtgcctgaagagcagcccagaagcaaaacaagagagcgaagctcatcaggcttagagtcaagg

SEQ ID NO: 6818068 - DNA, 73 bp, Homo sapiens
gcatcattgagaggattgatttatctggcgtgctgtaatgactgcagatgtggatctgttattctagatgagc

SEQ ID NO: 6818069 - DNA, 83 bp, Homo sapiens
ggtagttcagagtttcagaatacaaatactggctgttaaaattactagctatgtccctatgaattctggctctgccacttact

SEQ ID NO: 6818070 - DNA, 68 bp, Homo sapiens
gagaaatcatgaggccaagaaaagctgggtggcttactcgaagtcatcagtttggtcaatgatgggtc

SEQ ID NO: 6818071 - DNA, 99 bp, Homo sapiens
aataatgttgatatgtaaaatccatttattctgtgtaatcctgagagaaattcttacacatgtattgcagaagaaatgaatgaatatatccatattgtt

SEQ ID NO: 6818072 - DNA, 75 bp, Homo sapiens
ggaaattattgagacgtgatacacttcctatcaaaacaacacatgaggtggtgattcattcgattagtattttct

SEQ ID NO: 6818073 - DNA, 80 bp, Homo sapiens
gttcatgggagcgaggtggggcaccaaacactcgtgtctctctctgaggctggatctatgccacactcacttctgtggac

SEQ ID NO: 6818074 - DNA, 83 bp, Homo sapiens
acacgtgtacctgtgtggaaaccgcatgacgaggctaacaggctcacacaccttccatgtggtctccacacaagcaacactgt

SEQ ID NO: 6818075 - DNA, 82 bp, Homo sapiens
acgatcttggccacgtgctgggagctgccctctctgagcccttccttgcccagaggggcccggttctccgtcttggcctcgt

SEQ ID NO: 6818076 - DNA, 81 bp, Homo sapiens
tgttgatgttggtaaataagagcactggctttggagtatggcagacccaagctcgaatccttgctgtgcccttcattagca

SEQ ID NO: 6818077 - DNA, 59 bp, Homo sapiens
gtagatgtagccactgctaaaagagaggtccaggttcttcccttcagtggctgctctgc

SEQ ID NO: 6818078 - DNA, 80 bp, Homo sapiens
ttatctttttggcttacttgtagtttgtaatgtttcaacaataagtatggataattaacaagatagggataaaaagataa

SEQ ID NO: 6818079 - DNA, 56 bp, Homo sapiens
catgatcagaaagagaagctaggactttattatatagctttgtatttgtgattatg

SEQ ID NO: 6818080 - DNA, 96 bp, Homo sapiens
gaggtgggaatcctggggatggggatggggtcactctggacctgggggtccctcctggctggccctgccctcttcatctttggaagttccctcctc

SEQ ID NO: 6818081 - DNA, 60 bp, Homo sapiens
cccagaataggtaagcccagggggatagaaagtagatctgtggttatctaatttactggg

SEQ ID NO: 6818082 - DNA, 69 bp, Homo sapiens
gagctcaggtggtcaaaacaattctaatgaagttgagtttctacttcaattgttttgtatctgagactc

SEQ ID NO: 6818083 - DNA, 96 bp, Homo sapiens
tggcaagtctattaatagctcctagaacagagttccagtgatcattgtgtgatgaacactgaaggtctttttcaaaagctttgaaggttcttgtca

SEQ ID NO: 6818084 - DNA, 83 bp, Homo sapiens
aagtcgtgctctgctgcccactgtatttctccatgctcgtgtcctggagtgaacgctgcagtgatggcagcacagaaccactt

SEQ ID NO: 6818085 - DNA, 65 bp, Homo sapiens
tggtaggagcaggggtaggatgagccagagaaagctggagcctggcttctgccccattctctcca

SEQ ID NO: 6818086 - DNA, 63 bp, Homo sapiens
ggtctagctcacggcctgcacctgggatgttggggctgtgcagaggcgccgtgggtggggacc

SEQ ID NO: 6818087 - DNA, 62 bp, Homo sapiens
cctgtgtgaaggttaggcaggtttaggatgctagttacctcatggttcagctttcacagagg

SEQ ID NO: 6818088 - DNA, 84 bp, Homo sapiens
gagctattggaaaagatggaaagaaagtgtgaacaacttgggaatttcagtgtcttacagtttttttaaagcttgttatagttt

SEQ ID NO: 6818089 - DNA, 84 bp, Homo sapiens
ggaacaaattctgaagttgcaggagaagcttttggccctacaggaagagaagcaccagcttttcctgcagctcaaggaagtttt

SEQ ID NO: 6818090 - DNA, 60 bp, Homo sapiens
ccagatgagaccacactgctggaaagacttcctgctcagatagtgggtggtctctcacgg

SEQ ID NO: 6818091 - DNA, 56 bp, Homo sapiens
agccagtatcactctgtgttcttgattttttcttatcgacattcctgacactggct

SEQ ID NO: 6818092 - DNA, 66 bp, Homo sapiens
accttcacattcagaaaaagcccgttgtaatgtccagtggtaacaatggagcctaagagtggaggt

SEQ ID NO: 6818093 - DNA, 75 bp, Homo sapiens
gtcatgcttacactcaggtaaaactagggagacacgttgtgcccctagcagaaaatctgaaatgtcaaagcagat

SEQ ID NO: 6818094 - DNA, 59 bp, Homo sapiens
ctggcagtgtccagctcgtgatgggcttagttgcattatcactagagttacattgccag

SEQ ID NO: 6818095 - DNA, 88 bp, Homo sapiens
tgcactgcagccagcagcatgtggaatctctccatggttcctcccccggtataccaaggaagagattctcagttagttttccagtgca

SEQ ID NO: 6818096 - DNA, 67 bp, Homo sapiens
cattgctgacagatgaagagaactggtctaccacatcttggcttctttaccttcatttttagtaatg

SEQ ID NO: 6818097 - DNA, 55 bp, Homo sapiens
ccctcactgtccttgggcccttggcctctgctgagggcgtgggggacggtgttgg

SEQ ID NO: 6818098 - DNA, 56 bp, Homo sapiens
gcaggagatatgaagctacacagtctttaatggctaagtctggctttgttccttgt

SEQ ID NO: 6818099 - DNA, 58 bp, Homo sapiens
acccaggaagtggaggttgcagtgagctgggattgcaccactgcactccagcctgggt

SEQ ID NO: 6818100 - DNA, 93 bp, Homo sapiens
aggttctggttggttaagagttttgtgtcaagttcttttagttgcaaacaatggaaacttatctgacacgaacctaaacacaaaagagaattt

SEQ ID NO: 6818101 - DNA, 82 bp, Homo sapiens
accagatttctctagggaaataaactgagtggtgaccaaaatttaatatattactaggcagtttttctctgtgtttactggt

SEQ ID NO: 6818102 - DNA, 67 bp, Homo sapiens
acttatccatgtctatatgttgtgcctggtgtactgtaggtgcttagtgcttgtggaatggatgagt

SEQ ID NO: 6818103 - DNA, 83 bp, Homo sapiens
tttcattcagatctcgtgcctgggcaccagcgtctcgtgagaactcaaatgggctgagtgtcccaggccgaagtgagaagagg

SEQ ID NO: 6818104 - DNA, 73 bp, Homo sapiens
ggagtgctgagcagatccagaggggaaagcaacacagactcttttttccacccagagcatttgtttcccaccc

SEQ ID NO: 6818105 - DNA, 84 bp, Homo sapiens
ctttctccgtttttcacatttctttatgtagtcttttgttaagaggacttctaagctaagaagttgtagagataactgagaggg

SEQ ID NO: 6818106 - DNA, 70 bp, Homo sapiens
tcgcggctgggctggccgccgagatcgcctgacggcaggccgagaacggctgggcgggcccaggccggga

SEQ ID NO: 6818107 - DNA, 65 bp, Homo sapiens
ggatgcgaggtggtggtgattccacagagagagctgccttacagatcagcatcacgtcagtgtcc

SEQ ID NO: 6818108 - DNA, 118 bp, Homo sapiens
ttaaaaaatattattgagctgctatgtgcgttttcatgccagcaagaatagacagtaaaaaagacattcactgttcctcttctctggagcttatatactagcttggtgagtcctttaa

SEQ ID NO: 6818109 - DNA, 62 bp, Homo sapiens
tgctgagaattcagtccaggtctgattgacttctgggaaacaggacctgctgagtctaagca

SEQ ID NO: 6818110 - DNA, 113 bp, Homo sapiens
taacagtgtttgggaaaatttgaaagataagatgtaatcagaaaaacacacttcagtaaagtttatttgaacatctcttgttttcttgtgaattttgacctcaagttacttta

SEQ ID NO: 6818111 - DNA, 73 bp, Homo sapiens
ctgtagacatcagccaggtcagatagttatcaacacggatgattgtctaattgacttggtgtggtgcctagag

SEQ ID NO: 6818112 - DNA, 79 bp, Homo sapiens
gttggcaccttcttgctttatctgttcaggggaggaaagttttatcctcccattgtggaaggcagaagagcaagctagc

SEQ ID NO: 6818113 - DNA, 83 bp, Homo sapiens
tctggagttttggaaagaggtctatgctaggggaacttgtggaagttctctttggatagctttggtattctcagaaaaataga

SEQ ID NO: 6818114 - DNA, 88 bp, Homo sapiens
cagatgtagagaatgaaatggatggaattgacatttacatctgcggatgtagagaacgggattccatccgttctatcctctgcatctg

SEQ ID NO: 6818115 - DNA, 90 bp, Homo sapiens
aaggagtgggtggaagaggtcctggggctggtgagatgaaaaatgcattgtccttgggctgcaggcttccctccagcattctgactcctt

SEQ ID NO: 6818116 - DNA, 85 bp, Homo sapiens
ggggagaggatcctacacgaagcctccctggcctcagcaatgccaggctgagggtttagggtcaggtggcttctgtcctctcctt

SEQ ID NO: 6818117 - DNA, 71 bp, Homo sapiens
gtcaaatcttgtggaatgtggctgtcaattgatgccctaaagttaaggttggtctgtattccacaattgac

SEQ ID NO: 6818118 - DNA, 63 bp, Homo sapiens
aggtaccatgctgaatgaaagaaattagtttcaaaagctatgatttcatttagatgacatcct

SEQ ID NO: 6818119 - DNA, 64 bp, Homo sapiens
gctcacatttccactccctatgcgtgatcctgtgttaagtgtggggctcagtgggaatgtgtgc

SEQ ID NO: 6818120 - DNA, 61 bp, Homo sapiens
gggcttctacttgcaaaggatagggagagcttctgttcatccttgtgaagtaggctggctc

SEQ ID NO: 6818121 - DNA, 87 bp, Homo sapiens
ggagaatcacttgaacccaggaggcagaggttgcagtgagctgagatcgcggcactgctctagcctgggtgacaagaatgaaactcc

SEQ ID NO: 6818122 - DNA, 85 bp, Homo sapiens
tttcttagatacagagttttagagagatttttgtgtgtgacttttctcagtctttcaggtattttcaaggcttgtgttaaaggaa

SEQ ID NO: 6818123 - DNA, 72 bp, Homo sapiens
ttgtctgttgattgtggatttttatatatacattatataattatgtataagtacacagtcggaattgaacaa

SEQ ID NO: 6818124 - DNA, 90 bp, Homo sapiens
ctggggcagacccctccatttagctcagagcccagaggggaacagggagtgacaagtcacacctgggctctgaggagggagtcgtcccag

SEQ ID NO: 6818125 - DNA, 75 bp, Homo sapiens
cgcctcccttggtttcacactgcatggtgtagtccaaggactgcactggcatttcagtttgaacactaagcggtg

SEQ ID NO: 6818126 - DNA, 76 bp, Homo sapiens
tgtgtcaatgtatctaacccggaactaagttttcctgagtccctttctctgtgtggttctgagttagagttggcca

SEQ ID NO: 6818127 - DNA, 82 bp, Homo sapiens
gcaaaatgttaggtggcactcattatcaggtgctgacatgcacttgcgtggccttgagagtgagtgccaccttaagttttgt

SEQ ID NO: 6818128 - DNA, 100 bp, Homo sapiens
ctgttgaagctaaaaagatggaagacatgatgattctccttccagttgtatttcatttcgattaatcctttatggttttcctcccttctggtttctgcag

SEQ ID NO: 6818129 - DNA, 82 bp, Homo sapiens
ccagcatgttattgctcccaggactcttgagccaggtcatgtcctcggtttttatgtgttgggagtgaagataatccactgg

SEQ ID NO: 6818130 - DNA, 65 bp, Homo sapiens
tgggtctttgggcagatgtgtctgaatctacaaagttcactgccaggctctcatccagggaccca

SEQ ID NO: 6818131 - DNA, 58 bp, Homo sapiens
ttagataaagtgatgtaggctatattttgcttatgagtttttatattactgtatctga

SEQ ID NO: 6818132 - DNA, 78 bp, Homo sapiens
ataaggatattttgttgagtgcttaaaaactgaccatgtgtcaagttttgtctaagaactttgcaaatattaacttat

SEQ ID NO: 6818133 - DNA, 56 bp, Homo sapiens
cctggatcccgatggctgtgaggagctagagtttccacttcctaatggattcaagg

SEQ ID NO: 6818134 - DNA, 72 bp, Homo sapiens
aagctcaattcaacttatctaatgttgggatatttctatatgttgaataatatgttaagtgctattgagctt

SEQ ID NO: 6818135 - DNA, 65 bp, Homo sapiens
gtctgatctttcaagggaagccagcaaagtggatttttatgtgaagtctcttgaataggtcaaac

SEQ ID NO: 6818136 - DNA, 70 bp, Homo sapiens
atgtctgctttccttttaatcacaatctaagatcaggtcttcatttcacagtggtagaggaagttgacat

SEQ ID NO: 6818137 - DNA, 71 bp, Homo sapiens
gaggagggttagcctaagtggagaaatgaatggcttacaacaacgatttctagacttcaggcattctcctc

SEQ ID NO: 6818138 - DNA, 57 bp, Homo sapiens
tcaattgtgaacaagccccttattcaaaatttgagcaggagttgagtgcacagttgg

SEQ ID NO: 6818139 - DNA, 57 bp, Homo sapiens
tcgtagctgtgccttaaggtcatcatctcacagaggaggggacaggctcagtgacga

SEQ ID NO: 6818140 - DNA, 56 bp, Homo sapiens
atttctgttgcttataaattacccagtctaaggtattttgttatagcagcaggaat

SEQ ID NO: 6818141 - DNA, 85 bp, Homo sapiens
ggcccatgggagtgggaagagccaattggggtagcagaggatgctgtgctcccttaggaaagcttggccagcgctctgatgggcc

SEQ ID NO: 6818142 - DNA, 70 bp, Homo sapiens
gctcatgtgtcttgctgccctccatgtgaccccgagtgggtccgagtgtgggctgcagaggcacagctgt

SEQ ID NO: 6818143 - DNA, 61 bp, Homo sapiens
aatgtcttggatacagaggttggggacaatgtttgattcaccactgtatctccagcacatt

SEQ ID NO: 6818144 - DNA, 122 bp, Homo sapiens
ctaacatagttgcatcttggtactcaaagacagatttgatctagacaatgcactgtaaggaattccattcattctttagcatagtgctgaacattttgtctcatcttataatgcagtgttag

SEQ ID NO: 6818145 - DNA, 61 bp, Homo sapiens
aacaaatgttatgtttttgtgtccagctattcagctgggatgtctatagaacacttttgtt

SEQ ID NO: 6818146 - DNA, 87 bp, Homo sapiens
ttctgtgggctcaggagtcagaggcatactcccagtcttgcttacaattgcagaaaggtatgtgtgcctttggctgtgcccacagaa

SEQ ID NO: 6818147 - DNA, 57 bp, Homo sapiens
ggaccatggctttccagtcctccactctccatttgagtgtagacataggtctggtct

SEQ ID NO: 6818148 - DNA, 68 bp, Homo sapiens
tacattttagggatatgtatgccttttagatcaagaaccatctagctatttatagccactgaaatgtg

SEQ ID NO: 6818149 - DNA, 61 bp, Homo sapiens
tgtccatgagctagctttccaaaggcaattgattgctttaaaaaaatgttagctttgcaca

SEQ ID NO: 6818150 - DNA, 67 bp, Homo sapiens
agggcagcagctgtccctgagattcatagataaagccttgacttgcagaagggataagctgtgcttt

SEQ ID NO: 6818151 - DNA, 65 bp, Homo sapiens
ggcttcaggcccagcacagcgcgtgtcattctgggaaaacatcttgtctttttgggcctgaagcc

SEQ ID NO: 6818152 - DNA, 74 bp, Homo sapiens
tccacctgaaccatgtactttattctgttttacacatcagttgaaactgtaaatactagtaagtgtagggtggg

SEQ ID NO: 6818153 - DNA, 65 bp, Homo sapiens
tgacttggagactggtgcagataggcttttccatccatccctccctctgcacctccttccaatca

SEQ ID NO: 6818154 - DNA, 75 bp, Homo sapiens
caatttcaagatctcagtgggttaaaagagaaggagcttgtctctttcccacacagtccactgcaggtctagttg

SEQ ID NO: 6818155 - DNA, 124 bp, Homo sapiens
ctgaggccacctgctgtcatcctaggctgttccccctcccaccctctcccgatatttggtggtctgaggatagctagaggtagatgggttagaggcagtgtgagaatgcagttggaggcctcag

SEQ ID NO: 6818156 - DNA, 87 bp, Homo sapiens
catttctcagggtctggtccttagatttgaaagaactgggaagtaaaaaaattggattttgaaactaagaaccaggcctgagaaatg

SEQ ID NO: 6818157 - DNA, 64 bp, Homo sapiens
actgcaactttcagttaatgactccataggatctgcttaaactgggttagactgaattttcagt

SEQ ID NO: 6818158 - DNA, 60 bp, Homo sapiens
caatgtcagagaagctcatatcagtggttctgatgaaaaacgagtatttctctgatgttg

SEQ ID NO: 6818159 - DNA, 69 bp, Homo sapiens
gctcagcatgtttctcagccgttggagaatacatagatgttctcctggagcaggaaggtgggcctgagc

SEQ ID NO: 6818160 - DNA, 63 bp, Homo sapiens
tgtggagctctacagatatcatgtggttttctgcaaaagttttgatgtctgttgaatttcata

SEQ ID NO: 6818161 - DNA, 55 bp, Homo sapiens
tctggaatattagctggtcttaactaggcaaagttggacaaaagaatattccagg

SEQ ID NO: 6818162 - DNA, 59 bp, Homo sapiens
cagtgaatgttggaagttatatagagtagtactcagtttaactttccaataattcattg

SEQ ID NO: 6818163 - DNA, 73 bp, Homo sapiens
gcatttcctgccagggttcctttaagctttgtgattcagttcccatggccaaggggcctaggcagggaaatgt

SEQ ID NO: 6818164 - DNA, 106 bp, Homo sapiens
tttaggacaggcagaaatgaacctcaacctcagctgtgaggatttatgtagtttgaaagaagagtgcatgtgtttgccacagtgagctgcaggaatgcctcctgaa

SEQ ID NO: 6818165 - DNA, 84 bp, Homo sapiens
ccgtactctcctgaggggacaggactcatccaggctctcatcaagtctgcaacttgtgatttgtctcttccaagcagagtttgg

SEQ ID NO: 6818166 - DNA, 60 bp, Homo sapiens
attgctgcgtggcttttagaaggtctgtaggaaggaatatcttctgatttatggagcaat

SEQ ID NO: 6818167 - DNA, 126 bp, Homo sapiens
gggctttttagttgtatgggttgtcctcagataacaatggccttgtttcattacacgtggtcctggctgggaagaaaagacactacagtgtgataagaggggccttgggggacctgacctgggccc

SEQ ID NO: 6818168 - DNA, 81 bp, Homo sapiens
tgggcagtggcagagtgggggcagagaaatggacagttgggctgttgcttggattctgggtctttgccctctggcagccta

SEQ ID NO: 6818169 - DNA, 55 bp, Homo sapiens
ggggctcgccgctgcccctcccctccacaccaaggcctgagacagcaggagcccc

SEQ ID NO: 6818170 - DNA, 66 bp, Homo sapiens
ctgcatcctaatccctggaacctgcaaatatgttagattagctggcaaaggggaattaggttgcag

SEQ ID NO: 6818171 - DNA, 60 bp, Homo sapiens
tatacctgtcaaaagacatggagatcagcagcacaatctcagtcccattgaagaggtgta

SEQ ID NO: 6818172 - DNA, 89 bp, Homo sapiens
tcctataaggattcttacgagccttatgcaggcacttgcctaagtacctgcataatcccaggcttgcattcaaagcagtccttagatga

SEQ ID NO: 6818173 - DNA, 84 bp, Homo sapiens
tagagatgggaaagaatagagactttatcactcatgtaaagcagtgtcgatgtaggtttctgattcttgctagtattatttcta

SEQ ID NO: 6818174 - DNA, 65 bp, Homo sapiens
actattcagaatcaccagccttcaagttactattcagaatgtgaaaagcgtgtgttctaggtggt

SEQ ID NO: 6818175 - DNA, 69 bp, Homo sapiens
gcacatggaaatgtattcagtggaaactatgggtaaacactatactacacattgactatatttactagc

SEQ ID NO: 6818176 - DNA, 68 bp, Homo sapiens
tggtagctttagtgaaaaatatcagattatgatgattataattttggtgatgatactaatagctacca

SEQ ID NO: 6818177 - DNA, 62 bp, Homo sapiens
agggcatagcagaaagagctctggactgaaagtcaataaacttgagtttatctcctagccct

SEQ ID NO: 6818178 - DNA, 62 bp, Homo sapiens
gggctctgtgttctagctctcgactcgtgcagtgggagaagagtcttaatatacagcggccc

SEQ ID NO: 6818179 - DNA, 65 bp, Homo sapiens
tctgaacttaaaagcaaaattcttaggaagagccttttgaaatctaagacttttgtaagttgaga

SEQ ID NO: 6818180 - DNA, 56 bp, Homo sapiens
agagctaatcacaggagatgctccagaatgcctaaagtatcataatgaatagttct

SEQ ID NO: 6818181 - DNA, 67 bp, Homo sapiens
gtttgattaagcacctactgaatgctaggctctgtattagatcctggagatatagaggtgacaagac

SEQ ID NO: 6818182 - DNA, 57 bp, Homo sapiens
tgtgtctgtttttgtaccagtaccatgctgttttggttactgtagcactgcagtata

SEQ ID NO: 6818183 - DNA, 128 bp, Homo sapiens
tcatttcattgtataataaatgttgttttcctcccctggactcaggtccttggtaacagagtttctttaaatctgtagtcacagtacatgattcagtggtagcacattctgtattcattgtagaatga

SEQ ID NO: 6818184 - DNA, 130 bp, Homo sapiens
ggaaaaagtaaacctttcccttacagttttgtatgcttctctaggttctaaattaggtatttatctaaatagtatagaattcgtgtttgtaattcaggaggtaaaaaagagtattaaagggacttgattt

SEQ ID NO: 6818185 - DNA, 63 bp, Homo sapiens
tcttgtccctggtgacacgctaaacatactaattgatatgaagctgatttttaggagacagga

SEQ ID NO: 6818186 - DNA, 83 bp, Homo sapiens
tacactttcccttctgtgccagcagcctcctggagatagctgtggtctctccttgggagggtgtttggccatgggtcagtgta

SEQ ID NO: 6818187 - DNA, 77 bp, Homo sapiens
ttgtggcatcctggttttgaatatgtctgcttctggtggataagaattatggtatgttcaacaactggataccataa

SEQ ID NO: 6818188 - DNA, 79 bp, Homo sapiens
cctgtgagagttctgagggggtgtttataagctgctgaatttcaggagctcagttggccactctttcagactagacagg

SEQ ID NO: 6818189 - DNA, 62 bp, Homo sapiens
gcctgaatctgatgaatgatctttggtaacaagttttccagctgttctatcagaattctggc

SEQ ID NO: 6818190 - DNA, 102 bp, Homo sapiens
gggcctgagcgggtgctcacctgcatgatggaacatgagggacagcctcccaaacgggctaacctcgtactgtccacagcagcccacaccgcttataagccc

SEQ ID NO: 6818191 - DNA, 78 bp, Homo sapiens
gggaaaaatcagcacagcacctaggtttgtggcttaggcaggttttagcccaaactcatggtcctttgtggagttccc

SEQ ID NO: 6818192 - DNA, 56 bp, Homo sapiens
gcagaggcctgaaggtggcgggagctctgtgtatcctcctgctgcccaccctctgc

SEQ ID NO: 6818193 - DNA, 55 bp, Homo sapiens
ccaggacctggagctctatgaaggcatctagttctcgactcagtccagctcctgg

SEQ ID NO: 6818194 - DNA, 66 bp, Homo sapiens
gacttgggagtcttctgagatgggttcctaccacctcactctcccaatccagttagctgccaagtc

SEQ ID NO: 6818195 - DNA, 88 bp, Homo sapiens
ggtatcttctttctatgaagcaacagccctcctatttggcaagaacatcccagccaaaggggaggttcttcaaggaattgagatagcc

SEQ ID NO: 6818196 - DNA, 68 bp, Homo sapiens
aagcacatgtgtaggtataacttgtgagtaagcactatttactctacaaataaattactatgtagctt

SEQ ID NO: 6818197 - DNA, 72 bp, Homo sapiens
ttcccctcacccacattcctctagtatgtgactatgatcacgtatgtggtggaaatgtccccaggttgggaa

SEQ ID NO: 6818198 - DNA, 55 bp, Homo sapiens
gggccagacctcttctcagggaagaccgcgggtgtcagggaagaggatctggccc

SEQ ID NO: 6818199 - DNA, 61 bp, Homo sapiens
gcaaaggaaaagattcatgaattcaggccatagcctggggcctgagaacttttacttatgc

SEQ ID NO: 6818200 - DNA, 62 bp, Homo sapiens
gtggtcattaagatttttttctactgggattttccaagcagactgaatcctgataataccac

SEQ ID NO: 6818201 - DNA, 67 bp, Homo sapiens
gatgatgcatatctcctatctcctcaaatgtattccagtatgaggaacatgggagaaatgtcttatt

SEQ ID NO: 6818202 - DNA, 63 bp, Homo sapiens
ctccccagcatttctgggctgcacttgtagctgggccagcagtgctcccaggacctggggcag

SEQ ID NO: 6818203 - DNA, 56 bp, Homo sapiens
aatgagcatggctgtgttccaataaaattttatttgtggacacagaaagctgcatt

SEQ ID NO: 6818204 - DNA, 72 bp, Homo sapiens
agcaggaatatagtatttcgagggctcattgtaatgcgtaatgagaaactctttgtgtgcagtgtgcctgct

SEQ ID NO: 6818205 - DNA, 84 bp, Homo sapiens
ggctaataattctggaagttggaactgatatgatgtgtctccaaaaccccatcataaatcatatcattagactatccagtggct

SEQ ID NO: 6818206 - DNA, 93 bp, Homo sapiens
caatggccatcagagatttaggtcacagtgttaccatgctttagtcagaaggaaagaactctgggtcactgtgcaatttctggttggcttttg

SEQ ID NO: 6818207 - DNA, 63 bp, Homo sapiens
gctgatctggttccaggacattgcaaaagatttatttacaatcacccaaagagccagaatagc

SEQ ID NO: 6818208 - DNA, 65 bp, Homo sapiens
ggagtggcagagctgggatttggggcagtttgcttggccccaaagccctgctctccttccactct

SEQ ID NO: 6818209 - DNA, 66 bp, Homo sapiens
cttacttcagaccccagaatgaagccagtgggctatctccgctgttcagcgtgggtgtgaacagag

SEQ ID NO: 6818210 - DNA, 80 bp, Homo sapiens
catggccccaggcgtgtcaggctaatttgcacctgaggctcttcatacttggcagacagccagactgcactggggacatg

SEQ ID NO: 6818211 - DNA, 65 bp, Homo sapiens
gccagttgatccagcaatggcctttgtagaaaaatatctaatcagaaccttgggtcataactggt

SEQ ID NO: 6818212 - DNA, 89 bp, Homo sapiens
tcatcatgttctcatgactagagtattagttcaatgtcttccgtgccatggctgttgaaagtggagaacctggttgtgaagatggatga

SEQ ID NO: 6818213 - DNA, 71 bp, Homo sapiens
tgaagggagactagagttgaactatttgccatcaatgatgatgactaattgataactctgtaatcctttta

SEQ ID NO: 6818214 - DNA, 72 bp, Homo sapiens
tctcaaaaccattagtcaatcagcaagaaacagaacccgtgcttttgctgtgcaggctggtgacaaatgaga

SEQ ID NO: 6818215 - DNA, 70 bp, Homo sapiens
tgggagatatgaaatgggtaaacctggctaccacttacttaaccctgagctagtccaggcatatctccta

SEQ ID NO: 6818216 - DNA, 89 bp, Homo sapiens
agctggaagcacatatactttgtaagtgacttcttattaataatacattcaaatataagaagcattataacatgcaaggtcttccaact

SEQ ID NO: 6818217 - DNA, 84 bp, Homo sapiens
gaaagttttcacccctgttatagaaccacctcattctttttaatgactgaatagtgttctataatatggatgtgtcatattttt

SEQ ID NO: 6818218 - DNA, 130 bp, Homo sapiens
caatgagcccatgttaatatcatgcttagaaaaatgactcattaaataggatgatttttaaatgccgctgaaagtctagttgcttatgtgatggagccacttctttcgcagatggtgattgggtttcctg

SEQ ID NO: 6818219 - DNA, 87 bp, Homo sapiens
cagcctggacaacatggtgatacccagtttctactaaaaatacaaaaattagtcgggcatggtgatgtgcacctgtagtcccagctg

SEQ ID NO: 6818220 - DNA, 55 bp, Homo sapiens
caaaagactttcacctagcaaagaggcgttcgttctgatgagggaaagtcttatg

SEQ ID NO: 6818221 - DNA, 65 bp, Homo sapiens
gtctggtttgtgtaggccactagaatcctctttgggaatgatctactgccttgcacaggctagat

SEQ ID NO: 6818222 - DNA, 66 bp, Homo sapiens
gcagttctgggtgccagcatggctgagttctggtgaggactctgtacctggcatgtggatgattgc

SEQ ID NO: 6818223 - DNA, 64 bp, Homo sapiens
caggcacacagcttgcataaatcctgaacacattcctcaaggctttatgatgtgtgtgtgtgtg

SEQ ID NO: 6818224 - DNA, 83 bp, Homo sapiens
tgactctactgtattgtgaaagcagccatgggcattctctatgtgaatgggcatgactgtgtttcaaagcaacagtatgtaca

SEQ ID NO: 6818225 - DNA, 58 bp, Homo sapiens
gggctgcactagggcaaggtgaccaccctacttggtaaagacctgattggcgcagccc

SEQ ID NO: 6818226 - DNA, 106 bp, Homo sapiens
gggtttttattattggtccaggtttaaaacattttatctatttaaaacatatgttgtgtgttttaagaagttatgttataaataacagcattgtggttaagagccc

SEQ ID NO: 6818227 - DNA, 109 bp, Homo sapiens
gtcgctgtagctctttcacctcttccatggatttatctggcttttgttacttgggaaggggagcgagtgggcgggcaggatagagtgagagtgtgagagagacagagac

SEQ ID NO: 6818228 - DNA, 60 bp, Homo sapiens
cagagacattaagtgccatgattaaatcttcatagttgatctttgcactagatgtttctg

SEQ ID NO: 6818229 - DNA, 58 bp, Homo sapiens
gtgactcctcagttgcttcttagttttaacaagaactacttcccatctgaggctttac

SEQ ID NO: 6818230 - DNA, 63 bp, Homo sapiens
cagaaattatcatgggggagaaacatgatttatttacatgttcccagactcccaagatgactg

SEQ ID NO: 6818231 - DNA, 57 bp, Homo sapiens
tcaggagggagtgtggatagagtggattgttgtccccagttttccacaccctcctgg

SEQ ID NO: 6818232 - DNA, 83 bp, Homo sapiens
ctaaagggtgtgtatctcttagaggtgtgtgtgtgtatgtactgtgccttacatgtgtacttttaaggatgtgtgtgttttag

SEQ ID NO: 6818233 - DNA, 57 bp, Homo sapiens
ctagagaaaggcagtggagcaagagtaaatgtttctgggttttgtttccttctttag

SEQ ID NO: 6818234 - DNA, 77 bp, Homo sapiens
caaggacccaagtgcttttaactctccaggccaaatccactttgctcctgggctgaagcacactgggcacattcttg

SEQ ID NO: 6818235 - DNA, 129 bp, Homo sapiens
ggcacagtgtgaaccctaaagtgatggcaagcaagctgaagagatcaacacaaatacctaaggagatgttttcggactcttccgtacttgcacatccaccttagtgatctggttccaacccaacttgtc

SEQ ID NO: 6818236 - DNA, 73 bp, Homo sapiens
gaggcttaattaaggcatagcttgtgttgacatgggtataaagtcaatgcttagtttgcctgaagaaagtttc

SEQ ID NO: 6818237 - DNA, 75 bp, Homo sapiens
tttgcctatggatgtttatctacaggctccaaataatatggatttattctggtaatatacagaccatttggtaga

SEQ ID NO: 6818238 - DNA, 63 bp, Homo sapiens
tggccctttgtgtgctagctgagcctgcctacctggtttgggctggaagacactgaagggcca

SEQ ID NO: 6818239 - DNA, 76 bp, Homo sapiens
tgatggggagaaaaatgacttctgcaaggtcatttggaaagtctgtgactgagctgcagagtgtcacttctggtca

SEQ ID NO: 6818240 - DNA, 66 bp, Homo sapiens
gaggggccgaatcagtgtgtaaagtggctgcctaggctggggcagcactgggtgctgaagtccttt

SEQ ID NO: 6818241 - DNA, 71 bp, Homo sapiens
aaacaccatgcaggcagatatgttcgctttaaatacaacttactgtgctgtatatttgcctcatattgatt

SEQ ID NO: 6818242 - DNA, 129 bp, Homo sapiens
gagattgcggacgccagccatctgctcagcaaccccactctgtgggccaggcagccgggctgggagcgtccagtgccagccttggctttcctagccctgagagcctcagcaggggtttccatcagtctc

SEQ ID NO: 6818243 - DNA, 72 bp, Homo sapiens
ccagcagatcaataaaggttgtttcgggttcttcttttttcacttatttagaaactatagccgatctgctgg

SEQ ID NO: 6818244 - DNA, 83 bp, Homo sapiens
ggatgctggcactgagatgagttgcatagattttgaaaatttaaaaaaatcttctgacaatatgtctactttagagaagctcc

SEQ ID NO: 6818245 - DNA, 76 bp, Homo sapiens
gctagctctccgcctcttcagcaaagttcggccccctgttgggggtatctctgttaaggagcattttgaggttagt

SEQ ID NO: 6818246 - DNA, 57 bp, Homo sapiens
agggagggaagtttaggtgagcagagcctctgtccttctgtctcagtgtcccttcct

SEQ ID NO: 6818247 - DNA, 58 bp, Homo sapiens
gccaccctggtgttgccccgcttttcattatccaacaatgattggcacatcagggagc

SEQ ID NO: 6818248 - DNA, 68 bp, Homo sapiens
agggtaagacatagatttctcatgaccctgtcaagggctgcccttaggagaagctatgtaacagcttt

SEQ ID NO: 6818249 - DNA, 121 bp, Homo sapiens
gaaacatgtgattttgcaacatgtgtccacatgtggttcaagtactccacatgtgctctttcaatgggtcctgtgaccttgctgtggatcacatgtgtttcacatatggtttatatggttc

SEQ ID NO: 6818250 - DNA, 104 bp, Homo sapiens
cacattttacctggtgttcccagcattccagaagctcgactgagtcttacattctagtacatgctcagtggtattcggaaactggaagcaattctctgaaagtg

SEQ ID NO: 6818251 - DNA, 58 bp, Homo sapiens
cctggctggggcctagcaccagaaggcaggcgctcttctcaggagcccccaggtcagg

SEQ ID NO: 6818252 - DNA, 81 bp, Homo sapiens
tgagatgagcttgtagctgcagaagagttctgctgaaaggaactatgactttggtagataaatgcagttactgcctcctca

SEQ ID NO: 6818253 - DNA, 56 bp, Homo sapiens
ttcctgggctctggctggcctaagcctgcaggtgccgccatccagcctcccaggag

SEQ ID NO: 6818254 - DNA, 68 bp, Homo sapiens
gtcttggttttatgaaggtaactggcattggcagagctgctggctgcctgcctgcatagtcccacgac

SEQ ID NO: 6818255 - DNA, 64 bp, Homo sapiens
ccaaggatcccacccgggataccaagttacacttaattatcgtgtctctttgggttcctcttgg

SEQ ID NO: 6818256 - DNA, 85 bp, Homo sapiens
acgactccccttttcttctccaccgttgacctttaggttcctggaaaactttggtggtgagggtgtgaaatgagggggtgcacgt

SEQ ID NO: 6818257 - DNA, 68 bp, Homo sapiens
gtagatctcagactttgaaatttataatgaaactcatctcattttctgtttttaggtcttgggtttac

SEQ ID NO: 6818258 - DNA, 72 bp, Homo sapiens
cctactatagttggaagtaaggatgggggccttgagtaattgctctgcttctaacctgcttcctgtagcagg

SEQ ID NO: 6818259 - DNA, 77 bp, Homo sapiens
gtgtggtgtgtgtgcatataacatatacatggtatgcgtgtgtgtgcatgcatgtgtgcacacattttctgctacac

SEQ ID NO: 6818260 - DNA, 61 bp, Homo sapiens
gcagttatgtgaatcatgtgttataagagggggcttaaaggcatggttagacatggttagc

SEQ ID NO: 6818261 - DNA, 57 bp, Homo sapiens
gaagtggaggtggcctgtgtgctcttaactgcctcagcccagaagtcacctccactc

SEQ ID NO: 6818262 - DNA, 68 bp, Homo sapiens
cggcagtccattggtgacactgggaccatgctggcctcagcaggtgcccttcagacagtgggcagctg

SEQ ID NO: 6818263 - DNA, 58 bp, Homo sapiens
aggtgatcctcccgcctcagcctcccaaagcgctgggattacaggcgaaggttcattt

SEQ ID NO: 6818264 - DNA, 92 bp, Homo sapiens
aaggaagaagcaggtgtgtgccccagacagaagtgatttttttggcaagggaagacactaaactggggcttcagatccatctcgctgacctt

SEQ ID NO: 6818265 - DNA, 62 bp, Homo sapiens
gaacagtttttgtatacaggaatattgaacagaaacagagagttcctgtatacaaagagttc

SEQ ID NO: 6818266 - DNA, 84 bp, Homo sapiens
tctccttctctcgtgaggtctctacttagtccagaaatgccaggaatgggccccagtgtggaccttcacacagagatgggcagg

SEQ ID NO: 6818267 - DNA, 120 bp, Homo sapiens
gtttacaggttcccgctgtggtgaatgagtgggtgacagtgaacacgtacccactgtggtgagtgagtgggtgacagtgaacaggttaccactgtgatgcatgaggtggggacagtgaac

SEQ ID NO: 6818268 - DNA, 58 bp, Homo sapiens
gcccaggctggagtgctgtggtgtgatcatagctcactgcagcctcaatccctcgggc

SEQ ID NO: 6818269 - DNA, 55 bp, Homo sapiens
gggaggacgtgccaggcgatctccagcccctgggagccggacgcccacgcctccc

SEQ ID NO: 6818270 - DNA, 90 bp, Homo sapiens
agttgtcaggaggcctgagccccaggtttgttgtctgcccattccgtaagccaggtaatctctctggggttcagtccttgtttgtcaatt

SEQ ID NO: 6818271 - DNA, 58 bp, Homo sapiens
tggagccaatgaacatttgctggaatccctttctttaaagcagtgtttcttgactcta

SEQ ID NO: 6818272 - DNA, 65 bp, Homo sapiens
gcttcatccccaggttccacaaggatccttgggagtccttgaacagagggcctgggtgagacagc

SEQ ID NO: 6818273 - DNA, 55 bp, Homo sapiens
tcaggaggcaagtaggtattgacagttcccaaggtcaaacttcctggcctcctga

SEQ ID NO: 6818274 - DNA, 59 bp, Homo sapiens
ggcttctctaaagatcatgcgtgaacccaacaaaacgcatttccgggtcagaagaagcc

SEQ ID NO: 6818275 - DNA, 76 bp, Homo sapiens
caccctgccaggctttcaggtttggttggattatacatctttttttccccctccagatccttgcttggcagttgtg

SEQ ID NO: 6818276 - DNA, 62 bp, Homo sapiens
gctctgtacgtagcactgagagatgcaggtaattgttggagttgcccacggtgctgtagggc

SEQ ID NO: 6818277 - DNA, 55 bp, Homo sapiens
gtcggtactagtactggtgttgcgaggatatggcaccgtcagtactagtattgac

SEQ ID NO: 6818278 - DNA, 130 bp, Homo sapiens
tacaagctttgggagtaattattaatttttcatttaactaaatcaaggatatatagaggcataagaataattcttggagactcttgtatatttgttaaatagggaaattacctatcctaaatagtttgta

SEQ ID NO: 6818279 - DNA, 61 bp, Homo sapiens
gcagggcagctcactgtggttcattcaactcaatttgattccgcagctagtatgttggtgc

SEQ ID NO: 6818280 - DNA, 64 bp, Homo sapiens
gggagagggttaaagaggcaagacatcctagaaagtattagtcatagctcttttgtcttcttcc

SEQ ID NO: 6818281 - DNA, 56 bp, Homo sapiens
agtggccaagatataggctctccactgtcactgcccagtctaggattttggcagct

SEQ ID NO: 6818282 - DNA, 58 bp, Homo sapiens
agaggaaatggataaagggtgacaatctctctgcctctccccttatccatccttctct

SEQ ID NO: 6818283 - DNA, 90 bp, Homo sapiens
tcagttttcactctgtcaatatgtaataactgaatctgtctttgtggtgaggattcagtgagttaacatatttgaagtgcttaaaaatga

SEQ ID NO: 6818284 - DNA, 130 bp, Homo sapiens
gattacaggcatgcacaccacaactggccaatgctgtcttttgaagctcctgactggggccaattagctctcatgtcaggggtgtcaatgttctgagacaggccgggcacaatggctcacgcctgtaatc

SEQ ID NO: 6818285 - DNA, 74 bp, Homo sapiens
tctgtaatgattatgcagcatgagatcatcataaaaatatatcttttatttggtctgctgcaaattacaataga

SEQ ID NO: 6818286 - DNA, 68 bp, Homo sapiens
gggatcaatggctctgggtgaatggcagattgcagcagcaattgctttcttaccaagagaattatctt

SEQ ID NO: 6818287 - DNA, 57 bp, Homo sapiens
aacagcagcaagtaagcaggtctgcctgagcagttaactgtcaagactcctgctgtt

SEQ ID NO: 6818288 - DNA, 85 bp, Homo sapiens
ggaagttgctggaccttcctctggtacttaaagtgcttctgtgagaacaaagcatgtaatctagaggaggttttgggctttttcc

SEQ ID NO: 6818289 - DNA, 62 bp, Homo sapiens
gtgagcatttgatgagtaaattattttgataagcaagtggtttgcccactcgagtgatttat

SEQ ID NO: 6818290 - DNA, 82 bp, Homo sapiens
aggggcatagcacattgataattaaggcctccctctgtgacaacctacatgctggaggtgtaattacgtgtaaatagccctt

SEQ ID NO: 6818291 - DNA, 89 bp, Homo sapiens
gacagtcacgggacagtctttagagtattgtcctcttggagttcctgagcaggacatcaagctgaggcctgtcaagccctgggcctgtt

SEQ ID NO: 6818292 - DNA, 57 bp, Homo sapiens
tgtcctccttcggcaaggaagcctgcagcaaaggcgggctccaggtcagagaggacg

SEQ ID NO: 6818293 - DNA, 130 bp, Homo sapiens
acaacaaggcagccaaagttcccaggaaggccccaggaacagtagaagtagccagaagaggtgccagcaggtggctttaatgagtctttctgctgtctggagtcttcgaaagcatttgtgttttgtgtgt

SEQ ID NO: 6818294 - DNA, 55 bp, Homo sapiens
gtggagacaaaggctgagtgaggacttggattttggctcagaaggctgccttcac

SEQ ID NO: 6818295 - DNA, 57 bp, Homo sapiens
gctgctcatttgtatcctttgtagtatcctttgtaataaacagtaaatgtgagcagt

SEQ ID NO: 6818296 - DNA, 63 bp, Homo sapiens
gcagcttaagtgggtgcctggggtctctcatgggactagaatcaagctattggctgaggctgc

SEQ ID NO: 6818297 - DNA, 62 bp, Homo sapiens
agagagaggcagcagtgctcacgccgcaggagacagccgagcccgcagtgccagcctctcct

SEQ ID NO: 6818298 - DNA, 67 bp, Homo sapiens
gcccccatctccccacaggaacccgacatcatccaagtcaatcctgagccccagggaggttgggggt

SEQ ID NO: 6818299 - DNA, 65 bp, Homo sapiens
tggatagtgtgctgcttaaacagttgtggaaacttcatccttgtccccttgcagctcattttcca

SEQ ID NO: 6818300 - DNA, 57 bp, Homo sapiens
tgctatctcagataacctgcaccaatgcacttcttcgctgggcaccattgagaagca

SEQ ID NO: 6818301 - DNA, 69 bp, Homo sapiens
atgttcttggatgttgtgtataagtgtgtgttttagaaaaacaaagtaataatttagcatcaagaacat

SEQ ID NO: 6818302 - DNA, 77 bp, Homo sapiens
gtcctatgggtagagatgggggttagggaggctgccttgaattgaaacataccctggttgcaactctaccttaggac

SEQ ID NO: 6818303 - DNA, 106 bp, Homo sapiens
gtggtgcgggggaagctgggggcagggcagggaggacagggcaccgctcccttctggatctcccaggctgccctgtggaccccactggctaccctccctccaccac

SEQ ID NO: 6818304 - DNA, 56 bp, Homo sapiens
aatgttccaccaacatttgggaagaatcgtattctgtttatgttgggtggaatgtt

SEQ ID NO: 6818305 - DNA, 67 bp, Homo sapiens
ccaacatacatgtaaaggaaattatgacattaagtgccattcatagtgagaaacatgtatgtgtagg

SEQ ID NO: 6818306 - DNA, 71 bp, Homo sapiens
aatggtaagctgaagccacgagttggaacggaatacaggccgctctagggtgatgattcaggatgactatt

SEQ ID NO: 6818307 - DNA, 91 bp, Homo sapiens
atgggcttctgggttatgtagatgttggtttaaatttgtgttacttacattgaaaacaacaacaactaacttccataatcttgatgctcat

SEQ ID NO: 6818308 - DNA, 72 bp, Homo sapiens
tctgggatactttaagatatttgaaaacagggattctctctttcattgtttttaatgctttttaaatctaga

SEQ ID NO: 6818309 - DNA, 56 bp, Homo sapiens
agcactgccgtcttttttcttctgaaggtgcctccttcagaagttgagggcaggtt

SEQ ID NO: 6818310 - DNA, 61 bp, Homo sapiens
gaggaatcacatctcattcaacagcctgttacaggggtctgggaattggatgtgggatctc

SEQ ID NO: 6818311 - DNA, 60 bp, Homo sapiens
tgtattagtttcctgttgctgctgtaacaagtgattgcagatgcagtggttaacaataca

SEQ ID NO: 6818312 - DNA, 59 bp, Homo sapiens
tccccaaagattccctctggcttcttgcctgtaaatgaagcctgggtatcctttgagga

SEQ ID NO: 6818313 - DNA, 70 bp, Homo sapiens
aatggcagaacacaaactggactggtgagaacaaggtaggaactgagatctgaggttattgtctgccatt

SEQ ID NO: 6818314 - DNA, 77 bp, Homo sapiens
tttactcacctacttccaagagtttccaagggcttatctcatggtggatcctgcgttgggctttgtgggtgattgaa

SEQ ID NO: 6818315 - DNA, 57 bp, Homo sapiens
gtttctctacatgcatgcagacatatgtataaatttgcattaaaatgatggagaaat

SEQ ID NO: 6818316 - DNA, 70 bp, Homo sapiens
agtgggtctgtacatttggggaccccaggtccatccagtgggggcctggcctcccagagtggggacaact

SEQ ID NO: 6818317 - DNA, 56 bp, Homo sapiens
cacattccccagagctggggctggcctgagccctaggcgcagagtggggaggtgtg

SEQ ID NO: 6818318 - DNA, 67 bp, Homo sapiens
tggtatcacagaaagctgtgtcctgacagcaatggccattgacaggtacatagctatctgcaatcca

SEQ ID NO: 6818319 - DNA, 61 bp, Homo sapiens
gaacctcagtgaaactggaggtgagcgatgtggttcaggcatttccatttcagtgggattc

SEQ ID NO: 6818320 - DNA, 55 bp, Homo sapiens
ggaatgctcagttcttggtgctggagtgtgaggcagcgccctcctggtctattcc

SEQ ID NO: 6818321 - DNA, 60 bp, Homo sapiens
aggtgaacctataatccctgggcaagaaaggagagctagtccaggaatgtctgttcatct

SEQ ID NO: 6818322 - DNA, 68 bp, Homo sapiens
cagctgtgcctgctgttgaaactcttacatctctttcagtgggagtgcagctcacaggacatcaactg

SEQ ID NO: 6818323 - DNA, 62 bp, Homo sapiens
ttcagagggttttagggtcagaacattatctcaacacaggactgactagaaaaaaatctgaa

SEQ ID NO: 6818324 - DNA, 97 bp, Homo sapiens
tgctgtgggcaggtggagagtatgatgggatgacaggagtggcactcagccagtttccttcacctgtcaaacggacgatcgctacccacttacagca

SEQ ID NO: 6818325 - DNA, 79 bp, Homo sapiens
gctggcggccatctcgccgcaggaggtgggcgtgctcacggggccggacaggcacaccttcctgcaggcgggcctgagc

SEQ ID NO: 6818326 - DNA, 58 bp, Homo sapiens
tcttatgacaaggtggagtatgagtggaagcatttaaatacccttgactgtcattgga

SEQ ID NO: 6818327 - DNA, 63 bp, Homo sapiens
cagcaggcctgcaggccctcagggaggcaacgtagcttccctgcagacgtcctgcgggtgctg

SEQ ID NO: 6818328 - DNA, 120 bp, Homo sapiens
ctctgccctgtccagacctgccgggtcccgcccaagtccgacctgaggttccaggggcgtggggacactccccaccccttgtctttggggtcgtgtggaccgcccggcgacggggaggag

SEQ ID NO: 6818329 - DNA, 58 bp, Homo sapiens
ctttcatgcacttctttagatctccaatgttaacccaggtctgtgcagtgtttgagag

SEQ ID NO: 6818330 - DNA, 73 bp, Homo sapiens
caaccctcagctgctgcgggaacctctcaggtatgctcccctgtagacctgggtgccctgtgctttggggttg

SEQ ID NO: 6818331 - DNA, 104 bp, Homo sapiens
cagaaccccttcgggagcctgttaaggtgtatattctgtggttcctccggtctaggataaagcccaggaatctgcatcttgaccacattccctgagggattctg

SEQ ID NO: 6818332 - DNA, 78 bp, Homo sapiens
ggcagagctcctgaagctggagaatgggtctaggccacgcctggcctcgtgctcacggctccagctgcatcccctgcc

SEQ ID NO: 6818333 - DNA, 130 bp, Homo sapiens
acccagttaaacttgaatttcagacaaacaatgaataattcttagcataagtatgtcctgtgcaatatttgggatgcacttgtacttaaaaattatttgttgcttatccaaaattcaaatctaactgggt

SEQ ID NO: 6818334 - DNA, 130 bp, Homo sapiens
gagataattcattacaggggcatagcaagcattatgtttaaatttgtagctatgtaattaaaatcaacttttaattggctttgagaagtttgagttaatgattttgaattgcccatgtttgtattttttt

SEQ ID NO: 6818335 - DNA, 118 bp, Homo sapiens
gagacaatagtaatagagggatgttcttaagtcagtaagatgcaattaggagtactaatagctcacattctatggacttgggcattactaaaattccttatgttgatataaaatactc

SEQ ID NO: 6818336 - DNA, 89 bp, Homo sapiens
ctctgttccagcaaccctggttggggggtcagacttgatacactttcaggttgggagtggacccaccccagggcctgctgaggacagag

SEQ ID NO: 6818337 - DNA, 75 bp, Homo sapiens
ggaaccctcaaagcagcacattcgcaagcccgacgtataatttggagcttccatgtatgctcttgacatctttcc

SEQ ID NO: 6818338 - DNA, 57 bp, Homo sapiens
catcttacccctgctaatgaccaagtattctctggcaattggggactgggtaaggtg

SEQ ID NO: 6818339 - DNA, 78 bp, Homo sapiens
gaccatgtctatttcttacccacaattttatctggcatagtgcctggcatgcagctgtgggcaagaaatgacatggtt

SEQ ID NO: 6818340 - DNA, 61 bp, Homo sapiens
gcagcactggcttgatcagaagcactgtcctaaatacaagcagcactgtctgaccagtggc

SEQ ID NO: 6818341 - DNA, 59 bp, Homo sapiens
agaagtacatggaggatagctgctctgttttgtcaggaagtgctaagccatgtgctttt

SEQ ID NO: 6818342 - DNA, 65 bp, Homo sapiens
tctagcagccagacacctctcgggaggggagcttggagccacttgaaaggtagctggcagctaga

SEQ ID NO: 6818343 - DNA, 82 bp, Homo sapiens
ttaggcaaggaatgggaaagtctgtggtatttgaacctcagttcaatagagacctggattctccctccccctcttagcttag

SEQ ID NO: 6818344 - DNA, 66 bp, Homo sapiens
gtattcaggagactgtgaattgactgtcagaaccccaaagggactctcagcgcagtttcccaatgc

SEQ ID NO: 6818345 - DNA, 55 bp, Homo sapiens
ctctgtgttccgggttgctgctgccatctcgcggtaggcatcggaactgcagcag

SEQ ID NO: 6818346 - DNA, 70 bp, Homo sapiens
aggtaaggctgtaagctaagccacaaatcaaacttaccgccattgcagtcttggctttatagttttgcct

SEQ ID NO: 6818347 - DNA, 61 bp, Homo sapiens
cctgtcctgcatctgctttattctaaaatgggtcctgtgacctggcatgatgatggatggg

SEQ ID NO: 6818348 - DNA, 92 bp, Homo sapiens
gccctcagtacctcagaatatgacctaatttgggaatagggtcaaggtacatataacttgttaaaatgaggtcattctggagtaaggagggc

SEQ ID NO: 6818349 - DNA, 63 bp, Homo sapiens
tcaaccatcgcctccctgcaccccggcccaggcccctacctgggagtggagagcaatggatga

SEQ ID NO: 6818350 - DNA, 61 bp, Homo sapiens
gagctccagcatctctgccaaaggggacaaactttatctgtaacagagaatgtggaagttc

SEQ ID NO: 6818351 - DNA, 62 bp, Homo sapiens
tgaaggaaatgacggcagaagatatgacaagtgccatcttcatttctgtgttaattccttta

SEQ ID NO: 6818352 - DNA, 73 bp, Homo sapiens
aagctgacactgctaactcctggagttctgtgtataacccaaattcatagcccttgacatagcctgtcagctt

SEQ ID NO: 6818353 - DNA, 83 bp, Homo sapiens
gataaatactgaaacttttcctttatttaccaattttcattttaataagtttgtttattaggggagagttgtgaacatttatt

SEQ ID NO: 6818354 - DNA, 61 bp, Homo sapiens
agcacattcttgccttaacctccaagtcagatctctccatggtaacgcaggaatgtttgct

SEQ ID NO: 6818355 - DNA, 77 bp, Homo sapiens
ctgttcttttcacagtgttgtggctcttaataggctcccctggcgggccgttcagagcccacgctgcctctgagcag

SEQ ID NO: 6818356 - DNA, 55 bp, Homo sapiens
gttgggatgtcaggcctaggtgcgcatataagctttcggtgcctgagatcccgac

SEQ ID NO: 6818357 - DNA, 73 bp, Homo sapiens
taattgtggcttctttctttccatgtgtacactcaaaggagaacatctgtttgagaaaaagaagccatcatta

SEQ ID NO: 6818358 - DNA, 56 bp, Homo sapiens
gaaagggataccatgttacttggcaagaatgcatgcttggacataataaccctttc

SEQ ID NO: 6818359 - DNA, 67 bp, Homo sapiens
ctttctaaggaatagtgctatgaaaaacttaattagtgttttatgtagccactgattcttttgatag

SEQ ID NO: 6818360 - DNA, 88 bp, Homo sapiens
tgtaggggagatggtctgatgtctgatttcactatttgtttattaaaaagcagttgggagttatagactctatctctctaccccttca

SEQ ID NO: 6818361 - DNA, 76 bp, Homo sapiens
actgtttcacgtgtttaagcccaaagattatgtcaagaagtggcttgtaagtggcggcttgaaagctggaaattgt

SEQ ID NO: 6818362 - DNA, 58 bp, Homo sapiens
gtcactactgaagtcaatgttgtcacacaaccccaaagccagtgattgtcagtgggac

SEQ ID NO: 6818363 - DNA, 76 bp, Homo sapiens
tttatgtcttaagaagtcatctcaacagcttgcccagtgttcttgtaatgcaggagatggacttatgatgcataaa

SEQ ID NO: 6818364 - DNA, 62 bp, Homo sapiens
agataagtcaggctgttcctgtccaaaattcctgtaaggggaatttatagcctgacttgttt

SEQ ID NO: 6818365 - DNA, 67 bp, Homo sapiens
ggcctcccagcacttggtggtttagcctgagtttcttacatggcagctggatcccaaggcagaggtt

SEQ ID NO: 6818366 - DNA, 58 bp, Homo sapiens
ttcaccctgagccccacctctgcctcttctataacagactggcttggctctggctgaa

SEQ ID NO: 6818367 - DNA, 63 bp, Homo sapiens
agtgggaggcatccctgagtgctctctgacagctgaacggatcttctcagagatgcccttatt

SEQ ID NO: 6818368 - DNA, 65 bp, Homo sapiens
ctggacaaccacaaggccaataaacaagtcttcagggagaccatggccagctgtaggttgtgcag

SEQ ID NO: 6818369 - DNA, 128 bp, Homo sapiens
gctccagatgatattttctgagatttgggtttaattttgcttcagatattcaattaagttaaagcaaatcactttcgtttgatggggtattttgctgtttgaatctgggttggagttgttatagatgc

SEQ ID NO: 6818370 - DNA, 71 bp, Homo sapiens
gacggctcaggctttccgaagcgcgcggtgcgctgtccagcactgcgtgttcctgaagcgcgctggccttc

SEQ ID NO: 6818371 - DNA, 84 bp, Homo sapiens
taaactaattttactgtgctttactgtgttgcctttattgttaatgaatggtaaagaaaagcactgtatttaaaattggcttta

SEQ ID NO: 6818372 - DNA, 58 bp, Homo sapiens
tcattcctgcccgtctttcaagccaggttctccctactcttgttgattctaggaatga

SEQ ID NO: 6818373 - DNA, 89 bp, Homo sapiens
cagctgtgggttcatacaggcaggagctccccattccagctagaagccctggaatctcagcttctgccctgatgctcccaggtaagctg

SEQ ID NO: 6818374 - DNA, 79 bp, Homo sapiens
tatattgttctgcctcttaagtggatggagtggattcataatccttagctccagctattgagtgggcaagggactggtg

SEQ ID NO: 6818375 - DNA, 61 bp, Homo sapiens
ctgccctctagggatgcactgggctggacaacagcccaccaacattaccctgtaagggcag

SEQ ID NO: 6818376 - DNA, 63 bp, Homo sapiens
ctccagtctaggtcctacttatttaggatggtcctgctcaagtctcaaggcctagattcggag

SEQ ID NO: 6818377 - DNA, 58 bp, Homo sapiens
tcaacattttggctttgtttggacagcttttgtgcaagtgcaaacacagagtgtatga

SEQ ID NO: 6818378 - DNA, 56 bp, Homo sapiens
tacagtagaatcttatagcccagagcatgttttgggaaatatgcctctctgctgtg

SEQ ID NO: 6818379 - DNA, 59 bp, Homo sapiens
gctccttaaaaggagtcccaaaaggggtccacagacccctttggcatcattttgggagc

SEQ ID NO: 6818380 - DNA, 89 bp, Homo sapiens
tatctacagattatttagtaagacattgatctgtctgtgaggaacatcgatctcatccagaaaaatgtcttagccaagatgtgtgggta

SEQ ID NO: 6818381 - DNA, 72 bp, Homo sapiens
tgtatcattttaattatttttccagttcattcccagggaaactggctgatggggaattaattaatgggtcca

SEQ ID NO: 6818382 - DNA, 76 bp, Homo sapiens
gcccgccccctgactcggcgcgctcccgtcgcgcagccaatcgggacgaggggtgagcccgggtgggcggggcggc

SEQ ID NO: 6818383 - DNA, 79 bp, Homo sapiens
gccctggagtccaggcagcatcagtctgctgtattctaccagtcacagcagtcacaggctagcacagattcaatagggt

SEQ ID NO: 6818384 - DNA, 70 bp, Homo sapiens
aaaccttagtggtcattgttaaggtcacacagccatcgcctgaaggtgacctgacagtggcttctggttt

SEQ ID NO: 6818385 - DNA, 59 bp, Homo sapiens
ccacaggaccagaggagatcaccatgatatggtggagaagtccaaatatggtgccttgg

SEQ ID NO: 6818386 - DNA, 72 bp, Homo sapiens
gtttcctcttgggagtcccaggacatagggcagggactgccctgtggacctgctcttagagaccttgggaac

SEQ ID NO: 6818387 - DNA, 84 bp, Homo sapiens
tttgtctttatgtagcttatagttgagtgcacaaaataaatatggaatacatctgtgtcatacaacaataagtaccgagatgaa

SEQ ID NO: 6818388 - DNA, 62 bp, Homo sapiens
ttttattcccaggtaaaagtagagctcagcattatgtaggtgctgctgtcctgggactaaag

SEQ ID NO: 6818389 - DNA, 77 bp, Homo sapiens
ggaggaggtgcagaaactgtttgttaatatttacccaaattaataagatgttgagcaacagcttctacacaaaagcc

SEQ ID NO: 6818390 - DNA, 70 bp, Homo sapiens
gaataatgcagtaagcaatggtgaatgcttggaatgataactgtaatcatgcacctgttcactgcagttc

SEQ ID NO: 6818391 - DNA, 68 bp, Homo sapiens
agcccagttactgattcctttggcctaagcaagacaggtcaatttttaaagagggagtagctgaggtt

SEQ ID NO: 6818392 - DNA, 77 bp, Homo sapiens
tctgtgttaaaattgattatcatttcagctttcaaaatatcttgaagattatctgaagagatgtcaatattggcaga

SEQ ID NO: 6818393 - DNA, 59 bp, Homo sapiens
ccaatggaatgtcttgatatagaggttattggtgaccttggccagggcagttccagtgg

SEQ ID NO: 6818394 - DNA, 80 bp, Homo sapiens
gaaaatgcagactcttaggcaagtcaacagtatgccaactctcagggctgatgatttacacacctatgatttatattttc

SEQ ID NO: 6818395 - DNA, 56 bp, Homo sapiens
cttcttcctccagtctctgaggctttaggggtcctcagggatagaaaggaagacag

SEQ ID NO: 6818396 - DNA, 97 bp, Homo sapiens
gtattaatttccttccttagatccttcaatcacggacaaggggatagtcaataaattctgtgatttggaggaatgcagtgaaaggaattgttaatgc

SEQ ID NO: 6818397 - DNA, 63 bp, Homo sapiens
ttgctgttgctatcattgctgctatttttattccactcaagggcagtatctgaagccacacaa

SEQ ID NO: 6818398 - DNA, 60 bp, Homo sapiens
gagaccacaagtatctcccaccaggttgtaaataacttgaaagtaagaacttgtggtgtt

SEQ ID NO: 6818399 - DNA, 70 bp, Homo sapiens
gcccagcctggggtcacttgcagccgcacccacctgccggtgcgccatgtgctctcggccctcgctgggc

SEQ ID NO: 6818400 - DNA, 103 bp, Homo sapiens
tctttcatacctggttttgtccacttcagttatcaaaactctttactttaacagttaagtaggacagtggtgttctggagtggaccgaggtagggtgcaaaga

SEQ ID NO: 6818401 - DNA, 63 bp, Homo sapiens
gtaggcagccagcatcagttgggtcaatagcaataggtgatactcactgatgttgcctgtcac

SEQ ID NO: 6818402 - DNA, 71 bp, Homo sapiens
ggcacgggcaatcagcatttttacattcatgtagcactttgcagtggtggtaaagatgctctaattgtgcc

SEQ ID NO: 6818403 - DNA, 72 bp, Homo sapiens
gagttaatgcacctccctaagggtccagcttactaccagtgagtaactgaggaattggggagtcaagagctc

SEQ ID NO: 6818404 - DNA, 55 bp, Homo sapiens
agagcagaggaaggcaagatactagccagctagcatggtgttttttccctgttct

SEQ ID NO: 6818405 - DNA, 61 bp, Homo sapiens
cttaggccactctcctttgtctcatgtgatgacaattctgagctgagtgagttggcctggg

SEQ ID NO: 6818406 - DNA, 65 bp, Homo sapiens
ggaagccttcacagtcctgatgtaatagccgaggtggacagcagggggagctgttggacgcttct

SEQ ID NO: 6818407 - DNA, 56 bp, Homo sapiens
cagaccggttaacttgcccaagatctatagcttgctgcagtgatctcatcggtctg

SEQ ID NO: 6818408 - DNA, 56 bp, Homo sapiens
agagctgcttgcccagaagcagagcacatccgttctggagctcagcatgcagttct

SEQ ID NO: 6818409 - DNA, 73 bp, Homo sapiens
caagctcaggggtgcttcctcagggaagtgttttctgtttccaaaggcactgaggagccccctctcagcattg

SEQ ID NO: 6818410 - DNA, 73 bp, Homo sapiens
ggacacaggcactcattcagagaggtggcagagtaataactgaaaatgtccccatatcatgaggcctgagttc

SEQ ID NO: 6818411 - DNA, 66 bp, Homo sapiens
tgcttgattaagccttgtttgcaaaatcaaatatctacagatgtgggcaagaaacacaatcaagta

SEQ ID NO: 6818412 - DNA, 63 bp, Homo sapiens
tcagatttgctgccctggttctgtgatttcatcaacctggatgggtagggacagtggttctga

SEQ ID NO: 6818413 - DNA, 74 bp, Homo sapiens
tgagatgaagtgatgtaaaacatggggctactgttttctctccatctcccctcgccttgcctcgcctcacctca

SEQ ID NO: 6818414 - DNA, 78 bp, Homo sapiens
cccttcgtatctatgaaggtattttaatctaacaactgtgctgaaggagaggttaacactatccagatatgataaggg

SEQ ID NO: 6818415 - DNA, 57 bp, Homo sapiens
ggttgcagtgaggtgcagtgattggccagcctggatcacatgcacatctctggaacc

SEQ ID NO: 6818416 - DNA, 63 bp, Homo sapiens
catgctatctgagctgtcattttgttacctgactgaaggtaaaggagttattgccagggcatg

SEQ ID NO: 6818417 - DNA, 55 bp, Homo sapiens
tagttactgtaaggtgatgcagctgtggtgaagctgtaaaacactgtagtatctg

SEQ ID NO: 6818418 - DNA, 88 bp, Homo sapiens
cttggcattgggctatcgtgctggatgctttgttccaggtagtagagctcccggcagcattgccaatccagacatcagcctcgccaag

SEQ ID NO: 6818419 - DNA, 67 bp, Homo sapiens
ggacagaagccctgagtcaggcccaagccttggaatcctccatgcaaccctggccagacttctgccc

SEQ ID NO: 6818420 - DNA, 60 bp, Homo sapiens
acacagtggtgtttacaaaattcaagtgcctttgcaaaggattttagatcatcaccgtgt

SEQ ID NO: 6818421 - DNA, 71 bp, Homo sapiens
ggccggcccagccagcagctggcccctgccactcagcaggaggccagcctgaggctgaggggctcccggcc

SEQ ID NO: 6818422 - DNA, 56 bp, Homo sapiens
gtttcttaaatgtagcaggacctaagaagtcctagctcctggtattctttagagat

SEQ ID NO: 6818423 - DNA, 65 bp, Homo sapiens
tcagaggtcacacagcaagtttgcggcagggccagggctgaaacttagtgtttgtggccttctga

SEQ ID NO: 6818424 - DNA, 97 bp, Homo sapiens
ctttcttctttccattcctttttgctgataagcagaattcagttctacaggtagtatggatatgtttatagtatgaagtttggagattataggaaag

SEQ ID NO: 6818425 - DNA, 58 bp, Homo sapiens
ccagatatctttccataagaatgtctaaattttggcttgttataagaagactgtctgg

SEQ ID NO: 6818426 - DNA, 77 bp, Homo sapiens
cccggaacaaacacgggtagatggcaccacctggtggccgcactgccacacagccatcccagcctgtggttccaggg

SEQ ID NO: 6818427 - DNA, 81 bp, Homo sapiens
aatcatggttaatctgaatcagtaaacactacattttgaagtttaacaagtagcagagtgtctgatcagttgactagaatt

SEQ ID NO: 6818428 - DNA, 99 bp, Homo sapiens
ccaggttgccatggtgagctggctgccgactggctcttggctggggacccaggaggcctcccccggcggccctgcctgaacctcaccatggcagcctgg

SEQ ID NO: 6818429 - DNA, 78 bp, Homo sapiens
actcagcaccagttctgtctcctcttttcagccgccttctctctagctactgaggggaaaagtcaggatgaagcgggt

SEQ ID NO: 6818430 - DNA, 97 bp, Homo sapiens
ggtaattcatattgtattgggattttggctgtagttctaaaactatagataattaatgctaaggctcaggttctaaggacaatacaaaagagttgcc

SEQ ID NO: 6818431 - DNA, 60 bp, Homo sapiens
gcatatcacgtcaacagagggagtattgacaactggttgtcttcctagtagactgtgtgt

SEQ ID NO: 6818432 - DNA, 63 bp, Homo sapiens
tcttactcacaagaggctaggtggcaggcaatgcatttgatgccacaagatctgtgaataaga

SEQ ID NO: 6818433 - DNA, 68 bp, Homo sapiens
ttgtttctgttgctctggtgttttatcatacagggaccagactgtagcatcagtagctatagttacaa

SEQ ID NO: 6818434 - DNA, 56 bp, Homo sapiens
tcctgccttagagcaaggaaaattcttttgttcatctttgaaaactacaggcagga

SEQ ID NO: 6818435 - DNA, 70 bp, Homo sapiens
cccagcctatccttcgttttaagtgcctaagttaatgcattcggtcattcaatgagggcaggataaaggg

SEQ ID NO: 6818436 - DNA, 61 bp, Homo sapiens
gccatgcagcccctgaaaatggcagcaccactaggtagcagccatggtgagggttgcaggc

SEQ ID NO: 6818437 - DNA, 57 bp, Homo sapiens
gctcctgtccttagccccagagtcttgggaaagttctggatagtgaagggcagcagc

SEQ ID NO: 6818438 - DNA, 66 bp, Homo sapiens
agtgtagggtggtcagagcagagctgctgggcattgcagcctttaggtcttctgcttctttgcact

SEQ ID NO: 6818439 - DNA, 128 bp, Homo sapiens
gagccagttcccaaacccaggtctgctcactcccagctgggccttctgcagggtcctcaccccatggcagatggctcagacactggggcccagtgactggctgctcctggtgagggggagctggactt

SEQ ID NO: 6818440 - DNA, 101 bp, Homo sapiens
gcgccgggagccaaggatgctgttgctcccagggagagggtgtcctggctgcggcgcagccccacctctcctgggcagcggcttagcgtggctcttcgtgc

SEQ ID NO: 6818441 - DNA, 58 bp, Homo sapiens
ccatctccactgtccctgtcaaactcccagcaaatgtgcacagggagggtggggatgg

SEQ ID NO: 6818442 - DNA, 60 bp, Homo sapiens
aactttctagagatgagttcgggctttgagatcctgagttctcctgcactctggaaagtt

SEQ ID NO: 6818443 - DNA, 60 bp, Homo sapiens
aaagaaaatctgtgaaagtgtgtcttatcatggacgggacaggcttttacggatatcttt

SEQ ID NO: 6818444 - DNA, 77 bp, Homo sapiens
ctctgaccctagaaacaaaatggcatcttgttttcagaaatgcctagctgtgagaacaatgagtcaggggcttagag

SEQ ID NO: 6818445 - DNA, 80 bp, Homo sapiens
gcatcatattttcaaggtttattaaatgttgcatgtgcagagggggcactttacataaggataaacctgggagtgggtgc

SEQ ID NO: 6818446 - DNA, 57 bp, Homo sapiens
tacaatcacccaaaagtggctctggcttgggcagagagaaaggtttgggtggttgtg

SEQ ID NO: 6818447 - DNA, 60 bp, Homo sapiens
tttgtttgtctgtgttttctgtgtgggtggatcacattaactagaaagccagaaaacaga

SEQ ID NO: 6818448 - DNA, 77 bp, Homo sapiens
acattgagcatcatggtgaggggtgaagggcagccagttacggcctggcagcttgactccactgctgagtgcaatgt

SEQ ID NO: 6818449 - DNA, 56 bp, Homo sapiens
gatatttattaagtggttggtatgtaccagatagcatgctaagcactttaaatgtc

SEQ ID NO: 6818450 - DNA, 95 bp, Homo sapiens
cagagcagccagagtgattcaatgaaacttataagaatatgaattaatcattttaggtcataatgcaagttcataaatgtgtgctctcttttctg

SEQ ID NO: 6818451 - DNA, 55 bp, Homo sapiens
atctgtgaattgtaactggttgaatttttttcaactaatagagacaaacatagat

SEQ ID NO: 6818452 - DNA, 103 bp, Homo sapiens
tcagcgctctttctaggctggagggttcagcctgtccttgtatctcccacatactctagaacagtgctgagcctttggcaggagttcattacatatttgttga

SEQ ID NO: 6818453 - DNA, 130 bp, Homo sapiens
ccctgtccttgctcccgtccctggcccggaccttggctgtctcctctttgtgccgagattgtcagtctgtgcggctacagcggggtggagacggccggctctgtcacggcttcatgagagcggggacggg

SEQ ID NO: 6818454 - DNA, 89 bp, Homo sapiens
gctgcttgggtccttcagagaagtgcacaaaatcagctgcatgctggttttacagctctgtgcatgactctgaggagttatagggtagc

SEQ ID NO: 6818455 - DNA, 59 bp, Homo sapiens
tccgtgccatgggcagcctctcagggaaccctttgctgatgcccttgtccaggcaagga

SEQ ID NO: 6818456 - DNA, 64 bp, Homo sapiens
gtgcctaggcctctggggaatgccacagaaacatgtcaagcctcttgagaggcactcaggttac

SEQ ID NO: 6818457 - DNA, 60 bp, Homo sapiens
agcatttcttggcccattgtaggtgctcagtaaacacttacgggatgaaggagataagct

SEQ ID NO: 6818458 - DNA, 90 bp, Homo sapiens
gggcaagtctggtcactgtgcaggtagatgcctgggctcagaacgcgaacctcagtccagtcatctcccttcacattgctcatgaaaccc

SEQ ID NO: 6818459 - DNA, 84 bp, Homo sapiens
ttggacatatgctcatttacttgcttataatcaaaacattaaaaaactgttttgaactcaggctaggtgtaagtattggactaa

SEQ ID NO: 6818460 - DNA, 57 bp, Homo sapiens
gtggccaggagaccttgggcattccacccccctaccatgccaagattccctctccac

SEQ ID NO: 6818461 - DNA, 96 bp, Homo sapiens
atattactgaatttactgtttccatcaggatgtttggctgtcatatagaacaaactatcacagtctacatactagtcagaacagttaatgtaatat

SEQ ID NO: 6818462 - DNA, 130 bp, Homo sapiens
gggccagggaacgcgcccacgcccgcccgtcccgcggcctctcccgggtgccgctgggcccgctactcacagcgctgtggcgtccgcggggatgcgcagcgcgggaccgagcgtccgcagcccgcggccc

SEQ ID NO: 6818463 - DNA, 93 bp, Homo sapiens
gcagaggtgtctcagccaaagtcatatggctatttagtgggaggaacaagggctcttctcccaggctcttatgtgacttgcaagacatcctgc

SEQ ID NO: 6818464 - DNA, 88 bp, Homo sapiens
gtaaatttctttcaatcgctatttgttttaaagtcactgcttatatttgtggcagataaaataatagggaaaaggaggaataatttat

SEQ ID NO: 6818465 - DNA, 119 bp, Homo sapiens
gtctccccctgcccagagaacatgttcatttttctagctgtggatcaagaccaagttcagaggtcagagacctagcaagaaattggagtgtgttccagatcttcaaataggtggggaac

SEQ ID NO: 6818466 - DNA, 57 bp, Homo sapiens
ggaggttgcagccaggttgttatctggtgcttgactatggctggtggctcagcctcc

SEQ ID NO: 6818467 - DNA, 59 bp, Homo sapiens
gggtccagacactccagaggaaggtcatattatcctcctcttaaaagagtgtatggctc

SEQ ID NO: 6818468 - DNA, 74 bp, Homo sapiens
acaagcagctggaagagtaagatgaaaagagaaaaacagatcttcatgcagtatttgtctcttaccactgctgt

SEQ ID NO: 6818469 - DNA, 77 bp, Homo sapiens
ttgtcttgtttacaacacagctcaaatatttcctggtcagaaatatccaggactagctttggtgatgtgacagataa

SEQ ID NO: 6818470 - DNA, 66 bp, Homo sapiens
tgcttctcaggtgaggctgaggctgttggtctggagaccacaccttaagaaacactggacgaagta

SEQ ID NO: 6818471 - DNA, 62 bp, Homo sapiens
ctgcagccaccatgatgccactatgcagaatccccgaggttctgtggcttctgtaggctcag

SEQ ID NO: 6818472 - DNA, 65 bp, Homo sapiens
cagcaggcccaggtgctggtgaggggccctcatttttgttcctgcagctggagccaacgatgctg

SEQ ID NO: 6818473 - DNA, 59 bp, Homo sapiens
ttgatgttattgtgatcatgatactatctgacaagggcagtgatgcatgataacatcaa

SEQ ID NO: 6818474 - DNA, 58 bp, Homo sapiens
taccttgtgagctttctaacatggtgtctttggaccaaaggggagttcttttaaggta

SEQ ID NO: 6818475 - DNA, 60 bp, Homo sapiens
gtaactgcttaaaatagttcatttttgcataaaagcagagctaagtttttgagcacttac

SEQ ID NO: 6818476 - DNA, 78 bp, Homo sapiens
gtgctctgagtcctggagaaacgcaggtgcctgcagcattgagcgcaacgcaggtgtgttttcaggactaatgaatac

SEQ ID NO: 6818477 - DNA, 77 bp, Homo sapiens
gttcagatttctattagaaagcatcttctataatatatcaacttgtttaggggaaatttttctcaatgggattgaat

SEQ ID NO: 6818478 - DNA, 124 bp, Homo sapiens
ctctttttctgtcttcttgtttcaccagcatagtaggtggctcttgccattattgtaattagatatggctgttgcacatctaagcctgtgcacatgggtcctaggcaggaagaagaaagaagag

SEQ ID NO: 6818479 - DNA, 63 bp, Homo sapiens
ggcttttactgtggaaatggggaggaaggagaaacccttatatctccagactacagaagagcc

SEQ ID NO: 6818480 - DNA, 64 bp, Homo sapiens
cctcctccagctctccctgggggtgtctcagaggagtctcctggttcagagagctgagaggagg

SEQ ID NO: 6818481 - DNA, 56 bp, Homo sapiens
cccaggaggctgaggttgcagtgagccgagatcgtgccactcccctccagcctggg

SEQ ID NO: 6818482 - DNA, 101 bp, Homo sapiens
tggctggactgcagtgtgtgtacagttttaactctgaggggttaaaatattctcattggcccccaagactatgactttattactattgttcatccatgcta

SEQ ID NO: 6818483 - DNA, 63 bp, Homo sapiens
cagattggagatggaagaaaagtcagtaagcctggactctgatttgagaaatttttcaatctg

SEQ ID NO: 6818484 - DNA, 57 bp, Homo sapiens
cacactttgtgctaatctatttgcactcagcacattaggccctgcactaaagttgtg

SEQ ID NO: 6818485 - DNA, 71 bp, Homo sapiens
gctgaggtgtcaccttgctgggccaagaggaaaagagcagctgggattagcaacttggtggcattaacagc

SEQ ID NO: 6818486 - DNA, 58 bp, Homo sapiens
acttgcaggtgtctggagttaggaaggttcagagcctggctctatgaacttggcaggt

SEQ ID NO: 6818487 - DNA, 69 bp, Homo sapiens
gtcttagctgaatgccttggatttttactgcttctgtaacaaatttccattaatttagtggcttaagac

SEQ ID NO: 6818488 - DNA, 69 bp, Homo sapiens
ggatgctgtttaacttcatttttcttccttctcagaaaaacctcagaaaatggaagtttaaaggtatcc

SEQ ID NO: 6818489 - DNA, 83 bp, Homo sapiens
ggcctatggctttaacatcctctttatggcttcctgtgtgtctagcacagtcctggccccaaggaaggatggcattctaggtc

SEQ ID NO: 6818490 - DNA, 65 bp, Homo sapiens
tccgattaaaagtgcacaagttgtaatttagaaatacatggatgcctgtggattttaaaattgga

SEQ ID NO: 6818491 - DNA, 73 bp, Homo sapiens
gctttttagcaatatgaatgcatttgcacattacctccataacatgcaaatacttctgtatatgctggactgc

SEQ ID NO: 6818492 - DNA, 63 bp, Homo sapiens
ttgggttggctgttgtgtatcaagagggcacagcaactctggggtgcttcgacacttccccaa

SEQ ID NO: 6818493 - DNA, 57 bp, Homo sapiens
tcaagccctctgggttagtttagggagccacagtttggtacccagagttgggcttga

SEQ ID NO: 6818494 - DNA, 57 bp, Homo sapiens
agagtcagtcactggcactttgtctgtttggtgacatcatgtttccctgactgttct

SEQ ID NO: 6818495 - DNA, 56 bp, Homo sapiens
ggagcaggagacactagctgacctatatgtggtcagctcagagtgtgtcctgtttc

SEQ ID NO: 6818496 - DNA, 68 bp, Homo sapiens
tgcagtgtggccatgtcagctatgtggcagagacctagattcactagtagtgtgacaggctaactgta

SEQ ID NO: 6818497 - DNA, 78 bp, Homo sapiens
ttacagtcattccttggtcatgcaagatatcgatgcctatgatgggtcaggatatcacatgaataagtatggctgtaa

SEQ ID NO: 6818498 - DNA, 73 bp, Homo sapiens
tgatgtgagcttgagatcttagtgaaagtgtaaaaatgtttcacatacactaggatatttttttctcatgtta

SEQ ID NO: 6818499 - DNA, 57 bp, Homo sapiens
ttcaggtcatgatccattggtgagtggtgagatcaacttagtaagtcatgacctgaa

SEQ ID NO: 6818500 - DNA, 61 bp, Homo sapiens
ggcaagcatgtgcgagtcctcacagcctccagataatgacggctgggagttcactgctgcc

SEQ ID NO: 6818501 - DNA, 91 bp, Homo sapiens
tcttcttttctgagaaaaagataaaatggagaaactgttactattaagcaagtttcactaaggtctgtgtgttctttttccagaaggagga

SEQ ID NO: 6818502 - DNA, 88 bp, Homo sapiens
gccacaccctgcagcaggtcaggctgggctggtgttagagtcaagaatgggaggcttgggactgtggtctgtgctgcagggtgatggt

SEQ ID NO: 6818503 - DNA, 97 bp, Homo sapiens
ggtttgggactcctacctgtccgcctggtccaggtaaggaaagccattgctgagaagagggccgacccaccccaaggtatgagttatttcccaaacc

SEQ ID NO: 6818504 - DNA, 97 bp, Homo sapiens
gaataaacagtacttttattcttaatgagattgctttctatatctgtaaagcccttatctttggttttataagaagcaatgtctgagttgtggattc

SEQ ID NO: 6818505 - DNA, 100 bp, Homo sapiens
gtttcctgggcaagggctcgaaccagctattagtgtctatttgcactgcatgaaaacaaaatttaatgtaaagacgcttatagcttgcctaccctaaaac

SEQ ID NO: 6818506 - DNA, 57 bp, Homo sapiens
ggagagtgggaatggagggttccatcttatctcttagagctcctctgcccattcttc

SEQ ID NO: 6818507 - DNA, 75 bp, Homo sapiens
tgattatagtggacagtaacctctcctctgaagggagacattaactctctcttccaaggttgcacactatcatta

SEQ ID NO: 6818508 - DNA, 64 bp, Homo sapiens
ttccttatatgagttgatttttagaatactcaatgtgtctgactttattaattcacatttggga

SEQ ID NO: 6818509 - DNA, 62 bp, Homo sapiens
ctctcagatcctctccgaatgcgtagtaactgcgatgaattcccgcagagggcttctgagag

SEQ ID NO: 6818510 - DNA, 65 bp, Homo sapiens
ggccttgtgtttacacctgtctttgagcattatagaagaaaaaagacagacggaaacctgaggcc

SEQ ID NO: 6818511 - DNA, 56 bp, Homo sapiens
gcactatggctgcaggtcatctctgctggatgtcctgccatttccatagcctctgc

SEQ ID NO: 6818512 - DNA, 61 bp, Homo sapiens
cagagtgtctgaattagagcacaaaggcaaatactacctttctgccttgctcagcacactg

SEQ ID NO: 6818513 - DNA, 61 bp, Homo sapiens
ctgggctgggaggtcacaatgaggtacttgcttactctctttggtgcaccttgcagtcaag

SEQ ID NO: 6818514 - DNA, 127 bp, Homo sapiens
gctcaggtgcttggaagttcccctggggtcccttgggattcctgagattctcctggcttggaaggcgcgggagccttgggagtgccagccgggctcttggtgggaggctgagaagagcagcagcagc

SEQ ID NO: 6818515 - DNA, 61 bp, Homo sapiens
atcttcaaagaatttcttgtcctgtgcattctgtcctatggggaatgagattcttggagat

SEQ ID NO: 6818516 - DNA, 58 bp, Homo sapiens
ggacatcttccagctgcttgcctgtgaagatgagcctctgctggtctggaggatgtct

SEQ ID NO: 6818517 - DNA, 78 bp, Homo sapiens
gaccccctctgtttgattgttatccctgctgcctgaaagccctgggtggtgatggccagtcgcactggaggaggcgtc

SEQ ID NO: 6818518 - DNA, 64 bp, Homo sapiens
ttgggtcaggaatccagacagggcacagtgggaatggctgtctctgctccatttactggaccaa

SEQ ID NO: 6818519 - DNA, 60 bp, Homo sapiens
gatcagtgtaagaattcaaagcctactggttaaaaccattagtctattcctggactggtc

SEQ ID NO: 6818520 - DNA, 72 bp, Homo sapiens
attctacttctgacactgtttgtaaactggtccagctaacatctagagataagcaggagtcaggggaggagt

SEQ ID NO: 6818521 - DNA, 79 bp, Homo sapiens
actaatattaaagacagcagatggatggctcaagagttcctaccttttgtcttatctctttgtctgattttggttgggt

SEQ ID NO: 6818522 - DNA, 76 bp, Homo sapiens
cgaccaagacagactgcagggcggtcatcagccattattgcctcttgggccgggactgtcctctgtgtctgtgtcg

SEQ ID NO: 6818523 - DNA, 58 bp, Homo sapiens
gtcagtgggtgaaagatggctaagtctgaagcttgttcatgttgtcgtcctatgagac

SEQ ID NO: 6818524 - DNA, 128 bp, Homo sapiens
ttttctttctatatcctcttctttgttagagagggttgaacctataaactacatttctcagtctctagttacttgactttagccctgctctgccaataagaagcactaacataaggttagaaggcaag

SEQ ID NO: 6818525 - DNA, 62 bp, Homo sapiens
agatgagggggatgtggggtagcaaaccctaaaaacgagctactgaccacttctgcctgtct

SEQ ID NO: 6818526 - DNA, 72 bp, Homo sapiens
gggagggaagatggctctgtgagcacagggaggtgccagggcagctcccagagctcgagagtaaccctcacc

SEQ ID NO: 6818527 - DNA, 75 bp, Homo sapiens
tgctattttggtctacagcacttgggaacagggaaagtccgggtacctgctctgtgctgagaacaaaagtggaca

SEQ ID NO: 6818528 - DNA, 106 bp, Homo sapiens
gcctggatgtgttcaggttctgggctctggagagccataggcccttgttgggagtggccatcctagagggatggctgccagggccctgacctagcaccatgtgggc

SEQ ID NO: 6818529 - DNA, 58 bp, Homo sapiens
cagttcttatgctggtggcttccaaacctcactttgagaaatactgccttaggagctg

SEQ ID NO: 6818530 - DNA, 81 bp, Homo sapiens
gtccttgactttggcttgcactggcaccaacctcagccctcgctggttgggagctctcagctgcagtccatagtcactgac

SEQ ID NO: 6818531 - DNA, 69 bp, Homo sapiens
ctaaaggattcttagttcctgggactttatacttggcagtaaatagccagaaactaagtttcactttgg

SEQ ID NO: 6818532 - DNA, 78 bp, Homo sapiens
gaaggtttgtctgagtcaatacctctactgcatgcctgggcccagcagagcttatgttgggtcagtagtccaaccttc

SEQ ID NO: 6818533 - DNA, 62 bp, Homo sapiens
ctggatgctcacttctgcagggttcaaggatttgcattaggaaaccctgagaggtggtccgg

SEQ ID NO: 6818534 - DNA, 59 bp, Homo sapiens
tctctagggatctgttttaatttcctgattcttccaagacttagaacatcctctaggga

SEQ ID NO: 6818535 - DNA, 83 bp, Homo sapiens
ttgctttttggccccagcctagttttctttcattcccatgtctcatcttttatgcagctgcagagagcaggctgggaaagcag

SEQ ID NO: 6818536 - DNA, 76 bp, Homo sapiens
tcgtttgaacccgggaggcagaggttgcagtgagccgagatcttgtcactgcactccagcctgcgcaacagaatga

SEQ ID NO: 6818537 - DNA, 55 bp, Homo sapiens
tcctaggtgttaatagcgttagactagcagctaaatattatgttaacagctggga

SEQ ID NO: 6818538 - DNA, 122 bp, Homo sapiens
gcgcctcgggggctgggattgggggtggtggctgacggagaaggctgggcagcagagcgcctatgacatccagccccttgtccggtagccactgcttaccttgaccccctcctccgagatgc

SEQ ID NO: 6818539 - DNA, 80 bp, Homo sapiens
ctgctactattattatcctaatttctgttttatagatgaagaaattcaggtacacaggggttaagtaattatgggagcag

SEQ ID NO: 6818540 - DNA, 56 bp, Homo sapiens
aatgtgggtcctatggagtttcagtatcagacttataaaactcatagactcatatt

SEQ ID NO: 6818541 - DNA, 58 bp, Homo sapiens
gctttctggcttatattcagcagagtgcataccacactgtgaatgctagtaagagtgc

SEQ ID NO: 6818542 - DNA, 60 bp, Homo sapiens
tacagagtgttattacagaatcctgccagaggctttctttttctgcaataacatgctgtg

SEQ ID NO: 6818543 - DNA, 80 bp, Homo sapiens
ggctccaggcatctcagagaagtttcaaagaataaaggtacttatgttctgtcctctttgaagctgctcaatgcccagcc

SEQ ID NO: 6818544 - DNA, 83 bp, Homo sapiens
ccaaagaaagttgttggaggaaatgactgtcaacactttatttgacttactcaatttacttttagcaataataaagcatttgg

SEQ ID NO: 6818545 - DNA, 58 bp, Homo sapiens
tcatctgtttttaaattactctagaggtcaaagacaatcagagtggaagacagtttga

SEQ ID NO: 6818546 - DNA, 55 bp, Homo sapiens
gctgctgcttgaaggctcggagccaaagtatagggttcaggaataagatagcagc

SEQ ID NO: 6818547 - DNA, 67 bp, Homo sapiens
gctggcagtgggcctgaggaagggtgagaaactctattctgcaccccaagttctgtccactgcaagt

SEQ ID NO: 6818548 - DNA, 69 bp, Homo sapiens
gccctcatgcaaatgctagagaatgttggagtatgaaaccagggcttcttggcatttgctggggagggt

SEQ ID NO: 6818549 - DNA, 59 bp, Homo sapiens
agcagcctttgatcatctgggaagtcattgactttgatccttatcctatcaggggctct

SEQ ID NO: 6818550 - DNA, 59 bp, Homo sapiens
agctctgaaagttatgtcgccggctttgaccagcccagcccagcacctctctcagggtt

SEQ ID NO: 6818551 - DNA, 80 bp, Homo sapiens
ttctagacattccttaattatttggttattcttgagtaactatcaaatttaagagtaagtgattaagaagatgattagaa

SEQ ID NO: 6818552 - DNA, 60 bp, Homo sapiens
ccatctccccagaccctggacataatcagttctgattagttagggctcctgaggacctgg

SEQ ID NO: 6818553 - DNA, 55 bp, Homo sapiens
ggcatgggagtgagcaaccttatactaaatcaataagttgctaagactcctagct

SEQ ID NO: 6818554 - DNA, 60 bp, Homo sapiens
ttggagtctctaggggaaaatctatttctttgccttttccaccttctagagattgtccag

SEQ ID NO: 6818555 - DNA, 63 bp, Homo sapiens
ttatctacgtatttaaactcttgaaggaaagacaactgactgaagagttgaataggtaagtga

SEQ ID NO: 6818556 - DNA, 104 bp, Homo sapiens
ttttatgttttcagtcattgataggacatttgggcttagtgtttttgtgtaacattaagaacatgaagtcacaaatgcagctagagaagagacaaagcatggga

SEQ ID NO: 6818557 - DNA, 73 bp, Homo sapiens
tcagaagaaaaaagagctttccacactagtcagcaactgttggtgtttaagtgttctttcatttttcttctga

SEQ ID NO: 6818558 - DNA, 91 bp, Homo sapiens
ggtgttccagtgcctgagacacagcagatattcaatcagccctgctgcgttaaatcagatctgctgccatgcttcgtagcattggagtccc

SEQ ID NO: 6818559 - DNA, 85 bp, Homo sapiens
tcctcgtgggaccctcctggaaggtgactgtcttgaatgctttattcatggccatggtacctttttgaggaggtttcgtagagga

SEQ ID NO: 6818560 - DNA, 71 bp, Homo sapiens
tagcctgaggccaggaccattagcccagatctttcccaccagttctgctgatcgtttccctggccctgctg

SEQ ID NO: 6818561 - DNA, 63 bp, Homo sapiens
gacccttcttcaaatgctagtaatatcatcatcatggtgactgtttttgtttggggctgggtc

SEQ ID NO: 6818562 - DNA, 68 bp, Homo sapiens
ggggttaaggagcaggagagtcttcattgtttcccttcagaactgacagactttacttctcctattcc

SEQ ID NO: 6818563 - DNA, 55 bp, Homo sapiens
tatgtgtatgtgtgtgtgtgtgtagatagatagacagacagacagattgcatatg

SEQ ID NO: 6818564 - DNA, 97 bp, Homo sapiens
ctggacacatttattctactatattctctgctgcttttgtgtatagatttggaaaatgaactcaaaagaccagagagctgaggatagttggtatcag

SEQ ID NO: 6818565 - DNA, 65 bp, Homo sapiens
atagatttctgtcaccttctatgctaacaaacatcgcttagcgtagggtaatgatgggtgtttat

SEQ ID NO: 6818566 - DNA, 88 bp, Homo sapiens
tcagacttcagagcaccaggcgctggatgctgacagtggccagatcccactgtccaagcatgcctggctttctttggaaaatgtctga

SEQ ID NO: 6818567 - DNA, 78 bp, Homo sapiens
gtggggaagacagacaattttttttaagcactacgtctgtgccataacagaggaacagatgaggtgtttggagagcac

SEQ ID NO: 6818568 - DNA, 55 bp, Homo sapiens
ccaggcatccattgcttcctctcatcgtgaggtccctgcagcagactgccaatgg

SEQ ID NO: 6818569 - DNA, 88 bp, Homo sapiens
gcagttaacattattgtattaattgaaatgaatgctgacagagattttgttggctttacaacaaattgaatatggataatgtaaccgc

SEQ ID NO: 6818570 - DNA, 78 bp, Homo sapiens
tcttcagaagctaattaatatgagacaagtcatgaaggtaggtgtcctcatgattatattaatggcttcataaggaga

SEQ ID NO: 6818571 - DNA, 78 bp, Homo sapiens
gagctatcaccttaataaactgagctgcttatttaaataaattcatgcaagccactgagagttggggttgatgtgctc

SEQ ID NO: 6818572 - DNA, 82 bp, Homo sapiens
gagaatattatcagaaatgccttaaattggagtttcacaatgtatgttctagtttgttgagatatttttgcaaaatgttttc

SEQ ID NO: 6818573 - DNA, 62 bp, Homo sapiens
tcttgccaccgtcatggccattataattgagcacctatgatgtgccatatgttggacgtaga

SEQ ID NO: 6818574 - DNA, 67 bp, Homo sapiens
tcatccttctacctaggactatttttcagactttgaccctgggaggtagagctccagtagaaaatgg

SEQ ID NO: 6818575 - DNA, 90 bp, Homo sapiens
gaagatttgaaatttatttaatgcatggttgtttgcctacatatggcctaggcctgtttggtacaatctgccaagtatcttcaaaggttc

SEQ ID NO: 6818576 - DNA, 58 bp, Homo sapiens
ggacttggagctgggagtccaatacccatccaggtgctgacaacacagcttcaggtcc

SEQ ID NO: 6818577 - DNA, 94 bp, Homo sapiens
tcaaggatgcatataatgaagctctaaatgtacttagccaaagccctgttaatgaatatttaaagtttttctctattatggtgtgcattgttga

SEQ ID NO: 6818578 - DNA, 68 bp, Homo sapiens
gcaccatgacagtgaggagaacggagcacagttccttccgtgcctcctgccggcgctgctcaaggtgt

SEQ ID NO: 6818579 - DNA, 72 bp, Homo sapiens
tttcctagaatggttagaaaatatgttggcagcaatcagtataatttaatattttcataacattctaggaaa

SEQ ID NO: 6818580 - DNA, 87 bp, Homo sapiens
ttccctcagtgtgtattgtagctaggtttttgtagaacatagcaatgtttaaagccaaagtagtacaacctatacattggtttggag

SEQ ID NO: 6818581 - DNA, 80 bp, Homo sapiens
gcagcagaaggccatctagtggtaacttctgtctaaagactgctggaagtttgctgtggattaatgggtacttttgttgc

SEQ ID NO: 6818582 - DNA, 60 bp, Homo sapiens
tcaggattctcctcagagtacagcattggattgattctaagatttgaggaaatgtcctga

SEQ ID NO: 6818583 - DNA, 97 bp, Homo sapiens
gtttgcttatgcaatcattcattcattcattttgagatcccatggaaagcactgtgcaaatctttgaatcaatgaatcagtgagtgagttagtgaac

SEQ ID NO: 6818584 - DNA, 82 bp, Homo sapiens
tggcattagtgctcctactcagctgtggggagtaaactgtcaatcatcccaagatatgggttcaggggtgaagctgacgcca

SEQ ID NO: 6818585 - DNA, 82 bp, Homo sapiens
gggttttattatcttgtaaattagaataattatttgtcatgggcaatgaaaatttctaattgcaagttttagtattaggccc

SEQ ID NO: 6818586 - DNA, 81 bp, Homo sapiens
gggagggctgtgctgtgcatggtaagatgcttcacagtatctgtgacctctgcataccatgagccagcggcaccccctcct

SEQ ID NO: 6818587 - DNA, 101 bp, Homo sapiens
ggtgatcagtcactggatgcaactgctattggaaggaggcatgacctagtaggtaacatagttttttttagcagaggcaatctccaaagagggctgacatc

SEQ ID NO: 6818588 - DNA, 129 bp, Homo sapiens
ggttcagagtttgagctctggggtcaggcggagccgagttcagccttggcacattcccctgcaccagcccgtgccctggggtgaacccctgggctcccttggcctcttctcagctcctcactgtgtccc

SEQ ID NO: 6818589 - DNA, 71 bp, Homo sapiens
ggccttgggcagcaggctccacgttcctgctcatcgggagcccccaggaatcttgtctgttgtccctggcc

SEQ ID NO: 6818590 - DNA, 63 bp, Homo sapiens
tctggtttggacttccttgagaaagtgggaaacagtcacacattgggatgaagtctaaaaaga

SEQ ID NO: 6818591 - DNA, 66 bp, Homo sapiens
ggaccagggggtgcaggccctgtgacctgtagacagagtcctctgggcagctgccccacctggacc

SEQ ID NO: 6818592 - DNA, 88 bp, Homo sapiens
caaggtgacattggtgcttgtcttaccaaatatgatgcaactgacaagtgttttcatgtaaggaagatatatgcctcccatcaccttg

SEQ ID NO: 6818593 - DNA, 58 bp, Homo sapiens
cccgccaggaacccctgagggtgagtggtccctgttcttccctaggggctcctgaggg

SEQ ID NO: 6818594 - DNA, 70 bp, Homo sapiens
ttctgaaagggcttaagaatcttcaaggataaccgtcttaaagaagcaaacttaggacaccctaatagaa

SEQ ID NO: 6818595 - DNA, 79 bp, Homo sapiens
ggtggattatatttctaaggacaaggtcttggagagatgaggtctcccagcgatgaggtcacttgaaggcccctccacc

SEQ ID NO: 6818596 - DNA, 71 bp, Homo sapiens
ggagctgagcaccctttgtgagcataagtctacaactgtaggcttgttcatgacaagggtgtcacagctcc

SEQ ID NO: 6818597 - DNA, 60 bp, Homo sapiens
ctcaggagtctgtgcagttccacatggttccacccaactgtggtgacgggaattcttgag

SEQ ID NO: 6818598 - DNA, 68 bp, Homo sapiens
atctacttcaacagcttccaaagtgtgttccttggaatactagttttatgggatgttgttaattagat

SEQ ID NO: 6818599 - DNA, 85 bp, Homo sapiens
ggaatgaagggcttggaagggatattggcatatgatgctctaatcgtgttcgtacgtcagcgtctcctctcagcccttaatttcc

SEQ ID NO: 6818600 - DNA, 83 bp, Homo sapiens
gggtcaggtgcagctgtaaattgtcacctaaatgcttccaagtgaaagctaatcagagcacggtgacagaacacacctggccc

SEQ ID NO: 6818601 - DNA, 104 bp, Homo sapiens
tcactttctcttaggtttgtagaggatttcttcatttgtggtgaatgagatgtgtttttattgcattacatgatgaaggagcatgaggacatgggaggcagtga

SEQ ID NO: 6818602 - DNA, 82 bp, Homo sapiens
aaagatctggctccttaatttaaaatagttcaggcaacaagattcttgctgtgttttatgttaggttaacatgctgaacttt

SEQ ID NO: 6818603 - DNA, 85 bp, Homo sapiens
gtcaattgtggactaagcaagggacatatcaacgaatttagttttcagttgaaatctatgatcttgttttggtccatcttttgac

SEQ ID NO: 6818604 - DNA, 99 bp, Homo sapiens
ttgcccattcaaaattagggagtgagctggacttgtcttgcagaccatcgtttgatgacttcttttctagctattaccattaatgcttgttttggtcaa

SEQ ID NO: 6818605 - DNA, 70 bp, Homo sapiens
gtttccctccacagaatgtaagatccacaaaagacagatcttgtggtcttgttcggtctgtgcctagaac

SEQ ID NO: 6818606 - DNA, 80 bp, Homo sapiens
atttcaaaatgtttccaaacctcatcagtgaaggacatacctacatttctaacccagatgaggtttttgaaatgtggaat

SEQ ID NO: 6818607 - DNA, 60 bp, Homo sapiens
gtgtcttgtgtggagctctatgtctagcctctagcataattcctgacacacaagaagtac

SEQ ID NO: 6818608 - DNA, 87 bp, Homo sapiens
gagggagtcagctgcagcagctttggtaggggaaaggagagctcagcgctacacccacacttggggagcctgctgcgccactccctc

SEQ ID NO: 6818609 - DNA, 90 bp, Homo sapiens
tttttaaaaagagtgaaaaaagttacattgcactgtatgaaagaaaaatgttcacagtggtaggataactgttttcctctattttgagag

SEQ ID NO: 6818610 - DNA, 55 bp, Homo sapiens
gcactgtatgtgtgtgtgtatgtgtgtgtgtgtgtgtacatgcacatgtgcgtgc

SEQ ID NO: 6818611 - DNA, 81 bp, Homo sapiens
caggattgcttgatttggcagtgtattcataaggacttgggttctttatgcccgaatgcactgccatttcagtgattgctg

SEQ ID NO: 6818612 - DNA, 59 bp, Homo sapiens
gttcatttttagaatgctagtaaattatagatattgaaaatctggctttagaaatgagc

SEQ ID NO: 6818613 - DNA, 55 bp, Homo sapiens
gaacatcatgaagaaaacatatttcaggactcaggactatgttatcttgatgttt

SEQ ID NO: 6818614 - DNA, 60 bp, Homo sapiens
aggtagcacagcctgagtccagatctgaaccgcttggcctgaatcccggctctgctacct

SEQ ID NO: 6818615 - DNA, 113 bp, Homo sapiens
cttgaattgcaggtgaatatcagcctttggtttgggctgtgtgccccagatgatggtggtcccaaattacataggccaatatccagagctgggttaaaatgaagcatttcgag

SEQ ID NO: 6818616 - DNA, 94 bp, Homo sapiens
gggaacactttgaaggcccctgggttgtttaaaagactttgaggtcatcttggctgaggttccagacagcttagggaaggcaaactctgttcct

SEQ ID NO: 6818617 - DNA, 62 bp, Homo sapiens
ggcactaggagacctgggggtctttcttgtttttggcttgctacctggttctcctgcctgct

SEQ ID NO: 6818618 - DNA, 57 bp, Homo sapiens
ggaggaggagaggctgccattgattcaaaaataacatgagcagatgctcctgcctct

SEQ ID NO: 6818619 - DNA, 122 bp, Homo sapiens
ccagcggtgctaggttcggttcggacgcgcgctgctggatctaaatgggcagtgctgggtccgatgggtggtgctgtgttgggtccggacgcgcggtgcagagtccggacgggcggtgctgg

SEQ ID NO: 6818620 - DNA, 56 bp, Homo sapiens
tgagctgtgtgacattgagccatccttatgccatgcctcagtttcctcatggctca

SEQ ID NO: 6818621 - DNA, 69 bp, Homo sapiens
tggaattggaatcagatgctgatgttccattaaaaatcaatgcatcaaagttgatatccaattatgcca

SEQ ID NO: 6818622 - DNA, 69 bp, Homo sapiens
ggttcacctcagctcactcttttgtgcttgtgtaaaaagtgcaggtggagaaagtgagttgtgtttact

SEQ ID NO: 6818623 - DNA, 66 bp, Homo sapiens
gaggaaggggcctatcactttgaattagaataaaagtaaataagctggtgatgtggtccctcactc

SEQ ID NO: 6818624 - DNA, 58 bp, Homo sapiens
caaggtagttctggtcattgactcacgaattgagtggttttagataaagctgtccttg

SEQ ID NO: 6818625 - DNA, 69 bp, Homo sapiens
ttgtgccctgccagctctagcttttgaagggtctacactcatcatcaacaggtagactggtttttacaa

SEQ ID NO: 6818626 - DNA, 58 bp, Homo sapiens
ggcagggtgcctggctcctgttcccagctcaggctgtggctttgccaagcaccttgcc

SEQ ID NO: 6818627 - DNA, 55 bp, Homo sapiens
gcctgctcaggagtcaggctctggttctcgctatgacctctgacccagagcaggc

SEQ ID NO: 6818628 - DNA, 69 bp, Homo sapiens
taatcagatttgaaaactggtttttatttcactaggaaataggaaatgattttagtttatcatggattg

SEQ ID NO: 6818629 - DNA, 117 bp, Homo sapiens
acattttttttcacagagagactgtggaatggaatgactctccagagctgcagattgaaggcatattttcatctgactttggtgattatgtttccaatctctctgggaataaggtgt

SEQ ID NO: 6818630 - DNA, 71 bp, Homo sapiens
cccactgtgtgccaagcggtggcccccaccctgggaggtcagcaggccaccgctgaaggcactggcatggg

SEQ ID NO: 6818631 - DNA, 77 bp, Homo sapiens
tagctctctgtctgttattggtgtataagaatgcttgtgatttttgtacattgattttgtatcctgagactttgctg

SEQ ID NO: 6818632 - DNA, 63 bp, Homo sapiens
ctacaatggcccgtctttcctgagcccagtggagggtcccaggggggcaggagtcattgatag

SEQ ID NO: 6818633 - DNA, 68 bp, Homo sapiens
gtacgtgacaatctctgcgctgagaattccacatgcctcacttcagctcatctgagtgtcagcgctac

SEQ ID NO: 6818634 - DNA, 59 bp, Homo sapiens
ggcacctgtggggggccttccggaaccagaactctggcagggtcaggaaccagggtacc

SEQ ID NO: 6818635 - DNA, 60 bp, Homo sapiens
gtcagaaaccagtcaaacaagaacatccggccagggtcctgcttgctgggtggtttctgc

SEQ ID NO: 6818636 - DNA, 111 bp, Homo sapiens
tacactaattttccttaatgccttcaaaagttgttatattacttttagaatagctatgtagatgtcagaaaaggtagctgtgacaaaatgtcattaaggtgacatagtgta

SEQ ID NO: 6818637 - DNA, 74 bp, Homo sapiens
gttaccctgggtgtccacgttggggtgatagcagggcgtgaggaacttcactgtgggcgcattgtaagggtagc

SEQ ID NO: 6818638 - DNA, 77 bp, Homo sapiens
tatgatgcaaaagaggattgttactgattagctcttgtaactacgaagctggattaaatatagctttctgtattatg

SEQ ID NO: 6818639 - DNA, 59 bp, Homo sapiens
tccaagatcaaggtgttggcagggttggtttcttctgagactgctctccttgacttgga

SEQ ID NO: 6818640 - DNA, 122 bp, Homo sapiens
gaaagtcaagttcatacatatttgcctattaagacaggacccttaaatctccaagctggggggaaaggaagttaagtcttagaatgcacatgtacaaacttccctgtataactgagattttc

SEQ ID NO: 6818641 - DNA, 84 bp, Homo sapiens
atgggattgtaactagaagaatgcaccaagaaatcttttgagacaccgcttatcttgtatgtcttcatctggttgtgattacat

SEQ ID NO: 6818642 - DNA, 83 bp, Homo sapiens
atgcaatatctaggaaaagactgaatatattagggatacaaaatttacattttgaatctatgtattcagtgtatctactgcat

SEQ ID NO: 6818643 - DNA, 87 bp, Homo sapiens
tcatatctacgcactccttgtaccacctgctgccttatggaatttacttatctccactgcagtggtgggacagtggaaaaggtatga

SEQ ID NO: 6818644 - DNA, 73 bp, Homo sapiens
gtcaaacatccgggattatgtgtgatataaaattttttgaattatatgtatgtcctttaaaaggagccatgac

SEQ ID NO: 6818645 - DNA, 80 bp, Homo sapiens
ggctgactttgtggcatttgaacaatcacataggcacctgaacttggactctgtgattgatttaatgctcttctgttgcc

SEQ ID NO: 6818646 - DNA, 57 bp, Homo sapiens
tggctgaataaaatatggtgttgctacacctctacaccacagaatattatgcagcca

SEQ ID NO: 6818647 - DNA, 81 bp, Homo sapiens
aaatagagtccttgggaaaagcttgatttcatgctctcaagtggaaaacataaagcttttccttcaggcacaaccctgttt

SEQ ID NO: 6818648 - DNA, 55 bp, Homo sapiens
gcaaatggagtggctggactttgtaataaattaaaagtctggttgattcctttgc

SEQ ID NO: 6818649 - DNA, 83 bp, Homo sapiens
gatcgctattcaccaagtatatttgaacatgtaaatgcttaagaaataagcataatgcggatatagtttgggttaataggatt

SEQ ID NO: 6818650 - DNA, 72 bp, Homo sapiens
tgatagttgttggcagacttgcagctcacatacaaaaatgagtggtaggggccatgccaacaaatgccatca

SEQ ID NO: 6818651 - DNA, 67 bp, Homo sapiens
catagcaggccctcagcagatatttgtgtttgttgaatgaataaacatcaccctgctgctgctaatg

SEQ ID NO: 6818652 - DNA, 58 bp, Homo sapiens
acccaggctggagtgcagtggggtgatctcagctcactgcaactgccacctcccgggt

SEQ ID NO: 6818653 - DNA, 61 bp, Homo sapiens
ctccaaaatcacatgagccaattccttaaaataactctctattggctctgtttctctggag

SEQ ID NO: 6818654 - DNA, 71 bp, Homo sapiens
tcatactaatttacactgccattagttagtatattctctgactgtaaggtaaggataaaaccttggtaaga

SEQ ID NO: 6818655 - DNA, 88 bp, Homo sapiens
gctctttgaaggaatagaatgccttagaatgttcaccctagtacataccctggcaaatgaacttaacggcaactatttaagaatgagc

SEQ ID NO: 6818656 - DNA, 76 bp, Homo sapiens
ggaggccaatcctgggtgcattgagagcatagcaatgggacctcaaatccagcctggggcatccgggaaagcttcc

SEQ ID NO: 6818657 - DNA, 56 bp, Homo sapiens
atagagtacagtctttgattatggtcaatttaccatgttataaggcattactctat

SEQ ID NO: 6818658 - DNA, 61 bp, Homo sapiens
caagagttgcttatcagagtcttcaatgtcatgattataaaggctcagagagaaactcttg

SEQ ID NO: 6818659 - DNA, 74 bp, Homo sapiens
gcaggagggtgggaagcagttttatttatttatgtatttatttatttatttgagatggagtctcgctctgttgc

SEQ ID NO: 6818660 - DNA, 64 bp, Homo sapiens
agagctgtttccagaatcaaagcaaaagggtctgcctccttcatcctggcctggagacaactct

SEQ ID NO: 6818661 - DNA, 88 bp, Homo sapiens
gagagtaatatctgtcttgtggggggttgaaaggactttattcatagctaaagttcagtgccttctatacacacttatttttaatctc

SEQ ID NO: 6818662 - DNA, 65 bp, Homo sapiens
tgtccatctccatcgagtcctccatggggtggtggcacgtacttaggtgggagaaaaggtggaca

SEQ ID NO: 6818663 - DNA, 69 bp, Homo sapiens
tattctaggaggcagtcgttcttcagttctagctgttgcttctactatttgctgctgtgcttctgaata

SEQ ID NO: 6818664 - DNA, 63 bp, Homo sapiens
gctggccctgttggcagtttcatcagttgtcagcttctgagacagtatcgccccaaggctagc

SEQ ID NO: 6818665 - DNA, 61 bp, Homo sapiens
ggctgatctcgtgtgaccttgtaatgccccagggcaggggaaggtagcatgggttgcagcc

SEQ ID NO: 6818666 - DNA, 61 bp, Homo sapiens
tctagctacaaatctgataagtgggtagactaattggccactattatatttgttgtgcaga

SEQ ID NO: 6818667 - DNA, 62 bp, Homo sapiens
ggtggttggttctcctggcaaccagcccccatcctgaggctatccaggaacccctagctacc

SEQ ID NO: 6818668 - DNA, 85 bp, Homo sapiens
ggcgaagcccgagccgggtcgcaagacgcccgctggcactgccggcgccatggcggccgccttcggccacggcggaggactcgct

SEQ ID NO: 6818669 - DNA, 65 bp, Homo sapiens
agtcgtgaaggtcctaaggttgtgaggattctcgtgtcttcagaaaattatcacttgtacagact

SEQ ID NO: 6818670 - DNA, 68 bp, Homo sapiens
ttttcaccatagtcacaggaagtttcaatgtatgtactagcggtacattgagtaactgtgtgggagga

SEQ ID NO: 6818671 - DNA, 62 bp, Homo sapiens
ggtaagcacatctgtggttattaaatataattttattattccatggctggagatctgctact

SEQ ID NO: 6818672 - DNA, 89 bp, Homo sapiens
gaatggtttagttgcccttgattttatatatagtgatccagtcataaaactgtagtttatgtgtataattacaggaagacaattcattt

SEQ ID NO: 6818673 - DNA, 59 bp, Homo sapiens
attttgcacttgtttatgtgtggttgttcttcagttgtcacttcaagcaagtgtatgat

SEQ ID NO: 6818674 - DNA, 65 bp, Homo sapiens
gacttcttcatgtcttttccacctctttcatataatctaagggggatatggaccttggaggagtc

SEQ ID NO: 6818675 - DNA, 68 bp, Homo sapiens
ctcacatattccatttcaagttttgaatgtggcccgtcatctcattattttggactggagtgtttgag

SEQ ID NO: 6818676 - DNA, 78 bp, Homo sapiens
ggtttgaaatgaactttaattagcttttgtctccagaattccccatcgatgcctgggctttagggttctcctcacccc

SEQ ID NO: 6818677 - DNA, 76 bp, Homo sapiens
taagcttgccctgctaaccttggttccacctctggtcatgctatttcttgctgtgggacctttggcaggtcactta

SEQ ID NO: 6818678 - DNA, 75 bp, Homo sapiens
atcaatgggctctgctctgctcagcttgtctcttgggttacaaagtggcagagccgtgcaggtaggaccccgggt

SEQ ID NO: 6818679 - DNA, 61 bp, Homo sapiens
gcctctgaatcaaagggcctatttgcttggaactatgcaaagcaatgctccattcagaagc

SEQ ID NO: 6818680 - DNA, 76 bp, Homo sapiens
gagattggtaaagaaccaggttacaaattctaaaccccacacccctgtgatgatggaacagcctttgccaaatctc

SEQ ID NO: 6818681 - DNA, 129 bp, Homo sapiens
attcactggtgttaggaactgctaagttaagtagtactctcttcactgcgggctctgagaaaggagggctctgttattcatgaagaggtgacatttgactaggacccaggatccatgaattttttgaat

SEQ ID NO: 6818682 - DNA, 56 bp, Homo sapiens
tcctccttgttcttttgcctacattgataagtgttggggttgggggtgcaggaggg

SEQ ID NO: 6818683 - DNA, 63 bp, Homo sapiens
tcagaattgtttgatgggtttgttcagatgcagatatctgggtgctacaaacagtatttctga

SEQ ID NO: 6818684 - DNA, 67 bp, Homo sapiens
tcctatattgtgagttcagactaaaaactggtgtgaatctggtttatagttaggaattctcaaagga

SEQ ID NO: 6818685 - DNA, 95 bp, Homo sapiens
ccaggggcattcgggatcagaaataggtgagcagatccttaggctcagcagaacctttgtgggtctgtctttatatctggttcaggtgtcattgg

SEQ ID NO: 6818686 - DNA, 60 bp, Homo sapiens
ctgtaatgaactctttgtcagtttgtcaattttgactaaggacagaaagttcatgtgcag

SEQ ID NO: 6818687 - DNA, 98 bp, Homo sapiens
gtattggaattattttacatgcaacattggtattagtgtggctgatcaaagaattgattgtacttaaatatgcaaatagtattaggataatacaatac

SEQ ID NO: 6818688 - DNA, 92 bp, Homo sapiens
ggaaaatgaaggattcaggtgggcttttgtcatttgtgccatccgttacgatggtgatgaatgagcttagaggctgacatcctttcctgtcc

SEQ ID NO: 6818689 - DNA, 57 bp, Homo sapiens
ggaggaagccctcggtgccccacatgtgctaagagggcagcagtgagggcatcctcc

SEQ ID NO: 6818690 - DNA, 79 bp, Homo sapiens
cttctaatatgtgtgtgtgagaaaagctggtaaaggcaaatttactcaacagaagctttgtacatgtgcatatcagaag

SEQ ID NO: 6818691 - DNA, 74 bp, Homo sapiens
acactgctataataacctgggcttgaacagtgcctattagactagcaccgttcaaacccaggttatagtagtgt

SEQ ID NO: 6818692 - DNA, 79 bp, Homo sapiens
gttaattgctggaatcagttgaaatatttcacaatctcttccaactgtattatggcacactggttttaaagcagttaat

SEQ ID NO: 6818693 - DNA, 78 bp, Homo sapiens
gggcaccaatgtaatctgttaatatttgtatcctaatgttatgcaggtggatataaagaattaacatttttagggccc

SEQ ID NO: 6818694 - DNA, 101 bp, Homo sapiens
acattatcagtttgaactcagcatttagaatttgaagtgtcactggggaaattatttactaacacttagcagttttaattgcatgttaaaatttgtgaggt

SEQ ID NO: 6818695 - DNA, 58 bp, Homo sapiens
taacttcaagtctgtggatcagtagttaacaataaaattccttcagactttggagttg

SEQ ID NO: 6818696 - DNA, 56 bp, Homo sapiens
gaagaagcattctgctgttttggataattggttttcagtcagtatcttgcttgttc

SEQ ID NO: 6818697 - DNA, 79 bp, Homo sapiens
gagggcgtgtggtgcaggccaagctgcgagcttccggaaacccggcttccagtgactttggtcgtgcgctcacccccgc

SEQ ID NO: 6818698 - DNA, 90 bp, Homo sapiens
tgattttgtatcttgagactttgctgtatttgcttatcaacttaagaagcttttgggctgagacgatggggtcttctagatataggatca

SEQ ID NO: 6818699 - DNA, 69 bp, Homo sapiens
tcctggatatttcagtgttttaagagttcagtgaaaatttattaactgaatatctattggagtccagga

SEQ ID NO: 6818700 - DNA, 96 bp, Homo sapiens
agtggaagagacaggaggaactcggagggcaacagaagtgcttggaagaaagcctgaactctttgctctgtgaactctggctggccctgacccact

SEQ ID NO: 6818701 - DNA, 84 bp, Homo sapiens
gttatggggcagtcctttctctttgtagcactttactggtcctcacctgaggactgatgatggtgctgacagactgccctctac

SEQ ID NO: 6818702 - DNA, 67 bp, Homo sapiens
ccaagggagactgtgagacctctaaggccaagtaaaaagacttttctggaattactttctcctttgg

SEQ ID NO: 6818703 - DNA, 72 bp, Homo sapiens
gatattctattttagccagctaatactcaactacgatttgcaatttagagagttgtgcttgtatagattgtc

SEQ ID NO: 6818704 - DNA, 122 bp, Homo sapiens
gctttctttcctgagaagcctctgatatggaagcttgaggtcagtagatgttttctctatccttgaaaaaacttgtctgtctgttcgaacttaccctcttggggcttcaaagtcctggaagc

SEQ ID NO: 6818705 - DNA, 88 bp, Homo sapiens
agattcttccactgattctttctccaccaattcatgatagttacatatatgttgaagaggtacaagaagaggatatgtcagagagtct

SEQ ID NO: 6818706 - DNA, 72 bp, Homo sapiens
ggtccagactaagatgggcctaggattcgttttctaaatggaaatgtctgaggctcatctgaggttggcatc

SEQ ID NO: 6818707 - DNA, 127 bp, Homo sapiens
gtgaaggctttgcagggctagttttgggaaatcttaggtttggcttcatctgactcctctactggagcgaggcgtgcagccaagcctgcttagacctccccaggccacgggcccgcggcagcccagc

SEQ ID NO: 6818708 - DNA, 86 bp, Homo sapiens
tgttggaagactaacagatgagagaattgaggctcagagaaaataaagctgaaccaagatttatttattcttttattctttcaaca

SEQ ID NO: 6818709 - DNA, 63 bp, Homo sapiens
ttaacaggagtaactctagaaagctgaccctgaggattctagaactgtttactcactgattaa

SEQ ID NO: 6818710 - DNA, 93 bp, Homo sapiens
caggagaaggtggaggcaggacttgaatccaggcagtttggtcattttgctttactgtccggcacaagtgccacctctgtctgaggtcttctg

SEQ ID NO: 6818711 - DNA, 91 bp, Homo sapiens
tgtagagctcctgctggatttgaccaagttggaaggtgttttggacactacgcggggtcaagagttggtcaaatccaaaggaagaatgaca

SEQ ID NO: 6818712 - DNA, 126 bp, Homo sapiens
gccccttccccacccccacacactcagagcctcaccattgctgtctggctcaagactggggcctgcagagtttttttctataaagggccagatagtagatatttgaggttttgtgggccaaggggc

SEQ ID NO: 6818713 - DNA, 59 bp, Homo sapiens
aagcacagctggaacagcaggaaaatattccccaaccctgctgttgacatggcttgctt

SEQ ID NO: 6818714 - DNA, 65 bp, Homo sapiens
cttgaacagtgtatctagatcatggttgccatggttgccttgacacaatgaacatctgtatcaag

SEQ ID NO: 6818715 - DNA, 107 bp, Homo sapiens
tcctcctcttgttccatctctgtgggcttttgtcagcctaggcatttttcaaaatcacatgccacatccttcagaaagcttttgggggtgggaatatcagaggaggg

SEQ ID NO: 6818716 - DNA, 76 bp, Homo sapiens
ggcactgagctgccttggggcagagactttgctcgaagggtttaacactctatctccaaggcatagacacagtgcc

SEQ ID NO: 6818717 - DNA, 87 bp, Homo sapiens
ggacccttagggtttggagggcccgagaaggtgggtctatggatacaaatacacccacctctttaggccatggagccttggggatcc

SEQ ID NO: 6818718 - DNA, 56 bp, Homo sapiens
ttcctggcatggtcaaggctatgttaggagactaatttgcttgtccatgcttggga

SEQ ID NO: 6818719 - DNA, 65 bp, Homo sapiens
ggctgaaatcattccagaacttttagagctacatggaagctcagaaatgttctaatgattcagtc

SEQ ID NO: 6818720 - DNA, 130 bp, Homo sapiens
ctggtatcaggagtcttgggcagacttggtcgtcttgcggagaactgtgcccttaagcttgagtttggcaaacttactattgcggggtagccagtgttttctccacacagactcaatggagcacagacag

SEQ ID NO: 6818721 - DNA, 88 bp, Homo sapiens
tctgccatatacttaccaatgtgcttttgctacagtttcttgacccatctgctttagacagcatctggtgacttctttgtatggtaga

SEQ ID NO: 6818722 - DNA, 57 bp, Homo sapiens
gggctctgtagttggtcatggggccactgggcctcagcttgatttctgcagagaccc

SEQ ID NO: 6818723 - DNA, 128 bp, Homo sapiens
tttggccaaaaattatgttgaaaaattcctcctttataaagacatcttgatcatgctcacttaatagattgtttacaaaggcaaagggaagtttgacattgtcttaggaatctgcttgattggaaaga

SEQ ID NO: 6818724 - DNA, 60 bp, Homo sapiens
agttttacctaagctaattgctctaggttttgattacctaaaataagcttgggtaaaact

SEQ ID NO: 6818725 - DNA, 65 bp, Homo sapiens
gcagccctgatacattcttctgcctgtaaggaggattccacaggccagtgccatcagggttttgc

SEQ ID NO: 6818726 - DNA, 60 bp, Homo sapiens
ggagcgtgtcaatctatctgttccaacaagaaccatggtgcccctgagattggcacttcc

SEQ ID NO: 6818727 - DNA, 78 bp, Homo sapiens
ccttttatagtatgagataggaatgtttatgtggggtttcatcagtggatatatttatataggcttccatatgaaggg

SEQ ID NO: 6818728 - DNA, 85 bp, Homo sapiens
gggcctgcctcttggttttctgcacctcagcttttcccggataggtggggacccatcatcaaaagtgacagagaagataaggccc

SEQ ID NO: 6818729 - DNA, 82 bp, Homo sapiens
ggtgtgctgggagtcaccaggagcaaggtggtgaaggtgagttttctcctgagcccctcctgggactcattagcacctcacc

SEQ ID NO: 6818730 - DNA, 61 bp, Homo sapiens
tcaggctcaggtgcctcattcacaccaatgctcctccacagggtgtgtgcacctgccttga

SEQ ID NO: 6818731 - DNA, 66 bp, Homo sapiens
ccgcaccaggcttccctcaagataagttaaccttggggactgggctagagtggaagctggtggagg

SEQ ID NO: 6818732 - DNA, 58 bp, Homo sapiens
gagccaagctcttctccatgagtcatgttcaatagaagtgttcacaagggcttggttt

SEQ ID NO: 6818733 - DNA, 55 bp, Homo sapiens
ccccaggctaggaccgatttccctgtgtcttggggaaatatttctgacctgtggg

SEQ ID NO: 6818734 - DNA, 75 bp, Homo sapiens
gcagcagcccaggcccagcaccagcggtcttccggctcctctgagggctgccacgttgggcgaggggagccatgc

SEQ ID NO: 6818735 - DNA, 57 bp, Homo sapiens
catggatgttaggaatcatatacctagagatggtaactgaagccttgggcattgatg

SEQ ID NO: 6818736 - DNA, 69 bp, Homo sapiens
tttctcagatgtcttacccatgttgaaaacatttgtgtgatcacactgggtaacatatctgttaagaga

SEQ ID NO: 6818737 - DNA, 85 bp, Homo sapiens
tggcacatgcctgtaatctcagctacttgggaggctgaagcaagcgaatcgcttgaacccaggaggtagaggttgcagtgaccca

SEQ ID NO: 6818738 - DNA, 66 bp, Homo sapiens
atggaggtaaataagagtatgtctggaatataggagatccctgaaggcatctcttagtatcaccat

SEQ ID NO: 6818739 - DNA, 57 bp, Homo sapiens
gtcttaggcacccggatgtggtgtgtaaggcaatgggacttggagggtgtctaaggc

SEQ ID NO: 6818740 - DNA, 55 bp, Homo sapiens
gcagtataagtggattatgtccttcatagaagggaagtagaatcagttgtgctgt

SEQ ID NO: 6818741 - DNA, 130 bp, Homo sapiens
agctagagttagatgtgcctgagctgtgtaatgggttaattaaatgttggtgtttatgcagtggaaatacatacagtaaaatcatttagttacttaacagcctggacattaaatactttctcctttacct

SEQ ID NO: 6818742 - DNA, 76 bp, Homo sapiens
ctgtagagcaagtttttggtttgaaattattgtgttgtttgagcacctgtcacaagcagaaggcataactttacag

SEQ ID NO: 6818743 - DNA, 90 bp, Homo sapiens
tcctggtaaggacctgggttgccaggcttgggaggtagggagcatgccaggtgctctcctgctcctcagcccaactcaccttggccggga

SEQ ID NO: 6818744 - DNA, 66 bp, Homo sapiens
caggctccattaatcatcctgcacctaagttgttcctacgatggcaggatgtttggtggaaatctg

SEQ ID NO: 6818745 - DNA, 59 bp, Homo sapiens
gctgtgagaaataaatgtttgctgtttaacgcacacagtttggctatttttgttacagc

SEQ ID NO: 6818746 - DNA, 75 bp, Homo sapiens
tcccagagagattatggagaggacattcttatagtgctctatggtttagaacagtgctctataagctctttgggg

SEQ ID NO: 6818747 - DNA, 74 bp, Homo sapiens
tcataacaattacattaacataatattattggctaaatatttcccttgccaagtagaaggatgtgattgtatgg

SEQ ID NO: 6818748 - DNA, 71 bp, Homo sapiens
ggatattgtacaatgctgaggtttggggtatgaataatcccgtcacccaggcactgagcattgtacattcc

SEQ ID NO: 6818749 - DNA, 60 bp, Homo sapiens
ttctgtatacatccagatggatcccaggcatccgggcaccaccctggtgtgtccctagaa

SEQ ID NO: 6818750 - DNA, 58 bp, Homo sapiens
tggggtcagtagcaaatacagctggttgaagccatgtcatgaaatgctactaactcca

SEQ ID NO: 6818751 - DNA, 67 bp, Homo sapiens
gacaggaataggagggctagcttgtatagacccctgatctgtgctggcataccacctagttcatgtc

SEQ ID NO: 6818752 - DNA, 56 bp, Homo sapiens
gcagctcttggtgctcttttcaccttagttttgggtggaatgaggctgagcagtgc

SEQ ID NO: 6818753 - DNA, 70 bp, Homo sapiens
gagtccagctcccagaactgaccatgttgggcccagcgccctctgctggtcactctgggagctgctcctc

SEQ ID NO: 6818754 - DNA, 74 bp, Homo sapiens
cgtggagggagcggaatttaaacttccgggtcagcctcagtgcagcttgggaaacgtagttcctagtccccacg

SEQ ID NO: 6818755 - DNA, 76 bp, Homo sapiens
ttgaggttgtttcaacagtagtctcattttcagataaagaaaccgaggcttaaagatagtaagaaacctacctgaa

SEQ ID NO: 6818756 - DNA, 77 bp, Homo sapiens
gagaatacagagggtttcatgggcagaaattcattttctcagatggaacaagctgccctgagggcctgtgtgttctc

SEQ ID NO: 6818757 - DNA, 76 bp, Homo sapiens
gcagccctgagctggcctgggcttgcggggcaccagaagagatactggtacaaagccaaggcctgtctggggctgc

SEQ ID NO: 6818758 - DNA, 86 bp, Homo sapiens
gtaaataattcaaatggtaaggattgtagaaacgaagaaaatgaaaatttaagtttgtttcgtagtccattatttggattttttat

SEQ ID NO: 6818759 - DNA, 59 bp, Homo sapiens
ggagattttgggcatgtttctggaaaatggccaaaactgtaagtgcctcaaggtcgtcc

SEQ ID NO: 6818760 - DNA, 61 bp, Homo sapiens
gctccctccctgcacccccagctgtgattttcatcctgaggtgtgtccccagggaggtggc

SEQ ID NO: 6818761 - DNA, 56 bp, Homo sapiens
atgtgcatgtgtgtgcttgcatatatgtgcatgtatgtgtgcatatgcatgtacat

SEQ ID NO: 6818762 - DNA, 71 bp, Homo sapiens
gagagctccactcaaggccattgcacatgaatagagagtaggtgtttgctaacccttgaggtgaagttctt

SEQ ID NO: 6818763 - DNA, 119 bp, Homo sapiens
gggaggactcagggtcttctttttactctcttggtgggtggcctgttgatttgggcttataccgctcagcgtgtactcattaggctaagctgtaattagaccaagactgtggcattcct

SEQ ID NO: 6818764 - DNA, 71 bp, Homo sapiens
gtgatatgggaagttcagaagattcatgggatttacattctggattttagaaggcttcctaacaatgtcac

SEQ ID NO: 6818765 - DNA, 77 bp, Homo sapiens
cataaaaacaagtagaaaaccgcactggactagtgtaagttatgagttccctgtttttttccactgtacattttgtg

SEQ ID NO: 6818766 - DNA, 61 bp, Homo sapiens
gttttaagtgatgagcacagtaattagcttgctgctgagtgcaggagttcacattgagaat

SEQ ID NO: 6818767 - DNA, 98 bp, Homo sapiens
aatcttcaacttgtatttccagtacccagaacagaggcttgtactaagaaggcattcaattggtatgtaatggattagaataagttgaattgaagatt

SEQ ID NO: 6818768 - DNA, 120 bp, Homo sapiens
gatagaggctgggcatggtctctcttggcttaattgtggttctctgcttacggagatgtacctggcaagcccagtattgagctacaggcctgagatgtcttgctttgctagccttctatt

SEQ ID NO: 6818769 - DNA, 87 bp, Homo sapiens
tcaaccaatgagaactgggagttggtggccaaataccaagcttcctcaacccttggtaagtcaagtctcagtctctcagaggtttga

SEQ ID NO: 6818770 - DNA, 126 bp, Homo sapiens
atctattgagataatcatgtggtttttgtctttggttccgtttatatgctggattacgtttattgatttgtatatgtcaaaccagccttgcatcccagggatgaagcccacttgatcatagtggat

SEQ ID NO: 6818771 - DNA, 57 bp, Homo sapiens
tctcagtttcttagtctgagcaacagaaaggatgaagtgcagtgtggaagactgaga

SEQ ID NO: 6818772 - DNA, 59 bp, Homo sapiens
tgggatattttgagctttcctccctcccctaggtggaactgtggctgtaacgtatccca

SEQ ID NO: 6818773 - DNA, 64 bp, Homo sapiens
attaaggaggtaaactatggttgcaaaatcctttctataccgcaaagtagttttcagccttggt

SEQ ID NO: 6818774 - DNA, 97 bp, Homo sapiens
aggcaggaggatcgcttgagcccaggaggctgaggctgtagtgagctgtgatcatgccactgcacttcagcctgggcaatagggtgagaccctgtct

SEQ ID NO: 6818775 - DNA, 57 bp, Homo sapiens
cagggtggccaggtagataatagttccatccctgttattgctttccctgccttcctg

SEQ ID NO: 6818776 - DNA, 61 bp, Homo sapiens
tccattgatagatattttggttgtgtctactttttattattaatcaaaatatttctgtgga

SEQ ID NO: 6818777 - DNA, 83 bp, Homo sapiens
tttctgttccctcagtcacgtctcaggacttggggatgtgtggacagttacatatatcaaattgaggcagctgggggaggaaa

SEQ ID NO: 6818778 - DNA, 80 bp, Homo sapiens
tgtggttctgccctgggtaagtgcataaaaagtaaaatcccattcccttcactgcagttattccatcaggctgaaccaca

SEQ ID NO: 6818779 - DNA, 65 bp, Homo sapiens
ctttgtattccatatcatgccataagtcattggccttccagttcatggtatggtagattgcaaag

SEQ ID NO: 6818780 - DNA, 77 bp, Homo sapiens
tcccttagcccatctctggttactctcagggtaacttgcatttgagattcatgggtctaaccagtgtggctagtgga

SEQ ID NO: 6818781 - DNA, 60 bp, Homo sapiens
ttgttacaatgtacttccttgcacagtatctttgtgcacttgtatgagtacatctgtcag

SEQ ID NO: 6818782 - DNA, 69 bp, Homo sapiens
gacagagctttttaaaggatttttaaaggattgtaagatctaaccatccttcctttgagaggctccatc

SEQ ID NO: 6818783 - DNA, 68 bp, Homo sapiens
agagacaagatgagcagctcagtgtcagcactaggatctgattgcagagcgtgtgctttcttccctct

SEQ ID NO: 6818784 - DNA, 65 bp, Homo sapiens
gggcagtaagttctcagaagattttgtaggtcttttagtctataaattcttctctgaattagcct

SEQ ID NO: 6818785 - DNA, 80 bp, Homo sapiens
ttcttgccatttcattttggggtttgtcatcttttaagtttttccttagaagcttctaaaatgacctcagaatgtaagaa

SEQ ID NO: 6818786 - DNA, 67 bp, Homo sapiens
cagacactatgctaaggtactaataggaattatatattcctcacaatgaccttaagcaatagtgctg

SEQ ID NO: 6818787 - DNA, 89 bp, Homo sapiens
ctgtggtcagctgagctgcctgccttgcctggaggaacgcaggtcccacagctgcctctgtccggcaggcaggcaagttgtaccttcag

SEQ ID NO: 6818788 - DNA, 73 bp, Homo sapiens
caggcgtcccactgacccaggctgggtggcggcagagagtggcattcccactgaggtagctggtgactgcctg

SEQ ID NO: 6818789 - DNA, 87 bp, Homo sapiens
gtacatgtagttaggctgggaattggctaggatacactgctctaactgtaccgcttgttgccattgtcagccctgattggactgtac

SEQ ID NO: 6818790 - DNA, 64 bp, Homo sapiens
gtgcccccaaataccaggctacttagaaccaggcagagatgcctgtattttggtggggggctac

SEQ ID NO: 6818791 - DNA, 60 bp, Homo sapiens
agctgcttcctctttgatgtcattacttaacattcatatgaatcttgaggaccagtagct

SEQ ID NO: 6818792 - DNA, 78 bp, Homo sapiens
ttttagagtccttgcatatctgaaaatgtttcttccagactgtgaaacatgagtctgtgtgaaagtgattcattgaga

SEQ ID NO: 6818793 - DNA, 63 bp, Homo sapiens
ttattgtatcatcattatcagtctgcagatttctctatagctagaaagtgaagatcacagtgg

SEQ ID NO: 6818794 - DNA, 92 bp, Homo sapiens
gggcatgtgtcagctcactggcagcctggggtaggctgggacacgctgtcctttttctgcctgaggactgacaccagctcagcaaacagccc

SEQ ID NO: 6818795 - DNA, 84 bp, Homo sapiens
ggcaagcacgtgcccagagcagtgtttgtggacctggagcccactgtggttgataggtcctcgggcactggatggcagctttcc

SEQ ID NO: 6818796 - DNA, 56 bp, Homo sapiens
catggaactgtgctgaaaagtgtttatttaaacttctccttcagcatcgttgcatg

SEQ ID NO: 6818797 - DNA, 61 bp, Homo sapiens
cttcgtgctgtaacaacagagtgtctgcaagtgtggtagatacgtgcttgtgcagatggag

SEQ ID NO: 6818798 - DNA, 74 bp, Homo sapiens
gatgcccagaacttgtgctcatggtccagcatggtaactaaggcaccagctggcccatgagcacgtcaggcatc

SEQ ID NO: 6818799 - DNA, 63 bp, Homo sapiens
tccagaagcctgcctcagatgcactcacccttcttggcaggcatcaggggtaggtgtttagga

SEQ ID NO: 6818800 - DNA, 56 bp, Homo sapiens
gctcctacttcagccaagaaaactcagtcctcacaggattatgttgctgaaggggc

SEQ ID NO: 6818801 - DNA, 75 bp, Homo sapiens
tacttgccttcttctctacaccagcagccccactgaaagcccagcaggggtggccccctggggaggtggcaggtg

SEQ ID NO: 6818802 - DNA, 130 bp, Homo sapiens
ggcaggagatccctgggggtgtcaggaggaacatggcagagcctgcaggtgggtgagcagtattctccatggattggttggtccaggctgcagtcttgccctctctctcggattctcccactctggaaac

SEQ ID NO: 6818803 - DNA, 76 bp, Homo sapiens
gctctgcctgcatccgctgggcgggcaccacccactccactgtcctcgggcctgcccacggggctggcataagagc

SEQ ID NO: 6818804 - DNA, 71 bp, Homo sapiens
taggaccaacaccttctccttgcaggccagacggcagtttggctgtcaaagacaggatgttgtcactccta

SEQ ID NO: 6818805 - DNA, 66 bp, Homo sapiens
caggctgtgatggatgtaaaggaccgattcccaacgattgtcctttatgaaaacctcataagcctg

SEQ ID NO: 6818806 - DNA, 84 bp, Homo sapiens
gttgcacgtaatagtctcaaactcctggactcaagccatctgcccccattggccttccaaagtgttgggattataggcatgaac

SEQ ID NO: 6818807 - DNA, 72 bp, Homo sapiens
gtgtttgagagttgccaggtgtgagttctggagccatgcgtcctgggttcatgtcctggtgctgttttttac

SEQ ID NO: 6818808 - DNA, 69 bp, Homo sapiens
ggcagtgtttgctacttagatcttttttagatagaggcaggaaagtaattaagaagctggacacttgcc

SEQ ID NO: 6818809 - DNA, 81 bp, Homo sapiens
tgaattgcctaaattagtgataggaagccagattgagtccatgcactctgcttctggaacctgtgctgttaggcattttca

SEQ ID NO: 6818810 - DNA, 72 bp, Homo sapiens
cttgggacagtggcagtattagggcagatcccgtccgggccttctgcccaggcagtgctgcatcctcccagg

SEQ ID NO: 6818811 - DNA, 71 bp, Homo sapiens
gggcggccaggagagcccgggtccgggcttccgccttcgcagggcctgtctcgggctcttcggccgggccc

SEQ ID NO: 6818812 - DNA, 55 bp, Homo sapiens
tgcacattgaaatgaccagctgcactggaatgtagtagctaatcactaatgtgta

SEQ ID NO: 6818813 - DNA, 62 bp, Homo sapiens
cagggctggatttcatttctagcttaattaaatcctagaagcacacctgacctctagctttg

SEQ ID NO: 6818814 - DNA, 76 bp, Homo sapiens
ggcttattagaggacaagaggcctggctgataaattcctgaccagagggatggaggctaagcctttccctgcagcc

SEQ ID NO: 6818815 - DNA, 58 bp, Homo sapiens
ggtcagaatattagttacctttgcagttattgagtggtgaaggtataagtgatctgct

SEQ ID NO: 6818816 - DNA, 55 bp, Homo sapiens
aggtagtattctttccagcagacactatatttttctgttgggatgaagttaacct

SEQ ID NO: 6818817 - DNA, 118 bp, Homo sapiens
gagtccaagttggaggctggttcgcccagagatcttgtcctttccagccctgggcaccccagcagtagaaaagtggaaagggaggtatctctagggaaactttccttgagttgacctt

SEQ ID NO: 6818818 - DNA, 64 bp, Homo sapiens
gctgcaggagtgcgggtgggtgctcgccccagaatcggtttgcattgtctccccacttctgggc

SEQ ID NO: 6818819 - DNA, 77 bp, Homo sapiens
cagagaaatgcagcagctgaccagtgagtcctgcaagtaagaggcagaattgcaactcactctcattgctctctctg

SEQ ID NO: 6818820 - DNA, 74 bp, Homo sapiens
tgttacttgacacagtcaacttgatttttctctgaaacaataaaaggcaaagagaaaagcaacacgtgtcagca

SEQ ID NO: 6818821 - DNA, 76 bp, Homo sapiens
acaatcagcatgtattgctgagaattctcccaaacaattacgtttgaagagcttttctgtaataacatctgaatgt

SEQ ID NO: 6818822 - DNA, 86 bp, Homo sapiens
agggaaatcaaggaaggcttcatggaggaggtgagtcctgaactgattcagattgcactaatattcataagtagcttgatggccct

SEQ ID NO: 6818823 - DNA, 92 bp, Homo sapiens
aggtgggaagtaggagtgagacacaaacacatttagaggagatgacaaggatcctttgcatttatgtgtccatttttaaactgttctgcact

SEQ ID NO: 6818824 - DNA, 66 bp, Homo sapiens
ggcatccttgacacactccagtactgacaggaaccccttgaagactgtgcggggtgcggggaggtc

SEQ ID NO: 6818825 - DNA, 61 bp, Homo sapiens
ggggctggctgtggcccagctgggtgtggagtttcacagccagaggagccaggctggcccc

SEQ ID NO: 6818826 - DNA, 77 bp, Homo sapiens
aagaataacttatacacgaacacaaggtgtgtaccatgccatgtacatatcatgtttgccgtgtatatctttagctt

SEQ ID NO: 6818827 - DNA, 77 bp, Homo sapiens
gagaaatcaactttaactatttaagagaaagaaaagaaattttctgggagaatctaaatggttcagagaaacttctc

SEQ ID NO: 6818828 - DNA, 77 bp, Homo sapiens
tatttgctgagagaactctttatctgtggaatgtgcttagtaggatatagctggttaagggttgcttacagtaaata

SEQ ID NO: 6818829 - DNA, 97 bp, Homo sapiens
aattatggagggacaccatttagtctgtaacagtacagttacataagtagatccatttgccaatattgtacggttaagatttgtattttccatgatt

SEQ ID NO: 6818830 - DNA, 98 bp, Homo sapiens
cctccatttccttgcctcccgttctgtcagctggtctctaggaatggttaggaatgtagtttgagtagaaacctgggaggaagcagcaaaatgagagg

SEQ ID NO: 6818831 - DNA, 55 bp, Homo sapiens
cctaacagcttgaggaatatcatcatttgtatgaatgaccatctcaatgctgtgg

SEQ ID NO: 6818832 - DNA, 72 bp, Homo sapiens
ttatagttaaattgtcctcctggcagggcctttgaaatctgttggcctgtgtaaaagattagtttactatga

SEQ ID NO: 6818833 - DNA, 81 bp, Homo sapiens
gttagacttctagaaacggcaaccgtgcagatgtctgggaacccagaaatcagcaaaaatgccttcagaactccacttaac

SEQ ID NO: 6818834 - DNA, 56 bp, Homo sapiens
gtgggcatcaccagggcctccagatcctcctggggcagaagctgggcgatgttcac

SEQ ID NO: 6818835 - DNA, 77 bp, Homo sapiens
gtttaatgggtgaaatttaaaaacataatgtataggcaaaaagctaaaacactggttggttgaatttactattaaac

SEQ ID NO: 6818836 - DNA, 71 bp, Homo sapiens
tctccattagaagttcattttaagaacttcacagaatacttttggaagaggaaaatgagcctagagggaga

SEQ ID NO: 6818837 - DNA, 69 bp, Homo sapiens
ttcttcagtcccactagccacatttcaagtgctgaatacctacatgtggctagtttggaccatgaagaa

SEQ ID NO: 6818838 - DNA, 56 bp, Homo sapiens
ccttccagggagtcaaatgaactactttaggagtataagttaaacaccctgggggg

SEQ ID NO: 6818839 - DNA, 70 bp, Homo sapiens
cttaagataatccattataatgttatacacaattttgtcgtgtttgaacgcagtggtgggttgtcacgag

SEQ ID NO: 6818840 - DNA, 99 bp, Homo sapiens
tctgccctctctccttcctttgccaaacttctcaggcgttaagattcaacacgggcaatttaggatttttggccaggggaatgagagaatgcaggcaga

SEQ ID NO: 6818841 - DNA, 56 bp, Homo sapiens
ttgacaaagtgctaaaccacagaggtctgagaaagacactcttaagcctttgtcaa

SEQ ID NO: 6818842 - DNA, 81 bp, Homo sapiens
gaactaaaggcagtaggctggtgattagaagcagcccaagtgggtttgcttgaaattcagtcaagaatatctgtctggttc

SEQ ID NO: 6818843 - DNA, 57 bp, Homo sapiens
ggtgtcagggctccactcaccctccctgcaccacccagggggggcttgccctgcacc

SEQ ID NO: 6818844 - DNA, 90 bp, Homo sapiens
atcttcatttatgtatatgttatttatgtttgttgtgagagttgatgtctacagctaggcaaaaatgacatttcatgcatttgtgctgat

SEQ ID NO: 6818845 - DNA, 58 bp, Homo sapiens
ggcacgtgctccaggctcctccagccgctgaggctttggcttgccctggcagtacccc

SEQ ID NO: 6818846 - DNA, 126 bp, Homo sapiens
aataagcatgatataatctgtaggatgctttgtttggaaatagtttgaaagatacaacagagataggaagactgtagaatagacttttcaaaatctagaccacagattatatttaagtgacttatt

SEQ ID NO: 6818847 - DNA, 61 bp, Homo sapiens
gacaagtaaaggcaaatagagggatggcagacagcattcctgtatctgcttcttactaatc

SEQ ID NO: 6818848 - DNA, 65 bp, Homo sapiens
aattgagtaaatatacctagaagtgtgactgctggatcatatggtaagagtatatttactttttt

SEQ ID NO: 6818849 - DNA, 129 bp, Homo sapiens
gtgtcccagctctgtcctgcctcccactcttactcctgctgtcactgcagttccctcctccttggcagagcatgcagtgacagcagttgggctttgggagagaaaggagggatgaagccgcctgcccac

SEQ ID NO: 6818850 - DNA, 74 bp, Homo sapiens
gggaagtccagtgtcaaggtgccattaggtttggtgattctgattccaggatggcaccttgaacgctgcgtcct

SEQ ID NO: 6818851 - DNA, 58 bp, Homo sapiens
tcctgaggcctctgtgatgtgaggaagcccaacgtagcccatacagagacctcaagga

SEQ ID NO: 6818852 - DNA, 65 bp, Homo sapiens
tagcatgcagtgatgcactgcatcatcttttgtttgtggttgcaacaacgtgtcgctgtacgctg

SEQ ID NO: 6818853 - DNA, 76 bp, Homo sapiens
gagtttatcttctcagtcacctgtgagtcttcctttgagagtgggacttgcagagtggcttggtagggtagagctc

SEQ ID NO: 6818854 - DNA, 118 bp, Homo sapiens
gagctccatttagtctgatttatgtctttccaagagccatggtctcagggccataaggaaagagatccttaccatagacttgtggtctcaaaggcatgcatttaggaaacatgggctt

SEQ ID NO: 6818855 - DNA, 55 bp, Homo sapiens
ctaccaagccccaaataatgaggggtgagaggctcactgttcaagggcctggtgg

SEQ ID NO: 6818856 - DNA, 79 bp, Homo sapiens
gcaacacatagtggatatttatttctgcaggtagttaggtataacagttgctgaagtagtattcttaccacgtgtatgc

SEQ ID NO: 6818857 - DNA, 59 bp, Homo sapiens
cacccaggcatgggttgagatgcttgggtgcccatcccatctctgccagtgactgggtg

SEQ ID NO: 6818858 - DNA, 76 bp, Homo sapiens
ctatgcacccctagtgtatgcacaatgatcataggcagtacatagctacagcattgttcaacactgacttgcatag

SEQ ID NO: 6818859 - DNA, 55 bp, Homo sapiens
tgggagtagacatcctggactgaaattcagtgcatcactagggctgtggctctca

SEQ ID NO: 6818860 - DNA, 88 bp, Homo sapiens
gttagaatggggatcgagatttatccaagggagctgacaatctgtatagtacctttgcatggattttttaaaaggcccctctctggac

SEQ ID NO: 6818861 - DNA, 88 bp, Homo sapiens
gcacaaactttgtgtgcatgtgtatctacgtttgtgtgtacctgtgtgtttatgtgcatgccatgtggatagatgtgttagtatgtgt

SEQ ID NO: 6818862 - DNA, 64 bp, Homo sapiens
ttctctaagctggctgaggtctatgaccccagattgggtcctggcctggacaccagcaagagga

SEQ ID NO: 6818863 - DNA, 61 bp, Homo sapiens
gtttcagtgaagttcaagcttgccatctattttcagtagaagcaggaagaatgtcagagac

SEQ ID NO: 6818864 - DNA, 57 bp, Homo sapiens
gcagcttggggacatgaaaagacttgtagtttgatgctttcttatgtccgtaggtgc

SEQ ID NO: 6818865 - DNA, 56 bp, Homo sapiens
gcattcgctctctgttactcatttaactcacttgaaaagttacagtcagtgggtgc

SEQ ID NO: 6818866 - DNA, 57 bp, Homo sapiens
gggcagcagagccctgccgagtgagaggctgtggggcagcggctctgtcctgtgcct

SEQ ID NO: 6818867 - DNA, 91 bp, Homo sapiens
ttgtgacccagggtgagctggttagagggaggctggaggtgagtttcgcaacctgcagccttggcaaccagggactgtactcagggaacaa

SEQ ID NO: 6818868 - DNA, 55 bp, Homo sapiens
gaagggctgatctcactttcttttctccactccaggaatgaaagcaaagcccttt

SEQ ID NO: 6818869 - DNA, 60 bp, Homo sapiens
agaatgttgaaaagggagatggtgacactgcagacaaacttttctctctgataacatttt

SEQ ID NO: 6818870 - DNA, 68 bp, Homo sapiens
gagagaaagggaactggcaaagccactcattctcactgattctgtgggtttgtcattctttttgtctc

SEQ ID NO: 6818871 - DNA, 62 bp, Homo sapiens
cctgtcttattttaaaagggaagtttgcaaagggttccacttacagaaatacactagatagg

SEQ ID NO: 6818872 - DNA, 61 bp, Homo sapiens
cacttatctgcagaccggtttcttccttctgtgtggcaagaagcatggctgtagattcctg

SEQ ID NO: 6818873 - DNA, 77 bp, Homo sapiens
cacagagaaaacacatttctaaatttttaccggaactggcagttctggcaaggattttaaaatgtaagtcttttgtg

SEQ ID NO: 6818874 - DNA, 90 bp, Homo sapiens
gtgtctaatacgatgttttcaatatgccctcctctttttcttctctaaaatagaacacaaaaaagaggagggcagattcaaggcaggcac

SEQ ID NO: 6818875 - DNA, 100 bp, Homo sapiens
aggagggaataggggagaaggggaaattctcaagctggctgggagcagttgttgctcttaggggataggttgggtgtttcacagctccccttgcccttct

SEQ ID NO: 6818876 - DNA, 110 bp, Homo sapiens
cctcaagaagggggcatgaccttgggaaagacaattctctcagtcaaggcagtttcaaagagagttgacagttgagggttgtctaaactaaagttattctgtttcagagg

SEQ ID NO: 6818877 - DNA, 73 bp, Homo sapiens
agaagaattagctataggtgcatcctgttgttgtgcaaacaaaactacaggtggcttattggctgattttcct

SEQ ID NO: 6818878 - DNA, 58 bp, Homo sapiens
gaggcacagttcttcctccagatacaatgttggtaagaccaggaatcactgtgccctc

SEQ ID NO: 6818879 - DNA, 59 bp, Homo sapiens
ctagttagattacttggattatatggattccagtctcaggtctgccaagaactaattag

SEQ ID NO: 6818880 - DNA, 61 bp, Homo sapiens
ggctcttccaaacaaaaatctgtgttataaattaacagcaggttattgttatggcagagtc

SEQ ID NO: 6818881 - DNA, 89 bp, Homo sapiens
ccacccaaatctcatcttgaattgtactcccataagtcccacgtgttgtgggagggacctggtgggagataattgaatcatgggggtgg

SEQ ID NO: 6818882 - DNA, 62 bp, Homo sapiens
cagagcccatggcacatgtggaaaatcctctgctggatgaggtgactgtgcgatggtctctg

SEQ ID NO: 6818883 - DNA, 95 bp, Homo sapiens
gtcaagcattagattctcataaggaacgcacaacctagtccctcacatgtgcagttcacaatagggtttgtgctcctatgagaatctaatgtggc

SEQ ID NO: 6818884 - DNA, 60 bp, Homo sapiens
ctgggccctgagcacagctcctctccttgtcccaggagagccagctctgccgggggacag

SEQ ID NO: 6818885 - DNA, 72 bp, Homo sapiens
gtctctcagtctctgagaggtgagaagcagcagtgcccaggtcttgccttgctttggcggaggctgtgtggc

SEQ ID NO: 6818886 - DNA, 67 bp, Homo sapiens
ccttgtggcatcggagagatagaggggccagttcatcggcttctcccttcttctgattgagatgggg

SEQ ID NO: 6818887 - DNA, 85 bp, Homo sapiens
gaacaattgttcctctctgttgctaaatgtattgcctaattagagaatgaataaaatgtcatagcaaagagagtgatatttgttt

SEQ ID NO: 6818888 - DNA, 63 bp, Homo sapiens
atctggtctcaatcaagctactgggtaagagacttttgtgtaattgaaattgagaaccatgat

SEQ ID NO: 6818889 - DNA, 62 bp, Homo sapiens
atactttgctaaaatgtgcagaacttggttcaagctttctagaaaacaatttagcaaggtat

SEQ ID NO: 6818890 - DNA, 78 bp, Homo sapiens
gttgtttgtcataatatcattacagatgttttcactcgtaatccatttatttggtaatgatccagtatgatttataat

SEQ ID NO: 6818891 - DNA, 63 bp, Homo sapiens
aatgtgaccttctttggaaataggatctttgcagatgtagctgagttgaaatgaggtcatgtt

SEQ ID NO: 6818892 - DNA, 71 bp, Homo sapiens
tgggaaggcagggacggatgaggctgcagtagtcgaaagcctgaatgaattctctgcctgcgtattttcca

SEQ ID NO: 6818893 - DNA, 70 bp, Homo sapiens
aggccatgctgatgaggtcaggaagactggcatgaccccacacagtttaactggctttcagagtaggtct

SEQ ID NO: 6818894 - DNA, 74 bp, Homo sapiens
caggggtactgtcagtagttttaagtctgttaaatgagatttcccagaacagatcctggctcccagtacctgtg

SEQ ID NO: 6818895 - DNA, 130 bp, Homo sapiens
gagtttgtctaatggagaaaattaagtgggataataatggcatgagaatactgagggatatttatcttaattatttctcagcttttttggctaataagtaagcaaagtctttctcatctaaaataagatt

SEQ ID NO: 6818896 - DNA, 84 bp, Homo sapiens
gttattttgcttctcttcgcctaggtccttatctgtaaaaaggagataaggatgcttaccttgaagggatatcctaaaaatgac

SEQ ID NO: 6818897 - DNA, 79 bp, Homo sapiens
gtctgaatccagtttttccttgctgaggacccggtcgaggagcaatgagtgggagtagggaggaaaaatcatgtcaggc

SEQ ID NO: 6818898 - DNA, 70 bp, Homo sapiens
gcagacatttttggtcgttataactagaggatgctactgacatctagtgggtggaggccagggatgctgc

SEQ ID NO: 6818899 - DNA, 80 bp, Homo sapiens
acacttctagaagactggagctggaattactgaagtttcacctgcagattttagcacagaactccactcacagcaggtgt

SEQ ID NO: 6818900 - DNA, 83 bp, Homo sapiens
catacaacaaagtgagttaaagtacctttgtatgtgttaactacacatacctctgggtagctttcaacttctttagttgcttg

SEQ ID NO: 6818901 - DNA, 81 bp, Homo sapiens
gtatttttagtagagacggggtttcaccgtggtctcgatctcctgaccaagtgatacacccgcctcggcctcccaaagtgc

SEQ ID NO: 6818902 - DNA, 83 bp, Homo sapiens
tcagtctgtgaggccaccagggtactattcactgctttgcagcagcaatttaccaaatggtaccctggtgacttagagagtga

SEQ ID NO: 6818903 - DNA, 55 bp, Homo sapiens
ggctcgcacttgctacccactctggagcaaggtgtgggtgcaagctgcggatgct

SEQ ID NO: 6818904 - DNA, 64 bp, Homo sapiens
ccctcttctagatgataaaccagcagcgcaagagggtgcttggtttttctttcaggatctaggg

SEQ ID NO: 6818905 - DNA, 59 bp, Homo sapiens
gtttgttaatctcttggttttatttcaaaaatgaaactatatttagagagggaacaaat

SEQ ID NO: 6818906 - DNA, 65 bp, Homo sapiens
cctgagccctcttccctagtgatcgggactgctgcaggatctggttctggggaagggggttgggg

SEQ ID NO: 6818907 - DNA, 87 bp, Homo sapiens
acacagtaagtactgaatatctactgttattattaatagtaagagtatttgtattaatagaagcagtaacagcaatatttgcagtgt

SEQ ID NO: 6818908 - DNA, 60 bp, Homo sapiens
gcctctcccatgggcacccagtggttaatgcacaatgtttagcacgtcgcccagggaggc

SEQ ID NO: 6818909 - DNA, 55 bp, Homo sapiens
gggacaggtgggccatgaaaaatgaccatcaccttggctatatcacccccgtccc

SEQ ID NO: 6818910 - DNA, 78 bp, Homo sapiens
gaagggattctggttgtgttttacacttggggagtgtctttcttcaaagatttgataaagccacgagtgagtgccttc

SEQ ID NO: 6818911 - DNA, 61 bp, Homo sapiens
cttccactttcctttccagattacagcaaaatgtcaagaagtggtaaaggagggctggagg

SEQ ID NO: 6818912 - DNA, 100 bp, Homo sapiens
gttattttcttatattcttctttatgacctgtatttttccaaagattgggaagcaaaaatgtcaaggtgatagatgcatatagataggtaaaaagatgac

SEQ ID NO: 6818913 - DNA, 78 bp, Homo sapiens
gtggctgtaatcttggctacttaggaggattccttgagtccaggagtccaaggctgcagttagctatgattacgccac

SEQ ID NO: 6818914 - DNA, 57 bp, Homo sapiens
agcaatctccagagtaaccttggagcagtaatctgatctcagattgttctgggagct

SEQ ID NO: 6818915 - DNA, 115 bp, Homo sapiens
atgggagggaattttaactgggtgtgaatattgggaggtgtggttagttgggggctatcactgtatctcccacaggctgctacttctctcttaatatctcttgtcctcttcccgt

SEQ ID NO: 6818916 - DNA, 67 bp, Homo sapiens
cacacacacaaaggaatgtcatatcagcagtcagactccctgggtgtcaacacttcctggtggtgtg

SEQ ID NO: 6818917 - DNA, 129 bp, Homo sapiens
acttttaattttcatgccttctgcttctttggaaccagttcatgtttctcctgtgaagctatatggaagctcatttagggggcatggtacaaatttccaaggaagaatactgaattttgaaaagagagt

SEQ ID NO: 6818918 - DNA, 119 bp, Homo sapiens
cctcaattgtaagtcacattccaattccagagatgataaaatgtggtaaacatgtgtctgaagagtaattcaatatagtgttagctcatttgatcctcccattgactccacaaagcagg

SEQ ID NO: 6818919 - DNA, 72 bp, Homo sapiens
ttcatgatcctgtgcccaaactgattagaggaaggattggcaaactttttctgtaaagggccagagagtgaa

SEQ ID NO: 6818920 - DNA, 56 bp, Homo sapiens
ctatgtggtaggtgtccttagtctccccactttagagatgagaaactgacacatgg

SEQ ID NO: 6818921 - DNA, 64 bp, Homo sapiens
cttgcccgcgaagaagctaggattaaataatgtagaagattattttggtatatctgtgggtaag

SEQ ID NO: 6818922 - DNA, 63 bp, Homo sapiens
cttttctaaaatagagacatattttgcaatcaagatagggcagattttgctattttagagagg

SEQ ID NO: 6818923 - DNA, 72 bp, Homo sapiens
ggtcttaagtttgttcagggcttacattataatttgcccaaatttaatgtaactttaagcaaattcaaggct

SEQ ID NO: 6818924 - DNA, 128 bp, Homo sapiens
tccagatctttttcttaagaaaaaaatttcagtattgcacctgatgtcttagtgttagctgtcagtcatcttgacaagtggagatatttaaggtcaaatattgaaaatggaatgtgggagagggtgga

SEQ ID NO: 6818925 - DNA, 74 bp, Homo sapiens
cagagccagggtgggaggctgaaggcgttgctgccctctgcctgcttcagacatcctcaccggcccttcctctg

SEQ ID NO: 6818926 - DNA, 66 bp, Homo sapiens
ccagtactgtctccaatattccataggtaattagaatgttgcagtgatgatggcaggcagcactgg

SEQ ID NO: 6818927 - DNA, 59 bp, Homo sapiens
tgtatgaacctttaatatagtgctgccatcagacattctattaagaaggtaatcgtata

SEQ ID NO: 6818928 - DNA, 63 bp, Homo sapiens
atctttacagtgtaagtgcagactctaaatatcactaaagagatgaaaatgtgctgtaaagat

SEQ ID NO: 6818929 - DNA, 55 bp, Homo sapiens
ggtgttattctgcccacgacagtacctcaacacatctctgggcagggccagcacc

SEQ ID NO: 6818930 - DNA, 91 bp, Homo sapiens
ggtttatcaaagatcagatagttgtagatatgtggcattatttctgagggctctgttctgttccattggtctatatctctgttttggtacc

SEQ ID NO: 6818931 - DNA, 81 bp, Homo sapiens
gccccctctagcatatgcacgtctatttatgaagacacttagccaggatttagtaagttcactgcaaagctccaggggcgc

SEQ ID NO: 6818932 - DNA, 98 bp, Homo sapiens
tccacaggtttttggataatcctttatcaagttgctgaaactttatcaaaatcctttcaagaacagcaggcaagaagtgaggtccaataagccttgga

SEQ ID NO: 6818933 - DNA, 79 bp, Homo sapiens
cccaggcctggcctcctgcttttccatttgattccctgcctctttctattcggactggaatgccgggccaggctccggg

SEQ ID NO: 6818934 - DNA, 72 bp, Homo sapiens
gcatgccaaaaaataatgtgtgctgcagtcttaaaggaatttagaggcttgtagcatcattgagttgacagc

SEQ ID NO: 6818935 - DNA, 89 bp, Homo sapiens
ccttctatacaaagtgagatgtctgggccaatggagtgcacccccctagagcctgcaccctctcagaaatcccactctgtgtactgagg

SEQ ID NO: 6818936 - DNA, 90 bp, Homo sapiens
ttggaacttaatgaattttagaacatatgtgttgaatatttgaggacagatttgcaacctctgtaatgttctaggagaagttgagcccaa

SEQ ID NO: 6818937 - DNA, 119 bp, Homo sapiens
tagtgaggatcagcactgagatctaaatccacatggtccaggtggaaggtctgtgctctgggccactatggctgctgccttcccctgctcccatggggtggtgctgggctacctggcta

SEQ ID NO: 6818938 - DNA, 98 bp, Homo sapiens
taatgaaggggaaaggttagctatggaatgccaagttcactgctgagttattcagtaacaaatgcatctgggcattcatgctaatttctctacaatta

SEQ ID NO: 6818939 - DNA, 71 bp, Homo sapiens
ttgagagcactcgatactaaactcaaatgggatgctctgtgcctacatgcttttagtgtttcacttctcaa

SEQ ID NO: 6818940 - DNA, 62 bp, Homo sapiens
attacccttactgttttcactgtgtcactctgagaggtctcgcctgaagacatgaggttagt

SEQ ID NO: 6818941 - DNA, 129 bp, Homo sapiens
cctggccagccagtctgttttgtgtgtacaactgagggggcctcaggcccttaaggagctgagaagccaggtccagcacctggaggcgtccccaggaagtgcatgactactggccacatgaatggcagg

SEQ ID NO: 6818942 - DNA, 66 bp, Homo sapiens
ggatgtctctcattattatttgtatgggtcccagtacctaaccaacttagtgtgggagatcagacc

SEQ ID NO: 6818943 - DNA, 79 bp, Homo sapiens
acttttaaaaccatgtttaagcatttcacgatgtttctgtcttacattagcaggtgcataaacactaggtgatagaagt

SEQ ID NO: 6818944 - DNA, 100 bp, Homo sapiens
catgttggagaaccacctctgcaaccctggaatgggatatatgacatttgagctcccgatatcgtgggtcagaggagaaaaaaactgggtttcctacatg

SEQ ID NO: 6818945 - DNA, 66 bp, Homo sapiens
aaaaggctagctagtaacagaaataggatgaagacgtgtctcttgctctgagtacagctgtctttt

SEQ ID NO: 6818946 - DNA, 84 bp, Homo sapiens
ggtttgcctgtttaatcagcaatatgataggctttgtgactgttttcttgttatataggttatcatatttgccctgagtgaacc

SEQ ID NO: 6818947 - DNA, 81 bp, Homo sapiens
agattctgcatgattgatccttctaaatgcttagctccttttaaaactgaacgcaaaagaatgactagttctgtggaattt

SEQ ID NO: 6818948 - DNA, 74 bp, Homo sapiens
gggtgctattcagccacaggggtccagttgcttcgttgcagcaccaatcttgggctagaatagcaggaggtccc

SEQ ID NO: 6818949 - DNA, 75 bp, Homo sapiens
gccttcattcatttatgtcatgggcatttattgagggcctaacatacatgaggttctgtctttgacatagagggt

SEQ ID NO: 6818950 - DNA, 71 bp, Homo sapiens
gggcaaaaatgggacagttggttgggctcttgtgcctcctgcatgggcctcctattatccccatcttgccc

SEQ ID NO: 6818951 - DNA, 97 bp, Homo sapiens
gagaaacaggaggcaagatgaggaaggagggaaagcgcgcggggctcccttcttgtctccttgcgctttatcctgcttctgtctccttttgtctctc

SEQ ID NO: 6818952 - DNA, 83 bp, Homo sapiens
tccaattgacccagatttttggcctggtccttgtcaaggcatctcatagggtttggaagggccgggccgtgggatttactgga

SEQ ID NO: 6818953 - DNA, 100 bp, Homo sapiens
gcttctgtccagctcaaacccacccaggtgccagggtctttggacaccagggagccaggtgtccacattccctggcaggagtaggaggttgacatgaagc

SEQ ID NO: 6818954 - DNA, 125 bp, Homo sapiens
tgtgcaggagccctggccctggcccctgcctctccccgactctggtcagcgcctggagcgagcctcaggtgctgttggcagcgggcagagatcaggcaggggcatcccagggccaggctctgcca

SEQ ID NO: 6818955 - DNA, 59 bp, Homo sapiens
tgaggctcagaaatgtaagtttgtaacactaagttattaattaggtctctgtgcctaca

SEQ ID NO: 6818956 - DNA, 85 bp, Homo sapiens
gggcagtggctcggtccaggggtaccggccaggcagcctctgcagccccccacggctgtgcctctggcctattagagcccagccc

SEQ ID NO: 6818957 - DNA, 60 bp, Homo sapiens
ggtagcgagaacagaccttaaggactgtactgaaatgtcccacctgggtctgctcctgcc

SEQ ID NO: 6818958 - DNA, 77 bp, Homo sapiens
tgcaggcagagtaatgaatagatggtggcaggtcttattagtctccgaaaaacctctgatttatgttgtgccacgca

SEQ ID NO: 6818959 - DNA, 77 bp, Homo sapiens
gctatttcagagcaccccactaccccggcagatggtcctgggccagatggcttgggaggtagggggccgggagtggc

SEQ ID NO: 6818960 - DNA, 58 bp, Homo sapiens
acctggctgagaacgtgcagctggcagaaacaggcccatttgtcacaattcatcaggt

SEQ ID NO: 6818961 - DNA, 65 bp, Homo sapiens
catcagtgttgatccaccagcaattttcaggaagcagattttgcaaaggagatcaactctgtgtg

SEQ ID NO: 6818962 - DNA, 72 bp, Homo sapiens
ctgaactcaaaagacttaaacataagagggaaatctctttttcaaaaagtgttttagcattttggacatcag

SEQ ID NO: 6818963 - DNA, 66 bp, Homo sapiens
tttgtttatttactttgggccttgctcaaaactagtagcaagctgcctggaatgcaatgtgacgaa

SEQ ID NO: 6818964 - DNA, 73 bp, Homo sapiens
cagctaatgtgtaggtgaatcgaggctggtttaggcagctgaactttgttcttggctacctgtacagcagttg

SEQ ID NO: 6818965 - DNA, 88 bp, Homo sapiens
aactgcttattagatttgtgacattgattaaactatgggcaatccctttttccatattaggatttgttatacttccaagatggcagtt

SEQ ID NO: 6818966 - DNA, 87 bp, Homo sapiens
gagccgcatgcaggggagtggcaggcccggacccagtgcccagacctggctcacgtgactctgctttttccactgtgtctgcggctc

SEQ ID NO: 6818967 - DNA, 68 bp, Homo sapiens
tggagatgacccagaggagtgacaagaacataaacttgggaatcaaacagatctgggtttaaatccca

SEQ ID NO: 6818968 - DNA, 101 bp, Homo sapiens
ggtcagtgattaattatgctaagataaacagagttaattttcttcctggataaaactaattacaactgtgtttgttttggtaggacatggaattactgtcc

SEQ ID NO: 6818969 - DNA, 72 bp, Homo sapiens
tgataattctcctgtgtgcttatggagaacaggcctacttagcctaaacattggagcattaggaggttatca

SEQ ID NO: 6818970 - DNA, 55 bp, Homo sapiens
tctgtggctttcgtgtaagatggcggtatagggccatggacaccaatgccaaaga

SEQ ID NO: 6818971 - DNA, 66 bp, Homo sapiens
agtggactggactgaactaggtctttccaggcaaattggaaatagatcagcatggatcagtcttct

SEQ ID NO: 6818972 - DNA, 68 bp, Homo sapiens
gtggattctgaattcctaattactctgagacatgatctaatagctactggtaagaattgagagtttac

SEQ ID NO: 6818973 - DNA, 103 bp, Homo sapiens
gatatttgtttttatgtttccaatctcaggtgtcagatttgacatccagatgatccagtctccatctttcctgtctgcatctgtaggagacagagtcagtatc

SEQ ID NO: 6818974 - DNA, 78 bp, Homo sapiens
agcttgagggttgcaaatcagaagtatagattcaaattgccctgaatatgcactctgatttagcagtacttgcaagtt

SEQ ID NO: 6818975 - DNA, 56 bp, Homo sapiens
caagagggaacctaagatgtatgccaattcacatacagaattaggagatcctcttg

SEQ ID NO: 6818976 - DNA, 129 bp, Homo sapiens
gtagcagtttgtctatttcttctttttaggtcttcagcaaaaagaacagctggtctcaatcttttctatgtcagtttttcacatgcttggggacttaaaatggtgagctaggtcatgcctgtcaattac

SEQ ID NO: 6818977 - DNA, 73 bp, Homo sapiens
ttgggttagttgagaatattttttaaaattagggcaaaatattaatgctaaaggtgttctgtatttaactcag

SEQ ID NO: 6818978 - DNA, 88 bp, Homo sapiens
ctgcttttattcctaatgtactgatgggaagtggtggctgagcttaggtcacttaactacttagcagtagatttggaatcaaaagcag

SEQ ID NO: 6818979 - DNA, 57 bp, Homo sapiens
tggggcgaggcccagggggctgcagcaggaccttcaggcgctctgggtttcgtgtca

SEQ ID NO: 6818980 - DNA, 103 bp, Homo sapiens
ttgagatggagtctcgctctgtcgcccaggctggagtgcaatggtgtgatctcggctcactgcaacctccgcctgctggattcaagtgattctcctgcctcag

SEQ ID NO: 6818981 - DNA, 74 bp, Homo sapiens
gtccatgagtcatgggtgagcccaggcccatctggtggctcagacggcacctgggcagcttacattctcaggac

SEQ ID NO: 6818982 - DNA, 87 bp, Homo sapiens
caacttgaaactgccagtattcacgttcctgccgttcaacaaaacttgagacttttcaggcctgagtgtggaagtctttttaggttg

SEQ ID NO: 6818983 - DNA, 92 bp, Homo sapiens
ccacgctggcccagccccgccctgctctcagtctgtgcccagggcctacagttggctgagggcctcttgtgggtgggtgagggcccaggtgg

SEQ ID NO: 6818984 - DNA, 56 bp, Homo sapiens
tacataattgtctttgtcctcaaactgcccagaagtctgtaggacagaattatgta

SEQ ID NO: 6818985 - DNA, 57 bp, Homo sapiens
gtggcagcaaaatcctgcattcctatgagcaacatatgaatgtttcacttgctccat

SEQ ID NO: 6818986 - DNA, 61 bp, Homo sapiens
tagaagttaaaggaatacagaattagatgtttgctggttttctgtgcttttttggctccta

SEQ ID NO: 6818987 - DNA, 64 bp, Homo sapiens
acacatctactgatattccaggaaaataactctcttatttcctggaatacacagtttggtgtgt

SEQ ID NO: 6818988 - DNA, 81 bp, Homo sapiens
gcttcagagagagcccagggcaggcaaggcagtccccattggagctgacttccaaccccatgcatggctgcttctctgtgc

SEQ ID NO: 6818989 - DNA, 82 bp, Homo sapiens
gagcactgaatttttatccagttttgtttatcatttcagctaggccatttggcactgggaatgtgagcagctggacagcctt

SEQ ID NO: 6818990 - DNA, 63 bp, Homo sapiens
cctgccagccagatcactcgcctgtccaagaaagcacaaggctgggaggtagaggatggtagg

SEQ ID NO: 6818991 - DNA, 56 bp, Homo sapiens
ccagccagaaccactggaacggtgattcttcctgtgaccactctggttctgcttgg

SEQ ID NO: 6818992 - DNA, 62 bp, Homo sapiens
attttgtggccacctgaggagagcttcctttaaagcactgaatcatgttgggccatcagaat

SEQ ID NO: 6818993 - DNA, 56 bp, Homo sapiens
cttgagaaaggaacaggaagcttgtttacaaatgaacaaattcctgcttttgtaag

SEQ ID NO: 6818994 - DNA, 129 bp, Homo sapiens
acttgatattaaaggaaaatgagcaaagtgaaatagtccttagtaagctgtgaatgatgcaaattctctcagatctccctggggactaatcttctcttttaatagcactgtttaactcaaattccaggt

SEQ ID NO: 6818995 - DNA, 72 bp, Homo sapiens
ccaacttgctgtattcagaagctcactctgcctccctggcttcagttctccaatctgaatgggatgagttgg

SEQ ID NO: 6818996 - DNA, 68 bp, Homo sapiens
gggcccaggggcactgccgggcatggccaccctgcgccgtttgctgggcagtgtgccctcgagggccc

SEQ ID NO: 6818997 - DNA, 65 bp, Homo sapiens
actcctctagggtgtaaatctcacctgaaaaatgtgagtgaggctgagaatttactctggagagt

SEQ ID NO: 6818998 - DNA, 88 bp, Homo sapiens
tgctgggtgaccacaacttgtttagaagaggttacttaggtatttttttcagaaagtaagagctcttgaacaatgtggaaatctagta

SEQ ID NO: 6818999 - DNA, 57 bp, Homo sapiens
tctgtcctgtgtctaggggtcttctcatcaggagaagaaggccagacactggaaggg

SEQ ID NO: 6819000 - DNA, 93 bp, Homo sapiens
gcaggtagtggaaccggtcgtagttcttcagcaggtacttgggcgcatacatgtgctcgctggggtctgcaggcgggtactcctgctgcgtgc

SEQ ID NO: 6819001 - DNA, 73 bp, Homo sapiens
cataggatggagggctagtcatttctttttgtatcttttacataaaaatctatgactgcttctcctctgaatg

SEQ ID NO: 6819002 - DNA, 56 bp, Homo sapiens
ccccagctctgccatcatctgcctttgcctgaaggtgagaaactgcggagtggggg

SEQ ID NO: 6819003 - DNA, 62 bp, Homo sapiens
cgggctagcggcctgggttgggctttgtagctgctccgcaggcccagcccgggccgcgctcg

SEQ ID NO: 6819004 - DNA, 64 bp, Homo sapiens
cagctcttcctagccatgccacatttccagtggttccacttgggagcgtggcaggacagagttg

SEQ ID NO: 6819005 - DNA, 76 bp, Homo sapiens
aggctgcctgcacagagctgctttttaatcacaagatgttcaactaaaagtgcagccgtgttgtcagcgcatgtct

SEQ ID NO: 6819006 - DNA, 129 bp, Homo sapiens
attcaggtcattggtaacaacagattagatagacagatttagtttatatgtttggatattttcttggtaatctactgtgctttaaatagactgtcatctatttatatttatgtgttaatatcactctat

SEQ ID NO: 6819007 - DNA, 75 bp, Homo sapiens
gagtagctttcttggcaggccagttcttagggtttgggtgtcattccttaagtacctgactagcatgagtttctc

SEQ ID NO: 6819008 - DNA, 83 bp, Homo sapiens
tccccctttctttggccactatctgtcagaagccctttagggaaatttcttggagtgaatcactagatgcagaggagtgggga

SEQ ID NO: 6819009 - DNA, 62 bp, Homo sapiens
tctgggcctcctctgcccaagctacttagagggatgacagcaggggaaggggaggattcaga

SEQ ID NO: 6819010 - DNA, 59 bp, Homo sapiens
cacccacggactgtgtaattgctgctatcggggctgatgggcaggcacagccctgggtg

SEQ ID NO: 6819011 - DNA, 69 bp, Homo sapiens
ggcgccagaaagaaagaagagccaaactaaatttggcatttcacctttcatttccccccaaatgctgcc

SEQ ID NO: 6819012 - DNA, 83 bp, Homo sapiens
acaaagctttctgtacataaaggaggctctttgccaagattggtatttgcaaagagaatcctgtgtgtcctgagagcttatgt

SEQ ID NO: 6819013 - DNA, 68 bp, Homo sapiens
ggcctctccaggtaatttggatgctagttaaagtttaatagccactgctctaaattatctccaaggcc

SEQ ID NO: 6819014 - DNA, 57 bp, Homo sapiens
gcaggatgagggtgcccaggaccatgcccaggttggtcctgcccacgcccatctggc

SEQ ID NO: 6819015 - DNA, 65 bp, Homo sapiens
caggaagctcaggccagcatctgtgatttatgctgcaccagtctggaatttggcctgagcacttg

SEQ ID NO: 6819016 - DNA, 64 bp, Homo sapiens
catgaagcacactgtgtagagggcatgagagatgccgaatagctgctcacagatgtgctcagtg

SEQ ID NO: 6819017 - DNA, 65 bp, Homo sapiens
aagagtctccatggaaagtagccagttgggcatgactgtgcatttgtcatggggtttatgctctt

SEQ ID NO: 6819018 - DNA, 78 bp, Homo sapiens
ctacaaggaacactacaaggctgggagataattggagaagttttgttttgttttccggatcttgatggtttcctgtgg

SEQ ID NO: 6819019 - DNA, 77 bp, Homo sapiens
ttgagtgtttatcagacaagccctgcatggtcagaatctcttctgcatgaagctggggtttttctatggttattcag

SEQ ID NO: 6819020 - DNA, 56 bp, Homo sapiens
gcctccaggataagtcagggcctcctcctgaagccttgattcactctgtggaatgc

SEQ ID NO: 6819021 - DNA, 87 bp, Homo sapiens
tggcagagggtcagtaagagtagaggagttaaagagaaatgtactattcccttttgaccctgttattctccctgacctagattgtca

SEQ ID NO: 6819022 - DNA, 56 bp, Homo sapiens
ggctcctggcagcaacatttatatagaatatactgtgtttggtggctcctagggtt

SEQ ID NO: 6819023 - DNA, 62 bp, Homo sapiens
tgtgactgatcctgcaagtgtgttgacttatttttctgcacaaggcaacatagatcagggca

SEQ ID NO: 6819024 - DNA, 61 bp, Homo sapiens
tccgtgctttaaaccactgtgctgtactgccgagtacagtataatgctgtagggagaagga

SEQ ID NO: 6819025 - DNA, 61 bp, Homo sapiens
atggattagcatggtaatgcagtcaccccctgctaatcggggcgagtaccagctgatccgt

SEQ ID NO: 6819026 - DNA, 57 bp, Homo sapiens
atttacagacgtggattagtgctcgacaaatggagagcattttccaaggaagtaagt

SEQ ID NO: 6819027 - DNA, 72 bp, Homo sapiens
ccaggcacagtggctcacacctgtaatcccagcactttgggaggccaaggcaggtggatcactgaggccagg

SEQ ID NO: 6819028 - DNA, 86 bp, Homo sapiens
gtggttggtgaatgtccaggaagtcttaactcaagccaccccaaggctgtgattcagaacattttcgtggtccgtctcatctccac

SEQ ID NO: 6819029 - DNA, 70 bp, Homo sapiens
tcctatcatatagtaaataatgtctgtggagccttttactattttccagaacattcactcatatgtggga

SEQ ID NO: 6819030 - DNA, 64 bp, Homo sapiens
tctggagcctctatcagttttaggatgtcagaactttgaatctgtggctggtgagaggcaggga

SEQ ID NO: 6819031 - DNA, 65 bp, Homo sapiens
attgcttagacacttgttagtttcacctgcatatgtaaggtggagttggctgtagttcaagcaat

SEQ ID NO: 6819032 - DNA, 60 bp, Homo sapiens
ggtgatgcaaaccttacatggaccttggggtgacagggcctccttggattttgtatcctc

SEQ ID NO: 6819033 - DNA, 57 bp, Homo sapiens
ctacccaggtctatcaagttgggctcatctcccagggcccagcacaggacctggcag

SEQ ID NO: 6819034 - DNA, 59 bp, Homo sapiens
gcctgtttctagctgtaggaagctgagtggttcacttagcctcatcagcagaatggggc

SEQ ID NO: 6819035 - DNA, 83 bp, Homo sapiens
atgtcactgataatcccactagggagaaaagtccttggtcaacactttggggtttttttctccctggtatttacttagtacat

SEQ ID NO: 6819036 - DNA, 61 bp, Homo sapiens
ttccattccctttgattcgcgctgatcctgtgatctgctgtgtgtaatggaatgcaacgga

SEQ ID NO: 6819037 - DNA, 69 bp, Homo sapiens
gaactgcggaggtcggtgctgcgggctgggcagacccagccagagctcacagcccaggccagcgtgttc

SEQ ID NO: 6819038 - DNA, 80 bp, Homo sapiens
tgttggatgaccagtgagcacagcatggtgtgaggaatagagcactggactcgttctctcattgttacagtcattcaata

SEQ ID NO: 6819039 - DNA, 62 bp, Homo sapiens
agtgagaggggttcatcaggatatttgaattttgaaaatagttcctgaatttcctttctgct

SEQ ID NO: 6819040 - DNA, 65 bp, Homo sapiens
atatgtttttcacaggtttaagctaaaatattgttttagaaggcaaataaacctgagaagcgtgt

SEQ ID NO: 6819041 - DNA, 85 bp, Homo sapiens
tctcctgtttggcccagggccaagcccctttggctgtagcaacagatctactgcgggctgtggccctgggtcgcctctcagtgga

SEQ ID NO: 6819042 - DNA, 102 bp, Homo sapiens
gatttatgttaaagtatattttttctcaatattattggtattttcttattgagttttttttgcgcatattattggagtgtagtatacttttgtcatgtaatc

SEQ ID NO: 6819043 - DNA, 61 bp, Homo sapiens
gtaagcatgattaatatgcttactgtgctgggcatattatgcaaattaaattactgcttgc

SEQ ID NO: 6819044 - DNA, 88 bp, Homo sapiens
ctaggtgaatatattggtgaaaatagttcagataaacatacaaccatgtatgtaaaagtatttatcatcaatgcattatttgtagtag

SEQ ID NO: 6819045 - DNA, 73 bp, Homo sapiens
gaggcagaggacttatggcagtagctagaggagtctgcagtctctaaactactctcccatgattctctgtctc

SEQ ID NO: 6819046 - DNA, 76 bp, Homo sapiens
agaattgccagcctattcatctgatcttgaaagtgtacaaacttaccttcaaacagtgtagaatatatgcaattct

SEQ ID NO: 6819047 - DNA, 82 bp, Homo sapiens
gcacttcatttactgttactgagtctgctgtttagctgatctaggctctgagcttaacagcttgtaatagaagggaagttgt

SEQ ID NO: 6819048 - DNA, 75 bp, Homo sapiens
ggtccagtacggggcagtttcccgcagaaagggtcccacggttggatctttctcttcgaaaacctgccctggact

SEQ ID NO: 6819049 - DNA, 67 bp, Homo sapiens
ccttccagttcttggttgtaattggattcaggctaaaacaaccacgtccccaaccaggaaaggaggg

SEQ ID NO: 6819050 - DNA, 129 bp, Homo sapiens
gcttttgttttaatgggtgttcacttttaatggtttcaagcattcatcaaaaatgttcctctttgaaaaagtgaagaggacacaaagtggctgagatgcagacctagtgcttcccagttttcaaagtgc

SEQ ID NO: 6819051 - DNA, 65 bp, Homo sapiens
agatgaccagtgttgctggccccgctgaagattcagcctaaagcaatctacattgcatgttatct

SEQ ID NO: 6819052 - DNA, 68 bp, Homo sapiens
aggtggctcccctattctcatctgacgctggtctggcaagcaagtgtttttgggtagggtgagtcctt

SEQ ID NO: 6819053 - DNA, 63 bp, Homo sapiens
gggggccactacatatttaggaccactttaaactactggtgtcattttatgtatgtggtctgc

SEQ ID NO: 6819054 - DNA, 129 bp, Homo sapiens
tgttccactaacaaacacagatttaaaacgctcctggaatgtttgacttattcagtgacttcatcattaaaaggacactggggagggaggcaagaaaggagttttccaatatccattaccatgtgcaca

SEQ ID NO: 6819055 - DNA, 73 bp, Homo sapiens
ggggaaggcagtgagatcttggagggtgagagcacgctctacacccaggtaccgtgatttcatcagcaccctc

SEQ ID NO: 6819056 - DNA, 63 bp, Homo sapiens
ggatggatgtgatctgcctcctacgggaatgctatttaaaggggcagcctcacaatcctctcc

SEQ ID NO: 6819057 - DNA, 107 bp, Homo sapiens
tctgatcgggtcagctgcacagggtgtttctatgccttaattacttatctgcggccagggcacaggatggcagatgaagggtgtccctgtgagcatcctgcatcaga

SEQ ID NO: 6819058 - DNA, 56 bp, Homo sapiens
tgtgggagtcagacagcctgagattgtagtgattgtggatctgtctgtttcctcca

SEQ ID NO: 6819059 - DNA, 59 bp, Homo sapiens
gtattcccagagtgttacatacatgatctcatttgtttgtcatcacagctctggagtac

SEQ ID NO: 6819060 - DNA, 66 bp, Homo sapiens
atttccaaaaccacttattgcctttcaggctgatgtaagaatagttatgagtggttataagggaat

SEQ ID NO: 6819061 - DNA, 75 bp, Homo sapiens
ggggaaaagactagcatttatatgtacataataaaaataatcaacgtggcataataatgactagtttagaaaccc

SEQ ID NO: 6819062 - DNA, 72 bp, Homo sapiens
cctcagggctttgctgaccccattctgagtcaggccccagccaggtcttgggagatgggacagaaagtgagg

SEQ ID NO: 6819063 - DNA, 57 bp, Homo sapiens
tttggcagaaataagtggggcatgaggttctgattcattctctttatagctgccaaa

SEQ ID NO: 6819064 - DNA, 61 bp, Homo sapiens
ctgaggaggggcctgagtgagacctgcaggtgaggttctttgagacaaagggctctctcag

SEQ ID NO: 6819065 - DNA, 114 bp, Homo sapiens
tgttttccccctccttttggcctgtagtctgagcaagcagtgtgttgctgttgctatttttcattagccccaacacactgctcgctcagattaagcttatggtactcattaaca

SEQ ID NO: 6819066 - DNA, 58 bp, Homo sapiens
atggcttcattctgtagttaaaacatttacagtgttttatactgctcagtgtagttgt

SEQ ID NO: 6819067 - DNA, 69 bp, Homo sapiens
ggggctctggtgctattgacgaagagagcacactcattttacctccttcgggtcagcagcagcagcctt

SEQ ID NO: 6819068 - DNA, 81 bp, Homo sapiens
cttggctctctataacgttaggcacaacagcaccttgaaataataggggccagggtgcagagcttaactgtaggtagcaag

SEQ ID NO: 6819069 - DNA, 97 bp, Homo sapiens
catacatgtacacatatacagatggaaagatacacaggtagatagctgtaaaaaatatagtatgtgtgtgtttgtgtgtgtatgtagtatgtgtgtg

SEQ ID NO: 6819070 - DNA, 90 bp, Homo sapiens
tctcaaattagctattgttaacatgttttctttgtctttctttcttgggaaaataaacaatgaagataatgttgcagtgccctttagaga

SEQ ID NO: 6819071 - DNA, 67 bp, Homo sapiens
acctgtattaaacttattaaaagcttggcaaagcggccaacagtacttagaaagttaatataaaggt

SEQ ID NO: 6819072 - DNA, 59 bp, Homo sapiens
gttggaagtagcaagtgaaagccaggaaaaattatctgtgctttctgcatggttcctac

SEQ ID NO: 6819073 - DNA, 81 bp, Homo sapiens
ccaactagtggccctggttaccacaggggtctctgtagctgatgcctgtctgtgatgaaacccctgggagggccattttgg

SEQ ID NO: 6819074 - DNA, 71 bp, Homo sapiens
tgaaatattcgcatgttttactgagaaaacaaggaacctctgattttcttgggaaacaatgagagtcgtca

SEQ ID NO: 6819075 - DNA, 78 bp, Homo sapiens
ttctgcagcatcatatcttcagtgaagggaggcaggtagatgctgctcccagaaaaaggaggctatgaactagcagaa

SEQ ID NO: 6819076 - DNA, 71 bp, Homo sapiens
tttgataatggccgctatgagtcacctgcagagtagaactgtgtgtatccattagaggccaagacttcaaa

SEQ ID NO: 6819077 - DNA, 71 bp, Homo sapiens
gaacgcagtccatccctcgagttagggtgcagtcagccactgccctaagctttcgggctgagagtgaagtc

SEQ ID NO: 6819078 - DNA, 109 bp, Homo sapiens
gggctcccccagataaccctgtaggtctggaccctcctggagtgggctcaggggcctgggtttccactccacaggatgggtccagctgccccggcatttgtggcagccc

SEQ ID NO: 6819079 - DNA, 63 bp, Homo sapiens
ccatgtggtgggaaggagaatgactctcagccatgtcctttctcccatctcagtcttacatgg

SEQ ID NO: 6819080 - DNA, 65 bp, Homo sapiens
tacagtcagctttttacatgtgaaatacagcaaaatgtataaatgaaaaaagagctgattttgtg

SEQ ID NO: 6819081 - DNA, 69 bp, Homo sapiens
ttggaagaccagaggccttgtccagaagagtaaagattccagccagctgggcctatggtctgaatccaa

SEQ ID NO: 6819082 - DNA, 65 bp, Homo sapiens
ccatgcccggctaatatttttgtattttcagtagagacaggatttcaccatgttggccaggctgg

SEQ ID NO: 6819083 - DNA, 87 bp, Homo sapiens
gtgagttgctgagagtaaatttttgttaacagcctctaatgtgcttacaagctgatttttaaaaaatgtattattctagagactctc

SEQ ID NO: 6819084 - DNA, 65 bp, Homo sapiens
gtggaacactgtggatgagaagagacatgagaagtccaccatcttctgcaggcagtgtagaccat

SEQ ID NO: 6819085 - DNA, 98 bp, Homo sapiens
ctgttctttctatcagtagtgttttgaaggggaatctaggttcccagagcaatttgatgttctggagagatcttccacaacacaggcagagggatcag

SEQ ID NO: 6819086 - DNA, 57 bp, Homo sapiens
agaccttttcccacattaggtaacattcttagtttctagggaatgggatgaggatct

SEQ ID NO: 6819087 - DNA, 59 bp, Homo sapiens
ctggatgtgctatatacagtgcagctaatgtctgaggctgctgaagtgtggcaatctag

SEQ ID NO: 6819088 - DNA, 68 bp, Homo sapiens
ggtgggagagaaaaaagcagaggaagacatttatagatcactctttaactctgtcattctctttaact

SEQ ID NO: 6819089 - DNA, 61 bp, Homo sapiens
gggaaggtcattgatctgcggcacaataactcccaccctgcaacagtctaattcccttccc

SEQ ID NO: 6819090 - DNA, 65 bp, Homo sapiens
gaacgcagtctttgctctctgtcaggacttctgaaatgtttttattggagctggaggctgttttc

SEQ ID NO: 6819091 - DNA, 60 bp, Homo sapiens
aataatagttgcaaagtgtttagcacagtgctagacttacaactagttgcagttattatt

SEQ ID NO: 6819092 - DNA, 58 bp, Homo sapiens
ccagcttgtgtcattcatcttgtaaaataatttacaagatgtgtttatacaagctagg

SEQ ID NO: 6819093 - DNA, 62 bp, Homo sapiens
gcaccagtgtggaatgggagctctgtcttactttatataagcagagtccccttcccatgggc

SEQ ID NO: 6819094 - DNA, 123 bp, Homo sapiens
tatttctttattccctttctgagggtgggggactttttagtttgaattttctcaaagcagggggattctgagtttatttgggaggtaatccaagaaaatcatcagtaagggtttggagaaatg

SEQ ID NO: 6819095 - DNA, 74 bp, Homo sapiens
gaggcagagggctcggcggccgctcccgcgtccccgcggcgcggcagcccggcacgacccagcactttgttctc

SEQ ID NO: 6819096 - DNA, 63 bp, Homo sapiens
gagaaaggtcaaaatcgtgacattgggagttagcttaatgcacccagagtttgaacttttttt

SEQ ID NO: 6819097 - DNA, 74 bp, Homo sapiens
aggcagggtttatactatactaataatgctttgtttctcaagctttatggtaagtatagatgactattctgtct

SEQ ID NO: 6819098 - DNA, 64 bp, Homo sapiens
ggctgtagtttgaagacttagcaggtgctttctacacctcactttcctcatcacgactagagct

SEQ ID NO: 6819099 - DNA, 66 bp, Homo sapiens
caaatgataaggctgtagcttcagatgtagatacattcatgcctctgagttatgtccttacatttg

SEQ ID NO: 6819100 - DNA, 79 bp, Homo sapiens
gtgacacatttccttgcttctttgtattattcttaaaattatggtacaactgtattaggcaaaggagggcaggtgtcat

SEQ ID NO: 6819101 - DNA, 71 bp, Homo sapiens
gggctatgtcttcttgttttgaaggaaataggacacacactatctttccaatcaccaaggagaaagaggct

SEQ ID NO: 6819102 - DNA, 85 bp, Homo sapiens
cttttctttggtcactattgtttatgagaaatattgttacagctttttctggttagccaataatgccaacaagtgttcaggaaag

SEQ ID NO: 6819103 - DNA, 84 bp, Homo sapiens
acagtccagctttagtgagtgtggagctagactctgatctggatttgaattctggttcctgcattcattcaactgtgttactgt

SEQ ID NO: 6819104 - DNA, 74 bp, Homo sapiens
tagctttccctcctcaccaaccttgccttctcctctcccaagaaaagcagggtccaaggagatgtagagagcta

SEQ ID NO: 6819105 - DNA, 89 bp, Homo sapiens
ccggcttgcctgggactgaggcatttccaaggatgcaggacttcaaatgttaaacccaggaaagtctcaggcaaaccaggacaagtggg

SEQ ID NO: 6819106 - DNA, 56 bp, Homo sapiens
gggatctgattaataaggtggactgtctccctcccaggccacctgcttcagacccc

SEQ ID NO: 6819107 - DNA, 61 bp, Homo sapiens
acatttgctcttcatccccaactggttcagtatataatgagggggcttaggatgtaaatgt

SEQ ID NO: 6819108 - DNA, 55 bp, Homo sapiens
taacttatttttccctacctgagaaaactgagtctcagaaaggagaagtaatttg

SEQ ID NO: 6819109 - DNA, 55 bp, Homo sapiens
aaggttatgcaagaacagggactttttgtgtccacattgttcattgtgtgtcctt

SEQ ID NO: 6819110 - DNA, 61 bp, Homo sapiens
cccaaggccatcaggtaggtcctgacaggacagctgaccaagggcatatgatggtcatggg

SEQ ID NO: 6819111 - DNA, 65 bp, Homo sapiens
cctgggcaaaggagtcagggtagcctgtaaatcctcaggcacccaggcactttcctttcttcagg

SEQ ID NO: 6819112 - DNA, 95 bp, Homo sapiens
gctgatggaccacgcgcggtgtgcactgtcccccattttaagaaagagggaactgggcttcagaggggacagccacctgcccgaggtcacccagc

SEQ ID NO: 6819113 - DNA, 80 bp, Homo sapiens
ggctgatttgaagaccctgggggaagagaggggaaagtaactcaatggtttcctcttccatcttcccagggacaccagct

SEQ ID NO: 6819114 - DNA, 74 bp, Homo sapiens
ttttagaaatactgatttagtgactttttgatggttgacctggataaagacagtagatgcagtagcttttgaga

SEQ ID NO: 6819115 - DNA, 83 bp, Homo sapiens
ttttgtttgctttaaagtggatacaactataaatgaaggttcagttatattgtttgaagttgtagttcagtgaagaaataaaa

SEQ ID NO: 6819116 - DNA, 73 bp, Homo sapiens
ggttcagaatagggcaggtgaagaaaagctatgtttattttacccatagtttcaagccttctctgtattgatc

SEQ ID NO: 6819117 - DNA, 118 bp, Homo sapiens
agaattagctggaacatttggtaaaggtttagatctcagacccaacaccaggctgaattagtgggtctggagtagggtctgggaattgatatttttagcagatgttccaggtgatttt

SEQ ID NO: 6819118 - DNA, 59 bp, Homo sapiens
ttctcaatggcaacttgttgcttggattctcatcagaagcaaataattgtctttgaggg

SEQ ID NO: 6819119 - DNA, 55 bp, Homo sapiens
ggacaggtgactgcccagagtgaactgactggttagggctgggcctcccctgtcc

SEQ ID NO: 6819120 - DNA, 73 bp, Homo sapiens
ctccacaggcacaggctgctctgcacaggggctggtggggggacttcccaccaggcagagctgtccatgggag

SEQ ID NO: 6819121 - DNA, 56 bp, Homo sapiens
agcagcttggggccgagatagagtttcaaagcgttattcaatggttttaagttgtt

SEQ ID NO: 6819122 - DNA, 57 bp, Homo sapiens
gtcaactccccatgcactgtccctggattcggaaggtacaggcgctggggagatggc

SEQ ID NO: 6819123 - DNA, 77 bp, Homo sapiens
gaggaaaaaaaaggtggaaagaagggctagggactgagatgacactctggtttttcttccattaagacatgttcctt

SEQ ID NO: 6819124 - DNA, 69 bp, Homo sapiens
ggttgatttgaagtaaatactttttgttagcaataaatactttgcttgaaacattgcttcaatgtaacc

SEQ ID NO: 6819125 - DNA, 129 bp, Homo sapiens
ccaggagttgcctctctagtggtgaatacctttgggctgagtcaggaagtctcatacatcaaaagaccatgtgtatataagcatttacttgttatttggttcagagcctccagaaggcaaatctttaag

SEQ ID NO: 6819126 - DNA, 68 bp, Homo sapiens
gacaaagtactcgaggaggaggagcaaaagacctggaaaaggtgctttaatctccacggttctaagtc

SEQ ID NO: 6819127 - DNA, 100 bp, Homo sapiens
actgctgccttgtcggaaggaaaggtgctgtttggtctcttcgctggcatccccatctttaggaattccagcccaaacaagccgccttccaattagcagt

SEQ ID NO: 6819128 - DNA, 82 bp, Homo sapiens
gctatgggaaatattggctgtctgaagatgtccgcatgtaagaggcaaatggattcattcatggcatacatgtttcccaagt

SEQ ID NO: 6819129 - DNA, 87 bp, Homo sapiens
aacctttcagtgagtgcttgtgaaatactagaggcataagaagttatccctgtgtaaatagcaagctctgataactagagaaaggtt

SEQ ID NO: 6819130 - DNA, 70 bp, Homo sapiens
ctcatgcaacatacattctgaagcttttattgagctgaacttagaatatatgtatattaatctgcagaag

SEQ ID NO: 6819131 - DNA, 66 bp, Homo sapiens
ttccttgactttaaagcctgacattttaagctttgtatgaaatactgttgccttgagggaaaggaa

SEQ ID NO: 6819132 - DNA, 81 bp, Homo sapiens
gagtgagaggtcgttatctttgctggaggagtgcttgttctttggcaaggacacagctcttcagtaagatggtcttttctt

SEQ ID NO: 6819133 - DNA, 76 bp, Homo sapiens
ttcaccaagataagaacggagcagcttcgtgggccaagagggctggccaggtgctttggttctgcatctgtgtgga

SEQ ID NO: 6819134 - DNA, 80 bp, Homo sapiens
tcagcacctgatatgatgaggtataaaggataatggtggctgtaacattatgacccttactgcatcatacaaagcactga

SEQ ID NO: 6819135 - DNA, 76 bp, Homo sapiens
tcccaaagcaaatgtttgttttgttgcaatgatggaaacatttccattggtgaagcaaatatttagagctgaaaga

SEQ ID NO: 6819136 - DNA, 70 bp, Homo sapiens
tctgtggcattttgcatcgtcttattaataggaactgactctttgacaaaccctgcaaatagctcacaga

SEQ ID NO: 6819137 - DNA, 97 bp, Homo sapiens
accttttgctcattagcttaaatgaactcaatgatctcccagcccaaccagactgctgggagtctgtgattcaaagccctcacctgagctcagaggt

SEQ ID NO: 6819138 - DNA, 95 bp, Homo sapiens
agcaacatacgaaaactgttcttcattttcagtatgtatcagacacccaaaatacatactgccaatggggtggggaaaggggagcatatgttgct

SEQ ID NO: 6819139 - DNA, 91 bp, Homo sapiens
aagcgccatttttgttacatcaagagtcttactatcagtataaattatgactgatgatgctgactgtgatcacctggctgagatagtgttt

SEQ ID NO: 6819140 - DNA, 71 bp, Homo sapiens
cttatggctgtcttggaaaaggcaaagagaaaaacatttctctttgtttttcttccaaaacatctagtgag

SEQ ID NO: 6819141 - DNA, 57 bp, Homo sapiens
ggaacacaaggcatagcacacagaatttcctttcattctttgcatgtcctttgttcc

SEQ ID NO: 6819142 - DNA, 64 bp, Homo sapiens
gtaactaatatttgtctcaaaatatgtttccaaaagcatgtgtggagaaatatttttcagttac

SEQ ID NO: 6819143 - DNA, 66 bp, Homo sapiens
gattattaaacacctgtctagtgtagcttagggaggtttttctagactgggagtttgcagtggatc

SEQ ID NO: 6819144 - DNA, 130 bp, Homo sapiens
tgaccaccgggagggtcctcagttgcacccggtctgtcctgggccggcgactggtcatggctctggagggaggagcaggactggccagagcctaggaagcccggatggagggccaggtggtggaataaag

SEQ ID NO: 6819145 - DNA, 63 bp, Homo sapiens
gcagttcacaagcgtaggtgctgaagcacattttggtttagtatttaataacttgtcaaatgc

SEQ ID NO: 6819146 - DNA, 66 bp, Homo sapiens
gcccacttgatgaataagtaaactcctttggttaaaataattagtgtttgcaatattccagggggt

SEQ ID NO: 6819147 - DNA, 62 bp, Homo sapiens
cctgctgcaggggctggagttggcttcctggaagcccattcggctgccctgcacacatcagg

SEQ ID NO: 6819148 - DNA, 80 bp, Homo sapiens
tggcatatccagttgatgtaatactttgcaaccattaaattgatgtttacaaggagtttatattgacattggtgatgcta

SEQ ID NO: 6819149 - DNA, 62 bp, Homo sapiens
ccattgtgactttatttcgaaatggggtctttgcagatataatcaagatgaggtcatactgg

SEQ ID NO: 6819150 - DNA, 61 bp, Homo sapiens
tagtgttaattcagtttataattggcaaaggaaattgctgagtaaataggaattaatatta

SEQ ID NO: 6819151 - DNA, 65 bp, Homo sapiens
cccaggagaaggcgtgccttcctattcctgctacactgagaggttggctgagggcagcccctggg

SEQ ID NO: 6819152 - DNA, 70 bp, Homo sapiens
gctatcggcaatgcacattgaatgagcaaactgctagatgctattcttcactcaatgtgctcgcttaagc

SEQ ID NO: 6819153 - DNA, 104 bp, Homo sapiens
gatattgggaaattgaggcgggaagatagaccgattgaggaagtatagaattaggggattatgctgccttagaaatggctataaactgtaatattttctatatc

SEQ ID NO: 6819154 - DNA, 129 bp, Homo sapiens
aggtttaattttccatgggttgcctattttaaaactatgcagacaagattaacttgtggattttttccaaaagaagctgcaaaaaatttctgtctcatggaagaatcatccctgaaaagtttcttgcct

SEQ ID NO: 6819155 - DNA, 63 bp, Homo sapiens
ggtaagcataggtctttctgtatcaccttaagcctggaggcttacatgaagctggtgtttgtc

SEQ ID NO: 6819156 - DNA, 55 bp, Homo sapiens
atgcaaaatgcatcccagaattggagagaaacaacatgtgggttttattttgcat

SEQ ID NO: 6819157 - DNA, 89 bp, Homo sapiens
ccaccaggctgtgtgggtgtctgcggggcatggggagctggcatggctgggccactaacagcactggcaggcactgtctagcctgaagg

SEQ ID NO: 6819158 - DNA, 60 bp, Homo sapiens
gttgaaagccagcaactgagaagtcagaattctggctttttctcagctctggctgctgac

SEQ ID NO: 6819159 - DNA, 111 bp, Homo sapiens
gtcagttttaagaagtgccctcaattactaaccaaataatgtattacaaataactagttatgaggttttacagttgtttaatagggagtaattggccccaattaaactgac

SEQ ID NO: 6819160 - DNA, 129 bp, Homo sapiens
cttttttaccccaccatgttgcttccagttcacagggtttctagcagagtctctttaggctaaattgttgccttgaatgggcaatttgcttgaaatgtagctggatgtgcagcatctttgctcatgttg

SEQ ID NO: 6819161 - DNA, 78 bp, Homo sapiens
ggaagatgaggctgttagggcctgaggtagctggtgcttaagaagcagctgacctgaaatgacagtcttagtacttcc

SEQ ID NO: 6819162 - DNA, 96 bp, Homo sapiens
gagcacggtcctccccaccctgtgcttcaggttgtcgccacgtgttcttgtgagtgtggcaaggcagcttgaagcagcgggaaggaactcaggctc

SEQ ID NO: 6819163 - DNA, 58 bp, Homo sapiens
tgggcacatgtaaagctggagaaagtgtgtaaatttttaacatttgaacatgtggcca

SEQ ID NO: 6819164 - DNA, 92 bp, Homo sapiens
gataatgtaagtatgaatatatccatgtatatattcatcataattcttagtttttttgatggagtacagggaaatatgatatcagttttatc

SEQ ID NO: 6819165 - DNA, 61 bp, Homo sapiens
agtgttagcatttttatggtaaattgaacttttccagtatacttatgatattgtagacact

SEQ ID NO: 6819166 - DNA, 78 bp, Homo sapiens
gctctcactctggccttgcttctgggcatggtttctgatgagccaggagagatcccttagcaaggccagaagagaagt

SEQ ID NO: 6819167 - DNA, 89 bp, Homo sapiens
ctggaagctggttagaaatgcagagtctcaggccacaccccagccctcagggtgggtcccaggaatctgtgttctaacaagtggtccag

SEQ ID NO: 6819168 - DNA, 79 bp, Homo sapiens
tgagttctcattccttggctggtattgaactccatcccaaaaacggggctttgaggacacacaaagagtgagaacatca

SEQ ID NO: 6819169 - DNA, 68 bp, Homo sapiens
agcatctgaggaggaaacatccaaagctagttacctgaagctcagctttctcttctttagaaagtgct

SEQ ID NO: 6819170 - DNA, 65 bp, Homo sapiens
ggatgcttggtttacctaaacaataggctttgtcaaatacctatggagcgggtgagctgtcattc

SEQ ID NO: 6819171 - DNA, 93 bp, Homo sapiens
acataggcaatcaatgctgctagttcctttttcttctcctctccccagaggtcaagttgccttaatgaattgcagtactgacttgctccttgt

SEQ ID NO: 6819172 - DNA, 56 bp, Homo sapiens
gtggctgcagctctgaacggactcaaagtgagtgtctgtaaatcctgctcagcaac

SEQ ID NO: 6819173 - DNA, 65 bp, Homo sapiens
ctcacacctggtctttgcatgagcatgtttcagtaacacatgtgggcacacacacaggtagtgag

SEQ ID NO: 6819174 - DNA, 71 bp, Homo sapiens
ggcgacagttgtcaggctgggctggtttccacaggcattctcttcagctgcagaaaggacaactaattgcc

SEQ ID NO: 6819175 - DNA, 75 bp, Homo sapiens
gcgaggatcgcggtcccggcccgcgcgcacagagacgccggtccctgccaccagcgccgccatccgcatcctcgt

SEQ ID NO: 6819176 - DNA, 57 bp, Homo sapiens
gtgcagttcttgtaacatgctgcagaagggagctgtgagcatgtgaaagacctggac

SEQ ID NO: 6819177 - DNA, 121 bp, Homo sapiens
gggaaggaggcaggctgaggggtggagaggcctagagggtggatgaaggagagccagtgtgagcatctggccttgttctctctcccatcactgttactcttcttttagtcccttccttctc

SEQ ID NO: 6819178 - DNA, 111 bp, Homo sapiens
gggactaagtaacaagatgagtgagattgtggacatagaagcatgtggaagactctctgtatctcatgttttacctgtcctcatgttttacctgtctgacaactgcatccc

SEQ ID NO: 6819179 - DNA, 76 bp, Homo sapiens
ctggtagtggggtaaactttgggaattagattggtttctcttgctaatcagtgatcttgtttgccagaactgacag

SEQ ID NO: 6819180 - DNA, 102 bp, Homo sapiens
ttgatctccctgatatctgaatcattaaatagttttctagtggttaagatttacaattattgtaatgggctactaggaagagtttcagattctcaagatcaa

SEQ ID NO: 6819181 - DNA, 61 bp, Homo sapiens
aattcctaagtaactttcctagtgagctcatcttgcttcactgaaagtaattctagtgatt

SEQ ID NO: 6819182 - DNA, 84 bp, Homo sapiens
tgttgagtgttgagtgttaagttgggggttcaggcctataaagaaatttggctaaggggcttctcaacctcagcattactaaca

SEQ ID NO: 6819183 - DNA, 62 bp, Homo sapiens
caggagccaggccccatggggctgccactctgcagcccctctcccctgaggcctggcttgtg

SEQ ID NO: 6819184 - DNA, 58 bp, Homo sapiens
ttttgttttggtatgggctatgcatttataaaatgcgtatgtttactccaaaacagag

SEQ ID NO: 6819185 - DNA, 85 bp, Homo sapiens
tctgggaggtagaaggtggaggcagatgagcagctgtgtttattttaaaacatatcatttaaccctcacctaaaaacaaattgga

SEQ ID NO: 6819186 - DNA, 78 bp, Homo sapiens
tgaatccagataaatagatagataaactctatgtccagaaccaaggagtctattttggttgtctattgtctggatcca

SEQ ID NO: 6819187 - DNA, 83 bp, Homo sapiens
aaaatgcaagatccttttatcagtcagggtttatagctgcaagcaaaagcaactgcccctggctggtgaagcagagacatttt

SEQ ID NO: 6819188 - DNA, 88 bp, Homo sapiens
ttgcccctctttcaagaaaggcttaacagaagacctttgagctggttcttaaaggaagattgagcttttccaagcaaagcagggtcag

SEQ ID NO: 6819189 - DNA, 80 bp, Homo sapiens
ttgaagaagcctcatctttttagaattttctcattgagtttaataggattctagaaatttgatactaatgtggcctttag

SEQ ID NO: 6819190 - DNA, 67 bp, Homo sapiens
gtctggccagcccagtggtcctctctagcacattacagagattggcctttggagctgaaagctggac

SEQ ID NO: 6819191 - DNA, 79 bp, Homo sapiens
gctcatctttcttaagaatagtcgttcatcagataggtccatctggaggtcatcgtttgttcgtgagaaggcaaggagc

SEQ ID NO: 6819192 - DNA, 60 bp, Homo sapiens
gagctctggacccagacaaacctggattaggatcttaggttagatctggttccagcactt

SEQ ID NO: 6819193 - DNA, 76 bp, Homo sapiens
ggtgttggagctggctaatactgacttatgagagcatattgttaaatattcaggaattttaccagcagcaaccacc

SEQ ID NO: 6819194 - DNA, 60 bp, Homo sapiens
ttctgctcatcagccgagcagggcgatttatcaagagtcctgacggctgattggcctgga

SEQ ID NO: 6819195 - DNA, 63 bp, Homo sapiens
aggctggtctgttggcatttttactggacacattgttcactcaaaatatcagcacatcagcct

SEQ ID NO: 6819196 - DNA, 78 bp, Homo sapiens
ctttaatcattgctgtataattcatgctcttattgtctaaacacaaacaactgagctgaaattatataggtgttagag

SEQ ID NO: 6819197 - DNA, 86 bp, Homo sapiens
ccagagttcccagaatggatcctggaggacttgtcccagtgatgctccatgaagaggagcctccatggtcacattcgcactcttgg

SEQ ID NO: 6819198 - DNA, 63 bp, Homo sapiens
cagtctgccaggggccagccctagaaccaccttcccctctctaagctgcacacccagcaactg

SEQ ID NO: 6819199 - DNA, 80 bp, Homo sapiens
tggggccttgcaactctaaatgtggtctgcagatatgcagtgtccgtgttgatgaccacaatttatgctgccagtcccca

SEQ ID NO: 6819200 - DNA, 68 bp, Homo sapiens
tagattgattgcaaagacaggcatactattcaccaatctctgtatgcacactctttgcaatgagactg

SEQ ID NO: 6819201 - DNA, 66 bp, Homo sapiens
cagtttccagcagcacctattatagtgttttccacagagtaggcactcaataaatgttgccaactg

SEQ ID NO: 6819202 - DNA, 62 bp, Homo sapiens
cagagtctttttttctaatgaagtcctacctggagctccaatatggataaaaggggcctctg

SEQ ID NO: 6819203 - DNA, 98 bp, Homo sapiens
gcctggggctcccacccacctaaggaatgccatccttgtcaccggctcacggggcagctctttggtatccttccagggtggtgtgtacaagtacaggc

SEQ ID NO: 6819204 - DNA, 93 bp, Homo sapiens
ccccggggcagctccaggtttcactacaattaagttggcttatgatacattcaagccacagcacattgtaagaaagtggatcattgaccgggg

SEQ ID NO: 6819205 - DNA, 66 bp, Homo sapiens
ctccgaggagccaggggaccttcacagagcttcggcaagttctgggaggtcacattggtcttgggg

SEQ ID NO: 6819206 - DNA, 61 bp, Homo sapiens
cacagtcttcagaagggattgggtcttttgtgtacaaattcagtccattgttgaaactgtg

SEQ ID NO: 6819207 - DNA, 65 bp, Homo sapiens
cttttaagctgtggcattaattcttgattatcagctgtcaggtctttcattacatgggttaaaag

SEQ ID NO: 6819208 - DNA, 59 bp, Homo sapiens
ggcaccatcagctgtgcagggggaatttcttcactttattctgtgatcagcctggtgcc

SEQ ID NO: 6819209 - DNA, 65 bp, Homo sapiens
ttggcgtatagtgtcctattggcaggtttcccatgtgtacttgtaagtggaaggttatatgctaa

SEQ ID NO: 6819210 - DNA, 90 bp, Homo sapiens
gtgcctgaagtatattcatttgacagacatttactacattattactactttaaaaatactgttctgcatgctgtgagggaatacagacac

SEQ ID NO: 6819211 - DNA, 59 bp, Homo sapiens
cttagtctctgctggcaggggagcaggccagctttggtttctctgcagcagaggctggg

SEQ ID NO: 6819212 - DNA, 71 bp, Homo sapiens
tgagagacagcagggccagggcctgccagcaaagtcttcaatgctcacagccccatcacctgttgctctca

SEQ ID NO: 6819213 - DNA, 78 bp, Homo sapiens
atcttgttgagaccagacacgatgccttgctcttcttccattaccagtgtcaggcacagtgcctggaatcaaacagat

SEQ ID NO: 6819214 - DNA, 56 bp, Homo sapiens
cttgctgtcttgcatttagagcccagggttgggtacttaggaatggggacggcaag

SEQ ID NO: 6819215 - DNA, 73 bp, Homo sapiens
accatgctgggccttgggtgcactcatcaaaaaacggaccacaggcatgatgctcacaggtgcccggcatggt

SEQ ID NO: 6819216 - DNA, 55 bp, Homo sapiens
cagtctctgggaaagaggacaggccagggtctagtcattgtcttttttgagattg

SEQ ID NO: 6819217 - DNA, 62 bp, Homo sapiens
ctggccttttctctggtcagattttgaggggttgccacctcagagttggccacgagagccag

SEQ ID NO: 6819218 - DNA, 77 bp, Homo sapiens
aagtatgtcaatcatacttcaataaatttgtgtacattactttcaaaagctattatgttgaagaggtttgcatactt

SEQ ID NO: 6819219 - DNA, 65 bp, Homo sapiens
gtgcttttctatttaatccaataatgagcttacccatccttctgcattgctaaatggaaaagcac

SEQ ID NO: 6819220 - DNA, 56 bp, Homo sapiens
gcacagccttgccctgtgccctgggccctgttctttggctgctggtttggctctgt

SEQ ID NO: 6819221 - DNA, 113 bp, Homo sapiens
cttgggcatcatgtgaaaaatctgattgactatgttaatatctattgttatttatattgaaaataagatcctgaagatatgtttagattatgaattttaaaatgagacttgag

SEQ ID NO: 6819222 - DNA, 112 bp, Homo sapiens
ttgggaggttaaaaaaatctccgtgccttggtcccaacccccatccccgagactgtgatgtaattggtctggggtggggcctaggcatggggatatttacaagctctcccag

SEQ ID NO: 6819223 - DNA, 77 bp, Homo sapiens
aaagcactcctgatgtgggctgatgacatttctaacataacatttagtgctatacatgtacatattagtactgcttt

SEQ ID NO: 6819224 - DNA, 57 bp, Homo sapiens
ctctcaattcacggcaaggtctgcaggagaacacatagactctgttgtacttgaggg

SEQ ID NO: 6819225 - DNA, 73 bp, Homo sapiens
gttttacttgttatcccttactcttgatttgaattgacaggtgcagggaagaggaggtggcctgagccaggac

SEQ ID NO: 6819226 - DNA, 130 bp, Homo sapiens
agtgaggctgtgccaaaacaactttgctcttcacatttcccattgcagcaacatttaaagaaggattatttctgaaaatgtgcatgagtcagaagtggggaatgagtaattctgtgctttggactttatt

SEQ ID NO: 6819227 - DNA, 63 bp, Homo sapiens
caccagaccagctctctgaagaaagagttaatgaactcactgttccttggggagttggaggtg

SEQ ID NO: 6819228 - DNA, 56 bp, Homo sapiens
aacagactatttgagtttgcagcaatctcttcctgctttgaactttgtactctgtt

SEQ ID NO: 6819229 - DNA, 61 bp, Homo sapiens
tcagctctctgggctcgaacctagttggccgtaacatggttgaatgcaccaagagagttgg

SEQ ID NO: 6819230 - DNA, 58 bp, Homo sapiens
ctagtgctctaggggctgaaggtgggctcaagccctaacttcagccccagtgctctag

SEQ ID NO: 6819231 - DNA, 98 bp, Homo sapiens
gcctttctgactttttaaaacctctttcactccatttcagtttgtttcttttaacctagggaacaactgagcaggagtgacagaaacatgttgaaggc

SEQ ID NO: 6819232 - DNA, 71 bp, Homo sapiens
gccacttccatgccctccttgccttcactgcttccagcagggctggtgtggagaggctggcattcggtggc

SEQ ID NO: 6819233 - DNA, 56 bp, Homo sapiens
ttttggctcttggtaggtcagagtggcctttccttcatgcctgccaaagcacaaag

SEQ ID NO: 6819234 - DNA, 56 bp, Homo sapiens
ggggacttgctatgttgtccaggctggtcttgaactcctggcttcaagcagtcctc

SEQ ID NO: 6819235 - DNA, 71 bp, Homo sapiens
gcagttcatcttcctcccagtgcctgacggagggcacaggcttgcgggagggcactgggaatgtgggcagc

SEQ ID NO: 6819236 - DNA, 77 bp, Homo sapiens
ggtgatttcctggagccaagcctaggccccccacactggtggggtgagggtctggagcttggctaagggattgcacc

SEQ ID NO: 6819237 - DNA, 130 bp, Homo sapiens
agtataggcaaggggtacacaaattttcactgataggaaacagcttttaaaacataacattggattcacagaaccaaatgatccttgcaagctgtgatcagtcaaagtaaattcccccaaatgtgattct

SEQ ID NO: 6819238 - DNA, 65 bp, Homo sapiens
ggtagccatcataataacccagacacagatgagaagtattggtctggagtatgatgataactact

SEQ ID NO: 6819239 - DNA, 69 bp, Homo sapiens
ggagctccttcctcttctgagtgagactccctcctatcttggagcaggaagtcctctcaggagaagtcc

SEQ ID NO: 6819240 - DNA, 77 bp, Homo sapiens
ctttggggaataccactttggtatttcaattttagccacagcaaagtcaggaagtgcaaaagttgaagttctcaggg

SEQ ID NO: 6819241 - DNA, 107 bp, Homo sapiens
gggagggagtgtggggcagagcagagttgggggcagaagcaagaagctgaagacatccctgagcggtgtgcagcccctgcctgcctgacccccgggcacccactccc

SEQ ID NO: 6819242 - DNA, 56 bp, Homo sapiens
tgaaagcagtgccatgattatgagtccgggctgcatagtcgggccacctgtgttca

SEQ ID NO: 6819243 - DNA, 55 bp, Homo sapiens
ttcttcaaatgctgaaagtctaactgatggttatgattaggtgctatttggagaa

SEQ ID NO: 6819244 - DNA, 57 bp, Homo sapiens
atggtacaatgtgtgtatctttagcagactataaaatgctggacacacgttgatcat

SEQ ID NO: 6819245 - DNA, 123 bp, Homo sapiens
gaagcatggtactcagacattttaagggagggcattttctgggtcatcaggggttaaagggttgccagtcttgacagctgaggcccagagtaccccccacctctggacttctaggcaggcttt

SEQ ID NO: 6819246 - DNA, 71 bp, Homo sapiens
acttaggttccagaagaggagttaagactcataaaccactgggctctgtggctcatatctgtaatctcagt

SEQ ID NO: 6819247 - DNA, 65 bp, Homo sapiens
agtcttcctgcccagcaggaggtaggtggcggtcacttcgttgtacttctggctggtcaaggact

SEQ ID NO: 6819248 - DNA, 62 bp, Homo sapiens
aatctgctctgatgtgaccacgtagacaaatgatgtttgcaaaacatgtcaggagatggatt

SEQ ID NO: 6819249 - DNA, 60 bp, Homo sapiens
aaggagagtacaggagttggtactggaagccatctggcatcagagccctgtgctcttttt

SEQ ID NO: 6819250 - DNA, 102 bp, Homo sapiens
ttgagacagggtcttgctctgttgctcaggctggagtgcagtggtgtgatcatagctcactgcagcctcgctctcctgagccaagggatcatcctttctcag

SEQ ID NO: 6819251 - DNA, 55 bp, Homo sapiens
atcatccatggctgatcataaatgcttctccagagagtgaatggtcatggctggt

SEQ ID NO: 6819252 - DNA, 65 bp, Homo sapiens
gtcaggcactgttctaggtgcagagctgctgctccaaggagcttacattctgagaggtgatagac

SEQ ID NO: 6819253 - DNA, 73 bp, Homo sapiens
ggtatgcagctagaaaatgaaagataatttgaatagtcttttcagataatcttgaatattcttctttgatact

SEQ ID NO: 6819254 - DNA, 110 bp, Homo sapiens
ccttacttaagagtacagctgtacagagtaaattcactatgcttggaaacttctttcatatctatttgtgtaagtctgcagctagtttctgaacagttgtatagtgatgg

SEQ ID NO: 6819255 - DNA, 98 bp, Homo sapiens
tattatggtgactttgttttaaatgtgtctttattttcaatatatcactgcactagagataactacacttaagacaacccactttaggtcactgaata

SEQ ID NO: 6819256 - DNA, 99 bp, Homo sapiens
gcagctgagtgtgacccatgggagacagtgcagggtgggaagaaggggaggccagcgtctctccctcactctgcctcctggggtttccacagcagctgc

SEQ ID NO: 6819257 - DNA, 129 bp, Homo sapiens
gcgcgccgcggtctgggcctgcgcgagaggctgccgcccgcgtcgggcctgggcctacgcgtgtctggcctgggcctgccggtgcaacagcagttgtcgccaccggtcctaggccgcgccgagcgagtc

SEQ ID NO: 6819258 - DNA, 57 bp, Homo sapiens
agtacagatttagacacgataggttgttggaacctggcgttgggataagtcagtgct

SEQ ID NO: 6819259 - DNA, 89 bp, Homo sapiens
gaattcctggggttctgaactcatgatatgcttttgtatctgaagatgatcatccaaaacatattgagtagcactacgacaggattttt

SEQ ID NO: 6819260 - DNA, 55 bp, Homo sapiens
cccatggcaataaggtcacaggtccagaggacccttgtgctgcggtgcccgtggg

SEQ ID NO: 6819261 - DNA, 59 bp, Homo sapiens
ccaaacatttcaaatttagagatatttcttttaaatatcttggggagactagtgtttgg

SEQ ID NO: 6819262 - DNA, 80 bp, Homo sapiens
tcataaacatcactgtggctttctttttgctctctgtttcacagcagttattgtcaaggaagatagctattatgacatga

SEQ ID NO: 6819263 - DNA, 105 bp, Homo sapiens
ttttttggccttgtttgtttaaatgatgttcgggctgttcccctgattaataaagtcgtaaacacagtcaggagcagcttctgaaccatgtgcaaaagcaaagaa

SEQ ID NO: 6819264 - DNA, 89 bp, Homo sapiens
gcctgccccacagaggtctgggcccagcagagacaagacttgctccattgcccttctgtggctgtcgggcccatctctgttgagctggt

SEQ ID NO: 6819265 - DNA, 64 bp, Homo sapiens
tcatctgttatagttaggagtgggtttgactgtgagttatagaaaaccccccaaacaacagtga

SEQ ID NO: 6819266 - DNA, 101 bp, Homo sapiens
cgatcgcgcgaaggcgttcgagaggggcggggccacagtgaggctaggccggaaggcctggccaggctctcacgtggtctgcctctgcgcctgcgctctcg

SEQ ID NO: 6819267 - DNA, 87 bp, Homo sapiens
ttcaaaagaattctgggctctgcagttgatgttttcaattattcttgcaaaaaacatatgctgctggctgcccttcgatttgtggaa

SEQ ID NO: 6819268 - DNA, 67 bp, Homo sapiens
cccagattcactaatagctggcctcaagatacaccagatcgaggaaggctgagaagtagatcctggg

SEQ ID NO: 6819269 - DNA, 70 bp, Homo sapiens
tccgaaggttcccagactccacactgaggcaccccagagtgccgagctggagtcatgggaagctgccgga

SEQ ID NO: 6819270 - DNA, 61 bp, Homo sapiens
catgaagcaaaattgtgagatctgaaagaagaaataagaaaattcacaattatggttcgtg

SEQ ID NO: 6819271 - DNA, 72 bp, Homo sapiens
gtttagaatggcaaaattaagtcatgaacaaaaaccagtccataatgactaccgatctttgccaatttaagc

SEQ ID NO: 6819272 - DNA, 114 bp, Homo sapiens
ttgtttagaaagagttagctgatatttccatccattagtcttaaaactaagctgactggaaagaacagctatagatggactgaagaggaaataatgctataccttcatgaacaa

SEQ ID NO: 6819273 - DNA, 81 bp, Homo sapiens
actgtgtgctgctcaagggacaggacagtgcatgggcactgtgctggattttggttccttgtaaaaagcaatggctatagt

SEQ ID NO: 6819274 - DNA, 67 bp, Homo sapiens
gcccttcagctgtgagcactcttgcccagacctcggctctggtcctcgtggtcacacctgagtgggt

SEQ ID NO: 6819275 - DNA, 60 bp, Homo sapiens
ggactcagcccagcccagcaagtgcagccgctttcagctccgcctctggctgggttctcc

SEQ ID NO: 6819276 - DNA, 55 bp, Homo sapiens
gggagggcctgaggccaggtgcaattccccagggctggtcctcacaggtcctccc

SEQ ID NO: 6819277 - DNA, 62 bp, Homo sapiens
tgagtgggggtgcaggcagggcattgtggggtgccctggaagctgctgcatgctcctgttta

SEQ ID NO: 6819278 - DNA, 60 bp, Homo sapiens
gggtgggtggagattcagtgagatgaggcttgtgcagtgtctggccctcacagtcacacc

SEQ ID NO: 6819279 - DNA, 55 bp, Homo sapiens
agccagctgctaacacaaaggagtactactcagtagtcactgtgtaggagttgct

SEQ ID NO: 6819280 - DNA, 77 bp, Homo sapiens
gtcactgattttttggatggctgtacattaattaacatacatttattgagtgcatacccttctaaaaagtcctgtgc

SEQ ID NO: 6819281 - DNA, 62 bp, Homo sapiens
gcaagcaagtatctggcagggatgccccaaggaccctcagttccctctgggtactgccatgc

SEQ ID NO: 6819282 - DNA, 76 bp, Homo sapiens
tcccctctcttataatcctgaagaaccagtattgctaacccacttcaagaaccactggcaggatgagtgatgggga

SEQ ID NO: 6819283 - DNA, 59 bp, Homo sapiens
cagaatcttctctattttccctcagatattagttctctgcaggaaaccacagggttctg

SEQ ID NO: 6819284 - DNA, 68 bp, Homo sapiens
ttgagagtcgattttgaactaggcagtccctgtggttgctttgcttagtttattagattgcttctcaa

SEQ ID NO: 6819285 - DNA, 69 bp, Homo sapiens
ggccagtaactgcaagagtaaatgtctagacttaaaatatatttctagataagatttttggggtgggtc

SEQ ID NO: 6819286 - DNA, 66 bp, Homo sapiens
ttgtggttttggcctatcagtggaacacagccacaaaatactactggtaaatcactaaaattacaa

SEQ ID NO: 6819287 - DNA, 117 bp, Homo sapiens
tcatcagggcaaagagtcacagtgagaatgggaagggagagcccttggctgtgtcacacacagggatccagtgtccttcctttccatggaagtggcttttgagccaagacaggatga

SEQ ID NO: 6819288 - DNA, 64 bp, Homo sapiens
attccggatatgtaaatcatgaaacgtcagtcacactacaactcattgaatacatatttgggat

SEQ ID NO: 6819289 - DNA, 130 bp, Homo sapiens
atagagtcactcagggagctattgagaaacaggattctagggccccctgtacctgaggtttggattaaataggtctgggggaaagctcaggagcctgtattttctaaaagtcctctgttgatactgaaat

SEQ ID NO: 6819290 - DNA, 94 bp, Homo sapiens
ctctgcattttcctagaaggcctccctctggctgtcagacagatcaggctggtgaccacgagccagggggacgctttctggcccaaccacagag

SEQ ID NO: 6819291 - DNA, 72 bp, Homo sapiens
ccttctgccagcttgtgatttagaaaagtgtgttcattcaatagacatttactgagcacgtacgggccaggg

SEQ ID NO: 6819292 - DNA, 55 bp, Homo sapiens
acaggtttaagaggtatttcctctttctcataggaaatgctttgtatatatctgt

SEQ ID NO: 6819293 - DNA, 59 bp, Homo sapiens
gctaccttgaaccccaagctttgcagcaataagagggctggcctgggaagtaaggaagt

SEQ ID NO: 6819294 - DNA, 92 bp, Homo sapiens
gctcatgttccatcctctgtctccccactcccctcattctttctttcatgagcagggaggtgagaagggggtcagatgagaggacattttgc

SEQ ID NO: 6819295 - DNA, 57 bp, Homo sapiens
tactttgcatgcttgtgtgatcagccaaatcttatcgcatgtctaatgtgcagggta

SEQ ID NO: 6819296 - DNA, 82 bp, Homo sapiens
gatttggtcaggatgggcagccaaactagaaatttcatgccagaaatatgagttggtttggctgacttagcctgattaaatt

SEQ ID NO: 6819297 - DNA, 61 bp, Homo sapiens
gggaggcactgacttcgtggcagctcatacttgtgcccctggcactaagacggtgcttccc

SEQ ID NO: 6819298 - DNA, 88 bp, Homo sapiens
cattgtgtgatgcaagttttagaagtcatacattataaatgacaaaacgtagactctgaaagcataatttgtcccagatcacacagtg

SEQ ID NO: 6819299 - DNA, 56 bp, Homo sapiens
tgaggccaggatcccaggctctcattcttcccctgagtctggtgtcctcgggttca

SEQ ID NO: 6819300 - DNA, 89 bp, Homo sapiens
tagaaaatcaagtggcccccacataagctgacctcactcaatagaagaattttggttatgtatgggggccttatgacctgattattcta

SEQ ID NO: 6819301 - DNA, 65 bp, Homo sapiens
agagagtgtaacccatggtttggcattaggtgttcgatgaaaaggcagctgggtagcatctttct

SEQ ID NO: 6819302 - DNA, 59 bp, Homo sapiens
aggtcccatatatgtttatattggaaaaaataatactttctaaagcaaaagtgggatct

SEQ ID NO: 6819303 - DNA, 56 bp, Homo sapiens
tgggcagactgagccctgtcccctctgggatccctggagagagcttcagtcgctta

SEQ ID NO: 6819304 - DNA, 95 bp, Homo sapiens
tgaagcaggataatcgcttgaactcaggaggttgcagtgagccaagatggtgtcactgcactccagcctgggtgacacagtgagactccgtctca

SEQ ID NO: 6819305 - DNA, 74 bp, Homo sapiens
atatacccacaaacatatatgtaatttttcacaaatatgtaactgtgataacatgcatgctttggtgggtgtgt

SEQ ID NO: 6819306 - DNA, 68 bp, Homo sapiens
ttatttaggagaaggaaccctgttaactgagaaaattagtattgtaaggttcatttcttcccagataa

SEQ ID NO: 6819307 - DNA, 78 bp, Homo sapiens
tttgatggaatttgttgttgctcccctaagagaggacaccagcggcctgtctctgggagttgagcagcagccatcaag

SEQ ID NO: 6819308 - DNA, 67 bp, Homo sapiens
gtgggtgtggctataaaagggcaagagtgatggaaatattctctatcttgaatgcgtcaatgtccat

SEQ ID NO: 6819309 - DNA, 64 bp, Homo sapiens
tgtattttagtttccaccacacatgttcttttctgtagggcttgtatgttggaaattttatcca

SEQ ID NO: 6819310 - DNA, 84 bp, Homo sapiens
tgtatttttgaacgttagtcttcctttgttgtttcttctgttgtttcaaagttttgagaacgctgacgtttatccataaatata

SEQ ID NO: 6819311 - DNA, 56 bp, Homo sapiens
ggaagcatccttgtggcatacagtggttgcacatgttgtgactggatgctttgtcc

SEQ ID NO: 6819312 - DNA, 59 bp, Homo sapiens
tagcacagtgttcacaacagtgtctggcatcacaaacattggtgttattattgttgctg

SEQ ID NO: 6819313 - DNA, 86 bp, Homo sapiens
gcacagaggagaaagcactcggcttcatccagggccagaattatcaagaaatgctgcttggaggaggtggtgcttgattcttgagc

SEQ ID NO: 6819314 - DNA, 61 bp, Homo sapiens
gtcatctgcatctcttataaatgatgcaaatatgtttctcttaggtcagagatcagatgtc

SEQ ID NO: 6819315 - DNA, 117 bp, Homo sapiens
gagaaagctaactaattgctttaaaacagatttgtatattcttaacatttgctagtttcaagaactgtggagattcggaaggtacacattagtttagtgaggaagatttattttctc

SEQ ID NO: 6819316 - DNA, 63 bp, Homo sapiens
gctagcctgacagtttcttgaagtcctgtccctcagagggcagcaatgctgtgcaggcatggc

SEQ ID NO: 6819317 - DNA, 59 bp, Homo sapiens
ggagtcaaggaaggctctgtgatgggctctagcagccatgagcccctgccttgtactct

SEQ ID NO: 6819318 - DNA, 81 bp, Homo sapiens
ggaacgcctctgtgacagagcttgagtgagaaaaaggaattgtccttctacatctcagccaatgctccttcaccgtgttct

SEQ ID NO: 6819319 - DNA, 109 bp, Homo sapiens
atagtcacagggaaccccaatatcaaagtaagatgtgcctattcattttggggtaggcatgtcttcctttgagtgtcaataatctggggatgaggaacctgtgcattgt

SEQ ID NO: 6819320 - DNA, 121 bp, Homo sapiens
ggaagacggctgcccctgctctttgcacaatcccacgtcctccagctcgtgctctttctgtcttgagagtctgggcatttaggatgttggagtcagaggagactggggacaccagccatcc

SEQ ID NO: 6819321 - DNA, 69 bp, Homo sapiens
tggaaatgagctggagctgagtggctgcccccttggaaaagggcctgctgtctccagtttattcttcca

SEQ ID NO: 6819322 - DNA, 70 bp, Homo sapiens
gggttattgcgaccctagccccctcacttctccctccgaggctaagtgtgggactagggctccagggccc

SEQ ID NO: 6819323 - DNA, 81 bp, Homo sapiens
tagtgattcttgaatgtgactgaatatttactctacatgagacttgagagtgtaattaccagattataatgcaaatcacta

SEQ ID NO: 6819324 - DNA, 76 bp, Homo sapiens
ccaagcctaggtctgggtctagcagaaaagagtcaaaggtatggcttgacctgctttaatttagacaaggcagtgg

SEQ ID NO: 6819325 - DNA, 56 bp, Homo sapiens
tgtgcgaaaaccacagtagaggttttgtgaagaagagcatttgtggcttttgcaca

SEQ ID NO: 6819326 - DNA, 69 bp, Homo sapiens
tactggtacaatggaccataaaagcttcaaaaggaaaagaatgttttgtggactagttgtttcacagta

SEQ ID NO: 6819327 - DNA, 55 bp, Homo sapiens
attctgtggcaatttgttatagcagcctgagctaactaagacagattcctagagt

SEQ ID NO: 6819328 - DNA, 129 bp, Homo sapiens
agtaggggctcggtcctgggggcacacagtaggggcttggtcccggagcgcacattggagatcctgaagggagcggacatccagtgtgggcccggcctcctctctggagctctgcctggctgcctggct

SEQ ID NO: 6819329 - DNA, 82 bp, Homo sapiens
gaagaaagaagaaatgcatttgtgctccaatcactattttgaagatttgtttatgagcacagtgtgttgtgatttcattttc

SEQ ID NO: 6819330 - DNA, 60 bp, Homo sapiens
gggtgacagtgagtttggtgctttcaaaatgtcagggctctcacagacaggctgtcaccc

SEQ ID NO: 6819331 - DNA, 99 bp, Homo sapiens
tctgaaccagcccctgggcagaactcactctttcaattgaaagatgcttttagtatcagtttagtccagaggagagttgcgttatggggctataaaggg

SEQ ID NO: 6819332 - DNA, 95 bp, Homo sapiens
gctcccaagtcgcacccagtgcgagcctgtgctggcctcttggggctagatatcccggtgagccaggcatgactgcctcggtgcagcttttcggc

SEQ ID NO: 6819333 - DNA, 84 bp, Homo sapiens
tttgtccttttaaaaaaggagctgttttgccatttgaacaggggtttctgctcaaaggaaacacaagcttctggagagaacaga

SEQ ID NO: 6819334 - DNA, 56 bp, Homo sapiens
ggtgaggtgtctagatctaccagtagatcccgatttgcaggtttgagactcctacc

SEQ ID NO: 6819335 - DNA, 76 bp, Homo sapiens
tcaacatgtggagaaatttcaaaagtgagccataaaactcatacaaaaggttatacagttaagtttcttcagttga

SEQ ID NO: 6819336 - DNA, 55 bp, Homo sapiens
ggcattataattggcaggctgtgtggcctcgcctcagctttgcattgtaatagcc

SEQ ID NO: 6819337 - DNA, 126 bp, Homo sapiens
tgaacagataactttcatcaattaggatggctggctagtggcagggacttcatataaagaaatctttcccagaattgtttttccacattgccttctaatttgatcactccctataacagatgttca

SEQ ID NO: 6819338 - DNA, 122 bp, Homo sapiens
cactcattgtatttcttcagagtcaggtacttgaagtcttgatgaagcagtaataagtattgattttattgaaacttcactttttgagtaaattccttcttagaattttatgtagtgaagtg

SEQ ID NO: 6819339 - DNA, 59 bp, Homo sapiens
ctgtacagattgcacacggggaagctggcagtctttcacaccatgttcattctctgcag

SEQ ID NO: 6819340 - DNA, 64 bp, Homo sapiens
gtggttcctgaggacatcagcatcacctgggaacttataggaaatgcaaatcctcagggcctat

SEQ ID NO: 6819341 - DNA, 69 bp, Homo sapiens
agtgagggtgagagaggccagagtgccatgtggtgacctgaggccaggtgcttcccctgttacctcact

SEQ ID NO: 6819342 - DNA, 81 bp, Homo sapiens
ggatggcaggtacgtgcgtggatggaggttaaaggtcagattggcagttgtgcgctgacatccgggcacaggcccctatct

SEQ ID NO: 6819343 - DNA, 78 bp, Homo sapiens
tacagtagtaagaatgccttattttttacatctttgttctttaaattactcagattgctatggggcatttttgttgta

SEQ ID NO: 6819344 - DNA, 64 bp, Homo sapiens
gtagtcccagctacctgggaggtcaaggcagaagaaatgcattagcccaggtgtttgaggctgc

SEQ ID NO: 6819345 - DNA, 68 bp, Homo sapiens
agggtcttgttgagggtgatgggacatcaagctgtaaagatggactgtagccagaagcagaaggccct

SEQ ID NO: 6819346 - DNA, 57 bp, Homo sapiens
agaatcaggagagagagaagcaagctattttatgcagccactagttttcctgttttt

SEQ ID NO: 6819347 - DNA, 64 bp, Homo sapiens
aaacaatgtacatttataatgcctctttaggagagaggaattagatattagtggtgcgttgttt

SEQ ID NO: 6819348 - DNA, 58 bp, Homo sapiens
gctctgatatctctccctgggtcactttgttaccaatgctcagttagggatatcaggc

SEQ ID NO: 6819349 - DNA, 79 bp, Homo sapiens
agagcagctgaggcagtttgccatgccaggaggcttttccttctttgatatttctggagggcatgctgctgcctgctct

SEQ ID NO: 6819350 - DNA, 58 bp, Homo sapiens
tcccagccattcctttaggtgtttccttagttgaagagcctgatgaatgtggctggga

SEQ ID NO: 6819351 - DNA, 78 bp, Homo sapiens
ggggaggggaacatggcaaagaacctgctgtgaagtctgtctttatgcctccagatcttgcttacattttctctctcc

SEQ ID NO: 6819352 - DNA, 119 bp, Homo sapiens
gagagaaagatttgtccagggaatatagaaaatactgagttagagttaatttcctaacacatgacttgtgttcgataaaggtttaaagtactttttgtttggatttcgtctgttctttc

SEQ ID NO: 6819353 - DNA, 87 bp, Homo sapiens
tgagttagttcttcccatttgtggtagtgaatttagtaattagttcttttaccaaggcaaatggtctaataatggaggaataaatca

SEQ ID NO: 6819354 - DNA, 61 bp, Homo sapiens
gagacggggtttgagacgggtttctccacgttggtcaggctggtctccaacccccgatctc

SEQ ID NO: 6819355 - DNA, 61 bp, Homo sapiens
ttcatttgatggtgggagagaacatggagacaaagtataaatcacccaccctcagaatgga

SEQ ID NO: 6819356 - DNA, 70 bp, Homo sapiens
gcagactgagattctcctttcagaacagttcacaaatacaactgggctgagggagggactttgagactgt

SEQ ID NO: 6819357 - DNA, 57 bp, Homo sapiens
tcttgatggtgatgttgtgtcattgcttcatttttggcactcagtcactactcaaga

SEQ ID NO: 6819358 - DNA, 92 bp, Homo sapiens
tacagaaagatgaaaggacttgcacaaagtcacctagtcaacaagtggcagtgtaagatttgtgccaagtctacttttcaattaaccctgtg

SEQ ID NO: 6819359 - DNA, 64 bp, Homo sapiens
ctgtctttgttggtttatggtgttttgtttcactactgaattttaattagatctgcaaggagag

SEQ ID NO: 6819360 - DNA, 64 bp, Homo sapiens
ctttccttatagttaggccagagaatatgcaactaattctggtcaatggcctgtaagtagaagg

SEQ ID NO: 6819361 - DNA, 107 bp, Homo sapiens
tgctttatacaactttgaaagggaagagttcctcaatgtagtttttgtttgtaacatcataaatgctacacaggaattctcatttgtattcagttggtgttaaggca

SEQ ID NO: 6819362 - DNA, 101 bp, Homo sapiens
cagccggggctcagggagacctctggacactgcatccttccagggcatagagagtgaggtagggataggtgtccagagaccttagagctgaggccttgctg

SEQ ID NO: 6819363 - DNA, 100 bp, Homo sapiens
taagctatttgaagtctttcacttcctcagatgctctctggcatgtatttcagatggctgaacatgcaacaaagtacctgcaagtgagtttcgtagttta

SEQ ID NO: 6819364 - DNA, 94 bp, Homo sapiens
tttatatgtactaatttgtttaatcttcaggacagtcttttgaagcaggtatctgtagattgtcatgaggattaaataaattgatacctgtaaa

SEQ ID NO: 6819365 - DNA, 63 bp, Homo sapiens
ttttacacctcagatgagcagagctcaaaggtttggctgctgtctctggatgaggtgctgaga

SEQ ID NO: 6819366 - DNA, 84 bp, Homo sapiens
gggtcttgctctgttgcccaggctggagggcagtgtcatgatcatggctcactgcaatctcagcttcctaggcttaagtgatcc

SEQ ID NO: 6819367 - DNA, 55 bp, Homo sapiens
taccactgctctgtgccaccgtgcgaagaacacaggatgggaatcggagctggta

SEQ ID NO: 6819368 - DNA, 62 bp, Homo sapiens
tccatcgcattatccgtccagcagactgctaagcggctgcatttgttgggtgatggggagga

SEQ ID NO: 6819369 - DNA, 86 bp, Homo sapiens
aagggtcttggtgaccactatatcaaggattttgtttgctgaggtaaagacaatttctcaatatagaaactattcactaagaactt

SEQ ID NO: 6819370 - DNA, 55 bp, Homo sapiens
gccggcccaccgcctcccggtcggaagcggcagtgcaggtgaggcggcggccagc

SEQ ID NO: 6819371 - DNA, 60 bp, Homo sapiens
agtgtaggtgagggcctgggttccaggtgggggactggggtttcaggtgaagcctgggct

SEQ ID NO: 6819372 - DNA, 77 bp, Homo sapiens
gaatgtaatccatcagaacgtgagctccttgtgcttccagtgacaagcgggccacagtgctggtggcatgttgcttc

SEQ ID NO: 6819373 - DNA, 86 bp, Homo sapiens
gacagatttgtttatcttggaaccttggaggctctgcacccaaaagctttggccctagactctaagtccgcccccagcaaactgtc

SEQ ID NO: 6819374 - DNA, 56 bp, Homo sapiens
tccagagctaattcagcagctgaacaatgtaacagcactgcgtagaattctctgga

SEQ ID NO: 6819375 - DNA, 64 bp, Homo sapiens
tggctcctgtgtctaggcatgttgtgtgtgttttgctcacacatcaacctagacattgttccca

SEQ ID NO: 6819376 - DNA, 81 bp, Homo sapiens
gagctcacagtgagcccactccaggagaggggagagaacacagccatctccgagagggagcttcggtgaaaggagagcatc

SEQ ID NO: 6819377 - DNA, 66 bp, Homo sapiens
aggccaattaaggctgtggttgtggataaagttatcctgagaaggacagggcctatgattgagctt

SEQ ID NO: 6819378 - DNA, 68 bp, Homo sapiens
gggtggaggctgggggctgccttcctccctgtaaaggggctggaagtctgacagcttcccaaaggccc

SEQ ID NO: 6819379 - DNA, 57 bp, Homo sapiens
cctggctcttctgtgtcagccctgcatcctgggttgaatgctgttcttggagctagg

SEQ ID NO: 6819380 - DNA, 57 bp, Homo sapiens
ggcagtgcttctctggcccaagcattcagccaggccaggcagcaggaagccagtgcc

SEQ ID NO: 6819381 - DNA, 57 bp, Homo sapiens
atggcagcctgaacacttcctgttcccaggaatgggcttgggatcaaaggttgctat

SEQ ID NO: 6819382 - DNA, 70 bp, Homo sapiens
catattcagtcctgagccaatcatgatggctggaaaagatggccctctggttgcccaggactaggtcatg

SEQ ID NO: 6819383 - DNA, 55 bp, Homo sapiens
ttaagcgccttctctttgtctttatatttttaatctaagggattcaggtgtttga

SEQ ID NO: 6819384 - DNA, 87 bp, Homo sapiens
gagccacgctaagccgctgcccaggagaggtggggctgcgccgcagccaggacaccctctccctgggagcaacagcatccttggctc

SEQ ID NO: 6819385 - DNA, 61 bp, Homo sapiens
gaagctgaagctacacacttaaacaggtttaatacttctcaccagtagtgggtttagcttc

SEQ ID NO: 6819386 - DNA, 82 bp, Homo sapiens
ggcgtcctggggagagccaaggccctgactctctaataacacaagtggactcctgggagcccttgctccacccctggactcc

SEQ ID NO: 6819387 - DNA, 130 bp, Homo sapiens
caacatctcactggccagaactatgtcacatggccatccctagctgccagggaggctgggaagttaagtacttcagctttctagactctgtggtcatgatggcaagggcaaggggctgaagtgggtgttg

SEQ ID NO: 6819388 - DNA, 85 bp, Homo sapiens
tttccagatttctcaaattgcatgagtagcttgcaagctgacataattatgctgctctcattagcaatttaagtacagctggaaa

SEQ ID NO: 6819389 - DNA, 57 bp, Homo sapiens
gtaaagctccttggccagtgcctggcacaaatagggcctggaaccaatagtgtttgc

SEQ ID NO: 6819390 - DNA, 61 bp, Homo sapiens
tcatggtgaattttgtattagtcacactcggatggtgatttaaaatactggtttattatga

SEQ ID NO: 6819391 - DNA, 64 bp, Homo sapiens
gcagtacatttattaatggtaaaatttggaaataaattttgctgtttgtacaatgaaatactgc

SEQ ID NO: 6819392 - DNA, 63 bp, Homo sapiens
ggaatcgggctgaagctagaccttcccctgaaagtacccttgtgctggcttcttcctctttcc

SEQ ID NO: 6819393 - DNA, 59 bp, Homo sapiens
gcgtgtgtagggccctgttgggagacctctctacccaggaggtgtgcccaactcgccgc

SEQ ID NO: 6819394 - DNA, 62 bp, Homo sapiens
gtgtgttgtttaagctgctgtttgtggtcatttgttagagcagcaataataaagtaatacac

SEQ ID NO: 6819395 - DNA, 71 bp, Homo sapiens
gcagagcatagtaggtaagccatggtctttggagacaagaaagccaaagttcatacctaccatttgcctgc

SEQ ID NO: 6819396 - DNA, 62 bp, Homo sapiens
tggatgtggatgcagatgcagacgtagatgcagatacagatgtagatgtagacacaggtcta

SEQ ID NO: 6819397 - DNA, 63 bp, Homo sapiens
gagatgggaaatcgccatggggtaacggcagccgcctcaaagtcattcgatttcctctatctc

SEQ ID NO: 6819398 - DNA, 68 bp, Homo sapiens
ttggcacaagcagttgggcccaagggcacccactcatccctcctgggcttggaaagctgctgtgctga

SEQ ID NO: 6819399 - DNA, 84 bp, Homo sapiens
cccaggccacggcggctctccccggatgcttgtgctgctcgtttctaaagcacttttcttggagagccacccagtggccctggg

SEQ ID NO: 6819400 - DNA, 68 bp, Homo sapiens
gacaggttttggactccagatttgagaagtagatgactaagaaatactggcaagtgctaattcctgtc

SEQ ID NO: 6819401 - DNA, 59 bp, Homo sapiens
aagacagctcaggacagattcaccatgttgaaagcaggagtgctgattgatgttgtctt

SEQ ID NO: 6819402 - DNA, 66 bp, Homo sapiens
cttgtccacttctgacttgttcagatacaggctggtgtatgaacacactttggaagtgagggcaag

SEQ ID NO: 6819403 - DNA, 63 bp, Homo sapiens
cctaatcaggcatggcaagtgggagaatagtacttctaaaatttcactgtctgccagattggg

SEQ ID NO: 6819404 - DNA, 58 bp, Homo sapiens
ggaggtctcactttattgcccaggctggtctgaaactcctgggatcaagtgatcctcc

SEQ ID NO: 6819405 - DNA, 56 bp, Homo sapiens
agttggcttcagtgtatagtggggcttcttgacctccatcatcacatgagccaatt

SEQ ID NO: 6819406 - DNA, 55 bp, Homo sapiens
ctcatgagacagagggagaaaaaagtaatatagtttctttcattgttttcatgag

SEQ ID NO: 6819407 - DNA, 65 bp, Homo sapiens
cacagatatcgtaactgaactgctggggatacctagaagtatacagtaatgacatatctctagtg

SEQ ID NO: 6819408 - DNA, 91 bp, Homo sapiens
tggaatctcctggatatatattataattaaaattttggaggcagatgagttcctccagagagaatatgtagtatggaaatagaagaattta

SEQ ID NO: 6819409 - DNA, 67 bp, Homo sapiens
gagttcctggatttggggttgcaagagatttcaactctgcaggaagacttcccaagccagaggagtc

SEQ ID NO: 6819410 - DNA, 58 bp, Homo sapiens
ttggagttctgggcacagctgcgcctcacagaggcctgccagccccaccagaagccag

SEQ ID NO: 6819411 - DNA, 64 bp, Homo sapiens
agtcctaaactcagcacattctgggtggtcaagcactctggccatgctgcagtttcatgggact

SEQ ID NO: 6819412 - DNA, 94 bp, Homo sapiens
taatacatacggagaaacctgaatgtatgtcagaagcatgtgatctacatttgtttgctttcgttttaaatattcatggtttccgaatatatta

SEQ ID NO: 6819413 - DNA, 77 bp, Homo sapiens
gggaacgtgtggagctgtggagtagggggttggagaaccaggcaagtctcttcccttctctacacctcagtgttccc

SEQ ID NO: 6819414 - DNA, 59 bp, Homo sapiens
tctggagtaattacagtgactgccattcatgcctgttcagttgccctgattattccaga

SEQ ID NO: 6819415 - DNA, 85 bp, Homo sapiens
ggaatttgtcagggatgagagatggcacagataatttttccttgaatagaaagaacaattctgcatttcttattcctttgatttc

SEQ ID NO: 6819416 - DNA, 59 bp, Homo sapiens
ctgaggccccagccaagaattggggagacagcctgctgatctccatggcttaacctcag

SEQ ID NO: 6819417 - DNA, 61 bp, Homo sapiens
tggaaaacttgtctaccccacactcactatcctggtgcttgtcaggtgacagtttttacca

SEQ ID NO: 6819418 - DNA, 60 bp, Homo sapiens
ttcaaaaggttcttcaaagggcattttaaatttgatgttagaatgaagcgtgcctttgaa

SEQ ID NO: 6819419 - DNA, 56 bp, Homo sapiens
tggagagcacagttcctgcttccaaattggcttgaagtggggacatctgctctgca

SEQ ID NO: 6819420 - DNA, 75 bp, Homo sapiens
tgtggcagcagcctgggcagcctcacacaatgtttgtagacagcaatggactgagagctgcctgcatctgcctca

SEQ ID NO: 6819421 - DNA, 88 bp, Homo sapiens
ggtcagctcgtcaatcttgtgcttgcagctggggagagtgagtagacatttcgcctgacgtttgctgccagcataaaaatgagttacc

SEQ ID NO: 6819422 - DNA, 78 bp, Homo sapiens
gcttagcagtcacacattgttctctgtattgagataaataactgcccttccttactgaccattgtgtaactgctaagc

SEQ ID NO: 6819423 - DNA, 109 bp, Homo sapiens
ctccttggctaaggcattgaatgaaatctgctgggtaaagagtggaaggataagaagctgaggagcactctttacctacttcaggcttctttagtaacctttagaggag

SEQ ID NO: 6819424 - DNA, 95 bp, Homo sapiens
gataattgtgaaaggtgggtgacaggcacatgggagctcatcatgcttttgaatttgtgtgaaattaaatgtgtttgcaaaattttttacaagtc

SEQ ID NO: 6819425 - DNA, 84 bp, Homo sapiens
tattaggttggtgcaaaagtcactgctgtttttgccattgaaagtaatggcttaaatcacagtgacttttgcaccaacccgata

SEQ ID NO: 6819426 - DNA, 78 bp, Homo sapiens
ggtggaatgagttacagagaggattatggtggggcgtagcctcattcagtgattcatttgtacaactcaattcccatc

SEQ ID NO: 6819427 - DNA, 63 bp, Homo sapiens
ggagccagaagtaaggaaagaatttctaccaggatctcctgtgtagaatctactatttggccc

SEQ ID NO: 6819428 - DNA, 71 bp, Homo sapiens
gtgccttggaggaatgatgagagccatgaaaggagaaaagctttggttccaccaattctcctccaaggaac

SEQ ID NO: 6819429 - DNA, 60 bp, Homo sapiens
atgttaagttactgaaatgagatcatatttcaaaagtcctcattaaggtaacttggatat

SEQ ID NO: 6819430 - DNA, 77 bp, Homo sapiens
gccctagagaagatgtgaacagaaccacaggccattgtagtctgggtaggagtctgtcatgtcacctcctatggggt

SEQ ID NO: 6819431 - DNA, 59 bp, Homo sapiens
cagtgctttcaaccctgtggctaaaggtcatccccgtgtcccaggtgtctgaagctctg

SEQ ID NO: 6819432 - DNA, 72 bp, Homo sapiens
agatgtgcagtcctggcatataggtcctcactgaaagtagtggaggaacatgaccaggacctggaaacattt

SEQ ID NO: 6819433 - DNA, 77 bp, Homo sapiens
cttttgttgcattgtgattacagaggtgtattttctctatgcttagaaaaaacgctaatcagcaatgcaaacataag

SEQ ID NO: 6819434 - DNA, 61 bp, Homo sapiens
ctgacagtaactaatgtggagattttccttatcataaagggcctgcactagatgctggcag

SEQ ID NO: 6819435 - DNA, 56 bp, Homo sapiens
tctggctgtcattggaggcccccctattttgaggacctggctttggaacagccgga

SEQ ID NO: 6819436 - DNA, 63 bp, Homo sapiens
caggagacctcagggctttttcaggaccattgtgtccacatagtccggaagcccttctgcctg

SEQ ID NO: 6819437 - DNA, 124 bp, Homo sapiens
ggcatgcattctagggtgtaatcgttttagctctgggaactatatctggtggtcagacactaagagactaatctaattatgtttccagatgtgaagatatgtacctgcccatgtaatacttgcc

SEQ ID NO: 6819438 - DNA, 78 bp, Homo sapiens
gggtcaagggggcagctctggaagggactgcaggtgaccctgctgccctgcttgtttccagtggcgtctctctgtccc

SEQ ID NO: 6819439 - DNA, 72 bp, Homo sapiens
atagaggggactggggggagcctgcaagcctagagggaaagaaggacttgcttcctcctagccacttgctat

SEQ ID NO: 6819440 - DNA, 57 bp, Homo sapiens
gcctgatcaggtcctcggcatactggtaagtgaggatgctgggtttgcccatcaggc

SEQ ID NO: 6819441 - DNA, 91 bp, Homo sapiens
atgccttggtttctttacctgtaaaactgcgatataataataatacctgtaaacagcagacttacaggtgcataggaaatcccatatgcat

SEQ ID NO: 6819442 - DNA, 56 bp, Homo sapiens
aggcccttccatgttgtcatggagacctggacacaccatgatacttggaagggctt

SEQ ID NO: 6819443 - DNA, 66 bp, Homo sapiens
ggcccagtggggtgcttgggagcacatctagttttcttggggctttcagtgcctgccccttgggtt

SEQ ID NO: 6819444 - DNA, 68 bp, Homo sapiens
tatgagtgggggcaggcagtgctaggaagagccattgccttttagattgtgacctccccccatccatg

SEQ ID NO: 6819445 - DNA, 80 bp, Homo sapiens
gaggctgaagatggagaaggctggtcttaagtcgacatcccatcttgaagttcttgagtaggcacttctcagccagcctt

SEQ ID NO: 6819446 - DNA, 77 bp, Homo sapiens
ttgcttgacaacgtcaggctacactcttttcatggatctcatctccaaggtgttctttagcctgatgtggtcagtgg

SEQ ID NO: 6819447 - DNA, 74 bp, Homo sapiens
tttaattcactatttttcacttaggcttattagccttgctttttttaagtgtaggggagaatacatgaattaaa

SEQ ID NO: 6819448 - DNA, 71 bp, Homo sapiens
ctgcattattctagtccaagccagtagtatcatcacaacttctagattggctcaggttattcttaatgcag

SEQ ID NO: 6819449 - DNA, 57 bp, Homo sapiens
ggctggcctggttccaaggccccaggctgcgttgttccttgaggcccaggccaggcc

SEQ ID NO: 6819450 - DNA, 74 bp, Homo sapiens
gtgactcggcttgttgacgacttgactttctcaactataaaatggggatcatgcatcatcacattccgtttcac

SEQ ID NO: 6819451 - DNA, 77 bp, Homo sapiens
tttgggggtcatcctgttaataggtctgaaacaggaactcagtgtgagtcctgggtcacggcctcttttcccccaag

SEQ ID NO: 6819452 - DNA, 66 bp, Homo sapiens
ccgtaccccaggagctgtgcctagtccaggagaggctggggggcgccccatggaggtgagacgcgg

SEQ ID NO: 6819453 - DNA, 60 bp, Homo sapiens
gggtgggaaggctaagggattggcagcttgtaaggcctgggccccttagcctttcctctc

SEQ ID NO: 6819454 - DNA, 114 bp, Homo sapiens
aacagacactgcctcttacctagcctctctaggacaatgtcaaaataggaaacattatctttacatgtttaatctatttggcattttcctgggaaaagtgagaaactgattgtt

SEQ ID NO: 6819455 - DNA, 107 bp, Homo sapiens
gcatctcaggtgagtctgatgtagacagttcgcccaccacattttgagaatcactgatgccagggggttttgggtgaggagaggctgtctaactccctttctgttgc

SEQ ID NO: 6819456 - DNA, 73 bp, Homo sapiens
cgtctttgtgaagtggtttgaaatttcctgctatgtttaggtacaggggaagagccctttacatggaaggacg

SEQ ID NO: 6819457 - DNA, 77 bp, Homo sapiens
ctgaaccttggatttgggcccttaaatttgtaatgacagataatgatcaagttagggtgcataaatctaggttttag

SEQ ID NO: 6819458 - DNA, 58 bp, Homo sapiens
gccttaggggtcagacagagctggatatgggggtccttgttctgtaggagcttaaggc

SEQ ID NO: 6819459 - DNA, 59 bp, Homo sapiens
cagggacagatccagggacacaactgggataaccggtattcctggtaagcctgtcactg

SEQ ID NO: 6819460 - DNA, 56 bp, Homo sapiens
tgctttgaatatcacaaactttcaataaacttgagcccatagtggagttcaaagta

SEQ ID NO: 6819461 - DNA, 94 bp, Homo sapiens
aatgtctgagccaggtcttccatgactgaagcaggggcgggtatgagcagagtcctgccctgtgtgagtgcatgggtgctgtggcttgggggtt

SEQ ID NO: 6819462 - DNA, 73 bp, Homo sapiens
gtcacacacatttctttggtgctaaaggcacatgattctgtcaaccggcaacagcactgcagactgttgtggc

SEQ ID NO: 6819463 - DNA, 76 bp, Homo sapiens
ccccggaagtgactgcaccttgcggtcctgtggctggagcaattctcccaggaatgaggggcggaggcttccaagg

SEQ ID NO: 6819464 - DNA, 60 bp, Homo sapiens
gcagagggcgagctggctggccttcggggtgtggctcctggccgccgccttgtgctctgc

SEQ ID NO: 6819465 - DNA, 79 bp, Homo sapiens
cagtaatatttcttagagatggttaaaaataggttctgagtcatcttaagcatatttctaggaatttgttttattgctg

SEQ ID NO: 6819466 - DNA, 95 bp, Homo sapiens
ggagtgaaagatgaatccagaagtgaggctattgcataaaatgcataatgtaatttcctgtgcatttgctggagatggaccacacatttggctct

SEQ ID NO: 6819467 - DNA, 84 bp, Homo sapiens
gtgagagttaggaaaaaatatggattgttgatttggaaggagactaataaactatccctgccataattttttttcattttacac

SEQ ID NO: 6819468 - DNA, 62 bp, Homo sapiens
gtgtgtgtgtgtgtgtgtgtgtgtgtgtgtgtgtgtgtgtgtatgcatgcatgcacatgcac

SEQ ID NO: 6819469 - DNA, 72 bp, Homo sapiens
cctcatcactctttatcttttatgtctgcagtataaatagcatagacatttggtgtgaagggaggagaaagg

SEQ ID NO: 6819470 - DNA, 87 bp, Homo sapiens
agtttccttggcagcagtgtagagaatggccttgaagtagtcctggggctaaacaggaatcctctctcctgcccatgttaggaaact

SEQ ID NO: 6819471 - DNA, 98 bp, Homo sapiens
ctggacagaatgtgaaatgaggggatggagggtgaaggtggaggtggagctgacctggcttctgccttgcactttgtcagaccaaacgttctgaccgg

SEQ ID NO: 6819472 - DNA, 80 bp, Homo sapiens
cgtggccatcacgccacagtttcccggaggggccatccacagtcttctgggtggcagtgatggcgtggactatggtcatg

SEQ ID NO: 6819473 - DNA, 61 bp, Homo sapiens
acctgctgtttctttgatgatggaatgaatgcctcttattctatctaaagtgaacaaaggt

SEQ ID NO: 6819474 - DNA, 60 bp, Homo sapiens
ggtggcctggctggggtagaagtgagggtcatcctcttctcaactccagccagagcagct

SEQ ID NO: 6819475 - DNA, 82 bp, Homo sapiens
gagttcatggtaaaatacagattctgactcagagttctgattctggaaattctgattcaaagtttgagtgggccttgaactc

SEQ ID NO: 6819476 - DNA, 63 bp, Homo sapiens
gcaagtgcacagaagcagaagctagaccattcatctgaattttgtgatgtttgtggtacttgc

SEQ ID NO: 6819477 - DNA, 82 bp, Homo sapiens
gtgggaagtgagttatcctgcaagttggatatttagttttaggattaaactaaatagcctctggtagttgtgcacttcctac

SEQ ID NO: 6819478 - DNA, 59 bp, Homo sapiens
gatttcagggtgtcttccaactgaaatctcaatgttttcagtatgaaaaacctgaaatc

SEQ ID NO: 6819479 - DNA, 56 bp, Homo sapiens
gggggagactgtccagggttggggggaaactgtctttgcctggacctgtctccttt

SEQ ID NO: 6819480 - DNA, 66 bp, Homo sapiens
atggatggatggaagaagaatcctatgaggttgtgcttgcctcctggttgcttctccaacaaccat

SEQ ID NO: 6819481 - DNA, 95 bp, Homo sapiens
catttgatttcagttttataggacttggaaggagctcccagcctgggattttgtaatctgggctctctactttggagcctggactgagaaaaatg

SEQ ID NO: 6819482 - DNA, 105 bp, Homo sapiens
aagagcttaagtcacacagctggtggaggtgccaggatttgaaattgtgtgtgtttgactttaaagcctctattcttaaccactgtgctatactgcattgctctt

SEQ ID NO: 6819483 - DNA, 58 bp, Homo sapiens
gccagagctgatgggcccagggtagattcttagtccacttggggcaatgagttctgtc

SEQ ID NO: 6819484 - DNA, 129 bp, Homo sapiens
agtatggtttgccaaagggatgctctgattcaggaggctgaggtggggcctgggaatgttcatttctaaccttttcccaggtgatgctgaggccactggtccaggggccacctttggccctaagccgct

SEQ ID NO: 6819485 - DNA, 67 bp, Homo sapiens
ttctatgaggtgaaaaactgtgcatgccatcagtcaagctgtacagcaagttcaccttgggatagaa

SEQ ID NO: 6819486 - DNA, 58 bp, Homo sapiens
gcatctctgatggtggtggctggaggtgacagtggcccagtggccactgcagagatgc

SEQ ID NO: 6819487 - DNA, 56 bp, Homo sapiens
ctgcaggtttgtagtactgagaataatagagcgttttcagaccctacattcctcag

SEQ ID NO: 6819488 - DNA, 67 bp, Homo sapiens
tagatgccatcacttttccttttacagatgtactgttccatctggaagttaagcttggtgccaccta

SEQ ID NO: 6819489 - DNA, 81 bp, Homo sapiens
gcttcctgttgggtagtatgcgacttgaggtgacaaacacttgcattgtgtttgagaaccctgtattttaagcaacagagc

SEQ ID NO: 6819490 - DNA, 67 bp, Homo sapiens
atgtgagttcatgcaattatatccccaagcacacagcctaggcagatgtatatatgagccgtcacat

SEQ ID NO: 6819491 - DNA, 105 bp, Homo sapiens
gcaaggaaaatagataatgttggaagccactttagataccatcttagtgtgaatttcagcagtagtggatgggtaaagtattttccaaaataatgtatcccttgt

SEQ ID NO: 6819492 - DNA, 82 bp, Homo sapiens
tctgtaaacccaatctcataatcgtcattgctttcatagtcactatagagagaaatggtgtttgtagaactaggaaaataga

SEQ ID NO: 6819493 - DNA, 59 bp, Homo sapiens
gtggcttttgattggactgggctgtctctgagctggagcagaagttaatcgaaggccat

SEQ ID NO: 6819494 - DNA, 80 bp, Homo sapiens
caatgccctaggcagctgcaaacttcggtcccctagagcttctccctaggggctgcccacagcgggtgtttcgggagttg

SEQ ID NO: 6819495 - DNA, 86 bp, Homo sapiens
gctctaaaataggacaattttggcatagttctgtgtttgaagaacagagagttgctaatgtgcagaataatgtcgagaattggagt

SEQ ID NO: 6819496 - DNA, 57 bp, Homo sapiens
gattagtaagagtttacctattgtcatgaggcaaacctgggttcaactcctacagtc

SEQ ID NO: 6819497 - DNA, 61 bp, Homo sapiens
actgcatgctgagccaacagtgacaggcaagtactggctcaatgtttaacccagcatcagt

SEQ ID NO: 6819498 - DNA, 76 bp, Homo sapiens
gaccagaggccagactgccttttatgacttggccttggaagtcatacaagatcactttggccatgttcaactggtc

SEQ ID NO: 6819499 - DNA, 62 bp, Homo sapiens
gatggccaagaatatttctcaaccttgaaacaggttgaaatcttcaagaatgtattggcctc

SEQ ID NO: 6819500 - DNA, 57 bp, Homo sapiens
tctccaggtggggtcacctttttcctccattccataagaggtggtctaggctggaga

SEQ ID NO: 6819501 - DNA, 60 bp, Homo sapiens
tagtgccatagataggaccatttgcccctaccttgaaggcatagtcctacccatggtcta

SEQ ID NO: 6819502 - DNA, 64 bp, Homo sapiens
agcagggacatctttgtctagtacctgaatcttcagcatcagtacgtacagatgtgccctagct

SEQ ID NO: 6819503 - DNA, 58 bp, Homo sapiens
gcctgccactagctttcacatctttgccaccagggatctttctgatgctgtggcatgc

SEQ ID NO: 6819504 - DNA, 92 bp, Homo sapiens
tgtgacccaagagaaatgaagctgtattaatttggtttgttgttagggaaaagcactagccaagttttacgactaatttttccactttcaca

SEQ ID NO: 6819505 - DNA, 68 bp, Homo sapiens
ctgctgggaagtcaggctatatttttggcatcacagtgatctccttagtacctgatttcacagaccag

SEQ ID NO: 6819506 - DNA, 67 bp, Homo sapiens
gctttggttgttaaacatagagctccattactcccttgatggtgttaatgaaaaacaactcatgagt

SEQ ID NO: 6819507 - DNA, 63 bp, Homo sapiens
aaatgttctgaaagacccgctcttcactccagttttccctagggtgtttctggcagggcgttt

SEQ ID NO: 6819508 - DNA, 56 bp, Homo sapiens
ccgaggctggagtgcagtggcgcgatctcagctcactgcaagctccacctcccagg

SEQ ID NO: 6819509 - DNA, 63 bp, Homo sapiens
gtgcccaggcccaaggcaccactttatcacattcccctggccatagcaatgggccttggacac

SEQ ID NO: 6819510 - DNA, 64 bp, Homo sapiens
tggcagagatgaagagttgttttgattatgacataacagctgcttctatcttttcaatgagcca

SEQ ID NO: 6819511 - DNA, 73 bp, Homo sapiens
aggccccagttgtagacaggagtcaggctagaatcaggggctactgctgaagctactctagctgtctgggcct

SEQ ID NO: 6819512 - DNA, 78 bp, Homo sapiens
gacagcccagcccatggccttcctggcggctcagggttaggaaaagctgtgccttcagggaggcagggagtgggggtc

SEQ ID NO: 6819513 - DNA, 72 bp, Homo sapiens
tgtcctcttgtggccaaaagttgctgctgcatctggaaaagctggcaatttcaatgaggccacagggggata

SEQ ID NO: 6819514 - DNA, 130 bp, Homo sapiens
taataatatgcagtaaaaatcaaaatatggcacatgatcttatgtagaagatctcagcaccaaaatgaaaatgagttgtggtcaattttatctaaatcagagctattctatttatatgagcaatatttaa

SEQ ID NO: 6819515 - DNA, 81 bp, Homo sapiens
gtgtaaagactatttttttgtacaccttgaattaccaggagggtatccaagtgaagatatacagaaaatagttgtatacac

SEQ ID NO: 6819516 - DNA, 57 bp, Homo sapiens
gccatctgatgggcttggagtcagggttccttctggctgcgtggcctttagcagggc

SEQ ID NO: 6819517 - DNA, 57 bp, Homo sapiens
tcagggggaggagactgccagtgccgtgactcaaaatagctgtctcttccctgctga

SEQ ID NO: 6819518 - DNA, 95 bp, Homo sapiens
tccatcttatcctacaatcaggcagcaagtatttactgagtaatgattgcctgccagcagcatgcagtaagtaccctgtgatgtagagagataga

SEQ ID NO: 6819519 - DNA, 58 bp, Homo sapiens
aaatggagaggctgtgagtgagagcctcgtgtactctcaagtagaagcctccctattt

SEQ ID NO: 6819520 - DNA, 79 bp, Homo sapiens
ttcataagttgcagagcagtaggaatatagtataatgattaaaagcatagatttatattcaggctgcgcacagtatgaa

SEQ ID NO: 6819521 - DNA, 61 bp, Homo sapiens
ttctcagagctcactgtagtaagggaaggacacctgggaaggattacaggaactctgagga

SEQ ID NO: 6819522 - DNA, 58 bp, Homo sapiens
ctgctgattacacagaagaacattgctatttacatgcaaatatctttgtaatcagcag

SEQ ID NO: 6819523 - DNA, 82 bp, Homo sapiens
gcctgaggttactgtacagtgtagtcatgaggttactgtacactgtagtcatgaggttactgtacactgtagtcacatcagc

SEQ ID NO: 6819524 - DNA, 73 bp, Homo sapiens
caaagtaagtatgtggcttgaagtcatgtcaacactgagtttgaatcacagcttctgccatttgctagctgtg

SEQ ID NO: 6819525 - DNA, 94 bp, Homo sapiens
gctaatgtgcaaaagactctgggcttatcataattttaaaagatttcatctatatctattttgaaatatgtgatgagagagtacacgatttagt

SEQ ID NO: 6819526 - DNA, 60 bp, Homo sapiens
ggtgctgggttccatgagagacctactgggtcagaatctctcagatggggcactagtatt

SEQ ID NO: 6819527 - DNA, 101 bp, Homo sapiens
tgaggcaaaagaattgcttgaacccaggaggtggaggttgtggtgagctgagatcgcaccactgcactccagcccgggcaacagagcaacactttttctca

SEQ ID NO: 6819528 - DNA, 106 bp, Homo sapiens
aaggaagatgagaaggtggaagctgatgggagacagggcagcttgtgggtgtctctttcttctcctcctcctcctctttttcctacttctactccctctcttcctt

SEQ ID NO: 6819529 - DNA, 58 bp, Homo sapiens
tgggctcatagcccaagtccactacttattagctgagtgaacttgggcaagtggctta

SEQ ID NO: 6819530 - DNA, 76 bp, Homo sapiens
gctgtaagaatgctttgtctgctccagacttcccggtcctgggagatcaggtggtcaggcaaaacatccagaccgt

SEQ ID NO: 6819531 - DNA, 107 bp, Homo sapiens
gatttgccaaaggagctgtcctcctggtgcaaagggcctagagagtggtatcagtcacagtttgaactatgttctctgctctaggatgtcacagcttaccccaaatc

SEQ ID NO: 6819532 - DNA, 55 bp, Homo sapiens
taccctccttttctgataagaccacttgggatcagacatcagtcctgggagggta

SEQ ID NO: 6819533 - DNA, 60 bp, Homo sapiens
agtaaaatgacccattatgccttaagttacaaatatttacaggcctagggtcaatttcct

SEQ ID NO: 6819534 - DNA, 69 bp, Homo sapiens
cgaagtttggggagaggagtctgcagttactttttcacagtgagatttcaagatctccccttaacattg

SEQ ID NO: 6819535 - DNA, 80 bp, Homo sapiens
cctggacatttggtcacaccagtccacattaacgtggaccagacaatattaatgtggactggtgtgaccaaaagtccagg

SEQ ID NO: 6819536 - DNA, 78 bp, Homo sapiens
catgtttccgtgtatctggtggaagatgtgtgtctgcaggatgagtgtctcttttgtcggtgtatcatggattgtgtg

SEQ ID NO: 6819537 - DNA, 78 bp, Homo sapiens
ggttaagacacattcatatctgtctttctgcagtgctagtgaactgagtgcttatgggcagttatgttgtccttggct

SEQ ID NO: 6819538 - DNA, 100 bp, Homo sapiens
gaggcaggagaatcacttgaaccctggaggcggaggttgcagtgagtcgaaatcgcaccactgcactccagcctgggcaacaagagtgaaactccatctc

SEQ ID NO: 6819539 - DNA, 87 bp, Homo sapiens
aacaaacaaaaaccttcactgttggctttgcttgtcttggagatttcaagggcctacagaaggcagcagtgagaaattttggctgtt

SEQ ID NO: 6819540 - DNA, 58 bp, Homo sapiens
aaagcaatagcaacaactttacaggcctttgggcaatgtcatagtagtgctattcttt

SEQ ID NO: 6819541 - DNA, 125 bp, Homo sapiens
aatttagcagcatatgacaatgaatgaacttatttatataatagtgaacatcatcatgacttcattaaatgacaaaaggatgagttaactaaactgtgagtaaatctgtctcatctttctaaatt

SEQ ID NO: 6819542 - DNA, 65 bp, Homo sapiens
agtggctgtaggctatgagagaaaaagaagtcgagcatgatttcatgtctttggcctcagacact

SEQ ID NO: 6819543 - DNA, 77 bp, Homo sapiens
ggaggctccacagggtggccccactttggttggggttaagaatgtcccagaggctggtcaccctgagacgggcctct

SEQ ID NO: 6819544 - DNA, 80 bp, Homo sapiens
ctgcatttaatttcagtgcaagctcacggctttgcattcacatcccagcaccgatacttaaacattgaaatggtgtgcag

SEQ ID NO: 6819545 - DNA, 78 bp, Homo sapiens
gttgtagtttctgtgactcagggatctgggcctggcttagctaggtgctctgctcacaggtctctcccaagctacaat

SEQ ID NO: 6819546 - DNA, 64 bp, Homo sapiens
tcaggcaggacccaacctccctgctctgtgctctcacagtgcctggctgatgggtcctgtctgg

SEQ ID NO: 6819547 - DNA, 119 bp, Homo sapiens
gactccctgaggagtgcagagctggcagtggggccactcctggctgctgagtccaggactactccgggactcaaccttcccaggcgtgcccagccatgccctggctgcttctgggtgtc

SEQ ID NO: 6819548 - DNA, 104 bp, Homo sapiens
gacagtgtttctgccagtgtgccctttgggatgctagacacctcagataatatatattcagaggactctggatatcactaagcttggcaaaatgacacattgtc

SEQ ID NO: 6819549 - DNA, 81 bp, Homo sapiens
gccacctggggacaagtggttgcttgtgagtccccggaggccgctgagggcacaaaggcaacattcatcctcgggactggc

SEQ ID NO: 6819550 - DNA, 107 bp, Homo sapiens
gccaggcgagtgatcaagacttacacagacatggcatcatgaccagtttcagtttttctggctcagacaccactctgttgaggaacagacttcttggtgagcctggc

SEQ ID NO: 6819551 - DNA, 117 bp, Homo sapiens
ctttataaaggtgttattctgctgcccagttttgtaattctcaaaaatagtgccaggtcttctatagcttttttcagaattcatgggcttacaagtactgtatgcatctttaaaaag

SEQ ID NO: 6819552 - DNA, 85 bp, Homo sapiens
aactctttcccaagattatatccagagagatttctcagaagacttgaagaggaatgtcatagaataatcatgcatgaaagcagtt

SEQ ID NO: 6819553 - DNA, 125 bp, Homo sapiens
ttagaatctcctgtttttgttttgttttaattactgatgcctgtgttccaccacagagatactgatttaattggcatggggcataacggagatcagaatttttaaaagcttcccagggagtccaa

SEQ ID NO: 6819554 - DNA, 123 bp, Homo sapiens
aaatgcttctcccaccaaaatataatatgcttggttgacagaatggttgtgtggttaaaacgcagaagaggaagccaatctttgactatatgtgtattatctttatggatccaactagcattt

SEQ ID NO: 6819555 - DNA, 116 bp, Homo sapiens
acagaaaatggtattaaagcacagagataattttaagttttaaaatcttaaattggattacaaataaactaccaatttagtagagaaattaagaaagctctgttgccattttctgt

SEQ ID NO: 6819556 - DNA, 74 bp, Homo sapiens
acagaagaagttcaaggtgaagtctggggctatacatttcaaggtcatttatgtttcactgtgagtttttctgt

SEQ ID NO: 6819557 - DNA, 84 bp, Homo sapiens
ttggtagcattgatgtgagtttacatttggggctcccaagccaaactgtcagaaaagaccacattattctttgtaatttgccaa

SEQ ID NO: 6819558 - DNA, 100 bp, Homo sapiens
gagacaggagaatcgcttgaattggggaggcggaggttgcagtgaaccaaggtcgcgccattgcactccagcccgagcaacaaaagcgaaactccgtctc

SEQ ID NO: 6819559 - DNA, 82 bp, Homo sapiens
catgggcttcgggagggaccctctggtccagctgccccacccaaccacccttattagctccaagtccctctccaagcctttg

SEQ ID NO: 6819560 - DNA, 73 bp, Homo sapiens
gcttaattggcagtgtttttcaatgcttccactgtaataaacatggacaagtaaaagcacttccccccgaggc

SEQ ID NO: 6819561 - DNA, 128 bp, Homo sapiens
ggtcaagttccttagcaatacctgccttgttgactttactctgtgcctcagttttcccatctgtaaaatggcgataataagaatgggcaattcacagggttgttatgaggactaaatgaggatgtgcc

SEQ ID NO: 6819562 - DNA, 72 bp, Homo sapiens
cagtggcatgatgtcggcttagtgcaacctccacctccgggatgtaactgattctcctgcctcagcctcctg

SEQ ID NO: 6819563 - DNA, 68 bp, Homo sapiens
cagccttcaacctagctagagcagttcatcctgaacaatgctgggacccgctgggttttgaaaagctg

SEQ ID NO: 6819564 - DNA, 61 bp, Homo sapiens
aaccatggatttcagttcacctttcattatctaccgagaagtggtcatctatcccatggtt

SEQ ID NO: 6819565 - DNA, 79 bp, Homo sapiens
cagcagagtggccaaggctgaggccctgggcttggcctgatgtggccgtggccggtccctggccttggtctctctcctg

SEQ ID NO: 6819566 - DNA, 105 bp, Homo sapiens
gttgcctctggcctttccctgtccagcattgagcctgtaatccttgggccctgaccagagggcccagcccttgctggtctcagttgttggactggccaaggtggc

SEQ ID NO: 6819567 - DNA, 66 bp, Homo sapiens
cccttaaatccatctctccgagaagtttctagctgacgtttttcagggggtcatggagggtgaggg

SEQ ID NO: 6819568 - DNA, 58 bp, Homo sapiens
cctgtcatgtcagtgtgtgtgtgtggcctcccagcccaaccagaaattgacagacagg

SEQ ID NO: 6819569 - DNA, 71 bp, Homo sapiens
tgccttgagggagtaagatgagaagactggggtggttgtccaggcttattatcttctccattactcaggca

SEQ ID NO: 6819570 - DNA, 68 bp, Homo sapiens
tttttcatctgtgctgccaagactgagtggttggatggcaagcatgtggtcttcagcaaggtgaaaga

SEQ ID NO: 6819571 - DNA, 86 bp, Homo sapiens
ggtgaccatgactatgcacatccaggctacttcctgactaggccctgttcaggaagcatcctgaggtgtccattcctcgtggagcc

SEQ ID NO: 6819572 - DNA, 64 bp, Homo sapiens
tgtggaatattagattaggttgattaatcggtcattcataattaactagtgataatgttctaca

SEQ ID NO: 6819573 - DNA, 61 bp, Homo sapiens
ttgtctttcaaagctgtagtagattttccccctcatagaatccatcagcttttgaagagga

SEQ ID NO: 6819574 - DNA, 99 bp, Homo sapiens
agaagccaatgtcggaaaatgaatcctgtagattctaattcctgcactgtgtgaggactactggtgaattattttccgccacaatttgcattttcttct

SEQ ID NO: 6819575 - DNA, 96 bp, Homo sapiens
actaggattttggaattcaatggaaaaacatgtaatgaaagcttcatatggaattgaggtggctttactgtttcttactctgaaattccttttagt

SEQ ID NO: 6819576 - DNA, 104 bp, Homo sapiens
gacagaggacgatgactgctgtgctcatagtcaagagatttaagatattcctaaactgccgcccttgaattacatgaccctgagtagatagtgatcattctgtc

SEQ ID NO: 6819577 - DNA, 103 bp, Homo sapiens
aaagcctgtgtaaatagggaggcagtggcagggagcctggggctggaagtcaggaggcttgaattccagttctggctttgccactctctggctgtgcagcttt

SEQ ID NO: 6819578 - DNA, 81 bp, Homo sapiens
tgaactgaccagttgcttttgtactttccagcatcctacaattcagcctacattgtcataaaatcaactggctccagttta

SEQ ID NO: 6819579 - DNA, 74 bp, Homo sapiens
agagggtcaagaaacacaggagaaggaagaatgtcatagcacatcatcatctaaattgtgtcgctaaactctct

SEQ ID NO: 6819580 - DNA, 55 bp, Homo sapiens
ggccattgtgaatttcagttgggcttttaacaaaaaagctctgcttcatgtggtc

SEQ ID NO: 6819581 - DNA, 73 bp, Homo sapiens
gctgccagccagaaaactctacatgcttgtggtagaaagctgccctagctaagcacagttttctgggtgtggc

SEQ ID NO: 6819582 - DNA, 104 bp, Homo sapiens
gttgatggcctcaccaagtttagtcatagatacccaaggtcagggagggccattaccctgtgaaactttggggatctacggctggaccacgtggggccatgagc

SEQ ID NO: 6819583 - DNA, 65 bp, Homo sapiens
gtaggtgcatggtagactctcgggtcatgggagattatcctcatggcagagtcacctgtccctgc

SEQ ID NO: 6819584 - DNA, 70 bp, Homo sapiens
gtcctcattgtcactggcccgcagacaggaaaggaaaagtaaatccccgctgaggcaggggcagtgggat

SEQ ID NO: 6819585 - DNA, 59 bp, Homo sapiens
ggaaccacagcccccagcaggcctcgcgcggcgcgctgcctcctgggatttgtagttcc

SEQ ID NO: 6819586 - DNA, 59 bp, Homo sapiens
ggtttgctgcagtgagactcactgatacagtttcattcagtagaagcactaggcaaact

SEQ ID NO: 6819587 - DNA, 55 bp, Homo sapiens
ctgccttctttcaagggtaagcccttggtcacaaggggcctgggacagaaggcag

SEQ ID NO: 6819588 - DNA, 69 bp, Homo sapiens
gaggtgggaggatcactttgagtccaggagtttgagaccagtctggaaaacaaagtgagttcccatttc

SEQ ID NO: 6819589 - DNA, 70 bp, Homo sapiens
tagtatatacgtatattccaaagggtatttagtaaggaaaagacttgatcctatgtggtatatgttacta

SEQ ID NO: 6819590 - DNA, 88 bp, Homo sapiens
gattatcctcgaaattctgtagtttgaatttaggcattttcggttttatgagagtgattggttcgaatgtactaatttgaaggttgtt

SEQ ID NO: 6819591 - DNA, 58 bp, Homo sapiens
ctccgcacagccctgagcgcatgtctatctttaggccgtggaagaagggctggtggag

SEQ ID NO: 6819592 - DNA, 56 bp, Homo sapiens
tcaaattatttaggatagtgcttgcaaaagggtagtgtaatttctaggtaatttga

SEQ ID NO: 6819593 - DNA, 63 bp, Homo sapiens
cgcgctcatttccgcctccttctcgggcactcagcattccggacgggggcggagagaggagcg

SEQ ID NO: 6819594 - DNA, 68 bp, Homo sapiens
tttagacatggattcagggatgtgaatattagcaaaatattgaacaatcaaaagaattcatgtgtgaa

SEQ ID NO: 6819595 - DNA, 96 bp, Homo sapiens
tataagtttgtaattgaatgagaagttattgccatgtaattgactaacaggtgtatgttatggtaatgagtttgaatcatattcagttgaattata

SEQ ID NO: 6819596 - DNA, 114 bp, Homo sapiens
caatggttcggatcctttacatagtgctttcccactacaagctgcaaactataatttcagtggaaatggtaagtgggaggcattagctgtgttttatttcacaaaagttcattg

SEQ ID NO: 6819597 - DNA, 62 bp, Homo sapiens
acaacctggagttgaaggaaggtgggccagcttcggtgcccaccccacagctcctggtgtgt

SEQ ID NO: 6819598 - DNA, 70 bp, Homo sapiens
actgtgagcttgatttttgtttatccttacaactttagtaaaagaggataataataatctcgtttacagt

SEQ ID NO: 6819599 - DNA, 63 bp, Homo sapiens
gggggcgactgtatcttggggcagtaagggggtgttgcccagggatccgtgtcgtggaccccc

SEQ ID NO: 6819600 - DNA, 83 bp, Homo sapiens
agtctttgcttttacttgtatcactccgtatcatttaatctagtgctataactgagaagatacatagtagctgtcaactggct

SEQ ID NO: 6819601 - DNA, 77 bp, Homo sapiens
tttgaatccaaaatgtttgaatgcatgtgctgtatattgcaataataccacatatgtaactgcaggcattatgcaga

SEQ ID NO: 6819602 - DNA, 93 bp, Homo sapiens
tcattttgttagtctcctgggcttggttgttgagaacccaagaatatatatctgttcccatgcctccaagcttcagtgaattaatgaaaatga

SEQ ID NO: 6819603 - DNA, 60 bp, Homo sapiens
agtaggcccctggtgccctgaggccaagtgtggccaaaacagagggccctggtggccatt

SEQ ID NO: 6819604 - DNA, 118 bp, Homo sapiens
tggcaaaattaatttttccatcatattggagtgagccacatgtcaaacacaagtgtacacttcagttgtgtacaaattttggtccaagttttactcttttggaagaataagcatgtca

SEQ ID NO: 6819605 - DNA, 73 bp, Homo sapiens
tcttatgtggccatggtcagaatattggtataaatatggtggtaaaggcagttctgattaggtctcagatgga

SEQ ID NO: 6819606 - DNA, 66 bp, Homo sapiens
ggtgcctcagttggaaatgcagaaatcacccgttttctgctttgatcttgctgggagctgtagacc

SEQ ID NO: 6819607 - DNA, 102 bp, Homo sapiens
ggtaggagtggggatagcctcaaaggcagctggaggcagagactacaatagcatcagtgttgtttctgcttcttctgtgggtcagcttcattctctcaagcc

SEQ ID NO: 6819608 - DNA, 63 bp, Homo sapiens
agcagtgtttaggcattcagtagtccttgggagacactgaaataaagttgctaaaattctgct

SEQ ID NO: 6819609 - DNA, 75 bp, Homo sapiens
taaaggctaagaatatacatagttctgtgaaaagtaacagctgtttctcctcctcattggaactgtgtgccttta

SEQ ID NO: 6819610 - DNA, 96 bp, Homo sapiens
gacagtcctgagcatttgtttatgcccctggccactcatattgaattcttggattttggcttagagggtgggaaaggatcaaattgctcagctgtc

SEQ ID NO: 6819611 - DNA, 70 bp, Homo sapiens
gggagccttgggccatggactgctgcccatcatagctggaggagcggtcagctggccacacggggctcct

SEQ ID NO: 6819612 - DNA, 59 bp, Homo sapiens
gagtgggcaccgtgggcacactcggggaggtgggaggagtgggcaccgtgggcacactc

SEQ ID NO: 6819613 - DNA, 77 bp, Homo sapiens
aggtaaatttcctactgaagcaccattaaagacaagtgtgtatgtgtctgtgtggttttcagaattgaaaactacct

SEQ ID NO: 6819614 - DNA, 78 bp, Homo sapiens
tgtctgttttgcactagtctcagaggcaaaagctgaacagaacagccttttacctacccagtattatgaacacagaca

SEQ ID NO: 6819615 - DNA, 66 bp, Homo sapiens
ggggagattcattacagccaggaggaactcagtgaaactgttcaaggagatctggttaatatcccc

SEQ ID NO: 6819616 - DNA, 78 bp, Homo sapiens
cactatatgattcctctcacttatataatgaatcatagagtaatacttagggtagacagaaagcggaatcatacagtg

SEQ ID NO: 6819617 - DNA, 81 bp, Homo sapiens
tatctcatgtttgtttgggtccacaaacatcagatattgacccaaagtttgtgagatgtggacccaaacgtgattgagata

SEQ ID NO: 6819618 - DNA, 56 bp, Homo sapiens
gactttcaggaaaggcttttgttaggatacaatacttaagctaagacctgaaggtt

SEQ ID NO: 6819619 - DNA, 71 bp, Homo sapiens
gggcctgagcccagaagcccactcggcataacacataaggctgtgcttttggtgcattctgggcttggtcc

SEQ ID NO: 6819620 - DNA, 55 bp, Homo sapiens
attggggttgggtggtggtggaatgactttgtatatctaaccacctagccctgat

SEQ ID NO: 6819621 - DNA, 87 bp, Homo sapiens
tgaggagcaagtgagaatgagactatgcgagtgtgataacagttctatatccataacactttcatctcagagtacacttgtgcttca

SEQ ID NO: 6819622 - DNA, 93 bp, Homo sapiens
ccctgctcccaagtgactttgtcttcagataggcattcttcctggacttccctatacaggaagatgagagacagaataaatggtggttcaggg

SEQ ID NO: 6819623 - DNA, 109 bp, Homo sapiens
tcacttatcagcatatgtgtgtggaggatgtgtgtgtgtgtgtgtgtgtgtgtgtatgtaaaatcactacattgcaataataattctcttcagattgtagattgggtga

SEQ ID NO: 6819624 - DNA, 61 bp, Homo sapiens
gaagaggttcaacgtggtcatcaccaggtttttcaagtagaactccgtgttggggttcttc

SEQ ID NO: 6819625 - DNA, 58 bp, Homo sapiens
ggcctctgcaggcctcgacaaggccaggcctcctgcctcccaaaggcctgcacaggcc

SEQ ID NO: 6819626 - DNA, 94 bp, Homo sapiens
gaatttttacagagtgtgagatgtttgcagaccaggaggctttcttgcatttatgcctcaggaaatgggtcgttttataattcttgtggggttc

SEQ ID NO: 6819627 - DNA, 70 bp, Homo sapiens
ggttgcccatgggagtggttgacttgaaagcatatttatgtattgactttctctcctcccaggtgtcact

SEQ ID NO: 6819628 - DNA, 72 bp, Homo sapiens
acctggggtcaatgtggtggcagatgtcagtgccagatggcatgacacctaataaccaacatgtttccttgt

SEQ ID NO: 6819629 - DNA, 64 bp, Homo sapiens
ggccttggattttaccctaaaggtagttattgactgaatttaggtggcgagatacccagaggtc

SEQ ID NO: 6819630 - DNA, 77 bp, Homo sapiens
tgatcttgtatgtagccatgtgggtgtgaatgtgtatacatatttgcacttcctaatgtgtttttatacaatgttca

SEQ ID NO: 6819631 - DNA, 76 bp, Homo sapiens
agggaaagtaagcatttcattaactctgtgaaatttgtatgttgagtcagaaaataaatgaatggtactttaccct

SEQ ID NO: 6819632 - DNA, 86 bp, Homo sapiens
caacctgaaagggtgattctcaattttagctataaggctgtgaattcagtttgaagcagatggttaagcttgatcattacaggttg

SEQ ID NO: 6819633 - DNA, 59 bp, Homo sapiens
gtttgtctgcttttctttgtctggtatgatactttccaggctgtggatgcttaacaaat

SEQ ID NO: 6819634 - DNA, 55 bp, Homo sapiens
gccctgatgctatgtggcgaggcatagaaaatgaacatgctacccagttcagggt

SEQ ID NO: 6819635 - DNA, 91 bp, Homo sapiens
ctacaccccttgtttaacttaatctgcttgatgatttctgctttggagtttggatttcgttgaaagcatgataggttgtagcatagtgaag

SEQ ID NO: 6819636 - DNA, 72 bp, Homo sapiens
cccacaggcagacctcccacatcctagctctgcttccaagaaccacccccttgggtgtggaaggtcagtggg

SEQ ID NO: 6819637 - DNA, 56 bp, Homo sapiens
aagcactgagcacagtggctgacagataatgaggtctccactgaggcttggttctt

SEQ ID NO: 6819638 - DNA, 107 bp, Homo sapiens
ccccatccctagaagcccttgctaacccagtctcctcgtgtaaacctttccccaggtttacactccaggctggggtgggcaaagaggggctcagctataggatgggg

SEQ ID NO: 6819639 - DNA, 74 bp, Homo sapiens
agcagcctctggaagaattacatccatgaaattctgtattcatgtgattgtcttggtttttctagaaggttact

SEQ ID NO: 6819640 - DNA, 80 bp, Homo sapiens
atattgtaagctatttttgtgcctttctagcctttaaatacctactttactggaaggtaatccataatagttactagtgt

SEQ ID NO: 6819641 - DNA, 55 bp, Homo sapiens
tcttggtgtttgtctacaggccgcccctgctgcatgaaaaagacagacagtggga

SEQ ID NO: 6819642 - DNA, 66 bp, Homo sapiens
ttttgccccctagaatactgtgagcacattactggtgggggcagtgttccttctactggggcagag

SEQ ID NO: 6819643 - DNA, 110 bp, Homo sapiens
tgtttcatttagaaatctgaatgatggagtgttggcagagggccaccagaattcaaaagaggttgagtttaatcctccagcccaactgtccacatttagaaatgacaaca

SEQ ID NO: 6819644 - DNA, 72 bp, Homo sapiens
caggattctaattagttctacatgtttcttagaccccactgtctcaaacatggctgcgctatggaatacctg

SEQ ID NO: 6819645 - DNA, 83 bp, Homo sapiens
gtgggctgtcggtggtattttgggtatagagggcatattatgttaggatggaaaattcccagcatgcacgctgacactcctac

SEQ ID NO: 6819646 - DNA, 101 bp, Homo sapiens
cacagacccatggctccctccaggcttcaagggccggccctgagcagtccagcagcccagcgaggggtcggcagcctctgaggggagagagcgtcactgtg

SEQ ID NO: 6819647 - DNA, 82 bp, Homo sapiens
ccacactcttgacacaggaggaggcacgcctccagtgaattctgcctcacggtggctgctgccctcctaagtgcaaggctgg

SEQ ID NO: 6819648 - DNA, 58 bp, Homo sapiens
gctcatcccttaggaggaaggctcctggctattcagggctcccctctgcagggatggt

SEQ ID NO: 6819649 - DNA, 108 bp, Homo sapiens
atagtaaaagttaaagaggaaatttgctgatcatctagctaatgtttactatagaccattaaactaggtaatccaggcaataaaacttcactttaggctttaaactat

SEQ ID NO: 6819650 - DNA, 69 bp, Homo sapiens
tggacatctggaggagatgaatggcagattgaacacaagcatctaattatactcctcccagaaactcca

SEQ ID NO: 6819651 - DNA, 81 bp, Homo sapiens
aggaagcttattttataggagaactcttaaagttgctgaatgtgtttacaatgcttggtttttctagaaacttgtcttcct

SEQ ID NO: 6819652 - DNA, 90 bp, Homo sapiens
ggagatttctgaacccttctactacttatttacttatatgtgctgattgtgggtaaaatgagttaggagaaaacttggcttcagatctct

SEQ ID NO: 6819653 - DNA, 79 bp, Homo sapiens
ccatttgaacatctttccgtggactttactggctgctcctaggcctaggattcgggcataaagccattaagattcatgg

SEQ ID NO: 6819654 - DNA, 61 bp, Homo sapiens
gatttaggatcagagactttgaaggttagaagagacctaagagatcttctggtccagagtc

SEQ ID NO: 6819655 - DNA, 56 bp, Homo sapiens
gcctcgctcagctgaggtttcctgacaggaggggaagctgccagctgagctgaggc

SEQ ID NO: 6819656 - DNA, 71 bp, Homo sapiens
tgtctcccaggaacgggcctcacatccctgcagtgctgtcagcagcctgtggaaggcctgtcctgaaagca

SEQ ID NO: 6819657 - DNA, 95 bp, Homo sapiens
tctgaccagctgtataggcagctctgtggcctcccagccctggaagatagacagcgtcctggtgagactcagggatgctttacattaaactcaga

SEQ ID NO: 6819658 - DNA, 75 bp, Homo sapiens
gcagcctccgtcagttttctgttctacaatttgataaatggattatactcacacgtaggataaggaattggttgt

SEQ ID NO: 6819659 - DNA, 70 bp, Homo sapiens
ctgacattgatccagcagccgaataagcctgcagggaatggcgactcttggcagcgggtcaggctgtggg

SEQ ID NO: 6819660 - DNA, 94 bp, Homo sapiens
ggatccactgtgtctgccatggaagggggatcatcagtcctggcttgaacagttgggcttgaaaatgactcttgtgaagactcacagtgtgtcc

SEQ ID NO: 6819661 - DNA, 60 bp, Homo sapiens
tcttcggtgctattgtgctagagttctatcctggccctctttcctcagcacacaccaaga

SEQ ID NO: 6819662 - DNA, 55 bp, Homo sapiens
tctgtgatggtatggaaccactaggtggggaactagcgtcaatatcgtcaacagg

SEQ ID NO: 6819663 - DNA, 74 bp, Homo sapiens
gctgaccccaagctctgcctttcaccccctacatctgatagtaggcaagagagaaatgtgcagtttgggctggt

SEQ ID NO: 6819664 - DNA, 59 bp, Homo sapiens
agaaggccctgtgtggtctgagcctggcctacctgttcaacctaattgcacggccttct

SEQ ID NO: 6819665 - DNA, 87 bp, Homo sapiens
atataatatgagtattttacatcgtgtaattgactacttgatcgattcataaattatattgtggtgtgaatgtgtctgataatatat

SEQ ID NO: 6819666 - DNA, 66 bp, Homo sapiens
gccaggcaaaggcttccactgcatccttccaggcatgtggaggataaacacggagcttcccctggc

SEQ ID NO: 6819667 - DNA, 59 bp, Homo sapiens
gcagctctctggcctgccctggtgtgataatgctatcagctggttgtgggagtggctgc

SEQ ID NO: 6819668 - DNA, 65 bp, Homo sapiens
tggaaggatggtggaaagataagaagggtagctgatcatggctagtttctccgttttctacccca

SEQ ID NO: 6819669 - DNA, 100 bp, Homo sapiens
tcttaaaatcaagctgtgacatttgatttacttggtaggcaacggaaaaacactgaatttttttagcactaagtgatatgcttaaagtttattttacaga

SEQ ID NO: 6819670 - DNA, 91 bp, Homo sapiens
gtctgctacattttcttgtctcatctttcctcaaaagatccaagtttgggaaaagactggttgtgatcaggtggaaggtggagtagctgac

SEQ ID NO: 6819671 - DNA, 93 bp, Homo sapiens
gactataagctccatgaggacaggcaccttgtctgtcttgctcattgattttggtggcagacacagtgcctgtcacatgaggggagctcagtc

SEQ ID NO: 6819672 - DNA, 106 bp, Homo sapiens
tcttgcctgaagttgtcaccagggttgagtgtgtgtttttgagtgtgtgtttggcacacagagggcagaagatacatgtttcttagtctcacaactcatggcaagg

SEQ ID NO: 6819673 - DNA, 72 bp, Homo sapiens
ggctgtaggcttggcaagctcatagcagatcagagggtcaggaatatgagtgctgtctgtctagcctcagcc

SEQ ID NO: 6819674 - DNA, 59 bp, Homo sapiens
ttgttcactgtttcatccctagcacttaggagagtgcctggcacatggaaggtgttcaa

SEQ ID NO: 6819675 - DNA, 63 bp, Homo sapiens
gcagcctgcctggatgaatggcgccttgtgagagcgccgcagggctcacctccatggcagggc

SEQ ID NO: 6819676 - DNA, 73 bp, Homo sapiens
gggaggagttgtccaagtggatgttctcagctttctcatggctgggcccaggccacatggcagctcccatccc

SEQ ID NO: 6819677 - DNA, 60 bp, Homo sapiens
tgctgcggtggctggcgatgggagtgtttcctgaggctgccaccaagcccctcctcagca

SEQ ID NO: 6819678 - DNA, 63 bp, Homo sapiens
ccttagcaaattggcatcttctggaacagcaaggttccttccgaggtgtggatttggctaggg

SEQ ID NO: 6819679 - DNA, 77 bp, Homo sapiens
tgctatatttgacaaaggaaaaatgcacatacctaaaattcaaaggcattgcatttgctcatttgatatgcttagca

SEQ ID NO: 6819680 - DNA, 103 bp, Homo sapiens
ggatgttcagtggctagggattcccaggtcttgtttgacatcaattaccgtacagtttcctacattggtgaacaaatagggctataacttagcttagacttcc

SEQ ID NO: 6819681 - DNA, 56 bp, Homo sapiens
tttgacagtcccctgatgtttgcatgtagaagtgcagggattattacactgacaaa

SEQ ID NO: 6819682 - DNA, 81 bp, Homo sapiens
gattaatttggcctgtatgtatgtgaatagggcaacgattttaaaatattgtcttattttatcataagcactgaattattc

SEQ ID NO: 6819683 - DNA, 92 bp, Homo sapiens
ttttactatgattattcctgactagtggtttaaatcaagctgatttaaaccaagttgatttaaactactagtcaggaataatcatagtaaaa

SEQ ID NO: 6819684 - DNA, 58 bp, Homo sapiens
accttggcatggcctttgtccacatctcaggcagtggacatcttagtcatgtcaatgt

SEQ ID NO: 6819685 - DNA, 76 bp, Homo sapiens
tgattcagagtcgttacggtgggacccaaaagtctacatccaggtggccctgaggacccagtgtgggaatgagtca

SEQ ID NO: 6819686 - DNA, 56 bp, Homo sapiens
gggccttgccatggagcctgagtcctacaatcaggaatttctttgtgttaaggccc

SEQ ID NO: 6819687 - DNA, 80 bp, Homo sapiens
taaagatctccagatgtaagaccttcatgagggcttttagaagaaagtcccagtccccgtctctatgtctgagttccttg

SEQ ID NO: 6819688 - DNA, 67 bp, Homo sapiens
gggagcagcaggtggctgtgatggccttgcccctcctgtccctgaaggccctgcctgccacgctcct

SEQ ID NO: 6819689 - DNA, 58 bp, Homo sapiens
ggctgtgtttctgtttgacatttgcaattaattaccgaaatgcaatggagatgcagcc

SEQ ID NO: 6819690 - DNA, 83 bp, Homo sapiens
gaaattatatgtgtgttatctgttgttttggattctctacaaggctattctccaatgacatggataatcatatttttaatttc

SEQ ID NO: 6819691 - DNA, 120 bp, Homo sapiens
gaattcccaatgccaagttgcaataatacatttaatgcttttccttcaaataagaaatcaatagtatttatatatgaggttggggcaccagtgtctttgcaattttccaggagggaattt

SEQ ID NO: 6819692 - DNA, 97 bp, Homo sapiens
ggctgttcccagccctgtctgatccctccatagggcacagttccctgcggggaagtcctttgtctgtgttctccaggggcagctgctgggcccagcc

SEQ ID NO: 6819693 - DNA, 64 bp, Homo sapiens
gatgaaggaatattgctgagctagaaacttctaaggactctcttagctttaatattcccacatt

SEQ ID NO: 6819694 - DNA, 73 bp, Homo sapiens
gggaatcaggacagtgaatgagaatggagaaatgggaacaaatgcatttagtattctctatttccatcttccc

SEQ ID NO: 6819695 - DNA, 63 bp, Homo sapiens
tggtagtggatgttcagagatttgaacccaggtgtctggcttcagagtctgtgcattctgcta

SEQ ID NO: 6819696 - DNA, 80 bp, Homo sapiens
aggagctcagactgcacaccctggtctctgacaccaaggctcgctccatgcccaggactaggggcagcgtgggagctgct

SEQ ID NO: 6819697 - DNA, 90 bp, Homo sapiens
cagtttcctctcctctgtctgcatgtttacatttttgagaagttataccaatatctgtgaatgaaagacatgtatggaggcattaaactg

SEQ ID NO: 6819698 - DNA, 88 bp, Homo sapiens
ggatagtaagtggaagatgaaaatatgaaggctttgagaggttctactataatttctcaatattatatgtcataaatatatattatcc

SEQ ID NO: 6819699 - DNA, 78 bp, Homo sapiens
gatgaggactgggggggtctgggatgggtgccggggacatgcatctggagccagcccaggcccctctggcaattcgtt

SEQ ID NO: 6819700 - DNA, 91 bp, Homo sapiens
gagggcgtggctttctggtaccgtgtcagaaacccaagctatcgcgctgaggttccattcttgatcacgtgctcagttttagctacctttc

SEQ ID NO: 6819701 - DNA, 62 bp, Homo sapiens
gtgtttcctcacttacagactcaaagccagtatgtagacaggagttgtaaggaggaacccat

SEQ ID NO: 6819702 - DNA, 94 bp, Homo sapiens
tggaggaggaagtaaagctggaggctggggtagtggcaagatatgagcattcaggtctacaaagcttcaagtctctcattacttcactccatca

SEQ ID NO: 6819703 - DNA, 130 bp, Homo sapiens
cttcttacagcctccagaaaggactgggtttggaagtttattttaattagagtttaagagtaatgaacattaattacagtcaaacatatggacattcccagaagcatttctacaagcactatgttcattg

SEQ ID NO: 6819704 - DNA, 84 bp, Homo sapiens
gggagagtgaatgcgtggaggttgcaaactataaacaccaacttcaacacatattttttcaatcataggcattctctccttccc

SEQ ID NO: 6819705 - DNA, 56 bp, Homo sapiens
gcctttctctttgctgatcatgtctgatttggacaacaagagctaagggtaagggc

SEQ ID NO: 6819706 - DNA, 76 bp, Homo sapiens
ctgaatgccttattgtggatacgcagcctgggaggcagtgggtcccccaggcacagattatcccaatagaggttag

SEQ ID NO: 6819707 - DNA, 85 bp, Homo sapiens
tttactctattaggtatgcagcctatttgccagggtgagttatctcctcttagagtttggttatatacctagtctattttgtaaa

SEQ ID NO: 6819708 - DNA, 129 bp, Homo sapiens
ggacattgccagtgacccaggccccgtccttaccttcaaggctgttgcgaggtagtgagggaggctggcagcgtagtaggagcattgagggtatggaggtgaggccagggggagccatcaggcaggccc

SEQ ID NO: 6819709 - DNA, 122 bp, Homo sapiens
gtgcggggcgggacagggagaggggcctcctcgggaggagctgagtgtgtgtgcgcacgtgtttgcgcagatggagacgaggttccgccgaggcccgtctgtctgggagcgcctgtctgcgc

SEQ ID NO: 6819710 - DNA, 65 bp, Homo sapiens
tcctctgatatggatgcctcattgtcctctacatgagggcagtcagggacctccacatatgagga

SEQ ID NO: 6819711 - DNA, 105 bp, Homo sapiens
tgggcactcacacatgacacatggtggctggactatagtggggcagtgagagtacaagtaagagtctcctaaagtccttatcaagtgtaatcaggagtaaactca

SEQ ID NO: 6819712 - DNA, 69 bp, Homo sapiens
ggggcctatttgttcaacttccctcaaggtgacctcatcacagataagggatgaataatgaagggcctc

SEQ ID NO: 6819713 - DNA, 79 bp, Homo sapiens
tctgggattggtcagggccagggctccatttcctttaaaatgtaaattgtgcagctctgctcttattctcatcaccagg

SEQ ID NO: 6819714 - DNA, 71 bp, Homo sapiens
agagtctatattccatggtgatatgcaaatattaacagcttacaagtagttaagcatatcagatagactct

SEQ ID NO: 6819715 - DNA, 115 bp, Homo sapiens
ttcttaattttgtgttaatgagttagtagcagcattcagaggataagttatacaatctctcttgatgactgttgctggttttatttacttatttattcattaaaaaaattaagga

SEQ ID NO: 6819716 - DNA, 64 bp, Homo sapiens
cttgagcatccacaaagtttggtgtccttggggatcctggagccaatctcctgttgatgccaag

SEQ ID NO: 6819717 - DNA, 108 bp, Homo sapiens
ggaactaagtcttctaagcctcctaccctttctcttgcctttctcagaaggcagaggtattcagaaaagggcaagagagagggcaagaggcccaggagacttagttcc

SEQ ID NO: 6819718 - DNA, 80 bp, Homo sapiens
agggaaagctaagagcttgaagcatctgtaattggcattcaaagccattcatagtacagttctagcttttacattttcct

SEQ ID NO: 6819719 - DNA, 112 bp, Homo sapiens
ttttgactgaatttacaggtgaattcaatcaatgtgtcagttcccactgaactttcaagttgattgactacattgattgaataagttgacctattgtgttgtcagcttggag

SEQ ID NO: 6819720 - DNA, 60 bp, Homo sapiens
gctggtctgactttatgcagaggttctcttgttaaacttctgacatagcaggacctaggc

SEQ ID NO: 6819721 - DNA, 56 bp, Homo sapiens
atgagtaagtgaatctccaaaggtttcccagcccataatggagataaacttctcat

SEQ ID NO: 6819722 - DNA, 61 bp, Homo sapiens
atgatttttagtacattcttgggggatggcataagtcttctaggtcttgattgaatgtcat

SEQ ID NO: 6819723 - DNA, 107 bp, Homo sapiens
ggagcaggagagaacttttgggggtgacaggtatactcaccattgtgactgtggcggtggtttcatgggtgtacacatatgtcaaaacttaacaaattctatgcttt

SEQ ID NO: 6819724 - DNA, 59 bp, Homo sapiens
tttcagtgtaaggtttccaggagtaactcgagctgcttctgaaacttttactattgaaa

SEQ ID NO: 6819725 - DNA, 58 bp, Homo sapiens
cagccctgctgacactgtctgacccagtttgacaatctggatagaaatcatagggttg

SEQ ID NO: 6819726 - DNA, 64 bp, Homo sapiens
cagtgctggtgtaggctgaccaacttgttttggttttcccaggccgtacccatttttagcactg

SEQ ID NO: 6819727 - DNA, 100 bp, Homo sapiens
gagacagagggatcacttgagcccagaaggtcgaggctgcagtgagcccatgactgcgccactgcactccagcctgggcaacagagtgacaccctgtctc

SEQ ID NO: 6819728 - DNA, 93 bp, Homo sapiens
ttagtgtttggttgtgttaggtttcctaaatgagacaaagtcattaatgtttaaatttagaagaaacactgaattgaccaaaaaaaatactga

SEQ ID NO: 6819729 - DNA, 73 bp, Homo sapiens
gccgccgggaaacgggttgggggggttgccgcgtccggcggggcctgactctgacccgccgccccctggcggc

SEQ ID NO: 6819730 - DNA, 94 bp, Homo sapiens
aggtgttgtgaaaagttgccaagagataaattcaactgtttatgagaatcattatgaggttcagtgtttatttccctggcaccctccaagatct

SEQ ID NO: 6819731 - DNA, 63 bp, Homo sapiens
ccatgcagctgaagaaagagtggttagatgaatgtgtccagccccctttcttgagctctttgg

SEQ ID NO: 6819732 - DNA, 56 bp, Homo sapiens
ttctggagtattcctggcagccttgggagatgggaggtgccaggaatactccagaa

SEQ ID NO: 6819733 - DNA, 130 bp, Homo sapiens
ttctccttaacttgtcgaattctaatgctaatttcctgtatttctggttaaatgtgctaagcagtcttagctctatcacttgtgtatcagagatgagaggtggaggagttttttcgatatctaaatggaa

SEQ ID NO: 6819734 - DNA, 66 bp, Homo sapiens
gcaaggcagcgcggagtagctagaagctcagaaggaagctgagaattgttggctctggctgcatgc

SEQ ID NO: 6819735 - DNA, 64 bp, Homo sapiens
ccaggaaagcaaccagtccacattggagcaggaaaactccaggcttcaggagtggtttccaagg

SEQ ID NO: 6819736 - DNA, 77 bp, Homo sapiens
gtgacctttgctgtcagccgctattttcccagcagacaaatgcctctggagagtgagtggtaaagacagatattcac

SEQ ID NO: 6819737 - DNA, 56 bp, Homo sapiens
tgcctctgctgcatattcacctggaaatcatccacatgccaagcaccgcagaggca

SEQ ID NO: 6819738 - DNA, 59 bp, Homo sapiens
gtgtcctgttcagaagcttgggcagggaagagatgactcgggtgagttgagcaggacac

SEQ ID NO: 6819739 - DNA, 63 bp, Homo sapiens
cagggctggcttccaagttgttctgaaaatggtttaagagagcagggaaaggagtcagctgtg

SEQ ID NO: 6819740 - DNA, 74 bp, Homo sapiens
ggcgtgactcatctgccattcctgtacccctgagttctcagcactgctggtgcctgatggtgatgaggtcttcc

SEQ ID NO: 6819741 - DNA, 60 bp, Homo sapiens
tgctctcggttctatattcaatgtggcttttggattgcctcagaagttcagcctagagta

SEQ ID NO: 6819742 - DNA, 63 bp, Homo sapiens
agatgatatactacatggcttcaaagaagtttcctatctattggcttcaaagtgtgatcatct

SEQ ID NO: 6819743 - DNA, 61 bp, Homo sapiens
ggtcttcctgaaggatggcagcctccccagcagcaggtgaggttgatccagcaggacttcc

SEQ ID NO: 6819744 - DNA, 64 bp, Homo sapiens
aggggaagagccaaccgcaaagctttccagaatttagagccagaatgtttggacttttctccct

SEQ ID NO: 6819745 - DNA, 73 bp, Homo sapiens
tgaggggcagtgggggggccatgctgcaggtacaagttaatctccctgtatcgcctctgcccacttaccctta

SEQ ID NO: 6819746 - DNA, 64 bp, Homo sapiens
tgaaaatctgcacaattcagtttcagctctggataacttcagttgacctttgtgaaggttttta

SEQ ID NO: 6819747 - DNA, 95 bp, Homo sapiens
gaaggtatggacttggctaaattgagttatagatggactattattttacatcaaatcattgtcgaatggcatctgtagcttttaagtttactttc

SEQ ID NO: 6819748 - DNA, 89 bp, Homo sapiens
tgaagtgcagctctctgttttgttaatggtgtgtagaatgatctgacaaaaagttttcacaaactgaggagacaatgagcatcatttca

SEQ ID NO: 6819749 - DNA, 74 bp, Homo sapiens
actccacgctcgctgcctcgtggtggtctgggcagccttgtcttcgccacaccgcagcagcaggagcgtgtggt

SEQ ID NO: 6819750 - DNA, 99 bp, Homo sapiens
gagtggtttgtcccaggctgttggaaggggcagagtggctgccctcacccagggctccttttcagtgccctttccattgcaccttggcagcgcccattc

SEQ ID NO: 6819751 - DNA, 78 bp, Homo sapiens
gtggttaatgacacagtaatgtgtttcatctgataatggattaggtcagatgaatacagttttgtgagttctaatgat

SEQ ID NO: 6819752 - DNA, 92 bp, Homo sapiens
ttttatattttgcatttgcaaataatgaaagctcacatgggttgtaataattgttactagcttttaatattgggcaaagcacaaatacaaaa

SEQ ID NO: 6819753 - DNA, 56 bp, Homo sapiens
cttcatggagacacgcgtctgccttgtagaatgttacaggctgcctgttcctgaag

SEQ ID NO: 6819754 - DNA, 130 bp, Homo sapiens
gtttatggaatgttaatataaatcaaatgtggtgcatgaaacaaaaattaggatagtaatgatggtatcaataaaaagaataataaccaacatgctgggtgtttttgatgtatcagatatatttctaaat

SEQ ID NO: 6819755 - DNA, 61 bp, Homo sapiens
gagagtcttatctcgttaatgaatgaaaaatagaaatcaattattctgagatgagattctt

SEQ ID NO: 6819756 - DNA, 55 bp, Homo sapiens
tgggggccagctccattgtgaataacaccaccgtcttcaagatggatggctccca

SEQ ID NO: 6819757 - DNA, 71 bp, Homo sapiens
gccattccttctgcagctgtctcgcaggcatggacaacctgcgcgagactttcctcagcctcgaggatggc

SEQ ID NO: 6819758 - DNA, 61 bp, Homo sapiens
ctcctgggcttcgaaggctcccgggcccagtaagaaggaggtgggtgccaaggttgaggag

SEQ ID NO: 6819759 - DNA, 104 bp, Homo sapiens
ctttgtggttttgatggagacaaatgagacatcaattcccccaatttcctttgagggaaaagaagtttcctttgtaagttttccttcaaaagccagccacaggg

SEQ ID NO: 6819760 - DNA, 103 bp, Homo sapiens
cactgttatttttctatgtgtctttgagactctgctacagtgaaacatgaaacagaacaaattagcaggcatctcagagataattaatggtttgaatgatgtg

SEQ ID NO: 6819761 - DNA, 68 bp, Homo sapiens
ttctccctctcagttcttgcttaggcaactctctgcagtccccttggcagtggagtgaggtgggagag

SEQ ID NO: 6819762 - DNA, 56 bp, Homo sapiens
agtgtttttcaggagcagaacagggattaattgatcttttgtctctgaataatatt

SEQ ID NO: 6819763 - DNA, 125 bp, Homo sapiens
tcattcctctggggcctgggttccgtctccacctgggcactgagaacttggggacagaggttgccagtgacctcccaccgtatctcagtggcatggggttagggacatgggttctggaacagtga

SEQ ID NO: 6819764 - DNA, 129 bp, Homo sapiens
tcagttgaatttaaatttcagataagcaaggaatacttttttttagtataagtatgtaccaaatattacatgagacatacttatgctaaaaatatatttgtggcttacctgaaattcaaatataactgg

SEQ ID NO: 6819765 - DNA, 80 bp, Homo sapiens
gcagcttgtggtctttggctgcattcgagttgctggaacatttatctaacaacccaaggtgccagagctactaacgctgt

SEQ ID NO: 6819766 - DNA, 55 bp, Homo sapiens
tttggagaggagaagtcgaagttagaatgcctccatgttgcttcttttctctagg

SEQ ID NO: 6819767 - DNA, 69 bp, Homo sapiens
gcgctgcctctgctctccccacatcccgcacccgaggtttccgccccggcggggagactagcgcagcgc

SEQ ID NO: 6819768 - DNA, 55 bp, Homo sapiens
gtattatgttccttgcttctttaggctgcttctaaagaggttgaaaacctgatac

SEQ ID NO: 6819769 - DNA, 74 bp, Homo sapiens
tactgcagtgctgagtgactttttcttcatcgaaagaacgaaatgagggctgagatttattcaacagctcagta

SEQ ID NO: 6819770 - DNA, 77 bp, Homo sapiens
attctctgtttattcagcatttagaggaaggattaaaaatgctcacttcttcatttaaatgctaaggattcaggaat

SEQ ID NO: 6819771 - DNA, 95 bp, Homo sapiens
ggcctggctgctgttcccactggagacctggcatcttctccccgacctaaaacaatgaaagcagtgctcagcccggatgagatcacggccagccc

SEQ ID NO: 6819772 - DNA, 66 bp, Homo sapiens
ggactgtgtgggtgtctttcagtattctctttctacttctgctgcagctgcaaaaacatacagttc

SEQ ID NO: 6819773 - DNA, 90 bp, Homo sapiens
ctgctggagcagagggcatggccatttaagcttttggtcaacacagtgtgatgggcctgcctgaaggctgtaccagttgactcccagcag

SEQ ID NO: 6819774 - DNA, 81 bp, Homo sapiens
gttaatgctttcattttccccagcattggacagcaagccaaaagcagtatcctgctggaatggaaaatgaaggaaacatac

SEQ ID NO: 6819775 - DNA, 77 bp, Homo sapiens
gccagtgagaaagtcatgtatgttggaacagtggtctgctagctgctccaggggtcaggatacatgcatctgctggc

SEQ ID NO: 6819776 - DNA, 70 bp, Homo sapiens
ctggtgtggctcatgtggttggtcctacttgccctgtgtgtcggggctgccagccataggccagcactgg

SEQ ID NO: 6819777 - DNA, 63 bp, Homo sapiens
tctatctccttcctgccccagtgataaggcctcagcttactccgccctgcaggaaggcataga

SEQ ID NO: 6819778 - DNA, 116 bp, Homo sapiens
gtaagtggcactgggcaaggcccccagagcagggcaaggtctctagagcgggtctcccacatgactggcttcacacaggcacttccgctcgggttgcatgctctgtgtcatcttac

SEQ ID NO: 6819779 - DNA, 78 bp, Homo sapiens
ggtaagaactggccttcctgaggggtcactgctcttgtcttccccttcagccaccctccaggcgggcttgtgactacc

SEQ ID NO: 6819780 - DNA, 72 bp, Homo sapiens
ccctagtctagactatctggcagataaattaaccaggaaatgggttttgatgtgaggatggtcatgggaggg

SEQ ID NO: 6819781 - DNA, 80 bp, Homo sapiens
ccagtttgcagctgtttcgggtggaggtggaggaagttacgaatctattctacttatttcttggtacaaatttaaattgg

SEQ ID NO: 6819782 - DNA, 56 bp, Homo sapiens
atgacaggaggcttgtcttgctctgggaggttggggcaaagttgagtgcctgtcat

SEQ ID NO: 6819783 - DNA, 83 bp, Homo sapiens
agacctccaatcaataggtgatatgagctgggctacatcattagtcagggctaattagaatctagttcattcatttgaggttt

SEQ ID NO: 6819784 - DNA, 60 bp, Homo sapiens
ctgaagggctggatctctctgagcatctccagttgctccagggctgccagaccctcacag

SEQ ID NO: 6819785 - DNA, 130 bp, Homo sapiens
ccttgctcttgtaggagctccctgggcccctgggttccccactctgggccaccacaatccatgcagcatgcaggtttgttccgtttcccagatggagaggctgagggcttaccacagggttccgtcaagg

SEQ ID NO: 6819786 - DNA, 68 bp, Homo sapiens
catatctttccatggccacacagtcttgttaacacacggtgggcagagtggcctggaggtggtcagtg

SEQ ID NO: 6819787 - DNA, 100 bp, Homo sapiens
tggggcttcaggccagagaaggctggctccaaaagcaggggctagatcccctggctatgcctttgtaacaggggcccaagagcctttgccacctgctcca

SEQ ID NO: 6819788 - DNA, 56 bp, Homo sapiens
tggtaattacaaggagtcgggtaattcctttgaaatccatcttgatgtaatagcca

SEQ ID NO: 6819789 - DNA, 68 bp, Homo sapiens
gtttacagtggcttcattggatttggttgaaaacacaatggtggcaatagcagtgtagtctctgtgac

SEQ ID NO: 6819790 - DNA, 114 bp, Homo sapiens
aaagaaaggatgtggcatttcccaaacatatttatctcagagctcacacctcctggagtatcttgggtgggggatgagtgctgggcaggaaatgggtatgctaagtaaagcttt

SEQ ID NO: 6819791 - DNA, 76 bp, Homo sapiens
tcaaatatgttcaaaatagatcactagtacagatgcagcaaaggcaaaaacagtaggatctgttgaataaatttga

SEQ ID NO: 6819792 - DNA, 82 bp, Homo sapiens
agagcctgtgaatggatgtgcagtcagggaggttttacatcaccaagattcctatcccagaaacgcatatgttcatagctct

SEQ ID NO: 6819793 - DNA, 68 bp, Homo sapiens
gcaatctgaaacattctgtcagattcctctccaaagaaaactttggcagctgtcagaatgcaaattgt

SEQ ID NO: 6819794 - DNA, 68 bp, Homo sapiens
agacagaggtgtccctgaccctttgcaacacttctgaatcattgtggttactcgggacacctgtgttt

SEQ ID NO: 6819795 - DNA, 88 bp, Homo sapiens
gagggcagtgtccccagggggagcaccatggcgcagggatcacagggtcttcttgaaacctgctccctcaaatgctggcagtgtcctt

SEQ ID NO: 6819796 - DNA, 112 bp, Homo sapiens
aggttgttgttgttcttgctgtttttaagaacacatgagatttatatttttggaggcctgtgtccttctgagatgttgttttacagattctttaagcgagacctaacaattt

SEQ ID NO: 6819797 - DNA, 69 bp, Homo sapiens
gcctgggaccagggaaaggggagccaagcgtcagcctggtctctctagtgccatgaaagtcctccaggc

SEQ ID NO: 6819798 - DNA, 73 bp, Homo sapiens
gtgtctaaaatcttgagatgtcatctgctttggtaacagtggctaaagacaacacatcctcaagtttgtacac

SEQ ID NO: 6819799 - DNA, 62 bp, Homo sapiens
tgtagtgaggggatcttgtctggctttctaagagaatatgaagcaggtgaacctccagtaca

SEQ ID NO: 6819800 - DNA, 88 bp, Homo sapiens
gaaagaaaaagagtgatctgggagtccctgatcctgctaatgaaatcatgcggcaggaaaaccttcccatgtttctgatttttttttc

SEQ ID NO: 6819801 - DNA, 69 bp, Homo sapiens
tatttttgatattttgcatgtacatgtttgctgttctaggcagcacttcagcattcagatttgggaata

SEQ ID NO: 6819802 - DNA, 64 bp, Homo sapiens
acacagggcactggtcttcccagcgaactctgaaatacagatacggtgcccccagtccctgtgt

SEQ ID NO: 6819803 - DNA, 76 bp, Homo sapiens
ggtagcaggagatgcaaagttcctactttactggatgctggaatttcaggtccagaggaaagtttgcaaagctacc

SEQ ID NO: 6819804 - DNA, 56 bp, Homo sapiens
ggaccctcccagctcacgcaccatggcttgaaactgcagcacagctaggagggtcc

SEQ ID NO: 6819805 - DNA, 73 bp, Homo sapiens
acaccgagcatccttttttcctgccctgcggctgctccaggctgagagcagactctcaaagctggtttggtgt

SEQ ID NO: 6819806 - DNA, 78 bp, Homo sapiens
agggtggtagggacactatgcagaaaggcttgggttaatgagcactttctggattgagtgtctctcctgattaaccct

SEQ ID NO: 6819807 - DNA, 71 bp, Homo sapiens
ggcctcccaaagtgctgggattacaggcgtgcgccaccgcgccaggccgatccttgcacttttcagagccc

SEQ ID NO: 6819808 - DNA, 66 bp, Homo sapiens
tggggtctggtcatcggaaagatcaaagcatgatgagatggttggagctttcagtgccaccctcca

SEQ ID NO: 6819809 - DNA, 128 bp, Homo sapiens
tttacttactgtgttttttcccatctataatccaagcttcaggaggtcggtctcctttttgtattgttttgtattcacaagtggacccttcatggtgcctggcatgtagtaggcaccacaggaatgaa

SEQ ID NO: 6819810 - DNA, 58 bp, Homo sapiens
cttgaccttgtgatccgcccactttggcctcccaaagtgctgggattacaagcatgag

SEQ ID NO: 6819811 - DNA, 84 bp, Homo sapiens
tccgacgcaggctgccaaggctggggaggacaaggttccctcttgagttctttaaaagctgggccattggtgagttctgaagga

SEQ ID NO: 6819812 - DNA, 58 bp, Homo sapiens
tgggtggcatgtttatgtcagaatagatgtggtctatttttcctggaacagtcaccca

SEQ ID NO: 6819813 - DNA, 95 bp, Homo sapiens
gggctagtgtctccttactgaagggccaggggcaggctggaaggcagggtccccagtccagtggcaccttggccctcagcagtaagcaccagttt

SEQ ID NO: 6819814 - DNA, 67 bp, Homo sapiens
gcagtctgtctcaagttcttgcactcatatcactaatgaaaagagttatgaagtttgacacaactgc

SEQ ID NO: 6819815 - DNA, 55 bp, Homo sapiens
catgtgttgagtataggcttcgtatgttattacgaataaatctatttcacacatg

SEQ ID NO: 6819816 - DNA, 78 bp, Homo sapiens
caataatctagaagtttatagatgtctgtattataaattttaattggtagtgggtggcatttataattttagtcagtg

SEQ ID NO: 6819817 - DNA, 78 bp, Homo sapiens
ccttccacccgatgggaggctgtaacttgggcactggggtgactttttccatgcccttgtcatctccagggtgggagg

SEQ ID NO: 6819818 - DNA, 83 bp, Homo sapiens
tattagaggggacagtttttaatcctttcatggggataatgaaaatatctttgacatggattgaaaaccagtgtttgttgatg

SEQ ID NO: 6819819 - DNA, 129 bp, Homo sapiens
gtgtggtggctgggtggatgagggcataggaaagcagctggcgactctcctcgatgaaagcattgctctcgattgagtaggccagcactttctgcagtagcctcatgtactccgacttggcctctgtgt

SEQ ID NO: 6819820 - DNA, 65 bp, Homo sapiens
acaatgaatttaataccttatttcacgttcaaggaaaccaggggtagggcagttaagtacaatgt

SEQ ID NO: 6819821 - DNA, 124 bp, Homo sapiens
acgttagttcccaaatgtgcatttggcacaagaatcccaacagccagtgcaactggctttcatcagcaggttcacagctgtggggttcccgttgccgtctgcatgtggttttggagcgtgacgt

SEQ ID NO: 6819822 - DNA, 63 bp, Homo sapiens
gtactaagtcaggagaagaattgccccctgaaggggaagaagtctgtaacttgatcttggtat

SEQ ID NO: 6819823 - DNA, 71 bp, Homo sapiens
ctggcttccttcctctctttcctaattcagcccaagagtcactgagcaggcacaagaaagggaggtgacag

SEQ ID NO: 6819824 - DNA, 67 bp, Homo sapiens
attttacttcccatcactctggaatgggtaaaaaactgaactttttacactagtgtgggaagaaaat

SEQ ID NO: 6819825 - DNA, 67 bp, Homo sapiens
aagccagaactattgggaaattacagtttgctggagcaaactgctgtggcctagtacttactgcctt

SEQ ID NO: 6819826 - DNA, 72 bp, Homo sapiens
atgtcacctgttgctctgggctatctgagaaaggaggtaggtgccactttcccagccccagtatagagatgt

SEQ ID NO: 6819827 - DNA, 64 bp, Homo sapiens
gggcttgataaatgttgaaatagctgctatctatagttattcatcagtgcattaatttcagccc

SEQ ID NO: 6819828 - DNA, 55 bp, Homo sapiens
tgggttactttatttcaggggttacagaaattctcctgaaattctcactagctta

SEQ ID NO: 6819829 - DNA, 59 bp, Homo sapiens
agcagtcctccagtgtgttttagaatcctattcattgctgacactgggagaagactgct

SEQ ID NO: 6819830 - DNA, 65 bp, Homo sapiens
gagtagtcacattgggaatgtaagttatctgctcctacaacttatttttcctgctggatctgctc

SEQ ID NO: 6819831 - DNA, 61 bp, Homo sapiens
tgtgagcaccccgcaaatgtgcaagaatattatcagttcggcatgtgtggtgtgctccaca

SEQ ID NO: 6819832 - DNA, 89 bp, Homo sapiens
cacacccagcactggctcacgagggtcctggggagagctagaacagactggcactgcctggcagggccccacgggagccactgactgtg

SEQ ID NO: 6819833 - DNA, 65 bp, Homo sapiens
ggcttgtctgcattgtttctatgggaaatgtgttctgaattcctaaaacaatgtgcaaacaagct

SEQ ID NO: 6819834 - DNA, 61 bp, Homo sapiens
gcatctgagcttctgcctgctgcaagaccgagtctggccccggcatctgaagctcattagc

SEQ ID NO: 6819835 - DNA, 88 bp, Homo sapiens
gcagaagccagctccctcctcatccctctgccaggcccagggctgagcagtcctggggcaggtgggtgaggaaggcagatgtggatgc

SEQ ID NO: 6819836 - DNA, 59 bp, Homo sapiens
ggcaataaaagtatccagtttcccagatgagaaaactgaagtgggtgtaagttattgcc

SEQ ID NO: 6819837 - DNA, 116 bp, Homo sapiens
ctgcatagggctccaaatgcatctatgtgccctttctgctttgcagacagtgttccaagtatctggctgcaaagattgggtaagtagagcattcataatggctttcacacatgcag

SEQ ID NO: 6819838 - DNA, 67 bp, Homo sapiens
gagccagtcagtggggcctgggcctcctgggaggaaggaagaggcctgagtcccacctggctgtctc

SEQ ID NO: 6819839 - DNA, 77 bp, Homo sapiens
ggaaagagagaaatttgtcactgagagagttagaaattatttcaagatttgtagatagtgtaattatctcactttct

SEQ ID NO: 6819840 - DNA, 72 bp, Homo sapiens
cagaattctgagtggcattggaatttgtgttgcatgaccagctctgtgatacttgaatgtgttagacttctg

SEQ ID NO: 6819841 - DNA, 81 bp, Homo sapiens
ctgatcttcattaatgtttccagtctatgatggtttcgtgttatggtgtccatggatctggaaatgggaaaggagatgaag

SEQ ID NO: 6819842 - DNA, 66 bp, Homo sapiens
ttttgaccatgctggcatctttgaagaagcaggaaaaaacccaagcttctcatccagcattcaaga

SEQ ID NO: 6819843 - DNA, 104 bp, Homo sapiens
gaacaattaatgtggataattcaaagacattggacaatccagaggtcctcatttgacctgtgttgctatagtctaatgttctagatttaatttatatggtgttt

SEQ ID NO: 6819844 - DNA, 59 bp, Homo sapiens
cccttccgccaatcctatgaagtcggacagctacctgattttacagatgaggggaaggg

SEQ ID NO: 6819845 - DNA, 68 bp, Homo sapiens
tagatgatggactatttgcatatacttagagtcattgagatcatatgtacaaggtctaggcaagtcta

SEQ ID NO: 6819846 - DNA, 59 bp, Homo sapiens
gcttttatgtcataaggacactcaagaagccctatgagaaggcctgtgtgacagggagc

SEQ ID NO: 6819847 - DNA, 65 bp, Homo sapiens
tgcatggttaagcgaaaatatgtggaacctgggaaagatctgcaatcttcactcttaactgtgca

SEQ ID NO: 6819848 - DNA, 90 bp, Homo sapiens
ggagttgcaaagcactttgctgttataatgatagctcccttgatgtctgttcattattaactgcttttcaaaagtgctgctttcaactct

SEQ ID NO: 6819849 - DNA, 64 bp, Homo sapiens
ggagaaagtcagctccaagcagcaccctttgtgaggggcaattgttttgagtgtgattgtcttt

SEQ ID NO: 6819850 - DNA, 71 bp, Homo sapiens
tgaaaaaacatcatcctttgagtatttaggggcaatatcctaaaagaccacaaggtggtaatgtaatttca

SEQ ID NO: 6819851 - DNA, 71 bp, Homo sapiens
agccaacttctctggttgaggtccaatttctgtggcacctgagattcccctggctagagaagctgtgtgct

SEQ ID NO: 6819852 - DNA, 55 bp, Homo sapiens
gaggccatttctgcttggacacctgcagcccttggtggcccagagatgctgcctt

SEQ ID NO: 6819853 - DNA, 87 bp, Homo sapiens
tctgctgtcactgtctggaggacaggggctgcagcacactggggtaaccatgagcagcacctctgttctttggtagttgttttcaga

SEQ ID NO: 6819854 - DNA, 59 bp, Homo sapiens
tctctcacatgaggggagcattcacgattgcattttctcaactctgttcaagtgagagg

SEQ ID NO: 6819855 - DNA, 76 bp, Homo sapiens
ctttgacaactcaggcacctcatataagcagaatcgtacagtatttgtgcttttgtggctggcttcttttgtttag

SEQ ID NO: 6819856 - DNA, 57 bp, Homo sapiens
atgccctctgtagccgttctcagcctacaaccgcaaggctgaggccagagtgggcat

SEQ ID NO: 6819857 - DNA, 59 bp, Homo sapiens
tcatatgctggctttgcgagatgcattgcttctgtaatcaagtacaaagcagtatatga

SEQ ID NO: 6819858 - DNA, 66 bp, Homo sapiens
tccggatggctgtaaaaggtgggaaacaggtgtgccccacattcctactcctgcagctcagctgga

SEQ ID NO: 6819859 - DNA, 55 bp, Homo sapiens
gctcctctctgggcctcacgcgcccgtcgggggctgagaaggtgtggagatgggc

SEQ ID NO: 6819860 - DNA, 58 bp, Homo sapiens
tcctgggaggctgtgcctggcttcccaactgagagggcccggcacagccccgcggaga

SEQ ID NO: 6819861 - DNA, 55 bp, Homo sapiens
ctgggaaatgagacagtatttggtagacgtaacaacccaatacattcattcccag

SEQ ID NO: 6819862 - DNA, 72 bp, Homo sapiens
cttgtccctgcctttaggggcctctccctctccccaagaaaagtggtctcactgaagtttaccaggttcaag

SEQ ID NO: 6819863 - DNA, 57 bp, Homo sapiens
gccctggaaaggaacctgggcttacttttccacgccagcccagtccttgtcctgggc

SEQ ID NO: 6819864 - DNA, 59 bp, Homo sapiens
agcacagcatttaaagaaaatgaactcatctagtcattaaaggttttaaatgctctgtt

SEQ ID NO: 6819865 - DNA, 60 bp, Homo sapiens
gttgactgaaggtcacagactcctgtcaggtggccctgtgtgtctggatttttcggtaac

SEQ ID NO: 6819866 - DNA, 129 bp, Homo sapiens
ggacagggccggcctctgctgcctcacacccacctgtctggccaccagggcgatagtcccccctttggcctaggctgacgattgtcctggaggaccacaggctggggcagccaagcacaggcccgactc

SEQ ID NO: 6819867 - DNA, 122 bp, Homo sapiens
gtcaaagaaaggaatgggtcaggcctgagtaggctgagcagttctccttggtaggggctgccctgtgagctccacactgaggggaactgattggaatatggggactggttctgcctagtgac

SEQ ID NO: 6819868 - DNA, 77 bp, Homo sapiens
agaggcccagattagaagctgaatgttcattttcctcttgtgtctattccttttgtgtttggtttgactgggtctct

SEQ ID NO: 6819869 - DNA, 67 bp, Homo sapiens
ccacagttcttaaaacttgaattacttttctctgtgaaataagacaggtagtaagaacattttgtgg

SEQ ID NO: 6819870 - DNA, 68 bp, Homo sapiens
gaaatgtatgtcttcccccattgcagttcagttactttggagaatatgggaggaagagaagatatttt

SEQ ID NO: 6819871 - DNA, 82 bp, Homo sapiens
aagaagccttaagataagagcgagagattcaacagcaagtactatctgtaagaactttgatttcattgcatttaagcttctt

SEQ ID NO: 6819872 - DNA, 58 bp, Homo sapiens
tagaaagtggttgagagtttaggttctggagccagactgagttttaatcacttttcta

SEQ ID NO: 6819873 - DNA, 55 bp, Homo sapiens
cccttggctttagtttctaaagaagacttgttcctccaagaaaccaaaccaaggg

SEQ ID NO: 6819874 - DNA, 67 bp, Homo sapiens
actcagggcgtccttccccagctgagcccgaggggcagcggccggtgaggaaggggagctcgggggt

SEQ ID NO: 6819875 - DNA, 65 bp, Homo sapiens
gacagagtgcagggctagaagaagtcaaggcttgaagcccgaccccttgggccctgttctgtgtt

SEQ ID NO: 6819876 - DNA, 71 bp, Homo sapiens
agattacagcatgggaatgggatttaggctcgtcacatttggttgactgagcaattcttatgctctgattt

SEQ ID NO: 6819877 - DNA, 58 bp, Homo sapiens
gtgcagaacgtgcaggtttgttacataagtatacacatgccatggttgtttgctgcac

SEQ ID NO: 6819878 - DNA, 91 bp, Homo sapiens
tcgtcttatgatgttgcatatggaccaacttcttaattgataaatattgataaagttactgtttcattgagactatagacatcagaatcga

SEQ ID NO: 6819879 - DNA, 65 bp, Homo sapiens
cagagcagatgtaagagccaggtctttggtcacggcgccagcatctgaaaagcatttgcagtttg

SEQ ID NO: 6819880 - DNA, 62 bp, Homo sapiens
atttgtgttgtattaagctgctaagattatagtaatttgtgatgcagcaatagaagacaaat

SEQ ID NO: 6819881 - DNA, 72 bp, Homo sapiens
ggagtatctgtcatctcccagtgatggatgcttgcacaggaagcatccatccatgtaggaagatggtgctcc

SEQ ID NO: 6819882 - DNA, 82 bp, Homo sapiens
gaaatgaggacaaaatccaaacttcttagcagaatttacaactccctgcaagttctggcttttgtccttgcaatctcatttc

SEQ ID NO: 6819883 - DNA, 79 bp, Homo sapiens
ggatataataagctactgcttacaaaaggaaagaatacaaatatgtgtcttgcgtggggtaggcattgcttatttgttt

SEQ ID NO: 6819884 - DNA, 75 bp, Homo sapiens
gtagttaaatggttaagctggggttaaatgcagggagtctacctcctgggtgtgtcctcttaactattatgctgt

SEQ ID NO: 6819885 - DNA, 66 bp, Homo sapiens
ggaacctagaatccatctgcttattataatctctgtaatttgcacacagtggcattcttggcagcc

SEQ ID NO: 6819886 - DNA, 85 bp, Homo sapiens
gcaagtttagggtatttaactataatgagttaacttagtgctgataggatattcatgaccccatggttgattgaaatgagcttgc

SEQ ID NO: 6819887 - DNA, 85 bp, Homo sapiens
aacattttgaatatagcagaggcaaggatgtgaatgtttgcttggcgctatttatcaggaagtgcttctgcttgtttattatgtt

SEQ ID NO: 6819888 - DNA, 74 bp, Homo sapiens
ttcactgacaatgcgtttaggacataaggagaactataaaacagtgcttctccaacttaaatgcatagcatgaa

SEQ ID NO: 6819889 - DNA, 55 bp, Homo sapiens
atgatggaggtgtcctggatttgaaagatctcagtttctgggatgattttcacat

SEQ ID NO: 6819890 - DNA, 60 bp, Homo sapiens
cagcaaagcttaatttatatctgagggaactgagactcagagagatgaactgacttgctg

SEQ ID NO: 6819891 - DNA, 75 bp, Homo sapiens
atgctagaggaaacacaattggtgtgaaggctaagtaaactgagaggactcagatcatttgtggattcactgcat

SEQ ID NO: 6819892 - DNA, 66 bp, Homo sapiens
ggtagcaggtagtgctaaagacttactagactgcatgtttgtgctttctgctgcattcctctaatc

SEQ ID NO: 6819893 - DNA, 57 bp, Homo sapiens
tggtggctcacgcctgtaatcccataactttgggagcccgaggcaggcagatcaccg

SEQ ID NO: 6819894 - DNA, 94 bp, Homo sapiens
ggcattagttagattctcataagtagcgctcaacctagatccctcgcttgcgcagttcccagtaggcttggctctcctatgagaatctaatgcc

SEQ ID NO: 6819895 - DNA, 74 bp, Homo sapiens
cctattttgaaatttcaagtggcatctttgatctgattccttaggcattagatatccttgaagttatagtgagg

SEQ ID NO: 6819896 - DNA, 57 bp, Homo sapiens
cttcctggtctccagtggttcttactgggtagtgctggacaacagagtaccaggaag

SEQ ID NO: 6819897 - DNA, 58 bp, Homo sapiens
gtttcctcagctagactgtgggtatcataacaacggctcacagaatgttgaagggaat

SEQ ID NO: 6819898 - DNA, 125 bp, Homo sapiens
aaatttggaagaaagatcaaaattgactttttaatggggtggctagaatgagtgtcagttacagtgctagacactagggatttagtactgaggaaagttggtcgtggtctttataactcagtgtt

SEQ ID NO: 6819899 - DNA, 67 bp, Homo sapiens
tgagttatgtttgcttggaacttgtgagctgtaactgcttcacattttcttaggaaacttaaattta

SEQ ID NO: 6819900 - DNA, 126 bp, Homo sapiens
aaatagatgcctcttatagataacaaagctctcattgcatttattcactggcagtatttattcatttagctccaactgtgtgtgaggcactgacaatgctgggtatggggctggctggcactattt

SEQ ID NO: 6819901 - DNA, 80 bp, Homo sapiens
tctttacagaggtaatcaagttaaaatgaggtcgttagaatgggccccaattcagtgtgactgatggctttatgagaaga

SEQ ID NO: 6819902 - DNA, 60 bp, Homo sapiens
ctcactgggagatgtgggaaggggcgtgggacgcacgcggtcactccctctcctagtgag

SEQ ID NO: 6819903 - DNA, 61 bp, Homo sapiens
acagaatcgacctttgcatgcaatgcaatttgtacagaattgctttgcaggtggatttagt

SEQ ID NO: 6819904 - DNA, 108 bp, Homo sapiens
gcctgtgaaaagctggctgctgccaccagaggtaggcagggtgacttggcttcatgcagggaggccaagatagtcactttcctgctgtgcagcctgctgtttatgggc

SEQ ID NO: 6819905 - DNA, 119 bp, Homo sapiens
gggattgatttagcacatgaatgataagggtaagatattatataggggtgccaaaactttctatcttccaggcacttctggtgtcatactgcatttaggtcttactatttttttctccc

SEQ ID NO: 6819906 - DNA, 103 bp, Homo sapiens
tggaatatgtaactgtggctaataattagtatttatcttttcacacttcattttctatgtgcatgaatgcaagtattgtttgtttagccaacaagtgcttcca

SEQ ID NO: 6819907 - DNA, 61 bp, Homo sapiens
aagatgcttgcaaatttctgaagcctgggagagaaatcctagcagacctgacaaatatctt

SEQ ID NO: 6819908 - DNA, 56 bp, Homo sapiens
gagctgcagacttgatacaggaaggatctcttccatgattctgggatttggagctc

SEQ ID NO: 6819909 - DNA, 56 bp, Homo sapiens
ccggagctttaaccacagcagcctttactggacactaagggctgcaaaggctctgg

SEQ ID NO: 6819910 - DNA, 69 bp, Homo sapiens
acagtgggatatcagggcccagtctgtgcatctctcattccagggaggccggggccctgaatccactgt

SEQ ID NO: 6819911 - DNA, 80 bp, Homo sapiens
gagtgttcccattttggatgcggattggtacggtagaggaaatgagaagccaacaagtgccaagtatccagggattactt

SEQ ID NO: 6819912 - DNA, 76 bp, Homo sapiens
ttagttgtggtgagctctttgataaatatgtgacaaatcttactgagcatctattatttgcaaagaactacactag

SEQ ID NO: 6819913 - DNA, 69 bp, Homo sapiens
cagtaaacaatgcctttttggggaaataactttatgcagttaataaactaaaaggcatttgtttaattg

SEQ ID NO: 6819914 - DNA, 130 bp, Homo sapiens
gccagctcgtcgctctctgtagcctgaaagctgtacagggccacggactccatgccgctgctcggggctccagcagctgggctcagagctgggccgacagcttcctgcttcctctgcagtcgaggacggt

SEQ ID NO: 6819915 - DNA, 60 bp, Homo sapiens
ggagagcagaagtcacagttggaatattgcaatatcctcctaactgattctgcagtctct

SEQ ID NO: 6819916 - DNA, 55 bp, Homo sapiens
tgaacttgaattttggaaatactgagggctcagtattgctgctattgtcagttca

SEQ ID NO: 6819917 - DNA, 97 bp, Homo sapiens
tgggtctgaaacacttctttaccaagagatagagtcctcactgcctgtgcaagattcatcaccttgagtggaagtatcatttcctgtttcagactca

SEQ ID NO: 6819918 - DNA, 64 bp, Homo sapiens
atgttctttgccttattttaaactttattgtaataaattcactaatgaagcaggcagagaagat

SEQ ID NO: 6819919 - DNA, 71 bp, Homo sapiens
gttaatggaagactcatatgccagggtaaagtgtctttattttattctaagtatgatgggaggccattgac

SEQ ID NO: 6819920 - DNA, 59 bp, Homo sapiens
gaggtaccatggcacatatggtgatggtttattgctacactttgtgatgccgggagctc

SEQ ID NO: 6819921 - DNA, 61 bp, Homo sapiens
tcagttacacataaacattaaaggggcctgacttagggcgctctttgcctctgtggactgg

SEQ ID NO: 6819922 - DNA, 59 bp, Homo sapiens
cccctgataaacccatcagatctcgtgagacttattcactatcatgagaatagcagggg

SEQ ID NO: 6819923 - DNA, 75 bp, Homo sapiens
gtgattacataggattatcttttagtgcaatatttgtttttgtattctattgaatgataatctatatatggttac

SEQ ID NO: 6819924 - DNA, 101 bp, Homo sapiens
tatcagtcctgatagaacaaattctttctgcctattggagtctagataaaattgacagattggatgaaggcagaaggaggtgagctagaatgacgatgata

SEQ ID NO: 6819925 - DNA, 86 bp, Homo sapiens
cctctgctccatggctctctccttactgctgccaattcccacccatccatgggtcatgcataggctgagggagagctatcaggagg

SEQ ID NO: 6819926 - DNA, 55 bp, Homo sapiens
gttaggcatattgtacaatctagggatacttggaaagtacaagatatgctctgat

SEQ ID NO: 6819927 - DNA, 96 bp, Homo sapiens
gggggatcaattccttccactgtccaggcactttaggatcaggttgaaaccccctcctttcagaatctgaaaagcgcttggtcggggagatcgccc

SEQ ID NO: 6819928 - DNA, 75 bp, Homo sapiens
actacttttaaaatatcagcacttttgtggtataatagagcctattaacaacagttggctgacattagaggtagt

SEQ ID NO: 6819929 - DNA, 56 bp, Homo sapiens
cactgattgcttttggcctctgaggagctacagcaggctgagactgtgcattagtg

SEQ ID NO: 6819930 - DNA, 62 bp, Homo sapiens
agcttctggcgttggaggtctgagttctcgcgggccacgcgttcgatatccgcccggaggct

SEQ ID NO: 6819931 - DNA, 79 bp, Homo sapiens
agaatatccacactgaggagattgatattcgaatgattaactttctttaaaatgttaaaaccttcagtgcttagtatct

SEQ ID NO: 6819932 - DNA, 56 bp, Homo sapiens
gccatcttcaacatcagaagttttgaagaatttttgataaattgaggaataatggc

SEQ ID NO: 6819933 - DNA, 87 bp, Homo sapiens
ggcctagggaggggccgatgagaaagtcctaggggttgcggggaagccacaacctccctggccttctgattccctctctctgaggcc

SEQ ID NO: 6819934 - DNA, 88 bp, Homo sapiens
gaggaggcctgaggcttctggggcaccgagcgaccacaggccggggtgcgtggctcccccaggagctccagaggccctatgccccctc

SEQ ID NO: 6819935 - DNA, 84 bp, Homo sapiens
agtgactgagagtctggtattcaattattattttattcatttaactgcaccagtaaatagtgatagaattcagaactcagagct

SEQ ID NO: 6819936 - DNA, 87 bp, Homo sapiens
cactgagtatatatgtttgtttagatggtaaatcagtattgagatatactggacttaatgatgaattgtatatacaaatattcagtg

SEQ ID NO: 6819937 - DNA, 88 bp, Homo sapiens
cgggtcacctttgaacatcgttaccagacagtgttagagtcaagctgggaaatccagcactgtccggtaagatgctcacaggggcccg

SEQ ID NO: 6819938 - DNA, 62 bp, Homo sapiens
gcttttgctgaaaacagtggcaatgatactctttctgccttgctggatgtcagttttaaagc

SEQ ID NO: 6819939 - DNA, 94 bp, Homo sapiens
ttgctctaacaatagccttcatggcacaagtttgatgtgagttaaataaggtattgcatgaaaaacacgcaggcttgtgcctggtacagagtaa

SEQ ID NO: 6819940 - DNA, 87 bp, Homo sapiens
gtcatggggagaacttgaacttttcctctgaagaagatgggagccatggaaatctgagcagaagggtgcacgtgctgacctcatgat

SEQ ID NO: 6819941 - DNA, 61 bp, Homo sapiens
gagagcaggctctaggaattcaaagaccaagcaggcagagctggattctggagctgccctc

SEQ ID NO: 6819942 - DNA, 55 bp, Homo sapiens
gcccttcattgcccaaagagcctccagacaggtgggctcctgctttgtgaggggc

SEQ ID NO: 6819943 - DNA, 110 bp, Homo sapiens
attcagaaatacacattttgttccggaaatcagttgttatattaaagagccattttaaatggtttttgatggtgcatttgaatttctggggcctgatttttttcatgagt

SEQ ID NO: 6819944 - DNA, 58 bp, Homo sapiens
aatcagcagaagagaggtcttactgtcatagaagaataccttgatctactgctgtatt

SEQ ID NO: 6819945 - DNA, 56 bp, Homo sapiens
tatgattttacccacagcagcattccatggagggcagctactgtgggaaaattgtg

SEQ ID NO: 6819946 - DNA, 55 bp, Homo sapiens
agcttgtacagctgtggagaaggacctgaacccaggtctatatggctgtaaagct

SEQ ID NO: 6819947 - DNA, 67 bp, Homo sapiens
gtcagaggaatggatgagtgatttgtgaggtcttaactagataccccagtttcgtccttgttttggc

SEQ ID NO: 6819948 - DNA, 76 bp, Homo sapiens
gtattgattctgaatctaattttggtttccagcgtattgaggataactaaatctggcatttagagcactccaatac

SEQ ID NO: 6819949 - DNA, 61 bp, Homo sapiens
taggggggcccaggcaccacctgtgagcaagacaccattcagggtatatgggcctcacttg

SEQ ID NO: 6819950 - DNA, 94 bp, Homo sapiens
cctaacatttaactgcagtgaaagggaagtttggttcaagacagtctgaggaatctctccatacttgcctttggcctctgcagttgactctggg

SEQ ID NO: 6819951 - DNA, 107 bp, Homo sapiens
cctcagctctcagctgtgaacatgcacagacccaaaggccatccatgtgcgtgtgcttctccacatatccaagaggccttgggatgtgccacgggcagtgactgagg

SEQ ID NO: 6819952 - DNA, 96 bp, Homo sapiens
ctgagtcagtaactgaatgtctatgtatgatatttccagtatcatgattaaaatggagccccgaaatgtcattataaggcctagttgtggactggg

SEQ ID NO: 6819953 - DNA, 102 bp, Homo sapiens
tgtgaactatcaggttggtgcaaaagtaattgtggtttttgcatttttttaatggcaaaaactgcaattacttttgcaccagtctaatacttttagctcaca

SEQ ID NO: 6819954 - DNA, 102 bp, Homo sapiens
cttcatatcataggacattgtgttgaaggctgtaggcaaagtaggagggctgtgttgtcttccagctctgcttcacagtctcttctgattctagttgtgagg

SEQ ID NO: 6819955 - DNA, 82 bp, Homo sapiens
gtcatgtaccactgtgcctattttatcttggactgataagggtgttcctttctgtgataggtggcatagtgagatggatgac

SEQ ID NO: 6819956 - DNA, 60 bp, Homo sapiens
tgcatggtggaggaggctcttgcattcatttctgcccagcctcttttctcctgccctgca

SEQ ID NO: 6819957 - DNA, 58 bp, Homo sapiens
attatgaggcatatttgcaaagtatgaccccagatgtcgcaaaatatgacctcaaagt

SEQ ID NO: 6819958 - DNA, 57 bp, Homo sapiens
acccataggctgtacaacatcaggcataaaccctaaggtaaaatatggtctttgggt

SEQ ID NO: 6819959 - DNA, 118 bp, Homo sapiens
ctgcaccctaagctcattatccacaaggctgtgcaaaataataaatcactgttgttaggacgcaaagtttggtagtggtttgttatgtagtcgtggataactgcagcagggatctcag

SEQ ID NO: 6819960 - DNA, 78 bp, Homo sapiens
gtagatttctgattctttggcctttattgacagaagaaaacacattttgtcagcatgtcagccaaagatagcatttac

SEQ ID NO: 6819961 - DNA, 76 bp, Homo sapiens
tgctgttttccatgtgtctttcaatgtgtaattgacaaaatacaaatttattgaagggcatattggatttttagta

SEQ ID NO: 6819962 - DNA, 63 bp, Homo sapiens
gtatcccagctactcgggaggctgaggcaggagaatcacttgaacccgggaggctgaggttgc

SEQ ID NO: 6819963 - DNA, 81 bp, Homo sapiens
tcatctctgacaacatcagaagtagaagactcaggccataattgattctttggtttttctgaggtatctgttttagtctga

SEQ ID NO: 6819964 - DNA, 66 bp, Homo sapiens
atgtatctttgaaatggcagcagctgacctttaaaacagaggcaagccgtgcctgtctcaaaacat

SEQ ID NO: 6819965 - DNA, 55 bp, Homo sapiens
ggtgtcgtcctgttgtagctgggatactgtctcaggccagcagcatgacggcatc

SEQ ID NO: 6819966 - DNA, 64 bp, Homo sapiens
ccagattttcatccctcttctcatgcccacgaagatgactggggctggaggggtttgaatgtgg

SEQ ID NO: 6819967 - DNA, 56 bp, Homo sapiens
ggcagcccttttaggcagcagatgtggccaccaccctgtgcccagcagaggctgcc

SEQ ID NO: 6819968 - DNA, 64 bp, Homo sapiens
gcatatgtgcaggcttcattttaccccaaaggctgcttgtaattttgtccccctgcacatatgt

SEQ ID NO: 6819969 - DNA, 67 bp, Homo sapiens
ctggactcttgccagaactacggtgcaagccccattgtgtggctgcagattgtagtctgttaaccgg

SEQ ID NO: 6819970 - DNA, 72 bp, Homo sapiens
cttggaaggctggttctccctctgatgctctgaatcccatctaagggagcttctggcctcagcctcttcaag

SEQ ID NO: 6819971 - DNA, 73 bp, Homo sapiens
gcttggggttgtgtgcgtcgaactttgaggctggattccctgcacttgggcagagacgcacagacgcccgagc

SEQ ID NO: 6819972 - DNA, 77 bp, Homo sapiens
tccatactccctcaagtcactttagtttagttaatattatttgtgtgacaaaagtgttttgaacaaggaaaaatgga

SEQ ID NO: 6819973 - DNA, 64 bp, Homo sapiens
actcattgctatctttagattgcagtctcaaggtccttcctgagctgtgctaagtgaaatgagt

SEQ ID NO: 6819974 - DNA, 57 bp, Homo sapiens
cctgaggtcgggagttcgagaccagcctgaacaacatggagaaaccccgtctttagg

SEQ ID NO: 6819975 - DNA, 55 bp, Homo sapiens
tacacatgtgcacgcgtgtcctgcgtgtgttgtatggcatgtgtgcaggtgtgtg

SEQ ID NO: 6819976 - DNA, 79 bp, Homo sapiens
ctggaggctggaagtccaagatgaaggtgtcagcaagattggtttcttccgaggcctctctcgggcttgtagcggccag

SEQ ID NO: 6819977 - DNA, 97 bp, Homo sapiens
tttgagccatggcaccaagaggaatgggtgtgtttatgaaatcaaatttagttcataagaatattccatcctttgattgtgctgaacatgggttgga

SEQ ID NO: 6819978 - DNA, 69 bp, Homo sapiens
gccatttacagtacaccactgtgtacagtacaccactgtgtacagtacaccactgtgtacagtacaggc

SEQ ID NO: 6819979 - DNA, 59 bp, Homo sapiens
tcctctgcttggaactggacagaagttccaataagctactgtcttctattaagtaagga

SEQ ID NO: 6819980 - DNA, 116 bp, Homo sapiens
gattaaatcagaatcattcttgttgatatttgcatatgtggagtcataatgcggtgcataagaactgtagggcccataattcaaatataacactggagtgactttgttcttttgtc

SEQ ID NO: 6819981 - DNA, 64 bp, Homo sapiens
gaattgctactgaagagcttgccacattcatgacatttgtaaggcttctctccagtatgcattc

SEQ ID NO: 6819982 - DNA, 71 bp, Homo sapiens
ctggggtcagagagatgagagtggatggcggcggcggtggtgttgcttctcagcctgtctggaaatctcag

SEQ ID NO: 6819983 - DNA, 64 bp, Homo sapiens
gcaggctccaaggcctgggagagcctccaagccagggtctccaagccaggcctctggggcctgt

SEQ ID NO: 6819984 - DNA, 88 bp, Homo sapiens
cccctgctgaaacactaccgccagccagcgggctcatgcaccttggcctgttgctcctaggggtcacctgtgctattcagccaagggg

SEQ ID NO: 6819985 - DNA, 58 bp, Homo sapiens
ccccatgatggctctgggaccttgggatcacagcccctctctgggccctcctgtgggg

SEQ ID NO: 6819986 - DNA, 61 bp, Homo sapiens
gagtgtctgctttgagtcaggtgtcgtaattattttttacaccattttcacagcaaacctc

SEQ ID NO: 6819987 - DNA, 79 bp, Homo sapiens
ggcagaagagacaggctgctgtctgctaggaacgcctttttgttggtttcccctagttgaatcagcagccacatctgcc

SEQ ID NO: 6819988 - DNA, 70 bp, Homo sapiens
catctacgttgtggcatgtttcaggtgcttaattcctttttatcactgaatatattccattgcatggatg

SEQ ID NO: 6819989 - DNA, 76 bp, Homo sapiens
tttatctctgctatccttggtggtgacctgatattatttaagtgaaaaaggttggccagcaagagtaaagtataaa

SEQ ID NO: 6819990 - DNA, 63 bp, Homo sapiens
gggaggcttcccagctgagctcagctcctccagggctgaccatacagctgtgggtaagcccct

SEQ ID NO: 6819991 - DNA, 57 bp, Homo sapiens
cccttccttgtcgacgtctgtacctctgaggggaagaggagactggcagggaaaggg

SEQ ID NO: 6819992 - DNA, 113 bp, Homo sapiens
tatggtagcccatttaaaaggcagagagcctggaattaaggaaatgcagtgttgaatagttattgcactattttcaggctttgtgacctgggcattttaaaaaggagatcata

SEQ ID NO: 6819993 - DNA, 64 bp, Homo sapiens
ggttcagtgctgccctccccagcaggaagtgggttagtggacttgctgggaacaggattgaatc

SEQ ID NO: 6819994 - DNA, 59 bp, Homo sapiens
cagatggagaggttcacccggagcctaggagaaaggccagggctgttgctcttggtttg

SEQ ID NO: 6819995 - DNA, 59 bp, Homo sapiens
gactcagatttagagggtaagaaaagctttcttagaagaagcgctttttgagctgagtc

SEQ ID NO: 6819996 - DNA, 68 bp, Homo sapiens
gagggagcagaggatggaggaaaacctagtctgggagattggaaaatgctacatgttctgcttctctc

SEQ ID NO: 6819997 - DNA, 79 bp, Homo sapiens
ggatgacttgtgctttttccgggctgttttcagaaagctctgtaactcatgtcctaggagtaaagcaccctgctcatcc

SEQ ID NO: 6819998 - DNA, 92 bp, Homo sapiens
gcaaagacattataaggtataaggcctatttttagtagacactatgtaaacttatactagaaaataggcagatgcattgtattaaactttgc

SEQ ID NO: 6819999 - DNA, 71 bp, Homo sapiens
atgtctccagtctgtgtccatatgcttctggacaattaacttccagtttaaggcaggacatgggaatgcat

SEQ ID NO: 6820000 - DNA, 79 bp, Homo sapiens
tggctactggaagtccaagaacaaggtgctggcaggattgatttctcttgaggctctctccttggctttcagaaggcca

SEQ ID NO: 6820001 - DNA, 60 bp, Homo sapiens
attcattagccactaactagcacagtcgtatgagtctgatgttgttttatggctatgaat

SEQ ID NO: 6820002 - DNA, 73 bp, Homo sapiens
aggggaaaaagaatgttttctatagaagaacagttgatagaattaactgtctaaggagaatatgaaataccct

SEQ ID NO: 6820003 - DNA, 58 bp, Homo sapiens
ttgaattgttgtggaacagtgcagtcacattttatgcaaggtttgtacaacattttaa

SEQ ID NO: 6820004 - DNA, 99 bp, Homo sapiens
ggagccagcagtgtgggcccaggtcctgggagaagtgaggttcaccctgtctgctcgcagccctggcttagtctccaaactgccttccttattggctcc

SEQ ID NO: 6820005 - DNA, 61 bp, Homo sapiens
gtgtttaagtaaatgaatgtgtggctagagctcagacacacattaggcagtgcttaaatat

SEQ ID NO: 6820006 - DNA, 73 bp, Homo sapiens
gctccgggagtggtaatgagcagattagggttattacagccgaatggctcagagcgcacttgctcacccgagc

SEQ ID NO: 6820007 - DNA, 68 bp, Homo sapiens
ggaaggccacacatgatttttaaagagataatagcagcactattgtcacttaaaagtgcatgttttcc

SEQ ID NO: 6820008 - DNA, 58 bp, Homo sapiens
ttctgtccttttgaattccaaaagtgtgttggcctgtgagatagcataagggacagaa

SEQ ID NO: 6820009 - DNA, 55 bp, Homo sapiens
tgctgagcctggactacatgttcctaatgcatgcttttatgtcacatggtcagca

SEQ ID NO: 6820010 - DNA, 63 bp, Homo sapiens
ctaaggaggtgtgaggacacagtggttcacactgaggaacctggcttgtttctacctccttgg

SEQ ID NO: 6820011 - DNA, 69 bp, Homo sapiens
ggaggctcatggggcatggatgataagctggatcaccttgagctaatggctaagcccctctgagcctcc

SEQ ID NO: 6820012 - DNA, 84 bp, Homo sapiens
tccattatgccatttgattttcatgataaacttgtgaagtgatactatcctccatttcacagatgagaaatctgaggcatggga

SEQ ID NO: 6820013 - DNA, 65 bp, Homo sapiens
ctgcaggaattgttttaaagcctcttctttgaaattgagaagattatgaattagagcagtagcag

SEQ ID NO: 6820014 - DNA, 71 bp, Homo sapiens
tctctgctcagctggttggaagggagctgaatagtcatttaggtgctcgttgcgacaggctggggttgaga

SEQ ID NO: 6820015 - DNA, 73 bp, Homo sapiens
tccctttagcaattggaaaatgtatttctagaagccagtctcttggcaattggtgcattatccattaaagaga

SEQ ID NO: 6820016 - DNA, 59 bp, Homo sapiens
gggtggggctatctcagcttttgtgtgggaagccactgcagctggtggtggctctgcct

SEQ ID NO: 6820017 - DNA, 59 bp, Homo sapiens
tatttgggcttttaatctagagcagagattagaaaactttgcctataaagggccaggta

SEQ ID NO: 6820018 - DNA, 57 bp, Homo sapiens
catcatgcaggcagcctttagtaagcgtcacatgctacctaaagtggtttgcgtatg

SEQ ID NO: 6820019 - DNA, 75 bp, Homo sapiens
gtgaatgaagcaaaatgtctgcacatattcttagttacctaaaggtatgatgttagattgtttttcttcactcat

SEQ ID NO: 6820020 - DNA, 56 bp, Homo sapiens
agatattatgaaagggcaccactacaattgtactcagtgggccatgtgtaatattt

SEQ ID NO: 6820021 - DNA, 57 bp, Homo sapiens
ctttatgttggggtgtcttagtaatccgtaaggaacatgataggcattgacataagg

SEQ ID NO: 6820022 - DNA, 61 bp, Homo sapiens
gccagtagcacagtggactccatcatgcagaaggcatgaatgaagaacatctgtgccaggc

SEQ ID NO: 6820023 - DNA, 58 bp, Homo sapiens
cacagagagctacgtgcagcgtcgtagctgagcatctgtgtcgtctgcgttctctgtg

SEQ ID NO: 6820024 - DNA, 69 bp, Homo sapiens
cctgacccaggggcagccttgctgtgggagctatttccaaggacaaccctggcagccccagggtacggg

SEQ ID NO: 6820025 - DNA, 92 bp, Homo sapiens
ggaaatgcttgtcaaattccaagttttatgctgcaatggttttattcagcaatgagcttggattttaagtcaagaaagcatgtataatttcc

SEQ ID NO: 6820026 - DNA, 72 bp, Homo sapiens
aagcctccctggctggtgtagagggatcaggtccacagtggtgcagattcaaccaccacccagggagtgctt

SEQ ID NO: 6820027 - DNA, 57 bp, Homo sapiens
ctgtgactggaatctggctctttattcagtggtatttggaactaggctccagtgcag

SEQ ID NO: 6820028 - DNA, 66 bp, Homo sapiens
gtttgtcacatcttggattacaattttacttggtcaagtaaaattgtaagccaagatgtgaccaat

SEQ ID NO: 6820029 - DNA, 130 bp, Homo sapiens
tggtgggggccggggagaagcagtccttgtaacgttgggctggggtccactgcctggaaatgacacactgggggaggagacaccggaagcctcaatctgcagggactcacagactcctctcccccttcca

SEQ ID NO: 6820030 - DNA, 55 bp, Homo sapiens
tctagctgagggtaggagacctggaattcacatggtgctaccttacacagccaga

SEQ ID NO: 6820031 - DNA, 86 bp, Homo sapiens
cctgttcccgagccccaggccatgattcgcttcactctggacttcagttccagagagagaggtcaatggcagggcatgggaacagg

SEQ ID NO: 6820032 - DNA, 81 bp, Homo sapiens
ggcataagcaagacaagggttcctgcaagatttaagcctggcctagggctacatttttcaccgagcctctggttgcttgct

SEQ ID NO: 6820033 - DNA, 57 bp, Homo sapiens
gcatatgtcaggtgcacttacagagggtgccttatctgaaaggccctgagcatatgc

SEQ ID NO: 6820034 - DNA, 56 bp, Homo sapiens
ggtgcagcctccccagtgacagccccaggtctttgccactggagagctggaaaacc

SEQ ID NO: 6820035 - DNA, 79 bp, Homo sapiens
aaaatggtgcaaagatggcagttgcaatttgaacttgagctctaaaaatggtctatttgtggttatatttgcccatttt

SEQ ID NO: 6820036 - DNA, 91 bp, Homo sapiens
gagaaaaatgaatggaaattggaatttgaatcacttcctaattgttttacttggttcaaatggctgcagttaccatatacacatttttctc

SEQ ID NO: 6820037 - DNA, 56 bp, Homo sapiens
tttgcagttcatctgagaaaaagctgccatttcctcatacaagatgaactgacaga

SEQ ID NO: 6820038 - DNA, 82 bp, Homo sapiens
tggtcaaggtcacccagtaagtcagtggcaaagctgggaatacaacccagactttctgactcccttgcccatcccctgacca

SEQ ID NO: 6820039 - DNA, 59 bp, Homo sapiens
gcaagtgcttgaggggaataaaaagaaccttaaggtaggttcctaccctcaagcaatgc

SEQ ID NO: 6820040 - DNA, 60 bp, Homo sapiens
tcagaattaagctcttggtcagtagcactgattaataacttgaccagagccctgttctgg

SEQ ID NO: 6820041 - DNA, 57 bp, Homo sapiens
tgtgctttttataaggcagactgtgtgagctatactgttagagttttaaaaagcaca

SEQ ID NO: 6820042 - DNA, 111 bp, Homo sapiens
cctcacgcgtcttattcattactgctagtcccgattcttcctatacaggaagtaaacgcattgtcctgatgggaggaatgggtcatggaagtttaattcctttgcctcagg

SEQ ID NO: 6820043 - DNA, 60 bp, Homo sapiens
taaagtgttacagaaacaaatgaactcctattagttttctattgttgctgtaacgaatta

SEQ ID NO: 6820044 - DNA, 55 bp, Homo sapiens
gtcttcctttcacctctgcgaagaatgccttgagttcgtccaggtgctggaagat

SEQ ID NO: 6820045 - DNA, 87 bp, Homo sapiens
cagtgaaatactgcatgtgatgtggttagctagagtttagtccactctaagctttcccaaatatcagatgctattgttattttactg

SEQ ID NO: 6820046 - DNA, 63 bp, Homo sapiens
aatttgattgtgtctgagacgataattgagttaaaacgcttattgtaacagacacatcagatt

SEQ ID NO: 6820047 - DNA, 68 bp, Homo sapiens
aatatatggctactacgaataatgctcctgtgaacatttccatgcaagtctttgtgtagtcatatgtt

SEQ ID NO: 6820048 - DNA, 56 bp, Homo sapiens
tgtttttgttcaatgctaggtcctcagcacctaggactgtgccaggcacaaaaaca

SEQ ID NO: 6820049 - DNA, 58 bp, Homo sapiens
gggcaggtggggcagctgtgggagctggtgccagtctctgacctgcgtccctcctccc

SEQ ID NO: 6820050 - DNA, 66 bp, Homo sapiens
tggcagtctttcccttgagctctgcaaatgcagcaaagtactgagctcaaagggaagattcagcca

SEQ ID NO: 6820051 - DNA, 69 bp, Homo sapiens
tacttttctctgtaccgtatatctttgtggcagtaattagctttgtagaattgttgttagggaaaagta

SEQ ID NO: 6820052 - DNA, 55 bp, Homo sapiens
tccagttgcccatctctcttcttcaggatgcggaaggtgaggggtgggtgctgga

SEQ ID NO: 6820053 - DNA, 127 bp, Homo sapiens
agagattgaaaggttggaggaggagtgttcaggttgttaattcgcttggttactccactgtacaagattcaatgaattgattgcatcattcacgctggacatccttctccatgcaattgccatctct

SEQ ID NO: 6820054 - DNA, 86 bp, Homo sapiens
ttattgtatgctgtgtaggtctgtttgggaaatgtgactgcctggtctactgttaaattttagaaacagactctggctgtcaataa

SEQ ID NO: 6820055 - DNA, 122 bp, Homo sapiens
gaggcccatgcataggattcaggctcaatctgaaacaggtctgggctcagcctcagtctgtggctggcagcccagtccagctcactgggcccgacgtggcctgcgtccatgtgcttggcttc

SEQ ID NO: 6820056 - DNA, 130 bp, Homo sapiens
tacgcaaagatttacaatcattccaggtatgcagagtatcaataatagaggagctacccagaaatgtgttgtttctcattgaatattcagtgcgtgatatgaagatttatcttgtaaatatcactgggta

SEQ ID NO: 6820057 - DNA, 63 bp, Homo sapiens
gggtgattaaaaactccggaaacttacaactgtctgagtgtaagcctggaatttttgacttcc

SEQ ID NO: 6820058 - DNA, 56 bp, Homo sapiens
atcttgggagcttggcatgagggagcttctagattcctatgtcgcactcctaggat

SEQ ID NO: 6820059 - DNA, 85 bp, Homo sapiens
taatcacagtgcattacatgtaataaaatagtggtatcatttaacttttgttcattgtttatgcatgtgtatgcatatgtgatta

SEQ ID NO: 6820060 - DNA, 78 bp, Homo sapiens
ttacagatgtttaaatgtcacatacaatggcaagtctctccagatttgctttacaatgggcattccgtggatctgtga

SEQ ID NO: 6820061 - DNA, 64 bp, Homo sapiens
gagtgattgcagtgtgtgttccatgaggtagtatgcacacagagccttcatacactaaacactc

SEQ ID NO: 6820062 - DNA, 72 bp, Homo sapiens
gcagtgctcttttttaaggatgcagtggtgatctttttgttcaagtgctgcaaatcctcagaaagggttagc

SEQ ID NO: 6820063 - DNA, 57 bp, Homo sapiens
cagcagtgtacaaggtgtcagagtatgcacggcgctttggtgttccggtcattgctg

SEQ ID NO: 6820064 - DNA, 62 bp, Homo sapiens
ggcctccaaccataggtccaggggctgagacaaggtccttttgagctcctatgtgggaggct

SEQ ID NO: 6820065 - DNA, 65 bp, Homo sapiens
gctttcttccagtgtgcagagtgaccctggtgcatctccgcagggggctcagtgactgaagtggc

SEQ ID NO: 6820066 - DNA, 74 bp, Homo sapiens
gctctttttctcttcatatgtgaactcagtgatgtctgcaacctaaaaggcaacatattgtgggatgagagagc

SEQ ID NO: 6820067 - DNA, 60 bp, Homo sapiens
agtgtctttgtcaaattacaggagccaaacgctgctatctgagactgtgacagagccatt

SEQ ID NO: 6820068 - DNA, 60 bp, Homo sapiens
gctgagggattctgcctgctcaggagactctccctggtgactcctgaagatttcctcagc

SEQ ID NO: 6820069 - DNA, 91 bp, Homo sapiens
agagcactggtcatagttccttggagaatcctggttattcataaggcaagaatatgaattctctttcctggagcatagaccatgtgcctct

SEQ ID NO: 6820070 - DNA, 68 bp, Homo sapiens
cctagactcaggtcttggtaggccagagtctaggttttggctgagactccttctaagacctcattagg

SEQ ID NO: 6820071 - DNA, 59 bp, Homo sapiens
aaaaccagaatcagtatctcccacactcacaactgagttctggatgtgattttggtttt

SEQ ID NO: 6820072 - DNA, 84 bp, Homo sapiens
aaggggacctactgataggaacacagggacttgatgacctcatggtcattgtcatccctgtgtttgtatgaaatgtagcttttt

SEQ ID NO: 6820073 - DNA, 61 bp, Homo sapiens
tcagtttcagaatcaaaacatcaagctgtcactttagaatgaacaggatttgtgaagctga

SEQ ID NO: 6820074 - DNA, 113 bp, Homo sapiens
actgatttctatcactttatcactgttagctgaagttaaagaagaatagttcctttctctaacaagaacataactctctttgatagctgtttgaaaggatagtctgcatcagt

SEQ ID NO: 6820075 - DNA, 60 bp, Homo sapiens
agctgttgaacctgtaagtatagatgtggactgtgtcagcatgtatctttcaggtgtgct

SEQ ID NO: 6820076 - DNA, 73 bp, Homo sapiens
aacaggtttaatgatggtcatggcaactttttggcacagtgaaaaatatcgcccatgatcaacgtgttctgtt

SEQ ID NO: 6820077 - DNA, 90 bp, Homo sapiens
tcctcagattcctgtcaataccatttcattctttcctcattttgggagaagggaaggagggaaggaagtaaggaaggaaggaaggaagga

SEQ ID NO: 6820078 - DNA, 60 bp, Homo sapiens
acagggtcactgtagactctgatcttactccccaaggatctagaaacctgatgactctgt

SEQ ID NO: 6820079 - DNA, 106 bp, Homo sapiens
gtgacacatcctgggcacattccatcttgtcttcatcctttctctaattacagctctccatgattgcagggataaaacaagtgaatgtgtgtgcgtaggtcgttat

SEQ ID NO: 6820080 - DNA, 60 bp, Homo sapiens
cagcccagcactgggggcccagcccacaaacgaagggaacccctggaaggtgctggggtg

SEQ ID NO: 6820081 - DNA, 81 bp, Homo sapiens
ccttctactgagtgtggagtctgcgtaccctccgggctagtggatggccagggtggcgtagatgctgggctcagctggagg

SEQ ID NO: 6820082 - DNA, 64 bp, Homo sapiens
ttcagggagaaatgagggaatggagaatatcagagaagcagctccctcagaaattctctctgaa

SEQ ID NO: 6820083 - DNA, 76 bp, Homo sapiens
cctttagttcccatgagagggtggtggtgactgatttcattagatacagcagcccaccttcttctgaggctgaggg

SEQ ID NO: 6820084 - DNA, 60 bp, Homo sapiens
aagggatgtgtttggaaaggtaggtttggcacaaaccttgaatacttaaatacatcgctt

SEQ ID NO: 6820085 - DNA, 58 bp, Homo sapiens
cctggctggtggcagcgacaagggaaagaattgcgatcccttcctgccacctgtcagg

SEQ ID NO: 6820086 - DNA, 59 bp, Homo sapiens
ggtatgtctttcatttcttggaggctaggttgagcaactatcttcctggaagtcattcc

SEQ ID NO: 6820087 - DNA, 90 bp, Homo sapiens
ggctgcctgtttattcttctagctccctgagatgccacagcaagcaggagccctgctggtgcatcctcagggtcaccaggggacaggccc

SEQ ID NO: 6820088 - DNA, 70 bp, Homo sapiens
tcccatttgttcgcccagctccaagagaagtcatcgccttcattgtgggttgttttgggcaaatgatgga

SEQ ID NO: 6820089 - DNA, 60 bp, Homo sapiens
ggggatggtgggaaggcaatctggccaggagaagctgcgcgggagactcccgccatcccc

SEQ ID NO: 6820090 - DNA, 90 bp, Homo sapiens
cctggggaccctgtgaaatgcagattctgattctgtagcgctgaaaaagagatgcagccctggattctgcatttctaacaaactcctagg

SEQ ID NO: 6820091 - DNA, 94 bp, Homo sapiens
tgaagctctgcggtgcactgaacagccctgttaagtctgttctgctactggtattttgagcaggagggcctgttcagtgcactgcagagcttca

SEQ ID NO: 6820092 - DNA, 56 bp, Homo sapiens
gccacgtagaagtgacaggaaggtatgaagacatgctttccttggggtcatgtggc

SEQ ID NO: 6820093 - DNA, 130 bp, Homo sapiens
tttgtgcataattaagtagttgatgcttttgagctgcttcttataatgtgtctcttgtgttaaggtgcatctagtgcagttagtgaagcagcttagaatctactgccctaaatgccccttctggcacagg

SEQ ID NO: 6820094 - DNA, 57 bp, Homo sapiens
cgagtacccagatatctctgctctcctttcagggggtagagggcactgcggtgcgcg

SEQ ID NO: 6820095 - DNA, 65 bp, Homo sapiens
gtcatttttcaggagagtttcgggtaactgcagaagcctgtgtttactgttttctgataagtggc

SEQ ID NO: 6820096 - DNA, 91 bp, Homo sapiens
tccccgactgccctgtccagcccgggctccgccagcctccctctagtgctgttctgcgtcccaggctggtccgcgtggatttcagagggga

SEQ ID NO: 6820097 - DNA, 67 bp, Homo sapiens
gaaagccagattgaagccttgcatagatttttgcttcatttatcctgcaaggcttgcaatggtgatc

SEQ ID NO: 6820098 - DNA, 105 bp, Homo sapiens
ggaggcatattctttcattcagaccacaggggtactattttaataaattgccacttcaatgtgcaaaataatgccccaatggactggaagcgaagacttgcttct

SEQ ID NO: 6820099 - DNA, 66 bp, Homo sapiens
gtcccaggaatccgtcctctagatcatttcttcagcttttgacatctgaggaaaagttcttgtcac

SEQ ID NO: 6820100 - DNA, 63 bp, Homo sapiens
gtcatctgaaggctaaaatggactgaaatccaagatggttcactcacgtggcttacagttgac

SEQ ID NO: 6820101 - DNA, 71 bp, Homo sapiens
ctggccaggcccggcccgggctggtgcggctgcgcactgcagcccagcggagcgggcccgggaggagccgg

SEQ ID NO: 6820102 - DNA, 130 bp, Homo sapiens
caatttcaggaatgctcagggtatgccccacaggtctcagaagctataggttaaatcaaggtctactactttaggattattgtcaaagtaagattgttgaagctcatctcaccccctgggacctgactag

SEQ ID NO: 6820103 - DNA, 61 bp, Homo sapiens
ggggacgggacttagcatgagttgggaaggcctttcacatcccactgaggagcttgttccc

SEQ ID NO: 6820104 - DNA, 71 bp, Homo sapiens
gggtggcagctgttgccaaggtgttgctgatacagttctgcgtataatttattggaaacaggtgctggctc

SEQ ID NO: 6820105 - DNA, 66 bp, Homo sapiens
ggacttgtgggggttcctggtgaaaatctgagttcaaaggccttagaaccaggaactctaatatcc

SEQ ID NO: 6820106 - DNA, 76 bp, Homo sapiens
gcatttggaacaagtccaggtcaatttaaagccaataccatctggtttttaaataaacctgaactgagttaaatgc

SEQ ID NO: 6820107 - DNA, 126 bp, Homo sapiens
caccctgccccacaacctcaggagccagggcccttcccccaagcccctcctcaaacctcagccagactccacccctggctgaaggagggaagaaggctctgtgtcctgggaacccaggggcctgtg

SEQ ID NO: 6820108 - DNA, 112 bp, Homo sapiens
agccggaaaggggcagggtggaagaatagatgtcattgtcatccatcctgggtcacatggggtttgatggcagtcggcgtgctggcatatgccctgtcctttctttaaggct

SEQ ID NO: 6820109 - DNA, 64 bp, Homo sapiens
actccagaaaggagacttcagatctccttctaaattctagaagtctttagtctccttctgaagt

SEQ ID NO: 6820110 - DNA, 56 bp, Homo sapiens
gggtctggagatccgggtgaaggtctcagactatgtacaagaccggattcgggccc

SEQ ID NO: 6820111 - DNA, 56 bp, Homo sapiens
taaaaccaggtcttgggatttacgtctgaaagagataaatcctaaaattggtttta

SEQ ID NO: 6820112 - DNA, 58 bp, Homo sapiens
gagatgtttgtcactaagccatttccttctctctgaagtgggtttagacagtcatttt

SEQ ID NO: 6820113 - DNA, 57 bp, Homo sapiens
taatcactgatcatgtgcactaggtgccacttacctttgctccatctaaagtgatta

SEQ ID NO: 6820114 - DNA, 61 bp, Homo sapiens
cattggtgacatattgtgcatttcttttattatagaatctattacaatgatgttacctttg

SEQ ID NO: 6820115 - DNA, 77 bp, Homo sapiens
gtaaggagttctgttaagtattacgctgcatctgacagggcatccaggcagcaagattatttaatccaacatcttac

SEQ ID NO: 6820116 - DNA, 72 bp, Homo sapiens
gggctccagggtctctccttgtgctcgtcaacaggctggatggatagaataaagtggaagattctggagctc

SEQ ID NO: 6820117 - DNA, 59 bp, Homo sapiens
cacatgggtgtgcctggaggaagaaaaatgttcattctgccttccttgctccccatgtg

SEQ ID NO: 6820118 - DNA, 95 bp, Homo sapiens
cattctggaaatgtctagttggctgtcttcctggttcatgtgttggccttgctcagacaagccactcgagagtgctagctccatttcccagactg

SEQ ID NO: 6820119 - DNA, 80 bp, Homo sapiens
gcctctggcttcccactctgccgggctgcctctcattatctcatttgttgctcacagtatccctgggaggtcagaagggc

SEQ ID NO: 6820120 - DNA, 130 bp, Homo sapiens
tggagacttgcacacagttgctagtttatctttaaaatttccaccatctttgtgttccccatggaagacaaaggattaatgatgatgaaatgtagtataaggccagtgcaacagtggccaagtttggcca

SEQ ID NO: 6820121 - DNA, 67 bp, Homo sapiens
tgccatgtggatggtctcctcatcacacacaggctgtgactcttgatgacaggccacccaccttgca

SEQ ID NO: 6820122 - DNA, 75 bp, Homo sapiens
ggagcagccagaattattgaaaagaataaagaaggaaaattcctttggtagttttcttaaagatcaaatagctcc

SEQ ID NO: 6820123 - DNA, 62 bp, Homo sapiens
tggcagtcacatcagtaggaaggatgcagaaaaatgacagagtcgtcgtctttcttatgcca

SEQ ID NO: 6820124 - DNA, 128 bp, Homo sapiens
cagcagggcagccccttgatttcttccgcagactgcacctccagcggctggtgagcaatgagagccagaggcgccagctggtggggaagctgcaggtccttgtggaggaggcctttggttgccagctg

SEQ ID NO: 6820125 - DNA, 83 bp, Homo sapiens
ggtaatccgtgcaaaagtccttcgagtccttcagaaaaactctgtcctttccaaaggctcatcagggcatttagaggattatc

SEQ ID NO: 6820126 - DNA, 58 bp, Homo sapiens
gcagacacctggccaggccaggaagttccccttacctggcacagtcctgggtgcctgc

SEQ ID NO: 6820127 - DNA, 82 bp, Homo sapiens
cagtgtcatcatagatttgtgcaagaagggattccagatgctattttagaacaatcttctcattgtacagatgatgaaactg

SEQ ID NO: 6820128 - DNA, 74 bp, Homo sapiens
tgggaactcagttccatcttcatctttcccatcagtatgggtggggcgggtgcagctgggaagcttagctccca

SEQ ID NO: 6820129 - DNA, 85 bp, Homo sapiens
agaaagcaggtctttaaatgcaatgtgctttaccagggaccatggtttccttgcagtagccacattgcattaactcctgatttct

SEQ ID NO: 6820130 - DNA, 57 bp, Homo sapiens
ttcagggagcaagggctaggaaggaggcagctcctgggactggcattcttccctgga

SEQ ID NO: 6820131 - DNA, 70 bp, Homo sapiens
cacattgggagttgagttattaggataggctgggggcagagataatgttaaaaattcagctctagatgtg

SEQ ID NO: 6820132 - DNA, 68 bp, Homo sapiens
ttcatgctgcaagcattccctgcatctgccttgctcaggctttgtgctgggtgctgcagacaggtgaa

SEQ ID NO: 6820133 - DNA, 82 bp, Homo sapiens
caccaggagctgagagtcaccagctttaggttgcctgccagagagctctgccgggccctggatttggcattagccttgagtg

SEQ ID NO: 6820134 - DNA, 74 bp, Homo sapiens
caatttattctcacagatatttgcttcaggtggggtgactccactttatgtttgatatctatgggtctaggttg

SEQ ID NO: 6820135 - DNA, 74 bp, Homo sapiens
ctcaggtgaaacagctttctttccataaggtttcactttactggaagtgagattcaagaatgctgtttaatggg

SEQ ID NO: 6820136 - DNA, 67 bp, Homo sapiens
gggagctgaatggcaatggagaatgtgaagaggatcaaagtcatcacaggttcattcatgtgctcct

SEQ ID NO: 6820137 - DNA, 62 bp, Homo sapiens
tatatgcttgtgtgtatgttaatgtgtgtatattatacacacagagtttatacaggcatata

SEQ ID NO: 6820138 - DNA, 67 bp, Homo sapiens
gaaaatgaggtagtttgccattgagaggcttgaggagtgcctaaatgtgacaaatgatctgattttc

SEQ ID NO: 6820139 - DNA, 65 bp, Homo sapiens
gaggtgctggggggtttgtgggtctcacttgcacacctgacttcacatttaacccctcagacctc

SEQ ID NO: 6820140 - DNA, 61 bp, Homo sapiens
gggtagccagacaaggggatgctaattagagtctcacacagccccttgctgttgctgaccc

SEQ ID NO: 6820141 - DNA, 86 bp, Homo sapiens
tggcatccctcagaatcagagctgagtagaggcaaactggtgcagaagcatttcctgtgtctctatttatgtgttcagggattcca

SEQ ID NO: 6820142 - DNA, 108 bp, Homo sapiens
cctcccctatctaaccactgctccctgacagggtctcctctagatctgctccctgcactgagcacaggaagctgactgctggcaggggaggaggtggcagaggggagg

SEQ ID NO: 6820143 - DNA, 130 bp, Homo sapiens
caaccacagtaacttccacggaggtttcagcagtggcatctggggctggggtcgcggccgtggacagcaccggagccgggaccaaggccacggagcttgcagaggcaaggccgaggataaggagtggatg

SEQ ID NO: 6820144 - DNA, 71 bp, Homo sapiens
tcttggtggaatttcttcccttccttcttagggttaacaaggctaatttggaagatacattccatgcaaga

SEQ ID NO: 6820145 - DNA, 70 bp, Homo sapiens
tttcccagaagcagagcctgaggcagggattcagatgctcatgaactgtttgagggtttgctttcagaag

SEQ ID NO: 6820146 - DNA, 60 bp, Homo sapiens
aggagtgaggatgtcatggacctcacagaaggtgacagtgaggcctcagcctcagctcct

SEQ ID NO: 6820147 - DNA, 60 bp, Homo sapiens
actgtctgtagacatttttggttgtcacaactgggtgggaggcaaggtgctacagacagt

SEQ ID NO: 6820148 - DNA, 64 bp, Homo sapiens
gccagttagtcccatttgtgaccttgggaacttagtgttcccagcaagaaagggggtggctggc

SEQ ID NO: 6820149 - DNA, 77 bp, Homo sapiens
ggtgcaagggcacaggccacagtggagtctctgggtcttccccgggtgactttgctgttggctctgggccccacact

SEQ ID NO: 6820150 - DNA, 70 bp, Homo sapiens
ttggcttcattgatctcactttcttcaaaatactttttgatcattacattgaagtggtcaatgaaggcag

SEQ ID NO: 6820151 - DNA, 111 bp, Homo sapiens
ttttcatggctactcttaagaattttccttaatagttggtcttcattaaatgctttcttcaatttcactggaatagtggagactgggatttgtaagaggaagctgtggaaa

SEQ ID NO: 6820152 - DNA, 58 bp, Homo sapiens
gcatagggctactggtctcatcccagcgatcgggacagaaattgctaatagctcatgc

SEQ ID NO: 6820153 - DNA, 79 bp, Homo sapiens
gtgtttcctgctcacactcatgtccacgctcacatgtgcacctggagcctgcacgcactgtgtcatgcagggcttgcac

SEQ ID NO: 6820154 - DNA, 71 bp, Homo sapiens
gctgagctgaactttagcgcctatactttaactattgtgctaggtccctctttagctggttcagttcacgc

SEQ ID NO: 6820155 - DNA, 59 bp, Homo sapiens
tagttatctaaatattatttgagtaaaatactcggtctaaagtaatatttgtgtaactg

SEQ ID NO: 6820156 - DNA, 60 bp, Homo sapiens
gcaaagctggatatgtgatgtgataatatattctacatcatcatgcactctcaggtttgc

SEQ ID NO: 6820157 - DNA, 110 bp, Homo sapiens
agtcaagccctaggggagcttagaagtgtgtggtgggggaaagggtttgtgacctaagagaacccatgtttctccctttataagactgtaattcttccctctctttgact

SEQ ID NO: 6820158 - DNA, 60 bp, Homo sapiens
atctgtcaggagcaaggactactttggcattaaccatcactgtttgatttcttgacaggt

SEQ ID NO: 6820159 - DNA, 67 bp, Homo sapiens
aggcagaaaggacacacaggaggtgtctggggaaccccctccaacatagccagaatgtctcctgcct

SEQ ID NO: 6820160 - DNA, 69 bp, Homo sapiens
agggagtcaagggttcactgttatctatgagatgtacatgatatgggtagaagtggcccaagcttccct

SEQ ID NO: 6820161 - DNA, 56 bp, Homo sapiens
gaatcttatgtggtgttttctaaattgttttctggaaaatgccactcccaggattt

SEQ ID NO: 6820162 - DNA, 73 bp, Homo sapiens
ttacctcactgtcccgccgggcgcacgcagagctcaccttgcgtgccggccggtggaggcgagccataggtga

SEQ ID NO: 6820163 - DNA, 62 bp, Homo sapiens
cagaggcacaagaaagcaaggcatgcatggagcagcgcagttgtttggtttgaggccatctg

SEQ ID NO: 6820164 - DNA, 73 bp, Homo sapiens
ggtttcttttattaggcctctacctttgggatcaaaactgctaaattccaacagaaacatgatcaaaggaacc

SEQ ID NO: 6820165 - DNA, 89 bp, Homo sapiens
atcctcagagagcaggatgatccctggacttgagtaagtacctcaggacctacctaagctcagggaaaggccattgtactcagagtgat

SEQ ID NO: 6820166 - DNA, 62 bp, Homo sapiens
ctcatttgttacaattcatactcttgatgctggcattgagatccttgagtgtacaatctgag

SEQ ID NO: 6820167 - DNA, 56 bp, Homo sapiens
cagcagggcctctggcactggtccttagctgtgggcttcagtgagagtccctgctg

SEQ ID NO: 6820168 - DNA, 75 bp, Homo sapiens
cccagacagaatcatctcctgggactgacctcatgcacatgctcttgtctagctacacaggaggactcttctggg

SEQ ID NO: 6820169 - DNA, 86 bp, Homo sapiens
gaatgacaattgtgtgagacaattggctgtggcatttttatagtagtaaaagcgatgaaaccacctaaatgcttatacatacattt

SEQ ID NO: 6820170 - DNA, 57 bp, Homo sapiens
ttctggtatagaaaatgacagggccttgttcaggcttctcagaagtctgtgccagga

SEQ ID NO: 6820171 - DNA, 86 bp, Homo sapiens
catctttctcgttgacatttcctgtctggaggtcaaaggccttgttgcctttgagtttcacacagcgaaccacacagctggagatg

SEQ ID NO: 6820172 - DNA, 62 bp, Homo sapiens
tgaatgagtcaatcatttagctgtcaaatgattcaagaatgcagcaattgtgaacttattca

SEQ ID NO: 6820173 - DNA, 71 bp, Homo sapiens
tttggcagagaacacacatgattcccccaaatatgtttctggaaacggaattgagtctgttctgtgctgag

SEQ ID NO: 6820174 - DNA, 79 bp, Homo sapiens
gtgacatgagctgtaaggtggcttcctacacactgaagtcagagtccagaggaagttcatatagtagacgccctgtcac

SEQ ID NO: 6820175 - DNA, 71 bp, Homo sapiens
ctccctgcggtctcccacgatgcctggacacaaaacatctacctgcgggtgctgaggaagacagcagggag

SEQ ID NO: 6820176 - DNA, 78 bp, Homo sapiens
caggcttcagtttggggaggatatgtgagttattttaatgtttttgtctcaatttcttcatttttccctatgaacctg

SEQ ID NO: 6820177 - DNA, 92 bp, Homo sapiens
gcggcagatggtgtgtccgctggagagggggctgccaaagaagaggagtctcttccctggtttccctcctccagtgttgtctccatcgacgc

SEQ ID NO: 6820178 - DNA, 60 bp, Homo sapiens
aagggcttttaagatttatcctccatgtgaaatttggggctttatattctataggccttt

SEQ ID NO: 6820179 - DNA, 109 bp, Homo sapiens
agaagactctctaaatattttttcctgccttttcatctgagctggagttcaccctgtcttcattttccctcagcaggaatgtggcaggcaagtgagtggagtaacttct

SEQ ID NO: 6820180 - DNA, 96 bp, Homo sapiens
gcgtgctctcagagcaggtggcggcggcgcttttctcctcgtccgtggtgttctgctcctgcacggaggtgctggcggccagctctgagagcttgc

SEQ ID NO: 6820181 - DNA, 56 bp, Homo sapiens
gctcatgcgttcagcagaggcttattgtgccaggcactgagctgagctccatgggt

SEQ ID NO: 6820182 - DNA, 66 bp, Homo sapiens
ttgagacacagcagtgcctgcctcagctcttcttgggggaagtggggcggggcacctgcttctcaa

SEQ ID NO: 6820183 - DNA, 58 bp, Homo sapiens
gtcaggttcattctttcttgtattgtacggggcagatgggaggaggaatgggccagac

SEQ ID NO: 6820184 - DNA, 59 bp, Homo sapiens
tttgcagcccctaggccagcacctgctctggtggtgcctgccccacaaggggttgcaga

SEQ ID NO: 6820185 - DNA, 100 bp, Homo sapiens
ccacaggacccagatatctgacagaatcattaagaccattccttgaagtgggagtgttggtaatggttttaatattttatcacctggcagcgtcctgtgg

SEQ ID NO: 6820186 - DNA, 56 bp, Homo sapiens
actgggatttaattagtgaattgcctccttcagtgcagttctcttagatttccagt

SEQ ID NO: 6820187 - DNA, 56 bp, Homo sapiens
ccaggcctgcattccctctcagagttctgattttcaaaggttagaatgaggtctgg

SEQ ID NO: 6820188 - DNA, 59 bp, Homo sapiens
gcttccttattgttgccatagtaactgtctactgatggtgtatttataggggaagaagc

SEQ ID NO: 6820189 - DNA, 71 bp, Homo sapiens
tgaaaatcaccagcataccttttcacagtgtacatgctctgtccgaggtccagtgctcttggtggttatta

SEQ ID NO: 6820190 - DNA, 71 bp, Homo sapiens
ggagttctgacgggaggtgtgggagagattctttcctgtgtgaggcaggaaactcccctacatctcaatcc

SEQ ID NO: 6820191 - DNA, 76 bp, Homo sapiens
tcaggaggaaagttccactcaacttgctatttctcatctagctcggcagtgttgagaggcctggctcttttcctga

SEQ ID NO: 6820192 - DNA, 92 bp, Homo sapiens
ttgatgtataagtttatggcattgttggtgatgatatttgatggttttacaagtgtgtccttatctccaaacaatcaagttttatatattaa

SEQ ID NO: 6820193 - DNA, 60 bp, Homo sapiens
ctttaggtctgtaataaactttattgctaagagtacagtttatgaaacacagatttgagg

SEQ ID NO: 6820194 - DNA, 102 bp, Homo sapiens
tgaggcaggagaatcgcttgaacccgggaggtggaggttatggtgagccgagatcacgccattgcactccagcctgggcaataagagcgaaactctgtctca

SEQ ID NO: 6820195 - DNA, 104 bp, Homo sapiens
gaacgggcttaacccattttgctactggttattttccttcagcacaacaactgcattgcaagggaaatagctgctcacaagtgttaagggccttattactgttc

SEQ ID NO: 6820196 - DNA, 76 bp, Homo sapiens
gaatgctctgtggtctttaaatttgtgcctgttttttctccagtccagcaaaatttgaggattgcctggggctctc

SEQ ID NO: 6820197 - DNA, 59 bp, Homo sapiens
gaatattgaattgtttgtggaatttcatgaggccatggactttcagacatttcaaattt

SEQ ID NO: 6820198 - DNA, 56 bp, Homo sapiens
tgtatgtgttttatgtgtgtttaaataaatatgttagatacacgtgtatacataca

SEQ ID NO: 6820199 - DNA, 61 bp, Homo sapiens
gctgaggcaagagtttgattagagacaacatatcatcactaaagaacttttaggcctcagt

SEQ ID NO: 6820200 - DNA, 60 bp, Homo sapiens
tggattcatctctcagtgtccagaaagaatcagccttctggactctaagcagaggatcta

SEQ ID NO: 6820201 - DNA, 128 bp, Homo sapiens
ccagggctgcgggggcggctccggagggcggccccgggctcagctccacccacccccttcctgctccgggaggccagggctgcgctaagtgcgcctccttcctggggacccttgcgtgcggcacctgg

SEQ ID NO: 6820202 - DNA, 87 bp, Homo sapiens
gtgcaatttttaaaaaggctcttcttttattaactgatgtactactctgctcagagtttagaaatgaaagattttgaaagcctgcac

SEQ ID NO: 6820203 - DNA, 57 bp, Homo sapiens
agggctgggaatgtgttaggagaaactgtcctggagactctgtaacactctagcctt

SEQ ID NO: 6820204 - DNA, 59 bp, Homo sapiens
ggggtagagtttggctttcaaatgaccagcaagtcaacattggcagcagctcagccacc

SEQ ID NO: 6820205 - DNA, 81 bp, Homo sapiens
taaatttcattgaaacctaacataggctggattagcaaatatagaaagacaatgtagcctgtcgtggtctcaaggaatctg

SEQ ID NO: 6820206 - DNA, 64 bp, Homo sapiens
tatattatgcatggtctgaagtcaacctctaaagagaggttgtctaattgagcgttgtagtatg

SEQ ID NO: 6820207 - DNA, 62 bp, Homo sapiens
ttggtggtcgtgtaaaatgtgtatataggaggaaatgagacagattggccatgagtcaccaa

SEQ ID NO: 6820208 - DNA, 70 bp, Homo sapiens
tgtgtaaaccagagcgctcaagccttccctccagggggagttgggaaggcagtgtctggttgaaagcaca

SEQ ID NO: 6820209 - DNA, 73 bp, Homo sapiens
ctatctgtcccactgacccatagaattttagaatcaatagttcctaaaggataggtcagtttgagccagaaag

SEQ ID NO: 6820210 - DNA, 75 bp, Homo sapiens
agagctaggcataagcccaggtaagtggctcatgcttattttagtgatcagggccatatcttgtgcaccagctct

SEQ ID NO: 6820211 - DNA, 56 bp, Homo sapiens
agtgacagtctcagagatcaggctacagacacccccagggtcactgagatgctact

SEQ ID NO: 6820212 - DNA, 56 bp, Homo sapiens
ctttcacagcacaagcctgcctttgttgagaggcagcaacaggtgtgttgtgagag

SEQ ID NO: 6820213 - DNA, 78 bp, Homo sapiens
gttcagactccatctggcaaaaccagcattatgcatggacttctatacaataaggtaagggtattgtcagatttgaac

SEQ ID NO: 6820214 - DNA, 75 bp, Homo sapiens
agcacatttctcaggtaagtcatttctcttcccaaggggaggattgaatgagtttatggtgagaggctgaaagct

SEQ ID NO: 6820215 - DNA, 66 bp, Homo sapiens
aagtatggattccaacctgaaacatgctcccatgaattgtagggttttagggaggatatttaactt

SEQ ID NO: 6820216 - DNA, 73 bp, Homo sapiens
tgttcccaatcgatgtgacagtatgtttcaatgaacagatcagattgaattcatttctcattgagtgagaata

SEQ ID NO: 6820217 - DNA, 99 bp, Homo sapiens
tcctgttgtaattttatagtataatagggatgggaagtagggatgttgatacattaaaatatactttcaattcactgagatatatgaaatagcagagga

SEQ ID NO: 6820218 - DNA, 86 bp, Homo sapiens
actttgaggactaaaataaattggggaaggagtatggaaaaaagttaaattttactcaatttttaaatcgtttgagtttttacagt

SEQ ID NO: 6820219 - DNA, 91 bp, Homo sapiens
tagcgattataagtacttgcctaggtcaatatggaattctaacagttgaacagaatgtcctttgtatccctaggcagacaaaatagagctg

SEQ ID NO: 6820220 - DNA, 61 bp, Homo sapiens
gatgatgcactatgtaccagttccaaggaatacactaatgaatcagtacatactgcacatc

SEQ ID NO: 6820221 - DNA, 78 bp, Homo sapiens
ggggggataagtgcagggagaataaaagagtcagaagttcctgtcttttcatactttccctccccgctctgttcttcc

SEQ ID NO: 6820222 - DNA, 84 bp, Homo sapiens
gggtgcctgcgctcgctgtggtttctgtacatgggtaatagaaagctcttgtaattctggaagccccatgcctgccttgccccc

SEQ ID NO: 6820223 - DNA, 101 bp, Homo sapiens
tgagaaggaagcaggggtagagattgctggtgtaagggactttttcttcccttctgtcttctctcccactgttttgtcttctgctcttgctctctctctca

SEQ ID NO: 6820224 - DNA, 77 bp, Homo sapiens
agtagaccctggaatgctggtaaaatagcacattatgctgatgaatatatgtaatgataccagcatccatgtttgct

SEQ ID NO: 6820225 - DNA, 77 bp, Homo sapiens
ggctggagtgcaatggcatgatctgggctcactgcaacctgtgccttccaggttcaagcgattgtcctgcctcagcc

SEQ ID NO: 6820226 - DNA, 85 bp, Homo sapiens
gaagaatgcccagttcataggtttgctgtgaacataaatgaggtaagccatgattactgcagggcctatggagtgaacactcttt

SEQ ID NO: 6820227 - DNA, 123 bp, Homo sapiens
gtcctttaacccttcaagcaattaaaattgtggttttagcttcagttctagcttctttctaccacaaggtctggggagtatcctcaactgaaaaaccatatttagttcccttctttaaaggat

SEQ ID NO: 6820228 - DNA, 63 bp, Homo sapiens
actgaatggttactaccctgggtcttctaccgaaagaaagaacatgggtgtgggcattcaagt

SEQ ID NO: 6820229 - DNA, 79 bp, Homo sapiens
gtagtaactaagttagcatcaatgcattcacttcaaaccacttgaagaaatgaagtgttatttagtttcacagagctgc

SEQ ID NO: 6820230 - DNA, 69 bp, Homo sapiens
gctcttgtcagcggctgctccgcaggctggccttggttagggagccacctggcaggacgctggcacagc

SEQ ID NO: 6820231 - DNA, 58 bp, Homo sapiens
ggagggagtcagctgattagaatcacagagctatttctgatgggtctgaaatccctct

SEQ ID NO: 6820232 - DNA, 77 bp, Homo sapiens
tttgctttttattgcttatgattaggtgttatggctttcatggacaatatagttgaatgagcaagcactgaagtaaa

SEQ ID NO: 6820233 - DNA, 55 bp, Homo sapiens
gaaacctgtcccctcttcctcagtgcttgcctgaaaggttaatggacagtgtttt

SEQ ID NO: 6820234 - DNA, 83 bp, Homo sapiens
ggctcacttgtgcttatccaaactggtgaatcattagctgtcaccctggagagcagtgcagtttgggaaggcgtgggtgcgcc

SEQ ID NO: 6820235 - DNA, 118 bp, Homo sapiens
agccagggccccaacactatgacatgccagcaccttcctgctccctggctacagaaaagcagcttgcagggggcatcaggtcctggctccatcatttaccagcttgggggccttggct

SEQ ID NO: 6820236 - DNA, 82 bp, Homo sapiens
tcctacacatgtccttttatttaaagcaggcaaagtcagaattagctgaatagtcctgtcctaaggaaaggagcagtgttga

SEQ ID NO: 6820237 - DNA, 84 bp, Homo sapiens
gcctgcaggtctgatccctgcccccagacagaatccagttgccaatgaggcagctggggagggtttggaggaagggctgtgggt

SEQ ID NO: 6820238 - DNA, 77 bp, Homo sapiens
taggcttccttcctctatgttcaggtagaataagtactgctcagagcatttccatttgcgcataaagaggaagcctg

SEQ ID NO: 6820239 - DNA, 73 bp, Homo sapiens
aaactgagttggttaactgcaacttgggtaaagtaaataatgaggcctcagtgcatgttcactggcatggttt

SEQ ID NO: 6820240 - DNA, 67 bp, Homo sapiens
ctccagctcgcgagctctgctcccttattctgggaaatgtcccactgcaggggtgtgtgagctgggg

SEQ ID NO: 6820241 - DNA, 56 bp, Homo sapiens
tggcgggtgtccagcgggtggagccagagagctcccagccatgggccacctagctg

SEQ ID NO: 6820242 - DNA, 79 bp, Homo sapiens
ttgtgaggtgttgttttcttattgtttattatcaaggtaaaatacacaataaactggtaggaaaacagtaaattcagaa

SEQ ID NO: 6820243 - DNA, 112 bp, Homo sapiens
ggggtcttgtacaagctgctttgcctccagctgcctcagtctcttcatgtgaaattggggatatctgtcttagattgggggtcccctgaagcagacctagagacaagaattc

SEQ ID NO: 6820244 - DNA, 78 bp, Homo sapiens
agaaacttctcacttctcatggcctaaagtggtttatgcacctctgaaccagatattatgaccatggattgagattct

SEQ ID NO: 6820245 - DNA, 68 bp, Homo sapiens
tctaagtttttcctcaggatctgtgactagtggtctcatggtccagacatttctgaggtaaaagtggg

SEQ ID NO: 6820246 - DNA, 89 bp, Homo sapiens
gccattggcattggtagcatcactgaggagtaatatctgtgtgggcagttagggagtgcttgtcaggataagctctggctgctggtggt

SEQ ID NO: 6820247 - DNA, 68 bp, Homo sapiens
gaaagtgctaggaagtgttagagactgaatttcaaaccaaaggctaacaccaaaatccagtactcttc

SEQ ID NO: 6820248 - DNA, 66 bp, Homo sapiens
gcccgaggcctctgtgacgtcacggtgtctgcgggaggagaccatgacgtcacagaggcttcgcgc

SEQ ID NO: 6820249 - DNA, 58 bp, Homo sapiens
tcagcaaccaggggcacagtccaaaagaagcccagactctcactgctcttggggctga

SEQ ID NO: 6820250 - DNA, 64 bp, Homo sapiens
tccgggagatgatgtgggaggcagaataatggctttccaaagatgtctacatgttatccctgga

SEQ ID NO: 6820251 - DNA, 55 bp, Homo sapiens
tctactgagtgctgagattttggctgaaattgcccggatccttcggcctagtgga

SEQ ID NO: 6820252 - DNA, 90 bp, Homo sapiens
ctgacactgagatgtggagtttgtttgaagtttttgtacatttagtgaccagaggtattttgataaacgccattgcctcaaagtattcag

SEQ ID NO: 6820253 - DNA, 57 bp, Homo sapiens
gggggctcaacttgacagagaggtttcactaaaatctctgtacatcattgagtcccc

SEQ ID NO: 6820254 - DNA, 68 bp, Homo sapiens
catacagtttttaaggagtaagaaagtcagatgctacttatttgtcttgtgtccttaggacctgcttg

SEQ ID NO: 6820255 - DNA, 91 bp, Homo sapiens
ggtcaactaatttctaaggatgttctctgttgcaagggttattgactcttcagtcaaacactgtaacatggaaaatctaacctagttggcc

SEQ ID NO: 6820256 - DNA, 105 bp, Homo sapiens
cagcttcagagagaaggattccctctgccaatatttgaaatctgctcttagccattaatctgccaaagcacactcagatattgactcagggatttctgatagctg

SEQ ID NO: 6820257 - DNA, 93 bp, Homo sapiens
ggcagcttgctgacaatgcagattcccaggccccagaccagctgtatccaaatttaggtgctgcctaggaatctgtattttcaacaagtctcc

SEQ ID NO: 6820258 - DNA, 60 bp, Homo sapiens
agatttctccaggagaaatatgaaggagccaccgtgcttccatctctgcctgggaactct

SEQ ID NO: 6820259 - DNA, 82 bp, Homo sapiens
gggaacataagaatgaggcagagggctgtgccagctcaggagaaagagccaggtgagccctgctgcttcttgtattttaccc

SEQ ID NO: 6820260 - DNA, 68 bp, Homo sapiens
atttatgcagcactttacatttggaaagaggtcaatgaaatctagacagatttgagtgctgcctaaat

SEQ ID NO: 6820261 - DNA, 55 bp, Homo sapiens
cagccacgtagcccttggccgtggtgagggcctcggccgccagcacgtgtgcctg

SEQ ID NO: 6820262 - DNA, 79 bp, Homo sapiens
tgtttaaaccaaaactcttcctttctttaaagtatggtctgctctactgccagagacaaggatgagtaaagtttagaca

SEQ ID NO: 6820263 - DNA, 59 bp, Homo sapiens
agtccttcctctgatctagggtatgaatctgtgtgtgcactgggaaagaaggagggatt

SEQ ID NO: 6820264 - DNA, 71 bp, Homo sapiens
ttgctgcaatgggaagattctttgaactagaccatacttgtctgataatggacttctcatctgcccagcaa

SEQ ID NO: 6820265 - DNA, 63 bp, Homo sapiens
catcataatggaaagacatggtaatgctgcctgcagctttatatgttgtttctccatagggtg

SEQ ID NO: 6820266 - DNA, 60 bp, Homo sapiens
gagctaggctagggggagtcgctgattctgcttttctctgtggtcccctgagtctggctt

SEQ ID NO: 6820267 - DNA, 73 bp, Homo sapiens
tgttatcatgttcatcgtatttaggctggctaccactgagaaagcctggataatggtggtacttgtggtctca

SEQ ID NO: 6820268 - DNA, 82 bp, Homo sapiens
agagtctctgtcacccaggctggagtgcagtgggacgatcttggctcaccacaacctccgcctcccgggttcaagtgattct

SEQ ID NO: 6820269 - DNA, 59 bp, Homo sapiens
agcatagagaatctagatgcctttgacatcatcctcagagagcatcattttctcttgct

SEQ ID NO: 6820270 - DNA, 87 bp, Homo sapiens
gaagctaacttcctcaatgattctgggagtgtaggatggttacgaagccaatttcaactgtcttgcctactcagcattggctgtttc

SEQ ID NO: 6820271 - DNA, 60 bp, Homo sapiens
gaggaatggatcacagtgccgtgggtggggttgcaaacctctccctgtcatcccttcctc

SEQ ID NO: 6820272 - DNA, 62 bp, Homo sapiens
cctgcatgttgtctctacctatgtggagctctctcagttctcccagagtgtgggcatcaagg

SEQ ID NO: 6820273 - DNA, 64 bp, Homo sapiens
aagagctagagggagaagggcacttgcggagtagccaagctgcagagagctccctgtagctgtt

SEQ ID NO: 6820274 - DNA, 67 bp, Homo sapiens
gttccccttcacactttatttatttcatgctcccaaggcgggaagacaatggaggtgcctagggaac

SEQ ID NO: 6820275 - DNA, 68 bp, Homo sapiens
ttgttttatgtatcctggtttcaatttccctttggagaataccatacacaggatacatacggaagcaa

SEQ ID NO: 6820276 - DNA, 88 bp, Homo sapiens
tattcagtttggaccaaattaaaagttggctgcaatttattcccttgcactgtagctaaaatcacctttggtcctttgtaactgagtg

SEQ ID NO: 6820277 - DNA, 68 bp, Homo sapiens
gaaggagtaggtcatgctctaatttgcatccatggatgtatgttagtgtattatctaaatgacacttc

SEQ ID NO: 6820278 - DNA, 55 bp, Homo sapiens
cttctagctgggtggtctgacaggaacgacaagatgtgctacccagtttcagggg

SEQ ID NO: 6820279 - DNA, 130 bp, Homo sapiens
atgtgtgtatatatacacatatgtgtgtgtatatgtgtatatatacacatatgtgtgtgtatatgtgtatatatacacatatgtgtgtatatgtgtatatatacacatatgtgtgtatatgtgtatatat

SEQ ID NO: 6820280 - DNA, 67 bp, Homo sapiens
ttctacatgatttgagggaagatagagactagaagtttatttcagctttctgtcagattatatggga

SEQ ID NO: 6820281 - DNA, 106 bp, Homo sapiens
gcctggcacccctcccgcctctgccttgttccatatctactgtcaggacccagaccccagtgttcactctgtggagcccaggcagagcccgagaggcagccatggc

SEQ ID NO: 6820282 - DNA, 73 bp, Homo sapiens
ttgtgcaggaagcatagaagaatgccaagatcattccagatcaaggcaggatgcttatgtcctttctggacaa

SEQ ID NO: 6820283 - DNA, 68 bp, Homo sapiens
tatacaagaggtgagatgagcaggggactgcctttcccatcctgtctatcagcctcccttcttgagta

SEQ ID NO: 6820284 - DNA, 56 bp, Homo sapiens
tcatgagaattagagtcatttttaactaatgggaaatgactaaatgttcttataga

SEQ ID NO: 6820285 - DNA, 58 bp, Homo sapiens
gctgttctttgcatctctggtgcctagcacagtgcccagcatggagtgaggactcagt

SEQ ID NO: 6820286 - DNA, 61 bp, Homo sapiens
tcttaagttccaggtgtgctcaattcactccacttggtgagcagcacctatctggataagg

SEQ ID NO: 6820287 - DNA, 63 bp, Homo sapiens
gttaaaatattgttattctgcagtatttctggaaaatgaaatagtgtagttctagtttttaac

SEQ ID NO: 6820288 - DNA, 62 bp, Homo sapiens
gccggttgctgtggtagttaatattatttgtcttgcttgcgaaagaggcctcagcagctggc

SEQ ID NO: 6820289 - DNA, 57 bp, Homo sapiens
catttaccagctgtgcactgataatgatttactttgtaggcagtacagttgtaaatg

SEQ ID NO: 6820290 - DNA, 73 bp, Homo sapiens
gccagtgtggtgagattccaggtggatagtatgaaacctatcagcacatactgagaatcacacccattcttgc

SEQ ID NO: 6820291 - DNA, 76 bp, Homo sapiens
ggtgtccaatccacctccctacacccatgggggctgctccagtgtctcccccaggaatgggaaggaggaatggccc

SEQ ID NO: 6820292 - DNA, 83 bp, Homo sapiens
gcagaagctaggtacagaaggacttgagaaagacagtggtgaggtcttgtgactgtttgagtctatttgaattcagcctctgc

SEQ ID NO: 6820293 - DNA, 94 bp, Homo sapiens
gggtgatcaagagtgcagatactgaggactggtttcagccttctcattggagctgaaccacagaagtcaggagcttgctttgagatgatcatcc

SEQ ID NO: 6820294 - DNA, 77 bp, Homo sapiens
atgacagaatctcacaggactgaaacgtaacataatctttatgtgtatgttttctcgttgtagttgttatttgtcat

SEQ ID NO: 6820295 - DNA, 57 bp, Homo sapiens
ggcttcacttatctcatccttccttcatactggagttaaggcatgggaagagaagtc

SEQ ID NO: 6820296 - DNA, 57 bp, Homo sapiens
ggctctgctgggggatgtgtcccaggatcccctggccaagcttctctaagcagcgcc

SEQ ID NO: 6820297 - DNA, 130 bp, Homo sapiens
tcttttgtactgtttttgttttgtaatagtatcagagtaatagtggcctcataaaatgtactgggaagcatttcctctatattctgaaacagttagtgtagagatggaatacggtagaattcagcagtga

SEQ ID NO: 6820298 - DNA, 69 bp, Homo sapiens
tggaccttgccccttgccctttggtcattcaagtaacctgaatccctcagagaaaaggagcaagggtca

SEQ ID NO: 6820299 - DNA, 66 bp, Homo sapiens
aggccctgtccatggtgctgaaggacacattggggaagttctgaagttcacagcactgcagggcct

SEQ ID NO: 6820300 - DNA, 83 bp, Homo sapiens
ttggtggaggatgaaaagatctccccttcaaagagtatgtgaggcatagttttttgataatagatatgcataccttctcccga

SEQ ID NO: 6820301 - DNA, 79 bp, Homo sapiens
gctgctcaatggccttgttctgttatgctgcagagggtctgtacttcggcagcaaaggaagccaggtccagcatagcgc

SEQ ID NO: 6820302 - DNA, 62 bp, Homo sapiens
agatgtttttccaggtctaattataagagtcataaggctggaaagatttggagaaaacatct

SEQ ID NO: 6820303 - DNA, 68 bp, Homo sapiens
ggaggggcttaggacccagcccatggaggctgaatggggctgcaaagggcatggcctgagcacttttc

SEQ ID NO: 6820304 - DNA, 55 bp, Homo sapiens
gaagctgatgaggaccagattgccatgcttctcacatgccttcctcatctccttc

SEQ ID NO: 6820305 - DNA, 68 bp, Homo sapiens
gaggcaggagtctctcttgagcccaggagtttgaggccagcctgggcaacagagcgagaccctatctc

SEQ ID NO: 6820306 - DNA, 59 bp, Homo sapiens
tactctgctcattggagtgtgttcttcatgttcacgcacaagttttcaggagcatagtg

SEQ ID NO: 6820307 - DNA, 59 bp, Homo sapiens
ttttcagtgctaggtaatggagctcagaacacactgactcaaaatttggcatttgagga

SEQ ID NO: 6820308 - DNA, 80 bp, Homo sapiens
gttgaatgtgattaaaggtggaaggcaggtttgtatcactggctgcagagctcaactagtctattttcaatctattcaac

SEQ ID NO: 6820309 - DNA, 76 bp, Homo sapiens
ccaataagctatgttctgtgtctgtggatttgcttcttctgaacctttcatatatatagaatcatacaatatgcgg

SEQ ID NO: 6820310 - DNA, 62 bp, Homo sapiens
gtttcttctttccctctggctgcaaggtgccccacactcctgtggtctggaaggaatggagc

SEQ ID NO: 6820311 - DNA, 76 bp, Homo sapiens
gggaaaccctaaagaataatacccatggagcttaataaataaggcccacaggtcctacctctttctcttgtttcct

SEQ ID NO: 6820312 - DNA, 84 bp, Homo sapiens
tagtgggcctcagtgttggagaccttcagggagagggagaaaggcagccatagccctgaagtgttaccagcatggagcctgtta

SEQ ID NO: 6820313 - DNA, 79 bp, Homo sapiens
cttgggggctctgactccctcagctcctgcccagctagtgtgtcctgggtgcaagtggcagtggggcagggccctggag

SEQ ID NO: 6820314 - DNA, 66 bp, Homo sapiens
gtgggacaaaggggatagcactatggtttatgaggataaataagctggagcttcccccgtccacac

SEQ ID NO: 6820315 - DNA, 70 bp, Homo sapiens
ttcaatcctttatcttgtagttgatttatctttaatctaatgagaaaacaacaacggagaaagggttggg

SEQ ID NO: 6820316 - DNA, 89 bp, Homo sapiens
ggtcccaccaggaaggaggccccatcaggaaggaggccccaacaggaaggaggccccatcaggaaggaggtcccaccaggaaggagacc

SEQ ID NO: 6820317 - DNA, 82 bp, Homo sapiens
tcaaggtttgtatcattcattttgtgtgtgtgtgtgctgaggtatgtcaagtaatgattatgtacagaatgtgcagagctga

SEQ ID NO: 6820318 - DNA, 82 bp, Homo sapiens
ggaccttctgtccagggacagtgattcacccagcccagaatgctcacatctgcatgggagaacactgctctggatgggcgcc

SEQ ID NO: 6820319 - DNA, 59 bp, Homo sapiens
caagtgcatggtggcaaagaatgcaatgataattaattgcccttgctgccattgccttg

SEQ ID NO: 6820320 - DNA, 94 bp, Homo sapiens
tcaaataatttgtgtgcatatagtcttacatctgcattaattaattaaaaagttggtggcagagacataggacataatataacaaataatttga

SEQ ID NO: 6820321 - DNA, 62 bp, Homo sapiens
tctctttaagatgctggaggcttaataggactcaaagccttaaattctccatttgaaagaga

SEQ ID NO: 6820322 - DNA, 59 bp, Homo sapiens
gtaggaaagtaaatgaaatacagcaatttacacaaatgatgtttcataagctgtcctat

SEQ ID NO: 6820323 - DNA, 57 bp, Homo sapiens
gggtagatcacctgaagtcaggagttggagaccagcctgaccaacgtggtgaaaccc

SEQ ID NO: 6820324 - DNA, 90 bp, Homo sapiens
ggagtcttgttctgtccagcccaggctggagtgtagtgacacgatctcagctcactgcaacctccacctcctgggttcaaacaattctcc

SEQ ID NO: 6820325 - DNA, 58 bp, Homo sapiens
cttaggcagtttaggaaagagacattgatcacaatttttccttcctttctgtactgag

SEQ ID NO: 6820326 - DNA, 94 bp, Homo sapiens
gtcaaaatttcaaatttgagaaggaggcaagagtcttgtcgtgcaaggcactggtccattttctgcagcaggtttggttcaattaatttctgac

SEQ ID NO: 6820327 - DNA, 65 bp, Homo sapiens
tgaggtttcaagttgtttatatccagagtttagggactctggtatcctcttagaaacagaactca

SEQ ID NO: 6820328 - DNA, 69 bp, Homo sapiens
gtcttgtctacggctggttttgttctataatggcagaattgaagagatatgagtagttgtgacagagac

SEQ ID NO: 6820329 - DNA, 97 bp, Homo sapiens
gtgagtatgactgtattctgagacttgtgagtccttctagcgaataatcaaacttggagtggtcttggagactctacacgctaatatagacacttgc

SEQ ID NO: 6820330 - DNA, 76 bp, Homo sapiens
tgaagagaatgagaagagcaaggaactggttcacacagtgcgagccccattggtgtgctttacgtggtctgcttca

SEQ ID NO: 6820331 - DNA, 55 bp, Homo sapiens
ataaaaatgtgcacatgaaagggccttatatactgctctttagtcacatttttat

SEQ ID NO: 6820332 - DNA, 82 bp, Homo sapiens
gggtcatcaccgtggggcctaggacagaggactctggcaggcgggacccacagagcctctgccctgggcactgataggctcc

SEQ ID NO: 6820333 - DNA, 119 bp, Homo sapiens
ggcggtcaggccagacacaggagaagggcagcatgtcactagcatggcaaaggatcccagcggcacaggaggcttccccttggcagtgctgtgtttgctgcctggcttaatgtgccgcc

SEQ ID NO: 6820334 - DNA, 68 bp, Homo sapiens
aggaacatcttttttctctaattgtggtcattggcctactgtttaaatgaaaagagagtgtggtttct

SEQ ID NO: 6820335 - DNA, 62 bp, Homo sapiens
agatgattatgatagcactgttctaggcactttatatgaagaaggtactattattgtcatct

SEQ ID NO: 6820336 - DNA, 70 bp, Homo sapiens
agggagtagggatgctggtgactccggtgggaggcacatggagtcagtgatcgcgtgtctctactggcct

SEQ ID NO: 6820337 - DNA, 77 bp, Homo sapiens
tcaaatgtagtgattttcaagtggagcacatcttacatcaaggatatgtgtgctatatttggtagtcaaaattatga

SEQ ID NO: 6820338 - DNA, 98 bp, Homo sapiens
ccaggtgcagtggtgcacacctgtaataccagctacttgggaggctgagaggtggaggttacagtgagccgagattatgccactgcactccagcctgg

SEQ ID NO: 6820339 - DNA, 55 bp, Homo sapiens
tctcagagtaattctttaaggtaagcacatgtttagtttgatgcaatttctgaga

SEQ ID NO: 6820340 - DNA, 76 bp, Homo sapiens
ggcccaactcagattcaagagaaggggaaatagactccacttctggagtctggcccttcttttaaagagagtggcc

SEQ ID NO: 6820341 - DNA, 59 bp, Homo sapiens
ggtccaaggtgagactgaagataagtagaatctccacacttatttgtttactttggtcc

SEQ ID NO: 6820342 - DNA, 63 bp, Homo sapiens
ggtgctgcagggattgaaggaagggacacaatacgccttatctgtgacagccttgtatgcgtc

SEQ ID NO: 6820343 - DNA, 81 bp, Homo sapiens
gagagacaaagcacatttgagaggctgcctgaagaaacagcttgacacaggctacagcctcaagagtgcaatgcttctctc

SEQ ID NO: 6820344 - DNA, 94 bp, Homo sapiens
ggggaactgggctaataagtgactcactagctctcagtgactgcctttgtcctggggtgtaagctttgagtcagggtggtggtgcagattctct

SEQ ID NO: 6820345 - DNA, 59 bp, Homo sapiens
ccagccagaagtgagggaatggccgtcagccctgtgctgagtcccttcactcctgctgg

SEQ ID NO: 6820346 - DNA, 56 bp, Homo sapiens
ctccatgctggcccctgaaactttctttgttgagggacaggggaagaagcaaggag

SEQ ID NO: 6820347 - DNA, 72 bp, Homo sapiens
gctcgggctctgggccagtctcggccgctctgccacctgggcaggcggcgcgctgcctcgacgcgcctgtgc

SEQ ID NO: 6820348 - DNA, 61 bp, Homo sapiens
ccatttgtcatttctcaattactggtcacaacaagaggccactggagaaagtggcaggtgg

SEQ ID NO: 6820349 - DNA, 64 bp, Homo sapiens
gtgtttcatttagtaggaaattgtcttatatttccagagtgtaaaaataccctactagaaacat

SEQ ID NO: 6820350 - DNA, 88 bp, Homo sapiens
ggtgccttggctccattagtgtgctatgtggcctagggctgtgcgcccagtaggctctgcaggtatttcttgatgcggcctaaacacc

SEQ ID NO: 6820351 - DNA, 81 bp, Homo sapiens
ttttccattttgttgatgaagaattgaggcccaaaattataaaagaacctgtctaatgtcacatatcaagaaagtggtaga

SEQ ID NO: 6820352 - DNA, 81 bp, Homo sapiens
attgcccaggcaggagtgtggtggctattcacaggtgcaaacaaagtacgctacagcctcaagctcttggcctgaagcagt

SEQ ID NO: 6820353 - DNA, 59 bp, Homo sapiens
aaccccaggagcgcgtgaacaggctgctggcacggcgcaccgtccgctgctccgaggtt

SEQ ID NO: 6820354 - DNA, 55 bp, Homo sapiens
tccactgacaggtgaatggataaacaaaatgtggtatatatatacctacagtgga

SEQ ID NO: 6820355 - DNA, 92 bp, Homo sapiens
gctgctttactatattgtctctctggaaggcacactttgggtattgtttgctagcacaaagagtctttcagagtcgccttgtaaaggattgc

SEQ ID NO: 6820356 - DNA, 82 bp, Homo sapiens
gaaagatatctatttcacctaaaagtgtcaaaggcctcctgaggtaggaattgtgcattagggaaaggaactgctgtttttc

SEQ ID NO: 6820357 - DNA, 56 bp, Homo sapiens
tccagccggctctgacagctggggccaaggctcttcccagagaagagctggatgga

SEQ ID NO: 6820358 - DNA, 80 bp, Homo sapiens
tggtctataaaatcattttgtagacaaagtgatatttgtttgtttcttaaatatttctgcagaatggttttaaaaggcta

SEQ ID NO: 6820359 - DNA, 76 bp, Homo sapiens
tgaggttataaaccactcctgattcacttcattaagaatgtgtcttggagtttaactggggtgagatgtgacctta

SEQ ID NO: 6820360 - DNA, 55 bp, Homo sapiens
agtgtaagtagatacactgtccttcacaaaattggcagtgtgtactgaaagcact

SEQ ID NO: 6820361 - DNA, 61 bp, Homo sapiens
gcagcagcaggagccgtggggtgaggctgcagcctccatcctgtccaggccctgctccagc

SEQ ID NO: 6820362 - DNA, 58 bp, Homo sapiens
cagcatggaagttatgtaccttttttcgaatgagaagaaaacaatgacttgccagctg

SEQ ID NO: 6820363 - DNA, 73 bp, Homo sapiens
tgacttactgtggacacctattaccagtgagagaaaaacttcatcgctattattttaggttctcagtatctca

SEQ ID NO: 6820364 - DNA, 60 bp, Homo sapiens
ctggcctgcagatcccagggtctggcatcctgtttcatcccctggaatcctgagtgccag

SEQ ID NO: 6820365 - DNA, 64 bp, Homo sapiens
gggaccacctggggctcagacctgcctcccccgacaggcaggtcagctggtgccccaggtgccc

SEQ ID NO: 6820366 - DNA, 66 bp, Homo sapiens
ctccgttgttcaggaggggaatgtgaggctgagaggccaagttcttaactctgagcagcactgggg

SEQ ID NO: 6820367 - DNA, 91 bp, Homo sapiens
ttgagcagagtcaagtaagatgcagctttacaataagggaggcttttctcttccctctccgttatactctatcttgtgaacttctgttcag

SEQ ID NO: 6820368 - DNA, 116 bp, Homo sapiens
ttcatatcctatcctccgctgggctaacattttacaatccttccacaggctgttatcagctaacaccttgcagggattatgacagctggctcaggggaggaacacgtggaaatgga

SEQ ID NO: 6820369 - DNA, 57 bp, Homo sapiens
tctgagggaatagctattgtaggtaaggtgaatatctctaagtaggtgaccctcgga

SEQ ID NO: 6820370 - DNA, 59 bp, Homo sapiens
gacaccaggaatagttctgtctttttaaccttctccagagataagattattcctggttc

SEQ ID NO: 6820371 - DNA, 66 bp, Homo sapiens
gtcaaagatgatgctgaagttattagcttgggtgactgaggaaatgataatgccattaactttgat

SEQ ID NO: 6820372 - DNA, 78 bp, Homo sapiens
gtgctaggcattcagtagaagttagctattatcagctattggcttattaatggccacttcttgcttcaagtttaacac

SEQ ID NO: 6820373 - DNA, 64 bp, Homo sapiens
accacacccctgtagtttttctccttgatgggatgggtttgaggagagcagcagttggtgaggt

SEQ ID NO: 6820374 - DNA, 58 bp, Homo sapiens
catgcttgtccgaggtgagtactttctcagtaagaaagcttctagggtgggcaagatg

SEQ ID NO: 6820375 - DNA, 60 bp, Homo sapiens
ggagatccgtccctaggtcagtctggttgaaccagatattcctgaaggacagggttctct

SEQ ID NO: 6820376 - DNA, 89 bp, Homo sapiens
atgtaagtaagaccttcctaatgtctaatacaaactgggctccagcaagtggccctatttttattagggttttgaaggtttgtgtgtgt

SEQ ID NO: 6820377 - DNA, 89 bp, Homo sapiens
aatcacttaggaaaagatgttatgaaataactatggtcataaatgggccatggatgggtttaacataatatcatgatccattcgtgatt

SEQ ID NO: 6820378 - DNA, 119 bp, Homo sapiens
ggctcatggactgggtggaagatgggcagctctttgtggaacggcagtgtccaggaatttaacgatcctggccgggctggccacagccagagttgctctgccacccaaaccgctgagcc

SEQ ID NO: 6820379 - DNA, 61 bp, Homo sapiens
gccctgggaatggtctctcagctgtggccccttctgggtcccacaggggcctttccagggt

SEQ ID NO: 6820380 - DNA, 97 bp, Homo sapiens
cctctgtaacagtaaagtgatcaaacactaaaatcctgagctgccactgtaattagggaagtatttagtagttttacacatttgactgttcatcagg

SEQ ID NO: 6820381 - DNA, 55 bp, Homo sapiens
tgggtggttgctgaggctccttcgctctggcctggagagacctcatgaccagtca

SEQ ID NO: 6820382 - DNA, 55 bp, Homo sapiens
gcattgccacatgtgtcttagcggacatcattgtctccatgtgatagtggcctgc

SEQ ID NO: 6820383 - DNA, 100 bp, Homo sapiens
ccttctgtctgggtaaccgagtctccactggtccttcctaaaaaagggaaagactttattatagtggcaatagaagaggcatggtctccagtttggaagg

SEQ ID NO: 6820384 - DNA, 62 bp, Homo sapiens
gcttttggaatgaggaacatccagcattttcctctctgttagagattcagcatgccaaaagt

SEQ ID NO: 6820385 - DNA, 88 bp, Homo sapiens
ggcacaggctctgagactgctggcctgggctcaagaccagttcacatgctgctccaggatttcaggccaggtccttacctccctcacc

SEQ ID NO: 6820386 - DNA, 78 bp, Homo sapiens
caacaaaagactagaagagccatacaagtaaaagcaaaataaaacattttgcatgtttgtaggttcttctaaatgttg

SEQ ID NO: 6820387 - DNA, 63 bp, Homo sapiens
ggccagtgctctctcaaccccatgggaccccacatgcattatcgatggacagacagtttggcc

SEQ ID NO: 6820388 - DNA, 122 bp, Homo sapiens
atgacacagtctatgatattcagttaatcctcagtttaagaatctgttgggggccacttgtattttattttcacatatctcttgagctgaaggaagttactcaagtgtttttgatttagaat

SEQ ID NO: 6820389 - DNA, 55 bp, Homo sapiens
acagaggttattgctctccaagttcaatgttgtggacctgaaccagtgcctctgt

SEQ ID NO: 6820390 - DNA, 55 bp, Homo sapiens
gccagtgtaagctctagactagaaggatccttttagaattagctcttacataagc

SEQ ID NO: 6820391 - DNA, 90 bp, Homo sapiens
gggagggcccgcaagctctagctggcgctgacctggggctgaccctctccagcagcctgcaggaagctcagcggggccgggctgcctccc

SEQ ID NO: 6820392 - DNA, 59 bp, Homo sapiens
acttctgagaaatttaaggacagtaacataatgtctttaaaaccagtgtctcaagaagt

SEQ ID NO: 6820393 - DNA, 81 bp, Homo sapiens
tatgtgcctcaagtatttcctctgtcaaatgtagtagttaggcctaagctgtattctgggcagggaaggagaaggcatata

SEQ ID NO: 6820394 - DNA, 75 bp, Homo sapiens
agtgagtagacaaaagggttgccaccttgaaagtatatctatactgtagatgttgcatcctgacgtctattttct

SEQ ID NO: 6820395 - DNA, 59 bp, Homo sapiens
gtagacctactgaggcttgggttccagctcaagagtttgtatttttcagtgaattctac

SEQ ID NO: 6820396 - DNA, 60 bp, Homo sapiens
ggctcctctgacctctaggacaccccacaccccactctttgatccagaggtgttggagcc

SEQ ID NO: 6820397 - DNA, 64 bp, Homo sapiens
ggtggtgtgggcgtggcaggcaagcccagcaccctagggtttctagccaggttctgcattttcc

SEQ ID NO: 6820398 - DNA, 62 bp, Homo sapiens
tcccaaccccagacaccgcctcggggcctgagcccttgagagccactcctggggccctggga

SEQ ID NO: 6820399 - DNA, 62 bp, Homo sapiens
agtccatgatgaaaccagatccaaggtcttgatcttgatctttttactacatcatggtgact

SEQ ID NO: 6820400 - DNA, 61 bp, Homo sapiens
caatggttctcaaactatcatggggaagaagcaccaggaaggtttgttaaagaacagattg

SEQ ID NO: 6820401 - DNA, 76 bp, Homo sapiens
agttttttctctatgtgcagtagtttctttatctgtaaaattaagataatagctactttacagggttggaagaatt

SEQ ID NO: 6820402 - DNA, 129 bp, Homo sapiens
gagtacttacttactttatagaattatttttagttccaaattaatatactatatgttagatataccagtctaagacattagaacattaatattgggagttcagggtagagtttgtgacctattgtactt

SEQ ID NO: 6820403 - DNA, 60 bp, Homo sapiens
tagttgagttctactctcctactcttctattcttagaatagatgtgtagggctccagcta

SEQ ID NO: 6820404 - DNA, 63 bp, Homo sapiens
cctttttctctcattgcaggcagcatctgaagcagacgtagaaactgcactgagaaaaggagg

SEQ ID NO: 6820405 - DNA, 102 bp, Homo sapiens
gcaaagaaggaatgcatggagtggcaggcggccatgatctggcaggcgctgttcaggccctgtttgtgagagggctgttcacctaggtggtgccttctatgc

SEQ ID NO: 6820406 - DNA, 121 bp, Homo sapiens
aaagcagtcataatacagagcatgttttctttgaaagtgtttacttgggaactgtactaatctattaacttgaactgttctttgttctttctagagggaacacttcttatttttctttttt

SEQ ID NO: 6820407 - DNA, 67 bp, Homo sapiens
gtgtgtatggacacatgtcatgttgcgatatgtgatgtatatataaatatggtatgtgtatgcacgc

SEQ ID NO: 6820408 - DNA, 68 bp, Homo sapiens
ttagatcttctgactctgtttttgagcactgtgttcttgaaacagctgctgctgattcagaattctga

SEQ ID NO: 6820409 - DNA, 72 bp, Homo sapiens
aggaaaggggcaacaaggagggaaagggggtaagatttattaccttcaattatttttgttccaaactttcct

SEQ ID NO: 6820410 - DNA, 73 bp, Homo sapiens
tcttgagagttatttatatattttatatgcaagccccttgttcaatgtgtggtttgtaaatgatttctcttgg

SEQ ID NO: 6820411 - DNA, 77 bp, Homo sapiens
gaaatggaatgcataaatattgttgggagtattcatttgaattttgagctttacttaaaacacatttagcatttttc

SEQ ID NO: 6820412 - DNA, 63 bp, Homo sapiens
gtgggtgtaagagaagctaaccagaggaagtgaatcacttcctgtggtcattcttctgcccac

SEQ ID NO: 6820413 - DNA, 90 bp, Homo sapiens
agaaggtgtactaagggttcattccatgtacagaagttaacctaatgctttgttttgataaggaaatgaaactctaatattatgcttttt

SEQ ID NO: 6820414 - DNA, 73 bp, Homo sapiens
taatagtcactttatgggaagcaaaaatttaggttgatactttccagttttattgtcccagaggtgatagttg

SEQ ID NO: 6820415 - DNA, 60 bp, Homo sapiens
aggtagtagcatgtatcagtacttcattcctttgcatgactgaataatgttaccatactt

SEQ ID NO: 6820416 - DNA, 94 bp, Homo sapiens
attgttactagaaaacggtagctaccagtatacattatttctatttctattacgagatgctgtgaggaagctaggactatttcttgtgcacaat

SEQ ID NO: 6820417 - DNA, 105 bp, Homo sapiens
tcttgcacagcatttagtacagtgcttggtatctagtaagctctcaatagacattgctaccattgataccagcactgcctctactaataattctgctacaaaaga

SEQ ID NO: 6820418 - DNA, 61 bp, Homo sapiens
ctgtggatcagtttggaaactttattgccattttaacaatatcaagtcttttgatccatag

SEQ ID NO: 6820419 - DNA, 75 bp, Homo sapiens
gggtgatgctgacaggagtagggagcaagcaggaaggaccacgtgccttctctggcttctaccttgcagtttccc

SEQ ID NO: 6820420 - DNA, 115 bp, Homo sapiens
ctgccctgcagttgtgctgtgtttttcccaggctgggtctggcctttggcaaacagtcagctgggctagggcctgctatggtttggaaaggcagcttcagaggtaccatgggcag

SEQ ID NO: 6820421 - DNA, 62 bp, Homo sapiens
ttaggcacactttaccccctgaggaatctgaaacacacacagggattaagtgacttgcctga

SEQ ID NO: 6820422 - DNA, 59 bp, Homo sapiens
gtgactatttcacatagtctttctgaattgtcagtaataggcttgggtaaaaaggtcat

SEQ ID NO: 6820423 - DNA, 69 bp, Homo sapiens
gtgcctttgtgtctaaaacagccatgctacaaattagcactgacttgcctttattaggcacaggggtac

SEQ ID NO: 6820424 - DNA, 119 bp, Homo sapiens
cctggggccctggagaacagacagctctgactcagagaatatctagaaggagtgcagacctgggcatcctaagggattgttttttcagtctggttgaagtggtccagtagcatcccagg

SEQ ID NO: 6820425 - DNA, 86 bp, Homo sapiens
cttagtctcctatacccgtcttgggcatttagctgtacttgtggtcaaccttaagaagttctgcctaagggacaagggaggcttag

SEQ ID NO: 6820426 - DNA, 61 bp, Homo sapiens
gctgtgacttaagcataggccttctttctccccatggccctgtgtgcccttaattcacagc

SEQ ID NO: 6820427 - DNA, 75 bp, Homo sapiens
atatattggcaggctttaatagtgactggtttttcactggagatctgcagttttctaaagtctctttaaatgtat

SEQ ID NO: 6820428 - DNA, 66 bp, Homo sapiens
agtttctcttaatctagtatctatagtacataatgcaggcctgaaagtgctagattttgaggagct

SEQ ID NO: 6820429 - DNA, 76 bp, Homo sapiens
cagggtctggttgagggctggggtggtgacggcgtgattgtgcctggctaccgggttctcagccaggcagcacctg

SEQ ID NO: 6820430 - DNA, 57 bp, Homo sapiens
tatttgcaacataaaactctgaaatatttcttcttttgagagttatggttgtaaatg

SEQ ID NO: 6820431 - DNA, 76 bp, Homo sapiens
ttgctaattagaggggtcttgtggcctagaacagcttcttagtcttggctttaggccaaagcctaactagatgtaa

SEQ ID NO: 6820432 - DNA, 70 bp, Homo sapiens
tgtcggtgcaggccagcttgatgacctgtgggacatcacagaagaagttgtccagctggtttgggccaca

SEQ ID NO: 6820433 - DNA, 69 bp, Homo sapiens
agcttgaacctaaaacaataatttaagtggacatactaatgtggttgtaagttttaggtgtttcaagct

SEQ ID NO: 6820434 - DNA, 70 bp, Homo sapiens
cctgtgtatctgggaaggggagaatagagccctttggctctttacttcagtattctcagataaattcagg

SEQ ID NO: 6820435 - DNA, 129 bp, Homo sapiens
gatacctattccttgtcaaatatttgaaggtatgaaagttaattttgaatgtctttttgccttttaatagagtcaggaacattgtagaattgaaactgtattattttttctatttcccaccaggggttc

SEQ ID NO: 6820436 - DNA, 75 bp, Homo sapiens
tccgcaattaaaatgctagagtcagtgctaaattatttaaacctcaataattgcttgatgactagtaattgtgga

SEQ ID NO: 6820437 - DNA, 91 bp, Homo sapiens
cccctaatgcacatcaattgtaagttgacttaaagttgtacagatccttcctttctgtgcattgagtcatttcagtatgtctatggagggg

SEQ ID NO: 6820438 - DNA, 81 bp, Homo sapiens
gattttatgatacatactttttcttgcaagcaattttgcagcaagttctgttgcctgtaaagaaaggttgatcatttagtt

SEQ ID NO: 6820439 - DNA, 80 bp, Homo sapiens
tcatagaatgtacttacacagctgtagaaggtatagcgtacttgcacttgcaggctgtgtggtagaacctactgctgtga

SEQ ID NO: 6820440 - DNA, 58 bp, Homo sapiens
tgaccctgaaatgtagtggtttaaacaataaccattttattgcatcatttatgggtca

SEQ ID NO: 6820441 - DNA, 104 bp, Homo sapiens
tacttaaatatatttgatctggttcaataagtcagaatgtttggaaataaaagactgaataatattccaattaattgagtattgaccagaaaatttaaaaggta

SEQ ID NO: 6820442 - DNA, 67 bp, Homo sapiens
gtcccagctgggagcggccatattgttttctgaaaccatggaaaccattcccgactctcctgggtac

SEQ ID NO: 6820443 - DNA, 56 bp, Homo sapiens
ttcagcacctggaatagcacctagtaaatggttggtgctccataaaggtgtatgaa

SEQ ID NO: 6820444 - DNA, 70 bp, Homo sapiens
ccagacacacccctgggctgggcacacagttccttatttgggttttgtggttttcccaggtggtagctgg

SEQ ID NO: 6820445 - DNA, 124 bp, Homo sapiens
gagtagcagacacacttgacaaagtcaaaatgctctcctgtcagtgcccatatgaactattacaatgacagaagagcattttaattttgtccagttcttctttctccttttcactctgcatttc

SEQ ID NO: 6820446 - DNA, 67 bp, Homo sapiens
ggaaagtgatggaataatccaagattttaacggttttgaagccttggcccttcattataatttttcc

SEQ ID NO: 6820447 - DNA, 69 bp, Homo sapiens
tatattctgtgccattctttgtagcatgatgaactctcattctgccctgccccagtggcactggatgtg

SEQ ID NO: 6820448 - DNA, 56 bp, Homo sapiens
cctaaaaggtgaaatcatatgattgagtaaattatgtgatagagttactttatagg

SEQ ID NO: 6820449 - DNA, 73 bp, Homo sapiens
aagaatcagacccactgtagccactctgggtaactctttcaatatagaagctcagagtgatacatttattctt

SEQ ID NO: 6820450 - DNA, 67 bp, Homo sapiens
gcatttctgtcagctgctttgtctcaccatggcctgtaatggtgaaagtgttcactgccagaaatgc

SEQ ID NO: 6820451 - DNA, 58 bp, Homo sapiens
gtgtgcttccagggtgtcatccgccagggcagtggcctctgagctcctggaagcgtgc

SEQ ID NO: 6820452 - DNA, 92 bp, Homo sapiens
ggattaaatgagatcatgaatgtgtagcatttaatgcagtctctgacacgtgggctgcattccgttcactttagcgatcatcattattatct

SEQ ID NO: 6820453 - DNA, 67 bp, Homo sapiens
cagtgttgctagacaggtagatacagaaaggcaatttgggcagctgtagctgtctgagcagacactg

SEQ ID NO: 6820454 - DNA, 60 bp, Homo sapiens
gggaagcagagcaggggctgggatacaggctgctggtcctgctaccatgctgtgtgaccc

SEQ ID NO: 6820455 - DNA, 63 bp, Homo sapiens
cctctttctctgtctctctggaagcacacaaaaaacggtttctcagaaaatgtagagaaaagg

SEQ ID NO: 6820456 - DNA, 56 bp, Homo sapiens
gcggcagcctttcgggtggattttgttgttgcagtgccacctggccaaggctgtgc

SEQ ID NO: 6820457 - DNA, 56 bp, Homo sapiens
ggactatgtgcctgcgagtgtcaggtgataccctgaagcatcagggcaggtggtcc

SEQ ID NO: 6820458 - DNA, 59 bp, Homo sapiens
tggccatgaaggaggcagcagaggagatcccaactctgctactcaccaatcatgagcca

SEQ ID NO: 6820459 - DNA, 89 bp, Homo sapiens
tccattagccattgtgatgttctcttcctggtcagtgagtaatgactgtgatccaggccaggagagcgaggtttatgttttttgatgga

SEQ ID NO: 6820460 - DNA, 111 bp, Homo sapiens
gaagaaaatttgcactgctttccactaattttattgtggcagattggcattattcctagagtgcaataagtattgcttacatgaaagaggagagcgggacagggaagcttt

SEQ ID NO: 6820461 - DNA, 61 bp, Homo sapiens
tttggtttttacctgctgagagccatctttcaaggctagtttctagtagttagagaccaaa

SEQ ID NO: 6820462 - DNA, 68 bp, Homo sapiens
gctgctgagacacctaaggtaaatctctatatattagtccatttactaaataggtcagtcatggtagt

SEQ ID NO: 6820463 - DNA, 86 bp, Homo sapiens
ggagcgaggaggaaagaaaaatactgtgctccaggactcgtcccaagcctcaccaggagatgcggtgtttgctctcccactcctcc

SEQ ID NO: 6820464 - DNA, 56 bp, Homo sapiens
gcatccattcactcaacttagatggcatttcctttgtcgtttgagttaatggatgt

SEQ ID NO: 6820465 - DNA, 95 bp, Homo sapiens
tcagttttgatcatttatatatctgcagtactgaagaacttgcctggtattaagtgtccagtaaatatctgtagaacgaatgaataaatgcatga

SEQ ID NO: 6820466 - DNA, 75 bp, Homo sapiens
gcttggcatgtatgttagacaagcctacagggcttacctaatttgtgggactgactggctctttacatgccaggt

SEQ ID NO: 6820467 - DNA, 57 bp, Homo sapiens
gatgctgcttttgagttaaagtcatgatatgtaatgatgaattttaaaagcaccatt

SEQ ID NO: 6820468 - DNA, 84 bp, Homo sapiens
gatgtttacaggagaaacagtgtttttgcttatatatgtgtgaaagtgtatgaagccagaatctgtttataactggtatatatc

SEQ ID NO: 6820469 - DNA, 73 bp, Homo sapiens
gtgtttttacatgccttactatcctgctttttcttccaagatgaggttcaggaaatgggcaaagtagagacac

SEQ ID NO: 6820470 - DNA, 84 bp, Homo sapiens
tggtttttgttcctaagtgtctacatttgctaaccagattctctgtttctggtttctgtgaagatagctaccggcacaaagcca

SEQ ID NO: 6820471 - DNA, 70 bp, Homo sapiens
gtagagaaactatggcatttattttgtcaattttgatgattgaacaagtaaaagctattactttttatgc

SEQ ID NO: 6820472 - DNA, 87 bp, Homo sapiens
atcattctgcaagtctctagccaaaaggtcacatgctaacttggtacgtatgtatatatgttgggtagaatacttgctccagatgat

SEQ ID NO: 6820473 - DNA, 64 bp, Homo sapiens
tcctctctttcattggtcgccttggaggccgctcgcctccggcgcgggcacagagaggggcggg

SEQ ID NO: 6820474 - DNA, 55 bp, Homo sapiens
cagagtgatttgatgagttgcatatttaatggcatcatcgtggaatgcacgtctg

SEQ ID NO: 6820475 - DNA, 79 bp, Homo sapiens
gggtttatggaacaggatctgaaatctgctggttggaaatttcaacaagtatttttcaaggctttctatgtgccagccc

SEQ ID NO: 6820476 - DNA, 72 bp, Homo sapiens
gcagactgagtgatcagcttgggtccgtccatgtgggggacggagcagatggagtggtcaaattgggtctgc

SEQ ID NO: 6820477 - DNA, 72 bp, Homo sapiens
aaggatggggcgcagccttgacaggtggaggtatgaatgaatacaggttaagccaaggctggcctttttttt

SEQ ID NO: 6820478 - DNA, 90 bp, Homo sapiens
ctggagtctaatttctaagttaatccatgcttgccttataagtaccttaaccaaatagactgtaatggaagtgggattgcatgacttcag

SEQ ID NO: 6820479 - DNA, 70 bp, Homo sapiens
ctgcttttttctatcgcacagccattttatcatttacccttgtgatatccccgtgaaagagacagggcag

SEQ ID NO: 6820480 - DNA, 67 bp, Homo sapiens
gtgcaggtggcttctagcttctttggcagggaaaagaggcatgaagaaaagaagctaaattctgtgc

SEQ ID NO: 6820481 - DNA, 75 bp, Homo sapiens
gataaattaggttacgctatgggaacaaactctcaatgttaataaaagttgatttcctagctgacatgaaatatc

SEQ ID NO: 6820482 - DNA, 60 bp, Homo sapiens
ataatgggaagctagagagcatggttccagccatcactcagctttcaagcttgtcattgt

SEQ ID NO: 6820483 - DNA, 93 bp, Homo sapiens
tgaaggatgccagtactaaattgcaatagatatgcttgtcgtgcagacccagtgatctgataacaaccatgtctggcatgtagttatctttca

SEQ ID NO: 6820484 - DNA, 63 bp, Homo sapiens
gacagaaggcagccagatcctttgggttgccaaacccctccattctgaaggctgccatttgtt

SEQ ID NO: 6820485 - DNA, 66 bp, Homo sapiens
aaatcctaccaagaaattccctctttcctttatgggatttgcttggtggatttgcttggtggattt

SEQ ID NO: 6820486 - DNA, 70 bp, Homo sapiens
tctccagagctgcagattgaaggcatattttcatctgactttggtgattatgtttccaatctctctggga

SEQ ID NO: 6820487 - DNA, 56 bp, Homo sapiens
tgtcaacagtcattctagtatggtggcattcctccaggagggggatggctgtagca

SEQ ID NO: 6820488 - DNA, 80 bp, Homo sapiens
tttactgtgtgtgtacagatgaccttttgtttagattgaattgtctccccagaagtaagattactgtgagtcatggtgaa

SEQ ID NO: 6820489 - DNA, 104 bp, Homo sapiens
ttgagatggagtttcactcttgtcactcaggctggagtgcagtggtgcaatctcagctcacttcaacctctgagtcctgggttcaagtgattctcctgcctcag

SEQ ID NO: 6820490 - DNA, 77 bp, Homo sapiens
tgttgtttgtttcagttgccaagctaattctcaacattcttactttgagagatagcatggtatactggttaaccgca

SEQ ID NO: 6820491 - DNA, 77 bp, Homo sapiens
gaccgatgcagtaaacactagcattcttggaattgcaggttatcattttccaagctgctgctgttgattcttccttc

SEQ ID NO: 6820492 - DNA, 99 bp, Homo sapiens
cctatttttttttttcccttaggacaacaggcagacgtcagaaagatgtgggatttttctgagttttcctgattggcctaaagcaatgaagaggagagg

SEQ ID NO: 6820493 - DNA, 56 bp, Homo sapiens
taagtgagaaagacattaactgcttaactgatagcagctggtatttccttcactta

SEQ ID NO: 6820494 - DNA, 115 bp, Homo sapiens
ccccgaccttttcctagtaaaaccccttatttctcatcagatataagtttgcctggaagatatatgtctggaatttgaggttcagtttgcatgaggaggacaattttacttgggg

SEQ ID NO: 6820495 - DNA, 61 bp, Homo sapiens
gtgctggtgccctacacatttccagttttccaagcaaatgttcacggggagcatagagcat

SEQ ID NO: 6820496 - DNA, 70 bp, Homo sapiens
aaagctgtgtgccagacatgatgctatggcccaagttccccatggaattttctaggcataaaactgcttt

SEQ ID NO: 6820497 - DNA, 89 bp, Homo sapiens
agcagcatctattctaagagctcttcataaaggcatatgtcagtattcttatatggctcattaagggcttttcctagatgtatcttgct

SEQ ID NO: 6820498 - DNA, 76 bp, Homo sapiens
taagctagtaaaatatttcagaggatctggcttatgaaaactttaagcatttccaagagtatagtttattggctta

SEQ ID NO: 6820499 - DNA, 61 bp, Homo sapiens
tctccacagctggcccccaagaggaccctttccaagtccccagctgggggccctgtgtaga

SEQ ID NO: 6820500 - DNA, 64 bp, Homo sapiens
cccctcaaaggttctttgagaactctgtgcacatttatgcagaattgatggagaacttaagggg

SEQ ID NO: 6820501 - DNA, 76 bp, Homo sapiens
ttcctgttggctatgatgcccatacacgttctttttccagatggaaccaaaagagaaagtggcaggctttcaggga

SEQ ID NO: 6820502 - DNA, 68 bp, Homo sapiens
cttggacaagatctcattgcattctagattaatataacctgaagtaatttggaaatgaggctaccaag

SEQ ID NO: 6820503 - DNA, 117 bp, Homo sapiens
aggccccgggactacatgaagagagagagatggttggctaggtcccagctactctgcccctctgctgactacctggcttcaaccatcatttgactactactatgatagaccctgcct

SEQ ID NO: 6820504 - DNA, 77 bp, Homo sapiens
ctgtcccctctgcccttgcagggtgacgactggataatcacagtgaatgagctcctgccagggccagaggccagcag

SEQ ID NO: 6820505 - DNA, 63 bp, Homo sapiens
catgcttcacacactgaatgacaggtagaaaaaagggaccattatttagaccccagaggcatg

SEQ ID NO: 6820506 - DNA, 66 bp, Homo sapiens
gccatttcgtaatgctatgccttgctgtggatctattttcattacttaggcaggcatttagtgagt

SEQ ID NO: 6820507 - DNA, 63 bp, Homo sapiens
acccgaggacgccacctgggccctagtcccacttggacactggctctgggtgtgaccttgggt

SEQ ID NO: 6820508 - DNA, 59 bp, Homo sapiens
aggcaggactctgggtcagaactcaaatccagatcaatctggcctgaaagtccatgctt

SEQ ID NO: 6820509 - DNA, 129 bp, Homo sapiens
cttgcctcacctcaccttcccctctcttctcaaccctcttcaggatggcttgtgatgccaacattctcccttaaattactcttgcttggctcacgagtcaccttgaggacagtaggttcaatgggcaag

SEQ ID NO: 6820510 - DNA, 58 bp, Homo sapiens
acccaggctggagtgcagtggcacgatctcggctcactgcaacctctgcctcccgggt

SEQ ID NO: 6820511 - DNA, 64 bp, Homo sapiens
ctgttgctaaaggtagcatttatcttgcaggtattaattcagaaagtgctaatggttgcaacag

SEQ ID NO: 6820512 - DNA, 75 bp, Homo sapiens
cacttgctctgctgggtcctggtgctgagttctccacgggaggtgacagcagaggggcccaattgccagcttgtg

SEQ ID NO: 6820513 - DNA, 60 bp, Homo sapiens
tatgtatatggctcttccccatccagtttgcaaagtttttgagggcagggccttagcata

SEQ ID NO: 6820514 - DNA, 72 bp, Homo sapiens
actgagcagatatagtggcttgcctggggctcaatcctcctgtcttcattgctattcactgtactgctcagt

SEQ ID NO: 6820515 - DNA, 101 bp, Homo sapiens
agcgagtctcatgagatctgatggttttaaaaaacgggagtttgcctgcgcaagcgctctctctctttgcctgctgccatccatgtaagatgtgacttgct

SEQ ID NO: 6820516 - DNA, 68 bp, Homo sapiens
tttatgattatggtagaaacaagaagtgagattttcactctgtgtttagtgctgccattctttgtgaa

SEQ ID NO: 6820517 - DNA, 63 bp, Homo sapiens
tctaacctttttatcttacctccagctagtgaaactccagttagatagatgagaagtgttaga

SEQ ID NO: 6820518 - DNA, 115 bp, Homo sapiens
tggcagctggctgggattgaagtgtgaatgttgatatgagtacagaaatatctgggctaccccttctgattcattcacacattatcacatgattgccttggccttgataatgtca

SEQ ID NO: 6820519 - DNA, 64 bp, Homo sapiens
tggggtggtgtttgtctcatatcagcctatcttttctgccattgagataataaacatctcctta

SEQ ID NO: 6820520 - DNA, 59 bp, Homo sapiens
tcaccactgctatgtccccagcccaggctaaatgccaggcactgggaatgcagtgatga

SEQ ID NO: 6820521 - DNA, 107 bp, Homo sapiens
gggtgggtgcaaatggagatttagagactatgaagattcttaactttgccaaagttttaatcaaatgtatgagaaagtcgtatgtctcccgacctccatccccaccc

SEQ ID NO: 6820522 - DNA, 69 bp, Homo sapiens
gcagaggaaatgtttgctgaatggaatttctgtaaggagggattcatgtcatagcaggatttccactgc

SEQ ID NO: 6820523 - DNA, 59 bp, Homo sapiens
tgcaagcaagtttttgaagtgggcatgcatgaattctttcatttcagtaatggtttgca

SEQ ID NO: 6820524 - DNA, 129 bp, Homo sapiens
gtgaagagagatggggagagacagggagggagggaaagggagcattcagtgaacacccactaatgaggtaagtttataggtccctttgtcctagattctctcttttcttcctccaccccaacctgccac

SEQ ID NO: 6820525 - DNA, 121 bp, Homo sapiens
gggggtagaattcatggggataagtgtatgagtacatagagccaggcgtgtcacgtcaggcagtgctaccattgaatgcctgttctttgctcaacaacttgctctgcaaattataatcccc

SEQ ID NO: 6820526 - DNA, 61 bp, Homo sapiens
ctctctgggaatattttattctgatccagtagcagggaggaaaaggatgttatcccaggag

SEQ ID NO: 6820527 - DNA, 60 bp, Homo sapiens
ctctctgcctcaagtgaacttttcatgcaaagttgtggacagagcatttgggacagagag

SEQ ID NO: 6820528 - DNA, 57 bp, Homo sapiens
agaacaggcttccaggagggacgaaaagggtattttcggcctttcagagtgtgtttt

SEQ ID NO: 6820529 - DNA, 68 bp, Homo sapiens
ctacagtgatttctctggttaatagatgcatgcatttccatgcattatacttttagaaatttctgtag

SEQ ID NO: 6820530 - DNA, 65 bp, Homo sapiens
gccaaggagctgcaggcacttgtttatcttctggtgcgtacgagtgtgtatggctccccagtggc

SEQ ID NO: 6820531 - DNA, 67 bp, Homo sapiens
gctatttaccttgtgtagatgtccaggccttcttgctggtgttgccttccacgtcaggggaaatagt

SEQ ID NO: 6820532 - DNA, 109 bp, Homo sapiens
taggaaattcagaaggcgaagttatacagactgaactaggatatatttctgaccatgttgtccataggtaaatatgtctagtttttacctgtggcctgttctgttctta

SEQ ID NO: 6820533 - DNA, 123 bp, Homo sapiens
gagcttttcattaatttgtgccagaccatttaatatattctacagtgttcttgtttcacttaattttctggatttccaagaaagctttaggatttggtttggtgagaggccttgaagggactc

SEQ ID NO: 6820534 - DNA, 75 bp, Homo sapiens
gtcaatgttttgccagaaaatcaaagtcagaagccacctaggtgcgctcagaaaagattttcttcaaatattgac

SEQ ID NO: 6820535 - DNA, 82 bp, Homo sapiens
agggaatttatgacaaacaggtaggtgtgttagaagtcaacattttatacctgctgatgatttggcataaactatcttcctt

SEQ ID NO: 6820536 - DNA, 59 bp, Homo sapiens
ctctcaggagccacagcgggagttgctcactgagaagactttctgtggttaccagggag

SEQ ID NO: 6820537 - DNA, 98 bp, Homo sapiens
cagggtttgcttggtaggcactgtgtttgtaggagtacagtcttaactgctgtaacaaaggggctccaaagtacagtgacttaccaagagagaagttg

SEQ ID NO: 6820538 - DNA, 113 bp, Homo sapiens
gatgaatcaggaaaagagagaacagagatggggccagctgctcccagatccttagacattctaaataagggggagagactcagtcttttctgattaatctttgatgatttatt

SEQ ID NO: 6820539 - DNA, 66 bp, Homo sapiens
ttttggctaattttcatcatgggtttaacattagcttggctgatgtttgacatgaagaagccaaaa

SEQ ID NO: 6820540 - DNA, 93 bp, Homo sapiens
ctttacaggcataggctgttacactgtgcactaaatttgagaattcggaacagctatcagaatgcattttgtgtagctatgatgcctgtggag

SEQ ID NO: 6820541 - DNA, 63 bp, Homo sapiens
gaagaaagagatgtgccaaatagccttatggtgccagggctagaatccgcgtctcttgacttc

SEQ ID NO: 6820542 - DNA, 130 bp, Homo sapiens
ggaagaaagagctaggctaaaaaataaaaagagagacttatgaatgagagaatagtggagcaacacaattgcttcagattcttttcatgtctttaggtatctctcttttcccaaattaactttattttcc

SEQ ID NO: 6820543 - DNA, 92 bp, Homo sapiens
tgattctggggtggaggggtgggcatggggatacctgaaactgcagctctgtgcctgaaagccatgctcactcacacagctccagatgctca

SEQ ID NO: 6820544 - DNA, 106 bp, Homo sapiens
tttacttaggttctgtgatggtcaaggaatgtcaggaattttcctttcagagaggaatagcttcaccttccttgctaagaccagtcatgtctagaattagagtaag

SEQ ID NO: 6820545 - DNA, 59 bp, Homo sapiens
gatgcgttggttgagattacatcctctccttcgggaggggacagagggcagcccgcatc

SEQ ID NO: 6820546 - DNA, 66 bp, Homo sapiens
tgtctccattcttctatccctttcctcggggagccctgtgcactggttgacagaagaaggatgaca

SEQ ID NO: 6820547 - DNA, 75 bp, Homo sapiens
aaccacagaagcactaggaggaaacgttgctatttgtattagtgacgtggtcactggagtgcagtttccatggtt

SEQ ID NO: 6820548 - DNA, 73 bp, Homo sapiens
gctgatgtctcagagtggtcactgggaagacggatgacggtcctgcccgatgtccattgtggggccggatagc

SEQ ID NO: 6820549 - DNA, 77 bp, Homo sapiens
tgtggacttctcttaagcattcgggactgcagcatttttgagagcatgcagcattgaaatagctaggcttgtcttca

SEQ ID NO: 6820550 - DNA, 65 bp, Homo sapiens
ggaggtatgtatgctacattctttagttaatttcatgtgagggatcatcaggtatatatatttcc

SEQ ID NO: 6820551 - DNA, 77 bp, Homo sapiens
tgaagttaaagggcttgtccaagttcatacaactagttagatgtataagcagaacttggacctggtcctttggttca

SEQ ID NO: 6820552 - DNA, 60 bp, Homo sapiens
tatcacactcggaaatctaggatggtacctgtaattccatcctggacaatggggtggata

SEQ ID NO: 6820553 - DNA, 78 bp, Homo sapiens
agaggcatccaacagacaactcctgtggctcacccaggtcagggtgggtacatttcaggctgtcttgtagctgcttct

SEQ ID NO: 6820554 - DNA, 56 bp, Homo sapiens
actcattctggtactctattttgtacatcttgaactggagtgcactcagagttggt

SEQ ID NO: 6820555 - DNA, 58 bp, Homo sapiens
gtctctgccattccattaggactcagtgtcacccaggagcctagagggaaggcaggac

SEQ ID NO: 6820556 - DNA, 57 bp, Homo sapiens
cacttagtgccctggcccttacacctataaaatgagtgtcatgctggggcatgggtg

SEQ ID NO: 6820557 - DNA, 60 bp, Homo sapiens
aaagtttagtgtcctctaccacatgcttactacagtggagagctccagaagctaaacttt

SEQ ID NO: 6820558 - DNA, 63 bp, Homo sapiens
gttgtctctttcatataaaattaggttctttactcgagggcctacattttggaagcagccaac

SEQ ID NO: 6820559 - DNA, 55 bp, Homo sapiens
gaacgtggcaggctttactaccaggaacgcactcggtggtggaggccccatgttc

SEQ ID NO: 6820560 - DNA, 69 bp, Homo sapiens
gcttccacttgggaacctctctgactccaccaggatgagaaacaaagagttggagaggagaatggaggc

SEQ ID NO: 6820561 - DNA, 87 bp, Homo sapiens
ccatgattttaaaaatgagggagcttagggaatgaggaaagaccaaaactatagtctaagcccttcatttatagttggaatctgagg

SEQ ID NO: 6820562 - DNA, 65 bp, Homo sapiens
tctcagaatcaggacctacttcacgatgcagagtggtttagcagggagagaggccttggatgaga

SEQ ID NO: 6820563 - DNA, 68 bp, Homo sapiens
tcctgaaaggcatcatggctggctattttccaaggaagacaggtaatgcttggtgcaggtcatcggga

SEQ ID NO: 6820564 - DNA, 56 bp, Homo sapiens
gcaagtgtggcttaaaagtttccagagagtcagggaagatccaagcaggcacttgt

SEQ ID NO: 6820565 - DNA, 55 bp, Homo sapiens
tgtctggccttctctgttacagaaaatctggaaaatatagaaagggttaaagaca

SEQ ID NO: 6820566 - DNA, 128 bp, Homo sapiens
cccctgagccttggcttcttcatctgtgactgagctgtgagtgaggctaataggcaatggttttaaaattatgttttgctgagccctcagtccttccacagacagcattgtaagaggagggtcagggg

SEQ ID NO: 6820567 - DNA, 76 bp, Homo sapiens
tctttagcactggaaagttaagagttttgatctcagagttcatcaactcaagcttttgctttttatttgtaaaaga

SEQ ID NO: 6820568 - DNA, 69 bp, Homo sapiens
tatgctgccagggctataccactctataccccagctccaccactggggtctgtatggtatggaagcatg

SEQ ID NO: 6820569 - DNA, 65 bp, Homo sapiens
cctccactattggtccctgggcaagaatgtgtgccccagggcatgtaactaatggtggccacagg

SEQ ID NO: 6820570 - DNA, 55 bp, Homo sapiens
ccttatgggaatgagggtcaggacatataatcctttctctctccttcctctgagg

SEQ ID NO: 6820571 - DNA, 73 bp, Homo sapiens
gtttctttcaggaacttgtagtatcttgctgctctagtatctgtctgaaatactgcaggttctctgatgctac

SEQ ID NO: 6820572 - DNA, 65 bp, Homo sapiens
tctgtctgactaccatgaggcaaccctgaagatagaagccatgtgcctgtgggtggcagaataga

SEQ ID NO: 6820573 - DNA, 60 bp, Homo sapiens
tcttaagtacctcctttatcacagatggctcaaaacctgcagggaaggagatgctttaga

SEQ ID NO: 6820574 - DNA, 90 bp, Homo sapiens
atcatagttggttgctagctgctttgttagcacaatctattcctgagattttatgagatctggcttacgaagcactggttgataaatgat

SEQ ID NO: 6820575 - DNA, 84 bp, Homo sapiens
tttattaagcaattcagcaaacctagaaacatatattttgttgttgttgttgttgttagggaattcactgaaatgctgaataga

SEQ ID NO: 6820576 - DNA, 58 bp, Homo sapiens
tccattgtcactgctttaggttcaggcttttatcatcttgaacttcaactacaatgga

SEQ ID NO: 6820577 - DNA, 60 bp, Homo sapiens
gacagtcccccagcagcaaaccatgttccagtcattccctttcctactttggggattgtt

SEQ ID NO: 6820578 - DNA, 76 bp, Homo sapiens
gcaggacccattccttctggaggctccaggggagaagccatttccttgccctttacagcctctagagggtgcctgc

SEQ ID NO: 6820579 - DNA, 83 bp, Homo sapiens
ataccctgtgttgctgctagtgagatgcaactgatattacttaattgtataatattctgcctcactacagttgaatatggtat

SEQ ID NO: 6820580 - DNA, 74 bp, Homo sapiens
ctatcgtaatgcacatatatttccttattctgccataataagtagaatcaacaggatgtgcattgtaaaggtag

SEQ ID NO: 6820581 - DNA, 75 bp, Homo sapiens
tgctgtggtgatgttagggttcctacttttgtgggcaggatccatttaagtaaaagctttaccatgcgctatgca

SEQ ID NO: 6820582 - DNA, 87 bp, Homo sapiens
gctcccttacctacctcttaggatagttgtgaagataggctgagataacggataacttcagattaagttcgaaggaggtgttggtgc

SEQ ID NO: 6820583 - DNA, 69 bp, Homo sapiens
gccccctgagggtggctcctccctgggcccgtccctattggctccccaggctggtcccctcgcttgggc

SEQ ID NO: 6820584 - DNA, 60 bp, Homo sapiens
catttgcttctgtgaaatcaagttctccatcaagtggaacatgactataggagtcaggtg

SEQ ID NO: 6820585 - DNA, 56 bp, Homo sapiens
gaagccaatataaaagcatgtgattaaataatccagatgctgaattattgtgcttt

SEQ ID NO: 6820586 - DNA, 125 bp, Homo sapiens
gtatatttggacctgattatttgttccctggaaaaatctcttctatccctttcttatttttaccaaatgccctaaaggtagattctggatcgaaggttcagggaatctatgagttccaaatctat

SEQ ID NO: 6820587 - DNA, 79 bp, Homo sapiens
atttgcctagaatatgtggtgtatacttttggctgataagatatagttgtcaaaagtatataccacatatttgccagat

SEQ ID NO: 6820588 - DNA, 79 bp, Homo sapiens
atggcacttcaatgtaataaaatactctatagcattaaaatgagatagaatatttaatgacagaagaaaaggtggccat

SEQ ID NO: 6820589 - DNA, 86 bp, Homo sapiens
gcacagtgaggacttgaagcaggatggcttgcaggaggctgtgagagttggagcctcatggtcattcctttggagcctcagtgagc

SEQ ID NO: 6820590 - DNA, 65 bp, Homo sapiens
tgattccttatttgcccataggccctaccacaggtatccagcttggtttggcaaaggaaggagca

SEQ ID NO: 6820591 - DNA, 113 bp, Homo sapiens
ccatctgtgccacccgcatgggactgcctggggtccagtgcctggcaaggccctgcttctagaagccctccctgatgccagccctgagctcccagccctgtgggaggcagtgg

SEQ ID NO: 6820592 - DNA, 80 bp, Homo sapiens
ccaggaagccagaagcttcgtggctcttcaaatgaagtctctttcagaagtctgcctgccggggcctttgtgttacctgg

SEQ ID NO: 6820593 - DNA, 62 bp, Homo sapiens
accttggggtgatgctgaaagattgccattttcatgcagactatcaaattgctccactaggt

SEQ ID NO: 6820594 - DNA, 78 bp, Homo sapiens
tattagtctctagccttttggcatctgtgattgtgtaatcacttgtcctgagatgtcacaaggtttataggattaata

SEQ ID NO: 6820595 - DNA, 61 bp, Homo sapiens
gtaggagtgttcgggaactggggagcagtgcagtttgttagatccttccaactactcttac

SEQ ID NO: 6820596 - DNA, 93 bp, Homo sapiens
tcactgtttgaagccaagtcatttctcatggaacatagctcctccataaccacttattcttggaggcgctgcatgtgaaggagtttgcagtga

SEQ ID NO: 6820597 - DNA, 80 bp, Homo sapiens
tgtcacctctgctcacatttttataggtcagggcaagtcatatggcttcacttaacttccaaagagagcagaggtatgca

SEQ ID NO: 6820598 - DNA, 84 bp, Homo sapiens
agccagggcaggctcaggaggctcaagacctggcactgttcagtggctgggatggggtctggcctctgcaggccctgcctggct

SEQ ID NO: 6820599 - DNA, 77 bp, Homo sapiens
gttgcctccattttttaacctgtaaaatgggagaagtattacctgttttgcccaccttataggttttgatgcacaac

SEQ ID NO: 6820600 - DNA, 81 bp, Homo sapiens
ggcaaggagatctgaagggaagtggaaggcagaaaaacacccagacttcttcttcttctcatcctttagtatcctcatgcc

SEQ ID NO: 6820601 - DNA, 64 bp, Homo sapiens
tttcctgtgttaactatgaagctgtttggagatgaacaccacatgcaacaggtcagccaggaag

SEQ ID NO: 6820602 - DNA, 112 bp, Homo sapiens
agctttgaatttcctgatgtttacatagtacaaaggtttattagaagaggctgacgaatgtctaaaaggctcagtttcttctattgtattttcaaatagcagagaaatagct

SEQ ID NO: 6820603 - DNA, 65 bp, Homo sapiens
atgttacagaaactaagaggcttgggtagttttcaaggctaggaagtcttaggattctgtgaggt

SEQ ID NO: 6820604 - DNA, 62 bp, Homo sapiens
agtttcacatagctcagtgctctcggcaatatgaccttgttaccacgttgttgtgtgaaatt

SEQ ID NO: 6820605 - DNA, 96 bp, Homo sapiens
agcaggaggtaagaaaaatggatggacagttggaaaggtgtgaggggatagccttcactagtcatcaacttccattctattgtgttttcttttgtt

SEQ ID NO: 6820606 - DNA, 69 bp, Homo sapiens
aggatttcagaagaagagactccacagctccacaggagctcttttcttttctttgaataattgtatcct

SEQ ID NO: 6820607 - DNA, 74 bp, Homo sapiens
gcatactttttgtttaggatgctctattctgactcctgcgattttggcaaggggtgctttctctgagagtatgc

SEQ ID NO: 6820608 - DNA, 121 bp, Homo sapiens
tacacatactcatggccatcctagttttgtgtccgttttgtttcaggctcagtgcatacagaagcacctgagtctcaactgggaattgatttaggaaggagaggttttggatgtttgtgta

SEQ ID NO: 6820609 - DNA, 58 bp, Homo sapiens
acttgagttccatgagccaataaatccttattttgtcttaaacttgtgggacttcagt

SEQ ID NO: 6820610 - DNA, 84 bp, Homo sapiens
taatggctttttgatgcatattgattctttatgtaccatatgactaatagcataactctagatgtacactcagaaaagtcatta

SEQ ID NO: 6820611 - DNA, 58 bp, Homo sapiens
acaggcctgatgttatcctatttacttcccattgagttggaatatccgtctggcctgt

SEQ ID NO: 6820612 - DNA, 61 bp, Homo sapiens
aggaaggcttctttggtcttctcccccttaatcacacaaggtcaggtaagatcaccttcct

SEQ ID NO: 6820613 - DNA, 57 bp, Homo sapiens
gaagtgtagatgaaattaaacccagtattcaccactgggacatttctatttgccttc

SEQ ID NO: 6820614 - DNA, 84 bp, Homo sapiens
gttgagatcgttcagtatgaagtagagcagagatgccctctccgcagccgggcggtagttctctctcgcttcgttgattttaac

SEQ ID NO: 6820615 - DNA, 61 bp, Homo sapiens
aagtcaaccggtattagtctgttagggttgccataacacaatagcacaagctgggtggctt

SEQ ID NO: 6820616 - DNA, 119 bp, Homo sapiens
aattttatgtgaggtagtctagaagttaatgaggtaaggtattcagggaattctcatttaagttccccagaatcatttattcaaactagctcatctctaattgcatctcatttaaaatt

SEQ ID NO: 6820617 - DNA, 59 bp, Homo sapiens
acttgcaagtctgggaaatggccactttgtcaggtgccaaatattctctacgtgctagt

SEQ ID NO: 6820618 - DNA, 55 bp, Homo sapiens
tattttgctttggcccttaagtggtagcctactgtctgggttcccaagcaacatg

SEQ ID NO: 6820619 - DNA, 94 bp, Homo sapiens
tggtactttgtcaaaaatgaattgactgtaaatgtgtggattgatttgtaggttatctattatgttctatgtgtctgtttttatggcagtacca

SEQ ID NO: 6820620 - DNA, 104 bp, Homo sapiens
cttagtttcttccacaaactttcatgtatctctttcaccaaataggacaccaactggcaagtagacgagaggtaaatgaaaggttgactaaaagaaaacatgag

SEQ ID NO: 6820621 - DNA, 130 bp, Homo sapiens
caaaaaattaggagggagtatatcccatgttgaactgaacatttcttccctttagcagaaacaagccttgtttctgagagctgaagaaatgttcagttctacatgggatatatgccctcctaattttttg

SEQ ID NO: 6820622 - DNA, 81 bp, Homo sapiens
gtcaggaccaatgagttccatgtgtcctcaggaaaccctgaaggacagcatatgggaaccagtttgatatttggccttgac

SEQ ID NO: 6820623 - DNA, 126 bp, Homo sapiens
gcatgggaaatgagagaccctggaggatttattctggcagcagcatcagtggctccataacctattctaggagtggcagaggttgactgcagtgatgtcctgtgtccatttctgaagtagtcatgc

SEQ ID NO: 6820624 - DNA, 56 bp, Homo sapiens
agggtgccaggctgtagtcagggtcttgctgtgcccacccactagtgcctcacctt

SEQ ID NO: 6820625 - DNA, 60 bp, Homo sapiens
gtgtttgcatgtgtacttaattggttaatggggacaggctaataatggacatgtagatat

SEQ ID NO: 6820626 - DNA, 65 bp, Homo sapiens
gagagagggaatctaggctcagagtgccagaccaggtctgcagggcccaaagattgctctccctt

SEQ ID NO: 6820627 - DNA, 85 bp, Homo sapiens
caaagctggagctgcagtgaactgttttgtccccctggtaaaggagcttggctggagagtttattgcagttgccccaaagttctg

SEQ ID NO: 6820628 - DNA, 81 bp, Homo sapiens
tttagaagttgtagctgttcattgtaagtcattttgcaattttacaatgagttatttaatagaaaggcagcatattttaag

SEQ ID NO: 6820629 - DNA, 98 bp, Homo sapiens
ccggctaccgctgccccgagccgcagtgcgcgctggccttcgccaagaagcaccagctcaaggtgcacctgctcacgcacggcggcggtcagggccgg

SEQ ID NO: 6820630 - DNA, 77 bp, Homo sapiens
ggtttcctggtcagctgaggcaaccagaggagcacaaacttccccttcactccatgccaggctggcaaaaggaaacc

SEQ ID NO: 6820631 - DNA, 60 bp, Homo sapiens
gtatgtatgtgtgcatacactttatacaatacataaagtgtgtatatacatatggtatac

SEQ ID NO: 6820632 - DNA, 66 bp, Homo sapiens
ccagcaggcggggccactctcttctggacagtccttccagctccctgtctagagcccacccgctgg

SEQ ID NO: 6820633 - DNA, 74 bp, Homo sapiens
ggccaccctctgcaggactgaggcctgtttgttctcatcagtaaccaaacattgacctcatcctggcactggct

SEQ ID NO: 6820634 - DNA, 58 bp, Homo sapiens
tctaggcctggcttgggcccagtccttgctggaagcttgaacagggccaggctctgga

SEQ ID NO: 6820635 - DNA, 68 bp, Homo sapiens
tttttctagtatgtgtggctgaagagcagaggcatgcttgagcagactggtcttcagccttggaagag

SEQ ID NO: 6820636 - DNA, 81 bp, Homo sapiens
acatttttctctcccctttggaagaagggtctagaacattcttgtgtttaagactgtgaccgaagaaggaggaagaagtgt

SEQ ID NO: 6820637 - DNA, 59 bp, Homo sapiens
tcatttgtgcattgtttttgccagccaaggcagtggcttgaagagacagcagcaaaaga

SEQ ID NO: 6820638 - DNA, 62 bp, Homo sapiens
tcttgcctgccctgtgtcgtaaaatgggggtcccttactgcattatcaaggggaaggcaaga

SEQ ID NO: 6820639 - DNA, 88 bp, Homo sapiens
tggtgtggtttcccagcctgggtacaggacttggcagcctcatttctcaatgtcctcttctgcctcaggccctggggatctaaaacca

SEQ ID NO: 6820640 - DNA, 94 bp, Homo sapiens
ccactggcagaggaaacagatggagcagagctgatgggcctcagagtaggtttcagacaaggcttttgctctggctcctcttcctcttccatgg

SEQ ID NO: 6820641 - DNA, 68 bp, Homo sapiens
ataacagggaatggttcctagagcgtgaaggaccatttgctgctctgagaagtattatttcttgttat

SEQ ID NO: 6820642 - DNA, 71 bp, Homo sapiens
agcatttctgggagaattctaagtttggttaccatcttgacagataatacagaggcttccagtaaaatgtt

SEQ ID NO: 6820643 - DNA, 61 bp, Homo sapiens
atctggtccattgtgcgcccgtgaacctgctaatgattacatgtgtacacttggccatggt

SEQ ID NO: 6820644 - DNA, 81 bp, Homo sapiens
ccttttatttttactcagcaagtattttctgaatgcctctaacatacaaagttttaggtagggaaatagaaaattaaaagg

SEQ ID NO: 6820645 - DNA, 76 bp, Homo sapiens
actgtcttcaaactgggccatgtgttcccctggggagactggaggtccttctaaggggttcacaggcatagatagt

SEQ ID NO: 6820646 - DNA, 116 bp, Homo sapiens
gctcctcatcttaagatccactgatttgggaacttaattatgtctgcaaaatctcttcacagcagtacctaggttagtttctgtgaataactagaggatgtgagtataccaggggc

SEQ ID NO: 6820647 - DNA, 55 bp, Homo sapiens
tgattttaattgctctatataggaattaagatttgtgaagagagtaataaagtca

SEQ ID NO: 6820648 - DNA, 60 bp, Homo sapiens
gtcttatagctcaaaggaagagttcacatttaatggaagctcttcttcaggctcaaggat

SEQ ID NO: 6820649 - DNA, 62 bp, Homo sapiens
tatgtgctgtagcttactgttattccattttgtacagttaatcaaatggcatatggcgcata

SEQ ID NO: 6820650 - DNA, 67 bp, Homo sapiens
agagtggttggactcagagtgtctttttcaaatagtgaggatagcttagatacagtttaattactct

SEQ ID NO: 6820651 - DNA, 114 bp, Homo sapiens
gccctgtatcccctcaccatttatattcatagtgcatcctggcctgctgaacatagcacagaacactggtgagtccctgtagttggtggtgagtgtgggtgtgcatggaagggc

SEQ ID NO: 6820652 - DNA, 129 bp, Homo sapiens
gtgggctgcctccaggcgggtggcccgaaagtggacagctgtggccagggtgtgggcgtcggcacgtgggctcccggccggcgtgtgcccttctgtcctgccacccgctctggccccaggttcacctgc

SEQ ID NO: 6820653 - DNA, 76 bp, Homo sapiens
ggatcaaagcatgatttggcacttcacgagacagctatcggcaccagtgattctgtttagaggtgatgttttgtcc

SEQ ID NO: 6820654 - DNA, 84 bp, Homo sapiens
tacctattaaatgtgtggtagaggactagctgttttacttagatggtttcatttaatcctcacaacaactttataagataggta

SEQ ID NO: 6820655 - DNA, 98 bp, Homo sapiens
tgataaggtactatagttttgcaagatgttaccattgttactcaggaaattgagtgaaaggtgtccaatatttctctgtactacttcgtataactgca

SEQ ID NO: 6820656 - DNA, 73 bp, Homo sapiens
tgaactcggtctgagatatttgttcagctggcaggtccaggccagaaagttaaatggatatctctgaagttca

SEQ ID NO: 6820657 - DNA, 61 bp, Homo sapiens
ctcctttgatcccaaatgaccccacccgacatgggtcacagtcatttctgaacagagtgag

SEQ ID NO: 6820658 - DNA, 88 bp, Homo sapiens
atacttggagaaagagatgtgctgataagtttgagctctaattaagcagcttcttttacagctcatgctttaattcaattccaggtat

SEQ ID NO: 6820659 - DNA, 69 bp, Homo sapiens
tgtacagactattttgtgataactaatctgttctctttgactattactgaggcaaagtagttttgtgca

SEQ ID NO: 6820660 - DNA, 58 bp, Homo sapiens
ctcctatgtgccaggcactgggctgggtgctgggtagagacacagtctggggcgggag

SEQ ID NO: 6820661 - DNA, 55 bp, Homo sapiens
ctgcgcagatctgctgttctctggaacctaaactgggaaccctagacttgcgcag

SEQ ID NO: 6820662 - DNA, 62 bp, Homo sapiens
caggactgggtctagggcagcagggcttgggggtcgagccctctgcctgggaccaagtcctg

SEQ ID NO: 6820663 - DNA, 75 bp, Homo sapiens
attgctctttgaatttaccattgtggggtaattgaaaagaccccatattaacaagagtaatttcaacagagtggt

SEQ ID NO: 6820664 - DNA, 130 bp, Homo sapiens
ccctttcctaaagttacttccattagtgagcaaattcacaagagcattgcctgccatgaagaatatatctgtctttctagtaaagtgcttttggaattttttttccctagtgagagatttggaaacttag

SEQ ID NO: 6820665 - DNA, 82 bp, Homo sapiens
ccagcctcctgagaaaggagataaagggcccttcagcagcggctgggggctttgcagtccttaatctccgctcgggggctgg

SEQ ID NO: 6820666 - DNA, 61 bp, Homo sapiens
cagcatctctgcctgcctgcaattcccctcgtttggcagatgctgtcggcagaagacgctg

SEQ ID NO: 6820667 - DNA, 76 bp, Homo sapiens
gcgcggggacgtgtgcgcacacctgtttccacgtggacgtggtcctttgcttgtctgcgcgcagctgtgtccgagc

SEQ ID NO: 6820668 - DNA, 83 bp, Homo sapiens
gcacacagctgggaggctctgggaagcagtgagttcagaagtcaaatcagaaaactcaagtccagagattaaagattgtatgt

SEQ ID NO: 6820669 - DNA, 56 bp, Homo sapiens
tgctggaatttcagttgggcacaggctcctaccaatgcccagctgttcttccacca

SEQ ID NO: 6820670 - DNA, 71 bp, Homo sapiens
tggtattctgtcatagcagcccagaataacatatatgattatatacttgtaaaggctgttattgacttcca

SEQ ID NO: 6820671 - DNA, 89 bp, Homo sapiens
ggcaaacgtgatctttctttcctttgcccaatacatgtcaggctctgtgtggcaagggcgagggagaggcatgactatgtgtctctgcc

SEQ ID NO: 6820672 - DNA, 67 bp, Homo sapiens
gcctcttaggacgccctcccttccatgctgtgagcctcccaagccagcaggagggtgcctgggctgc

SEQ ID NO: 6820673 - DNA, 60 bp, Homo sapiens
gctccttacatgtacaagtctcctggctttcctcgaaacaggaagactgtactgtaaagc

SEQ ID NO: 6820674 - DNA, 101 bp, Homo sapiens
gggcctgtggatgccctcagccagtacttctcaagtttccacgggcttgagaatccactggggactctgtgaagatgcaggcttggtgtgtctacaagtcc

SEQ ID NO: 6820675 - DNA, 62 bp, Homo sapiens
cgtgtgtgtttgtgtgtgtgtcgcagggtttccactctgatgcatggttacatatacatgtg

SEQ ID NO: 6820676 - DNA, 58 bp, Homo sapiens
ttgtgattttccctgattctgtagaaaaatgcttttccagggctagagagaatgacaa

SEQ ID NO: 6820677 - DNA, 65 bp, Homo sapiens
taagcggccacacaaacacagccagtttccatttagaagcagctgcatgtctgtggtggtcttta

SEQ ID NO: 6820678 - DNA, 68 bp, Homo sapiens
agataatttttcgggcacacacttgacaggttccaaaggagtggcatatgtgcctgtgaatgatgtct

SEQ ID NO: 6820679 - DNA, 63 bp, Homo sapiens
agagaagtgagtgtgactcagcagatggaatgttccaatgctggtgagtaaattcagtttcct

SEQ ID NO: 6820680 - DNA, 66 bp, Homo sapiens
gcctcaatccctgccctcagtgcacccggcagcaggcgctgggggagctggcgggcaggctcaggc

SEQ ID NO: 6820681 - DNA, 112 bp, Homo sapiens
ggagaaatgcatttctgtcatagataagagcattgtaaaataatctgttttaaagtaaatatgaaatatagaatgtttggtgctctgctgatttgtattcaaaataaatccc

SEQ ID NO: 6820682 - DNA, 90 bp, Homo sapiens
ctccggggccaggcttcccccatcctaggatgagtcaattgcctttctagtcccagggtcctgggggccaggccttcttgaatcatggag

SEQ ID NO: 6820683 - DNA, 65 bp, Homo sapiens
gcatgaatcatgactcaaaattattgttttgctttctgattgggccagtgtgagtcacatcatgc

SEQ ID NO: 6820684 - DNA, 62 bp, Homo sapiens
agggtcaagtcactggttcacgatcacacatctgataagtgttgaagctgggatttgaacct

SEQ ID NO: 6820685 - DNA, 73 bp, Homo sapiens
ggaacctggcaggaggttttctccaggaaaatctgaaagtcagcaagttttagtttgcctcctaccagcttcc

SEQ ID NO: 6820686 - DNA, 55 bp, Homo sapiens
ctgtggagggagtactagaagttcctaccaggattagtgctaaatactcccacag

SEQ ID NO: 6820687 - DNA, 58 bp, Homo sapiens
ccattagataatgcacaccctccaaggacaaggacactgggtgagtgttttctactgg

SEQ ID NO: 6820688 - DNA, 83 bp, Homo sapiens
tggacaagtctgctgttctcatgctgattttctgttatccctttacattctgaaaacaacactgccagcagaagcgctgtcca

SEQ ID NO: 6820689 - DNA, 62 bp, Homo sapiens
ccgactgtatcttgcatttcagagttcagagaagtttctttaacgaaatgcaagaaagatgg

SEQ ID NO: 6820690 - DNA, 55 bp, Homo sapiens
ggtgacaggaacataaatgtaggagtgatgtattatgtctacatgggtcctggcc

SEQ ID NO: 6820691 - DNA, 57 bp, Homo sapiens
ggagtttctgtcatcctgtccccgtggcaacgccccccgggaatgatggaagacttc

SEQ ID NO: 6820692 - DNA, 63 bp, Homo sapiens
ggcccagtgtaccccaggcagttgcatcaataaaatctgcttgagtgggttcagcacagggct

SEQ ID NO: 6820693 - DNA, 72 bp, Homo sapiens
cagggagctggatcctgggatctggatgaccaaggagagatgtggtgcagagagggatctagggcttccctg

SEQ ID NO: 6820694 - DNA, 65 bp, Homo sapiens
tgactacgttgttgatgataatgatggtgatgatgacagagcttgtattgtgtcaatggtgttca

SEQ ID NO: 6820695 - DNA, 71 bp, Homo sapiens
cagggcagagctgcctctcactgggtctgggtcagccaagagccaccatttgtggaatgcactctgtgctg

SEQ ID NO: 6820696 - DNA, 77 bp, Homo sapiens
ttcattggcacaggggcaggttttggcttacaataagaaaaattacgagaaccatgcaaacctcctgagtcagtgag

SEQ ID NO: 6820697 - DNA, 112 bp, Homo sapiens
ttgctaatttgctaatgctcttaaaagcaccactgcacagaagaaactatcaaaataaattggttatggctttcttgtgcgtgtgggtggagagtagcggagtatgtagcag

SEQ ID NO: 6820698 - DNA, 58 bp, Homo sapiens
gcccaggagttcaaggctgcagtgagctaggatcgtgccactgcactctaccctgggc

SEQ ID NO: 6820699 - DNA, 69 bp, Homo sapiens
tggattgaaagcttgtggtccccaattttcctgagctgagcattctggaagcaagcttttaaacatcta

SEQ ID NO: 6820700 - DNA, 83 bp, Homo sapiens
tactgctctaaacaatttctgatatactgtagaatcctgttacaggaagtagtgaagttagaattaagtgttcaggtgcggtg

SEQ ID NO: 6820701 - DNA, 83 bp, Homo sapiens
tctttacaaggggagttcatgcatttgtggatttgtatgaggataaagttgaatcacatgtgtatgagctttgattatggaga

SEQ ID NO: 6820702 - DNA, 78 bp, Homo sapiens
ggttaggatttacttgtgctgtttctgggaattaacttgattattaactgcccagtgaaacggccaaggaagactgcc

SEQ ID NO: 6820703 - DNA, 79 bp, Homo sapiens
aatgttgttctcacaagtcagtggaattaatattatacttagtatcctggttactggtcttgcacagggacatcacatt

SEQ ID NO: 6820704 - DNA, 57 bp, Homo sapiens
aatgtatgacagttctagtggtgccacatctttggcaacacttggttctcatacgtt

SEQ ID NO: 6820705 - DNA, 91 bp, Homo sapiens
agttgaagctttcttgttatcactgccttagaacaaagcaggatctcccctgtgatcctagtcattgtggcaagtccaaaggaagacaact

SEQ ID NO: 6820706 - DNA, 67 bp, Homo sapiens
tacccaactcagactggattaaataaaaggggattttcttgcttatttaactctagattcagtggta

SEQ ID NO: 6820707 - DNA, 59 bp, Homo sapiens
caaatggctggcatccttctacaaagagaagattaacagggagggtttgccattatttg

SEQ ID NO: 6820708 - DNA, 67 bp, Homo sapiens
gtccgtatgcctccaagattcttacgttgggacctaatcccaatgtgatggtatttggaggtgggac

SEQ ID NO: 6820709 - DNA, 82 bp, Homo sapiens
actttggctgttgtacagattagcaatgagagtctgaatatagaagataaatctgattcattcatgtgcaccagccccaagt

SEQ ID NO: 6820710 - DNA, 72 bp, Homo sapiens
tacacaaatacctgggtcttatccccagagattctgcatcagtaagtctggggttaagcccaggaatgtgta

SEQ ID NO: 6820711 - DNA, 61 bp, Homo sapiens
gaagagagagtggggttctgcggggcagagagagatactgtggaacaaacttaaacttttc

SEQ ID NO: 6820712 - DNA, 70 bp, Homo sapiens
gaaagtttggttaaacgagagaacatatgccagatagaaggtattaaatgtttaatctaacttgattttt

SEQ ID NO: 6820713 - DNA, 67 bp, Homo sapiens
ggaaatgtttagctctagctgctgcctttgtacacattaaaaaggtacagggcttcctggacaagcc

SEQ ID NO: 6820714 - DNA, 55 bp, Homo sapiens
gctgcagggacagggcagggcctttggatccaattagaggtgcccacaccctggc

SEQ ID NO: 6820715 - DNA, 77 bp, Homo sapiens
tcccaggggcgcgagagagggcgacgtagagcagcaccgcccagcggcagagcggcgagcccctccgcggctcgggg

SEQ ID NO: 6820716 - DNA, 107 bp, Homo sapiens
agtgcaggtaggtgtgacatgcatgaggcaaagatgtcattggtaagacaagtgatcgtttccttgagtgcatatctttggctcataccattccacaacccagtact

SEQ ID NO: 6820717 - DNA, 72 bp, Homo sapiens
gcaaagtagcatttgaaatacagaatctgttttgttccaggacagaatctatattcagttatttacctttgt

SEQ ID NO: 6820718 - DNA, 126 bp, Homo sapiens
aaccggaggcctgagatagtgacactggaaggtgggcaggctgctaatgaggattcctggctgcgattcagcctcagcacgcagctctgtgtgcctggctgttgttaactgtgcagtgctctggtt

SEQ ID NO: 6820719 - DNA, 71 bp, Homo sapiens
tagtgctatgaaatggtggttttccatttactgtagaaagtatgtagaaataatttcagttcctggtatta

SEQ ID NO: 6820720 - DNA, 58 bp, Homo sapiens
ggggtggaggcagttaaattttcacctgtataggaaataagtctgtctgctttccctc

SEQ ID NO: 6820721 - DNA, 72 bp, Homo sapiens
cccagccaatgaacttcagtgatttctggccataaggcccaatggtgagactttctctgaagtcgggatggg

SEQ ID NO: 6820722 - DNA, 55 bp, Homo sapiens
cttatacataaaatgggtgtagtggattgaatttataccaaaagatatgtgtaag

SEQ ID NO: 6820723 - DNA, 79 bp, Homo sapiens
gcactattctaggaggttcttgaacatctgtaaagtaatatatactctatgagataaatggtgccccctggatttgtgc

SEQ ID NO: 6820724 - DNA, 75 bp, Homo sapiens
ttcattacagacttacaaggtcatatgtggttagtattccccactacatgaaaataagtttgaaaatttagtgag

SEQ ID NO: 6820725 - DNA, 61 bp, Homo sapiens
ggtggcatacatttctgtcttgtatgggacctattcagaaaagacatgaagtgatgctatt

SEQ ID NO: 6820726 - DNA, 86 bp, Homo sapiens
tgctgctcttcatctgactgggttaagttcatgtagagaagggatctgaaacatttctacatagctcctagtgatgcatgcatgca

SEQ ID NO: 6820727 - DNA, 126 bp, Homo sapiens
tttttcattgagtgacatctggagtgatgtttaataaattttaattacaattaatgctggaccagggtacttggattaataatttgtttttacttctccatgttgctgcaatttttaaccgaaaaa

SEQ ID NO: 6820728 - DNA, 93 bp, Homo sapiens
caggccccacagaggaggtgcagagtagggttggtactcagtttgcccagctccccaccagaggctctgccacctccactctgtggtggcctg

SEQ ID NO: 6820729 - DNA, 76 bp, Homo sapiens
tcagatgtcttctttggttcttatctttggagattatattactttgatgttactgggaaagaactatggcatccga

SEQ ID NO: 6820730 - DNA, 55 bp, Homo sapiens
ccagagcttgaatccaacaaagactgatatgggcagtctttagccagagctctgg

SEQ ID NO: 6820731 - DNA, 66 bp, Homo sapiens
gccccctggttcccacgggcagatgtggttggttggtttgaatatttccaaggcctgtcagggggc

SEQ ID NO: 6820732 - DNA, 56 bp, Homo sapiens
gcccgtgtctcctgctctgtgggccgagttcttgattcaccagctcaggcaggggt

SEQ ID NO: 6820733 - DNA, 64 bp, Homo sapiens
tgtgtatgtgcacatgtgtttgcgtgggttttttttccccaaaatacacaatgacacatatata

SEQ ID NO: 6820734 - DNA, 70 bp, Homo sapiens
ctgttcccgcaggctctggccagagactgaccgtgtacttggccttcctggtcagaggctgctggaaggg

SEQ ID NO: 6820735 - DNA, 129 bp, Homo sapiens
tgcttctgagtcgggaggtgcatgggttggcggcaggaggaagcgtcatggagcctctgtttctgagcccatgtgttgagattccagcctctagtcagaaaattccccttgcagcttctgcctggtcca

SEQ ID NO: 6820736 - DNA, 64 bp, Homo sapiens
atttcgataggaagtgaagaattagaaaacaccaaaacctatggcttcattctcttattgttgt

SEQ ID NO: 6820737 - DNA, 71 bp, Homo sapiens
ctctgtcaacctagcaagagattaagccaagcaggcctgggtttggcttcgctgctagctagttggtggag

SEQ ID NO: 6820738 - DNA, 59 bp, Homo sapiens
tgggggagctcagtccagcccagctcccaattgctgcagcgtgtgtgtgggcttctcca

SEQ ID NO: 6820739 - DNA, 68 bp, Homo sapiens
ttttggaagtggcattgagtttcacaatttagattgtttagtggaagttcactggctacattccaaaa

SEQ ID NO: 6820740 - DNA, 63 bp, Homo sapiens
gccagagttgaggcagtttattcatctatgttcaggtggacccaaacgagccatcattctggt

SEQ ID NO: 6820741 - DNA, 78 bp, Homo sapiens
accactccatctccaactccctcccctgtctagcttcattgaaaactgcaggatgggtagaagtggaagaggtgtggt

SEQ ID NO: 6820742 - DNA, 55 bp, Homo sapiens
ttgagggcaagaaggcgatttagtgtgacagatcgagtccttccaatgtcctcag

SEQ ID NO: 6820743 - DNA, 81 bp, Homo sapiens
ggaatctggctgaattcctgaatgcctgacatttcactgggagaactccagtggatggtgtgttcattttccagataatcc

SEQ ID NO: 6820744 - DNA, 107 bp, Homo sapiens
tgaaaagtggggaagcaaatcaattgtgtagatgactcaagccaaagaaactgcccttgagtatcaattacatagttgttttgtgcattctctatgggtacttttca

SEQ ID NO: 6820745 - DNA, 70 bp, Homo sapiens
ggaaaacgtggccatgtgagactagtatagatctccaactattgctgcctctgctgatatggccacctcc

SEQ ID NO: 6820746 - DNA, 69 bp, Homo sapiens
gattacacgtttttaatcacataagttccatgactgatgcaatggaatctcggttgataacttgtgatt

SEQ ID NO: 6820747 - DNA, 56 bp, Homo sapiens
gcacagtcactgcctgcatgtctaacttccctagacagtgaggacagggactgtgt

SEQ ID NO: 6820748 - DNA, 75 bp, Homo sapiens
gagataaagaatctgacataatttcctgtacttgcatagcaggaagtggaaacagattcaaatttattttgtctt

SEQ ID NO: 6820749 - DNA, 78 bp, Homo sapiens
gaaaccttgtggctctactgaaacttttcttcaactgggttaagtaatgcactaaaaagtttcaagcccacagttatc

SEQ ID NO: 6820750 - DNA, 66 bp, Homo sapiens
taggtcagggggattagaacaccacctggtttgtaccctcatggaattactaatctcaatgacctg

SEQ ID NO: 6820751 - DNA, 78 bp, Homo sapiens
cttttgaggtgttgaatagttggctgaaactgcacaggtaagtaggggcagcaagaaaattcacatgctcatcagaag

SEQ ID NO: 6820752 - DNA, 90 bp, Homo sapiens
gctcatctcagaggtgagaaagaagagtgttgctagtggatgggcggggccttccctccacttgccctcttctgtgctcacctccatagc

SEQ ID NO: 6820753 - DNA, 64 bp, Homo sapiens
tacagcaactcctatattgaaagcctggaattctggagcttgatgatacctaggagatgtttta

SEQ ID NO: 6820754 - DNA, 59 bp, Homo sapiens
gtcctggggaatacagaagccgcctcgaatgaatggtcggactcaccttttcccaggac

SEQ ID NO: 6820755 - DNA, 66 bp, Homo sapiens
ggacagtggtacatgccagtcctcccagcaatttgggaggccaaggtgggcagatcacttgagtcc

SEQ ID NO: 6820756 - DNA, 85 bp, Homo sapiens
gagtctcgctctttagccaggctggagtgcagtggcgccatctcggctcactgcaagctctgccttccgggttcaagtgattttc

SEQ ID NO: 6820757 - DNA, 63 bp, Homo sapiens
ccctcagcttctgagcgagcagttgtagtttgtacaatggcagaatgggccagaagcttaggg

SEQ ID NO: 6820758 - DNA, 81 bp, Homo sapiens
ttgaattctgaatcatgtttagttttaagggctttttgacaaaggtttgtagattcagcataagcatccattcagatttga

SEQ ID NO: 6820759 - DNA, 56 bp, Homo sapiens
aacactgctgctgggttctgtgtgtttgtccacacaaaggattccagaacagtgtt

SEQ ID NO: 6820760 - DNA, 70 bp, Homo sapiens
gcagttggctgtgcctgtgctctgtatgtcttctccactctggcatccaggccgcaggggcagcccctgc

SEQ ID NO: 6820761 - DNA, 65 bp, Homo sapiens
tgcaattcaggtttaagggccaggatggaactacaaattggatatcagtaaacctaaagattgta

SEQ ID NO: 6820762 - DNA, 80 bp, Homo sapiens
gggtgggcacctgaggagtaaactctctatgggaattctggaagccagtggagagtgtagacttcagagttatctcaccc

SEQ ID NO: 6820763 - DNA, 78 bp, Homo sapiens
tcgttggtacatgttaaggaagagtaataccatgatgtaatcctactcttccttaacatgtgtgttttaagcctttga

SEQ ID NO: 6820764 - DNA, 87 bp, Homo sapiens
gatgttctttccattgatagcatgtagagttatatatatatatggaaataattctacatgagaaaatgtatttagaccagaaccttc

SEQ ID NO: 6820765 - DNA, 79 bp, Homo sapiens
gagctattggtcctaggaagggcagggcctaaaagatacgccttttacagcttacattttaccttggacactttggctt

SEQ ID NO: 6820766 - DNA, 56 bp, Homo sapiens
ggtgggcaggctggcgtgggtgggctggcgctgcccactcaggcctcctgctctcc

SEQ ID NO: 6820767 - DNA, 96 bp, Homo sapiens
agggctgagtaggaagggtctgaggaactcctataattgtaattccagttacctcaattggtgagctctttagactgggacgtttattctggctct

SEQ ID NO: 6820768 - DNA, 109 bp, Homo sapiens
acagaaaataaggggggcagggcatctatactgacaggatatgtgggttggtgaattgaacaaataatcacaattcagatgtcttaggtttgcatcctgaattttctgt

SEQ ID NO: 6820769 - DNA, 63 bp, Homo sapiens
cccatttttgtgtgagtaatgaagaatggagggaattatttccatacttattagaaatatggg

SEQ ID NO: 6820770 - DNA, 58 bp, Homo sapiens
ataaatgggcctctttcttattcctctacctggaatgaggcaatcatggtccagttat

SEQ ID NO: 6820771 - DNA, 77 bp, Homo sapiens
gtgtggatagtgaggtataaggacagaggtgatattatctctccctacttctgaaatttcaactttactaatagcac

SEQ ID NO: 6820772 - DNA, 75 bp, Homo sapiens
ccctaattgtttccctctccgggagcagttggttgtctgcctgattctccagacaggcagagggaaggtgtgggg

SEQ ID NO: 6820773 - DNA, 80 bp, Homo sapiens
tccacagcattcagcttgttaccgagggagggtacttggtgtgggacaggtattactccttttctagcaggtgctgtgga

SEQ ID NO: 6820774 - DNA, 68 bp, Homo sapiens
gccagtgtctgtgcaactccttccacagacagagggctgtctgtggtcagagggcactgaacactggc

SEQ ID NO: 6820775 - DNA, 55 bp, Homo sapiens
tggttctgcttttgattctgcctaatgtctcaggggtattacaggcttagaacca

SEQ ID NO: 6820776 - DNA, 69 bp, Homo sapiens
atactcgactctttgacgtgcccatgtccctacagccaggagacaggctgcatgtgaggtgctgattgt

SEQ ID NO: 6820777 - DNA, 65 bp, Homo sapiens
gtgcaggcactggctgtggccacggctgctctgacggcacagctgcctggccggagccactggac

SEQ ID NO: 6820778 - DNA, 129 bp, Homo sapiens
cagcctcccaaagtgctgggatttcaggtgtgagccaccgcgtccggcctcataaagagttcattttaaaagtccttattggccgggcgcggtggctcacgcctgtaatcccagcactttgggaggccg

SEQ ID NO: 6820779 - DNA, 55 bp, Homo sapiens
ctttgtgttgttttaagccactaaattgtggcaattttttacagcagcaatagag

SEQ ID NO: 6820780 - DNA, 55 bp, Homo sapiens
agtgcatgcgcttgggaggggtcggcctgcccactccaaaccaagtgtgtgccct

SEQ ID NO: 6820781 - DNA, 109 bp, Homo sapiens
gattgcatatgctcagaggcctgtcccagaggctttggccacagtggtttatgtcctgaacgccactgtgcccaggcccctggggatgttcccccctgaggttgtcatc

SEQ ID NO: 6820782 - DNA, 71 bp, Homo sapiens
gcagtgtgtgtatgagcctccagctgggccagggaccaactttccaggcccagatgaattctcatcattgc

SEQ ID NO: 6820783 - DNA, 63 bp, Homo sapiens
cagcaagaacagcctgatgtgcatcctacaaaatactccactgcgcggacgggcttttgactg

SEQ ID NO: 6820784 - DNA, 104 bp, Homo sapiens
ggccgtgggcagcccggtgcccgagatccagtggtggtttgaagggcagggtcccaacgacacctgctcccagctctgggacggcgcccggctggaccgcgtcc

SEQ ID NO: 6820785 - DNA, 59 bp, Homo sapiens
ctgcctggagaaggcaccatctgggctgaggctgccagtgggatctttcttggggccag

SEQ ID NO: 6820786 - DNA, 60 bp, Homo sapiens
tactccttaaagtgcacctcctcatgttcatacatgctgttaaggaggttttaagtggtg

SEQ ID NO: 6820787 - DNA, 130 bp, Homo sapiens
cttcctactgtccatggcttttgggcccatgggttttcctccctgccttgtgtggccaggagccaggggaataaaggagaaatgcccatgactgcttgaaaactagccttgacaacggcaggtcaggaag

SEQ ID NO: 6820788 - DNA, 123 bp, Homo sapiens
atcattgttttaatctgatcaaggcagattaccaaacgggataatatagataccaaagtaggttataaaaattgaaatatcctgtttggttgtctgccttgatttcattaaccagacaatggt

SEQ ID NO: 6820789 - DNA, 83 bp, Homo sapiens
tgctaacttatttgccgttttttaatcatgtggaggtagaaaaacctcagcatggagggagaacaagtaggcagataggagca

SEQ ID NO: 6820790 - DNA, 59 bp, Homo sapiens
ggaaggatctggctgaaatccaagctctgggggaagtacagggagtggcagatctttct

SEQ ID NO: 6820791 - DNA, 77 bp, Homo sapiens
cacaatctattttgcttaaagttctttctggtgtgtgagatattatacttgaagaaaataggacaagaaaaattgtg

SEQ ID NO: 6820792 - DNA, 60 bp, Homo sapiens
ccttggaggtcctggctgggttttaatgactggtatccttccccaggaccttgagtcagg

SEQ ID NO: 6820793 - DNA, 91 bp, Homo sapiens
agctgccaatgcctgattcgcccctcagcgacccaccagccacttatgggaagttggcaggaagttggaggtggtgggagggagtggcact

SEQ ID NO: 6820794 - DNA, 107 bp, Homo sapiens
catttcagtcatccaagaaagctgccaatgtcacttcctttgaatattttccttcagttttcaggaaagagttggtgggactagcttatcatggatggcatgagctg

SEQ ID NO: 6820795 - DNA, 109 bp, Homo sapiens
gtgttcaaagtgtctttgaagtctaaaatatacggtccctaacagtccagcctcaggctcaggatgattgtatttgtgtatttagaatgggagggtcacttatggacat

SEQ ID NO: 6820796 - DNA, 56 bp, Homo sapiens
gagatctgtgtttgctgaagctacaattacatggcttcagagtgactcagcatctt

SEQ ID NO: 6820797 - DNA, 77 bp, Homo sapiens
ttgacttgacattgtactatgcatatgaccccaagcttgttactaaataagactttcatagtatagtattaagttgg

SEQ ID NO: 6820798 - DNA, 86 bp, Homo sapiens
tccctgatcctatcagctatgacatggacagaggccatcattctcatagctattgaggagtgatggtttccagtcactgacaggga

SEQ ID NO: 6820799 - DNA, 130 bp, Homo sapiens
tttgcttttcctttactcaaaaccaggatgggcatttcttccccaagtgaattttaacgcagctgctgcaggctgcagaataaaaccccgctggagaaagatgctccattaaagtaagattgaagccaaa

SEQ ID NO: 6820800 - DNA, 68 bp, Homo sapiens
gcagagttctgggccccgccctagactggatgaatcagaatatctggggacggggcccagcaatctgc

SEQ ID NO: 6820801 - DNA, 76 bp, Homo sapiens
gtgaaagttcctagagcctgcctctagtctctagagggaaaactgagggaaatctatagggaggtacgagctgtac

SEQ ID NO: 6820802 - DNA, 57 bp, Homo sapiens
ggctgggaggggagcggggctgtgagcaggagctaatggccgcctgtccttcccgcc

SEQ ID NO: 6820803 - DNA, 77 bp, Homo sapiens
gttctataacatatatagtaatgtcatagcagatctccacagggatgctgaagagttcatgattatgagtgttgagc

SEQ ID NO: 6820804 - DNA, 63 bp, Homo sapiens
ttttattggatcttttattgctcagggcctttatgttttgagatgaggtagaagccaatgaag

SEQ ID NO: 6820805 - DNA, 63 bp, Homo sapiens
cagctcttcctaatatgaaagagcttcagatttgctggagccaagagtcaaggggaggagctg

SEQ ID NO: 6820806 - DNA, 75 bp, Homo sapiens
ccaggggctgctatgacaataccagtgggctctgtcctcactagcagcctgctggctgtccattgcagcccctgg

SEQ ID NO: 6820807 - DNA, 71 bp, Homo sapiens
aaaatttgcatgggaggtagtaatcaatagttttactaaattcttaatgtgatttctgcccctcaaatttt

SEQ ID NO: 6820808 - DNA, 113 bp, Homo sapiens
acctccatgtttccctctgtggatggagtgtagttcattccgtcctattccttgtagagggattgtgaagtagggctgagtgattacacttggtgcagatgagatgaaggggt

SEQ ID NO: 6820809 - DNA, 128 bp, Homo sapiens
ccacacaaaatttaattctcagtttttttcatgtagattttttggagactctctgtatctcctctgaaatggagagtttccaggaaattatcagcggctcctaatacaaatttttaatacaattgtgg

SEQ ID NO: 6820810 - DNA, 58 bp, Homo sapiens
ggctttatctgccgagctgtaaattagcacacctactttacgctcttcaggtaaaacc

SEQ ID NO: 6820811 - DNA, 61 bp, Homo sapiens
cagtagaaagggcattagcctgggagatgagacacttggttcaaggccagccctgctactg

SEQ ID NO: 6820812 - DNA, 79 bp, Homo sapiens
cctgaatggaaaatggaggcccaggcccctccatggaatctgttctccaatagaggagctttggactcccccagtctgg

SEQ ID NO: 6820813 - DNA, 77 bp, Homo sapiens
cggtggcttcctcctgcagagccacgtgccagcgcctagggggcgctctcgatgtgctcagcagccccggagcctcg

SEQ ID NO: 6820814 - DNA, 130 bp, Homo sapiens
gctgtgagtgatgagaagggaagaattgcactggggccagctgaggccgtgcaggctgcagaccaccccctgcccagctcagcgactccttagtctccctgccttctctaagcctcatctgaacagagac

SEQ ID NO: 6820815 - DNA, 55 bp, Homo sapiens
gagccgcctgggggccctagggaggctgaacgcccggtggctcccgggatggctc

SEQ ID NO: 6820816 - DNA, 74 bp, Homo sapiens
ggaagtggtgattctgagacagaaacgtatttcatgtgggaatttagttttatacttagagactcattgctttt

SEQ ID NO: 6820817 - DNA, 89 bp, Homo sapiens
gtggtgagcctggggggcatgctggtgggaatggtctttgcctttctgttgtcactggtgacccacctcaccaagcatgtgcacatcat

SEQ ID NO: 6820818 - DNA, 66 bp, Homo sapiens
gagatctgagtcattgcagatgtggaggcagataccatctgttccaaggcgatggcgcagaacctc

SEQ ID NO: 6820819 - DNA, 55 bp, Homo sapiens
tttggaggtgtgcaaaatatttcataatgaaatagcatttttgttcatcttcaaa

SEQ ID NO: 6820820 - DNA, 56 bp, Homo sapiens
tctgaggctgcatctatgtgactcagttgagagtctgaggtccaccagtttgcaga

SEQ ID NO: 6820821 - DNA, 103 bp, Homo sapiens
tgcatgaatgaaaggcaagccctgactatgaagacataagaatcaaggtcaacttatgtgtctccatagccagctagcttttcccagattactccattctgca

SEQ ID NO: 6820822 - DNA, 64 bp, Homo sapiens
gccctccagcctgtggaaccggggtcaagccagggctgcgagcggagccagaggctggagaggc

SEQ ID NO: 6820823 - DNA, 82 bp, Homo sapiens
gcccttaaactctgatatgatattgagtatgttgccagaagatgcaagaataaaataaagtatgatttttagagtttgtggc

SEQ ID NO: 6820824 - DNA, 76 bp, Homo sapiens
agaagggaaatgtagtatgttgcatgtatcaaactaccttgtctgatttatgtccaaaatacttatttacctctct

SEQ ID NO: 6820825 - DNA, 58 bp, Homo sapiens
gtgctccctccagaccacaggcacaatttcagcctgatggtatattgttgggagtcac

SEQ ID NO: 6820826 - DNA, 59 bp, Homo sapiens
ttagaatgatagagaatttgtttcaggtctgagacaactgaattccctctgtcttctga

SEQ ID NO: 6820827 - DNA, 82 bp, Homo sapiens
gtatatgcaatgaacttttttaaatggacatattcttggcaaaaatgtcagtaacatgtctgttaagaaaagtcatttatgc

SEQ ID NO: 6820828 - DNA, 67 bp, Homo sapiens
tggcagcaaccaaccaggcatttgtaccagctcttcctccactccacaggtcctttggttgttggca

SEQ ID NO: 6820829 - DNA, 55 bp, Homo sapiens
ctttccccagtatatcattgccctagcaaatggacacatgtacctttggggaagg

SEQ ID NO: 6820830 - DNA, 86 bp, Homo sapiens
cggtcctcggcgacccggccggccggtggctgcaccacgccgggtcccgcgctggagccagcggcctgctgaggagccggggaccg

SEQ ID NO: 6820831 - DNA, 58 bp, Homo sapiens
gaaggcaggtttttcaaaactgggctaagcaattatcaaactgaactaacctgctttc

SEQ ID NO: 6820832 - DNA, 101 bp, Homo sapiens
cacagccccacagggcacccgcgaggccagcccctccatcctgttcaggaaaccttggaaagaaggtggcctggcacgggggtgccaggtggctggctgtg

SEQ ID NO: 6820833 - DNA, 74 bp, Homo sapiens
tctttttcttcccagtcttgggtagtatttatcagcagcatgtaagtggactaatacaaggactaagaaaagga

SEQ ID NO: 6820834 - DNA, 71 bp, Homo sapiens
gggcaatggttggggcctggagattgggaggacctcccaacctcagcctctccaggccttactccaggcct

SEQ ID NO: 6820835 - DNA, 70 bp, Homo sapiens
acattgccaagtgcagcggatgctgtccaattctgatatgattggaactctctgcagcacttgacaatgt

SEQ ID NO: 6820836 - DNA, 58 bp, Homo sapiens
cattcccaagcataaatggtacctccatatgatcaaagaggtgtgccaaatgggaatg

SEQ ID NO: 6820837 - DNA, 72 bp, Homo sapiens
gcattttatgggctggccactgggtctgggtagaagaaaggcccattcccaccaagcaggccatgcaaatgc

SEQ ID NO: 6820838 - DNA, 83 bp, Homo sapiens
gttgactccatctcccaataggcctcttctggaaattccctccccatgttagatctggcagagccactgggagacagagcagc

SEQ ID NO: 6820839 - DNA, 59 bp, Homo sapiens
accagtatgtgccttcagtgtctctttcttgatatctgcatgagggcatttgtctgtgt

SEQ ID NO: 6820840 - DNA, 77 bp, Homo sapiens
gcaaactgacagattgattaggcagggaaattgaagaaaattaatattccagatgaaatcattcaggttagtactgc

SEQ ID NO: 6820841 - DNA, 90 bp, Homo sapiens
ttttgctttttttgtatgcatttgtagtatctgtttatatatcaattggttatatagtgagagattacagaagcaaagaaagaattaaaa

SEQ ID NO: 6820842 - DNA, 71 bp, Homo sapiens
ggctggaaaacacatttgggctcctacataaaggcatggacagcttttgtggggccccaatgttgctggcc

SEQ ID NO: 6820843 - DNA, 57 bp, Homo sapiens
ggccccagctgtggtgaatagatctattcacattgatcatgttctacttcaggggcc

SEQ ID NO: 6820844 - DNA, 59 bp, Homo sapiens
gtgttgggcctgtctcttgtcttccagtccactggtaagataagagccaggcctgccat

SEQ ID NO: 6820845 - DNA, 62 bp, Homo sapiens
gttcttcctaagcatccttaacaggtgatcacctcgcctattgagaaccctcaggaggcagc

SEQ ID NO: 6820846 - DNA, 70 bp, Homo sapiens
gtctccttgttccagccttgcagggggagatcctgatccctccctggtgtccactggaggaagacgggac

SEQ ID NO: 6820847 - DNA, 67 bp, Homo sapiens
agacatcatgttacagattaagacatcaggcactctgtcctgggtaattggtttgtaatttgactct

SEQ ID NO: 6820848 - DNA, 67 bp, Homo sapiens
cttcaactcatgtccaactttctttatctttgacaaaggtaaagaaggagtgagacttgggttgcag

SEQ ID NO: 6820849 - DNA, 88 bp, Homo sapiens
gcatgtgaacatttgggctaagtctccttcatgatactgtcagtatcatgcaataaggtgaggcctactgagtgttttctaagcgtgc

SEQ ID NO: 6820850 - DNA, 62 bp, Homo sapiens
gatagatacttaactgaaatcttcctggagaaaatgtaagtcttggaagataagtagctatc

SEQ ID NO: 6820851 - DNA, 55 bp, Homo sapiens
tgggaagatgaggtgccatgggataacacacaaccatggcaggccttttttctca

SEQ ID NO: 6820852 - DNA, 129 bp, Homo sapiens
ctccaggggagggttctccaggggagggttctccaggggaatgttctccaggggagggttctccaggggagggttctccaggggagggttctccaggggaatgttctccaggggagggttctccagggg

SEQ ID NO: 6820853 - DNA, 103 bp, Homo sapiens
ttgagacagagtcttgctctgtcacccaggctggagtgcagtggcgtgatctcggctcactgcaacctccgcctcccgggttcaagagattctcctgcctcag

SEQ ID NO: 6820854 - DNA, 78 bp, Homo sapiens
ggttcatccatgtcagagcatgtatcagcctcttcttctttttaaaggctgaatgatattccattgtatggatagacc

SEQ ID NO: 6820855 - DNA, 77 bp, Homo sapiens
gtaggagttcttcaccaaggtcagaggcaacaagaatagtaggttccagcctgtccttgtgaggtcccagcttgtgc

SEQ ID NO: 6820856 - DNA, 112 bp, Homo sapiens
atttgaagaggtaaagtcagttaaagctgcatgtgtcagtggttaggatgacaggcttctattcttctgatacaatgtctgctttataccaaaactttctacctctttgaat

SEQ ID NO: 6820857 - DNA, 67 bp, Homo sapiens
acagatataactggtccagaggtcggtagtcatcatgagtactaagacctagatactaggggtctgt

SEQ ID NO: 6820858 - DNA, 57 bp, Homo sapiens
gcagtgcatatgattctgcagtttgaacagcaaattgcagcaaattgtagctatagc

SEQ ID NO: 6820859 - DNA, 61 bp, Homo sapiens
gcgcaccacctccaggtggccgtcgaagcaggcggcgcggagaggcgtggagttggtgcgc

SEQ ID NO: 6820860 - DNA, 88 bp, Homo sapiens
gggtgaggcacgcatctgtctattaggatggttggaatgcatgaatttgataagccctatatttggtgagggatgtctgtcctcaccc

SEQ ID NO: 6820861 - DNA, 58 bp, Homo sapiens
gtgttttatggagtcataacgtgtccaattctcccacactttgcggctcacagagcac

SEQ ID NO: 6820862 - DNA, 103 bp, Homo sapiens
tgtatagttggttacctctgaataaaaatgtttttgtgtggtaatttgtgaactgttttagtgcatacctaacatttttgcttatacaggtattctttttaca

SEQ ID NO: 6820863 - DNA, 97 bp, Homo sapiens
tactatggtaaccaagcaatgtgctgggagacagaagcctttaattgctttaacaacttcctggggctccagctaccaggcttggatttgctaagta

SEQ ID NO: 6820864 - DNA, 71 bp, Homo sapiens
actccccagtccctgtgagaaatgaagcaggttctctgtcagctttctttacacttacaggagctggaagt

SEQ ID NO: 6820865 - DNA, 65 bp, Homo sapiens
gaaaatgtctcatcaaggggtccccggatttttctgctccgggaaggctgcctgagggatggatc

SEQ ID NO: 6820866 - DNA, 62 bp, Homo sapiens
gtgtacgtgcatgcacgtgtgcctgtgtgtgaacatgtgtgggtgcgtgcatgcatgtacat

SEQ ID NO: 6820867 - DNA, 56 bp, Homo sapiens
ggcctctctgagagcagacgttggcctctgtgcctctctgcttctcctagaaggcc

SEQ ID NO: 6820868 - DNA, 77 bp, Homo sapiens
tggtgggaggtggtacctggagtgcaagtcattttgacttatttatatctctgcagtttaagaaatcatccccatta

SEQ ID NO: 6820869 - DNA, 72 bp, Homo sapiens
ttggggtatttggatgcactaaataaaatatgatatatcgcagattttggcaatgcatataagttaccttaa

SEQ ID NO: 6820870 - DNA, 81 bp, Homo sapiens
acgtatcacgtggatcagctatggaacagataccccaaaccgagggctgtctgactccaagttggagctccagtgtcctgt

SEQ ID NO: 6820871 - DNA, 95 bp, Homo sapiens
gctactgccccaaaataggatgggtccagagctgatggtcttttgaaggcatcaaagtgcagcttgccttggactgcatgttgtaggggatcagc

SEQ ID NO: 6820872 - DNA, 65 bp, Homo sapiens
gccctgcagtgctctgcctataatggaatagaagccacttccaccaaggagaacactcagtaagc

SEQ ID NO: 6820873 - DNA, 55 bp, Homo sapiens
atagtagtgcctaacactgagttcctgcccttcttagtgtttagaatactattat

SEQ ID NO: 6820874 - DNA, 95 bp, Homo sapiens
aagttagctaggtgagatgatagatgtgctaattaaatagatggtggtaaccattttgtaatcgtatgtgtatcaaatcatcacattgtagactt

SEQ ID NO: 6820875 - DNA, 75 bp, Homo sapiens
atgacacatgtttcaccaaggtaacctttgatctgttttcttatctgttaaagtctacttggtgattcagttcat

SEQ ID NO: 6820876 - DNA, 76 bp, Homo sapiens
ggctccaagccttctttgttacttacagttacagcactgttatccaaacagtaacaaagaaagcctttggaaggct

SEQ ID NO: 6820877 - DNA, 58 bp, Homo sapiens
ccggggctgcggggctcccgccgcggctgttctgccaaggctgtcccgcggctgccgg

SEQ ID NO: 6820878 - DNA, 103 bp, Homo sapiens
gctctgtttcattccccaggggcctggcaggcggtggcttcaaggtccgcagccaccatggccgccctttccacggtttctcatctggggaacccagtagagc

SEQ ID NO: 6820879 - DNA, 58 bp, Homo sapiens
gtgaatgtcttctgttcccagctgcctcctgtgaatagtctgaggagaaggagaacac

SEQ ID NO: 6820880 - DNA, 82 bp, Homo sapiens
ggagattgaagagctccctggggtcctctccctcctgggctgagaaggcccgaggaagggacagggctctgggacagcctcc

SEQ ID NO: 6820881 - DNA, 60 bp, Homo sapiens
tttattttcctagttctaagaaatgtagtgaagatagtcattcagtcctagggaaataaa

SEQ ID NO: 6820882 - DNA, 62 bp, Homo sapiens
aggggtgaaggcccgataggagctcagacaatttgacccctgagttccaggtctgtacttct

SEQ ID NO: 6820883 - DNA, 71 bp, Homo sapiens
gaactcttggcagtgctgcagtgcccttaatgctggcattggtggccttgatggcatctgcactgggtatc

SEQ ID NO: 6820884 - DNA, 64 bp, Homo sapiens
gaggagggaagattccccatatgggtcatgatattactgccccaaggggagattttcttgagtc

SEQ ID NO: 6820885 - DNA, 67 bp, Homo sapiens
ggcttctggtgaacctcgggtgtattctcaaaattatgtgttgtgaattcttaaggtcactaaagtc

SEQ ID NO: 6820886 - DNA, 55 bp, Homo sapiens
gcttagctctttaagaataagttcaagactagaactgacctcttcttggctaagt

SEQ ID NO: 6820887 - DNA, 62 bp, Homo sapiens
ttcatatcttcttgagatacttactaatttcaagtcccatcttggtcacaaggagttgtgaa

SEQ ID NO: 6820888 - DNA, 72 bp, Homo sapiens
tccaaggccccatcccatcccttttttcgagtttggacactgtggggtggagatggtggccctttagttgga

SEQ ID NO: 6820889 - DNA, 82 bp, Homo sapiens
agcatcagtaactcctatttggtagatggaagagaagttaaatgctttacctaaagtcatacaaggtgggagggctactgct

SEQ ID NO: 6820890 - DNA, 72 bp, Homo sapiens
tccctactcagtattcttttcactagtgtaccctcggagtgaggactatgaaagtataatattgaatagaga

SEQ ID NO: 6820891 - DNA, 130 bp, Homo sapiens
agagatagatgcattttcagattgcagatgccaggggtgtgttgattgttccagtaatgatactacaactgggccagcaactgcaatggatttcaccacctgattaagtttacagtaatgcactgtcatt

SEQ ID NO: 6820892 - DNA, 73 bp, Homo sapiens
ggtcattgtctcttgtcatttagtagatggattatccctcctactttttgtgtcaagcagtcaccaaatgact

SEQ ID NO: 6820893 - DNA, 110 bp, Homo sapiens
gtgttagccatccatcatatgctcagctgtgatatgcctgcctgagtgcctgtcccactcacggggcagtcagcatggcaagcagttggtgtggttcggggaaggagcac

SEQ ID NO: 6820894 - DNA, 85 bp, Homo sapiens
gaggtgaagtgagtggggcaaaggagggtctaagcaaatggtgacatttgtcatcagggcctcctaatttcctcatacctccctc

SEQ ID NO: 6820895 - DNA, 83 bp, Homo sapiens
gtgtcttgtgtgtgtgtgtttctgtgtgtgtgtgtgcatgttgtgcacatgcgtgcttagaaagaatccactcccacagccac

SEQ ID NO: 6820896 - DNA, 67 bp, Homo sapiens
tgcctggctcccccatcatagctgtcatccctctgtggatatcaggcccatgagggcagccacagca

SEQ ID NO: 6820897 - DNA, 105 bp, Homo sapiens
ctgaggattaagtgagtaataatagctgtaaagtgcttagaacatggtgtgatgtgccataatcattgttaacattacagttattattattctttgtattctcag

SEQ ID NO: 6820898 - DNA, 72 bp, Homo sapiens
tcctccttgccccttctttagctagcaaggaatacatttcaggcctggctgaggtggggaggcagttcagga

SEQ ID NO: 6820899 - DNA, 55 bp, Homo sapiens
ggatgtttgcccactttcttgagatttaaaattcagagagggagatgaaacatcc

SEQ ID NO: 6820900 - DNA, 73 bp, Homo sapiens
tggagcgagaaagccaaggttttggtcacagctgtgtttcctaccgccatgtgacccttggccacttgagcca

SEQ ID NO: 6820901 - DNA, 82 bp, Homo sapiens
ctcagagtcccttccttatcttctgaaatgggcataatcacctcgatcacagcctattgtgaggatttaaggagatgatgag

SEQ ID NO: 6820902 - DNA, 83 bp, Homo sapiens
cattccacttgtcttggtgcctggcacaggaattaggaggtccaagactcacctgaaagatgccggtgcccataacagggatg

SEQ ID NO: 6820903 - DNA, 75 bp, Homo sapiens
cagctgaatgcttcaacctcccacatgtgctttttttagttttgtaacatgacagggaatgaggtgaatgagctg

SEQ ID NO: 6820904 - DNA, 78 bp, Homo sapiens
cctctttagggcctggccccagatttcctgtagaggaggcaactcatggagcggggagtggggcttaccttgaagagg

SEQ ID NO: 6820905 - DNA, 60 bp, Homo sapiens
agtggcagggctttgctgttcttcactctcagccccctgaaagcagttcttcctgcctct

SEQ ID NO: 6820906 - DNA, 62 bp, Homo sapiens
tgggttgctgtagatttttaaagtctcattcttatgttaaattagaacatcaacagcaccta

SEQ ID NO: 6820907 - DNA, 70 bp, Homo sapiens
agagagggttttcatttctgagcattctctgaaaagaatgagggctcattgacatggaaaagccacttct

SEQ ID NO: 6820908 - DNA, 58 bp, Homo sapiens
cagggtcaggaggatctggcttcccattggccgacacgacagaatccttctcgctttg

SEQ ID NO: 6820909 - DNA, 82 bp, Homo sapiens
gtcacttattttagccagagcatttgcatggaccccaggccccctggaggccctgtgcgactctagaggttcaaataatgat

SEQ ID NO: 6820910 - DNA, 69 bp, Homo sapiens
gtgtacatttgtaagctagagccatgatttgtaaaacctacaaactgtaacgccagctttaaatgtcac

SEQ ID NO: 6820911 - DNA, 88 bp, Homo sapiens
ctgacatatggggagtctgggctagactccttgagggtgagaaactatgtgaagcaaggtctggccaatagacagccccaaatgccag

SEQ ID NO: 6820912 - DNA, 65 bp, Homo sapiens
tgtcccaggaagcccagaattctggaatggagacagtcaaattctaaaggggttctctgctggca

SEQ ID NO: 6820913 - DNA, 129 bp, Homo sapiens
cttttcatggtatttatcattttagtattgaagatgcagtgttcttttgggaattacgtatgcttagaagagagtactgatgctcaaaggtgaaatgatttgaatctagagttggataaaaagggaaag

SEQ ID NO: 6820914 - DNA, 81 bp, Homo sapiens
gtctctctgctctctggatccttctctgtgtattttgctgcccaaagccccaagagacagcatctgtttggctggacagac

SEQ ID NO: 6820915 - DNA, 68 bp, Homo sapiens
ttcgtttatgttccttccagagagcagaagtgttcaatttctgtggtatgaaagaaatatggaaagag

SEQ ID NO: 6820916 - DNA, 56 bp, Homo sapiens
aggcaagaaaggttaaattcaaagctacctgcacaaatttcagacccattttgcct

SEQ ID NO: 6820917 - DNA, 88 bp, Homo sapiens
gggtattggtggggaggggaggccagtggaccgtccccctgcggaagctgtgtggggacctgcgccactcactgtccaccctgtgctt

SEQ ID NO: 6820918 - DNA, 65 bp, Homo sapiens
cttggaagctgggtcgctgggatcctcctgctcactgtttaaggaggggacagagtagctccagg

SEQ ID NO: 6820919 - DNA, 78 bp, Homo sapiens
aaggtgactgaacaagaggaagggtaggtgaaatagaggtcataaaatcattacaggaaccagattgttcagcatctt

SEQ ID NO: 6820920 - DNA, 59 bp, Homo sapiens
tcaatgggagtccaacatcaaggactttgaataaagtcttctgttcagctcctatctga

SEQ ID NO: 6820921 - DNA, 113 bp, Homo sapiens
atgacaaataagcaggtgaaaagagtcttagcctcattagtcattaaggaaatgcaaattaaaaccacaataattcagtgctggttaagatgtgggtcacctggaactgtcat

SEQ ID NO: 6820922 - DNA, 69 bp, Homo sapiens
gagtctattatagttccagttcaagggaaaataaaataccttgattacttgattattgttgatagattc

SEQ ID NO: 6820923 - DNA, 60 bp, Homo sapiens
tcagaagtgctggctggacatggagcactgctacggtgaccagcgcagccaccactagga

SEQ ID NO: 6820924 - DNA, 98 bp, Homo sapiens
gggactccatgggcctctgtgccttaatgccagttctctgcgataatgtcctggttattcctaatacttgttttggggaccaggggtcctgagagcct

SEQ ID NO: 6820925 - DNA, 83 bp, Homo sapiens
atgcaacaacttggatggatctcaagggaattatgctgagtcaaaaagctaatccctaaaggttgcataaggtatgattgcat

SEQ ID NO: 6820926 - DNA, 58 bp, Homo sapiens
gggatgggagcagaggacgaccagtatccaaaatggttgggtagctgcgttttatctc

SEQ ID NO: 6820927 - DNA, 71 bp, Homo sapiens
gcttcctgcaggccagggtagggactagagtgaccagagctcatggctggtctcctctggctgcaataagc

SEQ ID NO: 6820928 - DNA, 88 bp, Homo sapiens
ttctgagagattaaattgctgaggcaaaccaagaatgtatttcaatacattaattgctttgcttttgtctaaatgatagtttctagaa

SEQ ID NO: 6820929 - DNA, 100 bp, Homo sapiens
tgaaagcctgagaatcttgttacatttgagttaagttatataagcatgtcttatacaagttaatgagaatgacatgaaaggaaaataaatctctttttca

SEQ ID NO: 6820930 - DNA, 72 bp, Homo sapiens
gtgaagtcacctcttgtttcccaggttgctgccccacctgcagctgccacagagcctggccagaggtctcac

SEQ ID NO: 6820931 - DNA, 64 bp, Homo sapiens
gaagtctcggttggctaaaatcagagtatctgacaagttctggacttgccttgctgatgatttc

SEQ ID NO: 6820932 - DNA, 74 bp, Homo sapiens
aagtacaccagcagctgactccaagagagcctatgttatctgtgctcaaggccttttcagctcttgttgtactt

SEQ ID NO: 6820933 - DNA, 62 bp, Homo sapiens
tgtctgactgcaagcagctcatttctccagtctgattttttgacagaagctgcagtcggata

SEQ ID NO: 6820934 - DNA, 83 bp, Homo sapiens
gacactgtctctcagtaactgcactgatggtgagtgagactgtgtccctcagtaactgcactgacagtgagtgagacagtgtc

SEQ ID NO: 6820935 - DNA, 92 bp, Homo sapiens
gggtatcaaaatgtgcacttctgctaattcaggtttgaggaactccatacttcaactttgtaagtagaattgccattttgttttatatgcct

SEQ ID NO: 6820936 - DNA, 65 bp, Homo sapiens
atgtgttgtatagatgagcttctatacatgggaacagacatctggcattatttgttacagcacat

SEQ ID NO: 6820937 - DNA, 79 bp, Homo sapiens
caggtttccgggcatcggggcatctggcagaagatggaagctctggcctcactgctggctggcctggcctggactcctg

SEQ ID NO: 6820938 - DNA, 69 bp, Homo sapiens
aaacagtaggaagagcttgcttgttttaacagaacatttatttgtacacattaagctctttagatgttt

SEQ ID NO: 6820939 - DNA, 67 bp, Homo sapiens
taaaaagattgtgtagaaaggatgccgtatttagttactggtgccatattatatacagttttcttta

SEQ ID NO: 6820940 - DNA, 68 bp, Homo sapiens
ggtcagggctccacagtgggctgaagccacactttactaaaaagaggcctcacctcactgcccccacc

SEQ ID NO: 6820941 - DNA, 59 bp, Homo sapiens
ggatgatgttcctttgagccctgcagctgtcatgccacagtttcacagaggggccgtcc

SEQ ID NO: 6820942 - DNA, 55 bp, Homo sapiens
gactgcatgatgttccagaggagtttagtctttacctttagatttctatgcagtt

SEQ ID NO: 6820943 - DNA, 65 bp, Homo sapiens
agatgaacccagcagggggcttactgcataaagatcagagcttatctcttgctggaaagttattt

SEQ ID NO: 6820944 - DNA, 61 bp, Homo sapiens
gctgattgagcacttattggtgttaggtgttttatgtatatcattgaatgctcaaaacagt

SEQ ID NO: 6820945 - DNA, 67 bp, Homo sapiens
ggtcattggcattccttcctcctcctcctcctgggagtggggtggatttcaggcggtgtcaaaggct

SEQ ID NO: 6820946 - DNA, 62 bp, Homo sapiens
tattagaattttggtttgagagctggcctccaagagtttgcatttaagctaagatactagta

SEQ ID NO: 6820947 - DNA, 60 bp, Homo sapiens
actgctgctgtggctgaaagcatcttccagaaattctgaggacacagcccagacagccgt

SEQ ID NO: 6820948 - DNA, 66 bp, Homo sapiens
cattgttaccatcttttacctacaccattgagtaaggtgggataggtttaagttggtggcataatg

SEQ ID NO: 6820949 - DNA, 94 bp, Homo sapiens
ctctgcttcttcactctcttccccgatggtgtttgggatactagtgtgtgagacacagctgggaactcacacagcagggctgagaagagcagag

SEQ ID NO: 6820950 - DNA, 87 bp, Homo sapiens
gccgcactgaggggcactccacaccacgggggccgccgcggccgacagccagccaggcggctgtggtgggggtgaggctggggcggc

SEQ ID NO: 6820951 - DNA, 90 bp, Homo sapiens
atgaatgaatgaatgaatgcttggccacctaagccttttggaggaaacttctggcatcgtgcgtggccttaggacacgtttattatgcat

SEQ ID NO: 6820952 - DNA, 112 bp, Homo sapiens
acttttttctccagttagctttattgtaagaatacagtatatcatccatataacatacaaaatacatgtttatggactgtgtatgttattagtaaggcttccagtcaacagt

SEQ ID NO: 6820953 - DNA, 73 bp, Homo sapiens
tctgcctcccttagagattctgtcagagtctagtcaggaaaactgaaaccactccagtatttcaaagagcaga

SEQ ID NO: 6820954 - DNA, 70 bp, Homo sapiens
ggagtggtggaaggggttacgcagcaggatggacaccacttccatgcgcgatggcctggcttcccgctcc

SEQ ID NO: 6820955 - DNA, 63 bp, Homo sapiens
ggccttggttctgtcacagccggtagattatttccctttgtgacacacaaaaccagctgggcc

SEQ ID NO: 6820956 - DNA, 129 bp, Homo sapiens
gtttgtttctctggtgctgccctgacttgctctgtttacagtttttagtaccctcagtgtgtgtacctctctaacttcagggctttctttgtaaaagaagggtcagaacttgtcacagagtcacaaaac

SEQ ID NO: 6820957 - DNA, 98 bp, Homo sapiens
gtgtgtgtgtgtgtgtgtgttatgacagatcttgtactcattattgaataattcattgttgcgttaatgtcttcagataccatctctcacttcctcac

SEQ ID NO: 6820958 - DNA, 56 bp, Homo sapiens
gagtacacagcccctgaaggcaatgctccataaatgcccaggatctggcgatgctc

SEQ ID NO: 6820959 - DNA, 82 bp, Homo sapiens
gcagagtctcaaagaggtcagtggacaaaggagtttctgccagaggggagaacttgtgtctactgaccaaggaattttctgc

SEQ ID NO: 6820960 - DNA, 55 bp, Homo sapiens
ccagggatctatagctggtaattgatggatccaagatttgctgtcagtccctagg

SEQ ID NO: 6820961 - DNA, 78 bp, Homo sapiens
attataaagagattgatgtgtatcagtgtgttgtaaaagaatgtttaccatgctgtgacacagtagttacctttgaat

SEQ ID NO: 6820962 - DNA, 55 bp, Homo sapiens
cctaggagatagttatttggcagttgctgctattgtggagtggttgttttctagg

SEQ ID NO: 6820963 - DNA, 63 bp, Homo sapiens
gcacctgtctcggcctggctgtgtcacctcactttcctggggtgccagccctgacacaggagc

SEQ ID NO: 6820964 - DNA, 67 bp, Homo sapiens
tcctctcttctctcttgataaacgccgaatcttacgtgcctgactctgtttaagagctgaaagggga

SEQ ID NO: 6820965 - DNA, 63 bp, Homo sapiens
ctttaaagaataactttaggaataggtaatcttgcaaaagcaagcctggagtatcctttgaag

SEQ ID NO: 6820966 - DNA, 59 bp, Homo sapiens
tgacacctggctgaggtcaccagtagctgagagactccttagctagtgctcagctgtca

SEQ ID NO: 6820967 - DNA, 62 bp, Homo sapiens
gggaaagttctgagactgatggctactttctgaggtggtcccctacagtttcaaagcttccc

SEQ ID NO: 6820968 - DNA, 76 bp, Homo sapiens
tttgagctccaggagggattgggctgtgggtcacccaaagggggcttccagagtctagaccctggtgatgctggaa

SEQ ID NO: 6820969 - DNA, 57 bp, Homo sapiens
ggggatgcacgaaggcgcctcggagagacccctttctccgggtgcccacgtgcccct

SEQ ID NO: 6820970 - DNA, 62 bp, Homo sapiens
aaggacgtttctcttccaggcctggctgccaggatgtgaggcccgggtggaggaatgcgctt

SEQ ID NO: 6820971 - DNA, 67 bp, Homo sapiens
agggccccctgtggctgtctggaggaaaagagctccaggcagaaggatccgcaggtgcaaaggccct

SEQ ID NO: 6820972 - DNA, 63 bp, Homo sapiens
catgacaagcatgtggtaaaaagacccgggttccagtcccaggtctgccacgtgtttgttgtg

SEQ ID NO: 6820973 - DNA, 73 bp, Homo sapiens
tcatcatgcatggcaatgaatgactttatgtgtgaggataatactattgaagtttcactgccagctgaggtga

SEQ ID NO: 6820974 - DNA, 61 bp, Homo sapiens
ttcatagtatcattttagtaggtgttacctccttttaactcctgaggaaatggtctcagaa

SEQ ID NO: 6820975 - DNA, 59 bp, Homo sapiens
tggcaggtcatgagtggccacctcactctccacctggtcacccccaccatcacctccca

SEQ ID NO: 6820976 - DNA, 56 bp, Homo sapiens
ctgccttttgcccttctttggaatgtgattttcatccagggaagaaatgagggcag

SEQ ID NO: 6820977 - DNA, 74 bp, Homo sapiens
gttgagtgctctgcaggcctgtgaagggtgccacctgagggagccgcctgcaagcggccctgcagccacaaagc

SEQ ID NO: 6820978 - DNA, 62 bp, Homo sapiens
ctgcagatgctccccaagccaggacctggatgaacttgaaccagttccaggcagcaactgag

SEQ ID NO: 6820979 - DNA, 96 bp, Homo sapiens
tgccagtttcaacttttcctggagatggagttgttttcaataatggagtgaactggatttcctgaacaagcctcccagtgaagaggaagcacagca

SEQ ID NO: 6820980 - DNA, 58 bp, Homo sapiens
gctgacagcaaggggctgccctcagattctagaggctgcttgcagtttcctgtcatgt

SEQ ID NO: 6820981 - DNA, 76 bp, Homo sapiens
agttgagggtgggagagaaatgaatctttatgttctcctgttagagaatagcttttttccttccagctttcacact

SEQ ID NO: 6820982 - DNA, 56 bp, Homo sapiens
tgcctgactcccaaagaggacgcgtggcagaagagctgatcttaagggagaaggta

SEQ ID NO: 6820983 - DNA, 62 bp, Homo sapiens
ccctaggtgggcctgctctagggagaaggtggtggaccaccctaggtgggcccgctctaggg

SEQ ID NO: 6820984 - DNA, 55 bp, Homo sapiens
gcctggcactcaatcatctgctatttgtggtttaataaagaactttgggctaggc

SEQ ID NO: 6820985 - DNA, 72 bp, Homo sapiens
gctctgtcacccaggctggagtgcagtggcacgatctcggctcactgcaacctctgcctcccgggttcaagc

SEQ ID NO: 6820986 - DNA, 101 bp, Homo sapiens
tgggaacactaacccagacctgtttgactaccatccccaagggagactcagtttctccaggtgagggtggttagagaggcactactgggtgggggtgccca

SEQ ID NO: 6820987 - DNA, 80 bp, Homo sapiens
gctgtgagctgtgtgtttcaccctgacaccaacattttttacatttgttgttataggtggtacaagcaaaatttcacagc

SEQ ID NO: 6820988 - DNA, 56 bp, Homo sapiens
aggctcttgtgaggtagctgcaaccaaaaaagagctgcaagccaagctgagagcct

SEQ ID NO: 6820989 - DNA, 56 bp, Homo sapiens
gtttggtttatgagtggggacagctaatagatttagtatttactcataggcctgac

SEQ ID NO: 6820990 - DNA, 105 bp, Homo sapiens
catttctaggaaattgtcatgaaaaccaaagaatagcctttgtccaaattttttaaaagattaggatgagtatggttatgctgttttatataaattcttcaaatg

SEQ ID NO: 6820991 - DNA, 64 bp, Homo sapiens
ggttcacaaaagagttttatagcaactgttattctggcagcgctggtgatctctattttgagct

SEQ ID NO: 6820992 - DNA, 64 bp, Homo sapiens
gctctgccaccttgtatcaaaataatctggaacaggtttccatggaagcaaaggtggaagtggt

SEQ ID NO: 6820993 - DNA, 75 bp, Homo sapiens
agggagcagtgccaaagaatttgcggacatgtttcaaaacatacagcccctgctctgtggacactgattatcctt

SEQ ID NO: 6820994 - DNA, 78 bp, Homo sapiens
tgtcattccggtcatcacagtgacagccaatgttttcagttattttgagtaagtgagtcactgtgctggaatccgata

SEQ ID NO: 6820995 - DNA, 83 bp, Homo sapiens
ttactgaatgtgatgctaaacatatgtctaatttgtgtatagatttgcagagaaaatgtatatgttgggttatgttacagtaa

SEQ ID NO: 6820996 - DNA, 80 bp, Homo sapiens
gcttccttctggtagtagccgtatgtcttcccatacataaacatatgtaggcatgaaggctctatagcaacagaaagagt

SEQ ID NO: 6820997 - DNA, 80 bp, Homo sapiens
acttcagacacagtgagaaatggaacttcatacgcttgcactgtaattgaatatggttccatttctccaatatctatagt

SEQ ID NO: 6820998 - DNA, 79 bp, Homo sapiens
ccactgctgaaacaggctgagcgtccatcttcactccttcctgagtcttaagtcaggactctcagctcattctttatgg

SEQ ID NO: 6820999 - DNA, 57 bp, Homo sapiens
tcctggttcataaaccttttgtatgacagtcaataaggatttgtggaccacactgga

SEQ ID NO: 6821000 - DNA, 129 bp, Homo sapiens
ttgacaaaaactctgtgggataggtggtaggtgccattctgagtgctttaaatgtatcatctcatttagtgttcacagccactctataatatcagtaccattattagttctcatttcacagaaaaaaaa

SEQ ID NO: 6821001 - DNA, 62 bp, Homo sapiens
agatactctggtaatgtgcacgtggtcaccaaaagacatgtacaaggatgctcagagtgcct

SEQ ID NO: 6821002 - DNA, 76 bp, Homo sapiens
atgctagaactgttctaagcaatatctaaacactatgtccatgtatatggcatgttacttagaataattctggcat

SEQ ID NO: 6821003 - DNA, 81 bp, Homo sapiens
tgctctgtgagtttccttcttgcctaggcatctgactcaggaatttgatcagaagttaatacgaggagaaattacaatgta

SEQ ID NO: 6821004 - DNA, 65 bp, Homo sapiens
tggagataggtgtacatccatgaaaccatcatcacaatctatggaggaggaacttcttatctcca

SEQ ID NO: 6821005 - DNA, 114 bp, Homo sapiens
caggacgggtctgcagttgggcagggagctggaaccacacaccctctctccagacttcttggtcaagtgatctgtggcctcctactctgctccagctgctgatcctgtgtcttg

SEQ ID NO: 6821006 - DNA, 60 bp, Homo sapiens
gagtatctcattttccacgagaagttggaaaacctgacttttcatgtgatgtgacatttc

SEQ ID NO: 6821007 - DNA, 56 bp, Homo sapiens
tcagctgctgtggtatgtacataggcttgcctgtgatgcatagttgctgcagttga

SEQ ID NO: 6821008 - DNA, 72 bp, Homo sapiens
ggaattagggaaattcaggacataattgcttaaggatgctgcattgcagtttctgaatttatccaaggtttc

SEQ ID NO: 6821009 - DNA, 62 bp, Homo sapiens
caacttcagcccaatggccttgacctctggacccagaggtcacagggcactggctggggttg

SEQ ID NO: 6821010 - DNA, 61 bp, Homo sapiens
gccacaaaaacaggaacatgtcaactcatcttgcatggcagcaattttcctgactttgggc

SEQ ID NO: 6821011 - DNA, 56 bp, Homo sapiens
cagcagcatcaggtctgtggttaaaaaatgacctcaacagataccctgtgctggtg

SEQ ID NO: 6821012 - DNA, 81 bp, Homo sapiens
tgaagttatcctgccaggaggaggtgggacagacaaggtgacttatcttctttctctcctctttctgcctctgggttgtca

SEQ ID NO: 6821013 - DNA, 71 bp, Homo sapiens
ggtcatatctattttcaagggagcaagaaagtgcagttgcattgtgtgcttcagagaagaatggaaagatt

SEQ ID NO: 6821014 - DNA, 65 bp, Homo sapiens
tggtgttaaccagctaaactttgcttgaaccctcagtccattgcagaggagcaagctggacacca

SEQ ID NO: 6821015 - DNA, 61 bp, Homo sapiens
atgctgtggccagagttcaactttacaaagtttttgaagttggttctcttcagcctagcat

SEQ ID NO: 6821016 - DNA, 64 bp, Homo sapiens
acagtagtctctttaatcacagtgtctgcttggttccaattactgtctgtaaagggaattctgt

SEQ ID NO: 6821017 - DNA, 74 bp, Homo sapiens
acaattgaggcaccagtaagagtagaactagctatctttggagttctcctgttttggtgattccatctgattgt

SEQ ID NO: 6821018 - DNA, 59 bp, Homo sapiens
tagaaagactgtccagatttcatttcttgatgaaacgatgctttgggtaagtcttttta

SEQ ID NO: 6821019 - DNA, 129 bp, Homo sapiens
tacaatcgactacaaagaaagataaaagtaaagttctcggaggtttgttaagtggcttgccgaaaagtcacttggctagcatctggcagcactggaatttgaaccaaagtattttactctactcttgta

SEQ ID NO: 6821020 - DNA, 108 bp, Homo sapiens
gagaaggctggactatgtaatatctattatgctatagaacttgcaatctaattgggaggcaaatcatggaataactagagattactgatagtattatcaagttctttc

SEQ ID NO: 6821021 - DNA, 74 bp, Homo sapiens
tggggtcacactgcctgctcataacattgctatgtggcttgagtgacagcaggagagcagtgcgtggtccccca

SEQ ID NO: 6821022 - DNA, 58 bp, Homo sapiens
tccagactggggccatgtctgccaagagggtcatcagggggcatgaacctgtcatgga

SEQ ID NO: 6821023 - DNA, 55 bp, Homo sapiens
ttgagggcaagtcttttccatacctaaataacaggggaaaagtactcctccttaa

SEQ ID NO: 6821024 - DNA, 124 bp, Homo sapiens
tgcccaaaaagccttgccacatcttccctcctcactggaaagacagcactcttctgtgttaagtatttgattttgtgatttgtctttcagaattggaaatagagcggccatttggatttgggca

SEQ ID NO: 6821025 - DNA, 62 bp, Homo sapiens
cagtccagtctcttctggtgagttatccaagtggcagatactcttagaaaagattgagcctg

SEQ ID NO: 6821026 - DNA, 76 bp, Homo sapiens
ctgcaagccaggaagagagagccctccacagaacctgactgtgcaggcagcctcatctcagacttttggcttccag

SEQ ID NO: 6821027 - DNA, 75 bp, Homo sapiens
gggtgggcgggcactttgaaaatccatttgtcacactaaacggcaagtccaggtccaggaggttcctgtcttccc

SEQ ID NO: 6821028 - DNA, 85 bp, Homo sapiens
ttctagtattgtttgaaacctttatttaaaagtgaaaatgggattcaacttattcaaagtagatgaagtttcaacacccatagaa

SEQ ID NO: 6821029 - DNA, 63 bp, Homo sapiens
tagacagggtggcttagaaacaacagaagtttatttctcacagttctagagactacaggtctg

SEQ ID NO: 6821030 - DNA, 61 bp, Homo sapiens
gccatcagcagccctgtgggtgacaccacaaactcgctgagcccacagagcatgctgaggc

SEQ ID NO: 6821031 - DNA, 88 bp, Homo sapiens
atcacatgtggagaattaaaaaatactgatgccagggcctctgggaatgtggccaggtttgatgtattatttaaagctcccaggtgat

SEQ ID NO: 6821032 - DNA, 72 bp, Homo sapiens
atcatgtttgacagcatatcctcatattttatttatagtgttgaaatgtgtatttgctgccaaatgtctgat

SEQ ID NO: 6821033 - DNA, 120 bp, Homo sapiens
ctccagtgtcctgaagcccggttcctgatgattcctgggtcctcacaatcccaggccctgtcagctctggggtctcagggatgggaggccccaggttctggaagctgttgtgcacttgag

SEQ ID NO: 6821034 - DNA, 81 bp, Homo sapiens
gcttgaagctagaaacacagatctggtgtcatcagctgacattgctctagatcgtttcgaagttcttttttaattcaaagt

SEQ ID NO: 6821035 - DNA, 79 bp, Homo sapiens
tcaggtgtgccctgtttggaggcttgttggcctggggaagctggaggcaggctaactacaagcggggcatcctacctga

SEQ ID NO: 6821036 - DNA, 98 bp, Homo sapiens
acactgaggaatgtcataggaagcaattctatgaagcttatttctgtgtttactgcagggatgttgtcaaggatgtggttgatgacattccacagtgt

SEQ ID NO: 6821037 - DNA, 92 bp, Homo sapiens
gccttgatcagctccacaaagtcctggtgtatggccagatcactctcgaaggcttcatggttgtggataagggctttgatgtctgatagggt

SEQ ID NO: 6821038 - DNA, 76 bp, Homo sapiens
tgcgtggcctgctggccaggcatcccctgatcctagcatggttgctggagggatgctctgtggtgcctgtcatgca

SEQ ID NO: 6821039 - DNA, 73 bp, Homo sapiens
gtaatatcttgctattgtgaggctcaaattagacaacttatatatgttgagctttgatgcatggcaggtgtac

SEQ ID NO: 6821040 - DNA, 59 bp, Homo sapiens
tgcagaatctaatgtaaaacagacttgcataaggatgaggtcttattgcagtagttgca

SEQ ID NO: 6821041 - DNA, 85 bp, Homo sapiens
gccctcattcaggaagaagatacattccatttctacttaattgcttaagttaaagaggcatgggaatgtatggcttttgggtggc

SEQ ID NO: 6821042 - DNA, 61 bp, Homo sapiens
ttctcagtagttagcatttgtgaattggcctcctttgatttctgatgaggctgtctgagaa

SEQ ID NO: 6821043 - DNA, 60 bp, Homo sapiens
gtcatgccagcggagctcgggaggcctgccgcgccgcaccgagaagctgctgtgtgtgat

SEQ ID NO: 6821044 - DNA, 60 bp, Homo sapiens
agtgaatgacaaatgagaggttcagagggatcagaggacctgctccatgtcaccttcact

SEQ ID NO: 6821045 - DNA, 56 bp, Homo sapiens
tcttgccagcacatatgcgttggagatggaaattaaactgcaaatgatgctggaga

SEQ ID NO: 6821046 - DNA, 78 bp, Homo sapiens
taggtgtttaggagtttagcagaaacttgtttgatgaattatttaaacatgagcatttctgtttaattctgtaatcta

SEQ ID NO: 6821047 - DNA, 75 bp, Homo sapiens
ggggaaggacagccagtgcgatggattcacactcctctcactgtgaccttggagaccctcgctctggcccacccc

SEQ ID NO: 6821048 - DNA, 92 bp, Homo sapiens
tctcactcttgaaatataatgcaatacctttttatgctgctttctgttatcacggcagcatgaaaagtgttgctatctttctttgggagagg

SEQ ID NO: 6821049 - DNA, 67 bp, Homo sapiens
ttgagacaggtgtctgcaagttactgggaattaggcagagaaccaggcattgacacctgatcatcaa

SEQ ID NO: 6821050 - DNA, 65 bp, Homo sapiens
ggggcttggatgctcagcttggccctttttggacctccaagatgtggtgggctgagtttggccct

SEQ ID NO: 6821051 - DNA, 61 bp, Homo sapiens
gaggtgtcactttctgcctactgtgggaaattcttcccaaatggtccttggctggcatctt

SEQ ID NO: 6821052 - DNA, 59 bp, Homo sapiens
tattgtgaaggccatgtgctaaatccagcaatccgctccagtaggtgtccttcaggata

SEQ ID NO: 6821053 - DNA, 60 bp, Homo sapiens
tcttgtacaagtcagtgctggggttagcatattgcccctagtgtgtgttgtacacctaga

SEQ ID NO: 6821054 - DNA, 71 bp, Homo sapiens
tagatgtgatttatttgatatgctactttgtgctgggcccagtatcaagtcttcacgtgatatctcattta

SEQ ID NO: 6821055 - DNA, 85 bp, Homo sapiens
cattcaccttttcatggctttgttctgttagatgaaagtgtttctagatttggcatttatctaacatagcatcatagggtgaatg

SEQ ID NO: 6821056 - DNA, 62 bp, Homo sapiens
gggcttgaggtagaaaaagcttgtagtgtttgagacatgaaaagcctgtctagctggagttt

SEQ ID NO: 6821057 - DNA, 76 bp, Homo sapiens
ggcagcaggactgccgttaaagtgatgtcagagtttccatttcagttccttattttcaatgctttagccctctgcc

SEQ ID NO: 6821058 - DNA, 62 bp, Homo sapiens
gggaagtcagtctggaaccaaagagttgtcaaacccggccatgtgttaaaggctgaggtccc

SEQ ID NO: 6821059 - DNA, 56 bp, Homo sapiens
ggtgcttggttgaggtctcttggttgagagacagaaaggggcaaacccaggacacc

SEQ ID NO: 6821060 - DNA, 74 bp, Homo sapiens
aaagtgtacaatttagtggtgtgtggttcattcacaaagctgtacaaccaccaccatctagttccaaacatttt

SEQ ID NO: 6821061 - DNA, 61 bp, Homo sapiens
tttaggttggcatttggctggatttttagacaatttttctagctttccttctagccctgaa

SEQ ID NO: 6821062 - DNA, 83 bp, Homo sapiens
gggaattgtattataattttaatttagctgctgtaacaagatccagaatagcagtggcttaaataagattaggtttatttctc

SEQ ID NO: 6821063 - DNA, 67 bp, Homo sapiens
ctatggacttgtgagtgttctccagaggtacaggatttaacatcctggtgaggactccaagatatag

SEQ ID NO: 6821064 - DNA, 82 bp, Homo sapiens
cctggtattgtgacacatatacctcttcttgagttttgacagctttcagataggagatgggagtgtggagtatgtaaccagg

SEQ ID NO: 6821065 - DNA, 78 bp, Homo sapiens
tggttcttcatctcaaggcataacctttttagaatctcaactgaatcttcaaaatgttctgcttgggacagaagtcca

SEQ ID NO: 6821066 - DNA, 85 bp, Homo sapiens
gattgtttcaggaatcaatggtagattaagtaaattagatcctttcaggatgcgttgcttttagtattatttctaagagacagtc

SEQ ID NO: 6821067 - DNA, 80 bp, Homo sapiens
acagatattcagaagtaactgtgaagtaattgtggatgggatccatgtctacttggtatgtttgtctcctgagcatctgt

SEQ ID NO: 6821068 - DNA, 66 bp, Homo sapiens
ttctcttggcagatggattcaacattattatcttcattgagaatgattctgacactgcctagagag

SEQ ID NO: 6821069 - DNA, 72 bp, Homo sapiens
ggtttctgcatgcaagttatgacaggtaggactgaaaaaacactgccttttgacttctagcatttagcaacc

SEQ ID NO: 6821070 - DNA, 56 bp, Homo sapiens
cagtgcccaagatgtgccatgcccaatttcaggagctggagatagaatggccactg

SEQ ID NO: 6821071 - DNA, 77 bp, Homo sapiens
ccaaatccttagcccactaatacttattgagtctctatttttatctattaatgggaaattctttgggttagggttgg

SEQ ID NO: 6821072 - DNA, 129 bp, Homo sapiens
gccattttctccctcgcttccccccacttcacggccgcgcggcgccccccaaccctggttccgtggcgcgcgcctcgttcacgtgacgtccccagcgttccgccgcgcgctaggcgaggggaagggggc

SEQ ID NO: 6821073 - DNA, 93 bp, Homo sapiens
agcctaataactatgggcttttggtatgttgtttagaggaaatgacatcagttaatctggcaggatatcgaagtgaaaagtagttaaggggtt

SEQ ID NO: 6821074 - DNA, 61 bp, Homo sapiens
agtaggagctcatggggccaggagggttgtgggatgccctctgggctctgtcagcacctct

SEQ ID NO: 6821075 - DNA, 86 bp, Homo sapiens
tggtgttgcaaagaaactttctccttctagaggtgaattccagcttttacagtcagaggagccaaagttctgagcctgcagcgcca

SEQ ID NO: 6821076 - DNA, 55 bp, Homo sapiens
gtgagtcatgtcccatctgatttatattggatctggctgtggagccatgactcac

SEQ ID NO: 6821077 - DNA, 58 bp, Homo sapiens
gctaaatgacagagctgggactagtagtgcacaggcacgctgacccctgctgtcatgc

SEQ ID NO: 6821078 - DNA, 75 bp, Homo sapiens
tggaagctgtcctgtgacctggcaccacagcaggctgtgtgctgcctcctcgtgtgcgcatcacaagaagctccg

SEQ ID NO: 6821079 - DNA, 63 bp, Homo sapiens
ccagacaaagtgacataaaatctcccaggattatatatcaatccaagggatgccattgtttgg

SEQ ID NO: 6821080 - DNA, 76 bp, Homo sapiens
tggccaggcagtgtttttctcacaggttgcttgactaatggctgtgtgcctgtgccaaaaggctgcttatgggtca

SEQ ID NO: 6821081 - DNA, 62 bp, Homo sapiens
taagtaccctgctgattccaagggcagcatttcagcagcagccctggcaggcgggttactta

SEQ ID NO: 6821082 - DNA, 62 bp, Homo sapiens
tcattggttccttgaaccctgcactgtggcaaagtggcccacaggctggaggaggaccaaga

SEQ ID NO: 6821083 - DNA, 57 bp, Homo sapiens
gtggtttgtgcatagctcctatcatgacagaaatgggtggagcttaatatgtaccac

SEQ ID NO: 6821084 - DNA, 57 bp, Homo sapiens
ctgcatctgcataatcaacttcttaaaattttttaggagttgtattgagcagattag

SEQ ID NO: 6821085 - DNA, 59 bp, Homo sapiens
caggatgaccatatgttccagtttgcccaggacaattctggatcatgcctgttatcctg

SEQ ID NO: 6821086 - DNA, 66 bp, Homo sapiens
tgtggaaggggccccatgaccagcccactgtgagctcacacgtgatgactgaggcttcttcacaca

SEQ ID NO: 6821087 - DNA, 64 bp, Homo sapiens
tcccagggactgggctaggctttgcatggaagataaattacaatagagctcctggtctcaggga

SEQ ID NO: 6821088 - DNA, 78 bp, Homo sapiens
gtagatattacaagcagcattaccaagacatggcaaaaagagtttgtctgaattgtaatgttgcgtttgtgaacctat

SEQ ID NO: 6821089 - DNA, 83 bp, Homo sapiens
cttgcataaagtcaataagtggtagggctgagattcaaatctaaatactagattatgcattccaaccttattcactatgtggg

SEQ ID NO: 6821090 - DNA, 93 bp, Homo sapiens
gagctggatgcgatcatcagaaagtaacacaagaggtccttgcggtgatggaaacgctgtgtgtcttgactgtgttaatgtcgtatcctgctc

SEQ ID NO: 6821091 - DNA, 61 bp, Homo sapiens
attctagacatctgcagttgtttcttagtgggaatggttgctttatgtctctctacagaat

SEQ ID NO: 6821092 - DNA, 71 bp, Homo sapiens
cctttgacaactcttctatcagtcctcttgggaactctaagaggatgattttaaggacactgtcaactggg

SEQ ID NO: 6821093 - DNA, 69 bp, Homo sapiens
gtgtttgaaagaacttatcctagaatttggttatatgctaggtgatttggaaaaggtcttaaggaacac

SEQ ID NO: 6821094 - DNA, 65 bp, Homo sapiens
tcacagctggggttttggcagcctgtcctcgggttgttcagcctggtgaccctagccgcctgtga

SEQ ID NO: 6821095 - DNA, 55 bp, Homo sapiens
ctccagaggaaagcacatagtgggacagaaaccagagtgctctagacttctgggg

SEQ ID NO: 6821096 - DNA, 56 bp, Homo sapiens
ggcggggtccaaggttagggcgcggtagacttgacccgctttcctcaaactctgtt

SEQ ID NO: 6821097 - DNA, 55 bp, Homo sapiens
ttttgtctgccctgagggaaagaaattatggtcaatctcttctggggagataaaa

SEQ ID NO: 6821098 - DNA, 78 bp, Homo sapiens
tgctctgtggatggaagctgtgttgatggcatggagcttcctcccttgaaggcacatcttcccccaagtccatttgca

SEQ ID NO: 6821099 - DNA, 72 bp, Homo sapiens
taagcaactgtctgtcaccaaaacagactcttctcactagtgtttacagtctagttggtgagacagagctta

SEQ ID NO: 6821100 - DNA, 81 bp, Homo sapiens
gcattgcttatgttgtaattgccattatggatatcttgcagtggccataaagtatttggaatggcatttttaaagtaatgc

SEQ ID NO: 6821101 - DNA, 61 bp, Homo sapiens
aggcctgagaaggataggaagcgattccctgggtcttggtgttgctaacctttttaggctt

SEQ ID NO: 6821102 - DNA, 57 bp, Homo sapiens
cgagggaggtggtaagccttggaaaactgtagaggtgacaaggccaccatttctccg

SEQ ID NO: 6821103 - DNA, 75 bp, Homo sapiens
ggggctgctaggctggttagatttgtggtcttcttcctcctgtggaggaccctagagagagccagcctgagccct

SEQ ID NO: 6821104 - DNA, 61 bp, Homo sapiens
ataccctgccatgttacctgcacaggtccaggaccacaggacccatgagtcagtgaggtat

SEQ ID NO: 6821105 - DNA, 72 bp, Homo sapiens
acagagttagaaatgtcacagatctgatttgacaaactgtctgatcttggctgcatttctattcctttctgt

SEQ ID NO: 6821106 - DNA, 89 bp, Homo sapiens
ccttgagataaacaactgggggtgaaggtgttagggagcatattcactatgctcatattcaactatcttcacttaaagttcacttaggg

SEQ ID NO: 6821107 - DNA, 74 bp, Homo sapiens
gtgtgtatgtctatagtttttaaatagaccaggaattatactaaaattatttaataaaactatggcatgtgcat

SEQ ID NO: 6821108 - DNA, 66 bp, Homo sapiens
gactagcacatatcaaattcctgggttgtgtcaattactgtactaggaactttatatttgttagtc

SEQ ID NO: 6821109 - DNA, 122 bp, Homo sapiens
tgccttcttcctggctccggctgtcatcacagttgagcagcctccgctcgtggccctgcctgtggctgctctaataactgtgattcaaacagaaatgctgagaaagatcaggattctaggca

SEQ ID NO: 6821110 - DNA, 76 bp, Homo sapiens
acagcaggcctctctggccccatggctgagctggcctctcagttggccaatgtggccaggtttaggccacccctgt

SEQ ID NO: 6821111 - DNA, 71 bp, Homo sapiens
tgtagagacactgtcttcagtttcactgcatcctcttcacagctgtaattaaactgaagacagaagctata

SEQ ID NO: 6821112 - DNA, 68 bp, Homo sapiens
tccaatgcttcctcctcacctcaggtcaggtgacaggaacccttctgagggcttgaggggaagtagga

SEQ ID NO: 6821113 - DNA, 71 bp, Homo sapiens
ttttaacctgggcattctttgagttctcagtttcgaggtgatggggagcaaaaatgatgcccaagttcaaa

SEQ ID NO: 6821114 - DNA, 83 bp, Homo sapiens
gccttattttatggaatatagtcttatatctcaaagcatttattgcatagtaggggagataagacatgtcctgtgataatggt

SEQ ID NO: 6821115 - DNA, 76 bp, Homo sapiens
agacccaggacactgcttctctggcagagccagccctggctgggctccctcacatcggagcctgtgccctcagtct

SEQ ID NO: 6821116 - DNA, 105 bp, Homo sapiens
ctcataaaaatttaagtgatgtgattaagcatttcagaatttgcaaatgaagattatgagttcatggagatttgggaaagcttgacacatgtagaaacccctgag

SEQ ID NO: 6821117 - DNA, 87 bp, Homo sapiens
ttggaagctttgagagcagaagcccctccagaccaagaactcctgattgtgtctttcccttgggctttcgcagttttcagcttctaa

SEQ ID NO: 6821118 - DNA, 98 bp, Homo sapiens
gatttttttcatttcagattgtgtgactttgggcaattcactcaacctctttgagtctttttgtcctgatttataaaatgaaggaattgaaaaatatc

SEQ ID NO: 6821119 - DNA, 70 bp, Homo sapiens
gcggctggcgctgtgagctgctgcttagaaacgagaggccggcagctttggattcgcggctgtcagatgc

SEQ ID NO: 6821120 - DNA, 67 bp, Homo sapiens
gcatgaagttcattccctccagctgtggctacctcaatatggtggctggagggttagtgagataagc

SEQ ID NO: 6821121 - DNA, 71 bp, Homo sapiens
gctccttctggcccctggtctctggtgtttgtgctgtgtcagcctcataccaagtcagaggcctcatgggt

SEQ ID NO: 6821122 - DNA, 55 bp, Homo sapiens
ggtggaggggccacactcggggccgactggccgcctggtttgtatttttaacacc

SEQ ID NO: 6821123 - DNA, 71 bp, Homo sapiens
gtgcggctgtcgctgtgagtctgcatgggagagtggcggcgtgctctcctctgcgcggcagtgccccgtgt

SEQ ID NO: 6821124 - DNA, 68 bp, Homo sapiens
taaggagacctttaaagcaagctgcagtggtgtcatatcattgtacagttattttaaaataatccata

SEQ ID NO: 6821125 - DNA, 57 bp, Homo sapiens
ctttgagtcagatgttttgaaagttcttttccaactttcaaatatcatgattctagg

SEQ ID NO: 6821126 - DNA, 64 bp, Homo sapiens
agagtggttcttgatctgtagagttgatgtgagtcttacatgagaaagaacctgcaaaagctct

SEQ ID NO: 6821127 - DNA, 75 bp, Homo sapiens
gaatgttgactctaccaagcagattaaatttagtctctgtgaggcttgatttgtcctgcttaagattgagcattt

SEQ ID NO: 6821128 - DNA, 81 bp, Homo sapiens
agagaagtttgaggcatgatgctggaagccacagggcatgctgtattttggccatgtgcctttcatcatgcttttgtctct

SEQ ID NO: 6821129 - DNA, 71 bp, Homo sapiens
ctggagtgagttggaaaacagacactcatgagacgggcctatctctgtgtctgtttcccagctctccccag

SEQ ID NO: 6821130 - DNA, 89 bp, Homo sapiens
cacctttggcggccatgtggtcatctgggtttgtggcatcaggtgagcagacctgggttgccactgacccaggggccacccagatggtg

SEQ ID NO: 6821131 - DNA, 73 bp, Homo sapiens
ttagacattgagctcctcaagagcaggaactgctttatctccacagtccagctcagggttggctcaagtctga

SEQ ID NO: 6821132 - DNA, 71 bp, Homo sapiens
ctttgtctttataatggttctaagatcatcagaagttacttttgtgcataaagggctatagtacagcaagg

SEQ ID NO: 6821133 - DNA, 57 bp, Homo sapiens
tcgatggctttacttgtcaacagacggcatctttactgcttggcataggccacttga

SEQ ID NO: 6821134 - DNA, 55 bp, Homo sapiens
cgcgaggtggaggttgcagtgagccaagatcgtgccactgcactccagcctggtg

SEQ ID NO: 6821135 - DNA, 80 bp, Homo sapiens
ttatggacattaaagcgatgtagaaaatgttaataaacccgagaaataaagcataatctacattttctttatgtacatga

SEQ ID NO: 6821136 - DNA, 88 bp, Homo sapiens
aagaaaaacactgaattaagcattacatacattcctctctggatgagaactgggtgtatggattcttgggttcatgattgaaattctt

SEQ ID NO: 6821137 - DNA, 56 bp, Homo sapiens
gatattggattagtttcctagggttcctaaaatcaggcccactctaatccactgtc

SEQ ID NO: 6821138 - DNA, 71 bp, Homo sapiens
ggctgccgccccacctgctaccttccagcagccgtcctgggcgctgtcccaggcaggctggggtggcagct

SEQ ID NO: 6821139 - DNA, 76 bp, Homo sapiens
atgctcccatgaccctggcaggtagcctcataatccatgcagattgtgacagtacctgccatggtcatgggagcat

SEQ ID NO: 6821140 - DNA, 97 bp, Homo sapiens
gtgctggctgggcccagaacaccaaaggcagagctgaacacttccactgggaagtgggggttttggcctcttgggctgggaaattcctggccggcac

SEQ ID NO: 6821141 - DNA, 95 bp, Homo sapiens
ggaccactgcctgtcatccctaggcgaaggtctgggtgggcagggagcctcatgccctacctcaggcctgtcctcctgggggtggctgtgagtcc

SEQ ID NO: 6821142 - DNA, 61 bp, Homo sapiens
ggccctggcctctctgagcagggagcaggagtcctgcctccctgtagaggccagcctggcc

SEQ ID NO: 6821143 - DNA, 58 bp, Homo sapiens
ctctttcttcttctggctgcacctggggttctgcccactggcctagaggaagaaatgg

SEQ ID NO: 6821144 - DNA, 72 bp, Homo sapiens
atttaaacataaagcagttcatttctcatcttttcatggagaaagggactgatctgctcctagtgtgaaaat

SEQ ID NO: 6821145 - DNA, 76 bp, Homo sapiens
gaattgtatgctgtcttgatagcaatgcttgaatggacgtcattgatgttgggcactcaagacagacatggagttt

SEQ ID NO: 6821146 - DNA, 117 bp, Homo sapiens
tataatgttttaagagggtttacgaatttgtgttagtccacgttcaaagatgtcctgggccatatgcggcccatgagcagtgggctggacaaacttgctttctgcttctgcgttata

SEQ ID NO: 6821147 - DNA, 55 bp, Homo sapiens
actatgctctgctgccagaggactcttccaaagttttacaggtcataggtatagt

SEQ ID NO: 6821148 - DNA, 73 bp, Homo sapiens
gcagaattatatctttattatgtctatctgctatgggtagaaaacaagcatggcatttgaaggtagaagatgt

SEQ ID NO: 6821149 - DNA, 59 bp, Homo sapiens
tcatggggcgtaggggatggatccattctatgtgtggcttgcctctacctacccctaga

SEQ ID NO: 6821150 - DNA, 78 bp, Homo sapiens
gagtgaagggagcagggctcctttgggtagcttggtcttggtagctcacctgctgggaagcctacgtttctctcattt

SEQ ID NO: 6821151 - DNA, 71 bp, Homo sapiens
ggagaagagatgactgatggctgattattaatgctctttcacaggtgatatgaatcaatcactcttcatct

SEQ ID NO: 6821152 - DNA, 60 bp, Homo sapiens
tctattgtgaacagtaaaaatcatttagttggcacattgccagtttctgctcacagttga

SEQ ID NO: 6821153 - DNA, 91 bp, Homo sapiens
ggagatcaaatatcagcttctatttatctttgtgttcccagaacccaacacagagtttgacacatgggagactgattgtttgtaaagttcc

SEQ ID NO: 6821154 - DNA, 56 bp, Homo sapiens
cagtagcttacttttcttgatcacccgagcttgtgatccgaaagtcaaagctactg

SEQ ID NO: 6821155 - DNA, 65 bp, Homo sapiens
gtgtcttattgatgttggcactccctaacatgtacataggatagtgttcagcatgtagtaaatac

SEQ ID NO: 6821156 - DNA, 78 bp, Homo sapiens
ttcaggagattagaaaaatgttcagtagtttctgctttaatatagagaatgtctattaacattttttgttcttaagaa

SEQ ID NO: 6821157 - DNA, 101 bp, Homo sapiens
gggatgtccaggtgtgggagagaggactttgaagtgggctttgggaaggcaggttcctgaccttctgccatttacaaatttcatgggcttggtctagtccc

SEQ ID NO: 6821158 - DNA, 60 bp, Homo sapiens
tagtacctttctgtatgcttagctgggactactttaccgtttggcagcttcagggtacta

SEQ ID NO: 6821159 - DNA, 64 bp, Homo sapiens
atgcacttatttcttttgtgtagatacccagtagtggaattgctgggtcagagggaaagtgtat

SEQ ID NO: 6821160 - DNA, 86 bp, Homo sapiens
cccagtttcagagcagtgcagaccttccagaaagaactttggcaccagaagttcttctccctgggtctcaagctgtgttttctggg

SEQ ID NO: 6821161 - DNA, 76 bp, Homo sapiens
tcccataaccatttatgaaattatcttttcattagtgcttcaacagaaaaggaaatttatagagatcgagatggga

SEQ ID NO: 6821162 - DNA, 56 bp, Homo sapiens
acagctgtgacttagagaagttgaactaactagctcaatctaagtgccaaagctgt

SEQ ID NO: 6821163 - DNA, 66 bp, Homo sapiens
ggctgctggcctctccccggccccacagtgaggacaaggctgccttgggaggggaaccaggcagct

SEQ ID NO: 6821164 - DNA, 64 bp, Homo sapiens
ttcctcagaaagcttttacttaaacaggacatcttcctgtcttgtgagattatttcaataggaa

SEQ ID NO: 6821165 - DNA, 73 bp, Homo sapiens
gctgtaataaactggaagagtgaatataactggttttctcagtcctgtgagtttttctagttacctgttgagc

SEQ ID NO: 6821166 - DNA, 60 bp, Homo sapiens
acacacaggtaaaggagcctggaagtatttcatgaatttttaggccccacctcctgttgt

SEQ ID NO: 6821167 - DNA, 67 bp, Homo sapiens
gacgaaccttggccgcagtccttgcgaactgttcgcaaaacagtgcgggctgcggtgggtcagcgtc

SEQ ID NO: 6821168 - DNA, 72 bp, Homo sapiens
cacaggttggccaggtgcctgtcacaccaaccccaagtgttgcaggggtcgtgcagacctgtccagcctgtg

SEQ ID NO: 6821169 - DNA, 69 bp, Homo sapiens
ctttcattgttgtgagatcaagcagttgcacttcaagtgcattcactgatataatttccagcaggagag

SEQ ID NO: 6821170 - DNA, 56 bp, Homo sapiens
tctagcgggtctgggccaagccccgtggctaaggaacatcacaggccgtcgctagg

SEQ ID NO: 6821171 - DNA, 76 bp, Homo sapiens
actcactacccagaacaaggaggagaggagatacacgaaaagtgtgagctctgcagattgttttaggtgtgtgtgt

SEQ ID NO: 6821172 - DNA, 65 bp, Homo sapiens
aggaagaccaccccctacagcacacttgcataaaaacatgtcctgagggtggttggtcacagcct

SEQ ID NO: 6821173 - DNA, 89 bp, Homo sapiens
gggagttggggcccaggaaatgaggctgaagggtgtgatgatgaatttccagttccccaccttccccagactcagtcctgccagcttcc

SEQ ID NO: 6821174 - DNA, 74 bp, Homo sapiens
tcatttttcattgaagacttactggcttcagttctcaagtcagagtgtgcaatgtatgtctcaatgattattga

SEQ ID NO: 6821175 - DNA, 87 bp, Homo sapiens
aggaagactttcagttattccccattcaatatgatattagctgtgggtctgtcattcatggcttttattatgttgagatatcttcct

SEQ ID NO: 6821176 - DNA, 67 bp, Homo sapiens
tagagtagcagctctccagggttcacaatgtgggttgtgtaacgtcctgttgagtttccctgcttta

SEQ ID NO: 6821177 - DNA, 78 bp, Homo sapiens
gaagataaatgttcagtagaataggaatggaatctaatgctttttcatgctgtggtaaatcactgaaaatgtgtcttc

SEQ ID NO: 6821178 - DNA, 99 bp, Homo sapiens
tagtgacaagggcatcccaaggcacttgcccagagctgcagagttgtgtgtgccatacctgcggctcaaagggaaggccttctatcccctgagtttcta

SEQ ID NO: 6821179 - DNA, 64 bp, Homo sapiens
ctggcctaaaattgcttctgcatctgttctctgcagcaagcctatgaattttaatcacggccag

SEQ ID NO: 6821180 - DNA, 61 bp, Homo sapiens
ctggcagacttaccatcagacaggaacatgggaggctactgtctgatggtcggtctttcgg

SEQ ID NO: 6821181 - DNA, 69 bp, Homo sapiens
aggagtctgccagagatctgggcagagtttatacacagaatctggggctcttttctctggctctctcct

SEQ ID NO: 6821182 - DNA, 56 bp, Homo sapiens
atgcttaaccttggtgtacaataagcacaatattgatgtacaacaatgctgagcat

SEQ ID NO: 6821183 - DNA, 91 bp, Homo sapiens
catgtttatgtagagaacaagtatggcacggaggacagtccctcgtcttctaccaatgccgtacgttttccatctaaatacaaagaacatg

SEQ ID NO: 6821184 - DNA, 95 bp, Homo sapiens
atgtcaattttctatcattaactcaacagacatttttaagcacttactgagtgtctttggctaagtgctgtgagagataaaaatagaagatacat

SEQ ID NO: 6821185 - DNA, 130 bp, Homo sapiens
tttagaccttaattttccatagcaggctggctgctttaacattctgatgctgtaattacctttattgaaacattgctgtgtaaaaggtgattgaagcagctgtccctgttacgagttttgattttctgga

SEQ ID NO: 6821186 - DNA, 89 bp, Homo sapiens
caggtgtgctggtgattgtctcctgagagctggacagaggcctctgcactctacctgcactcaggaaacatttacagaatcacactctg

SEQ ID NO: 6821187 - DNA, 87 bp, Homo sapiens
agttcgtttattcattggcctgtgacttccggggtcagttaattactagatttcagagtttattaggttaatggacacataagaact

SEQ ID NO: 6821188 - DNA, 55 bp, Homo sapiens
actctggctattcactataatactgcttcttatcagacatgtgcgtggccggagt

SEQ ID NO: 6821189 - DNA, 72 bp, Homo sapiens
gtctcctgaggctcgcgcgcccctggtgggcgtgagaggaggcgtccccgcggcggtccggcctcaggaagc

SEQ ID NO: 6821190 - DNA, 73 bp, Homo sapiens
gcaatttcctggaaactgttgtcaaatctgtttacaaagccaagcagaaaaggtttcatcaggaactcattgt

SEQ ID NO: 6821191 - DNA, 105 bp, Homo sapiens
ggagggccccgggtctctcgggcaagctctggagccggaggatttccaggaacagaggctgggatcgcctggcggctccacagccccgccaacctgcctcccttc

SEQ ID NO: 6821192 - DNA, 61 bp, Homo sapiens
tcagggcagcaaagtttgacctcaacttttaattcataattttgacaggctgttgccttga

SEQ ID NO: 6821193 - DNA, 67 bp, Homo sapiens
cctaatggtaatagcatgcatcctgcatagaatcactggtgaatctgggcactgctgagcctgtagg

SEQ ID NO: 6821194 - DNA, 77 bp, Homo sapiens
catatctcctgtgaattgcaacaattgcaacaatattgttgaatattgaagcaattttccagtcctgcagggatatg

SEQ ID NO: 6821195 - DNA, 76 bp, Homo sapiens
tttgagttcacagtgtttgatttaggggccactctttattggatggcaccaatatttcagactattgatattcaga

SEQ ID NO: 6821196 - DNA, 79 bp, Homo sapiens
actcacttattcctctgtaactgtgcttggccctagaaggcaattattaagtatttgttgaatgagtgaataaatgagt

SEQ ID NO: 6821197 - DNA, 112 bp, Homo sapiens
aaagggagcaggggtacaaaattagtgcaccaggttgaagtcacctagagctgactttgagactttggcccttaatttacattaatttataaagtaactccctgagcccttt

SEQ ID NO: 6821198 - DNA, 89 bp, Homo sapiens
ctgccacaccgatgggttgttctggcaaaagaaagaacaaatgtatgccagcctttcttcccagtgagacttatgggaaaggtgagcag

SEQ ID NO: 6821199 - DNA, 78 bp, Homo sapiens
gtgctttagtattagcgaagtgttttcacatatagaatttcatctgtagtaaagcaggttttgctgtctctatttcac

SEQ ID NO: 6821200 - DNA, 69 bp, Homo sapiens
tcttccttctttggcactgcgcagccatttggtgtatatggaattagctgggcctgttatctagggaga

SEQ ID NO: 6821201 - DNA, 92 bp, Homo sapiens
ttccacagcaaccaacgctggctgccaatttcagagctgcccctgggcctggctctgctggattgaggccaggagtgcctgggtctgaggaa

SEQ ID NO: 6821202 - DNA, 61 bp, Homo sapiens
ggtaaaatttggtagtatgtcaacttccctaactgggatcgatgacacagctaggtttgct

SEQ ID NO: 6821203 - DNA, 91 bp, Homo sapiens
tgggaaaattaacggaactgtctgcttggatcataatccctccagtctaaataatgcttccaaaacagaactctgtgaattgttttcacca

SEQ ID NO: 6821204 - DNA, 65 bp, Homo sapiens
tctgggtgggtcctaaatgcagtcacatgtatccttataagagtgaggcagagggattttacaga

SEQ ID NO: 6821205 - DNA, 78 bp, Homo sapiens
ggaggtgtggttattagagtgcagctattgctgattggatggcagaagcatatagctatctttgattggctgactttc

SEQ ID NO: 6821206 - DNA, 85 bp, Homo sapiens
agtgactaatcgccaatggggaggaaagaaggtcctgtgggagtcaaagccagggtcttcctctaccccattcgtgagaaacact

SEQ ID NO: 6821207 - DNA, 65 bp, Homo sapiens
tttggtgcatttctcactgagcagataaaagagctatttttatccattcagtgagaggtatcaaa

SEQ ID NO: 6821208 - DNA, 75 bp, Homo sapiens
gttcccctcagcctggctgctcagccactcacactcgagggtgtgcaattgcagggtcagcagccgggagtgaac

SEQ ID NO: 6821209 - DNA, 114 bp, Homo sapiens
gacgaatgcagaggtaggtactcaggatgcaatatggtggctccatagtccatccgagacctgagctatttctgccctctgttattgcatccttagcacatggcttccatcgtc

SEQ ID NO: 6821210 - DNA, 74 bp, Homo sapiens
ggctattacagacgggctcatggcagtccctgggggtccaagaacccagcgagctaagccacgtgctggaggcc

SEQ ID NO: 6821211 - DNA, 62 bp, Homo sapiens
gttaatgctttgtcagcctaagggcattctttaatgcactgaaaggaaaccagagcataaac

SEQ ID NO: 6821212 - DNA, 125 bp, Homo sapiens
ctcaatattcctttaatattagtctcaaatttggattactgtctttaggggtagaaatatttttaaatttatgattctaccatgtgagacagatttcagctttaagaagaaatctggaaattggg

SEQ ID NO: 6821213 - DNA, 58 bp, Homo sapiens
cccaaaggtgttggccttcagtgtgggaagggcctccaccctgactccccaccttggg

SEQ ID NO: 6821214 - DNA, 83 bp, Homo sapiens
gtgtctgcaggagcagagatggctggaaggggcctctgcacacggaagatggcttgttcagccgattcacctcctgaggatgc

SEQ ID NO: 6821215 - DNA, 111 bp, Homo sapiens
ccacctttataatatcctatttataaaccttatttatattgcatgtctaggtggggctagacattgctcggaaattagtgttaatagaaggagtaaaattatagattgtgg

SEQ ID NO: 6821216 - DNA, 79 bp, Homo sapiens
gcatacatacagaactttaggattttcacaggtaccttatgaggtagttgtagcctccttgaggttgtgcaaagtgtgt

SEQ ID NO: 6821217 - DNA, 71 bp, Homo sapiens
cacatgtaaaagggctttgtaaacttcaagtttctgtccaaatatgaatcgtgattagaggcctgcatgtg

SEQ ID NO: 6821218 - DNA, 129 bp, Homo sapiens
tgcatgagaaacgagcaatgtctgttattttctgaaaagctgccttccatgtgaggaagtgactaatttttcatttcacactataaagggcgtgaaaaggcaaaacagaagaaggctaagggttctgtg

SEQ ID NO: 6821219 - DNA, 130 bp, Homo sapiens
gaaaggccagcccagagcctcaccctcctccctctgtccctggcactgaccaggcactgactgccaggtttggctcactggtggatgctgggagggagggcaggcgggtggtggcaccggctggccggtc

SEQ ID NO: 6821220 - DNA, 60 bp, Homo sapiens
ggcagaggaatctgtctagacacaaggcgattgtcattccttgttccagatccttctgtc

SEQ ID NO: 6821221 - DNA, 65 bp, Homo sapiens
aagatgaaacagtaggcatgaattgcactgaaaatattgtttggttgcctttcctgtttcatctt

SEQ ID NO: 6821222 - DNA, 56 bp, Homo sapiens
gtctagaaaatgccgagggatgttctccacccttgtctataaatgcacttctagat

SEQ ID NO: 6821223 - DNA, 118 bp, Homo sapiens
gcctgaggccagggcttgggctctaggcctgcagggaagctggtgcgagctgtgctcagggacagatctgtgctgcagacgcagtagctctgagccaagaactgggccggcttcaggc

SEQ ID NO: 6821224 - DNA, 92 bp, Homo sapiens
cttgctttccatagtcctcagaatatcaagagtcatcttttcctcttaaaagtagcttagttgatatttcaaaagaggaaagagaaagggag

SEQ ID NO: 6821225 - DNA, 72 bp, Homo sapiens
ctgagggtcctggaggaataatctcctacccttaagtaagggggagggaggcagttcttctggggccagcag

SEQ ID NO: 6821226 - DNA, 68 bp, Homo sapiens
cacctttgaccttgcagcgcactcccaaacatgcaggtgtgcttgtcctgaggtttattttgggggtg

SEQ ID NO: 6821227 - DNA, 71 bp, Homo sapiens
gctctatgaggagctgttttaactgctgaatcttagcagtctataataatagtgcctaacacatagccagc

SEQ ID NO: 6821228 - DNA, 70 bp, Homo sapiens
caggttgttttggtggtacatgctggaagctatcattcgatgatcctgcagttctaccaaaatccacctg

SEQ ID NO: 6821229 - DNA, 69 bp, Homo sapiens
gcacattcatttcacacaacttccttgtctgagcttaaatctggaggaggtgtgaattctgggtgctgc

SEQ ID NO: 6821230 - DNA, 61 bp, Homo sapiens
gtggtgagagtaggtgtcctctttttcttgatcttaagaggaaagcattcatttttaccat

SEQ ID NO: 6821231 - DNA, 77 bp, Homo sapiens
tcaaaaacagaaagggagatggaatagattctgactttcttcagggaagcagatcaccactttgttactgtatttga

SEQ ID NO: 6821232 - DNA, 62 bp, Homo sapiens
aatgtattctgggaaaatgttaaatggatgcaacactataagattttccacagaaatatgtt

SEQ ID NO: 6821233 - DNA, 73 bp, Homo sapiens
gccaacgttgtagttctgagaagtccaggaaacactccagcctgaggctaccagataaattacagagttgtgc

SEQ ID NO: 6821234 - DNA, 55 bp, Homo sapiens
tctgggtgcataagtcccagcatgctgaagcagctctggggagctgctcccacga

SEQ ID NO: 6821235 - DNA, 110 bp, Homo sapiens
tcaaagaactggtgaaatgactcctaagtaagttgactttcagagaattggctgcttctcatgagggaaaatcaatttctgcttcttgttgtcatctgtttacaatttga

SEQ ID NO: 6821236 - DNA, 78 bp, Homo sapiens
caaggatgttgacacaaacagtgatgtagtaaaaataatttctacttactgagcactcacttttgttataggtccttg

SEQ ID NO: 6821237 - DNA, 107 bp, Homo sapiens
gctgaggcaggagaattgctttaaccctggaggcggaggttgcagtgagtcaagattgtgccactgcactctagcctgggcgacagagcgagactccgtctcatagc

SEQ ID NO: 6821238 - DNA, 66 bp, Homo sapiens
tctgtttctttgtagatattctttgcagcttatctgtaaagaagataaattttacaaagcaatgga

SEQ ID NO: 6821239 - DNA, 72 bp, Homo sapiens
tgagggaggtcagggtgcctgctggtggcaagatgatgttatccagtgttacggcttgaactatgtccctca

SEQ ID NO: 6821240 - DNA, 56 bp, Homo sapiens
tggaacatgcatatgtgggtcactggagaaatcctgagtgatctttcatgattcca

SEQ ID NO: 6821241 - DNA, 78 bp, Homo sapiens
aagggaacccaggaggtcctgacgttgttccctattttacttttgcctgaattacttcaggacaccctgtgcttcctt

SEQ ID NO: 6821242 - DNA, 58 bp, Homo sapiens
ccttgtttctctcccagataagctaaggttggcaggggctgaggggagtgaggcaggg

SEQ ID NO: 6821243 - DNA, 121 bp, Homo sapiens
aagttctagttaacgaagttttagcatgggtttgtgtgtagctactttgtgttcatgtcacattctactgcagccttatgaacagaagggggtatttacatttttatggtgactaggtctt

SEQ ID NO: 6821244 - DNA, 59 bp, Homo sapiens
gaggccagcccctcttgaaggcagtccttgaactctgccccaggtgggatggttgcctc

SEQ ID NO: 6821245 - DNA, 66 bp, Homo sapiens
ggaagatttgcccatgcacttttgagatccacagtcctcaggggtaaatctgggtgcaattcttcc

SEQ ID NO: 6821246 - DNA, 78 bp, Homo sapiens
gcgcgagcctctttcggctttccagtttgtctcggtcctttggaacgtggcaaacgtggaagccgagagggctctcgc

SEQ ID NO: 6821247 - DNA, 70 bp, Homo sapiens
ggctgctctgccttccagctgggaggaggccattgtatgggtgctggggacagagggaaggggagcagcc

SEQ ID NO: 6821248 - DNA, 56 bp, Homo sapiens
acgtgtaacttcaaatgggaagatcccttgtccttcctgagaatagagttgcatgt

SEQ ID NO: 6821249 - DNA, 70 bp, Homo sapiens
agggaaagtttacatgaagggttgacatttcacatttagcatgttgtttaatttttcatgagccaaccct

SEQ ID NO: 6821250 - DNA, 63 bp, Homo sapiens
caggtgcaagaaaggtaattgctggtacaaaatatgccattacctgttttacatgcacaactg

SEQ ID NO: 6821251 - DNA, 72 bp, Homo sapiens
aggaatttggaatttttcctgtgtgaaattagaagcccttggaggctggtgaaggagaaattcgggacacct

SEQ ID NO: 6821252 - DNA, 62 bp, Homo sapiens
gactgaaactgggcccagtctgagttgggcctagggcttagttcagggctcagtttgctgtc

SEQ ID NO: 6821253 - DNA, 59 bp, Homo sapiens
ggggtgacataatttattactggttaataaattctgactcaaagtaagtgtgtcacttc

SEQ ID NO: 6821254 - DNA, 58 bp, Homo sapiens
gcttgctgcaaccaaccctgacatttcaggttggaaagaaggcttggttgcagcaagc

SEQ ID NO: 6821255 - DNA, 85 bp, Homo sapiens
gggtgttgcattgcccttgtcaggcacgggttgggggcgctatcgggtgctactctgcctgcggtgggcgggacgtgttatatcc

SEQ ID NO: 6821256 - DNA, 82 bp, Homo sapiens
gatccctatgacttggtcattactgaaaaggcaacaaaattgaagactgtcttctcataattaggtaagtcagagatggatc

SEQ ID NO: 6821257 - DNA, 129 bp, Homo sapiens
cggacagagttccttctcaggcagccggccaaggacaccagaaattaagcaggggtctgtggctctgccgtctagctatgaccaaatttaaatttgtgctttttgccttgcctgccagtgaacctgctg

SEQ ID NO: 6821258 - DNA, 102 bp, Homo sapiens
cccaatgtcagcccaaagcccagcagtcaggccctcctgtgatctgcctggggcacccaggaaggggatggggcatgctgggatgggccatgatgtgttggg

SEQ ID NO: 6821259 - DNA, 76 bp, Homo sapiens
tgcctggagctgggggctcctcatggggccatgcaaagcgccctgtgtggaaggcaggaggcccaagtcccaggca

SEQ ID NO: 6821260 - DNA, 62 bp, Homo sapiens
agctcttctagccagcacatacttctatcatcctacaagtctggggtctggtagaacgagct

SEQ ID NO: 6821261 - DNA, 76 bp, Homo sapiens
gcttggatgtgcgatggaagcagacaggtaattccttccttgggggcaatgacctactgctttctgcataacgtgc

SEQ ID NO: 6821262 - DNA, 80 bp, Homo sapiens
cactggccctttaggctgaaaggagaggtgaaggacgtgagtctccctccctctctctttttgctgccaggggtttagtg

SEQ ID NO: 6821263 - DNA, 76 bp, Homo sapiens
gttgctgcccctgggtgagcagtggggccacagttaggtcccctctgcaaatagccaggctttccaaggcaggaac

SEQ ID NO: 6821264 - DNA, 70 bp, Homo sapiens
tatccatttgttcattcggtgttgggtagttacatgttaccatgcccgtcattttatgagtaggtttgta

SEQ ID NO: 6821265 - DNA, 65 bp, Homo sapiens
ggaggccaggtgggagtcatctcaccctgccaggtaacggggctggtgggcccgcgctggtctct

SEQ ID NO: 6821266 - DNA, 92 bp, Homo sapiens
atgtgctttctgcatggttatatactactagtgattttatcaaaacttctaaaatttaaattacgtggtaaaagatctgtaaaaggctgcat

SEQ ID NO: 6821267 - DNA, 70 bp, Homo sapiens
ggggatgaagcctgacttctcggtggttctcattcatgcatcattgggaagaaatgcttcacaagacccc

SEQ ID NO: 6821268 - DNA, 65 bp, Homo sapiens
agctattttgcagggccagggctatggaattttccccacttcctgtctctgccctacagaaagct

SEQ ID NO: 6821269 - DNA, 83 bp, Homo sapiens
tgtgcaagataaggaactaccactggctctgtgactttgagaagtcatttacatagctgcatgccagtgtcttcatctataca

SEQ ID NO: 6821270 - DNA, 62 bp, Homo sapiens
gctgagatctgttcctgtagagtccaagtcttagatggaggcttgagctggaacagcttggt

SEQ ID NO: 6821271 - DNA, 64 bp, Homo sapiens
ttggcctttgctgggctgttgagaatgagggcaactttccctgtgaggacacccggctggccaa

SEQ ID NO: 6821272 - DNA, 122 bp, Homo sapiens
atctcacacccaaactctttagctaactttctctactccttcatattttaattgaaggcttccctgatcaagtgatactttaggaagatctgaaggaagaaatagttaacagtttgggagat

SEQ ID NO: 6821273 - DNA, 61 bp, Homo sapiens
tgcgggagagcgactggcttctagggccctgtccagcctgagaagtccccactctgtcgca

SEQ ID NO: 6821274 - DNA, 75 bp, Homo sapiens
attacattacattagtgaagcaatattggcacttcattattaatgaagtacatgctttattcagagttctgtagt

SEQ ID NO: 6821275 - DNA, 64 bp, Homo sapiens
gagttctggagaatagaagtcttaaatcaaggtgtggataggcttggcttattcttgggggctc

SEQ ID NO: 6821276 - DNA, 59 bp, Homo sapiens
agacaggccaaaattcaggcattctggggtcccacatgtgcttgttttggcccttgttt

SEQ ID NO: 6821277 - DNA, 64 bp, Homo sapiens
gagaaatgtatgtatgtacttttgtatgtatgcatacgtaatatacagcttatgcatatatctc

SEQ ID NO: 6821278 - DNA, 55 bp, Homo sapiens
gctagggctcttgtccttgctcaacctccaccagagaaggacgctagtccccagc

SEQ ID NO: 6821279 - DNA, 56 bp, Homo sapiens
gcttctcatccaccccagctagtctagtgactggagtgtttggaggatgcaggagc

SEQ ID NO: 6821280 - DNA, 96 bp, Homo sapiens
catgtgattttggtaggaagctgacagtgtgtaaaggatggtgggtgtttaggtatatgcacaggacactgcagcatcagctacggaaattagatg

SEQ ID NO: 6821281 - DNA, 84 bp, Homo sapiens
gtattaggttggtgcaaaagtaattgcagtttttgccattaaagtaggaccaaaatagcaattacatttgcaccaacctaatac

SEQ ID NO: 6821282 - DNA, 74 bp, Homo sapiens
tacatgaatcaaagaggccaaagaatctacaagatttttacaatagtgagattcatggcctttaaaaatatgta

SEQ ID NO: 6821283 - DNA, 81 bp, Homo sapiens
aggaaattttcattagtaaaggtatttgttccaggaagatggccatccctgaagacaacttttatcacctgagagactctt

SEQ ID NO: 6821284 - DNA, 83 bp, Homo sapiens
acagatcagcctgtatttccaaattaaaatgtacaatgaagtagctcatttagacatttgatttgggggaaggttgaaattgt

SEQ ID NO: 6821285 - DNA, 70 bp, Homo sapiens
agggcctggttctgtgtagggaaaatgagagcttttcccctctcttctcattccggcacatagctgtcct

SEQ ID NO: 6821286 - DNA, 79 bp, Homo sapiens
atttttgtatttttagtagaggtgggtttcaccatgttggccaggctggaccccttctcctattaaaataaccaaaaat

SEQ ID NO: 6821287 - DNA, 69 bp, Homo sapiens
ttcttcacagtcctggtcagtggaaagttctacatcagacagtccaacctccattgccatgatcaagga

SEQ ID NO: 6821288 - DNA, 68 bp, Homo sapiens
gctggagatgtaatcattctattgtcatccttttgttactttgatttggttccttctgcattttcagc

SEQ ID NO: 6821289 - DNA, 67 bp, Homo sapiens
atttaatagtgattgctcaaaaataggtattgagcccttactctctactagtcagtcattgatagat

SEQ ID NO: 6821290 - DNA, 68 bp, Homo sapiens
gcaggtgctctaggtatctactttttacgcccacacaggtacaaatggtagtacttaagattatctgc

SEQ ID NO: 6821291 - DNA, 75 bp, Homo sapiens
ggtggagcttcccagggccagttcagaggacatgggacagcaccgtggtctaaagcccaggtcctggactccacc

SEQ ID NO: 6821292 - DNA, 124 bp, Homo sapiens
gcatacagtatatactgtgtgtagagtatatactgcatacagtatatactgtgtgtagagtatatactgcatacagtatatactgtgtgtagagtatatactgcatacagtatatactgtgtgt

SEQ ID NO: 6821293 - DNA, 100 bp, Homo sapiens
aggtcacacagctagtaagtgtcagagctggaatttgaaccaaggcagcctggttccagagtctggttccatggttattcattgctgtgatttgctgcct

SEQ ID NO: 6821294 - DNA, 84 bp, Homo sapiens
gagtctggctctgacgcccaggctggagagcagtggctcgatctcggctcactgcaatctctgcctcttgggttcaagcgattc

SEQ ID NO: 6821295 - DNA, 63 bp, Homo sapiens
tgaggacaccaagccctgagaggtaaagtgattttcttaaggtcccagggccaggtgccatca

SEQ ID NO: 6821296 - DNA, 85 bp, Homo sapiens
cataaagccaacagggctggaggagatccagaggctgtggtctcatagcttcctaccaccctccccaagctagttggctcagatg

SEQ ID NO: 6821297 - DNA, 75 bp, Homo sapiens
atgctgcgtatcaacagggtggccagtgtatttttacatgtaagtacacaaaggcactctgttgttaccacgcat

SEQ ID NO: 6821298 - DNA, 84 bp, Homo sapiens
aatttatgaggttcctaatctccatatgttcagttatgcagtgaaatatgatttgtttgcattgcatagacatcctcatagatt

SEQ ID NO: 6821299 - DNA, 69 bp, Homo sapiens
gcagttttaaatacataggaatttcttcagcactgatataattgtcacttcttttgtgtttagggttgc

SEQ ID NO: 6821300 - DNA, 101 bp, Homo sapiens
tctcactgcatcatcaacatccccagcgtctcctaggagaacagaacatgcttctgtggccaaggttagcatggtgggggtggtgagagccttgtagggga

SEQ ID NO: 6821301 - DNA, 68 bp, Homo sapiens
tgtgctgcccagccataggaaaatgtttgggtttctcatatttcaaaatggctggagcctgcagtaca

SEQ ID NO: 6821302 - DNA, 58 bp, Homo sapiens
gctcataaatgttgactaccagaccagctggtgtttggcagttttcttttgtgccagc

SEQ ID NO: 6821303 - DNA, 92 bp, Homo sapiens
gcatataatagcaaaaatagtaataatagttgttaatatttatttagaactgccaattgttgacaatgcactgtgctaagtgctttatatgc

SEQ ID NO: 6821304 - DNA, 94 bp, Homo sapiens
aaatttgtttaattcaagaatgtaaagctcaggtcaggagattttattatagattcaagcttctagctttgtattttaaaaatttaataaattt

SEQ ID NO: 6821305 - DNA, 104 bp, Homo sapiens
gaggccactgacggctgcagataaggacatttctgactaatgcagccaagccctccatcctgcattcctcaaaatgtcttggcctgtgattctcaatgagcctc

SEQ ID NO: 6821306 - DNA, 59 bp, Homo sapiens
agaagggtgtatacatttcctggatgtgatccttacatatagaagtatgtgaccctttt

SEQ ID NO: 6821307 - DNA, 65 bp, Homo sapiens
ccagctatggctattcaaggtctctatctggttcaaggggccatgactctccataccaaagctgg

SEQ ID NO: 6821308 - DNA, 130 bp, Homo sapiens
cagaaaagaattgagaaagtttgagttttaatcttactacatcaggaaaaaactggagccagaatatcttagttcttgcattttcttgaggtagagaattctttgtaatttttttttcttatttccattg

SEQ ID NO: 6821309 - DNA, 61 bp, Homo sapiens
agtcaaatatcttaaaaggctaaagtgaaattgtcatctcgtttgtttctgatatttgact

SEQ ID NO: 6821310 - DNA, 85 bp, Homo sapiens
cagcctgcgaggctcctcattcagtatgctgtgttgtgtggttagctgttccatagtcatactgaaagtggcttctcagatgctg

SEQ ID NO: 6821311 - DNA, 96 bp, Homo sapiens
tctgggttttttgcaggcctataagtagcattggaacttcagcaaacaattgaagttgtagagcaacttagtgtaaatggcttagcattgcttgga

SEQ ID NO: 6821312 - DNA, 97 bp, Homo sapiens
agataaaggatagagtccagagaattttagacaaaaatcactctgttaattctattatggtaatatttaagtctgaattcctggtttgacttttgct

SEQ ID NO: 6821313 - DNA, 56 bp, Homo sapiens
ggagggctgccacccgctcacggcgttgggactgtggttggggtctgcagccatcc

SEQ ID NO: 6821314 - DNA, 70 bp, Homo sapiens
tcttgtagttgcagaatattctggtgacaatgccatttacagggcagttattaagaaaattttgccagga

SEQ ID NO: 6821315 - DNA, 69 bp, Homo sapiens
cctctgccgggcagccaaagggccgcagtttgtcgtgcgactgcaggtgcctcttgagcttgtaagagg

SEQ ID NO: 6821316 - DNA, 97 bp, Homo sapiens
aggcaggagaatcacttgaacctgggaggtggaggttgcattgatctgagattatgccactgctctccatcctaggtgacagagtgagaccctgtct

SEQ ID NO: 6821317 - DNA, 77 bp, Homo sapiens
ctagactttcagtgtcgggctactctcagcagctgagccctgggacaagggacgggggtggtcatctgaaggtctgg

SEQ ID NO: 6821318 - DNA, 65 bp, Homo sapiens
ggctgagatagatgccagtccataagagtctttaccaagttatctcttttgtaactatttcagcc

SEQ ID NO: 6821319 - DNA, 70 bp, Homo sapiens
ggagaattaaaatagttttggtcgaggccatgatgttctcggtaacctaaattaatttataaaattcttt

SEQ ID NO: 6821320 - DNA, 124 bp, Homo sapiens
actctaccatttttgctgcatctactagaaaatgtctatggaatttccacacaaccataagggatgggttgaaattccagagaagaaacatagctaatacatacagatcccttcttggcagagt

SEQ ID NO: 6821321 - DNA, 58 bp, Homo sapiens
acagctgacaagagtccttggaggatttcccgaagaattccatggaccctgtcagtgt

SEQ ID NO: 6821322 - DNA, 60 bp, Homo sapiens
ctacacttgttcgactgcaggaaaaccctacaggttgctgggctgcagtgggggaggtag

SEQ ID NO: 6821323 - DNA, 55 bp, Homo sapiens
aggaatgttaggagatgagtctagagattatgctcagattattcctaagatttct

SEQ ID NO: 6821324 - DNA, 57 bp, Homo sapiens
tgcaggtgattctgatgcagtttccagtttgagaaccactgctgtagaccatctgca

SEQ ID NO: 6821325 - DNA, 101 bp, Homo sapiens
gaggaagtcacatttcttgtgtgcctgctcttgagacttacaactgccactgtcgttgtgtctcctctctgggtggcagggaatactgaagaaatttcctt

SEQ ID NO: 6821326 - DNA, 55 bp, Homo sapiens
gagctgagcagggagcctcactgtgagaaggtgaactgaggagtcctgatcagtc

SEQ ID NO: 6821327 - DNA, 59 bp, Homo sapiens
ggctgccttcatagaccatgggagaggtgaccatggtttgaagtaggatgggggcagtc

SEQ ID NO: 6821328 - DNA, 72 bp, Homo sapiens
agctcttctagcataaactcttctgtgcaatttagctgcaccgaggaaacgggagtttttctggaagggact

SEQ ID NO: 6821329 - DNA, 64 bp, Homo sapiens
ctctatggattgtctaactggacaggctgggaccccaaactcttccagctgcacaagcatgggg

SEQ ID NO: 6821330 - DNA, 130 bp, Homo sapiens
ggcggacctgggagggcggtttgcttttctttggagcgcgagacaggcctcccatccggagccccagctcgctgggggctcactcggctgggattggcctgattcccctcccctgcctgccctccacccc

SEQ ID NO: 6821331 - DNA, 89 bp, Homo sapiens
ctgaagatatgggcaacatgttgagcaagggctgctgttatattgagaagtgagctttagaattgttcagcaagtttcttcttgttcag

SEQ ID NO: 6821332 - DNA, 71 bp, Homo sapiens
tgttgaatcagaggctgtgaaaatcaagggcaaatatttatctaaagatgtcacaactttgaatttcaata

SEQ ID NO: 6821333 - DNA, 86 bp, Homo sapiens
ctgggcctcagtttcctcctctgtaaaatggagataatgtcccttatttcataggaatttaaagaggaacaaataagagagtctag

SEQ ID NO: 6821334 - DNA, 60 bp, Homo sapiens
cacaaatccaatttaattctggctcaaaaaagcaataagtgtttaaattggatttctgtg

SEQ ID NO: 6821335 - DNA, 88 bp, Homo sapiens
ctgaggtgggccctatattagttaagggtattcttttaaatttcacattctcagaaggagaaagaaatttttgattggcccagcttgg

SEQ ID NO: 6821336 - DNA, 62 bp, Homo sapiens
ggaaaacagtttaataagcatctttggacatacatctttatgcttacctctggctgttttcc

SEQ ID NO: 6821337 - DNA, 58 bp, Homo sapiens
gattgtctttattttatggctaacctaacccaaaagggaggcaaaagataagacaatt

SEQ ID NO: 6821338 - DNA, 55 bp, Homo sapiens
tagctttctccctgacgctttggacaagctgtcctgattcagcaggagaaatctg

SEQ ID NO: 6821339 - DNA, 64 bp, Homo sapiens
tgttattgggctttaattccagagaggaaaccaatgcccctctattctgagaagcccaataata

SEQ ID NO: 6821340 - DNA, 89 bp, Homo sapiens
gcagaattctttaggagactcagcattccctgggtcgaatggcttaggagaaccagagctgacccaaggattgaactctagaattctgc

SEQ ID NO: 6821341 - DNA, 60 bp, Homo sapiens
tcatctattgaaaatttgtatgtggctatgtgtgcctatgtatttaaatttcagtgatga

SEQ ID NO: 6821342 - DNA, 82 bp, Homo sapiens
tttcctggctttatctcttggtggatggctttatctcttagtcttcctaaaagcttcaagagaagagtgagtttctaggaaa

SEQ ID NO: 6821343 - DNA, 101 bp, Homo sapiens
cacatctctagcactggccctggtcactggtctcatccagcatctcatgatgggtgggcttggtcaggtccagtagccacgggctagtgtgcagaggggtg

SEQ ID NO: 6821344 - DNA, 69 bp, Homo sapiens
tctcctatttctctcacggttgcctgggtagtagggcatgccactggcaaatggagagaatgttagaga

SEQ ID NO: 6821345 - DNA, 61 bp, Homo sapiens
tgcgtgatgtttgtgtcacctgagttatgcctaggtctttcgtttgagataaatacatgta

SEQ ID NO: 6821346 - DNA, 78 bp, Homo sapiens
tcaagttgaaggaggtctgcattctacagttcagtgctaggatgaaatagaaaaacaggcttctatattggactttga

SEQ ID NO: 6821347 - DNA, 114 bp, Homo sapiens
tgggaacattcgtgggtgacacctgaggggcacagtaaagggtcccccaggtccgaaggcggcagggaccacaaggggtgcactccgggctctccacccacctccaccgtccca

SEQ ID NO: 6821348 - DNA, 83 bp, Homo sapiens
agaaacataagattctcagagagcttagtgtgctgcatgttaagttgcagacagacatgctagttttctttgaatcagtatct

SEQ ID NO: 6821349 - DNA, 69 bp, Homo sapiens
ttagcttttccatggattttgttactatcttttttctcgttactgggatatgtgtctgtggaaaactag

SEQ ID NO: 6821350 - DNA, 67 bp, Homo sapiens
ggtaagagcaggacgcagcacaccagtgacattggagctacactggcccagtgcttatgctctgacc

SEQ ID NO: 6821351 - DNA, 59 bp, Homo sapiens
tttgaacaagttgcccaactatggaggtagaaatagatattgataggcagcttgtcagg

SEQ ID NO: 6821352 - DNA, 63 bp, Homo sapiens
agatggaatatgctctttgggagaccaggttgagtgcccttccctcaggccttatctccatct

SEQ ID NO: 6821353 - DNA, 57 bp, Homo sapiens
acttctgctttgttttctgggaaaatcaactgagctctctctgagttgagcaggagt

SEQ ID NO: 6821354 - DNA, 109 bp, Homo sapiens
ttgatttagtgtgggatatttgtgcttttttatgaaaaaaattctcaagagcttttgagtaatcagtgaagcctgaacatttttgtcagctaaagtgccctgaaatcaa

SEQ ID NO: 6821355 - DNA, 80 bp, Homo sapiens
gatccttgggacagtgactatctgatttaaggggtccattgatagtggactcatatccatgaaggtacttctcaggggtt

SEQ ID NO: 6821356 - DNA, 130 bp, Homo sapiens
cctgagctcagtagttcaagaccagcctggacaacacagcaaaaccccatctctactaaaaatagaaaaatattagccaggtgtggtggtgcatgcctgtagtcctagcttcttgggaggctgattcagg

SEQ ID NO: 6821357 - DNA, 55 bp, Homo sapiens
ccatgctgggatgctccaagtgcatcctgggaatttggatgtgagcccggggtgg

SEQ ID NO: 6821358 - DNA, 61 bp, Homo sapiens
ctgtcaccagctacagactactgtgtagaagatacagaagcctgtatttctggcaggacag

SEQ ID NO: 6821359 - DNA, 67 bp, Homo sapiens
aaaatccattttagtacctcaagtatccattagttaatagctaatggatctgtgctgaatgcatttt

SEQ ID NO: 6821360 - DNA, 56 bp, Homo sapiens
ccggtttgccttgtgttacagttttgtgggtaattacccaaggcacagggcactgg

SEQ ID NO: 6821361 - DNA, 64 bp, Homo sapiens
caggcccattctaggcttgctaaaattaatccttgagcagcttgaaatattaggagatggcctg

SEQ ID NO: 6821362 - DNA, 63 bp, Homo sapiens
cccggtgtcttggacctggggctggcacagacagtgcccgggcccatgggctccagacctggg

SEQ ID NO: 6821363 - DNA, 114 bp, Homo sapiens
agagaagagaatgaagagaggcagccaagtactcactttgacagagaaatgaatcctggaaagggcttccgctggaaggtgagttcgctctgtttctctcatgctttcttttct

SEQ ID NO: 6821364 - DNA, 70 bp, Homo sapiens
gggaaatttcaaggggcattgtgagtaataggagttttcttctccttgcagcatcctttgctggtttccc

SEQ ID NO: 6821365 - DNA, 55 bp, Homo sapiens
acaggcttttttagaatgacatttggttcttaaagtctgtctacttaaagtctgt

SEQ ID NO: 6821366 - DNA, 82 bp, Homo sapiens
acacacctgtgctcctgtctgtctttggtccctttcagagttgagagatcaggagaaaagatagccaggttcagaagtgtgt

SEQ ID NO: 6821367 - DNA, 76 bp, Homo sapiens
ggcatcactgttttaaggattgagccatttttacacttggttttcaggaagtagaaaactcagtttcaagtgagcc

SEQ ID NO: 6821368 - DNA, 59 bp, Homo sapiens
agagcaggttgttgcacagtggggaccacaccaggatgccatcactgagccgcctctct

SEQ ID NO: 6821369 - DNA, 62 bp, Homo sapiens
gagtccctagtcgcatctgtggagaatgcagccattgagctgcggtcccagtgaagggtctc

SEQ ID NO: 6821370 - DNA, 82 bp, Homo sapiens
gctgctggccagggcagctgccagaggccatggcctggcgtgggcctggagcccctctggccagcctgccaggggccagggc

SEQ ID NO: 6821371 - DNA, 76 bp, Homo sapiens
ttgagaagctgtcgtgtgcaagtgacagaaatacctctgagcagagagtctagtccttgactgacatgtcttccag

SEQ ID NO: 6821372 - DNA, 85 bp, Homo sapiens
atcagtgagtcccattatatgacactgcttcctgagaaatcaacatttctagatgttttcaataaagcagtatgggagttctggt

SEQ ID NO: 6821373 - DNA, 64 bp, Homo sapiens
cagatctgggtaggctccgctgccggggagtccttccccagccagcaggacctctgagaagatg

SEQ ID NO: 6821374 - DNA, 75 bp, Homo sapiens
aaacgctgctcatgtcttggcttaggcacagacttccagggtctgggtcctggaacaggaggtgtgccggttttt

SEQ ID NO: 6821375 - DNA, 71 bp, Homo sapiens
tccctgttagctcacagagctttccccatgtgacttcagacatggttgacccatgtgagttagtgcagtga

SEQ ID NO: 6821376 - DNA, 62 bp, Homo sapiens
ctgaccagtgacccgaggcaagtccctgacttgctctaggcttcactgtcttcttttgtcag

SEQ ID NO: 6821377 - DNA, 65 bp, Homo sapiens
tatgtggaaatttatcaagatatacagttgagtgcactcatgtatgtgtgataaacttccatgta

SEQ ID NO: 6821378 - DNA, 72 bp, Homo sapiens
ctgttgctttggcaatgtcattttcaatcatacaggagtatgtgttgttgatcgtaacattgtagagcacag

SEQ ID NO: 6821379 - DNA, 55 bp, Homo sapiens
gctattcatggagcatgtactgtgtgccatacactgtgctgacccattgatatgc

SEQ ID NO: 6821380 - DNA, 87 bp, Homo sapiens
tctcatgctgtgactctctggagggaagcactttctgttgtctgaaagaaaacaaagcgcttctctttagagtgttacggtttgaga

SEQ ID NO: 6821381 - DNA, 63 bp, Homo sapiens
gaagcaagaagggcaaggaagtttgagcagggcacccatgacgcacaccacccttcatgcttc

SEQ ID NO: 6821382 - DNA, 61 bp, Homo sapiens
gtcctcttagccacttaattatactgacactctagcattaggacatgggggctgggggggc

SEQ ID NO: 6821383 - DNA, 71 bp, Homo sapiens
gggatcttgttaaaatgtaggtttgtaggtctgaggtaaggcctgagagtctgcatttctaacatgcttcc

SEQ ID NO: 6821384 - DNA, 87 bp, Homo sapiens
tgtcttctagctaaagtcagggcaaggcagagcgtcccccttaataggagtctggggatgtatttcccttccaggaaagagaggaca

SEQ ID NO: 6821385 - DNA, 59 bp, Homo sapiens
gcagagcccatgcaacaggcctagcgacacatttcgcaatgtcttatgcaagggtatgt

SEQ ID NO: 6821386 - DNA, 63 bp, Homo sapiens
caggagctggcagtggtagacatgggacaccatcctccatcccaactctctcctccagccctg

SEQ ID NO: 6821387 - DNA, 98 bp, Homo sapiens
tcaaatttcattttgcccaggaaatgaacttctgatttttgcagttagtaatttacaactaatcaaggttcttcttggggaatttgccatcaatttga

SEQ ID NO: 6821388 - DNA, 62 bp, Homo sapiens
gcttgctatcgtagctcccacagatgacgttgtcacctagggccaaaggctgtgatgcaggt

SEQ ID NO: 6821389 - DNA, 99 bp, Homo sapiens
gaaagatgaaggcataggacattgagtaagagcagagaagcccttaaaaaaaaggcaaggcttatattgctctattcacaactctcatgtctgtctttc

SEQ ID NO: 6821390 - DNA, 121 bp, Homo sapiens
tcaccagtggggctccaattatgccagggaaggggactctttttccctttctaggttctcatgatcatctcccaaggcacagaaagagtccctgtggccggcttaggatcagtcactggga

SEQ ID NO: 6821391 - DNA, 93 bp, Homo sapiens
gcagaagaaggtggttctgctgcggaatataattcattcgctacttcaggcactggattttgatctgcaaggtgtacagctaggttcttaagc

SEQ ID NO: 6821392 - DNA, 74 bp, Homo sapiens
gacacaaatttatctttcagttctagaagtcagaagcccaaactgggtctcactgggctgaaattaaaggtgtc

SEQ ID NO: 6821393 - DNA, 72 bp, Homo sapiens
ctgggatccaaaatttactgtagcatttcattgacttagagctagtgtgaccatagattttggattttctag

SEQ ID NO: 6821394 - DNA, 72 bp, Homo sapiens
aaggctgagtatttcttcatatgattactagtcatacaagttatcccttgcaggaatgccttttcatgcctt

SEQ ID NO: 6821395 - DNA, 111 bp, Homo sapiens
ggagacggggggcaggcagccacaggagtagggctggtggagaggggctatgcttctgtctccacttgagactggctctctgtggtgttgctcttctgctcctccatctct

SEQ ID NO: 6821396 - DNA, 57 bp, Homo sapiens
cccaggactcttcactgcagcctcattttaccagcctgaatgttgaggggtctaggg

SEQ ID NO: 6821397 - DNA, 59 bp, Homo sapiens
gcatatcttctgacatgatcaggttaaatagaagcctggcatataaatagaagatgtgc

SEQ ID NO: 6821398 - DNA, 75 bp, Homo sapiens
cacggacctggcctttcaggtacaccagggatgggcctctctccctcgtcttaggttctgccggaagccagggtg

SEQ ID NO: 6821399 - DNA, 105 bp, Homo sapiens
ttttgctccagcagggcacagttgcctctgccagagtagagaaggttaacaacagaactgggctttggctgggcaaagggaggtgtgtcggttagggagacaaga

SEQ ID NO: 6821400 - DNA, 61 bp, Homo sapiens
gccaggtctcataaatgcagctagccctcatccaagggcccaagtggccattgagcctggt

SEQ ID NO: 6821401 - DNA, 130 bp, Homo sapiens
aaaactgtatatatatattgttcttggataggaatagccaacatttattgaatgctttgtactatgtgctaggcactgtgctgatgtcttattgcctaatttaagatagtattttaaataattgtgtttt

SEQ ID NO: 6821402 - DNA, 72 bp, Homo sapiens
gaggggcctgccctcagctgccatgctccccagggacaggcggcggacagtggcagctgagtgcaccccctc

SEQ ID NO: 6821403 - DNA, 69 bp, Homo sapiens
tgtttttctgtttctttctgtctcttggttccttaagggctttgatgatcagggcagaagcagaaggca

SEQ ID NO: 6821404 - DNA, 67 bp, Homo sapiens
acctggaatatggtgcctccaatacctatggatcccaagcaggtatttacccacttttgttttaggt

SEQ ID NO: 6821405 - DNA, 67 bp, Homo sapiens
ctgacacatagcagctggcttaatccttcattcaaccaacatttattgagcacctactatgtgtcag

SEQ ID NO: 6821406 - DNA, 129 bp, Homo sapiens
catgtcctagtatgtaacgggagctcaataaacagcaggtcttgacaggtgtagcactgaaggtctacagaggtgctgctctggccaggaactgctgattattgagctcctattgtatgccaggacatg

SEQ ID NO: 6821407 - DNA, 58 bp, Homo sapiens
tagaaggcggactctccctctgctctgccttgggctgggtgggaggggctggcttcta

SEQ ID NO: 6821408 - DNA, 59 bp, Homo sapiens
caggtcagatttgactttatcaactaggcactgggttttatgaagacaaatccgacttg

SEQ ID NO: 6821409 - DNA, 77 bp, Homo sapiens
cctgctttgtccttaagcggtgtctactccagggagggctcaacccactctggacactggcatggggtcagagcagg

SEQ ID NO: 6821410 - DNA, 60 bp, Homo sapiens
tttacagttaagaaatgttaccggaaaggcctacagcatgtggcatctctcaattgtagg

SEQ ID NO: 6821411 - DNA, 107 bp, Homo sapiens
taattttcataatcttaaacatcatgtaggagtttgtttagtaaattagtagttattagcttatttgattagtaaacctgtacatgtttagaagattcagataatta

SEQ ID NO: 6821412 - DNA, 55 bp, Homo sapiens
tcctgagtgtttggccaggccaggtatgaaaggcacttaggctggatacctagga

SEQ ID NO: 6821413 - DNA, 64 bp, Homo sapiens
gccaggacagggagacgggagcccaggagcggaagagcagaggggcagcccgccctctcctggc

SEQ ID NO: 6821414 - DNA, 57 bp, Homo sapiens
tcttcctgcttggtgtgtctggcttagtgttcagccaggttcatacctttggggaga

SEQ ID NO: 6821415 - DNA, 57 bp, Homo sapiens
ggggctcagggtacagactctggagctacaccgcacctaactttgagtcctggcccc

SEQ ID NO: 6821416 - DNA, 62 bp, Homo sapiens
acctaactctgacattatctcttgtcaactgttttcctagtagacaggagagttaggtaggt

SEQ ID NO: 6821417 - DNA, 68 bp, Homo sapiens
tgttgcaatgaatcctcttgacagttatcctctgacccatggaactggagagaatgttcattgcagca

SEQ ID NO: 6821418 - DNA, 102 bp, Homo sapiens
cggctcctctgggcgactcttccagaacagtctgggactgagctccaccacagatcctgggtgtggctggttcacaggcttggactgcccagagcacagctg

SEQ ID NO: 6821419 - DNA, 96 bp, Homo sapiens
caataaattgtcagagctcggattcaaacccaggacagagctttgtggtctttagatccattgttctgtgttggtttattcagcaaatgtttattg

SEQ ID NO: 6821420 - DNA, 88 bp, Homo sapiens
catcagggagaattaagcctcttatttttaaactgtatttgccattgcaaaagcagttatctgggaggaatttaaaagcttcttggtg

SEQ ID NO: 6821421 - DNA, 130 bp, Homo sapiens
cccagagatttgatatttagaaagtagtgaatttagtttgtaagaaggcttacttttagatgctcaaatagatagctccgactaccttcacatagactaaggatttatttaatttgtttatttaatatgg

SEQ ID NO: 6821422 - DNA, 67 bp, Homo sapiens
gctccagcaagggtcttggggttgattgtcattggcttggcttgggtcacatgcccattactggagc

SEQ ID NO: 6821423 - DNA, 100 bp, Homo sapiens
ggtgaagtggagaagttgcatgtttcattggctttcttttgtgaaaattgattttcattttattttgacagaagaggccctaaaaatcttctttttcccc

SEQ ID NO: 6821424 - DNA, 62 bp, Homo sapiens
gctccgtggccggccccgggttgaagttggtaactgagcggcaactccggcgggcgcggagt

SEQ ID NO: 6821425 - DNA, 77 bp, Homo sapiens
gtagtaaataacttcctgggtttacgtattgggtctctgttgggactcagtgtaaagaactcagaattataaattgc

SEQ ID NO: 6821426 - DNA, 62 bp, Homo sapiens
ctgtggggaaggctggccagggagagagcctcaccccccaattctgccagctgatcccccag

SEQ ID NO: 6821427 - DNA, 77 bp, Homo sapiens
ccttcctgcttctggccttttatctcaggctgagaccacagccactgtgagaggaccagggagtaattcctggaggg

SEQ ID NO: 6821428 - DNA, 84 bp, Homo sapiens
ggtcagtggctgtagagctgggactgagctcagcccacccgatttctgggcttctctcccccagctccacattgcaccaccacc

SEQ ID NO: 6821429 - DNA, 61 bp, Homo sapiens
ggcctgacatttgcatcaacacagatgaactgtgaggatgtttttttaggtgaaataggcc

SEQ ID NO: 6821430 - DNA, 86 bp, Homo sapiens
tacctgcagcacagagagcagtgggggacaccctcctgtcccagcgttgagcaccctgttccccactggcttcgtgtagcagagtg

SEQ ID NO: 6821431 - DNA, 79 bp, Homo sapiens
aggaagtgtagcatagatagagatgaacataaaacaaggattttggttcttttgtaatgttttcttaatctcattttct

SEQ ID NO: 6821432 - DNA, 61 bp, Homo sapiens
tcccagggtcctcttctggaatccaactagagttcctaagggaggaggatccccagaggga

SEQ ID NO: 6821433 - DNA, 70 bp, Homo sapiens
ctgttttgagaagataggggaatactttgtcagcctcagcgtattggagtattgttcatcttcaagacag

SEQ ID NO: 6821434 - DNA, 62 bp, Homo sapiens
gatgcctggaagactcaatggcctgcctgaactgcagatagtgtccataagtgttcctattc

SEQ ID NO: 6821435 - DNA, 78 bp, Homo sapiens
cggtgatagattttcataacttgtagtagctggaaacaggactgggaaaagctatggcaaatctcctgtaggtcaccg

SEQ ID NO: 6821436 - DNA, 58 bp, Homo sapiens
ccatggacctaaatgggcttctagacctggtctttctaggagccatgtggtctgatgg

SEQ ID NO: 6821437 - DNA, 77 bp, Homo sapiens
agagattgttcaatgatgagaactggagtaatttaagagtaaacttctaagacttagttttatctagaacactttct

SEQ ID NO: 6821438 - DNA, 55 bp, Homo sapiens
aagggacttgtcattggatttaggacccacctggctaatccaggataagcccctt

SEQ ID NO: 6821439 - DNA, 92 bp, Homo sapiens
gccaacttataactgattatgtttgtagactttctttgtgttagtgtttcttacgggttatacttataaagcaagatctatgttgttatggc

SEQ ID NO: 6821440 - DNA, 100 bp, Homo sapiens
gatctggggtggagagttttgtagatgtctattaggtctgcttggtgcagagctgagttcagtttctggatatccttgttaactttctgtctcattgatc

SEQ ID NO: 6821441 - DNA, 90 bp, Homo sapiens
gtaagcactctagttttactgatacattgggaaatggagtagtagaataagagaccagtcatgcagtgtgtcagttgaaagagattttac

SEQ ID NO: 6821442 - DNA, 59 bp, Homo sapiens
taaccaggaaaaagatatgcatgtgctgtaagtccctaggtgcaagctttttcttgtta

SEQ ID NO: 6821443 - DNA, 66 bp, Homo sapiens
tgcttgctcgccgcctgctgacttccttactttgcacacggaaggggcaggaaccgcaagcgtgca

SEQ ID NO: 6821444 - DNA, 62 bp, Homo sapiens
cctgtaagtcctcccggaagaccagttcacagctcattggaagatcaaccaggattgacagg

SEQ ID NO: 6821445 - DNA, 78 bp, Homo sapiens
acttgtccaattcctctggttgcaaagcttgacctcagtagctgcttgtgattcagagaattctgaggcagtacaagt

SEQ ID NO: 6821446 - DNA, 60 bp, Homo sapiens
gattgaatcatatgaaattgtggatgtttaactgtttttgacctacaatgtgattcaatc

SEQ ID NO: 6821447 - DNA, 59 bp, Homo sapiens
gctgagctgggcctggacgggcagatctgagctccagactggccaagcccggctcctgc

SEQ ID NO: 6821448 - DNA, 86 bp, Homo sapiens
agggctggccatggcagccatgggagccaccagcgcaccttagctatagtgatgctgccttggctgaccaccaaagccagggtcct

SEQ ID NO: 6821449 - DNA, 123 bp, Homo sapiens
actctgtaaggttcagcaggaatacaaaacaagggaagaatcactgggatgtttatcttaactgagaaataatattttgttccttccacatgatttgttaagattgtatctgcccttaaatgt

SEQ ID NO: 6821450 - DNA, 84 bp, Homo sapiens
taaactcaatctggataaatagatacacttgcacataatgggaaaaaaatgtgtgtatagtgttgtttattgaggttttgttta

SEQ ID NO: 6821451 - DNA, 83 bp, Homo sapiens
gtagttttgagcgtgggtgctggagccaaactatctaattttgaatcctggctctaacatttacttacttgctgtatgactac

SEQ ID NO: 6821452 - DNA, 80 bp, Homo sapiens
ggctgtgtggtccagccctggtggagaggggcggagcggccactgctccaaccaccgccgccaccgccacactcgcagcc

SEQ ID NO: 6821453 - DNA, 68 bp, Homo sapiens
gccaccaaggccagggtggagtttggggagcaggcagcttcctgcagtctgcactctgcctgcctggc

SEQ ID NO: 6821454 - DNA, 56 bp, Homo sapiens
tgttcttcctggaagtggatttcctgttatctttagggaatctttgcaggaaaata

SEQ ID NO: 6821455 - DNA, 57 bp, Homo sapiens
gggtatgctgcatgctggggagctaggtcagagactcagacagtttgcagtgtgcct

SEQ ID NO: 6821456 - DNA, 65 bp, Homo sapiens
aacctccttcttctgtcctgctcagaacaatgagaaaaagccaaggtcaaaagcaaggccaggtt

SEQ ID NO: 6821457 - DNA, 58 bp, Homo sapiens
tcaagctacaggacacctctgctcagttttgtgcaagaggggagcatctgctggctga

SEQ ID NO: 6821458 - DNA, 65 bp, Homo sapiens
agtaatgctgttatgggtcaagcagttcttgaagtaggggaacatgaaacccaaacagaataact

SEQ ID NO: 6821459 - DNA, 56 bp, Homo sapiens
atagtagcattttctccatgtagttttagatatggagtatttatgatagttactat

SEQ ID NO: 6821460 - DNA, 67 bp, Homo sapiens
cacgaaggattggagcagctgccatggtgggcctggccagccaagaaagcagtgctccacactggtg

SEQ ID NO: 6821461 - DNA, 58 bp, Homo sapiens
cagacacacaccctggcctagcgctaagatggtgctaagacccctgggtgttgatctg

SEQ ID NO: 6821462 - DNA, 55 bp, Homo sapiens
gggcagaactagggcaaactgctgagagcatcaggaagcccattttagtctacct

SEQ ID NO: 6821463 - DNA, 77 bp, Homo sapiens
gcccttggtgccctccgtgccctcatctgcacttcatcctttgatagtttaatgccacggcagggaacagctggggc

SEQ ID NO: 6821464 - DNA, 69 bp, Homo sapiens
agctagcatatgaggcagggccacctcccttccagacctcgaggcctggagctcctgcccatcctggct

SEQ ID NO: 6821465 - DNA, 63 bp, Homo sapiens
ataagctttgtccttgaggagctcatagtccactaggagaaatgggccttgggacacaattat

SEQ ID NO: 6821466 - DNA, 94 bp, Homo sapiens
tccttcaccgctctgtctctggcagcagctggtaccttatgctgaggaaggattgggaatgaggctgccaagggcaagaaaaatgggagaaggg

SEQ ID NO: 6821467 - DNA, 67 bp, Homo sapiens
gttaagtagaaggcattttgggatagatcctaatagcatctcccctatacaggcttctttacatgac

SEQ ID NO: 6821468 - DNA, 63 bp, Homo sapiens
catatgtttagatgttgttttgtggtttgtttttcacaaattaccctcaacatctagatgatg

SEQ ID NO: 6821469 - DNA, 64 bp, Homo sapiens
tcctcacaagcatcctgtctcaggcacaatccatagactggctgtgacaagaatgcaggtagga

SEQ ID NO: 6821470 - DNA, 65 bp, Homo sapiens
gactgagtcaggattataatccccatgggcttcattatgtccagatttcatttctactcctagtc

SEQ ID NO: 6821471 - DNA, 70 bp, Homo sapiens
tccaccaccctgcctctattcactgaggcagtcacaaagactgtccatattcaaggggtaggggactgga

SEQ ID NO: 6821472 - DNA, 64 bp, Homo sapiens
tttgggagccactggttgcctctttctgttccctcttgcccagggacaagccacagctcccaga

SEQ ID NO: 6821473 - DNA, 129 bp, Homo sapiens
gctaagatagttatctcctataagttaataaattcatgtatgtaaatttcagtccttcatctacccagaatctattttgttgaagaggaatgagatatacacatgcttgtacatagttctactcatagc

SEQ ID NO: 6821474 - DNA, 63 bp, Homo sapiens
tagctttgaagaaagatgacaccacctttgatgaggtaggttaaatttctttatctaatgtta

SEQ ID NO: 6821475 - DNA, 61 bp, Homo sapiens
cagaaatgtacttctttagtcaatatgtagtttgctttatattaaatgaagaggtaatctg

SEQ ID NO: 6821476 - DNA, 76 bp, Homo sapiens
ggttcttctctgtagacctagaaggcagcatcagaaatgtgttgctggcttttgcaggtgttgctagagtagaatc

SEQ ID NO: 6821477 - DNA, 102 bp, Homo sapiens
gctattagcttgccactgtcctggatgctgagaggtaccaagcaagtacatttgagttgcttcttagtgccaagtactggactagggggaatagaaaatggc

SEQ ID NO: 6821478 - DNA, 55 bp, Homo sapiens
ttgagatggagtctcgctctgttgcccaggctggcatgtaatggctccatctcag

SEQ ID NO: 6821479 - DNA, 76 bp, Homo sapiens
gctgagaccagaacccagagggagcacagagcctgctaacaggcacctgatgactgcttccctgggcattcccagc

SEQ ID NO: 6821480 - DNA, 84 bp, Homo sapiens
tatattctgcattccacataaagcgataacaggaaaacataaaattccactaacttcattattatttgtgtgtgtgtaggtgtg

SEQ ID NO: 6821481 - DNA, 66 bp, Homo sapiens
tatgaggtccaggcttctttcaattctcaggtccaacaaactgaaagtacagccttcattctcatg

SEQ ID NO: 6821482 - DNA, 70 bp, Homo sapiens
ttcttctttccccctgtggtaccccttgttcagaaaagtttgctaaatgtctacaggaaggaaagaagaa

SEQ ID NO: 6821483 - DNA, 57 bp, Homo sapiens
aatctcagctggcttgtttgttcttgaggactttcaggggtcattccagttggggtt

SEQ ID NO: 6821484 - DNA, 59 bp, Homo sapiens
gccccattctgctgatgaggctaagtgaaccactcagcttcctacagctagaaacaggc

SEQ ID NO: 6821485 - DNA, 55 bp, Homo sapiens
cctgcttcctcacatgtaagcaacacactcaagtgtatttgcaaaggaagtatgg

SEQ ID NO: 6821486 - DNA, 106 bp, Homo sapiens
ctgaacgagggaagccgtgaagtgttgtgcagagttgaagacaggagagctgacttttagctgtcaccctgccaccaaatagctccatgagcttctcctctttgag

SEQ ID NO: 6821487 - DNA, 79 bp, Homo sapiens
aggtgtctaggcaatattagactttgtctttttaattttcatataaaaatttgaagtataagtaattgctttcaggcct

SEQ ID NO: 6821488 - DNA, 77 bp, Homo sapiens
cacacctggatcagagccctgagtcagttctggagaccaacatctctctgttcttattcagaggcctttcaggtgtg

SEQ ID NO: 6821489 - DNA, 60 bp, Homo sapiens
gacagctcgtacctgctttctcacctaaaaggggaagaaggctccaagtagagtttggtc

SEQ ID NO: 6821490 - DNA, 92 bp, Homo sapiens
ttgacattcagaatatttgttttcataatagtgcagtttgttggatttatatttcaatattttggttatgataatttttttgtatatgtgaa

SEQ ID NO: 6821491 - DNA, 80 bp, Homo sapiens
tccagaggctgcgctcatctcagggcaagggctgattgcagcctggcaggggcctgggagtgggcccagccgccactgga

SEQ ID NO: 6821492 - DNA, 126 bp, Homo sapiens
gcccctattgttcagcccatgtgcattttctgtccttgctaccctatttgctttgtttatcacccaactgagtaagcaccgggatggtcaaggaaggcagttgaatgccatctacagatagagggt

SEQ ID NO: 6821493 - DNA, 85 bp, Homo sapiens
gaagatatgcctatgaggcatactttgaattaaatatttcagaaggctgatgataggtacaaggtttttcgtaggaatgttcttt

SEQ ID NO: 6821494 - DNA, 80 bp, Homo sapiens
ggccgactgggggtccgggacggcgccgaggccgggccagctcccggctctgctggcagcccccgggccccgggtgggtc

SEQ ID NO: 6821495 - DNA, 61 bp, Homo sapiens
tgaaccccagggcttgagtcatccatgtgttcatgtttggttaacaggctctgtggttgca

SEQ ID NO: 6821496 - DNA, 81 bp, Homo sapiens
tgatgtcactgacttaatatatttctgctaagctcaacatatatgttgaactgtggccagtaattaatgttggtggtttca

SEQ ID NO: 6821497 - DNA, 62 bp, Homo sapiens
gtctcaggttcgagcctccttagggcaccccctttccgtccaccttagcctggaactgagac

SEQ ID NO: 6821498 - DNA, 93 bp, Homo sapiens
cttagcgtccttgagaagtgcagagtggttaagcaggaggttcaagtgacttggttcaatcccagctctgtcacttagtaggacttgctcaag

SEQ ID NO: 6821499 - DNA, 77 bp, Homo sapiens
tccctatcagttcctgtttgctcagctcccaaagaggacttaggtgccctctgaggaagcagcaggaagtgaaggga

SEQ ID NO: 6821500 - DNA, 71 bp, Homo sapiens
ttctgaaagctctgctggtcaaggctgggtccctgcctgtctgattggggaggcctggccagtcttcagga

SEQ ID NO: 6821501 - DNA, 55 bp, Homo sapiens
gaaggaagaggtgcttttaccaccacccaaggatgaaagcagtgatttctccttc

SEQ ID NO: 6821502 - DNA, 93 bp, Homo sapiens
actactataaaatattattagattcttaattgtaatcgcagtaagccttgcaacctcttatagttacagaattggggtaatgtggatattagt

SEQ ID NO: 6821503 - DNA, 66 bp, Homo sapiens
acacttctctttgaagaacaataccacacttgaaactttataaggtatgggctggttaggaagtgt

SEQ ID NO: 6821504 - DNA, 122 bp, Homo sapiens
ttgagacgattagagatcatggttattagataagcctcaggaggatgtttttcttgggttgctcacaagcattttgaaagagtcgtgttccaggtttgagatcccatgtttcttcctcttaa

SEQ ID NO: 6821505 - DNA, 105 bp, Homo sapiens
gctgccatcaatagtttctgtgattaatgctgttggagatactaagaccaagcagtgtctgtatcatccagggtcttaatctgtgaaagagcaaataaggcaagc

SEQ ID NO: 6821506 - DNA, 63 bp, Homo sapiens
gctggctttaatgtcatctttctcactccaaaaagagtaagagcagaataattcaagctcagc

SEQ ID NO: 6821507 - DNA, 62 bp, Homo sapiens
gccctttcaccttaagaacagggagttcaaattcttgacattcttagggctggacaaggggc

SEQ ID NO: 6821508 - DNA, 64 bp, Homo sapiens
agagaccttcctgactccagagctcaaatgcccaatgcaatcccaaggctctggcagggactct

SEQ ID NO: 6821509 - DNA, 55 bp, Homo sapiens
gaggctctctctctgctcgctggaacggcagctagaaaactgggaggagagcttc

SEQ ID NO: 6821510 - DNA, 72 bp, Homo sapiens
acctctaagctgattccactttttccacagagctgctccagggcggtgtggttggaggggggatcaggaggt

SEQ ID NO: 6821511 - DNA, 78 bp, Homo sapiens
atttaagggggcacttactctcagggcaagtgccgactctacatttacaccaccctgagagtgcgtgcctccttaaat

SEQ ID NO: 6821512 - DNA, 71 bp, Homo sapiens
tagtagtaaaaggtcttcctttgtttgagtaaacactctttgtctaagcagaagaggtcttgttgctgctg

SEQ ID NO: 6821513 - DNA, 66 bp, Homo sapiens
tcctgctttgtgtggtccctccagggatgcagagtccctttccctgacctgacccataagcaagga

SEQ ID NO: 6821514 - DNA, 84 bp, Homo sapiens
aggatagctgttggagagaacagtgtctgaaagcgttaagagaatatgccatgagaaaatgctcatttaagaattagttatcct

SEQ ID NO: 6821515 - DNA, 96 bp, Homo sapiens
gagctccctcactggcccaccaggcagctctgatttatgtctgatcctcttcagatgtccagcgtctggctgcctgtggcctggagggaccccctc

SEQ ID NO: 6821516 - DNA, 68 bp, Homo sapiens
gtaggtgaggtccaacacaatgggtgttactttttcagtgagcagcatctccatggatctgatgctac

SEQ ID NO: 6821517 - DNA, 71 bp, Homo sapiens
agccatgattatccaaatatgaaatcataaaatctctgtctttggagtgattctatattggaaaaggggct

SEQ ID NO: 6821518 - DNA, 78 bp, Homo sapiens
agaccaagtacatgctaggaattccagtcaattaatggttataatttacatgcaactaggaggttcttagcttggtct

SEQ ID NO: 6821519 - DNA, 70 bp, Homo sapiens
gtttttacagcagcaaaatactgcagaggcaaagttgatattgtggtagatttgctgtgggtgtaagaat

SEQ ID NO: 6821520 - DNA, 98 bp, Homo sapiens
tttaatttttttgtattggcagtgacattaaggattcttcaagatattcacttgagactacctgtgttattagaaaccattacagtcagaaaattaga

SEQ ID NO: 6821521 - DNA, 60 bp, Homo sapiens
gggctggttcctgctgggacggctggtttctgatccattcagcaccagtgggggcagccc

SEQ ID NO: 6821522 - DNA, 60 bp, Homo sapiens
ttgtcttctcactgtgtgtgcagctcctagtggagtatccaacatgtagtagagagagaa

SEQ ID NO: 6821523 - DNA, 72 bp, Homo sapiens
tctcataacttattgtggcttggccagttttaccttttaattctattgatctctgctttgtaagttgtgagg

SEQ ID NO: 6821524 - DNA, 62 bp, Homo sapiens
ttgttcacaggatatatgtgcagggttggggagctgcacccttgcaccctttcctgtgacaa

SEQ ID NO: 6821525 - DNA, 87 bp, Homo sapiens
gaaaagagtcagtggaccacggtgggcattggggggtggaaaatgccaactttctgggttaccatttgtggtttatttgctcttttt

SEQ ID NO: 6821526 - DNA, 56 bp, Homo sapiens
ccgctctgcactagtggtcatatgtccaaggtacgtgacagcatagagcagggagg

SEQ ID NO: 6821527 - DNA, 75 bp, Homo sapiens
ttaggaattgttttcacttgtggaagctgagaaacagagatattctgagactccataagttgaaagatgttctga

SEQ ID NO: 6821528 - DNA, 58 bp, Homo sapiens
accatgatactttgctcctttacttagtaatagctaagtttggggaaaatgttaaggt

SEQ ID NO: 6821529 - DNA, 76 bp, Homo sapiens
ggctaggggcaaaggggtagggtagggagcaaatccagagaaacatgccattttccctcctttcctcccctcagct

SEQ ID NO: 6821530 - DNA, 59 bp, Homo sapiens
gcaagcttttggagatcagttcatttgccccaaatgtctgagctgcacagaagtaatgc

SEQ ID NO: 6821531 - DNA, 58 bp, Homo sapiens
taggataggatggagacagaatttggtaacataaagcagtctttaattatccttcctg

SEQ ID NO: 6821532 - DNA, 70 bp, Homo sapiens
aggtaccagcagaatcagtgtctggtgagggcttcctggttcacagtcggtgacttcttgctgcgtgctt

SEQ ID NO: 6821533 - DNA, 80 bp, Homo sapiens
agagtgcagggctcagagcaaaagggcacagtggccccttcccagtctcagtgcccctcccctctgccctttgtcactct

SEQ ID NO: 6821534 - DNA, 59 bp, Homo sapiens
atgtctgcgaaggcaagggcatgtatagcttgaaaaatatcctttggtttccatgacat

SEQ ID NO: 6821535 - DNA, 64 bp, Homo sapiens
tggatatgctatacatatgacatcacacatgtaaggtgtgtatcacagtgaatggcatacacta

SEQ ID NO: 6821536 - DNA, 75 bp, Homo sapiens
cacaaatatattgccaatgagcttctataatcttgtcaacaatggcaattttttaagaagtttaggggatttgtg

SEQ ID NO: 6821537 - DNA, 56 bp, Homo sapiens
tccccaaagctttgtggtcagggtatccagagctgctcaccacacaactatgggga

SEQ ID NO: 6821538 - DNA, 129 bp, Homo sapiens
aggagggaaagcagtgtgaatgtagatggagattctggcaaaatcctggcttttaacctacaaagactgggaatgaagttatattttgtcctagactttttattctttatgttgaaatttccatatcct

SEQ ID NO: 6821539 - DNA, 71 bp, Homo sapiens
aaggaaaggagataataatcgcttgatggaagtgattacttcagtttcattagattattgttttttccctt

SEQ ID NO: 6821540 - DNA, 55 bp, Homo sapiens
cagaactgaactgtaaaattgaaaccagaaggttgcaaatttcagttagttcatg

SEQ ID NO: 6821541 - DNA, 77 bp, Homo sapiens
gaagtgaaaattgcattcttgtcttgatagagatgaaaatggatttctggtcatgaaatagatgtagttgtcacttt

SEQ ID NO: 6821542 - DNA, 65 bp, Homo sapiens
agatgcaatatatgtatgtgtactagcttctgtgtatggatgtgtacacatacacatattgaact

SEQ ID NO: 6821543 - DNA, 59 bp, Homo sapiens
tgtgctgcagccatgcttccgagatgagaatggtcacaggaaggcaatggtttggcaca

SEQ ID NO: 6821544 - DNA, 130 bp, Homo sapiens
tcagaaaaaaagccagtggctggatcacataaataaatttggaaagagatgaagctcaacaggtaggtgaggaccacgctatttcaggctatatttcttgtttattgtgcctcattggttttgttttaaa

SEQ ID NO: 6821545 - DNA, 65 bp, Homo sapiens
tttgtgcagatgtatatttgtgtagaatctttatttgtggtaatcacaggtaacatatgcacaaa

SEQ ID NO: 6821546 - DNA, 60 bp, Homo sapiens
acagctgtggggactcttgcccatggtttggtgtttgcagggttattctcggcatgctgt

SEQ ID NO: 6821547 - DNA, 58 bp, Homo sapiens
tgaaatctgagtttatgttcccccaacaaattggaggacacatttatttcagaattca

SEQ ID NO: 6821548 - DNA, 60 bp, Homo sapiens
tggtgttattagaacagtaatcatggtaataaaagccacttgcaatgttctagtaatcta

SEQ ID NO: 6821549 - DNA, 69 bp, Homo sapiens
attgaatttttgggtctctccgggcatctcatctggtcccagagccctagggggaaccgaggactcaat

SEQ ID NO: 6821550 - DNA, 69 bp, Homo sapiens
tagagtgacaggtcagtgaaagtgtttcaacttttagaaattgttgactttccaggacttgcatttctg

SEQ ID NO: 6821551 - DNA, 57 bp, Homo sapiens
ggtcagcctacttaatcttgctgatattccagtttttcatcaggaacaaggctgatc

SEQ ID NO: 6821552 - DNA, 56 bp, Homo sapiens
gctgatgtcccactgacagccagcatcaactgccaggtgtgagtgaagatatcagc

SEQ ID NO: 6821553 - DNA, 61 bp, Homo sapiens
tttttattggatgcataccatacatcagggactctttcaagtgctgggcatgcagtggaaa

SEQ ID NO: 6821554 - DNA, 60 bp, Homo sapiens
tctatgccaaagtcacagccctaataggcaaaatgtaggaactctgagactttggatgga

SEQ ID NO: 6821555 - DNA, 125 bp, Homo sapiens
agctgggcattgtggtgcacacctgtagtcccagctactctagaggctgaggcaggaggatcacttgagtccaggagtttaggctgcaatgggctatgattgtgccactgcactacagcctggct

SEQ ID NO: 6821556 - DNA, 72 bp, Homo sapiens
gccgccgccgctgtgcaatttagcagaaatccgacaggggccgcgtttgctgagcgcatccggcggccgggc

SEQ ID NO: 6821557 - DNA, 73 bp, Homo sapiens
tgggacctggagccagggaggcaaggccagcagagtgtctgctggaggagtttactgtggccccaagagcccg

SEQ ID NO: 6821558 - DNA, 77 bp, Homo sapiens
taggcaaatattgaatagctgcttgttgtatttgatgaatacagaatccaaatgagtactgctaattaatgcgccta

SEQ ID NO: 6821559 - DNA, 128 bp, Homo sapiens
gtggacaccttgacttcagacttctggccgccagaactgtaagagaataaatgtatgtgttgaaagtcacccagtttgtggtacttaggtttggcagcccctaggagactaagacagcaaggtgctat

SEQ ID NO: 6821560 - DNA, 63 bp, Homo sapiens
gttctggaaagcaagaaagagtgctattaattcattgcactaattttgaggactttccagagc

SEQ ID NO: 6821561 - DNA, 80 bp, Homo sapiens
ctctcagaagagcatttgcccaggctgtaggacgtttcccgatcagtgcagccccagggaagatgtgtgcttactggggg

SEQ ID NO: 6821562 - DNA, 76 bp, Homo sapiens
tttggctattactgaaaaggcaaagtagttgttgggacaaaaatcattctctactatttgtcctttataagccaga

SEQ ID NO: 6821563 - DNA, 57 bp, Homo sapiens
actgtctgtctgttgttgagaagcagtaatgcttaggatgctagcaggcatgagggt

SEQ ID NO: 6821564 - DNA, 66 bp, Homo sapiens
ttctaaatagaaaagatttcagctgccaagcgctactgaggtagagtgaagattttgtgtttagaa

SEQ ID NO: 6821565 - DNA, 55 bp, Homo sapiens
gatgacataacctaattacagtgatggagctttcattgtagggaaaattgttatc

SEQ ID NO: 6821566 - DNA, 66 bp, Homo sapiens
cagtaaggatgcacataactaggaaggaaattctccccttctgttttgttgttgttgttgttgctg

SEQ ID NO: 6821567 - DNA, 106 bp, Homo sapiens
gatagtttacctctttagcctgttttaacatttgtaagttgttcttagcctcacaaggttgtacaaagatgtttaaagcatttagcaaagttcctggaaaactgtt

SEQ ID NO: 6821568 - DNA, 80 bp, Homo sapiens
gcacttgagtccttgctttagaatctgcttctggggaaacccaaagtaaggcaattcctaaaatgcatcagaccctgtgt

SEQ ID NO: 6821569 - DNA, 58 bp, Homo sapiens
tgtcttgtaagcctcaagaaaatgcaatgttggtaataattggggtgaatgccagaca

SEQ ID NO: 6821570 - DNA, 74 bp, Homo sapiens
tagaactctgcttggaatttcttggacttggtctcatttacttggttcaacttttctaagtagtcagagtacta

SEQ ID NO: 6821571 - DNA, 75 bp, Homo sapiens
agtattgatgattctttacaatcttttggcactttgtttatgttctgcctttgaatgtgacgacatcaaaatatt

SEQ ID NO: 6821572 - DNA, 60 bp, Homo sapiens
ctttcctttcaaggagaatgatgacactggtgtgtcttcactgggctcctgagagggaag

SEQ ID NO: 6821573 - DNA, 80 bp, Homo sapiens
ctcccgtctcggccagtttcctggtggagggacaggcttagctaaggctttgctctccctccagccagctggggcaggag

SEQ ID NO: 6821574 - DNA, 77 bp, Homo sapiens
tgggggcctcctgcaggtggatgattctctccaaccctccaatgtaagaggctctgccgcctcaggtaggccctcca

SEQ ID NO: 6821575 - DNA, 68 bp, Homo sapiens
tttcttttgacttctatctagtaagaagcaggctgatgggcttctttctgggaagagttcagaagaaa

SEQ ID NO: 6821576 - DNA, 62 bp, Homo sapiens
gcagctgcagaccctcagtgcttttcctccacatatcctgccacagagggtctgccgtctgc

SEQ ID NO: 6821577 - DNA, 55 bp, Homo sapiens
agctgcattttccttttaatcacagcttacctccaggcagagggaaaatgcggtt

SEQ ID NO: 6821578 - DNA, 95 bp, Homo sapiens
ctgagcaggcttccctccctcctgcatggaagcagtttggctccagggatggggctggccagctgacagcagggctgggagggaagagggtgagg

SEQ ID NO: 6821579 - DNA, 60 bp, Homo sapiens
attgtcattggcttctatgtctatggcttcctaagagtgataaataaagccatgcacaat

SEQ ID NO: 6821580 - DNA, 89 bp, Homo sapiens
gcctcctcctcagccaggtcctcgtcgtgctgggccagctgccggttcatggcaatggcctcagccgcgaaggacgtgaggtctttggc

SEQ ID NO: 6821581 - DNA, 86 bp, Homo sapiens
gagtgaggagaatggggcaggaaatgggataagggctgggtagtcctgagccagcaatcctctttttgttaattctttcctttctc

SEQ ID NO: 6821582 - DNA, 72 bp, Homo sapiens
tatggaaaacagaagtaaggaacagaaacagctggatgggttctagcttggcgtttgccttctttgaacatg

SEQ ID NO: 6821583 - DNA, 78 bp, Homo sapiens
aggtaaagctggacaggtcccaggtcccagcacatctgtcccccttggcagctggcatacctgggcccggctctacct

SEQ ID NO: 6821584 - DNA, 92 bp, Homo sapiens
actctctcacgctcacatgcaccttcagtttttcccttgctgtccccccatatgggaggaagagaagatgtctccagaagtgtgagcagagt

SEQ ID NO: 6821585 - DNA, 76 bp, Homo sapiens
gggctgtagtctcagatttctgaaagccctctctacacaattttgtgagaaacacagaggtctggagttgctatcc

SEQ ID NO: 6821586 - DNA, 58 bp, Homo sapiens
ctccgctggccaggcccagggcaggataacgcttcctggcctcctgtggcgggtgggg

SEQ ID NO: 6821587 - DNA, 62 bp, Homo sapiens
agtataggtacagcagatattcttagtgagcatgttctgtaagaataacgttgtactaggct

SEQ ID NO: 6821588 - DNA, 80 bp, Homo sapiens
cagagccaacaacttttggtcatagattgcgaacattttcaaaatgattctggtgtttgtgacacagataaaggcttctg

SEQ ID NO: 6821589 - DNA, 58 bp, Homo sapiens
gatggctgccttctccctgtgtccacacatggtggagattgggagaaagcaagctctc

SEQ ID NO: 6821590 - DNA, 120 bp, Homo sapiens
ttcttcacttcctttactttctaaatctttgatgagcatgcaatatttgataatcaaagggagaaaaaatttgtaaatatccatggttaacagagagaaacaagaggatccagaaaagaa

SEQ ID NO: 6821591 - DNA, 62 bp, Homo sapiens
tgagttacttgagaactaagccagggaccacatctcctccaaattattcttaaagtagctta

SEQ ID NO: 6821592 - DNA, 72 bp, Homo sapiens
gccataggcaggagtatgcagctatggtttagctatcctgtggcagccatgtatattgttgcagtctttggt

SEQ ID NO: 6821593 - DNA, 66 bp, Homo sapiens
agcagggaccagggccagatccatcttcgagtctgtcagaacaatgggcaagtcttgttccctgct

SEQ ID NO: 6821594 - DNA, 61 bp, Homo sapiens
gtccattccttgcctctgggcctggttgctcttaatccatctgccaggtagctcagtggac

SEQ ID NO: 6821595 - DNA, 72 bp, Homo sapiens
aggcatgtatgtatgatcatacatatttatggtaccctagaaatgtctgttagtcatatcatgtcagcgcct

SEQ ID NO: 6821596 - DNA, 91 bp, Homo sapiens
gccaggatggtctagatctcctcaccttgtgatccgcccaccttggcctcccaaagtgctgggattacaggggtgagccactgtgcctggc

SEQ ID NO: 6821597 - DNA, 102 bp, Homo sapiens
gtcttggagacacagaacacattggaggggcagaaagcaggaggtggcaggtgataggcctcctattgctgccattttccaatgtaaatctttgctcgagac

SEQ ID NO: 6821598 - DNA, 98 bp, Homo sapiens
gggcaggtgcgcatgttgcattagtgtcataaggtggcatgagactgtaccaggccattagtcctgattctgatccagcagcatcactgccttgctcc

SEQ ID NO: 6821599 - DNA, 65 bp, Homo sapiens
agctggtccacttttgtatcttccagagtgcccagaactgggttgtacacacaggtggatgggct

SEQ ID NO: 6821600 - DNA, 61 bp, Homo sapiens
gtgaaggtggggagcctcagttctgtgaatatcagcattgccgagcctactccatctccac

SEQ ID NO: 6821601 - DNA, 66 bp, Homo sapiens
gttctacacagaagccagaaggcctgggtctgaatcccagatctatctagctgtgtgaccttgagc

SEQ ID NO: 6821602 - DNA, 130 bp, Homo sapiens
aggggggctattcctggggttctgggcccagatgggcaaatgggtctgtaaggcagacttttccaggaggagggtgcagaccctttgcaagttgtttggggacagagcttagtttgcatctggccttctt

SEQ ID NO: 6821603 - DNA, 64 bp, Homo sapiens
tttctgccaggtttctggatgagtcttggtaccatttgcatcaactagatcctgactccagaaa

SEQ ID NO: 6821604 - DNA, 59 bp, Homo sapiens
gggggagggtggcgcaaggagaggacacctctctcctggccctgtcgccatcttccctc

SEQ ID NO: 6821605 - DNA, 130 bp, Homo sapiens
gatctcatttatccatttttgccttggctgcttgtgctttgggggtattattcaagaaatctttgcccagatcaatttcctggagagttttcccaaagttcttcttctagtagtttcatggtttgaggtc

SEQ ID NO: 6821606 - DNA, 60 bp, Homo sapiens
ggtaagattaccctctccatttgactgatgaggaaactggctcagagagggtaattaacc

SEQ ID NO: 6821607 - DNA, 61 bp, Homo sapiens
gcctctgaaccaccaatttgctactttgctgccagtttgcagttgaatggtcagacaaggc

SEQ ID NO: 6821608 - DNA, 60 bp, Homo sapiens
tctgcacccacgtaccttggctgaaccacagcggggcaagtgataaggggtgggtgcaga

SEQ ID NO: 6821609 - DNA, 69 bp, Homo sapiens
ctagatgctattatggcagtgtttttaatacccttgagttgaataatgatattgtgatgatgtctttgg

SEQ ID NO: 6821610 - DNA, 81 bp, Homo sapiens
ggacctgatgtgggccagcttttctcctgggtgtgtgactgaatccttcttcccagagcatgtgctgcctttgttaggtct

SEQ ID NO: 6821611 - DNA, 61 bp, Homo sapiens
atgtcttctgatgggacaaattggtgagcacaactattagctgagtgacatcaaaaggcat

SEQ ID NO: 6821612 - DNA, 79 bp, Homo sapiens
atgggtccaataaggagggtcatttccagaggaacacacatgtttctacatggaagagccttcttccacagctgcccat

SEQ ID NO: 6821613 - DNA, 81 bp, Homo sapiens
ttctaaaggcttgccaaaaattctgatatttgaacatgtgccattgtattagtcaggaccttttggtttcaagtaacagaa

SEQ ID NO: 6821614 - DNA, 80 bp, Homo sapiens
cagtttggagagaaacatctgtgggtggcaagagcaggctgtcactattgcaagccttccccagtgattctctcagcctg

SEQ ID NO: 6821615 - DNA, 87 bp, Homo sapiens
cagcttggacaacatggtgaaaccccgtctctactaaaaatacaaaaaattagccgggatggtggcttgcatctgtagtcacagctg

SEQ ID NO: 6821616 - DNA, 87 bp, Homo sapiens
actggccctaatacttcattcaagttcgctatagttttggcccctcaatcccagacatatgcataattggataagtagaagggaagt

SEQ ID NO: 6821617 - DNA, 83 bp, Homo sapiens
gagtatggttatcaaaggaagcaaaggtaacagttataaccaggggaccaactcctgaccttagtttccttgtgactgaactt

SEQ ID NO: 6821618 - DNA, 59 bp, Homo sapiens
caggaacacctgcagctagtggaacaaattatagggaatactggcttcagtcaaacctg

SEQ ID NO: 6821619 - DNA, 59 bp, Homo sapiens
ggggctgagggcagatggggtagctgggcagccttccacccctcagctcttcgtgcccc

SEQ ID NO: 6821620 - DNA, 67 bp, Homo sapiens
caggagatgacagggaagaaccaggaagcacctcctctcccagcctggggcttcccaccatctcctg

SEQ ID NO: 6821621 - DNA, 123 bp, Homo sapiens
gaggaggaggccttgatggtgcgcattcgagctgatcttttctgattccagtgggacctctctctgccaacctccactaggagtctcaaaaagactcagccctgcttcatccagactcccctc

SEQ ID NO: 6821622 - DNA, 72 bp, Homo sapiens
gttgctgcaaaagtaattggggcttttgccattgaaagtgatgacaaaaaccgcaattacttttgcaccaac

SEQ ID NO: 6821623 - DNA, 79 bp, Homo sapiens
tctaaacagcaaatttgaatgagaattattgtcattttgtcactgatgagcagaactaattttttttcactgttatgga

SEQ ID NO: 6821624 - DNA, 59 bp, Homo sapiens
tgtgtgtcaggtactgtgctagggactaagaatgtggccctaaacaagactgacacaca

SEQ ID NO: 6821625 - DNA, 58 bp, Homo sapiens
tgagccaagattgtgtccctgcactccagcctgggtgacagagtaagtctctggctca

SEQ ID NO: 6821626 - DNA, 107 bp, Homo sapiens
tagacgggtggcttaaacatagaaatttatttcttacaatgctgggtgctgggaagtccaaaataaaggtgtgggcagatctggtttctggtgaggcccactttctg

SEQ ID NO: 6821627 - DNA, 68 bp, Homo sapiens
gtggctatgatcccagttttggaatgttctaattatggctttgaatgttcctggtatatcatgaccac

SEQ ID NO: 6821628 - DNA, 100 bp, Homo sapiens
gggttcctcctgtaggggggcatggacttttcttccctttgtggctgctgtgcaaaggggacagagtccactggtgcccatcctgtacgggtgggagctc

SEQ ID NO: 6821629 - DNA, 61 bp, Homo sapiens
tagaatcaaagatgtttcagggtgtatcccacagggacatgcatctttagtcttatgtctg

SEQ ID NO: 6821630 - DNA, 68 bp, Homo sapiens
tgcaccctgacggtgggcagcttgagtgtctaaaccttcggccctcaggaggtctgctgcggggtgca

SEQ ID NO: 6821631 - DNA, 55 bp, Homo sapiens
gcgcctattttcattatcaaggccacattcctgggattccttggtgactaggcgc

SEQ ID NO: 6821632 - DNA, 76 bp, Homo sapiens
aggacaacctggagtgcgcttgtttcctcgtgtgacaaatggattctcatacaggctcaagctatacggttttctt

SEQ ID NO: 6821633 - DNA, 55 bp, Homo sapiens
ttcgcacctggacagtgaccctagcctggcagatcatggaggggccgggtgggaa

SEQ ID NO: 6821634 - DNA, 76 bp, Homo sapiens
ccaggtgaagagggcaagtcttggggtcaacagcaggtgtcagctgtggccatagctcagctccttcattgcctgg

SEQ ID NO: 6821635 - DNA, 125 bp, Homo sapiens
tggctaataaatgatttctattaggagcttgggaggtgggggatgtgtgaatgttctaagtacttgccattctgtgtctctccacagcccctaaacctgtctttcctagaatcacttgaaagtta

SEQ ID NO: 6821636 - DNA, 129 bp, Homo sapiens
gaatggtttttagaactgagtgagattacttaggaaataaatacttatggttaataaagggtaatgtgttctaatgagaagtaatttgtgcttgtttatttttactcttctatgttttaaaaagaattc

SEQ ID NO: 6821637 - DNA, 79 bp, Homo sapiens
taccgagacctgagaatgtttaacagagaaaataaagagcatattttaaattctcaagtaaaatactctctgattggta

SEQ ID NO: 6821638 - DNA, 63 bp, Homo sapiens
gcctggcaggcctgggccagcaatatctagaacacaggcctggctccaggagaagccagaagc

SEQ ID NO: 6821639 - DNA, 58 bp, Homo sapiens
gtagaggggtgattctgtgagactgataggcctgactattctcaattctccccactgc

SEQ ID NO: 6821640 - DNA, 74 bp, Homo sapiens
gggctccgagtggggcgtggatccagcgtcgctccagcaaccctggacaacagcctcataaacaggaggggccc

SEQ ID NO: 6821641 - DNA, 80 bp, Homo sapiens
tgccctgtgaagagttatgagaaggtggaggagcagtgaagggaatcctactttgaccaccatctgattaatctagggta

SEQ ID NO: 6821642 - DNA, 68 bp, Homo sapiens
tactagctgtgtggtttgggcaaattacaaaacctctctgtgccttaccctcacccataaaaatagtg

SEQ ID NO: 6821643 - DNA, 57 bp, Homo sapiens
tagtgcagggttttaagcactgagaaaatcaattccaaagtcttttaccctccatta

SEQ ID NO: 6821644 - DNA, 114 bp, Homo sapiens
tgaaaggcaatttatttaagtctggaagtttaggttgaagataagaattttgaaactgttcttactttatctcctagattccagtgttacttttaagaaatcagatgtctttca

SEQ ID NO: 6821645 - DNA, 105 bp, Homo sapiens
cagtctatgacacagctgaaactgaattcggaagttctaaggtgcattattctcatcaatgtaggtataatgcgtagaactcttggccacagaagccatagaatg

SEQ ID NO: 6821646 - DNA, 65 bp, Homo sapiens
tcagaatggttggggtgtgatgggcttctagtttctctagctgcatcacccttgaaccatccaga

SEQ ID NO: 6821647 - DNA, 57 bp, Homo sapiens
ccttggtctgataggccaggggtaatctcatttctctgggctgcttaaggatcaagg

SEQ ID NO: 6821648 - DNA, 78 bp, Homo sapiens
ctcacagatgagtgtttgtacccgtgcagatgtcattttctaccaacatgtgttaattccacaaacattcattatggg

SEQ ID NO: 6821649 - DNA, 87 bp, Homo sapiens
ttgaggtttataaagacaggtctactggcaagcagtggatagtttgttcatgtagctttgtggacctgagtacacttgtatcttcaa

SEQ ID NO: 6821650 - DNA, 93 bp, Homo sapiens
tttgatgggcctaaattcagttatatgtccacttccaaaccatttgctgtggccaagggaagagggcatgataattagcttgagccaatcaag

SEQ ID NO: 6821651 - DNA, 108 bp, Homo sapiens
atgtcctttaagactatccaagcctgtttagaaaatagtgaagcaagtatcaactacattgacttctgtcactttgttttctgagaacttgatacacttacttgacat

SEQ ID NO: 6821652 - DNA, 65 bp, Homo sapiens
tctcattgagagaatcacatagaagtgaccaagtcacctgtttatcattttcctcaaacatgaga

SEQ ID NO: 6821653 - DNA, 67 bp, Homo sapiens
ggaaattttgccatgtaagtcaatagtgtttaaactttaccctattattagacttatatggtagtct

SEQ ID NO: 6821654 - DNA, 120 bp, Homo sapiens
tctttaggtttaggaggagatactaagatactggatgtttatcctatcttagtttggttggagtaataagagagaagaagagggtggactttggcttttcagtgttttttcccctaaaga

SEQ ID NO: 6821655 - DNA, 95 bp, Homo sapiens
gcttaagagataggttggtgcaaaagtaattgaggtttttgccatcactttccatggcaaaaccgcaattacttttgcaccaacccaatacttgc

SEQ ID NO: 6821656 - DNA, 123 bp, Homo sapiens
tatcaaccctgatcccctggcagcatgtcccctgcagtcctttcttggctctaggtttggtggccaggacattgccaggcacttcaggacataagacaaagccaggagccatgggggaagata

SEQ ID NO: 6821657 - DNA, 79 bp, Homo sapiens
catagcattccactatgtagacatggcgtaatttgtccaaccataccgcaatgattgctatttacataaaaatgctgtg

SEQ ID NO: 6821658 - DNA, 80 bp, Homo sapiens
ggaggtgattgaaaggactgttttttcttctagggccctttgttggtaagagaagattgaaagagtccattgtttcctcc

SEQ ID NO: 6821659 - DNA, 56 bp, Homo sapiens
gggagtgtgcagaagctggggggtaaatgcaatcttgagaaattcagcacagttcc

SEQ ID NO: 6821660 - DNA, 68 bp, Homo sapiens
tacacatgtttggcaagtatgtccaggctcaaaaccttgaaaccaagcatgctgcaaaaccatatgta

SEQ ID NO: 6821661 - DNA, 64 bp, Homo sapiens
gctctgcatcataaaatttagagttgaagacagatgctgtaacttaaaaggattgatgctgggc

SEQ ID NO: 6821662 - DNA, 67 bp, Homo sapiens
gttgcagttcttgcagacaaatgtgttccagtcctttgctacacagagtggtttgtagaatagcagc

SEQ ID NO: 6821663 - DNA, 68 bp, Homo sapiens
gcgaatcttgaggtttcatgaggcaaatatgtattactttttagccttttgaaatctataggttgtgt

SEQ ID NO: 6821664 - DNA, 68 bp, Homo sapiens
gaaaaattatccaggaggaactcattttgcattaatgttgatataaagtgtaattctccaggattttc

SEQ ID NO: 6821665 - DNA, 84 bp, Homo sapiens
tacttacatacccagctggggaagtggggcatatggttctacatatcttattttatttctccaaaacatgctaagtggtaggta

SEQ ID NO: 6821666 - DNA, 67 bp, Homo sapiens
aagatgatgtgttagcttagtggatatttcctgttaacatattcattacagttaattacaacatctt

SEQ ID NO: 6821667 - DNA, 60 bp, Homo sapiens
taggggcaggtggcaaggcctggctgggccttccttcctggcctcagccacctggctctg

SEQ ID NO: 6821668 - DNA, 82 bp, Homo sapiens
gggtaagaggaagaaattgaattcatgagcttaaggcatgagcaatgaagccaggagctgaacaatatcttacttcataccc

SEQ ID NO: 6821669 - DNA, 68 bp, Homo sapiens
cttctatgaggagagacatgcacaggaacaaaagaataactcttcagcatttttctctcctataggag

SEQ ID NO: 6821670 - DNA, 111 bp, Homo sapiens
atgcatccctacattttcatgggcagcaaggtggcggaaatgagtaatgtagcaattgaatgggcagataattttttcggccatctgttgtgcatatgtctagcggatcat

SEQ ID NO: 6821671 - DNA, 128 bp, Homo sapiens
ccaggtccaaagcgtgggaactggagaaaggccactagtcactcagcactgacaaatatagtaaactcctgctgtctttgttagagtgtgggaggctggggaagggaggaggttgatacaggatgagg

SEQ ID NO: 6821672 - DNA, 76 bp, Homo sapiens
cttcagttatgggcaactgaaaaattgtattcatatgaattgtgcaatataaccagttgtcatgcaataattaaag

SEQ ID NO: 6821673 - DNA, 68 bp, Homo sapiens
ggcaatctccggccagacaggactcctttcctggtgagggacgaggagcctgtggcctggtattgatc

SEQ ID NO: 6821674 - DNA, 66 bp, Homo sapiens
gatccccttgagccagggagctggcagacactgagggtgctgccctgcctatgggtcgagggtttt

SEQ ID NO: 6821675 - DNA, 99 bp, Homo sapiens
aggaatttttaaaacattagttacagaatgtacagaggtttatggtttatttcccagatagcttgtgtttttctaagtatctgatttttatttatttct

SEQ ID NO: 6821676 - DNA, 85 bp, Homo sapiens
caatatttaacaatgaatatcatgaagtactagtgcaaccttataacttggacagtattatagagtttattgtttatgaaaattg

SEQ ID NO: 6821677 - DNA, 75 bp, Homo sapiens
cagagatgtgatccagctgtcttctccagtaccctaagaaagaagagaaaccccgccatctggatgattctcctg

SEQ ID NO: 6821678 - DNA, 57 bp, Homo sapiens
gtggccaaggtttattttgatacattggacaaagtgcagtcttctgagccttgctat

SEQ ID NO: 6821679 - DNA, 76 bp, Homo sapiens
tcatcctcttgttcagagttgcaacaacgctgtttcacacagcgtccttgcaagatctgtacaaggaataggatgg

SEQ ID NO: 6821680 - DNA, 57 bp, Homo sapiens
actgtaaagttacgatcaagttgtaaccacaattttgcccttgaagaattttgcagt

SEQ ID NO: 6821681 - DNA, 82 bp, Homo sapiens
tgcccacagtacgttttaaacacggagccagcatttttaaagtttagatttctggctcctgtttaaccagctgctgtgagta

SEQ ID NO: 6821682 - DNA, 98 bp, Homo sapiens
gagatggagtcttgctgtgtcaccaggctggagtgcagtggcgcgatcttgactcaatgcaacctccacctcccgggttcaagcaattctcctgcctc

SEQ ID NO: 6821683 - DNA, 102 bp, Homo sapiens
aggacatgaaagatggccaggctggctggagctcaggcccagcaaggccccctgggggccatggtcatgggtgagcttgggtttggcttctgttttcgtctt

SEQ ID NO: 6821684 - DNA, 124 bp, Homo sapiens
ggagcatttggtcaggtcatgggatgccaagcatgccttgcaaagcagtcttctgtgcctaaggctccttccttgcagaaacagagttttgccatgtccttattcctcactgctcataacctcc

SEQ ID NO: 6821685 - DNA, 84 bp, Homo sapiens
tttcctccatctctgcatcatttttcagagccggccagtttctatggcaacggttagattgaaagatgagcggcgagcaggaga

SEQ ID NO: 6821686 - DNA, 104 bp, Homo sapiens
gaaatctgttttccttccctgtctgtctccatctctgctgtgtctctgtggcttctgtgtctctttcacagtggatcctctgactccctcttattctggctttc

SEQ ID NO: 6821687 - DNA, 61 bp, Homo sapiens
aaggtcagagcaggaaggagtcccgtgagcataccatcctctcttacccacctctgacttt

SEQ ID NO: 6821688 - DNA, 56 bp, Homo sapiens
gggaacttgccccagaggaatttcccctgctggaatgttcctttaatgtagttccc

SEQ ID NO: 6821689 - DNA, 61 bp, Homo sapiens
tgccaggctctggcctactggagtccatgatacttttgtgtcatgcaggcagagtttggta

SEQ ID NO: 6821690 - DNA, 102 bp, Homo sapiens
tccagatactcttttgaaggattatgtaactaagtaatagcttaaaaggtaatagttaatatcttggcatgtattagttggcagttgttgaaaaggagagga

SEQ ID NO: 6821691 - DNA, 79 bp, Homo sapiens
cgccacttaatgaacctgtttgtggagagtccacctggtgcctgcctggctttaggaacccgcagcagtccgagtggtg

SEQ ID NO: 6821692 - DNA, 59 bp, Homo sapiens
ggctctgaggttcctttgccctcgccttgctgaatggtgagccgctgcctctcggagcc

SEQ ID NO: 6821693 - DNA, 71 bp, Homo sapiens
gtggcaaagcagagggtatggccaggtttggtttctaccccaacccatttgccatccctgttgtgtcccgc

SEQ ID NO: 6821694 - DNA, 55 bp, Homo sapiens
gccagcatccctggggttggccagagtccctgccagtgagccctgggatgtgggc

SEQ ID NO: 6821695 - DNA, 130 bp, Homo sapiens
agagtttttctttgtagagtctttgcaaggcttagtgcacttttccacatccatagcagataacgattttgctctgggcttggttagggctgttgaaggctcactgtttgacgatacggtgacagacttt

SEQ ID NO: 6821696 - DNA, 74 bp, Homo sapiens
gttgcagtgagcagagatcgcgtgattgcactccagtctcagtgacaagagtgaaactctgtctcaaaaacaac

SEQ ID NO: 6821697 - DNA, 68 bp, Homo sapiens
acttttagtgaatggtacatgtcttagtcttcgtgggcttacatgacagaataccattgactaggtgt

SEQ ID NO: 6821698 - DNA, 70 bp, Homo sapiens
aggatgtgagccagcctggcctgctcaccatggtgggcctaatatctagtgttaggcgtatttaggtcct

SEQ ID NO: 6821699 - DNA, 81 bp, Homo sapiens
ctgaacgaacattgtttctgaccatgatgagctttttatggatagtcaatgctcacaatgttggagaaacagatcgttcag

SEQ ID NO: 6821700 - DNA, 81 bp, Homo sapiens
agctgctttctgcatgctgtgccttctctgtgccagtctctgcttggcacagacagcacagcaatgaacaagggagtggct

SEQ ID NO: 6821701 - DNA, 65 bp, Homo sapiens
tcagtctcactgggtacatgagaaggttggaatcaacatgcttagttgcctcagtgggcacttga

SEQ ID NO: 6821702 - DNA, 56 bp, Homo sapiens
tgcatctcacacttgtatttccaaagaataaacaggctcagcaaaggtgaggtgca

SEQ ID NO: 6821703 - DNA, 56 bp, Homo sapiens
tggaggcccccaggcaacagcactgatcagctctctgctgctcctctgggcttcca

SEQ ID NO: 6821704 - DNA, 56 bp, Homo sapiens
ctgagagcacacactctgggaatgtaatccaccaccctctggctgtgtgttcttag

SEQ ID NO: 6821705 - DNA, 57 bp, Homo sapiens
tggcccatgtatgtgtcagggtttgcttagggacccccaaacatgatcatggtgcca

SEQ ID NO: 6821706 - DNA, 68 bp, Homo sapiens
gagaagggctggtctagaaagggagaggggaaattccgtctctcatccctgtctgccactctgaaatc

SEQ ID NO: 6821707 - DNA, 81 bp, Homo sapiens
agtagctcttctacagggatgaccagagggatgtgagtactgatttaagaccacttccagggtcccctgaaggaagactct

SEQ ID NO: 6821708 - DNA, 70 bp, Homo sapiens
gttctcaggcatagttggcttttttgatgaaaacaaaagcttgattaaattagcaaactgtgaaaagggc

SEQ ID NO: 6821709 - DNA, 61 bp, Homo sapiens
ggttcctgtgcctctagctggccgggccacaagcatttctccagctgctggcccagggacc

SEQ ID NO: 6821710 - DNA, 72 bp, Homo sapiens
gctgggtgcctgaggcccaaggactctgtcccgccatacacagggtgggacggggcagggcgggcattgagc

SEQ ID NO: 6821711 - DNA, 76 bp, Homo sapiens
gtggccggtctgcgttctgtctgccttgtctctggaaagaacgagagaacacaagacagaggctgaggctggccgc

SEQ ID NO: 6821712 - DNA, 96 bp, Homo sapiens
ctccaaggatggtgcttagcatatggtcagcactcagtaaatatctgttgaatgagtgcctgaacatagagtagctaagaaaaactatttttgaag

SEQ ID NO: 6821713 - DNA, 60 bp, Homo sapiens
ggagcaagaggtggtgaaaaatgtttatttactctgcattagtggctaacctcctgttcc

SEQ ID NO: 6821714 - DNA, 77 bp, Homo sapiens
ttcatggcttcatgggagtctgcaaatgactgacaagccttaaggttgcaggctggcagatatctcatgctactgag

SEQ ID NO: 6821715 - DNA, 80 bp, Homo sapiens
ctaagctgtcaagtctgcctaaccttcatgttctgtacaagtaggaggagaaggctaaggcagagttgtaaactgtttgg

SEQ ID NO: 6821716 - DNA, 116 bp, Homo sapiens
cagcttggactatagaatatgacagaaatgatcatgtaatttcagaagctgggtcataaaagaagatgtgacttctgtcctgttggatgaatcattcatgtttgcagcccgagctg

SEQ ID NO: 6821717 - DNA, 64 bp, Homo sapiens
ttggagtagatggttatggattagcaaattgtatagcttgttaagttctatgaatctactccaa

SEQ ID NO: 6821718 - DNA, 100 bp, Homo sapiens
gttaagagtatgcatactttagagctagattgcctgagttcaaataccagctctgctaattcctgggcaatctactgaagtattttgtgtatctgtttgc

SEQ ID NO: 6821719 - DNA, 110 bp, Homo sapiens
aaagatgactcaatatggtggtagatggggtaggagggagttgaagagtatgggctctacatgcttccaactgccccatcctaagctcctaccctattccttctatcttt

SEQ ID NO: 6821720 - DNA, 80 bp, Homo sapiens
tcaaggtgtcagcagggccatattgtgtgacggctctagagaagcctcttctagttctggtatttgctgacaattcttga

SEQ ID NO: 6821721 - DNA, 67 bp, Homo sapiens
gtgcctgccatcagaaacactcaaagccctctcgtttgggttttgaaatggactctggtggagatgc

SEQ ID NO: 6821722 - DNA, 96 bp, Homo sapiens
tcaaggaaatttcaggggtaagcagggtcattacagtggtatctccagttctatttcacagtgatgaatcctctatgccttttggggattctttgg

SEQ ID NO: 6821723 - DNA, 107 bp, Homo sapiens
ctggctccccacgtttgggcttcatttttgtctccggtttgtgctactctttcttcatccaaaaaggcgttggagatcccgagaatctgctgcagcttggaagccag

SEQ ID NO: 6821724 - DNA, 59 bp, Homo sapiens
ttctttaccctctctgcaccctttctgtaagggaaatttatgcagagagaggcaaagaa

SEQ ID NO: 6821725 - DNA, 79 bp, Homo sapiens
gcattgctgtccagacgagggcctggcacacagtgtgttcttgtaaatgctgtactcgggttctcatcctcacagctgc

SEQ ID NO: 6821726 - DNA, 123 bp, Homo sapiens
gtcacttagctaattaattccagggctggaacatgggctatctgtaaatttgaggttcttgctttaatgcaaaagaattatgcatcaggtgtgcaccatgttggttgaggaaaaagaagtggc

SEQ ID NO: 6821727 - DNA, 99 bp, Homo sapiens
ggcaatgaaagcttttaaggaggacacacagaatacaaatccacaggagtgaaacttaaaaggctctgcaggtctgtgactgccccctgctttcatgcc

SEQ ID NO: 6821728 - DNA, 68 bp, Homo sapiens
cagagcctggtgtggggctgcagaggagcctggctcaccaggcctctgctttccactgccagggtttg

SEQ ID NO: 6821729 - DNA, 59 bp, Homo sapiens
tgtggcctggagtttgatgtaggccagtggtgtctggctccttgcacctctaggccaca

SEQ ID NO: 6821730 - DNA, 70 bp, Homo sapiens
gggaatagttcagggttatttcaaggtcagattcacttcatgatcagaaacgttacctagggctgttcct

SEQ ID NO: 6821731 - DNA, 78 bp, Homo sapiens
tcgtgtgggaaatgggaggtctgagccgtggggggtgttctccagcccatggctcttaccttgttataatctcactga

SEQ ID NO: 6821732 - DNA, 70 bp, Homo sapiens
acgtgaaatcttgagaaacatctaatctttgtgttgaaagacagtaatattttacatgtttcttgcatgt

SEQ ID NO: 6821733 - DNA, 60 bp, Homo sapiens
ttcatcttctgtttcccagcttttcagatgcctgatagtcataggcaaatagaagaagaa

SEQ ID NO: 6821734 - DNA, 69 bp, Homo sapiens
ctaccagttctggctttacttcccatccagcagcacactggatattgaagaaagtcagtgaaatgttag

SEQ ID NO: 6821735 - DNA, 102 bp, Homo sapiens
aggaagggagacaggtgctagagtagagagagtcttagggctaattcaagtggtagattggccaggtccatttctccatctgggcctcagtttcctcatcct

SEQ ID NO: 6821736 - DNA, 88 bp, Homo sapiens
aagacgctgacccatgaatgccacgatttcatcctgcagttttctcaatgtgagtgactgtgcgcccttcatctgggtcaggcgtctt

SEQ ID NO: 6821737 - DNA, 67 bp, Homo sapiens
ttggcttcccagtttgaccattagactttggaaaaaattttctaaactagggttaaaggaaagccag

SEQ ID NO: 6821738 - DNA, 72 bp, Homo sapiens
aggcaggggaaggccatggccataggactacagcactttccgggcgcttttggccacccctttctctgcact

SEQ ID NO: 6821739 - DNA, 60 bp, Homo sapiens
cgaggacctgtgtcaacacgtcgccagcaccagccagcccggtttgcccacatgtccttg

SEQ ID NO: 6821740 - DNA, 67 bp, Homo sapiens
gagtgtgaacgctgctgctttctggtgctgtttcctgcaagccacaatctgcatcagcattcatctc

SEQ ID NO: 6821741 - DNA, 107 bp, Homo sapiens
tgttttcaaaaaagaaacatggaaagagcaagggctttgaggctggctgaaactggctcaaaccctggcctcagcagcttgttaactctatgacttttgggaaaaca

SEQ ID NO: 6821742 - DNA, 81 bp, Homo sapiens
gttttcagacaaaggctgcctaaaagctggggcccacattgtggctctgtggcattcatgggcagtattgtttttgaaggc

SEQ ID NO: 6821743 - DNA, 76 bp, Homo sapiens
atgtgtgtgtgtgcgcgtgtatatatgtatacatctatgtgtgtgtatatgtgtatatatgtgtgtgtatatatat

SEQ ID NO: 6821744 - DNA, 65 bp, Homo sapiens
ttgatttattgcactattgattttctagacttaagcaagtgatggagaaagtgtcaatgattcag

SEQ ID NO: 6821745 - DNA, 55 bp, Homo sapiens
ccatgtgcctctgagaagtgagcttccccagccaagcccacaggaggacatatgg

SEQ ID NO: 6821746 - DNA, 86 bp, Homo sapiens
tcgaggactctgtgggtggtagccatgggcaaatgcagagctgctgctgttgctttgcagtgcctgtaggacttagagggcctgga

SEQ ID NO: 6821747 - DNA, 57 bp, Homo sapiens
gtaatggagaataaatatgcttggattattaatctggagaatgtttgtctccgtggc

SEQ ID NO: 6821748 - DNA, 104 bp, Homo sapiens
ctccagaataaataagaaaatttccattgcagtaatccaggtaagacataatagggccttaacaaagaccattacacttggattgtaaagggatcaatatggag

SEQ ID NO: 6821749 - DNA, 92 bp, Homo sapiens
cagcaaatgtttagtgagaaatgtaggcataattattttactgaaatattttacaaagaaaaatgtgctacttttgtgctatttttgtgctg

SEQ ID NO: 6821750 - DNA, 95 bp, Homo sapiens
gccaggagtcgagggacataaacgttgctatttactgcaagagcttatcctgagcttggcctgcaggcagcagcgcatgtgccgattaaacccgc

SEQ ID NO: 6821751 - DNA, 81 bp, Homo sapiens
gatttatcaggcttcttctctgtgtccagcactgagtggaacagcatgcaaggcacacagggggtaagagccacagagatc

SEQ ID NO: 6821752 - DNA, 60 bp, Homo sapiens
gacaaattaatgaatggatgaatcaatggatcgatcagtcggtccaccagtcaatctgtc

SEQ ID NO: 6821753 - DNA, 62 bp, Homo sapiens
ttcagtttgctgaactaaaattctgaaggtctggttttcaggtgtgatgtctgcgaactgga

SEQ ID NO: 6821754 - DNA, 107 bp, Homo sapiens
gctgacaaaagtacagtcagagaaggatttacctccagctaggctgggtaggaattttctgcagctaggctgtaggtaaattactgtttggtgtactttgggccagc

SEQ ID NO: 6821755 - DNA, 66 bp, Homo sapiens
ccggcgcagcttcagggccaggagggcggccccgtgcacgtccccatgaacttgtggctgctccgg

SEQ ID NO: 6821756 - DNA, 56 bp, Homo sapiens
agccagtggaattcccaggggtttctcaaacatacctttgggacttatccatggct

SEQ ID NO: 6821757 - DNA, 100 bp, Homo sapiens
tcttagccaagttttacagttgttatatgtgggagtttccaagatcttaaaaggcagagaaagcatcctatatgtaaactgtgttttaaataggtgaaga

SEQ ID NO: 6821758 - DNA, 65 bp, Homo sapiens
tccagtagttggacaaatagattcggtctcacaagaggggaataatttgtgtattcaactaggga

SEQ ID NO: 6821759 - DNA, 130 bp, Homo sapiens
tcaaaaactctaattattttatagatattaaaggtgttgcaggaagcacaagtctgagaccagaatacctacttaggacttccttcctagcctacttatttttaaaccaccatttctgaaaaagcattga

SEQ ID NO: 6821760 - DNA, 63 bp, Homo sapiens
gttgaatgactccttcgtctgggtagctgcacaaggcagacagacctggcagtcatcctcaac

SEQ ID NO: 6821761 - DNA, 99 bp, Homo sapiens
cagcaaatgcaggcctctgcaggtggttttggctgacagcaatatctagcattggtgcacaggtggtccatctgcaccctgagaccctgcagtgtgctg

SEQ ID NO: 6821762 - DNA, 67 bp, Homo sapiens
tttggagctgtggctttctgtttctgtttttggtttaatctgtattgagagccacagcgtgcacaga

SEQ ID NO: 6821763 - DNA, 68 bp, Homo sapiens
gctgcacacatgtgggatccgcagggcattagagaaaccctgacccagtggcccagcatgtggtgagc

SEQ ID NO: 6821764 - DNA, 74 bp, Homo sapiens
ccaggtgctcccgctctgtcatagcactgatcagtgacaacttacaggaatgtagcagcgatggaattacctgg

SEQ ID NO: 6821765 - DNA, 81 bp, Homo sapiens
gtggggggaggagttaagagtgtgaaaatgttagttagctatagagtttgttagcatcaagtacctcgacttcatccttac

SEQ ID NO: 6821766 - DNA, 58 bp, Homo sapiens
gggagggggatgagccagggctgagccgtggcatcaggctgggctcctctccccaccc

SEQ ID NO: 6821767 - DNA, 76 bp, Homo sapiens
tgttccgtatgagaatcagacacatattatgagtcttaacatcatttcccgaagtgtgggtcatgattccagagca

SEQ ID NO: 6821768 - DNA, 79 bp, Homo sapiens
tcccattgagccactgaaagtaccagcaaatcctttgatgttgctgattctgtatttaaggtgatgtcttcatttggga

SEQ ID NO: 6821769 - DNA, 91 bp, Homo sapiens
tccgggacatcctatgtggatccttcctttactcatcactcacctgcagtgacccagagtaacagatggattctctaagggaagttttgga

SEQ ID NO: 6821770 - DNA, 59 bp, Homo sapiens
attggcatcctagtgagagatgctagtttttggaactgagcaatgcagtgggagcgaat

SEQ ID NO: 6821771 - DNA, 96 bp, Homo sapiens
tttaatcgtggccattttcaaacacagatctgcacagtgaacaattttctgaggaattcttacaaagcagagtctgttcagaggatgctgattaaa

SEQ ID NO: 6821772 - DNA, 64 bp, Homo sapiens
gattagaggtacaaaccttcacttccccacctccacttagggaaagaggtgtttgacttcagtc

SEQ ID NO: 6821773 - DNA, 86 bp, Homo sapiens
ttaatctctagcagcttctattttcttggtttataaaacatctgagctatttaaaaggaagtggagtgagctggcatagctattga

SEQ ID NO: 6821774 - DNA, 74 bp, Homo sapiens
tcttggcttccaggggcttttacagatacccccagtctggaggggaaactgtttctggctgactggggctagga

SEQ ID NO: 6821775 - DNA, 59 bp, Homo sapiens
catcaaagcttttttctgtgttgggcatatacccaacacacacagactcagcttggatg

SEQ ID NO: 6821776 - DNA, 88 bp, Homo sapiens
ctgctgaaaaaatacagaatgcaattctcttgatatagcttgaaaatagttttttaaaaaatatggaactattctgtgtagaaggtag

SEQ ID NO: 6821777 - DNA, 90 bp, Homo sapiens
ctgtctctgttctggattcttgaaatatgctgctaaagagaagaggcaaggcccctgccttgttggagcctatgtcctaggctgagacag

SEQ ID NO: 6821778 - DNA, 64 bp, Homo sapiens
ggggctcttagaagtacatttagaacatattttaagtttcaatgtgttcatagttctaaacccc

SEQ ID NO: 6821779 - DNA, 81 bp, Homo sapiens
cttttcagttctttcactcaagaaggatctgcaacttgaattcagcaggtttggtcttcagtggggcctggaagtggaagg

SEQ ID NO: 6821780 - DNA, 60 bp, Homo sapiens
gagagttattattatccccattttccaaatgaggaagctgggtgttaaaaaataattttc

SEQ ID NO: 6821781 - DNA, 82 bp, Homo sapiens
agtgccatggcactttacacccatttggctggtgaacattacaaagctgggtaatgccaagtgttggtggggctgtgggact

SEQ ID NO: 6821782 - DNA, 58 bp, Homo sapiens
attgcaaagcattgtgagcgcagtaaaagctactgaattgtacacagtactttacaat

SEQ ID NO: 6821783 - DNA, 71 bp, Homo sapiens
gtccatcactgcttgttttctaaaacatcatttatagaccgtaagagattcagcagaagacgggtaaggac

SEQ ID NO: 6821784 - DNA, 61 bp, Homo sapiens
ctgaatagctgaataatgcgtctgcagctttttacgtcactgcgcgtgcaacagctgttag

SEQ ID NO: 6821785 - DNA, 72 bp, Homo sapiens
ctttgtcttcagttactcccacctgaaagcccactgtacaaaacgtgcaggtggagctgactgagggcagag

SEQ ID NO: 6821786 - DNA, 71 bp, Homo sapiens
aacatgagatacttggtttctgtttctgcattggtttgcttaggagagtggattccagctgtatccatgtt

SEQ ID NO: 6821787 - DNA, 75 bp, Homo sapiens
ggaggggaggcaaagacagtgctgcatagacccccaccgaacaaaatgtgattgcttgcttatttgcccttctcc

SEQ ID NO: 6821788 - DNA, 89 bp, Homo sapiens
catcaatgggcctgcttaacaatgaaatgtatctagtttctgtgtttattatctgaaatcatgaacaaggtaggtgagtagccctggtg

SEQ ID NO: 6821789 - DNA, 66 bp, Homo sapiens
actagtgtccttatataagaggccccagagatctgctttgcccccttcatcatgtgaggacacagt

SEQ ID NO: 6821790 - DNA, 59 bp, Homo sapiens
tatgatccacagttgttcatattttcccatccggatgggacaattcaaagctggtcatg

SEQ ID NO: 6821791 - DNA, 68 bp, Homo sapiens
tcctggaggggagctctcagctgtctttgtatgctgcagcatacagtgcgggtgcgggcctcttagga

SEQ ID NO: 6821792 - DNA, 75 bp, Homo sapiens
aaatagtggactttgccattctgagatgagaagaatacttctatattgtagctgatgacaaatgtgccattcttt

SEQ ID NO: 6821793 - DNA, 57 bp, Homo sapiens
gccattggccatccacctgaaactgctcctctgcagaggccacctgtggccactggc

SEQ ID NO: 6821794 - DNA, 60 bp, Homo sapiens
gctgctgtcagtggtggcagttcctactctttctctcgaatctctactgctgacatcagc

SEQ ID NO: 6821795 - DNA, 57 bp, Homo sapiens
atgaacagaggcactaggagggaataagtatgggatcatctctgtgtctctgtttat

SEQ ID NO: 6821796 - DNA, 110 bp, Homo sapiens
gtaatgtgaagccaagggtagagagactgggctaagtattaataattattgtaaaagtgacatttattagatgcttactacatgccaggactctgctgacatttacatgc

SEQ ID NO: 6821797 - DNA, 108 bp, Homo sapiens
taggggcttgctgtaatgcagtcacttggtgaacacattatgtgcttctgggagataataagctacatcgatggtcagccgaggagatctgctccacagagaccccta

SEQ ID NO: 6821798 - DNA, 94 bp, Homo sapiens
ggctgctttagatttttatgtctctaagattcttggtctggtattgggtgggatgccagggcatgtccaagacttagaaaagatcaccatagtc

SEQ ID NO: 6821799 - DNA, 119 bp, Homo sapiens
tcatttaaaccatgtactttttagaatatgcatcatttgttcacttgattccaagaagattttgtgaatcataatcaggtaattaggttagcagagaactaatgtgcatggaaaaatga

SEQ ID NO: 6821800 - DNA, 84 bp, Homo sapiens
tcctttctcctgtgtaagccgcccagcactggaaaccacagggtatctgaccatggggcttgcagacctccaggggaccaggga

SEQ ID NO: 6821801 - DNA, 108 bp, Homo sapiens
gcagccagtgacaggtttaaggtgtctcctaaggctgaatatctctgcatcaaaaacttttgcaggcagtattcctcttggggctaacatcaccatgtcagtagctgt

SEQ ID NO: 6821802 - DNA, 89 bp, Homo sapiens
catcatattcttctgacaatagccatgccattttgtgttcccagggccaaggagaagacagaaacctgtttggcttgaggaatgttatg

SEQ ID NO: 6821803 - DNA, 62 bp, Homo sapiens
gcccaggcctcgcagccctcgctttcttcctaacaaagtggctgaggcatgcaggcctgggc

SEQ ID NO: 6821804 - DNA, 111 bp, Homo sapiens
ttagattaaggttagggttgaggaaggtgaatgttattagaggttgatctcattattaggagcttctcacctttggataatctttgtgtttctgccctggctctttcctag

SEQ ID NO: 6821805 - DNA, 129 bp, Homo sapiens
gcccggcggccctcaagctgggcacccaacagctgatccctaagagcctggctgtggccagcaaggcaaagaccccagcccgccaccagagcttcggggcggctgtacttagcagggaggccgcccggc

SEQ ID NO: 6821806 - DNA, 59 bp, Homo sapiens
actgcaggctcggaagtgctggctttgcctgacgcaagagttgagcaccgggtagcagt

SEQ ID NO: 6821807 - DNA, 65 bp, Homo sapiens
acaggcgctggggccaaggctaaataattcctctgtattcacatgccttcactcccagagtttgt

SEQ ID NO: 6821808 - DNA, 79 bp, Homo sapiens
tgagaccaagcagccaaatgaagattttacttatagataatctgtcctagtagacactgtatttgatgctttaggttca

SEQ ID NO: 6821809 - DNA, 78 bp, Homo sapiens
ctgttacaagaggaagcattgacataatctccattagagctctatataggggcttgtttcattgcaatctcttagcag

SEQ ID NO: 6821810 - DNA, 66 bp, Homo sapiens
ccctgtgtagtatttgtacacatatatcagctcctcagctttatttgttgcatatgttttatgggg

SEQ ID NO: 6821811 - DNA, 58 bp, Homo sapiens
tcatgcagcaatatgcattaggtgcctgtaatgtactagatgctattttagctgctgg

SEQ ID NO: 6821812 - DNA, 63 bp, Homo sapiens
ttgatgctaaattcattattgatttatcattcttcatggataccataatgagattggcctcag

SEQ ID NO: 6821813 - DNA, 55 bp, Homo sapiens
catggctgggtgcagtgatagtaggaagtgtgcctatgtgtctctgtgtagcctg

SEQ ID NO: 6821814 - DNA, 129 bp, Homo sapiens
ccacgacagccctgtttttcctgtgctgcgtagctgagctctgggtcacggctgccgagtgcaggcaacactcgggcagtcccagggctgaccgactgcgcatctggacactggcaatcacagggaagg

SEQ ID NO: 6821815 - DNA, 72 bp, Homo sapiens
tatccattcaaccttgggcaagttggaaactgaggcttagtttcctaactgcaccatagcaattgtgagata

SEQ ID NO: 6821816 - DNA, 61 bp, Homo sapiens
ttagctcaggcagtgccctctggccgtggcaggcactgcaatgggcacctgcttgagagga

SEQ ID NO: 6821817 - DNA, 91 bp, Homo sapiens
tatggttgccagacttaggcagggccagtgggttgaaaggcagtaatactttgctaggcaataattggtttaggggtgctggttagctgta

SEQ ID NO: 6821818 - DNA, 71 bp, Homo sapiens
cctctggtagtgtatcctccaatgacataaatttttcccttacactcacaggcagagaactcagccagagg

SEQ ID NO: 6821819 - DNA, 103 bp, Homo sapiens
tactcaccccttggagacctgtttgttatttataacagtgagaacgggggacctagtgcctccctcctggtgatgatgcaaatggtcaaggagatagtgagtg

SEQ ID NO: 6821820 - DNA, 97 bp, Homo sapiens
tgccaagtctgagggatatcatttctctgagtctgataatttctagatcagtaaacagtcagggcttactcagggagtttgaacctcatgggtggca

SEQ ID NO: 6821821 - DNA, 59 bp, Homo sapiens
ttcctcacaggagtgtttaccatctgaaataaatggaaaggagatactgaagtgaggaa

SEQ ID NO: 6821822 - DNA, 56 bp, Homo sapiens
gtctgaatagctctgtgaataccagtgggctgcaggggcacagaggttatacagac

SEQ ID NO: 6821823 - DNA, 58 bp, Homo sapiens
ggagaacagagcctgctattctcttggaatatctttcatcagcaggtgctgtttcttt

SEQ ID NO: 6821824 - DNA, 57 bp, Homo sapiens
taggtctggccccatgcagccatcgggtttcttcatcagctttggggcccaggcctg

SEQ ID NO: 6821825 - DNA, 102 bp, Homo sapiens
gaggcactcctgctctgtacaagggctggcttcttccctggatctaggggttgcccctgccttttagaagacagatgcacagccccagagcctagttgcctc

SEQ ID NO: 6821826 - DNA, 86 bp, Homo sapiens
gagggactaaagaacgttgaatggttaatttgtattcagtgctatccctgcatacagtcttcatattaagtttttgttgggacttt

SEQ ID NO: 6821827 - DNA, 61 bp, Homo sapiens
ccacctgctctaatggcttctcactgccacgaatgggctgacaggccagaagagcagctgg

SEQ ID NO: 6821828 - DNA, 88 bp, Homo sapiens
gatcccatcactcaaggaggagaaggatgtttccagttttcatttctgtaggtaagttatatccttctcctccttgagtgacatgatc

SEQ ID NO: 6821829 - DNA, 75 bp, Homo sapiens
gtcagttccttgtccttgtccttgtttgtccttccatgaagggacagtcacttccaggagaggacagaattggac

SEQ ID NO: 6821830 - DNA, 67 bp, Homo sapiens
gctgattttatttgaagcagaaggcacagactctcgtctggcagaagtgctgtcagtaagaagcagc

SEQ ID NO: 6821831 - DNA, 59 bp, Homo sapiens
cagcctcccctcaaaagtgagattttcctggaatgtcactagtcgcggggggaggtatg

SEQ ID NO: 6821832 - DNA, 89 bp, Homo sapiens
tttgctatctgcaaggagttgacattgtctgacaagtgaaatataatttttgtgaggctgtttttctctatttgcagtactattgcaaa

SEQ ID NO: 6821833 - DNA, 68 bp, Homo sapiens
cacaattgttctaggtcatccttattactcccatgttagagatgagaaggctcaggcttagagaggtg

SEQ ID NO: 6821834 - DNA, 63 bp, Homo sapiens
gggagcactaaggcagtcgcttcaagtcattattagtccagcagactcctgaactgtgctttt

SEQ ID NO: 6821835 - DNA, 86 bp, Homo sapiens
tagcaggactaaatcatctgccagtgccagagtacataaatctatctcaagctgtgacttttcacaggctggtccttttcctgctg

SEQ ID NO: 6821836 - DNA, 85 bp, Homo sapiens
gctgaccgtcggggacaccggcctggactgcgaggcgctgtgcggccaggccccgcagtgcgtgctggtcttcgacgtggtcagc

SEQ ID NO: 6821837 - DNA, 78 bp, Homo sapiens
tgttcagttccccctctgttgcacgtttgcaatttgccttaatgagaactgcccatgtgcatcaagtagaatcgagca

SEQ ID NO: 6821838 - DNA, 64 bp, Homo sapiens
ccttcttaatgtcctctttctgagctcttcaattagcatttgaggccaaaggatatttagaggg

SEQ ID NO: 6821839 - DNA, 66 bp, Homo sapiens
tatgtctggaagtgtacttgtcacttctgctcacaatacatgggcaaaacaagtcacatggacata

SEQ ID NO: 6821840 - DNA, 57 bp, Homo sapiens
ggtcagatagtgaatttgtgagccatatggtctctgtcacaagtactcatctctgcc

SEQ ID NO: 6821841 - DNA, 72 bp, Homo sapiens
ggctaggcagttttctcagtggggtacagatattaatttatttacagtgagccagagaagtctgctgtagct

SEQ ID NO: 6821842 - DNA, 62 bp, Homo sapiens
ttcttcatcacagtatttggcaggcattctcgaggtgtttgactgagttctttgatgaagga

SEQ ID NO: 6821843 - DNA, 62 bp, Homo sapiens
ctctacaacattccacaggcatgttctcctgataggaggcatgtgtgtttgtgtgtgtaggg

SEQ ID NO: 6821844 - DNA, 99 bp, Homo sapiens
ctgtgttgaaattaccttaccatttagggttatataccatagcatttatagatgaaatgacatgatggttgaacttaaagggaatgggtagggatatag

SEQ ID NO: 6821845 - DNA, 89 bp, Homo sapiens
ctgaaccctcaatgagtaaaggactccatgggtaagtcatattttgggtaacatattaacactttggagtctgctcaggggctgtttag

SEQ ID NO: 6821846 - DNA, 65 bp, Homo sapiens
tggtaacttgcaaggaatagggcagctttcttctgtggctaggtagctagtcctttaagttatta

SEQ ID NO: 6821847 - DNA, 83 bp, Homo sapiens
tagcccctccctctccccaggccccccttgctggtttgctgggagcaggggctacatgtgggggccccaggagctgggggctg

SEQ ID NO: 6821848 - DNA, 125 bp, Homo sapiens
tgtttgggcaggattgagagtgaacatctatctggtcagggtcagattccagagcctgtgttagaagattaaggactggtgtgtgatcagcattagtagatggatactctttcatactacatgca

SEQ ID NO: 6821849 - DNA, 61 bp, Homo sapiens
gtaggccagtgtgaaacctggtaggagccacagaacagtgtgaggttttacattggcctac

SEQ ID NO: 6821850 - DNA, 70 bp, Homo sapiens
ctaaattaaggaatctctggctggagctgaggattgcagcctcactacagtgtagagattaggagtttag

SEQ ID NO: 6821851 - DNA, 68 bp, Homo sapiens
ataaggttaacatcatcagtgataattcatgttgatagcatgtactccctgatatgatgtgatgttat

SEQ ID NO: 6821852 - DNA, 78 bp, Homo sapiens
gtttttcagacgatgttgcatttgtcagtggtttcttcctttctattactgaatagtgctgcattgtacagatagaac

SEQ ID NO: 6821853 - DNA, 65 bp, Homo sapiens
ccgctcaaggggtgctgttggaaacccagcttctgagggtgggtgtttaaaagaccctagagtgg

SEQ ID NO: 6821854 - DNA, 65 bp, Homo sapiens
caggctggctcaggtgtgagctgaagaggcaaaactgtctgtttaggttgcattgggttcccctg

SEQ ID NO: 6821855 - DNA, 72 bp, Homo sapiens
acagctcaggccattcctaccaagggaagaaaggctggcctctgtaacccctgtaggaaaggcctgctttgt

SEQ ID NO: 6821856 - DNA, 66 bp, Homo sapiens
ttgctagatccagaatggcttttcactcttagcgcttatctgtgaattcagtttgacatctagcag

SEQ ID NO: 6821857 - DNA, 91 bp, Homo sapiens
acatatagactttttgcactgtggaagtagatttgagaaggtaaagtcatttattaactcaacaaatatttactgagtgcctattatgtgt

SEQ ID NO: 6821858 - DNA, 105 bp, Homo sapiens
ttgacagttgtttagtgagtgcttactaagtgtttggcagtatcatgatcactgtatgtggtaaagttcacacgctagtagggagaagctaacaataacaatcaa

SEQ ID NO: 6821859 - DNA, 82 bp, Homo sapiens
aaggaagttgcagaatgcatggcagatgttgttagatttgtctagcaaagcccacgtgccaagcatgattgatgacattctt

SEQ ID NO: 6821860 - DNA, 66 bp, Homo sapiens
ttcttctaggatctgggatttttgacactgaagggtcctggctgccttaaatcctttctagaagaa

SEQ ID NO: 6821861 - DNA, 104 bp, Homo sapiens
gtgctttgagatagcacattttggctgcctagtgtctgagcagaaccacttttcctcctgggttgcctcaagctctggcgcttaagtggttaagttggaagcac

SEQ ID NO: 6821862 - DNA, 84 bp, Homo sapiens
cactgccccactggacccgtcgcccccctgggaggggccgccagttcggctggccctgtgggccatgtgtctacaggggttgtg

SEQ ID NO: 6821863 - DNA, 61 bp, Homo sapiens
atggtcaagatcctctagtttagaactttttgctaaactgctaagcgggtcttacaaccat

SEQ ID NO: 6821864 - DNA, 65 bp, Homo sapiens
gattattgacaaggcatgtgtcatccatgtaaccaagtctctgctgggacacacttgcagtagtc

SEQ ID NO: 6821865 - DNA, 78 bp, Homo sapiens
ctagatatctttttagtataactatgtgtttggtatataatatgtgtacatacacaaatatactgttttgagatctag

SEQ ID NO: 6821866 - DNA, 57 bp, Homo sapiens
tagcgcatcctaatgtcttcaggtcttacttactacagtgaagttagtggtgtgcta

SEQ ID NO: 6821867 - DNA, 55 bp, Homo sapiens
ctcctagaggatggtaggaagcttgatagcatccaagctgctaaattcttaggag

SEQ ID NO: 6821868 - DNA, 59 bp, Homo sapiens
tttgtctttagttgcgttatcttacttttccaaaaggggatctgtaagttgaagacaaa

SEQ ID NO: 6821869 - DNA, 69 bp, Homo sapiens
tcttgtgaaacaagatgtttcaggttcatcttatcctttctttgcctggaatcagccttttttccaagg

SEQ ID NO: 6821870 - DNA, 64 bp, Homo sapiens
agctctttctgtgtgtctcagcaagctgtgtccccagggtccagctcagcacataggaggtact

SEQ ID NO: 6821871 - DNA, 79 bp, Homo sapiens
ctctgctctgcatcactgtggcccaaaacctcaggtagagcgtcccctacctggaaacacgctagtgatgagagcaggg

SEQ ID NO: 6821872 - DNA, 82 bp, Homo sapiens
ggggaaagagagtgtagtggcattgacttcgtaattagggaaaaaaacctaaatatgaggatgtactaacacatatttctcc

SEQ ID NO: 6821873 - DNA, 56 bp, Homo sapiens
ttcctgcaggccatagagcctgccacaaaccaggtagattccattggcccagagaa

SEQ ID NO: 6821874 - DNA, 56 bp, Homo sapiens
tgggagctgagctaaaccccagcctctggataccagatggggatgcttccctccta

SEQ ID NO: 6821875 - DNA, 88 bp, Homo sapiens
tggtgagggagtccaggcccagggtgcggccctggctgggggaaagttcccgtgcagctcctgccctgaggatgggctgccctcgttg

SEQ ID NO: 6821876 - DNA, 86 bp, Homo sapiens
atggtgcagagagtgtggggtcttctcttggcctgggctgattgcctgttctctgtgcctaggcagaaacccccacacccaaccat

SEQ ID NO: 6821877 - DNA, 56 bp, Homo sapiens
gaatacatccagagcagggctgtccaatagaagtgcccatgatgatggaggtgttt

SEQ ID NO: 6821878 - DNA, 74 bp, Homo sapiens
agaagaaatagaaaagaaaatgaggcagtgccactctagttggtgatacatgacatttctttctgttctctttt

SEQ ID NO: 6821879 - DNA, 72 bp, Homo sapiens
gctttcactggaggtcagtggagcactggggttgcaatgataggacagtgccctgggccttccaggacaagc

SEQ ID NO: 6821880 - DNA, 63 bp, Homo sapiens
gtttccagaaaacgctttatttaggtgctctttgcattttgaatccgttcgttctttgggagc

SEQ ID NO: 6821881 - DNA, 122 bp, Homo sapiens
agtatcacctgggagcttgttagcaatgctctttcctgggttccctctcattctatggaatcagaaactgtaggggatgaggcccaggaatctgggtgttgtcagcctttccaagtgaaact

SEQ ID NO: 6821882 - DNA, 71 bp, Homo sapiens
gcctggcacagaggaaggctctgggaatgtttgggccggatggatctgggagcctcttttgcatgccaagc

SEQ ID NO: 6821883 - DNA, 87 bp, Homo sapiens
gttcctgccaagatcaagatacatattctgggtttctgcagttgaaggaggaattcctgcagccatcgcagagtctgtagtaggagc

SEQ ID NO: 6821884 - DNA, 81 bp, Homo sapiens
gataagagagcacagctgagagctggaaagtgattgacacctgacgctactgtcctagatccagctgtgctgaggcttatc

SEQ ID NO: 6821885 - DNA, 78 bp, Homo sapiens
tcatttagtcagtgcttcccattagaactgtgatgttctgaggatattaataggttatttggggagcattgggggtga

SEQ ID NO: 6821886 - DNA, 83 bp, Homo sapiens
ttatggtattcttttatgtgagacatgaaaattccaaacatcctgtacttactaaggttctgtctggcaaaggattaccatga

SEQ ID NO: 6821887 - DNA, 79 bp, Homo sapiens
actgaaagcacagggactttaggaatatgttacctaacctggcaacttaatcctttccctgctgcttctaaaagtcagt

SEQ ID NO: 6821888 - DNA, 72 bp, Homo sapiens
ccaagccctggtctggctagtttaggccaggcatgtttgcctggtaccaagcatgctgacctatggccatgg

SEQ ID NO: 6821889 - DNA, 98 bp, Homo sapiens
aggtgttcggtctattctgttcactgttgagttcctgatattaatgcagtgcctggcatgtatagagaccttagtagtaattatttgaatgaatacct

SEQ ID NO: 6821890 - DNA, 74 bp, Homo sapiens
cagaaaggctgctgatttctgatttcctacgttccacctgaaggttggcagtctcagtcagatggccctcgttg

SEQ ID NO: 6821891 - DNA, 103 bp, Homo sapiens
cctgaccaaagcctgctttgccagtgtgagtggagttcttggaataaaactctatgtggctccttactcatcagcaactgaagcagagatgaagcttttcagg

SEQ ID NO: 6821892 - DNA, 106 bp, Homo sapiens
aagtatttttacctctgagtcacatactatgtaatagagttatagacaggttaatgactatttcaatctgtgtaaagtgtgcaatgatcatgcctaaaagtcactt

SEQ ID NO: 6821893 - DNA, 83 bp, Homo sapiens
cttgttgaaaatacagattcctaggcagcacctaaatttggatacagctggtctggggcctgggaatctgcattgtcagcaag

SEQ ID NO: 6821894 - DNA, 96 bp, Homo sapiens
tcctaggcagatgtccctctagttgtttaatattgattgactacccacagtgggactcttagattaagcacacaaaatgggctctgccctttagga

SEQ ID NO: 6821895 - DNA, 88 bp, Homo sapiens
gacacgagaggtatgctacagtagagtaggcctctgaccaaactctttgtcacatccttactttatatgtggttctatttcaagtgtc

SEQ ID NO: 6821896 - DNA, 80 bp, Homo sapiens
gcacctggaggctgccagctgggaaccccctttaggcgacgtcagcgccgttggttctcagcctgagccgccccctgtgc

SEQ ID NO: 6821897 - DNA, 57 bp, Homo sapiens
ctctggagaacgctatggatctgtagagagtcccatagatttgtggagtgctctgag

SEQ ID NO: 6821898 - DNA, 56 bp, Homo sapiens
caaggagcctgtgggccaagaggctgaacacttagggaaatggcttgggtttcatg

SEQ ID NO: 6821899 - DNA, 55 bp, Homo sapiens
tctgttgtctgaactccctaaggtcaacgctcaagggctccgggcaggcgatgga

SEQ ID NO: 6821900 - DNA, 84 bp, Homo sapiens
gagccttactgtcttcagtggcaaatggatctgtcaacaggctccattgcctggggttgttgctgctgagattaagggaagctc

SEQ ID NO: 6821901 - DNA, 58 bp, Homo sapiens
acccaggctggagtgcagtggggccatcttggctcactgcaagctccaccctccgggt

SEQ ID NO: 6821902 - DNA, 91 bp, Homo sapiens
tctttcagtcattcactcattcagcaagaatttactgagcttatttagtgagaccagttcccttcttggctgacggaatgtcactgaaaga

SEQ ID NO: 6821903 - DNA, 90 bp, Homo sapiens
gggtctcccttttggtatctaatttcctgtatcctgatacaataagagtctttccttttggagttaggagacaggatgatgtcatcaccc

SEQ ID NO: 6821904 - DNA, 71 bp, Homo sapiens
tccccttggcccacatggaagcatcgaggaggcccagccccctcctgcctggccatttgggcacagggtga

SEQ ID NO: 6821905 - DNA, 100 bp, Homo sapiens
accaaatcagtgtggatgaactcagtgaaggtgtgagccagctgcatctcctgggctgcacggagacacatcctcagacttcaggatgcactgattcagt

SEQ ID NO: 6821906 - DNA, 58 bp, Homo sapiens
gcttgatctctgccctcatgtagctgacacactgaggcaactgagaccacagacaagt

SEQ ID NO: 6821907 - DNA, 67 bp, Homo sapiens
acaagattgataagtctgccctcgtggaatactgatttctggaaggagatgcaggcattaatcatgt

SEQ ID NO: 6821908 - DNA, 76 bp, Homo sapiens
caagagttgaaaagccagaggaacttgatgactgtaaatgcattagaatcatcttcttttgggtttagtatccttg

SEQ ID NO: 6821909 - DNA, 59 bp, Homo sapiens
gtgaagtctcatttgatgctctgaacagggaaagtttagagtgaaggttgacacttcac

SEQ ID NO: 6821910 - DNA, 93 bp, Homo sapiens
tattctttcagtggaccacagtttgatgatatctgcagtcccaagtgtaaatctaaaatcatagcatgtgagtctattccagttgaaatagta

SEQ ID NO: 6821911 - DNA, 61 bp, Homo sapiens
gcctgggtccaccctgtgaagtagaatccactgtcatctcctccacatggtcaccccatgc

SEQ ID NO: 6821912 - DNA, 82 bp, Homo sapiens
tgacatctatgacaaaattagctgcaaaggatgttatctaccttgatgatttccagttgttgctaagattatagatttatca

SEQ ID NO: 6821913 - DNA, 72 bp, Homo sapiens
gagggttagaggatggagatgaggaaaattagaaaccctcttgtctactcacatctctgttttctaaatctc

SEQ ID NO: 6821914 - DNA, 80 bp, Homo sapiens
gctagtgctggggacatagccagtctggctgatacccatatcagtacagaaagctgtcctcacccacttcatgcactagt

SEQ ID NO: 6821915 - DNA, 71 bp, Homo sapiens
agctagtgtttatggagtgcttacctgccagacactgttctaataagcattttatgtggattcactcagct

SEQ ID NO: 6821916 - DNA, 59 bp, Homo sapiens
tctcccatgaggctgcggtcaaatcaggactggattccaaactggagcctgatggagga

SEQ ID NO: 6821917 - DNA, 56 bp, Homo sapiens
gcaggtttcttcttgtcaataaacaagatatctttgttgtataagaatgtatctgt

SEQ ID NO: 6821918 - DNA, 99 bp, Homo sapiens
gctcacatggatgcagtcagatggcctgtatttgggccagagctagaacactgatgttccactataggctatcaaaagatgaagtgtaaatggatgggc

SEQ ID NO: 6821919 - DNA, 71 bp, Homo sapiens
ggtgcggggcctccccaggggtgtcatgagggaatgaagagaccccacggagcctggggaggctgcgctcc

SEQ ID NO: 6821920 - DNA, 73 bp, Homo sapiens
cagtttctttgtaagactgcctcttgcctattccctacagtctggcagggttgtcaatcaaaagaaaacactg

SEQ ID NO: 6821921 - DNA, 84 bp, Homo sapiens
gaagagtggcaggtaagaccagaacagtggtttgtatttcataagattgggatgctcacatttctgattataccaaagcttttc

SEQ ID NO: 6821922 - DNA, 73 bp, Homo sapiens
ccctgctggctctttcaaatttactaaatttataaccaaaggaaatttgggattgaggaggaggctggcatgg

SEQ ID NO: 6821923 - DNA, 84 bp, Homo sapiens
tacccagggaatcttggtaagctgacattgctttgaagagattgattccaagagcagccttaggtattgtgattccttgatgta

SEQ ID NO: 6821924 - DNA, 55 bp, Homo sapiens
agcaccctcagccttatccagattgtctgactctggagaaaggctaaagggtgct

SEQ ID NO: 6821925 - DNA, 61 bp, Homo sapiens
cttgctgtgtgagtgactgcatctcactgctttctagcgtgaggcgaagctgcaacagaag

SEQ ID NO: 6821926 - DNA, 108 bp, Homo sapiens
agctcatgagttaatgtgtcagcaatttaggctgggttcagctgggtgattcttctggtctcctctgggcccacttaaatctggcagttatctgacttatcatcagct

SEQ ID NO: 6821927 - DNA, 87 bp, Homo sapiens
atataccccaatgtctagatgactgggaccactaggtttcatatttcccagatgagattagttgtacagttcattttgcaggtttat

SEQ ID NO: 6821928 - DNA, 59 bp, Homo sapiens
acagttagggactataatcatttggaagcttctttactcatgtttagtgcctagtctgt

SEQ ID NO: 6821929 - DNA, 72 bp, Homo sapiens
ctcttcttggtatttggggaaatattttcctccccgtccattccaggaaatggctccaagtgccaaggacag

SEQ ID NO: 6821930 - DNA, 68 bp, Homo sapiens
agagaggtgaagagggcaaaaacttcccaaagtgtgaacatttcaggattatactctcttccctttct

SEQ ID NO: 6821931 - DNA, 58 bp, Homo sapiens
gattaggcttaatcacagaaagcagaagagctttcaggtgggccttttgagcataatt

SEQ ID NO: 6821932 - DNA, 62 bp, Homo sapiens
ttactatttcttgtgggaaatgcagcatcaccccagagatctgtagccatcaggaagagtag

SEQ ID NO: 6821933 - DNA, 76 bp, Homo sapiens
gatagtgttagaatcttatttttaaatcttccatagtgcagtcattaggagatttttgatgaggttttgatgagtc

SEQ ID NO: 6821934 - DNA, 85 bp, Homo sapiens
gggcatttgtgttctaatataatgtcctatgggaataaggtaagactactcctctataggaaattagaacttggaaactgagcct

SEQ ID NO: 6821935 - DNA, 84 bp, Homo sapiens
taactagaatggcatgggaaatgcagtggcctttaagaaatctggtttatgccactgtcttttccaggctgaaatttcttgtta

SEQ ID NO: 6821936 - DNA, 61 bp, Homo sapiens
tgaatagactggggctgtgaagtcattggcagaatgacattcaaagtttcaatctgtatca

SEQ ID NO: 6821937 - DNA, 58 bp, Homo sapiens
gcaggttagatttaatccattcctaacaggagctggaatctatagtctacaagcctgc

SEQ ID NO: 6821938 - DNA, 92 bp, Homo sapiens
gaacttttgaaaaatatgtatatctgtgtcccaaaccccaaaatcccagatttaattggtgtgggtgggacatcatctttttttaaaagctc

SEQ ID NO: 6821939 - DNA, 66 bp, Homo sapiens
ggagaagctgctgtgggcagggtagctggctaggcagccagcttctctgttccagcccctttgtcc

SEQ ID NO: 6821940 - DNA, 80 bp, Homo sapiens
ctagggattgattttcaattcattgacaatttaacaagttcttgctgttgtcttagaattggaagggacattccaactgg

SEQ ID NO: 6821941 - DNA, 60 bp, Homo sapiens
gtgccacctctgccccagagggtatatttaaaatcattcctcatgtcacagatcaggtac

SEQ ID NO: 6821942 - DNA, 81 bp, Homo sapiens
aggtaatgccttcgatcagagccctgatgacagactgtggagtgcaagttttttcaggtgctctgtttgctcagtaatcct

SEQ ID NO: 6821943 - DNA, 70 bp, Homo sapiens
caggagaagatgcccagccagtttagagaaagtggtcccaactcaaggctggctcggcttttctgtcctg

SEQ ID NO: 6821944 - DNA, 56 bp, Homo sapiens
ggtgattttcgagtttcatgtttcttcctgcctcggggctctgaccggaaatcatc

SEQ ID NO: 6821945 - DNA, 79 bp, Homo sapiens
gggtctgatttatacttcataatgtctatttggctgcaatgggtcaacagaattgaaggaggtatgagttaatgggcct

SEQ ID NO: 6821946 - DNA, 57 bp, Homo sapiens
ggcaggatgaagggcaaaggcaagactcaaggaaactctctgcccccttctgtcccc

SEQ ID NO: 6821947 - DNA, 62 bp, Homo sapiens
tccttcctagtgtctactttggaggctggctgggggctcacagaaatggcactggggtagga

SEQ ID NO: 6821948 - DNA, 56 bp, Homo sapiens
agaaagcacagcgggtccattttaaggatttttccaaatataccagctggctctct

SEQ ID NO: 6821949 - DNA, 79 bp, Homo sapiens
aagagagagatggaaatagatagtatcattcagcattcagaagcttgaagagtattaggttatttgaaactctgctttt

SEQ ID NO: 6821950 - DNA, 117 bp, Homo sapiens
gggggctgagcagagcacccttctctgctgggccagccttgggatgatttatcagcagaaaactggatggatctgtttgttcaagggcccagggaagacaggctttggggagccccc

SEQ ID NO: 6821951 - DNA, 78 bp, Homo sapiens
ctggcccttctaaccatacacattgtttccgggaggctaaatataacccctcaggcagtggtatggatgggtggccag

SEQ ID NO: 6821952 - DNA, 55 bp, Homo sapiens
ccagctttcatatcatgaggtaaccctagggagaggcctacatgagtaagcttgg

SEQ ID NO: 6821953 - DNA, 123 bp, Homo sapiens
gtgtgctgggcccagcagagtagttcttctagactaggctgggctccctcatgtgtctgcagtcagctgccaagtcactggaagcctgaatagtctaagataacctcagctgggatggcacat

SEQ ID NO: 6821954 - DNA, 59 bp, Homo sapiens
gcgtgtgtgtgtgtgtgtgtgtgtgtatgtgaatgtgcacatgagacacacatatatgt

SEQ ID NO: 6821955 - DNA, 64 bp, Homo sapiens
gtgtgtgtgtgtgtgtgtgtgtgtgtgtgtgtaagccacattcagggcagaccactcatttcat

SEQ ID NO: 6821956 - DNA, 67 bp, Homo sapiens
aggaacagccaggggctggcgtgttgatggtagaaaccattacagagttcgcacctggtgggtaact

SEQ ID NO: 6821957 - DNA, 63 bp, Homo sapiens
acttcacaggttttcataaaaccccaaatacaactgatggaatatgtatgaaagctgtggagt

SEQ ID NO: 6821958 - DNA, 56 bp, Homo sapiens
agctggctatgccctgtgaacccatggttcagtcccttctccaggtcagcacggct

SEQ ID NO: 6821959 - DNA, 83 bp, Homo sapiens
tgtctgagcgtatctgtgagtagcctgggagtgaaattggaactgatactaaccctcagctctcacacttagcttctatgata

SEQ ID NO: 6821960 - DNA, 60 bp, Homo sapiens
cctggcacaagagcagcattggtttaatcatcagcagcccttctgctctctgtagtcagg

SEQ ID NO: 6821961 - DNA, 83 bp, Homo sapiens
gtcttgtgtcagaacttttacagtacagaaaataacagaatagccttctgtaatgaggcgtttgttagagttttgcatgagat

SEQ ID NO: 6821962 - DNA, 60 bp, Homo sapiens
tttcagtgtgagtgtcttattttaagcctagcatcggtgaactaaagtgctcacaggaag

SEQ ID NO: 6821963 - DNA, 61 bp, Homo sapiens
cctcctggaaaaattccctggcctcagaaagtgtaacaatggcctggcggatttctggagg

SEQ ID NO: 6821964 - DNA, 62 bp, Homo sapiens
tcagtgtgcactctgtgacccagggtcccccagcatgtaaggggtcactgggaggccactga

SEQ ID NO: 6821965 - DNA, 81 bp, Homo sapiens
tatgccagattgattttggtcttttgtaagttatctcaggatttgtaggaagttacaggtagaccacagttataaggtatg

SEQ ID NO: 6821966 - DNA, 89 bp, Homo sapiens
ggcagtcttgggtcccacagttcagaagagtctacggcttctggcggctatgggagcagctgttctgacttgtctacccatattctgcc

SEQ ID NO: 6821967 - DNA, 81 bp, Homo sapiens
gcttcatgatactaagctgaagtgttggtggtttcagtattaatgtgtgataactaatatattttagtgtgtgttttgtgc

SEQ ID NO: 6821968 - DNA, 57 bp, Homo sapiens
ctggccaggttttgaacagttgcagagaaagtgtgcttactgtaacagagtggctag

SEQ ID NO: 6821969 - DNA, 78 bp, Homo sapiens
acacaaaaattgaagtcaccaaaaattggtgggagaaagaaagccaccaagagcaaggaggctttaaaatttttctgt

SEQ ID NO: 6821970 - DNA, 128 bp, Homo sapiens
tcctgagtccatgtgactaaatttcaagagggcaggttagaaaaagcaaagttgatggggcattacctgtggtttgaacttctacctgtcatatttcaggaaatcaccatgaggagcttgacttagga

SEQ ID NO: 6821971 - DNA, 99 bp, Homo sapiens
ggttgattcataattcttggtataaaaccaagttttccttagtcttgaggaatttgaagaaaggtaaaatgttggattttaagcaaagtaggattgacc

SEQ ID NO: 6821972 - DNA, 100 bp, Homo sapiens
gcattttacagcttcatgacaaacagttttgtgcccataccttagaaaatgtggtgctgagttaaataaaggctgtttgagcactggagcagaaaaatgc

SEQ ID NO: 6821973 - DNA, 67 bp, Homo sapiens
ctctcttccctaacaggtccacagtggtcaaaactctaaacatatgaacacttattggggaaggtag

SEQ ID NO: 6821974 - DNA, 72 bp, Homo sapiens
gcctggctttaaacactgggggttaatgcagaatctggagagagctgtcaaactcccagtttgatacgtggc

SEQ ID NO: 6821975 - DNA, 98 bp, Homo sapiens
gctgtccttggagtagaattcaaggcagtaggatcttccacagtggaagcataaactgttgaaactaactgttttatattatattcacagagggcagt

SEQ ID NO: 6821976 - DNA, 60 bp, Homo sapiens
tgacagtgcgggtacatcataggacactggaggaaagtcctttgaatgtaaagcatgtca

SEQ ID NO: 6821977 - DNA, 56 bp, Homo sapiens
catgcaaaggtcaagatcaggagaaggaaggaattcctcctgatcagcctttgctg

SEQ ID NO: 6821978 - DNA, 90 bp, Homo sapiens
gaggaccagatgggggcagttggcccagggctatcagacaccactggatggaggcccacactgggtagatgcaccttcccccaggccctc

SEQ ID NO: 6821979 - DNA, 85 bp, Homo sapiens
cttgataccaaatgatggattataaatattttaaggaacttaaaaaaatctctcctaaatattatgatttttaagtggtaaaaag

SEQ ID NO: 6821980 - DNA, 64 bp, Homo sapiens
aggtgaccctgagaagagcttatgagtgacagccctgtgttatgaagtcttctcagggcaacct

SEQ ID NO: 6821981 - DNA, 59 bp, Homo sapiens
gtatgtgacacttagaacagtgtctagcacatcctaagcactcaataaatgtcatatgc

SEQ ID NO: 6821982 - DNA, 70 bp, Homo sapiens
cgatgtaatgggaagaatgaaaagtctaatatttgcatagtgtgcagtttcaggacatcccattacgttg

SEQ ID NO: 6821983 - DNA, 73 bp, Homo sapiens
cctgtgtgtctggaagctcagggagcagctgtgacctgcacgtgggattcctgagctcccatgaacaggcagg

SEQ ID NO: 6821984 - DNA, 64 bp, Homo sapiens
aggccctgaaaccctgtcatggtctttgtctccagcttccaaagccctgaaggtttcaggccct

SEQ ID NO: 6821985 - DNA, 75 bp, Homo sapiens
tctacctctcaggcaggagtctcccttagtcatcttttagataaagaggtaatgactgcttgagtaaattgtaga

SEQ ID NO: 6821986 - DNA, 73 bp, Homo sapiens
taagaacaagggctctgagctggaccacctgggtacaaatccaagtgctctcgttcacggctgtgtgatctta

SEQ ID NO: 6821987 - DNA, 96 bp, Homo sapiens
ctgctgccaggccagctgtgggaatttgctgccctcttctggccaccaacttcggacaagaaggcgtaggagattttcaaagcaggctaccagcag

SEQ ID NO: 6821988 - DNA, 71 bp, Homo sapiens
ggagggcaacagaaatgcaaaatctgaggtcccagccctatggaatcagaatctgcatttttaacgtcccc

SEQ ID NO: 6821989 - DNA, 68 bp, Homo sapiens
caggagaagcagggagtcggggctgcggatctttgcctctgagccctctgttttccctctgcttcctg

SEQ ID NO: 6821990 - DNA, 64 bp, Homo sapiens
tcagacagcttgggataactgagttaccataaaacctgcaatgttgtctcacccactgtcatga

SEQ ID NO: 6821991 - DNA, 61 bp, Homo sapiens
tgccagccataaacccagatgacttttatatgtgggagtacactggcaaatgtggtgggca

SEQ ID NO: 6821992 - DNA, 58 bp, Homo sapiens
gatataacgacttcccaggtcttttacatgtctgagctgaaactggagtccttatatc

SEQ ID NO: 6821993 - DNA, 63 bp, Homo sapiens
ccaggtgggatgtgtggatcctgagtgctgaacaggtaacagtaacgagatgtcctaacttgg

SEQ ID NO: 6821994 - DNA, 55 bp, Homo sapiens
gtgtcttagaaagactgaatgctttttgttagagttctcattctactaagtacac

SEQ ID NO: 6821995 - DNA, 55 bp, Homo sapiens
agtaatgcggtggggaaaacaaggctatcatttcttgaatctgcactgcatggct

SEQ ID NO: 6821996 - DNA, 71 bp, Homo sapiens
tggtggggataggcatgacatgcagggatttctatttttaataaactcccaagtgatttctatttacacta

SEQ ID NO: 6821997 - DNA, 109 bp, Homo sapiens
tcagtgattctgtaaggatgaaggtgatgtagagtagtagatggcagctctactctggaagtccagaatactgctctgattcacacctgcaagccttattggtcaatga

SEQ ID NO: 6821998 - DNA, 80 bp, Homo sapiens
gagacggcaagggcaaggcgggatgggccaccgcccccgctggagcggcaggagccacctgcctgacccttgtctgcttc

SEQ ID NO: 6821999 - DNA, 69 bp, Homo sapiens
ttgttgttgttgtttttcttatggtgggacctatttcttgaagcactatacagaagaggataggaacaa

SEQ ID NO: 6822000 - DNA, 71 bp, Homo sapiens
accagctggtcacctgggcactattctctcccttctgtctgtgtccctttgaaagcagttgaccacctggt

SEQ ID NO: 6822001 - DNA, 75 bp, Homo sapiens
gtttgagataagatatactattaagtaccatggtaaagtactatgcaagtttgtggtggtatttcagtttctaat

SEQ ID NO: 6822002 - DNA, 55 bp, Homo sapiens
aattctgatcagttcttttaagcttcattgaaagagaaaaggagagatcagagtt

SEQ ID NO: 6822003 - DNA, 61 bp, Homo sapiens
ttagtccccagtgtgcagctcttctccactttaaaaggaggaggcctgaaactgaggctga

SEQ ID NO: 6822004 - DNA, 85 bp, Homo sapiens
ttcttcctaggtgacagcaacactcaattctgcagaagtaaccagtcagttttgctctgggttcttgctgttactgacctaagag

SEQ ID NO: 6822005 - DNA, 69 bp, Homo sapiens
gcccttcctggcagaggccccgacagcactggtcccacacagccccctgcctggggccctgtcaagcgc

SEQ ID NO: 6822006 - DNA, 59 bp, Homo sapiens
agttacattctgagctgagtagtttaaaaccactattaagctctccaggaaatgtatct

SEQ ID NO: 6822007 - DNA, 63 bp, Homo sapiens
ttaaactgggtccctgctggcagtttttggcagctgaaccaacaataagcaggacttgtttag

SEQ ID NO: 6822008 - DNA, 74 bp, Homo sapiens
tagcaggcatggagatgactgtgtagaaccctctaaatcacactaaccagtcctgtctttatgacttcaagcta

SEQ ID NO: 6822009 - DNA, 101 bp, Homo sapiens
ttcatcacatctataaatttattctttttggggtcatgtggtagagaattttgttcaccagaagttctccaaaaagatttgaaaatttgttagagtgagaa

SEQ ID NO: 6822010 - DNA, 66 bp, Homo sapiens
atcaccaaccagtagctgagttcaaaaactacatatttcttgggcagtcctctactggtatgtgat

SEQ ID NO: 6822011 - DNA, 66 bp, Homo sapiens
tgggtaggtgtggcctgaatgttgtcagttacccacttctataaatatcccagtcacatctaccca

SEQ ID NO: 6822012 - DNA, 55 bp, Homo sapiens
gatgttattgtgatcatgatactatctgacaagggcagtgatgcatgataacatc

SEQ ID NO: 6822013 - DNA, 76 bp, Homo sapiens
tgtcagtagtgccattgccaggaagggccatgaggaaaacaagggtcctctccctggctggtacattcccctggca

SEQ ID NO: 6822014 - DNA, 86 bp, Homo sapiens
actagcagaatgtaggccttcagtgttaacatagcctttttctgttattgcatttatctgcctttgttctgaagccccagtctagt

SEQ ID NO: 6822015 - DNA, 82 bp, Homo sapiens
tcaccctcagctccctccacccagaccagacaaacttcaggttagtttgtaggagggtgctggaggtaagggagcagggaga

SEQ ID NO: 6822016 - DNA, 81 bp, Homo sapiens
tctggcaatatctggagatgctttttgttgtcacaatgggggagagagtgtgctactggcatctagtgggtagaggtcagg

SEQ ID NO: 6822017 - DNA, 77 bp, Homo sapiens
gggatcttgttaaaatgcagaaactgatcctgtatgtctggaggagaactaagactctgcatttctaataagctccc

SEQ ID NO: 6822018 - DNA, 81 bp, Homo sapiens
aggtagaatcaggaggacttgataacttactgactttgaagaaaagaagtcaaagatgaccgagttcctatcctgaagcct

SEQ ID NO: 6822019 - DNA, 92 bp, Homo sapiens
acctctgaagtgccacaagataaagtatcataaatgcagaggaatgattccattgctttgtgcatatttaaaaggatatggcgctgagaggt

SEQ ID NO: 6822020 - DNA, 65 bp, Homo sapiens
aggagctgctcttctaggtggatcttcaggagtgaaaggaagaaggaacacactgagcaactcct

SEQ ID NO: 6822021 - DNA, 67 bp, Homo sapiens
ctgctgttagagaatgacgtgcaagcctccagtgccattggaagagcatgcattttctgagagtcag

SEQ ID NO: 6822022 - DNA, 73 bp, Homo sapiens
gtttttaaaagagaagaaaataagagagtgaaaatgacatcttagattttcttgtattcactcatttgggaac

SEQ ID NO: 6822023 - DNA, 56 bp, Homo sapiens
ccaggggtctgctcggcttatgggcactgtgcttgcccaaggacactggctcctgg

SEQ ID NO: 6822024 - DNA, 96 bp, Homo sapiens
atgatgcagcaataccacatgtggatatatgtccaatggaaataaaattagtatttctaagagatatctgtacttctgtgttcattgtagcattat

SEQ ID NO: 6822025 - DNA, 56 bp, Homo sapiens
gacactccatgcaggcatgccgtttgctcttgtaccactgggcctgcatggttgtt

SEQ ID NO: 6822026 - DNA, 69 bp, Homo sapiens
cttaaggtagtcagcctctgtgtacacagtttaaattatctgtaaacatgcatggctgcttaaattaag

SEQ ID NO: 6822027 - DNA, 129 bp, Homo sapiens
gttcccatctggtagtcaggcctttcacgagtagcccaggaaggaagcaggggtttcacaaccattactgagaattcacttgtcttccattttactctcctcctgtaagggtgatgtgctggatccaac

SEQ ID NO: 6822028 - DNA, 61 bp, Homo sapiens
ttggtcctgccccctccaggtccttgaaggctccagctggaagctgctggggcagggccga

SEQ ID NO: 6822029 - DNA, 70 bp, Homo sapiens
gagtggcatctcgcattcttgtttctacagtgccttgaggcatcagccaagatgctgaggttgccttctc

SEQ ID NO: 6822030 - DNA, 58 bp, Homo sapiens
gcacatttagaggttagcatggtattttgcagataccttgagttagcactgaatttgc

SEQ ID NO: 6822031 - DNA, 74 bp, Homo sapiens
ggcccagacacataggaccacactgtggtatgtgtatgaactgtttttcacattgtggtcctatatgtctggtc

SEQ ID NO: 6822032 - DNA, 66 bp, Homo sapiens
gctttgcttttcctaaactgatttctgtacactcaatatggtgttaagtctaggagagggtaaagc

SEQ ID NO: 6822033 - DNA, 56 bp, Homo sapiens
ggatgggtgactttgggcaatggacttcacatctccaagcctcagttttctcatcc

SEQ ID NO: 6822034 - DNA, 56 bp, Homo sapiens
tccaggagtctagcctcaggcctgatcccacggggagctctggagcagacactgga

SEQ ID NO: 6822035 - DNA, 63 bp, Homo sapiens
tttttctctttttggggtggggtgggataggagccttgttcaccccaccctgaggaggaggga

SEQ ID NO: 6822036 - DNA, 92 bp, Homo sapiens
caaacctccccagtgtgacctcagcctccctcccctcctctgggcttgctctggtttcatggatggccgggaggtgatgcacctgtggtttg

SEQ ID NO: 6822037 - DNA, 106 bp, Homo sapiens
gcatttcctacttcgcaggctcatccggagtttcagtcttgcctggcctgcagcttcagccgaggtctgcaaggcagcaccagctcttggagccaggtgggaatgc

SEQ ID NO: 6822038 - DNA, 56 bp, Homo sapiens
gccacagtgggctggggccagagaggggaagttccagggtccccacctagttgtgc

SEQ ID NO: 6822039 - DNA, 76 bp, Homo sapiens
cctacttaattctagtttaacacttagtaaggcttccaggcttcaaaatttgagtgctaaaatagaataaagtagg

SEQ ID NO: 6822040 - DNA, 84 bp, Homo sapiens
ggatagatggaagcaaagtgggatgacagtgctcatatgaagtcatcatattgctgtcattgtccctccaggctgctgtcttct

SEQ ID NO: 6822041 - DNA, 81 bp, Homo sapiens
ggtgagagattgctcagtagaacttttaaccaatttcagaatgagacctgttgggttcattggctccatccatctctcacc

SEQ ID NO: 6822042 - DNA, 95 bp, Homo sapiens
aattcattccagggtgcatacccatgcatacctttagaagaaaatagcctagggtgaatttctgtatgtgtgatgtgcacccagggacttgaatt

SEQ ID NO: 6822043 - DNA, 67 bp, Homo sapiens
gttccttctcttgttcctgtatttggcaaatttgtatgttaggatgtgcatatatatgggagggagc

SEQ ID NO: 6822044 - DNA, 56 bp, Homo sapiens
ctgcttcatgtcctgggacctggcttcttgtctctgactgtcctgagatgaagcag

SEQ ID NO: 6822045 - DNA, 84 bp, Homo sapiens
tcaccaaaggtctcaaacaagaatatgtagacagtagctacgttggatttctgtgtctataagagttgtttatttctctggtga

SEQ ID NO: 6822046 - DNA, 74 bp, Homo sapiens
tcctttagctttttataaccagaaatgatccagagtatttgtaatcacatgaggttatgacaaagcaaaagaga

SEQ ID NO: 6822047 - DNA, 82 bp, Homo sapiens
cctcttgcaccccgagggcccgcacctcgaaactccgtggaattcccagcgaggaactggcggtgggcccgtagggttgagg

SEQ ID NO: 6822048 - DNA, 55 bp, Homo sapiens
ggatgagttaggggcctgagtggacccctgtccctcacctagtctttgactctct

SEQ ID NO: 6822049 - DNA, 73 bp, Homo sapiens
gcaggggcagtggtccaggctacagctactgttatggtcagaaggctgattctcactgacctctgttgcctgt

SEQ ID NO: 6822050 - DNA, 67 bp, Homo sapiens
aggtaatttctccaaacatgctacttactcaacaaaaagtagtctaggtgtcttagagaaggtgctt

SEQ ID NO: 6822051 - DNA, 98 bp, Homo sapiens
agggactccttggacaaaatttcaagtcttgaagaagtaggtttactcaagcaaaactaacctcctttccaagtctggaataggtatgagatgtcctt

SEQ ID NO: 6822052 - DNA, 90 bp, Homo sapiens
tgcttatcactattattgtgcttaaatctaaatgtcatatacttagcaaaaggagatactgctaagttagaggttaggcacttaaaagca

SEQ ID NO: 6822053 - DNA, 56 bp, Homo sapiens
gctgcagcctgttgtaccagcctgtgctgacctgcaggcttctcaataggttcggc

SEQ ID NO: 6822054 - DNA, 62 bp, Homo sapiens
ggtgccctgagcccctcactgtccttccaagacatggcaggcagagagcatggctggggccc

SEQ ID NO: 6822055 - DNA, 118 bp, Homo sapiens
gcaggggcagtgatgtgatgaggtttgctctaatggaaggcttgcagctctgtggcacctggacacatgcagatgtttttgagtagcgggctttcctgcctctcccactgcactatgt

SEQ ID NO: 6822056 - DNA, 76 bp, Homo sapiens
tcttttgttattattggtagaaataggttctggaagacaaaagcagtaagccactaaagctatcagtaacaagagg

SEQ ID NO: 6822057 - DNA, 79 bp, Homo sapiens
tggcagagttatatagtgtcagtgataaatatcatgaagaaaaataaaggtcaagagatgctgtctacagatctggcca

SEQ ID NO: 6822058 - DNA, 84 bp, Homo sapiens
ctctaaacagctttgtcctgcaaacctgaacaaaaagaaattcagtgtgactgtcaggacagatgctccagaaacagttttgag

SEQ ID NO: 6822059 - DNA, 93 bp, Homo sapiens
tccctttggcccccaactctctgccctgcagggagcagtaagacctgaaactcaattgtcctctgtagagcagctcctgggaggacggaggga

SEQ ID NO: 6822060 - DNA, 64 bp, Homo sapiens
ggtccttttctcttccccagagtacattcccccggtatgtacattgagggaggaggagaggact

SEQ ID NO: 6822061 - DNA, 92 bp, Homo sapiens
gaagctcagcaaacctcaagtgcaagatatatgccatcaggtggcgagaagactcagtggcatgttttgctcttgaaaaggtgagaagcttc

SEQ ID NO: 6822062 - DNA, 76 bp, Homo sapiens
aagctttttgagaaactgctttgtgatgtgtgtattcatctcacagagttaaaagtttcttttgattgatcagctt

SEQ ID NO: 6822063 - DNA, 55 bp, Homo sapiens
ggaggcagaacttcccgtcagtaaaactttctctgtgtgaggacatctgcctacc

SEQ ID NO: 6822064 - DNA, 78 bp, Homo sapiens
atttggttccctgcagggttcggggaagacattttggagcaggtgattttttttcctctgagctttgaataattaagt

SEQ ID NO: 6822065 - DNA, 62 bp, Homo sapiens
ttttgtcatcattctgctcctctgtactcctaaatttgagagagacagaatcagagataaag

SEQ ID NO: 6822066 - DNA, 67 bp, Homo sapiens
gttattgagattatggcatgctaaaatatttgagtttgcttaaatttcagcagcttaattttgtagc

SEQ ID NO: 6822067 - DNA, 59 bp, Homo sapiens
ggaggagattcccctctcactttccagaaaaaggacaaagggaattaggaatcttttct

SEQ ID NO: 6822068 - DNA, 85 bp, Homo sapiens
tcagagagagcaagccagtcctctactgggcaccagaagacaatgcaactgggagtccaaggagaggatgaggggctcgatttga

SEQ ID NO: 6822069 - DNA, 82 bp, Homo sapiens
atgtctccaaaaattttggctaaaacgtggagagtacacaaattcttacatagttaaatagtacagctattattggaatcat

SEQ ID NO: 6822070 - DNA, 65 bp, Homo sapiens
ggtagagtgacggctcatctctggaagctcaacctccatgtttcctcccaggacctcactctact

SEQ ID NO: 6822071 - DNA, 56 bp, Homo sapiens
ttgctttgtttaaaagtggtatttcatgtatttcgtgaccctcttgcacaaagcaa

SEQ ID NO: 6822072 - DNA, 121 bp, Homo sapiens
aaagctgccaggtggttcccagtgcctggaaaatgaagaagcagaggctccatgctgggtcatgacttctgtttcagctgttccctgcttctgattttcacgggggctgattgcctgcttt

SEQ ID NO: 6822073 - DNA, 63 bp, Homo sapiens
gctgaggtgcactgaggtgggaactagccccatagctgccactttcacccagtgctcccaagc

SEQ ID NO: 6822074 - DNA, 59 bp, Homo sapiens
tggaatttctctgtactgggatgcaaacaagagctgaaaatccttaaagagaatttcta

SEQ ID NO: 6822075 - DNA, 68 bp, Homo sapiens
cattcccacactccatataattcaggggggatatcaaatagtattcctgagcaggagtcatgggaatg

SEQ ID NO: 6822076 - DNA, 73 bp, Homo sapiens
tttcctttttcaatatagaattgcattcgggctatccatagagtgcctgcaatttcaaatatcagaaaggaaa

SEQ ID NO: 6822077 - DNA, 72 bp, Homo sapiens
ggagcaggagaacaaagcaagctgccccagaccacccggctttcgcagaacccagatgatgctcctgtctcc

SEQ ID NO: 6822078 - DNA, 128 bp, Homo sapiens
gcatgagaaggacctggagtgcttgctgaaattcagattcctaggcatcacccagaccaacagaatcaatcatcctggcagggcccaggagtttgcattttaacaagttccccaggtgatttttatgc

SEQ ID NO: 6822079 - DNA, 68 bp, Homo sapiens
acccagcacaaagcaggcaattctgagatctcctttgcctctctgaattaaaccctttgtgcctgggt

SEQ ID NO: 6822080 - DNA, 101 bp, Homo sapiens
ctactttggaagattagattgtgtgctacacgagggtaaggaatatcgctgactaatctctgtatcctcagcatctagcatgaagtctaagtaccatgtag

SEQ ID NO: 6822081 - DNA, 80 bp, Homo sapiens
tgggcagctcattctagagttcatttcttgcgtgttagaactccttacattcttgaagtgaagtttattttgactgttta

SEQ ID NO: 6822082 - DNA, 63 bp, Homo sapiens
gggtgtggagtaaatcttgttttcaataacctgttgagtgacattttatattgccattggccc

SEQ ID NO: 6822083 - DNA, 69 bp, Homo sapiens
gtgacttttagaacatttagtgggttatgtagccatcactataatcctgttttagaacatttttgtcac

SEQ ID NO: 6822084 - DNA, 84 bp, Homo sapiens
tatcatttgcaactaaaatggaagttgtctggcatgtgatgctatggcatgcaaatagtcatgcttccatagaaacatatgatg

SEQ ID NO: 6822085 - DNA, 93 bp, Homo sapiens
cacaagtgcatttgtcattgaatgtgtacacgattgtttgaggaaagtatttggtttaacgaattgtgcataattccactgtttgcacttgtg

SEQ ID NO: 6822086 - DNA, 68 bp, Homo sapiens
gtgtgtctgtgccacctctccagtgtccagaatgaagcctggatctcagtccctggcatggaatgcac

SEQ ID NO: 6822087 - DNA, 61 bp, Homo sapiens
atcacagatttgatacttttgtgccaattagcttcatgcacacaaaattctgatctgtggt

SEQ ID NO: 6822088 - DNA, 56 bp, Homo sapiens
caccctggaatagtagttctgccacaacaggttattaatgaactctatccagagtg

SEQ ID NO: 6822089 - DNA, 89 bp, Homo sapiens
tccaggctagcgtgagaggccctggtaggtcagagtgtctggttgcctaagcttttgtacatcagtggccttggacacgttttcctgga

SEQ ID NO: 6822090 - DNA, 97 bp, Homo sapiens
ccagaatattgtctatttcacatcctgaagccccactggttgaatgtaccattgtggcattaattcagttactgtgaaaagttgtggttaattctgg

SEQ ID NO: 6822091 - DNA, 127 bp, Homo sapiens
cccaagcccatttcctctacctccctccgtagtgacatctggcctcacgtccccggggttcgtccttacagaatgggatggaggttctcagatgctcattagccaggaggataattgagggcttggg

SEQ ID NO: 6822092 - DNA, 86 bp, Homo sapiens
aggaagcacctgtgttcttttctctaaactgataaactaatgtctatttttacctggaggaaaagaaaatcaacagatgctgacct

SEQ ID NO: 6822093 - DNA, 62 bp, Homo sapiens
ggtgcctcctaccacaccctcagtctgtgatattccagccaggggaaatgggggaaggggcc

SEQ ID NO: 6822094 - DNA, 93 bp, Homo sapiens
tccttgaaggacagaaaccatgccttacttcgtttgtttgtccccagagcagctggtacaggaacgaatgtacattgtttccttctctaagga

SEQ ID NO: 6822095 - DNA, 84 bp, Homo sapiens
agcacttgtcaagcttttttggagaatgttttggtcagaatgacaagataatttgtgactgaggctccaagctagagaagtgtt

SEQ ID NO: 6822096 - DNA, 78 bp, Homo sapiens
aaagaaaaagatgcttattgctcctgcagtgttctctctcaggacctttctgctctaggtcatgggtactttgtcttt

SEQ ID NO: 6822097 - DNA, 80 bp, Homo sapiens
aggccaggatccgcaaaccacactcagcgtatcgggcgtgcaggtcgacgagctgagtgtagtttacttcggtcttgcct

SEQ ID NO: 6822098 - DNA, 72 bp, Homo sapiens
ccaaagcccagtgatggtgatcagatgttacctaagtatgtagactactgcctaccacgctgtacttgttgg

SEQ ID NO: 6822099 - DNA, 62 bp, Homo sapiens
aaagagtggcatccaatttgttgccatatgaggtatggcagcaatttgtgatgttgaccttt

SEQ ID NO: 6822100 - DNA, 71 bp, Homo sapiens
tggccaggattccatggtcaggaaatagctctagtatagagactctgtgtgttggccatggaatcaggcta

SEQ ID NO: 6822101 - DNA, 55 bp, Homo sapiens
gcctggcactcactgaagaggcagggcactggagcttcctccacaggtgccaggc

SEQ ID NO: 6822102 - DNA, 60 bp, Homo sapiens
caccaggcagctgggggtgatgtggagacacaggcacaggtgtgccccacctgcctgctg

SEQ ID NO: 6822103 - DNA, 79 bp, Homo sapiens
agaggcaggctgaagtttaacttgaattctttctctgcttttctgagcacagaaaagataagttaattctccttgaact

SEQ ID NO: 6822104 - DNA, 63 bp, Homo sapiens
ttctttgtcctctccaacagcctctgtgtacactgcacagtagagagttggtgagggcctgaa

SEQ ID NO: 6822105 - DNA, 114 bp, Homo sapiens
ggaaattcattaatgtcggagacagcattagaagtagttggggattattttatcttctacatatatttttctcacttgctgtttcatatttaccactcaaacatagacctttct

SEQ ID NO: 6822106 - DNA, 86 bp, Homo sapiens
aggaaactaagactgagagactaagtgctttgcccaagctcacctggtgtgccatgcagctgccacttgctctcggctcccttcct

SEQ ID NO: 6822107 - DNA, 61 bp, Homo sapiens
gatttggtgagtgacctggagaggactggggtggaagtcccacagagtggctcacctagtt

SEQ ID NO: 6822108 - DNA, 60 bp, Homo sapiens
gagagtatcagtgctcccagcttagcattaaaatgcagcctggtggtcactggagttctc

SEQ ID NO: 6822109 - DNA, 62 bp, Homo sapiens
tctgaggaggcagcgtgctgagaagtgttcgaggtgaacattcagggcagctgctcttcaga

SEQ ID NO: 6822110 - DNA, 58 bp, Homo sapiens
caaaggccattacttgcttttagactctgtgtgttgagagataaggagatggtttgtg

SEQ ID NO: 6822111 - DNA, 72 bp, Homo sapiens
ttgggacatggactgctgaactaaggcaaagttgagcgactcctttgacttcttgcagtccagctatcccaa

SEQ ID NO: 6822112 - DNA, 105 bp, Homo sapiens
ggatagtgctccaccaatgctcaaaactggcttttagtgtgaagacttggactctcattttgatatgtggaagcccactgagtttggtaaacaggtgtatcatcc

SEQ ID NO: 6822113 - DNA, 55 bp, Homo sapiens
ggtatgactcctctgagaaagagcttcttgcgttttctcagggaggagtcaagcc

SEQ ID NO: 6822114 - DNA, 76 bp, Homo sapiens
catggttgtagttttgttattttgtcaggtgagctggttgcagaaactcatcctggagatgaccctaattgccatg

SEQ ID NO: 6822115 - DNA, 83 bp, Homo sapiens
gatgtgactttgacttgaggattgtctcctgtgatgtgctcctagtggggctacaggggtcagtcctttgctttgagcacctc

SEQ ID NO: 6822116 - DNA, 97 bp, Homo sapiens
tattttttccttgaccatgtagaaacagacatcttttcctcactaaaaacttaaaaaaggaaacattgtaattttagcatggattaaagaaaatata

SEQ ID NO: 6822117 - DNA, 60 bp, Homo sapiens
tgctttccattcagggctgtttgaaagttcacctgtctatggatctgctaatgggaagca

SEQ ID NO: 6822118 - DNA, 88 bp, Homo sapiens
gctgtgaaggtgcatatgctacacacatgtgtctctgggggtgggtgcctatgcttctgggcaaatgtgtgtgactgtgcctttgtgt

SEQ ID NO: 6822119 - DNA, 102 bp, Homo sapiens
ttttctttgcctaccatacatacatctagagtcataaaaacatttgggtggcattccatcagttgctctatgtgtgttctatgtgtgtgaacagtcagaaaa

SEQ ID NO: 6822120 - DNA, 83 bp, Homo sapiens
gagtagtaaagtctaacacactggcccccagtactgacagatttcctgttatacagcattgctagtgatgtagatttactctc

SEQ ID NO: 6822121 - DNA, 69 bp, Homo sapiens
gcagagtgggtggggcaattccaaagggacttttccattttccctcctgggctgcactccattttctgc

SEQ ID NO: 6822122 - DNA, 85 bp, Homo sapiens
tctttctaatcttcagtgtcctcatttgtgagatggggacagttccaatacatagtacagagggctactggttgattaaatgaga

SEQ ID NO: 6822123 - DNA, 61 bp, Homo sapiens
cctgtgggaaagctggtggtggtgtccttttccaccatcttagtggccagctctcaccagg

SEQ ID NO: 6822124 - DNA, 56 bp, Homo sapiens
gggcagtgattttccttagaggggagcaagaaggtcaccaggaaagtctgctgtcc

SEQ ID NO: 6822125 - DNA, 73 bp, Homo sapiens
cagccacctgagataagagagctcacaccggtcagaggtatgatgcgtctcctctttcaggtatttagggttg

SEQ ID NO: 6822126 - DNA, 68 bp, Homo sapiens
tggcctctggggtctagcaatagcaggaatggtgcccctgtctttagcagaggacctcagtgtttcca

SEQ ID NO: 6822127 - DNA, 61 bp, Homo sapiens
ggtataaacaagcttcactaagtgtaaaatgctacatgagtgttagtagttgtcttatgct

SEQ ID NO: 6822128 - DNA, 63 bp, Homo sapiens
cagtaatggaaatggtcaggccataagatgaaatataacttcattggaatgatcgttttgctg

SEQ ID NO: 6822129 - DNA, 118 bp, Homo sapiens
gtaaatggtgtttgcaggcaagtaatgatttttcctccctctctataaatgatattactttggtagagagagaaatgaaatgtgctgatgttatttgttctttgtgaaaccattttgc

SEQ ID NO: 6822130 - DNA, 61 bp, Homo sapiens
cttcagattgtacacataattgcctttggctgccaaccaaaggcttgtgtgttcagtgagg

SEQ ID NO: 6822131 - DNA, 69 bp, Homo sapiens
tctccctgagcattcatgtgagcttgctttcaataattaagttaggctagctgattgccttagaagaga

SEQ ID NO: 6822132 - DNA, 72 bp, Homo sapiens
ctgggcaccactgctgccttgttgccctgtggctgtgaggtgccatagtgccaagtcttcagcacgccccag

SEQ ID NO: 6822133 - DNA, 92 bp, Homo sapiens
gcactaggagagccaggagtgtctccacacagcaaagagacaccctgaaattacctctgatttgcttcttagatattcctctctctctgtgt

SEQ ID NO: 6822134 - DNA, 110 bp, Homo sapiens
gcccatttctcattttcctctgtgctcccatggagctgatccaatggtttttaagggagctctgagcttggacaagctctgaagggcatggggcaagacaagaaacgggc

SEQ ID NO: 6822135 - DNA, 56 bp, Homo sapiens
gctgtgaccttagcaagggaaatttggaaacggagtcttgtgttttcaggcagagc

SEQ ID NO: 6822136 - DNA, 58 bp, Homo sapiens
cctgagctggcagtgacctggaacccgatgagggcgtgggtgacacatcagcgtcagg

SEQ ID NO: 6822137 - DNA, 130 bp, Homo sapiens
cagtgatctattatcccatcattgccctccagcctgggcaacagagcgagggcctgtctttttttcctttgagatggagttgagctctgttgtccaggctggagtgcagtggtgtgatcttggctcactg

SEQ ID NO: 6822138 - DNA, 120 bp, Homo sapiens
tacatggtgataccatagcgtgtttaactgttcatgtattgaaaagcattttaattgcttccagttttggttttgtttcctaataatgattgtttccaagctgctatgaagaatcatgta

SEQ ID NO: 6822139 - DNA, 129 bp, Homo sapiens
caatacccctcattcctttacgtggttgctacaggcgagtgggtacgcttttggtctctgcaggttctgccgtgagtccagcaggatgcaagtgccatcttgtagaattcatgggaatggaggaggatg

SEQ ID NO: 6822140 - DNA, 86 bp, Homo sapiens
gagtctcgctccgtcgcccaggctggagagcagtggcatgatctcagctcactgcaaactccgcctcccgggttcaagtgattctc

SEQ ID NO: 6822141 - DNA, 70 bp, Homo sapiens
gtcccacctttacttcccctttgttttgatatcttgcaaatagaggggctccccagtaaggttgacgggc

SEQ ID NO: 6822142 - DNA, 59 bp, Homo sapiens
caggacaagctgccagcatcccggaaggggttaatccccctctggtggctcagctcctg

SEQ ID NO: 6822143 - DNA, 70 bp, Homo sapiens
actggcatttggaaattgcaagtgatttgcatggtgaaatacagtgaacatggaaatttcctatttcagt

SEQ ID NO: 6822144 - DNA, 57 bp, Homo sapiens
attggcagggccagcatctccctgcagctgagagggttagctcaggccctagtcagt

SEQ ID NO: 6822145 - DNA, 58 bp, Homo sapiens
gtgaaggcttgacgtcatcaggcagcattagcatcacctgggacttttcaagcctcac

SEQ ID NO: 6822146 - DNA, 111 bp, Homo sapiens
tgttcagttgatggatgtgatgaagacaacacatgtatgccactcttctgggccaacacccaggtagatggcgtttatgctgttggctttagcagccaatacctgtaaaca

SEQ ID NO: 6822147 - DNA, 60 bp, Homo sapiens
ttgtctgaaccatctccctggcccagcacccgggatttatcctgggaggtgttcagagaa

SEQ ID NO: 6822148 - DNA, 65 bp, Homo sapiens
ggaaagggtggggtgctacatctttacagccaggtggaagtagaggtataggcttctcgccctcc

SEQ ID NO: 6822149 - DNA, 87 bp, Homo sapiens
ccctggggaaaggctcaacagctgtactttgtctaggaacttttacgtaggataaagtctttctcattggccatgctgtccctaggg

SEQ ID NO: 6822150 - DNA, 63 bp, Homo sapiens
atcaaaaccacctggagggctcgttaaacagcgatcactgagtccattgccagaatttttgat

SEQ ID NO: 6822151 - DNA, 97 bp, Homo sapiens
atccaaaccaatctcgtgtgtatttgctggctgagatctgttttcctcatgttctgtagaagggaaggagtaacatggtctcctttagatgctggat

SEQ ID NO: 6822152 - DNA, 82 bp, Homo sapiens
actctgtcagctgtgcaaggtcactgtcctctacagagtagaacatcgacactgagaaagtgacctgccaaggccacagagt

SEQ ID NO: 6822153 - DNA, 129 bp, Homo sapiens
aaccagatgtagtccctgtaccacactgttgaggacgagatgtggcctcctgcatgctatcattctagtccttatggtctgcttcgtgttctgactatcctgcattcatcaatatccatctctaaagtt

SEQ ID NO: 6822154 - DNA, 87 bp, Homo sapiens
tagctggttttacaggtgtgagccaccatgcccaattaatttttgtatttttagtagagatggggtttcaccatgttggccagacta

SEQ ID NO: 6822155 - DNA, 69 bp, Homo sapiens
gtgcagtttaaacttggcaacttgatgccctggtgttccctgggggagttagggagtttatatttgcac

SEQ ID NO: 6822156 - DNA, 67 bp, Homo sapiens
tggcaaagctccaaatgggtggaagtggccagaaatgggcccagcttcctccatctggggcttgcta

SEQ ID NO: 6822157 - DNA, 82 bp, Homo sapiens
atgagagagatcaattctcctggagaaatgccttattctcatctctagaaagaagagcatttggtgagatttgactcctcat

SEQ ID NO: 6822158 - DNA, 58 bp, Homo sapiens
ataaagtcctctttcacaaacagcttggcaaactgtgcaagtcaaagatgggctttgt

SEQ ID NO: 6822159 - DNA, 57 bp, Homo sapiens
gaattgggctgcagtttttagttacaattgacgctactgccaaactgagttcagttc

SEQ ID NO: 6822160 - DNA, 77 bp, Homo sapiens
ggagagaggggtggacatgagagatggaaagagactcctgtctacatgttcctatggctcagttgcatttctcttcc

SEQ ID NO: 6822161 - DNA, 58 bp, Homo sapiens
cagccacttccatctgcacttggctttcttcttgagtccacagttctggcaagggctg

SEQ ID NO: 6822162 - DNA, 75 bp, Homo sapiens
gcaggctccctctgggctgagttcatggccctgccccctggtggccagagccggcttcacaggataagagcccgc

SEQ ID NO: 6822163 - DNA, 96 bp, Homo sapiens
gttaagtattaggctgatgccaaagtaactgaggcctttgccactacttttaaatggcaaaactcgcaattacttttgcaccaacctaataataac

SEQ ID NO: 6822164 - DNA, 96 bp, Homo sapiens
gtcgcaacctagaatgtgggctggagagcgctgtcccagtggtggccccgaggccacaggttctgtcccagatgttctcagcaccattttagcgac

SEQ ID NO: 6822165 - DNA, 87 bp, Homo sapiens
catctttactgcccgtccctttgctctcgcgctgctacaacgaggagagactgcagcctgagtcggggctggggatggggggagatg

SEQ ID NO: 6822166 - DNA, 81 bp, Homo sapiens
tgcctctcctcaccctccctctcttcctgcagggcctgggaagggctttgagggagcctgggagccatgtgaagaggggca

SEQ ID NO: 6822167 - DNA, 74 bp, Homo sapiens
acagtgtaaataactctccagaattattactattatttttaataaaggtaatatttgggggaaaattatatggt

SEQ ID NO: 6822168 - DNA, 62 bp, Homo sapiens
tccatccgtccatttattcactgagcatttgttatgtgccaagaagtatggttggggctgga

SEQ ID NO: 6822169 - DNA, 60 bp, Homo sapiens
cggcgctggtacagtggaagagggctgtccagccctggatgtctttcatttctagctctg

SEQ ID NO: 6822170 - DNA, 73 bp, Homo sapiens
agtgctgtctcaagaaggattctggaatcacaagagagatcagtgaagaaagggctccttgttgattagcatt

SEQ ID NO: 6822171 - DNA, 59 bp, Homo sapiens
gttatgtgtgtgtatacatacaaacacacatgacttttgtatgtacacacacacaaagc

SEQ ID NO: 6822172 - DNA, 113 bp, Homo sapiens
ctaaactatgttttcttgtttaatgcccaaggatctggttctttttacaaacttttttccatgttgaggtaaagagaagtcagagcctgcatgtgcatctgactgtagtccag

SEQ ID NO: 6822173 - DNA, 55 bp, Homo sapiens
gaataggggcagatgaggaatggggctggcttcagggagaactctgcttctgttc

SEQ ID NO: 6822174 - DNA, 59 bp, Homo sapiens
gggcatagccatgagtgaaagttagcacctcgaacttgtcactataagagggcttgccc

SEQ ID NO: 6822175 - DNA, 76 bp, Homo sapiens
gagtccagccaacaccttgatagttacctgtgaaagaccctgaagcagaggactcaatcaaggtatgcttggattc

SEQ ID NO: 6822176 - DNA, 62 bp, Homo sapiens
cagcctctctgtatctcaggatcctcgtctgtaaaaccgcagtcctagttgccatgaggctg

SEQ ID NO: 6822177 - DNA, 56 bp, Homo sapiens
ctgagctgtgtcttggtgagagtcttcagcttactccacatttgaacacagttcag

SEQ ID NO: 6822178 - DNA, 91 bp, Homo sapiens
gtgaatgcagaggactctgaggtgccacccaagagccttttaaaataaatagaagtttttaaaaatgctacttaagagtcactgcagaagc

SEQ ID NO: 6822179 - DNA, 56 bp, Homo sapiens
tttcttctcacccaggacagagtcacagagaccttgaagaatggaggaggtagaaa

SEQ ID NO: 6822180 - DNA, 57 bp, Homo sapiens
gagtgcctggaccctctttccggaggaaacagtcccctctggacctcgttcggcctc

SEQ ID NO: 6822181 - DNA, 57 bp, Homo sapiens
cacatgaggtggagatgaatgagtcttcttttgacaaaacattttatcccttatgtg

SEQ ID NO: 6822182 - DNA, 94 bp, Homo sapiens
gtcttaaatgcttcatgggataggagatgatccaatgggaactgaatgttttcaattaggatgtttccatggatactattaagcatgccaagat

SEQ ID NO: 6822183 - DNA, 81 bp, Homo sapiens
cagtgctgtcattctcttagtattgctagtttagcttattctcttacatgtgctggttcaggccactaagaagacccactg

SEQ ID NO: 6822184 - DNA, 65 bp, Homo sapiens
gggactagcttgtgtgaaggccttgcagtgaaaaactgctgaagagctccaggcaatgcggtcct

SEQ ID NO: 6822185 - DNA, 69 bp, Homo sapiens
tctgaaatggatgagagcagaggttaaattgaaagaatgagggatgagatctttagccatccaatcaga

SEQ ID NO: 6822186 - DNA, 55 bp, Homo sapiens
ggaggtgcctgtaaaaatgagcatgttttattctaggttcatttctaggcactcc

SEQ ID NO: 6822187 - DNA, 65 bp, Homo sapiens
gagagacatggagaggcaaagttacacagcaagttagtgaaccaaaaccacactccatgcctctt

SEQ ID NO: 6822188 - DNA, 82 bp, Homo sapiens
gatagtgacttgagtgagaaataaaccttaatgcattaagtgacaaaatgttaaggttatttgttatgtcagttagcctatc

SEQ ID NO: 6822189 - DNA, 64 bp, Homo sapiens
gagggatgtgcctgaaggcagggagttggatctggtgacttcttaagtcctttccacatctctc

SEQ ID NO: 6822190 - DNA, 64 bp, Homo sapiens
cgccactaggctcgctacgaggaagcgccgctgagggtccatctttttaagagatctagtgacg

SEQ ID NO: 6822191 - DNA, 63 bp, Homo sapiens
cctgctggacgtggaggaggggctgagccttgggctgcattctctgcacccacctctagtagg

SEQ ID NO: 6822192 - DNA, 67 bp, Homo sapiens
cctgcctgagtctgtacgttagccataattgcatcacaaggttatatggctcataaaacagagcagg

SEQ ID NO: 6822193 - DNA, 67 bp, Homo sapiens
ccgagtgtgaagggctcgtccaatttggatgaattctttcccccaaggatccagcccttcactctgg

SEQ ID NO: 6822194 - DNA, 92 bp, Homo sapiens
agaaaggcgttattttcatgcatgtttaaggggcatgcattaactgagccaatgcaagtcaaattagatatgtattgattaatgttaattct

SEQ ID NO: 6822195 - DNA, 61 bp, Homo sapiens
atagttagtatgtgtagtctagcttttaattaactaaaagcagggccagaatacttgctgt

SEQ ID NO: 6822196 - DNA, 58 bp, Homo sapiens
gatttttctactctccttatctctttagggagataggacaggagaagtagcagaaatt

SEQ ID NO: 6822197 - DNA, 85 bp, Homo sapiens
taaagtttgtgttctggtccagaatttatgattctaagtcaggaggatggggagtttgttttgaggccaggaggacattatttta

SEQ ID NO: 6822198 - DNA, 98 bp, Homo sapiens
aagtgcagagatgtttcttcttttggtggtgggcttggcagcctggacagcagcagtgttaagttgtcagcagcactggcaaagagactcctgggctt

SEQ ID NO: 6822199 - DNA, 67 bp, Homo sapiens
actattcagatataccagtatttgtatttagatattcccatttagatggctggtgttctgagctagt

SEQ ID NO: 6822200 - DNA, 77 bp, Homo sapiens
ggagaacctccagcttggagagaagtttcttggccagggtcacacatccaggaagcggcttccaaactggactctcc

SEQ ID NO: 6822201 - DNA, 60 bp, Homo sapiens
ccttgaaatgagaaaaagttggagcttaagtaagtgaattgaagctatttccattcaagg

SEQ ID NO: 6822202 - DNA, 80 bp, Homo sapiens
tcacttgttgatggatttttgggtcattgcagtttttgatattactaataaaactgctataaacattcatgtacaagtga

SEQ ID NO: 6822203 - DNA, 75 bp, Homo sapiens
gctggagcagagggcatggccatttaagcttttggtcaacacagtgtgatgggcctgcctgaaggctgtaccagt

SEQ ID NO: 6822204 - DNA, 65 bp, Homo sapiens
caagttcatctctagacaggaggctggtgaggtggacatcagccaggccctaagagattgacctg

SEQ ID NO: 6822205 - DNA, 66 bp, Homo sapiens
gaagggctgcatcacaatggcctgtagacttcatccttccctcactctgcctgtgttcagcctttc

SEQ ID NO: 6822206 - DNA, 79 bp, Homo sapiens
actttctttgtttctgtttaaattgtgtatacttatcataaacaattcaagcaagagagacaaatgcaaaggagaaggt

SEQ ID NO: 6822207 - DNA, 91 bp, Homo sapiens
ccagaagccccctcagcaggcttctgctgatatttcattggctataaccatgtcaattggctgtcacggaggctggagggtgggcatttgg

SEQ ID NO: 6822208 - DNA, 75 bp, Homo sapiens
tgacataggataaactgtatttgggattgtgtaataaacacacagtatgaaaagtctagttaatcctttatgtca

SEQ ID NO: 6822209 - DNA, 63 bp, Homo sapiens
atgtctttattaatatcatgccaagggatgacattatgagccttgcagaattgattaggacat

SEQ ID NO: 6822210 - DNA, 120 bp, Homo sapiens
tttttagacatttagaaatagagtcagtattcagatgctttttaggtattacctgaacagttctttctcagatgcctgaaagcatgttgttgctcactcattcttggatttttttaaaaa

SEQ ID NO: 6822211 - DNA, 71 bp, Homo sapiens
ctcattgttgggctttgctggagagagagagatgttcttcctttgtagtctgagcaatagcctcaaatggg

SEQ ID NO: 6822212 - DNA, 61 bp, Homo sapiens
attctgatatgaacacacatatatatataattgtgtacttgtgaaagtgcatgtctagaat

SEQ ID NO: 6822213 - DNA, 65 bp, Homo sapiens
gagaagacgtgatggccaagaatcagaaacaattcccaacggcttcctggtagtcaagtctcctc

SEQ ID NO: 6822214 - DNA, 84 bp, Homo sapiens
ctgtacccactaaataaaggcttggaaactagagtgtgcagcaagtcctaaagctctgggtttctagatccctagtgggtgcgg

SEQ ID NO: 6822215 - DNA, 88 bp, Homo sapiens
ggtcagtctggtaaactgcagtttttggtaaaagcaccctggctggctgacactgccgaaactgtagagttttcattacctactgact

SEQ ID NO: 6822216 - DNA, 130 bp, Homo sapiens
cagttttgaggggcaggaatctggaagtggcttagctgagtggtgctggctcagggtgtctcaagacaagctgttggccaaagccacagtcatctggagctagacaattccgtgctcactcatacggttg

SEQ ID NO: 6822217 - DNA, 60 bp, Homo sapiens
aggttcttgactctaccttccagtaaaatattcctatggaaactgaagagacaggaactt

SEQ ID NO: 6822218 - DNA, 56 bp, Homo sapiens
gtactgtctggagttgccaaaggctataacatatgcctttttgcttatggacagac

SEQ ID NO: 6822219 - DNA, 81 bp, Homo sapiens
aaacaaaacacaactgagttaaacaatgaagaaagcaagcttttgatgacaaacttttggctgagaagttgtgctttgttt

SEQ ID NO: 6822220 - DNA, 87 bp, Homo sapiens
agatgaagaagattctttaagttctagcattgactgttgaaagccacttgtataaaaggtgccaagaactacaggattctttcatct

SEQ ID NO: 6822221 - DNA, 81 bp, Homo sapiens
ctccaagttgtcctgctggcttccatgcggacatcatgaatgttcctgaaccagctggaggcgagtttggatatgacagag

SEQ ID NO: 6822222 - DNA, 59 bp, Homo sapiens
gcctgcagagagaaccattcaacctgctcaaacgtggtagattctcccacctgccaggc

SEQ ID NO: 6822223 - DNA, 55 bp, Homo sapiens
cctcctgcggcgtccgcgctctgtctctctctggctcgtggagctggcaggcagg

SEQ ID NO: 6822224 - DNA, 67 bp, Homo sapiens
gtatgtgagagacacactgtgcatgtagtttacagacagcactgggtgccacatggtttccagatac

SEQ ID NO: 6822225 - DNA, 89 bp, Homo sapiens
gtggtcctggtgctggtcattgtcggcctctgtctctggctgccctcggcctccaaggaacctgacaaccatgtgtacaccagggctgc

SEQ ID NO: 6822226 - DNA, 96 bp, Homo sapiens
ggggaaaggacatcaggggagctgcgacctcaggaggacccctcctgagggaatggaggaaaagggaatcagctcacccatacctctactttcccc

SEQ ID NO: 6822227 - DNA, 59 bp, Homo sapiens
gacactggggactctggccttttgacaggacatgtgtcaaaatgccgagtgcccaggtc

SEQ ID NO: 6822228 - DNA, 79 bp, Homo sapiens
tgtgtcccccgctttcctgggaagactgtgaggacaggagcttgtccctgttcatatccccagcacagtgcctggcaca

SEQ ID NO: 6822229 - DNA, 91 bp, Homo sapiens
gcgggcctgggggcaaaggctcagaatcggcagacccagaccccagttggtgtgtttgaaagctgagcctgctggtcctcccgggccacgc

SEQ ID NO: 6822230 - DNA, 62 bp, Homo sapiens
gaggacaagctgtgagtggggttgcagaacaagtctggagaaccctgctttatgccgtcctc

SEQ ID NO: 6822231 - DNA, 61 bp, Homo sapiens
agtcacacagggcctccaaatcagaagggtactgcctctggtttaatactctgctgtggct

SEQ ID NO: 6822232 - DNA, 57 bp, Homo sapiens
atgatcatggaagtgcacccattggggttatataagggttgtgtgcttcatgatcat

SEQ ID NO: 6822233 - DNA, 58 bp, Homo sapiens
tgtcctgcaagccctaatgaatcctgccctaggcagttttagcaagtgtttgagggca

SEQ ID NO: 6822234 - DNA, 57 bp, Homo sapiens
taaggctgattagactgatagcttttataattcaaggctaaccagctaacagtttta

SEQ ID NO: 6822235 - DNA, 108 bp, Homo sapiens
ggagagaaggccatcaggccatatacagccagctgaatgtaccatgactcatactgaatgggatcaggcattcagtgggctgactgaagccgtgtatcctatcactcc

SEQ ID NO: 6822236 - DNA, 109 bp, Homo sapiens
cattgacggcctcagcattctttcagtatataaaataatttctctgttgtggggtattttctcaccagtctttattttgttattagtcgccatagaggtaaaatcgatg

SEQ ID NO: 6822237 - DNA, 63 bp, Homo sapiens
gcttgtttgcacattgttttaggaattcagaacacatttcccatagaaacaatgcagacaagc

SEQ ID NO: 6822238 - DNA, 118 bp, Homo sapiens
gagtgagctggcagccctaggagcagcgggacatgcccctcagtgggtgtctcacctgggagacaaagctcgccacctctgagggcgggtcattcttgctgtcctgccaggtcacctc

SEQ ID NO: 6822239 - DNA, 115 bp, Homo sapiens
gcctgacttggcctgtgcccatggacatgctgactatgtgtgctttgtgaatgcaagttttctgtgtgccacgaggtcacttggatgtgaagtctgtaggtgcttgtgagcaggc

SEQ ID NO: 6822240 - DNA, 59 bp, Homo sapiens
ggctctggagatgtccgacctgcatttggatgacaggtattgaccacctccttgatgcc

SEQ ID NO: 6822241 - DNA, 93 bp, Homo sapiens
ggatgctcaatattctggggatgtacatggattcctttcctccaggagaagcactaagggagaggccacatgtacagccactaatatgcagcc

SEQ ID NO: 6822242 - DNA, 81 bp, Homo sapiens
acctcccaagccttgtccccagcaggttggttttgttttcttgaagcttgtctgaaggagataagtctgcacctgggaggt

SEQ ID NO: 6822243 - DNA, 69 bp, Homo sapiens
tgtgtgtcttgaccaggatcggatataaattctattattggaagtttccaggaccctggtagacacaca

SEQ ID NO: 6822244 - DNA, 62 bp, Homo sapiens
cacaagtgaaccatgtgtccttggctatttgtccttggggaagatacatggcttctcttgtg

SEQ ID NO: 6822245 - DNA, 69 bp, Homo sapiens
cactcctccctctctgtctattcccccacctccgttaccacacataggtaagcagtgaggtgaggagtg

SEQ ID NO: 6822246 - DNA, 74 bp, Homo sapiens
agaatgttcaaatccatcaaatcttctagaactttacacacaggtactgaaagagtggtggactctggcatttt

SEQ ID NO: 6822247 - DNA, 61 bp, Homo sapiens
tccagaagttctttcatataggctgaatataataaccatcctatatacagagctttatgga

SEQ ID NO: 6822248 - DNA, 86 bp, Homo sapiens
gagtctcgctttgtctcctaggctggagtgcagtggcacgatctcggctcactgcaacctccgcctcccgggttcaagtgattttc

SEQ ID NO: 6822249 - DNA, 91 bp, Homo sapiens
agcatccagtccagagaggaggctgtgtgcgctggggaaatggtgactgacccacagatactgagcatcctttctgtggcagcttggtgct

SEQ ID NO: 6822250 - DNA, 79 bp, Homo sapiens
gtcacatatgtttatactttgatgtactcatgcaaaacacatggcaaaaatgggtttattaatgtgaactgtataagac

SEQ ID NO: 6822251 - DNA, 56 bp, Homo sapiens
agataagtagtaagtatgtatgccttgaagccatcaggctgtgacttacactatct

SEQ ID NO: 6822252 - DNA, 55 bp, Homo sapiens
ttctgaaatgttgagagtccatttgtgagactggaaacttggaacgtcttcagaa

SEQ ID NO: 6822253 - DNA, 79 bp, Homo sapiens
tcctgggacaggaaggctggttccatccctggtgtgactgcttaccacctcagggacgggatcacttggtctcccagga

SEQ ID NO: 6822254 - DNA, 65 bp, Homo sapiens
tgaaagttctgggggagaagaacgaattgagaggattatacgttggctgctccccaaggctagca

SEQ ID NO: 6822255 - DNA, 89 bp, Homo sapiens
gctacctttagatgtttccagatgagtgaaatcctgggaggaggatgcgcctcctgtttgttacctcgtttgagtttcagaggggaagc

SEQ ID NO: 6822256 - DNA, 77 bp, Homo sapiens
ccaagtgtcctaactcccaacatcatggctctagaatgacataccaggaagaagctcgtagtgttgggataggctgg

SEQ ID NO: 6822257 - DNA, 100 bp, Homo sapiens
gctgagaaggcctgcgcttccagcccattcctgccatgccgctgccctaatggctgtgacaatggatggatggatggacggagggccaggccaaccaggc

SEQ ID NO: 6822258 - DNA, 98 bp, Homo sapiens
gcataatacatgaaaaattggagcaggtgctcagggtaataatttgtataaatagctattgccttacactagcatctaaattataatcattaactagc

SEQ ID NO: 6822259 - DNA, 59 bp, Homo sapiens
gcctcttgcaaagcggttagcctctctcctcttcgagctgtacctcttcagaaaggggt

SEQ ID NO: 6822260 - DNA, 70 bp, Homo sapiens
attcgaagcttcttagaatgcatgtgccaaacatcttatggaccagtgttgctaggaagctgctttgggt

SEQ ID NO: 6822261 - DNA, 78 bp, Homo sapiens
ggtcgcacccatccttgcagggaaactggacccagccagaccctggctccagccctgagcaagctcttgggagaggcc

SEQ ID NO: 6822262 - DNA, 57 bp, Homo sapiens
ctcttcctcttctgctgagaagtgggggaatggactttggaggtgggagggggaaag

SEQ ID NO: 6822263 - DNA, 57 bp, Homo sapiens
gtaaagagctagtttataacttgtcttcagaattttggatacaagactagcatttac

SEQ ID NO: 6822264 - DNA, 69 bp, Homo sapiens
gcacctatgagaacgggggcgtgtgggacagcccagggccccgcacgacgctttcgttctcgccggtgc

SEQ ID NO: 6822265 - DNA, 60 bp, Homo sapiens
atacatatgtatttgtgtatacgtgtggacccatatacatgtagacccatatatatgtat

SEQ ID NO: 6822266 - DNA, 129 bp, Homo sapiens
tggctaatgacctgtaaccactcccttgcttgctggagtcacttccattgtatttcagaaacaaatatcttttcaagaaaatacagagttgcttaaaagctataggggattccattactccattaacca

SEQ ID NO: 6822267 - DNA, 73 bp, Homo sapiens
gtcttttattctagacacggctgacttcattgctagctctgatgttcagcaatagatctagaggctggaagac

SEQ ID NO: 6822268 - DNA, 65 bp, Homo sapiens
acactgtgagtaactgagatccaatcccattgggatatgcttccaagttattccacccaaagtgt

SEQ ID NO: 6822269 - DNA, 57 bp, Homo sapiens
gcatgcggatctcatcactgtgattacaccgtgttagccacagtgattgttctatgc

SEQ ID NO: 6822270 - DNA, 96 bp, Homo sapiens
gtgacttgctaactgatgagaacagaacagaggccttatgtttcagaaactaatgggaattatggtcactgttcctggggggcttaagcaagtccc

SEQ ID NO: 6822271 - DNA, 128 bp, Homo sapiens
ctgagacggagaaagtggtgtggcagaagaggttgctggtggccatgggtcggggtgcagattatgagagaactctggccagtgactgctcacccggggcagcgttgagtccatcaacaccgttttgg

SEQ ID NO: 6822272 - DNA, 67 bp, Homo sapiens
aattagctttccgccatcacacaattatgcagttccatccatcaagggtgtggtgggaaagtggatt

SEQ ID NO: 6822273 - DNA, 70 bp, Homo sapiens
cagttttgggtgggcaatgttaagacggaggatgtaaacctagtgacagctgcacaccccttcaggactg

SEQ ID NO: 6822274 - DNA, 79 bp, Homo sapiens
cactatggaaaatcagtttgagaaatggcagggagagcaataggaggttgttagatatttcttagaagaagccatggtg

SEQ ID NO: 6822275 - DNA, 77 bp, Homo sapiens
tatgtcatggctgaaattcttcgcttgcaatagattgtgaccctctctaggataagcatattccagtcatgtccata

SEQ ID NO: 6822276 - DNA, 60 bp, Homo sapiens
ttcctcaccagaacatgttgtcccctttcatcaagggtgcagcttctgaaggtgtaggaa

SEQ ID NO: 6822277 - DNA, 89 bp, Homo sapiens
aattgaataaggcaacatatatgtaaagtactttgtatggtatgaactacacattgagtgctccataaatcatagcccttgttataatt

SEQ ID NO: 6822278 - DNA, 72 bp, Homo sapiens
gttaatagctagctgtggcttaaaatattatattgtgagtgttttattcgggagccactgcagttgattaat

SEQ ID NO: 6822279 - DNA, 129 bp, Homo sapiens
gtgtggtggggattggggagcaggacaaggggcaccaggggcaggagggccaggaccctgctttgtacctttgtaggcttggtacctgccctgggccttgcctcgtgccatttgtagaccccaccaggc

SEQ ID NO: 6822280 - DNA, 111 bp, Homo sapiens
gtcatgcaaacttttatgtaactttttattatctatatattttgcacttaatcacatactgtcataggttagggaaatattgtaggttagggatacaggaattaaagtgac

SEQ ID NO: 6822281 - DNA, 56 bp, Homo sapiens
gttcagtttgctacaagcaacatcttcagaagtggcagaatagtggcaggatgagc

SEQ ID NO: 6822282 - DNA, 55 bp, Homo sapiens
tcccgtgtctttttccagccctgagcgaaggctgtggggttggctggcacaggga

SEQ ID NO: 6822283 - DNA, 104 bp, Homo sapiens
actgctttatactgctttgctgccattatattttactgcatgggaggaccacaatctattttatttattagtgaagacatagtcagtttccagttataagcagt

SEQ ID NO: 6822284 - DNA, 56 bp, Homo sapiens
gcacagactgtatcttaatcatgctggaaaccccagcccttaggacagcatctggc

SEQ ID NO: 6822285 - DNA, 67 bp, Homo sapiens
tatcattcatacaagtttgtttcatttcatggtggtattgagatgaaagtagaatgtctgaatgatg

SEQ ID NO: 6822286 - DNA, 74 bp, Homo sapiens
tgaaagattttgagcataaaggacatttgtcacttctggcctgaagcaatagaaactccctatgtaatttttca

SEQ ID NO: 6822287 - DNA, 66 bp, Homo sapiens
aaatctaatgcagttctgggtatttcaacaaagcttttagttgaagtcccatgcatgtattgattt

SEQ ID NO: 6822288 - DNA, 70 bp, Homo sapiens
aagtctttgctactgtgaatagtgccacaataatcatatgtgtgcatgtgtctttatagtagcatgattt

SEQ ID NO: 6822289 - DNA, 72 bp, Homo sapiens
ggcccaggagggggctagctaagtgcctgagatgttcaaagttaccatcataacagctaagtccctttctcc

SEQ ID NO: 6822290 - DNA, 73 bp, Homo sapiens
taatgaaatgtttacgaatataccattaatgaagcaagttgacattaggttgtgctttgtggacatttaatta

SEQ ID NO: 6822291 - DNA, 65 bp, Homo sapiens
tttaggccagatttatttgacatctccactttgatattccacggagagttcaaactctgtctgaa

SEQ ID NO: 6822292 - DNA, 86 bp, Homo sapiens
tctgttccccagtccctgctttcctcagctggcctgattgggggtcttcccagaggggtcgtctgaggggagggtgtgggagcagg

SEQ ID NO: 6822293 - DNA, 74 bp, Homo sapiens
atataggctgatggcttcctgagtctttctacttgatagtgttctctatcctcaggagcttcctcagcccatat

SEQ ID NO: 6822294 - DNA, 59 bp, Homo sapiens
gggctccagaggctcaccctggcctccttctcctggcccagggcagcagcacggagcct

SEQ ID NO: 6822295 - DNA, 76 bp, Homo sapiens
cacgaccatctctccacggcagctctcgggataaattggcctccagaggcagccgggggagaacgagctggtagtg

SEQ ID NO: 6822296 - DNA, 100 bp, Homo sapiens
tctggatcagggtgcttcgcttacatctgcactccaggacagggttatgaatccttcctgtcctgtggacctgaggacgttgaaggaccctcttttcaga

SEQ ID NO: 6822297 - DNA, 82 bp, Homo sapiens
ggaaggcattctcagggtgcccggatcccaggccagggtcaaggtaatggtttggcttcctggcttcactgaggctgcatct

SEQ ID NO: 6822298 - DNA, 76 bp, Homo sapiens
aatgacagctacagggagagcattgccacttggaaacaactttgcagatgttgttcctgcctgtagacaggttatt

SEQ ID NO: 6822299 - DNA, 62 bp, Homo sapiens
ctgtgtgtgtctgcagcatactatataaaataaaggagttttcagggctgctggccatacgg

SEQ ID NO: 6822300 - DNA, 63 bp, Homo sapiens
ccatctgatatgtgtgggctcatacagaaaacatgctgtaatgtgaagacataaatcagatgg

SEQ ID NO: 6822301 - DNA, 69 bp, Homo sapiens
gcaggtctggtgagagaacagttaaagaaacctgaggacccgctctttactctgtcttgagccatctgt

SEQ ID NO: 6822302 - DNA, 77 bp, Homo sapiens
agatgtgtattgatgagcattactctctaactgctcgtgtcaaagcacttggggaggctcatcaatcttgtgcgttt

SEQ ID NO: 6822303 - DNA, 82 bp, Homo sapiens
ggcttgtagatggcttccttctcactgtgtgcttgcctggttcttgtttagttcatgcatggagatagggagactgtgagcc

SEQ ID NO: 6822304 - DNA, 61 bp, Homo sapiens
actgcatcagcccaggtcacgtaatcaagtcttccttgacagcagctctgggttgagtagt

SEQ ID NO: 6822305 - DNA, 76 bp, Homo sapiens
gtgccaacaggactgtcgtctccctgacaccttggctcacatgccacggatgtctctggctgcagcctgttctcat

SEQ ID NO: 6822306 - DNA, 110 bp, Homo sapiens
gtcaggtaagttaataaatatttattgagagtttacattgttcaagcaattgtgctttggacactggagattcgtcagtaataggcacacatggaatttaataatctgac

SEQ ID NO: 6822307 - DNA, 65 bp, Homo sapiens
ggagcactgatacgagtttgactttttcaagagcgcttgaattccaaattgtgtttgtgagctcc

SEQ ID NO: 6822308 - DNA, 102 bp, Homo sapiens
gcgatgctttcccttcttggagagattatcagaccagcaatcttttagaaaaggtccgtaggaattttgtgagctttcccagaagataggtagggtatctgc

SEQ ID NO: 6822309 - DNA, 59 bp, Homo sapiens
cctggcacagggagacagccgtggcctgagtgcccaggctggttcatccctgggtcagg

SEQ ID NO: 6822310 - DNA, 76 bp, Homo sapiens
tgtattctttctgctgttcattcttttagctctgagtatttataagagacttcaccatgaatataggaatggtaca

SEQ ID NO: 6822311 - DNA, 68 bp, Homo sapiens
gcttttagagagagagctgggcactctgtggagtttctttatatgacctgaggccttactctagtggc

SEQ ID NO: 6822312 - DNA, 59 bp, Homo sapiens
tctgcctttcacacagacggccaacctctggaaggaccgggcctctgaggacaaggaga

SEQ ID NO: 6822313 - DNA, 58 bp, Homo sapiens
gcctccagaagcgggagagaagacattcctgttgttttaaactcccctagttggtggt

SEQ ID NO: 6822314 - DNA, 58 bp, Homo sapiens
tcttaatagtgctaaaccattgactatgaaattggtttgagtggtagtattattttga

SEQ ID NO: 6822315 - DNA, 63 bp, Homo sapiens
aggacacagcaggaggttgggggaaaggaatgaggccactccctgggcctcctgctatgcact

SEQ ID NO: 6822316 - DNA, 62 bp, Homo sapiens
gggcaggggcagctcggtggctcctgtgtccctgcctcgggcctgcctgctgtcatctgcct

SEQ ID NO: 6822317 - DNA, 119 bp, Homo sapiens
ttaatgaagtaatattagggtaccttcagataatgacaggtcaggagatctgctctgttcatcttctcttggtacctgacactgtctgtgaatgggccttttgtttatatattcattaa

SEQ ID NO: 6822318 - DNA, 82 bp, Homo sapiens
ctatgagtcataaaccaatggggttggttgggaatttccaagaagttcagtatgacagacgcattggaggtgtggcttggag

SEQ ID NO: 6822319 - DNA, 79 bp, Homo sapiens
gaagaagaaattgcgtcatccttctcaggcagagatgatcttcctgacctgcggggaggagggccgccttttcggcttc

SEQ ID NO: 6822320 - DNA, 65 bp, Homo sapiens
ttcactacctttagctgtagaggttttctcattcctccacagacttcaacagcataatgtaggaa

SEQ ID NO: 6822321 - DNA, 65 bp, Homo sapiens
gggaagggctttctgggagaagagacacttaaaactgagtcctctggactgaggaggcttttgcc

SEQ ID NO: 6822322 - DNA, 67 bp, Homo sapiens
tggccatgggtgggagtgaaggggctcagccttaggggcgggaagtcttttcttccacccaaatcca

SEQ ID NO: 6822323 - DNA, 63 bp, Homo sapiens
tggtaaatgctccaagcagtactgtgtttaaggaacctgttttgcccaatgcagcatttccca

SEQ ID NO: 6822324 - DNA, 76 bp, Homo sapiens
tgtgaagaaaatatgagatgttctctttcgggtcataaggactcactgaagtagtacatgtttatggagcttcgca

SEQ ID NO: 6822325 - DNA, 57 bp, Homo sapiens
ttggaaggcagcatttgtccatggaattggagagagacgggggctgctgctttccag

SEQ ID NO: 6822326 - DNA, 98 bp, Homo sapiens
gaaggctaaggagctaatccattgcacatctgagaagagattggaccttgcaactctttctcatttgctgtagagtctagtttccttgatatgccctc

SEQ ID NO: 6822327 - DNA, 61 bp, Homo sapiens
ctccatctctgtacctcagggggctaaaagtagtaagtgcagagccctgggcacatggtag

SEQ ID NO: 6822328 - DNA, 77 bp, Homo sapiens
ttttaccttcttaggcctggaattctccagctctgaacatagcaggagttaaggataccaggccaaaaagtgtagaa

SEQ ID NO: 6822329 - DNA, 59 bp, Homo sapiens
gcttcacaacgacatctggttagagctcagcttcctctgaccaaaactgttgctgaggc

SEQ ID NO: 6822330 - DNA, 65 bp, Homo sapiens
ttcctttctctgtccctaatcaccctcttctcttggtgatgtgtgggcatgcagacaggcaggga

SEQ ID NO: 6822331 - DNA, 63 bp, Homo sapiens
tggcagtggccctaacaccgtttctcaggattcctttgaacggtaagtgccattcaagagcca

SEQ ID NO: 6822332 - DNA, 60 bp, Homo sapiens
gcctatggatgacaaatattcttctcagattctagcagtagagttactgtcatcctaggt

SEQ ID NO: 6822333 - DNA, 58 bp, Homo sapiens
atgcacattgaaccatatattagtggattatttctgtgatataaagttcagtgttcat

SEQ ID NO: 6822334 - DNA, 56 bp, Homo sapiens
ggagaggaggattctttggcaagaggggaaggactaatgaagcgtcgctcctcttc

SEQ ID NO: 6822335 - DNA, 75 bp, Homo sapiens
tgttttcttctgaggcattaacatataaagaagtttctttgatgaaatttaatttatagatgtggatagagaaca

SEQ ID NO: 6822336 - DNA, 63 bp, Homo sapiens
tcagaagttcatttagcctctctggtttctgaaaataagaggactcagctagatgaattctga

SEQ ID NO: 6822337 - DNA, 59 bp, Homo sapiens
tcacaatctgcctgccagcagtgcttcgtgctctgctgaggcccaggagcactttgtga

SEQ ID NO: 6822338 - DNA, 69 bp, Homo sapiens
ttcagtttccttgagaaaggcacaagttgttacttctggtaattttgcttttacttagagtggactgga

SEQ ID NO: 6822339 - DNA, 57 bp, Homo sapiens
agcagtggctaataacagctaaacagtccatctagattgttgctgtaagcctttgct

SEQ ID NO: 6822340 - DNA, 95 bp, Homo sapiens
gtctggtcaaaattctgtcattaaattgtggccaactcaattgatctctttgagcctcaaggtcctcaactttgacatgggagggttggaccgac

SEQ ID NO: 6822341 - DNA, 91 bp, Homo sapiens
gattctgactatatttcccttgactcgtttatatattggtattaagcccgttctggagctgtggtcaacaggaaattttattcagtttatc

SEQ ID NO: 6822342 - DNA, 69 bp, Homo sapiens
gcactgtgagcagggaagtttctgtctctggaaatacaatcaaaacatgtgcttttattgctcaggtgc

SEQ ID NO: 6822343 - DNA, 82 bp, Homo sapiens
ttataactttatttgatgtatctgacgatcagggattagttctcatccacattgactgtctgtagatttttgaaagtggtaa

SEQ ID NO: 6822344 - DNA, 79 bp, Homo sapiens
ccctgggttctgtccaggcgcccagctatggcgcccggccggtcagcagtatggttagcgtctatgcaggtgcccgggg

SEQ ID NO: 6822345 - DNA, 85 bp, Homo sapiens
gggcacgggcagggctcagccgctcccacctccccacagaagcccaggagtgtgtggacgtctgagcccagctttctgcgtgccc

SEQ ID NO: 6822346 - DNA, 129 bp, Homo sapiens
tggacatgtgttttcatttcttttggatgtattcctagcattgcagttgctgggtcatatgtaaatatgtaactttacatttaacctttgaggaactgccagagtatttccaatggctgcaccagtcta

SEQ ID NO: 6822347 - DNA, 80 bp, Homo sapiens
tgcaatgttgggttgtaagagagtgcactttaaaaccatggatagaaatagaggtaactttgcttacatcttcatgtgca

SEQ ID NO: 6822348 - DNA, 55 bp, Homo sapiens
cagaaagcttggtacaatatgctgatttctattgcttttctgtatttgctttctg

SEQ ID NO: 6822349 - DNA, 59 bp, Homo sapiens
gtacagcctgatttggagccactgttacagtgtgtgcattggctcctagtcagctgagc

SEQ ID NO: 6822350 - DNA, 60 bp, Homo sapiens
ttggaggggccactgcagagctcgcggtccttgaggacacggctggcggtgcctttccgg

SEQ ID NO: 6822351 - DNA, 72 bp, Homo sapiens
tgagctcataaatatattgggttttagtgattgctgtagtaattgctgtagctactatgtattcattgctta

SEQ ID NO: 6822352 - DNA, 106 bp, Homo sapiens
tctgttagacagctggtagagtacattttcttaaatatttgcaggacatagccatgtgttagttgttcatgttaagagtagcctgtgccactgtttcctagacaga

SEQ ID NO: 6822353 - DNA, 73 bp, Homo sapiens
ggaaaacctgtagttttcttaccactatgaaatgaagccattggatagacataagaaaaattttaggtcttcc

SEQ ID NO: 6822354 - DNA, 55 bp, Homo sapiens
ctcccttgcttctggcattttgctggcctcagccaatgggaggccccagcaggag

SEQ ID NO: 6822355 - DNA, 113 bp, Homo sapiens
tttggattttaaaattaagaaaatgactgtgtaggtgatatcagcaagatggcagtataggaatttctagccctgattccctcacagaaacattaatttgacaatgaaccaaa

SEQ ID NO: 6822356 - DNA, 72 bp, Homo sapiens
ggctttatgtgtcctcaagagcaatgattttgcaaattcagaattgctacttcctcaggaaaacttgaagtt

SEQ ID NO: 6822357 - DNA, 59 bp, Homo sapiens
ggaaagaggacagctctaactaaagtcaggactattgctatgttggacatgcctcagcc

SEQ ID NO: 6822358 - DNA, 63 bp, Homo sapiens
gcttattctcatctagaggctgtggcagcttgcccatgaaacgatgtctctgtgggaattggc

SEQ ID NO: 6822359 - DNA, 56 bp, Homo sapiens
tctatgaggaaggtgcaaggaagccacaaaatacttccagggctaattcctgtgga

SEQ ID NO: 6822360 - DNA, 81 bp, Homo sapiens
gtcatttctagagaagactgctgagagaatggaaatgagcttcgtttcttgaatctaatgcagtttctcagcaggaaaaac

SEQ ID NO: 6822361 - DNA, 72 bp, Homo sapiens
ctgagggaggcctccagccacatgccagtgaggaactgaatcctcagaaagcaactgaaggccttagttcag

SEQ ID NO: 6822362 - DNA, 55 bp, Homo sapiens
tggtctgatttctttctggagttcacttcctccatggggtgctgaagttagatca

SEQ ID NO: 6822363 - DNA, 70 bp, Homo sapiens
tggacattagtagcttgctgtgtgattgttaattccaatcagtttacattaggtcaagctgccaagttca

SEQ ID NO: 6822364 - DNA, 76 bp, Homo sapiens
cccctaggctgctgctaccaccctgaaagtgccagcctgtctgcagggaggccccgcagccctcaagccccagggg

SEQ ID NO: 6822365 - DNA, 62 bp, Homo sapiens
tttcacattttatacttaagcctattttccattttgagttaatttttgtatgaggtgtgagg

SEQ ID NO: 6822366 - DNA, 100 bp, Homo sapiens
ggaaagagtctgtgctagggcagaagagtggggtgcagtctcccagagctgaaatagcaccttaactctgctgcgtgatccttagacatttaatctttct

SEQ ID NO: 6822367 - DNA, 80 bp, Homo sapiens
ggccttcatgggagcccagggcacctgcttctccacccagcacgctggtctgctttgccctgggctttgctatgactgcc

SEQ ID NO: 6822368 - DNA, 80 bp, Homo sapiens
ttcccgcggcccttgcctcccgggagcggctcccctctgacgactgagtggactgcgcttgagggggccgccgctgggaa

SEQ ID NO: 6822369 - DNA, 90 bp, Homo sapiens
ccttccaatattttggctacttcatggtccatgtattttttagatgacagagcattgcacgacatgagaggctgtggagtacaaggaagg

SEQ ID NO: 6822370 - DNA, 64 bp, Homo sapiens
cctgagtgcaagatgacggtggcagacacgtacaaagacttccccaccaggtcttctgctcggg

SEQ ID NO: 6822371 - DNA, 68 bp, Homo sapiens
gtaaattgttggcctttaaactggactttctgaatcagaacctcctgagatggagtcctgcagtttat

SEQ ID NO: 6822372 - DNA, 122 bp, Homo sapiens
cgcttgtttgcagacgaggacgctgaggaccaaagagaagggacttgcccaatttggagcatttgggcttcaactttggccccttcctagctctcagttttctcatctgtaaaatggaagtg

SEQ ID NO: 6822373 - DNA, 80 bp, Homo sapiens
tccccactggagagctgcagaggtgcaatgaaccagcaaggggagttctgctgggtttgcctttcaccatgccaggggga

SEQ ID NO: 6822374 - DNA, 85 bp, Homo sapiens
tcctttgagatatggtttcttctttcatttaagagctgttattttgcttggtttcaaagatgataggaaatcatagtttagagga

SEQ ID NO: 6822375 - DNA, 67 bp, Homo sapiens
caagtatttgcggagttccacgtttgccagctaggatcaaatccccgtggtagctagccaatacttg

SEQ ID NO: 6822376 - DNA, 62 bp, Homo sapiens
gttctagacaccagggattcagcagcaaactgaatagataaaaattcctgctgtcatggaac

SEQ ID NO: 6822377 - DNA, 64 bp, Homo sapiens
tgccctctgcaggccgccatgggaagtgcacactgcatcccctaggcaggattgtaggcgggta

SEQ ID NO: 6822378 - DNA, 66 bp, Homo sapiens
gcagataaatgtgaaatgagcagttatgttgtaagtaagacatgctttgttccatcatttgtgggc

SEQ ID NO: 6822379 - DNA, 58 bp, Homo sapiens
tctgtccccacagagaaggctggggctggagtccgacagctggcgcctggggaccaga

SEQ ID NO: 6822380 - DNA, 73 bp, Homo sapiens
ggggatatatcgtgttcctgggttgagaggattctttcaacacaggaacatgatataaatgtcagtcctcccc

SEQ ID NO: 6822381 - DNA, 72 bp, Homo sapiens
tgaaaggctgaggctcatgccatcttggcatgctttaggattatggcaaggaggtaaaagtccattttttca

SEQ ID NO: 6822382 - DNA, 129 bp, Homo sapiens
ctaattatgtgtgaattgtgcagaattcagggaagcttataagttttcatgctcaattgtgaatagtttgttttcacagatagtatgtaaattaagcaaccaaaaatgaattccttatgcatcatctgg

SEQ ID NO: 6822383 - DNA, 81 bp, Homo sapiens
tgggtggcagagggagagaaggaggaggatttgacccatttacgttaaatctcatgagcttcttgtcccaacaattaccca

SEQ ID NO: 6822384 - DNA, 94 bp, Homo sapiens
ggttggaagctgagggaccttgccggctctgagctcagcgtcagagtttagcaaacagtgaagcgtgctcggtgcagggttcggcttgctgact

SEQ ID NO: 6822385 - DNA, 65 bp, Homo sapiens
ggtgggtggatggagagaggcccccagcctaaggacccaggctcctgccttcccaccacccgtcc

SEQ ID NO: 6822386 - DNA, 56 bp, Homo sapiens
gctcagggctgggagctgttgttgctgctggcagcccagctgctatgtacctgggc

SEQ ID NO: 6822387 - DNA, 56 bp, Homo sapiens
tcatcctcttgccccttgattttctcctgagagtctgacttggccaggagctgtga

SEQ ID NO: 6822388 - DNA, 74 bp, Homo sapiens
tagaggttatttctgtatgcataaaaggaaaaaaaagtttgttttatgtcctttgtatgtgatatggatcttta

SEQ ID NO: 6822389 - DNA, 81 bp, Homo sapiens
gagccaagacaatgagtggaatcaggccgtgcgtggggccaagataaactgtgctaatgtcctgaccgttctggatggctt

SEQ ID NO: 6822390 - DNA, 57 bp, Homo sapiens
gtgatgataagtctttagacaggttcatattgtcctgtcatctgaatttctcatcac

SEQ ID NO: 6822391 - DNA, 61 bp, Homo sapiens
atgaggcctttcttcaccctttcttggtggcttgccttgagggtgttaggagatggtccat

SEQ ID NO: 6822392 - DNA, 69 bp, Homo sapiens
acactgtgtctagcattttacaggggagcaataatgtttgttcataaaaggatagcagatggatggtgt

SEQ ID NO: 6822393 - DNA, 130 bp, Homo sapiens
ctcactgaagttccctttctgggacagtcctgtgtgttcacatttgctgggacaaaagtgagtgtaagcagtgagtagtgaacagccacaggattttaatcaatcctgtgaagagggaaactttccatag

SEQ ID NO: 6822394 - DNA, 83 bp, Homo sapiens
tatgcaaagtcctaagaaagaaatgcaagagggaaggccagaaaaatgcatatattctttattagtttagtgagctttgtgta

SEQ ID NO: 6822395 - DNA, 94 bp, Homo sapiens
gggctctggatgagtaagagccaaggcctcagtctcaaccgtaaaatgacaagctggttctggggctaaatggcactgcctaaatccagggctc

SEQ ID NO: 6822396 - DNA, 73 bp, Homo sapiens
gtgccaggagtggagacaggacagtcgatacaagaggggcccctgtcatgtcagctgctgagtcccctggggc

SEQ ID NO: 6822397 - DNA, 71 bp, Homo sapiens
ctgcttgggaaagctgcagaaattctcaggacttggaggcttgaaatgctcaggggttttccagaaagcag

SEQ ID NO: 6822398 - DNA, 77 bp, Homo sapiens
aatgcagataagaatcaggtttgataaatgagggaaaacaattttataggataaaccaatgatttaaaatctgtatt

SEQ ID NO: 6822399 - DNA, 87 bp, Homo sapiens
aatctcacatgggcacgtgctttcttggaccattcctgccaccattgcaagtgggtcttctggaaagcagactgtgaaatggagatt

SEQ ID NO: 6822400 - DNA, 60 bp, Homo sapiens
gcagggccgggcacgcagcaggcattcatggagtgctgctgatggatgcctggaccgggt

SEQ ID NO: 6822401 - DNA, 64 bp, Homo sapiens
atcactctgcatttttgacccttaaaaacaacactgacttggggtcacaggggagaagagtgat

SEQ ID NO: 6822402 - DNA, 62 bp, Homo sapiens
ccatgttagtctgctctagctgccataaaataatatcacagactgagtggattaaacaatgg

SEQ ID NO: 6822403 - DNA, 59 bp, Homo sapiens
tcgcggataagcagtgaacggtctatgaatggtgagggcaataacgagcttgtctctga

SEQ ID NO: 6822404 - DNA, 58 bp, Homo sapiens
acccaggctggagtgcagtggcgtgttctcagctcactgcaacctccgcctcccgggt

SEQ ID NO: 6822405 - DNA, 62 bp, Homo sapiens
ccctcagctgccccagtggccccagcatccactgcttgggggcggtggggtcaggtgcaggg

SEQ ID NO: 6822406 - DNA, 66 bp, Homo sapiens
gctgtaaacccaggtggacaaggctttcacactataaagtaagctcaaagtctaacctggcacagc

SEQ ID NO: 6822407 - DNA, 63 bp, Homo sapiens
gcaacagcattctcattgacatttggggccagataattctttgttgtcaggggtgtgctgtgc

SEQ ID NO: 6822408 - DNA, 71 bp, Homo sapiens
aggtaagttgccctgaagaacgtcccagattttgaaattatctgtttgcttcttcatggtatcacttgtct

SEQ ID NO: 6822409 - DNA, 75 bp, Homo sapiens
gtccttttggcctgggaggctgaggttgcagtgagctgtgatcatgccactgcacttcagcctgggtgaaagagc

SEQ ID NO: 6822410 - DNA, 62 bp, Homo sapiens
taataacactgtaaaaattgtttggcgtagttgcagataaggttaggattatagtgttatta

SEQ ID NO: 6822411 - DNA, 58 bp, Homo sapiens
cagcttgcttcacagctcagcttataggtgtccgagctgagatttgaagcaagttctg

SEQ ID NO: 6822412 - DNA, 111 bp, Homo sapiens
ttggtcttaaggttcaatcaaggatgtctgctcacttttcttgctatctctgtggttctgcaaggatatgggtagtatgatgtcatagattgaccatttgttaagacacaa

SEQ ID NO: 6822413 - DNA, 69 bp, Homo sapiens
gcttggtagatttgagcgtgagtagctgacaaatgttatcaattttatgcagtcgacatctgatcaggt

SEQ ID NO: 6822414 - DNA, 83 bp, Homo sapiens
catctctagtgcatgctgccacctgtggtagtctgtagttactgtcagtcaccaccaggtggcagtattgttgaatagaaatg

SEQ ID NO: 6822415 - DNA, 74 bp, Homo sapiens
gtaatagttttagcaaaggtgtcttgggcatattatcaagatgctattagaagccatgctgttttcattgttat

SEQ ID NO: 6822416 - DNA, 77 bp, Homo sapiens
tttctgacggctccccaaagataacggcttcttcttttttgcaagccagcaagctgttcttggagagtacaaagaga

SEQ ID NO: 6822417 - DNA, 82 bp, Homo sapiens
ggaagcaaggaatgaattctacatgcatcctagtttttcctgttgtaaatgaggagtatggtggggtcattctttggcttct

SEQ ID NO: 6822418 - DNA, 80 bp, Homo sapiens
ttgaggttgaacaagaccatagatatcgcagaagcaatcttactacagaatacttctagatttttgtaattgttccccaa

SEQ ID NO: 6822419 - DNA, 60 bp, Homo sapiens
ggaactcagtatcagactccagagggctttgggatctggagtcatgactgcctgagatcc

SEQ ID NO: 6822420 - DNA, 63 bp, Homo sapiens
ttgcagttttctggagggggttgcagtcaaggacttgccctgcccctcctgctagatatgcaa

SEQ ID NO: 6822421 - DNA, 68 bp, Homo sapiens
gcttacctctcttgaaggcccaccgcttcagccacagcttggagaaggccggccaggagtggttgagc

SEQ ID NO: 6822422 - DNA, 55 bp, Homo sapiens
tggcctcaaccgtcctaagcacacgtgtgctagaaaaagggagagttgggtgtca

SEQ ID NO: 6822423 - DNA, 83 bp, Homo sapiens
gcaggcttctgccactgggtgagttgatgaaggagatgatgtctcctctcataatgctgcaccaaacagatggaatggcaagc

SEQ ID NO: 6822424 - DNA, 77 bp, Homo sapiens
ctgttacaaaggagtagagaaggcttttcttcttcagtcttagtacagaggcttttaatcttagtctcttgtgatag

SEQ ID NO: 6822425 - DNA, 83 bp, Homo sapiens
agggagaggtggggtgagctgcagactacacccacatggctataaatggggagcctctggctgctgctcactcagcctccctt

SEQ ID NO: 6822426 - DNA, 62 bp, Homo sapiens
gatgattgatggtgatagtgctgtggttaatggacataccactgtatttcccatcacttttc

SEQ ID NO: 6822427 - DNA, 72 bp, Homo sapiens
ggcaaggggatgggctcttcagctttgatcagggcagcagcctggaggactgaggggacccagaaccttccc

SEQ ID NO: 6822428 - DNA, 81 bp, Homo sapiens
acctgttatttgtggtgctgatttgttgctgagatttagattttcatgtgtgttactcaagagatagctttaaatgcaggt

SEQ ID NO: 6822429 - DNA, 68 bp, Homo sapiens
gcagttctagcatgccttttagcacatacttactgattatgtgccagaaaatatgctgaggatacagc

SEQ ID NO: 6822430 - DNA, 68 bp, Homo sapiens
catgtagagtccattaatgcaagtttctttaactttgtgtttatgaaataggcaaatgcttctgggtg

SEQ ID NO: 6822431 - DNA, 61 bp, Homo sapiens
ggtctcagcaggggtgtcattgtagttatcccctggtagctcctgcagactcctgctcacc

SEQ ID NO: 6822432 - DNA, 55 bp, Homo sapiens
gttgattccggggccatttcaacgtgcagaggcttgggatgggtctgggaccagc

SEQ ID NO: 6822433 - DNA, 61 bp, Homo sapiens
tatttctggtcctccttagcattgggttaaattagcacctgcatgcttgaggtcaggtgtg

SEQ ID NO: 6822434 - DNA, 80 bp, Homo sapiens
tacttcttctggtgctattcttttcattctgctgtctgagttttccagcactgtcttctgagagggcattataggaagtg

SEQ ID NO: 6822435 - DNA, 104 bp, Homo sapiens
acctcagtctgaacccatataaatcttggacagactaaaattgcacagtgggatcatttcattcacatgagtttgccaatatgtgggtattaacaggcaaaggt

SEQ ID NO: 6822436 - DNA, 56 bp, Homo sapiens
gcaggtctagaagctgcctctgaaccacatcacactgtgcatgcttgtggagttgt

SEQ ID NO: 6822437 - DNA, 112 bp, Homo sapiens
aatgcatcaggcgttttaagaatgaagtgaaagtaagaaagtaggactgcccaatggaggacagtcttccaagagttatatttctctcttttttctaaatgcctatggcatt

SEQ ID NO: 6822438 - DNA, 68 bp, Homo sapiens
tagttttacttatcttttggttatcacagttaaaacaaactatgctaactgggggaaaagagatcctg

SEQ ID NO: 6822439 - DNA, 75 bp, Homo sapiens
ctttgtatttactgattttaaacttacttaagccttgtttcaaaaaaggcctaagtggttaaatggcttacaaag

SEQ ID NO: 6822440 - DNA, 56 bp, Homo sapiens
ctggggacgtcgggcagtgttctgaacagcgggagccagtgcctcaacttccccag

SEQ ID NO: 6822441 - DNA, 72 bp, Homo sapiens
aagcaagggagacagcagaaactagagcacttgagtaaaagctggatgcttaggtccctgttgttcatgttt

SEQ ID NO: 6822442 - DNA, 58 bp, Homo sapiens
taacatgttcaatgcatgtctgtatcattttcaagatttacatgcatatggacagttg

SEQ ID NO: 6822443 - DNA, 58 bp, Homo sapiens
aggcagggctgctgaggaagccttgcggagccctgcaagtgacctcagcatgttccct

SEQ ID NO: 6822444 - DNA, 68 bp, Homo sapiens
agttgaagcagggtggccagattgtcattcttttggtatcctaggtagacaatgatggtgtttcagct

SEQ ID NO: 6822445 - DNA, 74 bp, Homo sapiens
agtagtcacttaataggttcatctgaagaaggaatcatttattcattgcagaaatatttattgagtgacatact

SEQ ID NO: 6822446 - DNA, 55 bp, Homo sapiens
caaccgggtagtttctttttagagaagcagaaaactgaagaggaggagcaggttg

SEQ ID NO: 6822447 - DNA, 78 bp, Homo sapiens
tcagatgattctcatttgctggctatatgatgtcctgctctggaaaagcatgtagcttagaaatgagactgcatgtga

SEQ ID NO: 6822448 - DNA, 72 bp, Homo sapiens
agcaatagattccagtgtgcttccttgctacacataattttgggatgacaatggggcacatggaaagtagct

SEQ ID NO: 6822449 - DNA, 59 bp, Homo sapiens
agtcagttgcagtttatggatgattcggttatggtttactctgtatgcttgcactgatt

SEQ ID NO: 6822450 - DNA, 68 bp, Homo sapiens
gtgggatgggaggagagactgacctgggagccacttcagaacatccttcctccttttctcccacccac

SEQ ID NO: 6822451 - DNA, 79 bp, Homo sapiens
cactaagtaatttccactcctacgtattttgatatagagatgttgctatttttctatttacagtgctaggtacatagtg

SEQ ID NO: 6822452 - DNA, 69 bp, Homo sapiens
gtctcgcccgccctgcctctcgggctctgcccagcttcctgagtcctgacagagcacagtgggggagat

SEQ ID NO: 6822453 - DNA, 98 bp, Homo sapiens
tcaaggtttaaagggtatggctcttgaaaattggaacacagaagaaaaccagcctcatctgagtgaaatatttcaagaattgccttctcagaccatga

SEQ ID NO: 6822454 - DNA, 110 bp, Homo sapiens
taatacatcctggcatatttgcatcaatggaatgctctacagttatttttaaacaatgatagagactatagagcacttacttgggatgaaaagatgcctgcaatatattg

SEQ ID NO: 6822455 - DNA, 66 bp, Homo sapiens
gttttccttggtattattagacatgggtgttataaccaatctgtttcaacaatgcttagagaaaac

SEQ ID NO: 6822456 - DNA, 57 bp, Homo sapiens
attgttgctttattatctctaggttctcctccttccctggagtctgggggtggcagt

SEQ ID NO: 6822457 - DNA, 59 bp, Homo sapiens
cctgttatacctgagccacaaagctgcacagctttgtaccagccacatatgaaaacagg

SEQ ID NO: 6822458 - DNA, 60 bp, Homo sapiens
ctcctgaccttgtgatccgcccgccttggcctcccaaagtgctcggattacaggtatgag

SEQ ID NO: 6822459 - DNA, 67 bp, Homo sapiens
gagggtgacggtgggggtagcaatggtgtggaggacataacactgctaaatctccatcgattacatc

SEQ ID NO: 6822460 - DNA, 76 bp, Homo sapiens
ctactctttattattgtgagtataactgcatttaaatgaacaggataaatataagagcagtctccataaggggtag

SEQ ID NO: 6822461 - DNA, 58 bp, Homo sapiens
ccaagacgggctggctcggacttggccaaccgctatgtccagagccggcctgctgagg

SEQ ID NO: 6822462 - DNA, 56 bp, Homo sapiens
ctctgtgcctcagttttcttctctgtaacaaagagagtagtaccgaccgcacaggg

SEQ ID NO: 6822463 - DNA, 57 bp, Homo sapiens
gctgtgtacattgtcactcatcaagtttacgaaagagctaggggacatgtgcaaggc

SEQ ID NO: 6822464 - DNA, 114 bp, Homo sapiens
agcagaggaaattcgaggtatcggctttcagtataaaatcaaagtgatgtgtttcagaacagattttgacgttgacatgactttctagttgacttttttagtattcctcttgct

SEQ ID NO: 6822465 - DNA, 76 bp, Homo sapiens
ctttggttttattttcaatcattgcaaagtaatggaaaggttttatgcaaggcaatagattgaatttgtgccttag

SEQ ID NO: 6822466 - DNA, 55 bp, Homo sapiens
tcagtgcattgttcattgtaggcactcggtttacgaattgaataatagtagctga

SEQ ID NO: 6822467 - DNA, 78 bp, Homo sapiens
gcaacctcaggcataatctcatcttgtttctattacaatttcaaattctggaaaaaggaagttgtggtctggagttgt

SEQ ID NO: 6822468 - DNA, 77 bp, Homo sapiens
atgcatagtgcagtggactgagttaatacttgggttctatttctactctgcttttgacctagtcattgatcatgcat

SEQ ID NO: 6822469 - DNA, 81 bp, Homo sapiens
taaaatgggcatgatagtggcatttatggcacagcactgtggtgctgctcaatgagatgccatctgacgtataacattttg

SEQ ID NO: 6822470 - DNA, 55 bp, Homo sapiens
gctagagaccagaggccttgaaggaaggaagcccaagggtctctcctggctctgc

SEQ ID NO: 6822471 - DNA, 87 bp, Homo sapiens
acgtagaagtaaagataattttcttccaggtagatgctttagttggataaagaggaagattatctactttatggccaaattctatgt

SEQ ID NO: 6822472 - DNA, 70 bp, Homo sapiens
ggctgtgcagaggtgagaatccaacctcccaccctgggtctgcggtctctttggttctccttccacagtc

SEQ ID NO: 6822473 - DNA, 55 bp, Homo sapiens
ggtggagcctccagtctttctagaaccaagttctacatgattagagtctctgacc

SEQ ID NO: 6822474 - DNA, 111 bp, Homo sapiens
atgcagagttaaagttagaggagattgctgtttgtgataatgacatttccttcacttctgttgaaagctattcaacacgaacatgtgactcttttactaattgtaatgcat

SEQ ID NO: 6822475 - DNA, 67 bp, Homo sapiens
ttaccagcctcagttgtgagcccccctgggctgtaacaggacctgggctggctctgtggtgtggtga

SEQ ID NO: 6822476 - DNA, 92 bp, Homo sapiens
gcagtggggccaagagtgtttcagtcttcctagatcagccacactgccatcaaggtctggagggcacctgaggcaccaagggtcccaaatgc

SEQ ID NO: 6822477 - DNA, 82 bp, Homo sapiens
gggagtgaataaatgtataaccataggaaattttaagtataatcacccttagaatttgttagattatcattacttgatttcc

SEQ ID NO: 6822478 - DNA, 87 bp, Homo sapiens
cgcgcgggagctgggcagaggcaggataagaactgcggatgaggccgagcgcagctcttaccctccccttaccctccgctccccgcg

SEQ ID NO: 6822479 - DNA, 76 bp, Homo sapiens
cctgggcaagtcttggtccctctctgggcccctttgccgtaggtccctggtggggccagacttgctactttctagg

SEQ ID NO: 6822480 - DNA, 56 bp, Homo sapiens
gcattcaggaaccggaagggtagaaacacaaagaattccggtgcttcctgggctgt

SEQ ID NO: 6822481 - DNA, 74 bp, Homo sapiens
tgtgttaccaaccctgaagaaacttctaagtgggagaactccccaggaggatgattttaagaggccggaacaca

SEQ ID NO: 6822482 - DNA, 56 bp, Homo sapiens
ggatggcaagcacataataaatgctctctgaatagcaattattggtgctgctgttc

SEQ ID NO: 6822483 - DNA, 76 bp, Homo sapiens
atttctccacctcatttgaagaacgagcttcgtagcccacggagctgaggttagtataaatgtggaagggagaagt

SEQ ID NO: 6822484 - DNA, 59 bp, Homo sapiens
gacagcttggaaagtgtgtgtgtgtgtgtgtgtatcaacacatatatgtcgaagtcctc

SEQ ID NO: 6822485 - DNA, 97 bp, Homo sapiens
gcactgtttccagagccagtcactccagcctgcctcagtgcacacctgggcaccaggcaggtgtctggaagtgactcattctctaaagaacatttgc

SEQ ID NO: 6822486 - DNA, 82 bp, Homo sapiens
taggacacttgttcatttgcaacaaccaaatatgggccttttagtcactatagatggttgtcgcaaatgaatgattgttttg

SEQ ID NO: 6822487 - DNA, 83 bp, Homo sapiens
ggattgcttgagcacaggaggttggggctgcagtgagctgtgatcatgccactgctctccagcctggatgacagagcaagacc

SEQ ID NO: 6822488 - DNA, 70 bp, Homo sapiens
gccaggaagtccacaccagctgggacttggggacagtagacagctgatgatgggcccagggtttcttggt

SEQ ID NO: 6822489 - DNA, 74 bp, Homo sapiens
tctagagccactgttgggcactttccttactggccttgacctgtctgggatatcgcctaccagtagtctccaga

SEQ ID NO: 6822490 - DNA, 56 bp, Homo sapiens
cacatggattcgtgcatcaaacactattgagtgcatattgcatgccaggttctgtg

SEQ ID NO: 6822491 - DNA, 62 bp, Homo sapiens
tgagtctgtcaaaacaatcctcttgtccaagcttccagagccaagaaattgtggtagactca

SEQ ID NO: 6822492 - DNA, 62 bp, Homo sapiens
cttctcttcctctcctcactgagccctcaagctggaggctctatgcatgggagcaggagagg

SEQ ID NO: 6822493 - DNA, 82 bp, Homo sapiens
gaaggggcatcctgcagctcctctgtcagagggattcctgccggagcacctcctggcagagagcatgaggcccggccaattc

SEQ ID NO: 6822494 - DNA, 68 bp, Homo sapiens
ttcctcagttcagaaggcagcaaatgaaaaccacgcttgtgattcctcattctagtcttcaaggggaa

SEQ ID NO: 6822495 - DNA, 100 bp, Homo sapiens
acacatatgtgtgtgtatatgtgtatatatacacatatgtgtgtatatgtgtatatatacacatatgtgtgtatatgtgtatatatacacatatgtgtgt

SEQ ID NO: 6822496 - DNA, 94 bp, Homo sapiens
aaaggcaaaagatacgggaaaatgtagaagtgggcattatagaagaatccaaatgtgtctaatgtcttcttcatactaattccttctagccttt

SEQ ID NO: 6822497 - DNA, 67 bp, Homo sapiens
ttaaatgataatgttatgtctggggtattttcagagagcaattttcccataaaaacattgcatttga

SEQ ID NO: 6822498 - DNA, 63 bp, Homo sapiens
gctctggccatagagtgttcctggagtgcccccaccgactctgagtgagcacatggttagagc

SEQ ID NO: 6822499 - DNA, 98 bp, Homo sapiens
gtgaggcagagagtgggaaaacgcagggaatgtgggcacttatgtcggttaaggtgtcaaattttacatgtctgggttttgtttccaccaggctccac

SEQ ID NO: 6822500 - DNA, 84 bp, Homo sapiens
ctgcgagggagctgtagagcagggagcaggaagctgtgtgtgtccagccctgacctgtcctgttctgcccccagcccctcacag

SEQ ID NO: 6822501 - DNA, 76 bp, Homo sapiens
acggaggccctgacacacaccgaagactcatttacagtgagagtgaagctttcctgtggtcaggaaatacttctgt

SEQ ID NO: 6822502 - DNA, 56 bp, Homo sapiens
ctgtcccagccccgtactctaacaatgttgaagttagggtctccggcgcggcacag

SEQ ID NO: 6822503 - DNA, 67 bp, Homo sapiens
cacctttaggcctggctggatctgccaccgccctcctgggggtcacctttccagcaggtctgaggtg

SEQ ID NO: 6822504 - DNA, 78 bp, Homo sapiens
gcccggattttggcggactgagaacgcgggccacgtaggccttggcctgcgcgtctgggtctgtctctgactctgggt

SEQ ID NO: 6822505 - DNA, 79 bp, Homo sapiens
cggcggggcggagggcgacagggcgaccgcgcgccctctgccgggacgcccgccctgccctgccccgccgccgccgccg

SEQ ID NO: 6822506 - DNA, 59 bp, Homo sapiens
ctggcaggcactcatgaaataagctgaattgtgtttaattaggtttggggctttgccag

SEQ ID NO: 6822507 - DNA, 56 bp, Homo sapiens
ttctgtcatcctttctagatgtgagaatttaggttcatttaggagctatggcagaa

SEQ ID NO: 6822508 - DNA, 81 bp, Homo sapiens
ggttagtataagctgaaggacttggtgatagttgagacagttataacctcaactatctggtaagttctttggaaaataacc

SEQ ID NO: 6822509 - DNA, 71 bp, Homo sapiens
gtgagattagttgatctatatccaaagaattcagacactttttgttgtttttggatctagtcactgttcac

SEQ ID NO: 6822510 - DNA, 61 bp, Homo sapiens
gggtctgagcagggcagtgtccatggagcagtgtgctctaggggacttcactgctcagcct

SEQ ID NO: 6822511 - DNA, 61 bp, Homo sapiens
tggtcttagctggaaggagggatggggaagaaaaggcaatctctcgctctcactggtacca

SEQ ID NO: 6822512 - DNA, 56 bp, Homo sapiens
ggcatccaactcacctgggtatgagtcccagctctgccttttactagctggatgtc

SEQ ID NO: 6822513 - DNA, 115 bp, Homo sapiens
tctgctttatttattctgacatgctgacttgttagtgacagtctgatttctcaaaactagaattttcaggatttaagaggttactcgatgtcagcaagtaataaatgagcgctga

SEQ ID NO: 6822514 - DNA, 70 bp, Homo sapiens
tgcttttcataactgttaagataatttttaaaggaaaacctgagagactgtcacataacagaggaaagca

SEQ ID NO: 6822515 - DNA, 58 bp, Homo sapiens
cttgttttcttctgcagtctatccatctgaattgaaggggagggtggaagaaagcaag

SEQ ID NO: 6822516 - DNA, 55 bp, Homo sapiens
cagcctgctagggcaatgcctttgccttccatagcccctttgtcttagcaagctg

SEQ ID NO: 6822517 - DNA, 58 bp, Homo sapiens
atggaagtcacgccagaaggttgttcattttgcacagcagacattgggtgattgacat

SEQ ID NO: 6822518 - DNA, 100 bp, Homo sapiens
ggagactggacacagcaaagcaggaagctcctgacagagcactggtgccctgcctggcatccctgtcactgatgctcctgccactttgtgccaaatctcc

SEQ ID NO: 6822519 - DNA, 93 bp, Homo sapiens
aggtggaacatatatggctggcatttatatcccagtttatgatttataaagcaagaacaaaattatgaagggaatataagtgctgccccacct

SEQ ID NO: 6822520 - DNA, 57 bp, Homo sapiens
ggagatacacaggcagaaaaagacctttctgggcttctctttatattgtgtgtctct

SEQ ID NO: 6822521 - DNA, 129 bp, Homo sapiens
tattttccatttcgtgaatcataaaatcagaggtttgggctgactacctttaggttcccttacggtgttttttgggaaccgctttggagtcagctatctgctaagtttggaattgccaccacgaaagta

SEQ ID NO: 6822522 - DNA, 63 bp, Homo sapiens
gagccagctggagactggcaggggtactgacacttctccagcctcatctcctggctgtccctc

SEQ ID NO: 6822523 - DNA, 64 bp, Homo sapiens
cagcgtgattgtgactggtatggctgcatggaagcttccctgtggcattaatcataaaatgctg

SEQ ID NO: 6822524 - DNA, 65 bp, Homo sapiens
gtcagggcactgtcacctgatatggaggatgaagccccgtgttgggttagggcactgccactgac

SEQ ID NO: 6822525 - DNA, 65 bp, Homo sapiens
tgatcagtatgttgacttattcttggagcaattttggctctttataagatattaactactgccca

SEQ ID NO: 6822526 - DNA, 62 bp, Homo sapiens
aagtaacacatgttacttctgcctacatttcagtggttatagcaagtcacatggtcatgctt

SEQ ID NO: 6822527 - DNA, 83 bp, Homo sapiens
tgccttgggatatctgtcagcagcttcctgtagtctggctgtcccagtggctggagtgctttgaacaccgattcccagggaca

SEQ ID NO: 6822528 - DNA, 103 bp, Homo sapiens
cccactgggggttgtccataaaatctgacaatcggaatgttctgaccatcttcagaaagcatctccattgtaggtatggggacacaagcgagactgcagtggg

SEQ ID NO: 6822529 - DNA, 65 bp, Homo sapiens
gcatatgttacattgttgcctccctttctgcccttggcctgcaggaggcccagtgaatatattgc

SEQ ID NO: 6822530 - DNA, 68 bp, Homo sapiens
catggtccggagaggtgggggcagcatctgggcccccttgctcagtcaggctccttgcctttcccatg

SEQ ID NO: 6822531 - DNA, 91 bp, Homo sapiens
gtcaatgatagtcaagaaaaggtacgtattctgtgttatttttcactttataaaagtagaataattggattacagtttagactacattggc

SEQ ID NO: 6822532 - DNA, 56 bp, Homo sapiens
ccatcagattagcaaaatccaggattcctatttatcttgttgttaatgaatgatgg

SEQ ID NO: 6822533 - DNA, 61 bp, Homo sapiens
atgctctgggaaagcattgccttgatcaaatgccaaggctgttgcatgccacagatagcat

SEQ ID NO: 6822534 - DNA, 82 bp, Homo sapiens
tggctctaactgtggttctattctagaattcctgaacgtgttccaggagttatggcagaatcaaataagttccttttagcta

SEQ ID NO: 6822535 - DNA, 55 bp, Homo sapiens
aggttcccagttttcttaggggagaaatcctggcagaggtatattgggaggacct

SEQ ID NO: 6822536 - DNA, 58 bp, Homo sapiens
agtgtctgagctatcattaggggcactaatacatttccctagcatggtttcatatact

SEQ ID NO: 6822537 - DNA, 76 bp, Homo sapiens
cttgtgcctcccgggaccatgcactgactaaaggaggagaaggggtcctgccagggcaggtgttggaaggcagagg

SEQ ID NO: 6822538 - DNA, 58 bp, Homo sapiens
tcgtgcagctgggccggctcgggccctgtagactcggccattctggtcttgctgccga

SEQ ID NO: 6822539 - DNA, 81 bp, Homo sapiens
gggtagctgaggggatggtagaccggtgacgtgcacttcatttacgatgtaggtcacccgtttgactatccaccagcgccc

SEQ ID NO: 6822540 - DNA, 76 bp, Homo sapiens
agtatgaccacatggagatttggaaagcagctggatcacataactgtgctgctgaattaaactctatgtggcagct

SEQ ID NO: 6822541 - DNA, 57 bp, Homo sapiens
aggatcttagcacaagacgtgctcattgttactagcgtgtcattgtttctaggacct

SEQ ID NO: 6822542 - DNA, 58 bp, Homo sapiens
ggtgggtcagtagccttgcagaactgtcctgagaagttattgctggtgctggccagcc

SEQ ID NO: 6822543 - DNA, 62 bp, Homo sapiens
ggtaaatgctgagtactggagaggaggaaaggggtgcctgctgctgcctgtgggtgtttacc

SEQ ID NO: 6822544 - DNA, 68 bp, Homo sapiens
gtgtgtccacactcaaatatgtgcgtgtccacactgaccgcccacactaaatatgagcgtgtccacac

SEQ ID NO: 6822545 - DNA, 130 bp, Homo sapiens
tgcagctaagttttttgctgtgtgaagaaagttattctgtactctttgagaagaatgatgcgaaatgctgagattcaacaaggaggatggagaaagtttctaacttcatctggacttcatctggcctgca

SEQ ID NO: 6822546 - DNA, 68 bp, Homo sapiens
aatcttagcaggaatgaagttctgaggtagaaagttatctcataatgttgttatttcagctcaggatt

SEQ ID NO: 6822547 - DNA, 129 bp, Homo sapiens
gaattcctcagctttaaaaatagtggcatctggttccttttccctgaaggtatttactcaagccaaggaatgaagcacctgtgggtgaagagcagatgaaagctggaactataaaagccggagggaagc

SEQ ID NO: 6822548 - DNA, 60 bp, Homo sapiens
agccacttgtgatgctggggaagttcctctacacaagttcccctggtgccacgatctgct

SEQ ID NO: 6822549 - DNA, 93 bp, Homo sapiens
tccacaggagcagctaaagtcaatcacatgcacactgaatggaaaaagaatattaagttgtgacacgtgataaggcagagggcttatgctgga

SEQ ID NO: 6822550 - DNA, 81 bp, Homo sapiens
attgtctggtaattatgtaaagatgctccagtgaaacaccatttttggcttagggaaatatttatatacttaccagatagt

SEQ ID NO: 6822551 - DNA, 99 bp, Homo sapiens
cctggggaattgttagcaatgcagattctcaggcccacagcagacccacggactcagaagctggggtggggcctggcactgtttatcaagccctccagg

SEQ ID NO: 6822552 - DNA, 80 bp, Homo sapiens
cttggcaggcaggtttctggaaaggttttgctttcaaaatcatatataagtagctgggccaggcaacctgacctgttgag

SEQ ID NO: 6822553 - DNA, 80 bp, Homo sapiens
tcctcattgcagatttttcacattcagatatagacttgattcttaaatcagtgtgtcacaaaatatgaaagctgcaagga

SEQ ID NO: 6822554 - DNA, 76 bp, Homo sapiens
gccgggcgggccctggggggagctgcgtccagcagagctgctgggtggttgctcctcccgggctctcatctccggt

SEQ ID NO: 6822555 - DNA, 57 bp, Homo sapiens
gtcctggagcagctggaagatgctgtcattgcactccatgatccagtgttcctggat

SEQ ID NO: 6822556 - DNA, 64 bp, Homo sapiens
aggtaggaatgagcttgtcaagcagcagagctgggtgaaccaagcctgcttgagagtcctggct

SEQ ID NO: 6822557 - DNA, 75 bp, Homo sapiens
gaggtgaatgaatgcagttctctgaagcaaaaaacacaatggttaaaaacagagcaattgcgtcatttgtgcctt

SEQ ID NO: 6822558 - DNA, 75 bp, Homo sapiens
tttgcagttcccataggagataaaacaagtctcttttcaaacatgaagagatttcctatggtaattataggcaaa

SEQ ID NO: 6822559 - DNA, 59 bp, Homo sapiens
cctgtgctggcagacctggagttgttgccacagagggccgataagattgtgagtacagg

SEQ ID NO: 6822560 - DNA, 71 bp, Homo sapiens
tgcttatgtcatgcatttcagagactcaatctgagcaaaaatttctcagtgaagagtataacaaataagca

SEQ ID NO: 6822561 - DNA, 66 bp, Homo sapiens
ttgggtatctattaagaaaacagccatttcatcacggctcgtaaaaattggttcatggatgcccaa

SEQ ID NO: 6822562 - DNA, 67 bp, Homo sapiens
gtgacagcctgcagccccaggtcgctggaggacatgctcagcagactctgtggttgcagagctgtgc

SEQ ID NO: 6822563 - DNA, 69 bp, Homo sapiens
agtgagtgcaagagcgctctctttcattaccttatttccagggtttggtaacagtttttggcacttact

SEQ ID NO: 6822564 - DNA, 58 bp, Homo sapiens
gcatagtcagtaggattctcaattcttaagtttggaggttgggatttctgttgaatgc

SEQ ID NO: 6822565 - DNA, 60 bp, Homo sapiens
agagaaactgatgtcctttgaagccaaccctggccttgaattaggcaaattaatttctct

SEQ ID NO: 6822566 - DNA, 60 bp, Homo sapiens
gcgcctggacttcacttatttgacttttcttttgaaaaattaaattgctagatccagggc

SEQ ID NO: 6822567 - DNA, 78 bp, Homo sapiens
agctcacatctatttctgctaataacaatcccactgctaattatgggatgtggtagttatagtgataagagaggagct

SEQ ID NO: 6822568 - DNA, 125 bp, Homo sapiens
ctaaggatttgtgctgcctgcgacccctctctccccagactctctccatttcctccgtcagaagttggggtaccttgaggctggggttagagtagggaggggacgctggaggggcaaatccaggg

SEQ ID NO: 6822569 - DNA, 102 bp, Homo sapiens
gctcaccagagcgagacattttctgttcaactttggagatttaataatagctttaggatggtcactactggttgcgtggctgaaatgctctggcctgggagc

SEQ ID NO: 6822570 - DNA, 60 bp, Homo sapiens
ctatactttcagggatcatttctatagtgtgttactagagaagtttctttgaacgtgtag

SEQ ID NO: 6822571 - DNA, 103 bp, Homo sapiens
cacaaacccccgcagcccggcctggccagaggcgtgcctgtgcatcccggcaagtgagcgcccagggactctcggccagagaggctgtgagggtggctttgtg

SEQ ID NO: 6822572 - DNA, 79 bp, Homo sapiens
ggacagtggctatggcccaggccaggatccagctttacaccggaagctctcccgcagcctggtgggcccgccctgcttc

SEQ ID NO: 6822573 - DNA, 59 bp, Homo sapiens
agccgctcttggctttgcccagcaccgagaaggcagcctgggcagatggcagtgtggct

SEQ ID NO: 6822574 - DNA, 67 bp, Homo sapiens
gtctagctggggagctagacctcagcacaggcgatactgtcctgacactgtctctccccagctgtgc

SEQ ID NO: 6822575 - DNA, 69 bp, Homo sapiens
tattctgagccaacatgtcaattttgtattgtaaatgtataatgcacatgccacatgtggtacatggta

SEQ ID NO: 6822576 - DNA, 83 bp, Homo sapiens
ggcccaactggcagagctggagggggaagaggagggatggggactgcatccttcttcttcccccttcaggggtcataggggtc

SEQ ID NO: 6822577 - DNA, 89 bp, Homo sapiens
tactttgcagtctgagcttagtgttataactgttctaaaaatgtctcatttggaaggaagagctgtagcctgctctttattgcccagta

SEQ ID NO: 6822578 - DNA, 63 bp, Homo sapiens
aaccccatgctgtgggatgagcaaggggactgccccattgctggtcccctgcagcctgtggtt

SEQ ID NO: 6822579 - DNA, 119 bp, Homo sapiens
gtaaatggttcaagtctacaccaggaataagagctacagccagttctgtttgactctaaaattcagaattatagttgctttttaaagttacctaggacaaatgtaacaggattatttac

SEQ ID NO: 6822580 - DNA, 69 bp, Homo sapiens
tcgcgccccgccctcttgggggcccgttggaggcgagcgtgggcgggccgttaggaaggtggggcgcgg

SEQ ID NO: 6822581 - DNA, 59 bp, Homo sapiens
gcctggtccaaagacaagagttcaggtccccactaagaagctctatgacttggccaggt

SEQ ID NO: 6822582 - DNA, 63 bp, Homo sapiens
tcaaaactcattttggaagtaagcagtgtatcccagggctgaggttccaaaatcaggatttga

SEQ ID NO: 6822583 - DNA, 65 bp, Homo sapiens
ttgcagggtgtgagggacagagggatgaagaataactcctaagtctctgccttacgccactgggg

SEQ ID NO: 6822584 - DNA, 75 bp, Homo sapiens
gcttcccaaagtgctgggattacaagtgtgaggcactgcacccaggctggatccctgcatttttacagatttagc

SEQ ID NO: 6822585 - DNA, 69 bp, Homo sapiens
cctgtttgttccttctactgccctctgagtcaggacaattgaccagcagagttgaggaggacacgaggg

SEQ ID NO: 6822586 - DNA, 61 bp, Homo sapiens
tctgggcgtgtcttccagctggctgtgggctgcattgccagtccagtaagatatggccaga

SEQ ID NO: 6822587 - DNA, 55 bp, Homo sapiens
tgacagtggtgacaggatggggcaggatgcattaccattgtgtatgctatagtca

SEQ ID NO: 6822588 - DNA, 55 bp, Homo sapiens
aggaaggtttgtttctcacttcccagggtatagcccagaggaacattcacctcct

SEQ ID NO: 6822589 - DNA, 61 bp, Homo sapiens
aagtagacagtcatctactttgggaagactaataggtccttaggtaacggctcttctgctt

SEQ ID NO: 6822590 - DNA, 74 bp, Homo sapiens
gctgctcatcgtggtttgccatgcagccaggaaggaggggaccgcctgccttccctgtgggcgccctgagcagc

SEQ ID NO: 6822591 - DNA, 58 bp, Homo sapiens
attgtgctttagatcacagtctttgggaacacaccatggatatgattctggctgcaat

SEQ ID NO: 6822592 - DNA, 58 bp, Homo sapiens
ttcctgctcaatgctgtcgtcgctgtccacggagctactgtcaccatcagagcgggaa

SEQ ID NO: 6822593 - DNA, 73 bp, Homo sapiens
gagattaatcacagaaatgcccattcagccttaattataatgatggtctggcttgcatttctgagattccctc

SEQ ID NO: 6822594 - DNA, 91 bp, Homo sapiens
attagcgaagaaatttccttttctgagagggccaagattacgttttgtgtaatcttgctttccatagaagtgaccactttcaagtactaat

SEQ ID NO: 6822595 - DNA, 58 bp, Homo sapiens
ttgtttttggatgttgtatgtgcatatgtttacgtattgcaagcaattccaaaaggaa

SEQ ID NO: 6822596 - DNA, 103 bp, Homo sapiens
gacaggaatctggtgggcaggtgcacctgagccatctgaacccgttcagagtcaccttttcctcaggatgcctccgttttgctcctaggttacacctacagtc

SEQ ID NO: 6822597 - DNA, 65 bp, Homo sapiens
gggagaggctccatgaccccggcaggctctggccaaaccttgctgcgtttcatggagcccctccc

SEQ ID NO: 6822598 - DNA, 55 bp, Homo sapiens
cagacctcgtgatccgcccgctttggcctcccaaagtgctgggattacaggcatg

SEQ ID NO: 6822599 - DNA, 86 bp, Homo sapiens
atcccacagtgagtagcagagttggactatgcaatagattcctgaacctctttgtatatcacaagactgtgctaggtgctagggat

SEQ ID NO: 6822600 - DNA, 69 bp, Homo sapiens
aagtaaaagctagagaagctgctgtcaactttttacttaaatctgacagtatatctctgccttggactt

SEQ ID NO: 6822601 - DNA, 93 bp, Homo sapiens
tattttattcagccccttagtacatattttcctctttcttttctaactgctcactgtatttgagggagaaaaggaaggggctttattaaaatg

SEQ ID NO: 6822602 - DNA, 55 bp, Homo sapiens
ctggggtggggagaacatgggcacgggaggtggaaaacctaagctccagccccag

SEQ ID NO: 6822603 - DNA, 63 bp, Homo sapiens
taatatgctttgatagtttattacatgtatcaactgacatggttttactagtaaggcgtctta

SEQ ID NO: 6822604 - DNA, 57 bp, Homo sapiens
gcttggctggagaaagttacctctttttatcaaaaatgtgacttagcccagtccagc

SEQ ID NO: 6822605 - DNA, 61 bp, Homo sapiens
gtatgtttctgcccatctctggaaaaacccaggtaggcactggtgggaagagagaacatgc

SEQ ID NO: 6822606 - DNA, 67 bp, Homo sapiens
ccggctggcctgctggcgtccaggctgttcttggtcagtgcgaggggctgctccaggccaaggctgg

SEQ ID NO: 6822607 - DNA, 55 bp, Homo sapiens
agatcaagggagtgctcactctgaacttctctagatggtggcacaaatttgatct

SEQ ID NO: 6822608 - DNA, 66 bp, Homo sapiens
cagcacctgtagaaagcatgtagcctgtatccataggtgggtaccacaatatgtttactgagtctg

SEQ ID NO: 6822609 - DNA, 59 bp, Homo sapiens
ctccgatttcattgacaaacatggctcgtgaatgtgagcctggcacctgcagatcggag

SEQ ID NO: 6822610 - DNA, 98 bp, Homo sapiens
gggaggtcaggggcttctttctggggttggtacccagggcatcatggctctgggcagccgccccataggattgttgcgtgaggctcttgacacagacc

SEQ ID NO: 6822611 - DNA, 55 bp, Homo sapiens
tcttgtgagctgagataaagccttgtctttggtctattgtcttagctgcataaga

SEQ ID NO: 6822612 - DNA, 58 bp, Homo sapiens
ggccatttttgttcttatctctggttcaaggattccttggaaaataacaaagttggct

SEQ ID NO: 6822613 - DNA, 60 bp, Homo sapiens
actttatggatatgcaacattttgtttatcgattgacaaactgaagtatatttagaaggt

SEQ ID NO: 6822614 - DNA, 65 bp, Homo sapiens
ctgtgccaggctgtcaattcacccaggtacctctctgggacaagtggcttggcagcctgtcaaag

SEQ ID NO: 6822615 - DNA, 82 bp, Homo sapiens
tccacactcagacagtcatcagagcttgtctattcacccaaggggtgtgatcctgcagttctgaggctgctgtataaatgga

SEQ ID NO: 6822616 - DNA, 57 bp, Homo sapiens
agcctcacacgttccaacttggctgccttcagcggcatccaggagcagtggtgagct

SEQ ID NO: 6822617 - DNA, 60 bp, Homo sapiens
gggatggggaaagcccaaaacaccctgctggaagcgctgtctcggggctttctcctgccc

SEQ ID NO: 6822618 - DNA, 63 bp, Homo sapiens
taaaggcacaaaatccaagtagcaagcatgaaatgtggtttgcatattaaatcggtgccttta

SEQ ID NO: 6822619 - DNA, 67 bp, Homo sapiens
tttcatttatatattgcttacaagtacgtggtaatttgaacttcagtaggtgatatgtgcaaggaga

SEQ ID NO: 6822620 - DNA, 81 bp, Homo sapiens
ccctaggtgtcctctcaaggagccgagattaccatggctattggtgggctgaggggccttgatgacaggcagcaccaaggg

SEQ ID NO: 6822621 - DNA, 72 bp, Homo sapiens
ttcccagaagcgccttggcatcgccagactccggttctccgcaggtgggagcacccgtggtgcggctgggag

SEQ ID NO: 6822622 - DNA, 66 bp, Homo sapiens
aactacaaccatagacatatactaggcagtactgcaagagcctaaacagtgcatatgggtgttgtt

SEQ ID NO: 6822623 - DNA, 56 bp, Homo sapiens
tcttttctgccacagcctgagccagagtggaagctgggctgtgcagcagagcagga

SEQ ID NO: 6822624 - DNA, 69 bp, Homo sapiens
agattagaagtaacttctgtttgtggttttgctcacttaaagctgcagataggatgttatttcaattct

SEQ ID NO: 6822625 - DNA, 58 bp, Homo sapiens
gaagtcattttaccaagatttgtctttaaaatagctgacaggctttagaaaatgactc

SEQ ID NO: 6822626 - DNA, 73 bp, Homo sapiens
aaagatctccttcctctgagtcagtttggttctgagtttaagaagtcaaagctttcagaggaaagttgttttt

SEQ ID NO: 6822627 - DNA, 56 bp, Homo sapiens
tttgctttaagttccattcttcccgttcctctagaggaaccaggaactaaagcaga

SEQ ID NO: 6822628 - DNA, 118 bp, Homo sapiens
gagagtttacaaacaaacacacagtgtgcagaaagcttaggcaagttggaggagaggagtgtcccctgcaattgcctaattttcatacacaaattacgtggtttccctgtagatggtc

SEQ ID NO: 6822629 - DNA, 61 bp, Homo sapiens
gtgccactggtgtcatataaggggctctgttatctacagaggattccctagtgacctgcac

SEQ ID NO: 6822630 - DNA, 100 bp, Homo sapiens
ggaggcggtcctggtagggagtgcgtagcagggtggagtcgctgtccggtcgcgcttcacttctgctccgccctccctgctccccataacagacccctcc

SEQ ID NO: 6822631 - DNA, 59 bp, Homo sapiens
cactgaagctttcattctcttgtcttccacagactttgagagaaaaatgagcttcattg

SEQ ID NO: 6822632 - DNA, 62 bp, Homo sapiens
ggtaatggtgttccaggcttctcccttccaacagagagaaaccgattctgcatgtcattact

SEQ ID NO: 6822633 - DNA, 73 bp, Homo sapiens
tcacacatgagtaaatacagggaggtttaacataactttattatcttgctgtcttttcttctcattgatgtga

SEQ ID NO: 6822634 - DNA, 97 bp, Homo sapiens
tagcttttttacatcccctcttcatcctcctgcagagaagtacgaagtacttttttggtgctcctaggaaggtggtagaaatggagtagacaggttg

SEQ ID NO: 6822635 - DNA, 80 bp, Homo sapiens
ggaaaatggacgtgtgtctcatggtagccgcagtttaagtaaacataaactctgaaccagagatcatacccgccatttcc

SEQ ID NO: 6822636 - DNA, 65 bp, Homo sapiens
gctcagtggctgttcattttacacaatataagtattgatgttcctaagtgcacagcctatatagc

SEQ ID NO: 6822637 - DNA, 90 bp, Homo sapiens
ttgtctaatatgttgtgatccaagtttctttacacttaaggttttactgtatggagtgctgttgatcaaggtttaatatgtacttggcaa

SEQ ID NO: 6822638 - DNA, 61 bp, Homo sapiens
ctcattttatttgctcctccttatatttttcactcccctaggagggtttcaatgggatgag

SEQ ID NO: 6822639 - DNA, 84 bp, Homo sapiens
agtaaccactaatctattttctgtctctatagagttgcctattctgagcaattcatataaacggaatgatataatgtggtctct

SEQ ID NO: 6822640 - DNA, 72 bp, Homo sapiens
tggagagctttaatgtgtaatcttagatgggtctgtaacaccccagagccaatacactgaagatctaatcca

SEQ ID NO: 6822641 - DNA, 65 bp, Homo sapiens
tgtataattggcttgggaaggaagatcttgaatgtttggatatttcccagttagtcatttttaca

SEQ ID NO: 6822642 - DNA, 61 bp, Homo sapiens
tgcaagtctggagtaatgtttgtgattatgtttaatgcaaattcacatgattgcttctgca

SEQ ID NO: 6822643 - DNA, 63 bp, Homo sapiens
ttagatagtattgttggaagggtaagttgatcatattaaattgcttttcaagggtacagctaa

SEQ ID NO: 6822644 - DNA, 90 bp, Homo sapiens
ctttcttttctccccctctgcctttaagaactagttgtctgacctcttgaaatgaggtaacaattctcaaaagaggggagaaccagaagg

SEQ ID NO: 6822645 - DNA, 93 bp, Homo sapiens
ggctgagtttaaaggcttttctgtttgtcttggtagcatgtgtcatcttgtgatatttacatgactcaatagaagggcatgagtaagctggcc

SEQ ID NO: 6822646 - DNA, 59 bp, Homo sapiens
gccccttcttctggagattcaaactagttgctaaaatgaattctcccagaagaatgggt

SEQ ID NO: 6822647 - DNA, 55 bp, Homo sapiens
gtagaggacatttgacatgatgttggacaccagcatcctaagtgcctttctctac

SEQ ID NO: 6822648 - DNA, 77 bp, Homo sapiens
catgtgtttgtctcttggcctacctctcgttctgaaatgaagatgagcaagatgtgaaagcttgagagaggcaactg

SEQ ID NO: 6822649 - DNA, 116 bp, Homo sapiens
attatgttcaagatttattgttttggttttagttttcttcatcagtgaagtgacttgaattagtctcacgtaactgtcaaggaaacaaaattacaggccctaatgaccaacataat

SEQ ID NO: 6822650 - DNA, 76 bp, Homo sapiens
tgagtctcttaattgtgtgtgcatgcactgtgtgttcatgtgtttgtgtgtatgtatgcatgctacagttttctca

SEQ ID NO: 6822651 - DNA, 60 bp, Homo sapiens
tcatgcagtgaatctttcttgccagagagactaaaaaggcagagagctagaacttcatga

SEQ ID NO: 6822652 - DNA, 83 bp, Homo sapiens
gctcggcatctgctgagtaccgccatgtctgttgggcatccacagtctcccaccaggcattgtggtctccgctgacgctttgc

SEQ ID NO: 6822653 - DNA, 60 bp, Homo sapiens
tcagagagttagtgtcttagcttgttctgatagatctagagctgccaccctagcttctga

SEQ ID NO: 6822654 - DNA, 80 bp, Homo sapiens
cagtcatttcgtttccttgcctcggggtaccttgcctttcaaggttgaagagtgtccttgtaaaaataatgttgtggctg

SEQ ID NO: 6822655 - DNA, 56 bp, Homo sapiens
tcagaatcggtggggccaggaatccagatttttggcaggtgccccaatgattctga

SEQ ID NO: 6822656 - DNA, 78 bp, Homo sapiens
gggatggggtaagccctaattggtagtgtttgccaatttctctcgtgtaaatactcccaccatggctgatttcatgct

SEQ ID NO: 6822657 - DNA, 71 bp, Homo sapiens
ggtctaatgaacacatattaggtgctcatgacctgttgtggaaatgggcacatagtaggtgcgcaggagct

SEQ ID NO: 6822658 - DNA, 108 bp, Homo sapiens
agccaggaatcagacctgggagtgcaggcatgaagctccagttaggcaggccccagccttcctgcagcatgacttatgtctggtacccctgcgggttgcattcctgct

SEQ ID NO: 6822659 - DNA, 86 bp, Homo sapiens
tttgtagctccctgatgatagtgatttattgaggggaatcagttttctacttaaaggaccattagtcgtctcagaaagcttacaaa

SEQ ID NO: 6822660 - DNA, 66 bp, Homo sapiens
gcctccagctcagcttcctgggtgtgtcagagaggcgtgccaggagccagagctgaggaatgaggc

SEQ ID NO: 6822661 - DNA, 68 bp, Homo sapiens
gtgaatattgagaggccactgcggagagagtgagcacttgtcctctgggagtggccacttctcatcgc

SEQ ID NO: 6822662 - DNA, 60 bp, Homo sapiens
ccattagctatgcagatatttgcattattgaattaaattggatctgcatagtttgaatgg

SEQ ID NO: 6822663 - DNA, 97 bp, Homo sapiens
gcagggaaatgggttaggaggcaattgcagtagtcagaggtgacagtggtttgcactagtgtacaagtggtggagatggctctgtctcatgtcctgt

SEQ ID NO: 6822664 - DNA, 130 bp, Homo sapiens
agtttggggtggaaccagtatcatagatgtaaattctatgttcttgagtaagaagaacccctcttaccttctttgcctttgaatagtagaaaaaataatgatacttctctcctagctccacctccagcct

SEQ ID NO: 6822665 - DNA, 58 bp, Homo sapiens
gctcaactctgtggctgtcccacaaaagcgaccagtgaccagacagacatgagtgagc

SEQ ID NO: 6822666 - DNA, 73 bp, Homo sapiens
tgatgttcctgaagccactagaactagatggagcctacattctcctgtcaagctaagggctttagaaacacca

SEQ ID NO: 6822667 - DNA, 72 bp, Homo sapiens
aggccatattaattacacaggatgagaatgtttacaccattaagttctactccagtgttataatatgcgtct

SEQ ID NO: 6822668 - DNA, 63 bp, Homo sapiens
ctagacttgggacctaggaatggagggtatcattgatcatccccctaaagccccaggatttag

SEQ ID NO: 6822669 - DNA, 124 bp, Homo sapiens
ggttccagcagcggctgacaaagcctccatcagataggtgcaagagaaagcttgtctcagagtcttcctgttgtcacagtctgcggtgctgtcctaagccctgaaatacagttgctcggcttcc

SEQ ID NO: 6822670 - DNA, 55 bp, Homo sapiens
agctgctgccggtggccaccctggagccaggtatcgccagaggccggcaggggct

SEQ ID NO: 6822671 - DNA, 56 bp, Homo sapiens
ggcaaggccttgcccagcattctgcactacagaggtgctggctataaaggctttcc

SEQ ID NO: 6822672 - DNA, 56 bp, Homo sapiens
ttgcatgtcctacatctgtgtctgaaacacagtatgcaatcatggaggatgtgcaa

SEQ ID NO: 6822673 - DNA, 65 bp, Homo sapiens
tctgtggcctgtgtccaagtgcatttgttttcccatgcctttaacctaatgacacagtgcacaga

SEQ ID NO: 6822674 - DNA, 60 bp, Homo sapiens
gcctgccacgcatgcagagtcactggaacatatgacttggtcttcaaatgcatgataggt

SEQ ID NO: 6822675 - DNA, 88 bp, Homo sapiens
gccacagaaagcaggaatgttttgtatgcctctgagctaagaatggttttcacaggggcctgcaaaacctaaatatttactgtctggc

SEQ ID NO: 6822676 - DNA, 83 bp, Homo sapiens
attccaagcatgcttctgggttcagggaaatttccatgtgtttccagcctggagacactttcccttcccagatgctctggagt

SEQ ID NO: 6822677 - DNA, 108 bp, Homo sapiens
agatgtgatttttctctatttttcttggctagtgttttggggtttatatttggcataatctaatctgatattagccaaaaagagtactgaagagagagactttgcact

SEQ ID NO: 6822678 - DNA, 59 bp, Homo sapiens
ttacaggcaagggttgttaccatggcattcgatatgcgtgacaggcaccctggctgtga

SEQ ID NO: 6822679 - DNA, 104 bp, Homo sapiens
agtcttcattaaatattaggccactagttttgcattgctgaaatatggctgcctttataaatcatacatgtttgtttagctagtgccctacttttgatgtggct

SEQ ID NO: 6822680 - DNA, 58 bp, Homo sapiens
ttccagtgcttttttaccttccaaccctgaacatgttgagagaaagagaagcctggag

SEQ ID NO: 6822681 - DNA, 69 bp, Homo sapiens
gaccactggctggagcccctcaagagcagggcttgttctttctcatgtcatggttcccagcacctggtc

SEQ ID NO: 6822682 - DNA, 97 bp, Homo sapiens
gtaatttttctttgtgagctaattttcaatgaggttttaacttgggaaacattttgtaaacttgtttgaaggtatggcccatcaaatggatttgtgc

SEQ ID NO: 6822683 - DNA, 78 bp, Homo sapiens
tggttcatagcctcacaggatattcttagtaaatatttgttaaatgaatgagtaaatcctgttaggattatgtatcca

SEQ ID NO: 6822684 - DNA, 69 bp, Homo sapiens
ggcagcttctcggctgggagtatttgaatatgagttaaaactacaaagtaactcctcgttagaactgtt

SEQ ID NO: 6822685 - DNA, 116 bp, Homo sapiens
atacgtgtgtgctggtgctctgagcctgcctgtattcaattttgtgtgatgtgtggcccacatgcacctgctgtatatagggactctcaggctccagggaggagacatacatgtgt

SEQ ID NO: 6822686 - DNA, 70 bp, Homo sapiens
catggtgagcagggcaggactggggaggggacagtctctattcctttatctctgctttgcctctgccatg

SEQ ID NO: 6822687 - DNA, 69 bp, Homo sapiens
tttctttactgaatttggtatattccatttgcaatgatttaacaaggggaataggaccttcaggagaag

SEQ ID NO: 6822688 - DNA, 76 bp, Homo sapiens
ccacctcctgggatccaagcatggggttcagtaggaatctgcattcctaacacaagctgatgctgccaggaggagg

SEQ ID NO: 6822689 - DNA, 63 bp, Homo sapiens
gcatagtacatgggtgtcctcacacagtcctcccaagctgtgtgtgtgtgtgtgtgtgtgtgt

SEQ ID NO: 6822690 - DNA, 99 bp, Homo sapiens
ccttgttatataccttcctatacatttccttcataacatttatcacagtgttaaattattgagggattgtcaggctataggtggtacttgatgacaagg

SEQ ID NO: 6822691 - DNA, 67 bp, Homo sapiens
tgagttcattgtgtgtggtcttctttgctgcaacaagtaaaaagcccagcttcataagatgccttca

SEQ ID NO: 6822692 - DNA, 85 bp, Homo sapiens
aacatatgacatcattacaaaggacagcagaaaaataattggaattatattgttgtgaggttcttatatgtggtggtgtaatgtt

SEQ ID NO: 6822693 - DNA, 55 bp, Homo sapiens
tgtcaataacatttacttctatttggaacgtgatgatagggtggagttattggca

SEQ ID NO: 6822694 - DNA, 81 bp, Homo sapiens
taacctgttcctgccttccctgcccactgcataaaggaagatggcagttcattgcagccaggaagcccaggacacaagtta

SEQ ID NO: 6822695 - DNA, 93 bp, Homo sapiens
ttcgcttgccctggcctccaggcagtcctgcagcagcaaacacatcatcagccttaggagctggcctgtgaggttgaccactctgtaggtgga

SEQ ID NO: 6822696 - DNA, 96 bp, Homo sapiens
ccttggagcttattggagatcagatgcagaggctgggggtacccaggctgcggagactcccccagcttctgcccgtgtttgctctcctgcccctgg

SEQ ID NO: 6822697 - DNA, 61 bp, Homo sapiens
gtcctagaaactctcacgagtgaaacagcaacctgtgctgtctttgctagtttctgagggc

SEQ ID NO: 6822698 - DNA, 58 bp, Homo sapiens
ccacagtaaatggattcagacctgcataaaggcaagtcataagatattatttctgtgg

SEQ ID NO: 6822699 - DNA, 78 bp, Homo sapiens
agttatttgaagcagaaaagagcaactgtgtggccaagcatgttggttgaaggggctagctttatgccttcaaagact

SEQ ID NO: 6822700 - DNA, 116 bp, Homo sapiens
cccagcccctgaagggacgacttggctcttgactgtggaggtggatggcccggacgcccgctccaggccacgacctcctggatgagcacaggccagctcgtactgtggggtctggg

SEQ ID NO: 6822701 - DNA, 82 bp, Homo sapiens
acagttagaatgcaaacttcttgttacttgtcattttctgaaatcctagaccagttgttttggaagtttgcagaatagctgt

SEQ ID NO: 6822702 - DNA, 60 bp, Homo sapiens
tggcacgtaggagctatgtcagggctccagcatgccttgacatgcctcctacatgatcca

SEQ ID NO: 6822703 - DNA, 69 bp, Homo sapiens
atttctgttctagttattcacagtggagagaggaaatgtccgtaggctgtatttgacttgagcggaaat

SEQ ID NO: 6822704 - DNA, 57 bp, Homo sapiens
aagaaggcctggtagacgtcttgaaagtctaatatcgggagctctgtcatgcttctt

SEQ ID NO: 6822705 - DNA, 55 bp, Homo sapiens
tacatcactcaaaacctagtgcctggccttggttggtgcaggtaatgatgatata

SEQ ID NO: 6822706 - DNA, 55 bp, Homo sapiens
ccaagagcttcccatagcttcttgtggccatttccagaactaaggggagctctgg

SEQ ID NO: 6822707 - DNA, 79 bp, Homo sapiens
agagcatcccggctgaccctgcaggtctggagtgaaaagaccctgcactggactcttcagggcagtgagcgggatctct

SEQ ID NO: 6822708 - DNA, 59 bp, Homo sapiens
gtggctaaagtaatccttcataaggagataattttttcttgtaggtgatttttttccac

SEQ ID NO: 6822709 - DNA, 130 bp, Homo sapiens
gttatttgcatacattttgggcatgtaggcagaatggctcaaagacaaaaatctgaggttcagccttgtttggcctcctggtgtttgatcttgaccgggctacctgcttctctgactggcatgcaaatgc

SEQ ID NO: 6822710 - DNA, 59 bp, Homo sapiens
gttttgggctgagatgtgggccgagcctcagtggggctcccagcagcatagctcagaat

SEQ ID NO: 6822711 - DNA, 93 bp, Homo sapiens
gggggctgcacctggttctattctgataaatgcatggaaagaacaaggtctttctctgcccaagtttctcaagtgtgagccaagccaacaccc

SEQ ID NO: 6822712 - DNA, 128 bp, Homo sapiens
gtcttggctgtgtgaagtttgagaggcttaatagacatcttggtggagctttaaagcaggcagtttgatacataaggctaaagttctgggggtgtttctgggctggatgatgtttacagccaaaagat

SEQ ID NO: 6822713 - DNA, 66 bp, Homo sapiens
agagtttttcatttacccgttgttcgaagccatatgagcactttaacagggtaaataaaaagatct

SEQ ID NO: 6822714 - DNA, 90 bp, Homo sapiens
tttgagctatcttgaataatttatagtagcctttggcaagttatccttaactactcacaaggttcactataaattggaaagaggcccagg

SEQ ID NO: 6822715 - DNA, 56 bp, Homo sapiens
aagagccagacaagatggggacactaacaacacaatctccagtgcttctgcctctt

SEQ ID NO: 6822716 - DNA, 57 bp, Homo sapiens
caactcactgagccttgccagcttggtgccttaccgtcctgataactcagtgctttg

SEQ ID NO: 6822717 - DNA, 80 bp, Homo sapiens
tccgtgaaaccccatcatctttgaggtcattataaataattagttgcagacgcagagatgttgaggcttcgtcactagga

SEQ ID NO: 6822718 - DNA, 59 bp, Homo sapiens
acagcaaagaagacacaggcttcatcatcaagcagacctggacctgtccttctcgctgt

SEQ ID NO: 6822719 - DNA, 70 bp, Homo sapiens
atgagaaggcacttggaggtctctgcccatacaacacagtctgggcaaagaactccaagtgccttctcat

SEQ ID NO: 6822720 - DNA, 55 bp, Homo sapiens
gctgtcacatttggagcactggtgtgaaagcaagagggctctaggatttggcagc

SEQ ID NO: 6822721 - DNA, 82 bp, Homo sapiens
aggaacacaggccaaactttctgtctgagctgcagagtattgaaacttagattgtgagctgggcaggaattcctgtggccct

SEQ ID NO: 6822722 - DNA, 73 bp, Homo sapiens
tattccacttaaaattcagaggtagtagcagagttgagaattatctagattctgtttcctctggtttggatta

SEQ ID NO: 6822723 - DNA, 59 bp, Homo sapiens
gtgagcatgtagtaatctggagttcagaatagactggtttgagattacagcatgttggc

SEQ ID NO: 6822724 - DNA, 77 bp, Homo sapiens
tggcatagagcaagccctccgtacgtgctagcttttagtattatttttagagtggtgcacacagcagggctttgcca

SEQ ID NO: 6822725 - DNA, 94 bp, Homo sapiens
gaggctgctgtgagatgcacagatccccaggacccttgggctggccccctcagaggcttgagggcctggtgacctgggtcctctgagcagcttc

SEQ ID NO: 6822726 - DNA, 78 bp, Homo sapiens
aaaggagtcaccttgggaaggtatttagctgctgaagattatcatgatttctcagcacctttttaggacttctctttt

SEQ ID NO: 6822727 - DNA, 94 bp, Homo sapiens
ggttaactgacttgcccaaggccatattgcctgtatgtgatatagctgggattcaaatccaggtagtttggtttgagagtccacactgttaatc

SEQ ID NO: 6822728 - DNA, 85 bp, Homo sapiens
ttgagtttctaattaatttctggagggagaaagagtagaacaaagtattcccttgacttcttctagaaataagcaagagaaccaa

SEQ ID NO: 6822729 - DNA, 81 bp, Homo sapiens
ggctctccgccttcattttcttgtctctgttgtaggtaatatatttgacaccaggagagaaaacacggaggacacagaacc

SEQ ID NO: 6822730 - DNA, 81 bp, Homo sapiens
actcaggctccataggtaatgagctgagattacatgatttattgctttcagtttgtcggccttggactgttctgcctgtgt

SEQ ID NO: 6822731 - DNA, 56 bp, Homo sapiens
ctccctcaggccttagccctgccttgggtggagggagggcacctggtctgtggggg

SEQ ID NO: 6822732 - DNA, 93 bp, Homo sapiens
gcagaacagtttcctattttgagacttgacacctaattagtcatcttactatttaagctgaaaaatagtgtcgtgttttgggtaacgttctgc

SEQ ID NO: 6822733 - DNA, 73 bp, Homo sapiens
tggacagggcagccaggccccgtgggaaggtggctggagactgggcccatgggcatcctggtggccctgttta

SEQ ID NO: 6822734 - DNA, 90 bp, Homo sapiens
tggaaaggtaggaactaagcaggcagggtggagagttttctgtaagacaaaaactgtctggacactgctgcggttctgttacaaagacca

SEQ ID NO: 6822735 - DNA, 123 bp, Homo sapiens
ggcggccgggaagaggcgctcctcacttcctagatgggatggcggccgggcggagacgctcctcactttccagactaggcagccaggcagaggggctcctcacatcccagacgatgggcggcc

SEQ ID NO: 6822736 - DNA, 67 bp, Homo sapiens
ctgatgatatccctggccctgccatcagagatcaattgttgaagcagagtgaaggtgaattcatcag

SEQ ID NO: 6822737 - DNA, 69 bp, Homo sapiens
agtgtcatggtagataacaacatgggcttagaaatttaaagacctaagttcaaaatcaaccaggacact

SEQ ID NO: 6822738 - DNA, 70 bp, Homo sapiens
aaactcaaaaggctttgaaaaccaaaaggttttttggaactcgtttggaggcaaagcctgacctgagttt

SEQ ID NO: 6822739 - DNA, 86 bp, Homo sapiens
ggcccatctcaatggccacctcatggataagataaactgatggtatttcaccagttaaactttgccagatgggattcagataggcc

SEQ ID NO: 6822740 - DNA, 63 bp, Homo sapiens
tcaggaccctgcagccacccgacatgtgaggcctgggcatggtggggcagggcaggggcctgg

SEQ ID NO: 6822741 - DNA, 85 bp, Homo sapiens
ggccgtggagccagagaggctggggcagcagacctttcttgggcaaatcagggggccctgctgtcctcctgtcacctccagagcc

SEQ ID NO: 6822742 - DNA, 65 bp, Homo sapiens
ggaagaattcaatttatagtcagagcagtttcttagagatgaaactggtccaagatagattgtcc

SEQ ID NO: 6822743 - DNA, 62 bp, Homo sapiens
cagctatggttattgtcttcttcatccaaggattgattgaagtaaaataaccttcataggtg

SEQ ID NO: 6822744 - DNA, 76 bp, Homo sapiens
gcctgagatcttgccttgagatctgattggacttaactgagcatttgtgatttgatcatcttaaggtatctcaagc

SEQ ID NO: 6822745 - DNA, 79 bp, Homo sapiens
ggtgtgggtgccctcctggaattgcagccccagttgcaactcatcttcgagtgaggctggcatctaagcactacacacc

SEQ ID NO: 6822746 - DNA, 58 bp, Homo sapiens
actccctctgtgttctctagctcaataaagtcacccagcaaggcagaccagagtgagt

SEQ ID NO: 6822747 - DNA, 102 bp, Homo sapiens
actttaagaatatttgccagaagtgactctgcattttatggatctaagtaaatcttaagtgaccttggaatttagtagtcttccctagcaaagtaagaaggt

SEQ ID NO: 6822748 - DNA, 64 bp, Homo sapiens
ggactctgctggttttgttcactgctgtatccccggagcccagaacagtgcttagtagatgttc

SEQ ID NO: 6822749 - DNA, 72 bp, Homo sapiens
tagagaaatagattggtccagaacagtttccggtcaacgagcattattttggattagtcaattttgggaata

SEQ ID NO: 6822750 - DNA, 66 bp, Homo sapiens
tctctcttaacatctgtctctagttgggttcagtcagtggggagccctggcagatgacaggagaga

SEQ ID NO: 6822751 - DNA, 56 bp, Homo sapiens
gaggtagagatgtgaatcagacaagtccttaaatgcatgattcatctaactgcctc

SEQ ID NO: 6822752 - DNA, 60 bp, Homo sapiens
agtttaattggaggcgtggctcggacgtaaattcaaggagctgcggctagaaagtgaatt

SEQ ID NO: 6822753 - DNA, 67 bp, Homo sapiens
acaattcagaaagcagttgtcaatgggctggagctttcagctgataaggaggcatttctggaattgt

SEQ ID NO: 6822754 - DNA, 84 bp, Homo sapiens
ctgggtgataggacgtttgggttacagcactggacatgagaggccactctattcaccacactgaacctcagtgtcttagcctgg

SEQ ID NO: 6822755 - DNA, 99 bp, Homo sapiens
cacgcaatttattctgtgcttcactttcttcatctgtaatatggagataatggcatctacctattaaagttgtgaagattcaattagatgagttgtatg

SEQ ID NO: 6822756 - DNA, 79 bp, Homo sapiens
gaatatagatgaaatgttaggctcttttagaaaatattattttcaaggactgtaagagccatttcatatcatctcattc

SEQ ID NO: 6822757 - DNA, 56 bp, Homo sapiens
ctctctggcccatcctgttgcctggagcaaccaggggcagcctgacccccagagag

SEQ ID NO: 6822758 - DNA, 56 bp, Homo sapiens
gtgggtctggctttgagggtcagcagaattcaggttgctggcagggacaggctgat

SEQ ID NO: 6822759 - DNA, 106 bp, Homo sapiens
cctgtgtgattctggtgtgcagccaagtttgagaacactgccctaagtcattgttacaggctagtacagtggcattcaaactttggtgtacaatagaatcacctgg

SEQ ID NO: 6822760 - DNA, 67 bp, Homo sapiens
ttcaaggatgggagtggaggtttaggaaaaggttaaaagaagatattaaacctccccattttctgaa

SEQ ID NO: 6822761 - DNA, 64 bp, Homo sapiens
tcaatcacctgggaggaaccatctatggtcctgtcatgagggagttcctcctaggtctggttgg

SEQ ID NO: 6822762 - DNA, 74 bp, Homo sapiens
tcgaacacttgcactgtcgtggaaatgattttctggtatcaaaacgttttcagtgactgtgcttcggggttcgg

SEQ ID NO: 6822763 - DNA, 59 bp, Homo sapiens
tattcagtggtaagcaaaacagacagagcccctgtcattatggagcttccactgtgata

SEQ ID NO: 6822764 - DNA, 102 bp, Homo sapiens
tgaatttcagatgaataatgaataatggtttaacatatgcttgagtcaaatattacatgggacatggttatactaaaatattcgttgttcatctgaagttca

SEQ ID NO: 6822765 - DNA, 129 bp, Homo sapiens
ctcctgggctcagctgtatctctctgttctgggagcctgggtgctctgtgtaaggggaacgtatacccaagggcccccctgcaagacgcccagccttgtctgaggctgcagagaaagcgccaaagcccg

SEQ ID NO: 6822766 - DNA, 66 bp, Homo sapiens
aggaagttttctgtactcgctcttggcgaatccccagaggagccccaattgagcagtacgtttcct

SEQ ID NO: 6822767 - DNA, 63 bp, Homo sapiens
agctcttcagatctcagatggtctgctcagctgagccgtgctctctgaggtgctggcagagtt

SEQ ID NO: 6822768 - DNA, 59 bp, Homo sapiens
gtatatatttatttcacaaataggtatctttttgatggcttttgtgaagaaaatgatgc

SEQ ID NO: 6822769 - DNA, 67 bp, Homo sapiens
gcagggagtgtaaatggtgctcagcggcagtataatatcttcatgccctcttttgcttgctccctgc

SEQ ID NO: 6822770 - DNA, 89 bp, Homo sapiens
gtcctcccggttgatgggttgtttcctgcaccgtgtgggctctggtgggtaggggaggagagtaggaaggaggccatcttggcggggac

SEQ ID NO: 6822771 - DNA, 72 bp, Homo sapiens
tcttttgaatctttttggaaataaagagggctcatcatttgtcttctgtttcaattggaaggttccaataga

SEQ ID NO: 6822772 - DNA, 80 bp, Homo sapiens
actgaggaggaactcagaaagaaggtggccttagtgggtctgtgcttgtcattactggtttctcgttttattcattcagt

SEQ ID NO: 6822773 - DNA, 82 bp, Homo sapiens
tgaatttaaaacaaccaggatgtgaagcctgtgtccttatcccaagaggtgccaaaagctataatttggtgagaagaattca

SEQ ID NO: 6822774 - DNA, 70 bp, Homo sapiens
aggattcctgaggggaagcttcccaagaaagcgaattaatctatcttggaaagtaactcccttgtctcct

SEQ ID NO: 6822775 - DNA, 108 bp, Homo sapiens
tttcacagctgggccacccagaagctctctctggctctcttgacagtggagctgttgaaaggaatacagaggcctaggagagagtccttggtctattgaagctagaaa

SEQ ID NO: 6822776 - DNA, 64 bp, Homo sapiens
tcagtgattttctccagctggcaggataataattgatttctgttttctctgagagaatcaatga

SEQ ID NO: 6822777 - DNA, 83 bp, Homo sapiens
ttttttcttacattcccacgtgttctttgcttctattctcaattgaaggtgatgggtaggaaatgtggcgaaatgagaagaag

SEQ ID NO: 6822778 - DNA, 55 bp, Homo sapiens
agccaggatcacccggggctgtctgcatacagacttctcaggggagttctcagct

SEQ ID NO: 6822779 - DNA, 98 bp, Homo sapiens
ttgccttttaggtttcagagttctgtcctccccactctttatctccatattacagggctggcgttgggacagaagtcaagaaaatgacaaagtggcaa

SEQ ID NO: 6822780 - DNA, 80 bp, Homo sapiens
ctcggtagccgtgtggcgcagatttcctcctccgtggtctcccgggcaacgcggagctgcctgccaagcctgctgccggg

SEQ ID NO: 6822781 - DNA, 63 bp, Homo sapiens
ccctgtctgtggtgctcctatgctgtccattgaggactcagctggaacgtcacaggagcaggg

SEQ ID NO: 6822782 - DNA, 86 bp, Homo sapiens
gccagtcctgaccgagcccagccggattcccagttcccgccgtccggggccagggaagttttggcggggaggggtagagcgctggc

SEQ ID NO: 6822783 - DNA, 65 bp, Homo sapiens
tgaagatatgagtatgagaggagagagagatatatatatacctctcaggacacacatgtctatca

SEQ ID NO: 6822784 - DNA, 72 bp, Homo sapiens
tttacacagacctagcactctagattgccttgtacctttaacctgtagccagatctgctgtgtctggataaa

SEQ ID NO: 6822785 - DNA, 130 bp, Homo sapiens
taattaattctttacaatgtcagtaagaatgtaggaaagtgacagttatttcttctaagatgagaaagatttcatgaacaaatgatttactaaatttgcataacaagttactgaaaagatggaattgtaa

SEQ ID NO: 6822786 - DNA, 65 bp, Homo sapiens
ccagatggagttgcctggaaagcttatacacatgaaaagacagtctccaggtaacatctctctgg

SEQ ID NO: 6822787 - DNA, 61 bp, Homo sapiens
tgatttcaacattacacaggcaattcatggtttcttaagaaagcctatgatgttggaacca

SEQ ID NO: 6822788 - DNA, 66 bp, Homo sapiens
ggtggccttttatgagcagggtggccttaaacaaggcttataaactagacttcatcgaaggttacc

SEQ ID NO: 6822789 - DNA, 63 bp, Homo sapiens
ggccctggtcctaggggtggaaccatggaggaacaccctggtcacccactgggactgcgggtc

SEQ ID NO: 6822790 - DNA, 105 bp, Homo sapiens
tgaccttaggcaagcagcctccttctggggccccagtgtcctcgctggtggaaagtgctgtgagtttcaaaggaggccacagagagagctagcttgggaaggtca

SEQ ID NO: 6822791 - DNA, 63 bp, Homo sapiens
tagcacacagtactatatgctacagatgaagtacaatgctgtcaaataggggtacttgtgtta

SEQ ID NO: 6822792 - DNA, 68 bp, Homo sapiens
ccccagagcccagcacacggtgctcaggggccacctgctggcagtcaggggcatgtgtgactctgggg

SEQ ID NO: 6822793 - DNA, 70 bp, Homo sapiens
aggtctctggctgtttctcctttgtctattgcatttttcctggagttgacgagatgagaaatcctgactt

SEQ ID NO: 6822794 - DNA, 128 bp, Homo sapiens
tgtaactggtcacagcaatgttttctagactagtgagtgtgtgctcatacagcaccatgtgtgttcaacaacacacaaagttggatgacaaaatcactttagtgagaaggcagctatttccaggggca

SEQ ID NO: 6822795 - DNA, 127 bp, Homo sapiens
cttagataagaaaatgtttctcaccttagttataggttatatgcattattgatatttgactgaacgccactagttttcaagatgtgatgtaacttttggtctaacctaaccttttcttgttttaatg

SEQ ID NO: 6822796 - DNA, 67 bp, Homo sapiens
atgcgtatgtttcaagagctccagcagcctacccaggatggcttgatgttgtctcttagcaccgtat

SEQ ID NO: 6822797 - DNA, 79 bp, Homo sapiens
tgttctgcagataataacacatatttcaagagtagttgtgaggattaaatgagatcatgtgtttgatctttgcttggca

SEQ ID NO: 6822798 - DNA, 66 bp, Homo sapiens
ctgtgatttttcatctattttagactattgattaatggtatctaagaaagattaagaaatttgcag

SEQ ID NO: 6822799 - DNA, 96 bp, Homo sapiens
tgccccagtttgcacattgagtaagtagaggagccaggatttggaatgaggcgttccagcttcaaggtctaggctcttctccactctacttgggca

SEQ ID NO: 6822800 - DNA, 71 bp, Homo sapiens
tccaagagacagttacccccaaaagaattcagcagacttagtatctatttggggatgactttatcaatggg

SEQ ID NO: 6822801 - DNA, 87 bp, Homo sapiens
tctacaggccagattgcttctggaaagcagttttagaaatcacatgaaaatagttgtttggatcaataaaaacactggcatgttaga

SEQ ID NO: 6822802 - DNA, 103 bp, Homo sapiens
atgtgaagaaaaagggacaggaatcagcatatcttgagcttcatgcccagccacgggctagaaacattacatgtgttaattcaagttcctgcaatcatcatat

SEQ ID NO: 6822803 - DNA, 81 bp, Homo sapiens
cccaccagggtccatgaaggagctgcacccacggagcctgttcctccccggagtcctggacaagcccttcaccctgctggg

SEQ ID NO: 6822804 - DNA, 72 bp, Homo sapiens
ctgtcacagaacacacccttcgtcatgacctgccatgtcacacatgtacaggtcttggcaaaggggagacag

SEQ ID NO: 6822805 - DNA, 59 bp, Homo sapiens
cctgctttttccaatggagccattctggactacgagatcaagtactatgagaaagtagg

SEQ ID NO: 6822806 - DNA, 104 bp, Homo sapiens
tgttgatgcactccagttagaagactgtttgtagaggaagatcagttgagaaaaaatgagaacttcttcaacataatggacactttctgtagactaaatcaaca

SEQ ID NO: 6822807 - DNA, 60 bp, Homo sapiens
tggggcgggaactgtatcggtgaggggccttccatggtcacgctcctgttcccggtccca

SEQ ID NO: 6822808 - DNA, 59 bp, Homo sapiens
ctggatgcatcttatcaaaaattatatctgtatacagtgtatacataaggtgtaaccag

SEQ ID NO: 6822809 - DNA, 85 bp, Homo sapiens
ttttacttaactgttttgtgccttagtttccccatgtggaatatggggataactttagtacctacctcataggaatagtgtgaag

SEQ ID NO: 6822810 - DNA, 64 bp, Homo sapiens
actagtattcttggtcttgtatttattgttctctgccaagttttgcagggcttgaatattatgt

SEQ ID NO: 6822811 - DNA, 55 bp, Homo sapiens
gggcctctgtttggagccaggatgaggagtttcagccgagctctgagcagggcct

SEQ ID NO: 6822812 - DNA, 85 bp, Homo sapiens
ccctgattctacaatggatttgctctgtgaccttgggcattttattaaagctctttggcactgagcagcatctgtaaaattgggg

SEQ ID NO: 6822813 - DNA, 67 bp, Homo sapiens
acacatcaggtagacctacagaggcaccataattcattgttgatttcatgagattatctgcatgtgt

SEQ ID NO: 6822814 - DNA, 60 bp, Homo sapiens
gataagtttgatctgacaaagctggaaatacctgttttagctctatcaggccaaaatgtc

SEQ ID NO: 6822815 - DNA, 63 bp, Homo sapiens
ccattctgagatcctgtgcatagtgggctgggcaaggtcatagaatcacaggatcttgggagg

SEQ ID NO: 6822816 - DNA, 89 bp, Homo sapiens
agaaggagaagcacacaccagtttgtaacctgttttcatctaaatgatatggtagacatttctacatagcttttgtaattctctcttct

SEQ ID NO: 6822817 - DNA, 61 bp, Homo sapiens
acatctttgcccatccacttccaccatgttctatgaagattttgcaagtgtgggaagatgt

SEQ ID NO: 6822818 - DNA, 76 bp, Homo sapiens
ccaatagctaggtcatattttgcaaggtcagctatatccctgtgtagatctgtcctcagtgtagattctagagtgg

SEQ ID NO: 6822819 - DNA, 95 bp, Homo sapiens
agacaggggcagggttctcaggtggcccccatgagtgggtgacatcaggagaccccgcatcaggcaaggttacctgtgtgcctgctgacttgtct

SEQ ID NO: 6822820 - DNA, 71 bp, Homo sapiens
tggtgtggtgggcagtgtgtcagtatcttctttttgtagaatggtgaagaaatatgtgcttgattacagca

SEQ ID NO: 6822821 - DNA, 87 bp, Homo sapiens
tgaatcgaatcaaattgaattgaattgaattgaattgaattgaattgaattgaattgaattgaattgaattgaattgaattgaatca

SEQ ID NO: 6822822 - DNA, 55 bp, Homo sapiens
gatggacagaggaggacagggatttgtagccacttctgcaatcgctctgaccatt

SEQ ID NO: 6822823 - DNA, 74 bp, Homo sapiens
ttaatctctttggctcaaggatcctctctcagtttgggttcccccggaaatggaccttgagacaaggattttag

SEQ ID NO: 6822824 - DNA, 55 bp, Homo sapiens
tctggagggcactttgcagggtgtgggcaaatgagagaattgcatgctctccaga

SEQ ID NO: 6822825 - DNA, 57 bp, Homo sapiens
gctatctaccacatcagccaggtattcctcctctaggttgaggatgtggtcaatggc

SEQ ID NO: 6822826 - DNA, 55 bp, Homo sapiens
ctgccagctctctggaggctcttggggcccatcctaccctcaggggacctggcag

SEQ ID NO: 6822827 - DNA, 64 bp, Homo sapiens
ctgaagttaaagtagtttttatgtagttaaaggtttgaacagtaaaagaactcttcagcttcgg

SEQ ID NO: 6822828 - DNA, 100 bp, Homo sapiens
ctgatgtaatgagccctcccctctatccttatctgtctggtcgagtcattctgggctgactgggcaccatcatgagataggcaggaggtctcatcattgg

SEQ ID NO: 6822829 - DNA, 68 bp, Homo sapiens
agtatactgagttttaccttttatgcccagaacagtgcttggtatacaggtggacttcagttagtatt

SEQ ID NO: 6822830 - DNA, 118 bp, Homo sapiens
agccctctgggggcagtgggctgggggtgggagaggcagctcttctgaatggggtgagcaggtctggcttctcggctttgggctgcactctccctgcccagcccagccgccagcggct

SEQ ID NO: 6822831 - DNA, 68 bp, Homo sapiens
ttccaacagtttatgtgaggagaaactggcatatgctattagaatcttcagttgtaaaagtgttggga

SEQ ID NO: 6822832 - DNA, 92 bp, Homo sapiens
cctgtgttcaccatgtaagtgggcagacatgatagaaggagatctattatacttccttgtgttatgtgcctatggaatagagggaacagtgg

SEQ ID NO: 6822833 - DNA, 67 bp, Homo sapiens
aaccacggtgtacctcggaagaagcgttctcagagcaacatgcacgtgttccgtgtgtaccgtggtt

SEQ ID NO: 6822834 - DNA, 70 bp, Homo sapiens
ttacatttttatcagtagcaaagttttaaaggtaaaaacctcttaatatctaatgctggcaaagatgtga

SEQ ID NO: 6822835 - DNA, 69 bp, Homo sapiens
gatgcgacaagagaggcaagggctgcagtctgagttctaggctccagccctggctcttcacctggtgtc

SEQ ID NO: 6822836 - DNA, 61 bp, Homo sapiens
tgtccctgcatctgcaggccatgtcaaaggacgccctgaatctggcgcagatgcaggagca

SEQ ID NO: 6822837 - DNA, 72 bp, Homo sapiens
ctgcactaattgagaatgcaatctactatggcacctatttgctgatttttggagcatttttaatttatgtag

SEQ ID NO: 6822838 - DNA, 87 bp, Homo sapiens
atttacgttttaagcaaatgtcctaattgcttgggaacatttttagtaattttggtggttggaatatgtgtatgaaaagcagtaaat

SEQ ID NO: 6822839 - DNA, 72 bp, Homo sapiens
acagtgaacatctgggatcattgctgtgtattccccgcaacagagagctgcagaatggcccaggtgcgctgt

SEQ ID NO: 6822840 - DNA, 61 bp, Homo sapiens
ggttctgagaaactctcaccattagctttatagctatgtaagacttgagatttctctagcc

SEQ ID NO: 6822841 - DNA, 55 bp, Homo sapiens
gaagtagctttggagttgggccaaaaaatcctcagcaccaagctaaggttacttt

SEQ ID NO: 6822842 - DNA, 55 bp, Homo sapiens
caattgcatatatatgaggccatgtgaagttgttccatggttcatttatgctttg

SEQ ID NO: 6822843 - DNA, 85 bp, Homo sapiens
caggtcccagtgcaggggaaggaaacagagggcacctgagcccctcaggctgggtaccctgtttccccttgaactgcacgacttg

SEQ ID NO: 6822844 - DNA, 55 bp, Homo sapiens
tgagcatgaggatgctgagggcctgctcctaaccctgcaccacactcactgctca

SEQ ID NO: 6822845 - DNA, 77 bp, Homo sapiens
gataggctgagccttgatgtcccttgtcctggaggctcctccatgctgaacaagcagcatcaagagcctgccctgtc

SEQ ID NO: 6822846 - DNA, 61 bp, Homo sapiens
gctggtagctggctttgatcttcccatcttattagacaggaaacaaggctagcttgaaggc

SEQ ID NO: 6822847 - DNA, 82 bp, Homo sapiens
acccagttcccattcttacacaatattttaatattattgtgtccagtgaggttcaaattaagtgtttaatggtagctgaggt

SEQ ID NO: 6822848 - DNA, 62 bp, Homo sapiens
aaatgctgtaactgatattctgggaaaacaaacctggttccagaagtgcagctgtggtgttt

SEQ ID NO: 6822849 - DNA, 71 bp, Homo sapiens
tatgtataaagcactaggtcacacaagttatgttatttaattcacataaccgtgtgacatgggcatgcata

SEQ ID NO: 6822850 - DNA, 129 bp, Homo sapiens
tcttatggtgggtgttgtaatgcttttattttgcagactctactggggccagtgaacaatgagggaatgaagtacatcattccacatgttagctggttaaagtcatggcacttggcagcctccttgaga

SEQ ID NO: 6822851 - DNA, 88 bp, Homo sapiens
agcatatacaatgctctaaagattgctcaaaactgtgacctgaattttaggattctgttttatagtggccaatctcagttgtattgct

SEQ ID NO: 6822852 - DNA, 55 bp, Homo sapiens
gacagccaggcatagggagtatgatttactgcctgcattttgtggctggcttgtt

SEQ ID NO: 6822853 - DNA, 98 bp, Homo sapiens
ggcataaaccttgtttttacccctaactcagctgtgaggcattcctagaagccagctaagcctggcaggtgtggagtggggtgagctgaggatgtgcc

SEQ ID NO: 6822854 - DNA, 72 bp, Homo sapiens
atcgtgccttagcaaacatcttcgtgtgagctacttcgtgagcccacatgtatgtgtttgttgaggggcgat

SEQ ID NO: 6822855 - DNA, 56 bp, Homo sapiens
gtggaatgtaataaaagcatggtttataaaaacttgcttatattattacattgcat

SEQ ID NO: 6822856 - DNA, 55 bp, Homo sapiens
agccctctctatggccctcttgttcacacgttgctggagctgtaggtgggaggct

SEQ ID NO: 6822857 - DNA, 56 bp, Homo sapiens
gctttagttgtaagtttctttgggttatggacccttttgagaagctgattgaatgc

SEQ ID NO: 6822858 - DNA, 116 bp, Homo sapiens
ttcaatgatgaattaataggctggccctcaattcccatatctcttgtaactggtctctgctgtcaaattagaaggctgagcttacaggtgaggcagcaagaatttgagtgattgga

SEQ ID NO: 6822859 - DNA, 63 bp, Homo sapiens
aatgttctgtggcttgtagatgcatcactccaaaaatctctatctacaacatcacatggcatt

SEQ ID NO: 6822860 - DNA, 88 bp, Homo sapiens
taagtgtgatgtggtagatgttaacttttggaaaaccgtggttttgaaaaggtcaaatagttgacattaacttgactcagaacattta

SEQ ID NO: 6822861 - DNA, 125 bp, Homo sapiens
gtgctaacaagtggttcacatccaggatctcatttaatcccccaacaaacctgtggggaaatgtcatcctcactccacaggtggggaggctgaggttcaggatggctaacagaccatgaggacac

SEQ ID NO: 6822862 - DNA, 63 bp, Homo sapiens
ttggtgcaaattcctgtaagagattcttttagtcatatatttctcaaggactttgggcactaa

SEQ ID NO: 6822863 - DNA, 74 bp, Homo sapiens
gttaattcctctgagctctatctgtgggaatgatgaattctagccattatggagttctgtgaggttaaattaat

SEQ ID NO: 6822864 - DNA, 81 bp, Homo sapiens
tgtgtgtgtgtgtgtgtgtgtgtggtcatgactgccctcctttcactctagctcaatcccttacagcctattcaccacata

SEQ ID NO: 6822865 - DNA, 58 bp, Homo sapiens
gcatctgccggacgcctcactcagctcaagaccaggagtgcatgcgccgctgagatgc

SEQ ID NO: 6822866 - DNA, 122 bp, Homo sapiens
cacagatggtgctctgcagacctctctgctgtggcacttccctccctgaatggcttcctgcaagaggtgctaattgcaagtaagggatggagtgcggcccggaccgcagagcttatttcgtg

SEQ ID NO: 6822867 - DNA, 65 bp, Homo sapiens
ggcatatatctctatttagccaatcatcacactgatatgcaaccttggttaggtgtttatatgtc

SEQ ID NO: 6822868 - DNA, 65 bp, Homo sapiens
gagttctcaccataaatcaaaggactaaaattctggtacatatgtccttattagagtgagagctt

SEQ ID NO: 6822869 - DNA, 78 bp, Homo sapiens
tgtcaatttccccagataggaaaagctaggcatagaaccccaaagttctattttagccatgttccatttggggtgaca

SEQ ID NO: 6822870 - DNA, 84 bp, Homo sapiens
ttaaagcttaatgagcgcttgtctgtttggaatgtgcaattagatttacaatcggggatgggagagagctccaaatggctttaa

SEQ ID NO: 6822871 - DNA, 77 bp, Homo sapiens
cttttagtatagaaagtttagtataaaaggttatagaggattactttacaaaaagaaactggagttcatgctaagag

SEQ ID NO: 6822872 - DNA, 93 bp, Homo sapiens
ggaacaggatatgcattttttgggagtgggtaagaatttctggttagacaagctccaaattctttggcctactttgaaggcactgcctgttcc

SEQ ID NO: 6822873 - DNA, 58 bp, Homo sapiens
cagttgaacagatgcatttataggttctgggccctgtaacactcaatctgtttaactg

SEQ ID NO: 6822874 - DNA, 63 bp, Homo sapiens
agagcaatggcatccagctgattttatttataattaatgtctttggagaggtgccatttcttt

SEQ ID NO: 6822875 - DNA, 96 bp, Homo sapiens
tgggggtagggctgagcaaggcatagtctttaagttctgactcagtcaattttttatcgagtcattttttaatctgagttttcagctctatcaaca

SEQ ID NO: 6822876 - DNA, 80 bp, Homo sapiens
aggaatgaaagatgctcccgtgcctccgccttggcgccgtcttccctccacacgccagggcaggggagcatctgcctcct

SEQ ID NO: 6822877 - DNA, 63 bp, Homo sapiens
tctgcagggctggggctgctcctgagtttctggtaaggccttcgggagtcccagctctgcgga

SEQ ID NO: 6822878 - DNA, 89 bp, Homo sapiens
gtgtgaacagatctgaggtttattgatctaaatcaacgtgggctgaggaacagcacagtaactgatgtgatcaaacgagcttctcatac

SEQ ID NO: 6822879 - DNA, 74 bp, Homo sapiens
gtggctgtattggaataggataaaatgggaccaaagatggtctgagcattgaattttcttccacactcagctat

SEQ ID NO: 6822880 - DNA, 57 bp, Homo sapiens
ctcaggattaaggaatctaaatttaatttcattttggatgcctaagtaagtcctggg

SEQ ID NO: 6822881 - DNA, 69 bp, Homo sapiens
ggtgtgtgtgtgtgcgtgtgctcatgcatgcacaagtgaatttgcatacacaagcatacatgtaccacc

SEQ ID NO: 6822882 - DNA, 69 bp, Homo sapiens
tcagatgagaggagctgtgagtgtggcctggaaaagatgtctccggcaaaccccagcccctctatctga

SEQ ID NO: 6822883 - DNA, 65 bp, Homo sapiens
cagtgaaatagtggacatcaaataactttatgggttgtattggttcctttactatgttctagctg

SEQ ID NO: 6822884 - DNA, 96 bp, Homo sapiens
gccccctggtctgtctggagcagctgcagccgcagctgtggcctgggcctcaccttccagcgccaggagctgctgcggcctcctctgccagggggc

SEQ ID NO: 6822885 - DNA, 60 bp, Homo sapiens
gggaaggcagcttcaccacagcattgccttaggacaggctctgagtagagctgccagccc

SEQ ID NO: 6822886 - DNA, 60 bp, Homo sapiens
ggatagtttccctgccctcccactttttaaaaatagtttgatggttcaggccagctgtct

SEQ ID NO: 6822887 - DNA, 57 bp, Homo sapiens
atgtcacatgtttaatgtggacttgctggaagtcagggggtctttagcgtgtgatat

SEQ ID NO: 6822888 - DNA, 78 bp, Homo sapiens
agcaaagggctaagacaattcttcagtcacaatacatctatttcctgtgttgcctaaatcttgttttacactttggct

SEQ ID NO: 6822889 - DNA, 71 bp, Homo sapiens
gatgtaagactccaggtaggcacattgacattttctagacatgaatgttagagcccacgtggtccaatatc

SEQ ID NO: 6822890 - DNA, 89 bp, Homo sapiens
tgcatttaattaatcatggtgaattcatcggaaagtaaatagatattttagtgagtttttccgtggctacgataagttaatttaatgca

SEQ ID NO: 6822891 - DNA, 58 bp, Homo sapiens
acccaggctggagtgcagtgtcttgatctcagctcactgcaacctctgcctcccgggt

SEQ ID NO: 6822892 - DNA, 58 bp, Homo sapiens
agaactctaggattggctggatagagctttagcttttcagtcaggagccaagggttct

SEQ ID NO: 6822893 - DNA, 73 bp, Homo sapiens
acagtaatttattgaacaccttcactgtgcccagcattgtgctgtgagccattgggtgattaaaagatgctgt

SEQ ID NO: 6822894 - DNA, 95 bp, Homo sapiens
gctgtctctggaggaaccatatttagctcatttccagtgcctgaaatatgtcttgcacctgttgaacagctgagcttgccctttgaggaggtggc

SEQ ID NO: 6822895 - DNA, 69 bp, Homo sapiens
gggttggcctagaattctctggttgaaaagtggtgtcagctgtggggagcttgggccatcaatcaatcc

SEQ ID NO: 6822896 - DNA, 102 bp, Homo sapiens
ggctgagctccatggagaaggactgaggtatgatttttaaaatgaggcttataactgctgacatttttataagagtcaaactgaccccagtggagctcatcc

SEQ ID NO: 6822897 - DNA, 78 bp, Homo sapiens
ccagcaccacatgccttcctcaggcctctctgtcttaacgaacttaccagcaggggcgagggtgggtatggggactgg

SEQ ID NO: 6822898 - DNA, 91 bp, Homo sapiens
gcaattaattgagagctagaggactttgattttgtaagatctttgtaaaatggttttacaaacttggagtttggttttatacagtcagtgc

SEQ ID NO: 6822899 - DNA, 59 bp, Homo sapiens
tggaggaagggagtgtacttgccctcaaaacagcaaagggactatgcttttcttctcca

SEQ ID NO: 6822900 - DNA, 79 bp, Homo sapiens
ctttgagcaacctcatttctcagaaaaggaatcttctttatagaagatacaactcagaagtgtggttacttcctcaagg

SEQ ID NO: 6822901 - DNA, 89 bp, Homo sapiens
gcattaacaggttgtttattcctgctcttgtaaattttcccttatttctaattaaatttggaacagtgtgaaaaggttatctgtttggc

SEQ ID NO: 6822902 - DNA, 111 bp, Homo sapiens
gaactttcccacagaacataaataaaatgcacgctacccagctagattttggtgttagaaatctgtgctgcaggagtctgcatggctttttgaaatgatctgagaaagttc

SEQ ID NO: 6822903 - DNA, 62 bp, Homo sapiens
gttttccaggtaccttggtattcaaaaaagccttagaatagcagattttggttttggaggac

SEQ ID NO: 6822904 - DNA, 78 bp, Homo sapiens
cctttctcttgaccatgatagacacttgtgccgaaaaatagtctggcacacatagatctgcactggcttagagggtgg

SEQ ID NO: 6822905 - DNA, 56 bp, Homo sapiens
aggccaaatagcaggtttgctaaatgttttaatgttgtaaactgcttccttggcct

SEQ ID NO: 6822906 - DNA, 64 bp, Homo sapiens
gtccacagggatggccacacatttaacattcccaaccagaaatgtcctagtcaatcctctggac

SEQ ID NO: 6822907 - DNA, 127 bp, Homo sapiens
tttgcatattgaataccaagtactgaaggatggaagagatgtggcacagcacagtaagaggagacttctgtcattcttacattagtctgtgctttcaactagctttgtaaccatgggaaagtgcaaa

SEQ ID NO: 6822908 - DNA, 59 bp, Homo sapiens
caaacctgagaacatgtgctgtgtactactttgtggtccagacatgagtctcagctttg

SEQ ID NO: 6822909 - DNA, 87 bp, Homo sapiens
aggaagagaaggaagatgtgggtgtcttcagctggtaaactcaacattgttagctctgacaaaggccacttacactaggcttttcct

SEQ ID NO: 6822910 - DNA, 78 bp, Homo sapiens
ccaccactacaagtcaatctagagattaaaataggcaaaactgtgatctacgttaggatggggttgtttgagtggtgg

SEQ ID NO: 6822911 - DNA, 56 bp, Homo sapiens
aaaatccacaacgctcatttcactgaaaggtcgttcaggtggcggtggtggatttt

SEQ ID NO: 6822912 - DNA, 72 bp, Homo sapiens
ctaaacatacccagaccatgatggacagctctggtctcattgttccttgatatcccatggtcaggtgattag

SEQ ID NO: 6822913 - DNA, 92 bp, Homo sapiens
gccttgaagttacctggaaggtgatggtacagcaggtcgcacccagcagcctgtgctgtaccaatgccttcaatgcaggtgatgtctgaggt

SEQ ID NO: 6822914 - DNA, 55 bp, Homo sapiens
ctgacctgtgcagtgactggtggcccagcaaacagggccttgtatgcagaggcag

SEQ ID NO: 6822915 - DNA, 57 bp, Homo sapiens
cttggctgccagcactggtgtagagtgacagtttcctcatccgtcttggtagctggg

SEQ ID NO: 6822916 - DNA, 63 bp, Homo sapiens
agcatgtgaggtccttggtgtgcttagctcatgcctggcaggtggtaaggatttcataaagct

SEQ ID NO: 6822917 - DNA, 75 bp, Homo sapiens
taccatggcaatgttagcaaagcatttcctgccaaatccaaaaggagatacattgttctaagcattgcatttgta

SEQ ID NO: 6822918 - DNA, 129 bp, Homo sapiens
aggaccctcaaagctatataaggagataagctttcacagtgtaatatatttttctttcatataattacatttgtgagctgacagagaggtaagttatgaagggtttgttgctctatgcttagggggctt

SEQ ID NO: 6822919 - DNA, 79 bp, Homo sapiens
gaagaaaatttggcttagtaggaaagtgtttttgtactgggcagaaacactgtgtcaaactggggcaaacaacctcttc

SEQ ID NO: 6822920 - DNA, 129 bp, Homo sapiens
ctttatacaaaaccaggtcagcacactgtgtcttggaggctgatgctgcctcacagagatgactcctttctgtagaaaactgcagccttagcatccagggccagactcttacctcatgcaatgatagag

SEQ ID NO: 6822921 - DNA, 59 bp, Homo sapiens
aaagtggccatcctctgcatcggtaagcttagggatccatggagaggtttggctttttt

SEQ ID NO: 6822922 - DNA, 64 bp, Homo sapiens
ggaagcttgttggagcagccctgcttaaaggacatttattgcacagcaatttctataagctccc

SEQ ID NO: 6822923 - DNA, 89 bp, Homo sapiens
tggcatgacagagggctcctacagtgtttgagtccagaatcagaggggatccgctggcttccatgctgtagtggcttttatacattcca

SEQ ID NO: 6822924 - DNA, 85 bp, Homo sapiens
gcaataatgccagccgatattgtgaattttagagagtatgctgagtaatttttggcctttctacaatttttggcatgagcaatgc

SEQ ID NO: 6822925 - DNA, 88 bp, Homo sapiens
atgaagctgcttccatcagtgaaatatttaacgtccaggtccctgaggggcctatctgtcaaatttctctggcctgagaacacttcat

SEQ ID NO: 6822926 - DNA, 59 bp, Homo sapiens
acttagcagcttaagtaattagaatttattatttctttggattctgtgggttgctgggt

SEQ ID NO: 6822927 - DNA, 58 bp, Homo sapiens
ggccgcacctgcattcccctcaatgggagcccgagagaaaggcttgcaggctgtggct

SEQ ID NO: 6822928 - DNA, 96 bp, Homo sapiens
gagggagccgccttggccccgccgtcctgccatgccagcatgcccgtcgcccacgggccggcggtcggcggcgcggggttggggatggcgccgctc

SEQ ID NO: 6822929 - DNA, 66 bp, Homo sapiens
ttttccctgtgggagtaggaaagttcatctgcacatagcatgtttattttcatttccaggggagga

SEQ ID NO: 6822930 - DNA, 70 bp, Homo sapiens
gccttgaactcatgtatattgatttttgttgctatcacaaatcaggtagaaaatgtttatcagttcaggc

SEQ ID NO: 6822931 - DNA, 94 bp, Homo sapiens
gccagctggtgcagctccaggaggctctggttgacgttcttctccaggtagaaggcgcagtccatggcctggagcccgctctcccagccttggc

SEQ ID NO: 6822932 - DNA, 66 bp, Homo sapiens
tgcaggtgaggggtattgttgtcaggcgtcgttatgtttttcaacgtgtaatcttatttaaatgca

SEQ ID NO: 6822933 - DNA, 78 bp, Homo sapiens
aaacactagtacaagcattctcagaatgtcatttttatatatacttgattagaaatggcaagaggattgcctgtgttt

SEQ ID NO: 6822934 - DNA, 104 bp, Homo sapiens
tttttctgttaccaagtaagttttaaagaacagtttcagttactgatgagtatgcacttatcttattttggtcagtgtactgggctgccctttggtcagaaaaa

SEQ ID NO: 6822935 - DNA, 57 bp, Homo sapiens
ctggggccccaccttaggcttggaaattagaatctacagtttaagaaaaagctccag

SEQ ID NO: 6822936 - DNA, 64 bp, Homo sapiens
agcttgctcatctgtaaaacaggattagtcagggggctaaccctattttacagatgcggaagct

SEQ ID NO: 6822937 - DNA, 58 bp, Homo sapiens
ggcacactctgtcccagagtgaagacaacacatgggtcagcacggaacagagggtgcc

SEQ ID NO: 6822938 - DNA, 112 bp, Homo sapiens
tgacctctgagagcagctgtccaggcaggcacagctctccatgagggatgcctgtggcaagctctctaacagtggctgctgcctgtcgtggacagctagcttccagatctca

SEQ ID NO: 6822939 - DNA, 64 bp, Homo sapiens
gcgcgcgaggctgggccctgcaggcggcggggggctggcgcctgtgtccccggtgtccccgcgc

SEQ ID NO: 6822940 - DNA, 61 bp, Homo sapiens
tttggtcatgtcgtcatttgggctggacacacacctcctatttggttttctcatggctaaa

SEQ ID NO: 6822941 - DNA, 60 bp, Homo sapiens
tcagctgcctttcccatgctagcttctctgaaacaccaggccagaggaagggagagctga

SEQ ID NO: 6822942 - DNA, 86 bp, Homo sapiens
catgtggatgctacttgccagttacttgatctaggccttgactcttggttttctgttgctcggataagttagcatgatttgacatg

SEQ ID NO: 6822943 - DNA, 126 bp, Homo sapiens
gaacaaatgctaaatagagtaacagttaaatgtatgtgtacactcttcccaaatgccaagagtgcagcggtggggtgagattcagatattcatttatttctaagtctgtagttaacatttatgttc

SEQ ID NO: 6822944 - DNA, 71 bp, Homo sapiens
ggttctctcctgtgcctctctaagctttctacaactataaattaatagataaagtttggagtcaggagacc

SEQ ID NO: 6822945 - DNA, 66 bp, Homo sapiens
gaagataacatgttgcagattctgcctccatagtgatcagagtagcaatctgtgatgtgtgtgttc

SEQ ID NO: 6822946 - DNA, 58 bp, Homo sapiens
tggtggaggcagtgacacagtagcttccatgtgctctgggaactgactgccttctcca

SEQ ID NO: 6822947 - DNA, 64 bp, Homo sapiens
catagcatttaatgtattgtcaatgactaatttcatggtctaatggcagagttgagtagttatg

SEQ ID NO: 6822948 - DNA, 71 bp, Homo sapiens
ttcaggtcagtagggaaatcattagtgagatagtgtagctctttaaagatttcttacttattgatgctgaa

SEQ ID NO: 6822949 - DNA, 68 bp, Homo sapiens
agtcaggaacctcagcaagtctactcacactaagctctctaggattgtcaacttgttggggcctgtct

SEQ ID NO: 6822950 - DNA, 70 bp, Homo sapiens
ggatctgctgtgcctcttttcacgtgtctccctaaaaagtccatgtgtctccagaggcagagctaatgcc

SEQ ID NO: 6822951 - DNA, 78 bp, Homo sapiens
gagtgaatgagggagggagagagcaagcaagtgggtcttcccattgctgacctttgctctccgttccccaggctactc

SEQ ID NO: 6822952 - DNA, 97 bp, Homo sapiens
gctggagcttaatccagctcaggtcattccagggatgacctaaagatgctggagaaggagggttatccctggtctgaggggataatggagctacagt

SEQ ID NO: 6822953 - DNA, 62 bp, Homo sapiens
cgtgagctgctcattcccagcacatggccagcgaggtcatagcgagtgacgaggagcacacg

SEQ ID NO: 6822954 - DNA, 75 bp, Homo sapiens
agtttgcaaaataaggaagaagaagatgaggagatgcagtcttcatttcatttcttttcccaatattttgctgct

SEQ ID NO: 6822955 - DNA, 55 bp, Homo sapiens
tgactagagcaattggaaacaattgttaaaaattgtttttaaaatgtcctggtta

SEQ ID NO: 6822956 - DNA, 127 bp, Homo sapiens
atggggcaggttaggtgaatttgtggtccctctcctgtttctgctccactctctccaggatggtggtctgtccaggagtggggcagaggtctcaggaacaatgcagatacctctcccctagccccat

SEQ ID NO: 6822957 - DNA, 77 bp, Homo sapiens
aggacacacagctctttggcgttggcagagccaggtgtgagctctggtctgcctggatcacagcccctgtgtggcct

SEQ ID NO: 6822958 - DNA, 58 bp, Homo sapiens
agtgtctggtgagggctctctcttttggttcacagacagagcctcttcactgcatact

SEQ ID NO: 6822959 - DNA, 55 bp, Homo sapiens
gctccagcacctagagcaggtccaggacccataaatgtttttaggatgtctgagt

SEQ ID NO: 6822960 - DNA, 80 bp, Homo sapiens
actcaggtatccccagggaggcctgacctggcagctcgggaccccatttcagagcctggaccctggaggactgctggggt

SEQ ID NO: 6822961 - DNA, 83 bp, Homo sapiens
catcaagcccagtgcccagacttctgggaggatctggctgctactcagtgaaaggaagcctgggaggtttgggagggcagatg

SEQ ID NO: 6822962 - DNA, 70 bp, Homo sapiens
gtgatggtatcgctggggcaatgtctacaaccaaatttagaaagttagaacattcacaggatattatcat

SEQ ID NO: 6822963 - DNA, 119 bp, Homo sapiens
tcctagagcccacagagcaggcctgcccagaagtgactcagcactgtctgccagcctcagcacgggttgagtggacactctgcttgcaggtaacaatcttctcatggcggctgctggga

SEQ ID NO: 6822964 - DNA, 130 bp, Homo sapiens
cttttggtgtacttttcatataaggatgattttgtaatattgatttctattgagaggttaggaagataactcattcttttctcaaatggacaatattgtgggggttttttgtactaatagtataggtaag

SEQ ID NO: 6822965 - DNA, 66 bp, Homo sapiens
atgtgagcaaggccagggccgtgaattaaatgagagacccatggctgctttcccttagcaccacat

SEQ ID NO: 6822966 - DNA, 119 bp, Homo sapiens
gccatcagcagaggttgtcctcccagagcatgtggctttggcatgtgccccttgtagcagagaaggggctggggcatgtgcccaacccaccagttgggaggcacccactctgctatggc

SEQ ID NO: 6822967 - DNA, 77 bp, Homo sapiens
ttactttccacaatatagtctcccattggcctgctgtttactttcattctgccacagcagggactacgtgaaagtga

SEQ ID NO: 6822968 - DNA, 73 bp, Homo sapiens
tttttccctcaattctagagccttacattgtggttgagtttataggttatttattggctttaggaaggaagaa

SEQ ID NO: 6822969 - DNA, 67 bp, Homo sapiens
gaagtttcacgtatgctctagagctcttttcactgtttctagtgtttgttctcagagcatgagcttc

SEQ ID NO: 6822970 - DNA, 90 bp, Homo sapiens
ctggatgagaaggtgttcagtcctgctggcttcaggagattcattcctgaataccttgctgtagccacgcagtgatggagctcctgacag

SEQ ID NO: 6822971 - DNA, 81 bp, Homo sapiens
taaatatatttctactgtgagaaacatgaatgggatctacttaatctagatagtcaaactctacatagggaattgtattta

SEQ ID NO: 6822972 - DNA, 66 bp, Homo sapiens
ggcagaaggatttaaaggaaagaatgtcagtggaaggatatgcttacagcttaaaatccagctgcc

SEQ ID NO: 6822973 - DNA, 96 bp, Homo sapiens
gatgagtgtcctgctgtgggcctgatgctgccatgagtccctgctgcgcacccgctctgcctggccagccctcgggccacactgtgaccctctgtc

SEQ ID NO: 6822974 - DNA, 76 bp, Homo sapiens
aggaggtagctcttactctctccggcctgcacagagctgaggaaagcaggctggggagaggggaagcacatgtcct

SEQ ID NO: 6822975 - DNA, 58 bp, Homo sapiens
cctgctgagaagctaagcaggaaagactaaaggatgaggcatgcttggcttctttagg

SEQ ID NO: 6822976 - DNA, 60 bp, Homo sapiens
tgtcttaatttggatgatgtttttattctacaaaatagaattattatcttgttcgaggca

SEQ ID NO: 6822977 - DNA, 83 bp, Homo sapiens
ctttgtgccaagctgggaggcactgaggtttcaaatggctatgcattatcaatatctcagtgtgcttctgacagggcataaag

SEQ ID NO: 6822978 - DNA, 73 bp, Homo sapiens
gggctcccccgcaggtgccggcagatggggtagcgaatggtcctgtgcctccacctgctccgggagggagtct

SEQ ID NO: 6822979 - DNA, 55 bp, Homo sapiens
acttagcttgaaatcccagctctgctcattaatagctggttgacttcaggcaagt

SEQ ID NO: 6822980 - DNA, 62 bp, Homo sapiens
gaatttgaggtgtgtatgttggggaaggaggtatcctttctctatcgacccatcgcgaattc

SEQ ID NO: 6822981 - DNA, 73 bp, Homo sapiens
catgtctctagatattgccagatgtccccggaagaacaaaaatttctgacacaaaataatgactaaagacatg

SEQ ID NO: 6822982 - DNA, 81 bp, Homo sapiens
gggaagggggaggaatgaagtatcctaagtagcaaccatggctgcgctgctggaggcctgactgtgtttctttcccttctc

SEQ ID NO: 6822983 - DNA, 58 bp, Homo sapiens
tggcagagttatgggtatttataattttattctttgtagctttctcaattttctgcca

SEQ ID NO: 6822984 - DNA, 77 bp, Homo sapiens
actgaggcttaaagatcttaggaagattttccaaggaaacaactggagagtgctagagctgagatttgaacttcagt

SEQ ID NO: 6822985 - DNA, 56 bp, Homo sapiens
aggctcccttgccattcccaggagggcaagccgcagcctgggtggctagggagttt

SEQ ID NO: 6822986 - DNA, 88 bp, Homo sapiens
ggtcgatggggaggtgaggaggacagagcagcacgtgcttaagtgcgtgctccgagtgccctgtcgctcactcccacctccattgttc

SEQ ID NO: 6822987 - DNA, 56 bp, Homo sapiens
caaatgctattttagatgggtggctagggaaggcctctctttttaggtggtgtttg

SEQ ID NO: 6822988 - DNA, 65 bp, Homo sapiens
tggtggggatgagagcaggaaccatggccagaattgtctgtgcatctgttcattcgttcccagca

SEQ ID NO: 6822989 - DNA, 102 bp, Homo sapiens
ccactacaagcactgcatgattccatttttatgagctatcaaaaatagtcaaactcgaagaagcaaagaatagaataatggttgtcaggagcttgtgggagg

SEQ ID NO: 6822990 - DNA, 73 bp, Homo sapiens
ggggctgagacccaagtcctgagcctcccagtgcatgcctccccagaccgctctcagggcatgggacagcccc

SEQ ID NO: 6822991 - DNA, 62 bp, Homo sapiens
ggttcaagcctcccctggggcaggtggcttcaaacccacctgggtcccagccaggctttgcc

SEQ ID NO: 6822992 - DNA, 68 bp, Homo sapiens
gatttctcaactctcaagagaagctattatttcctggagagaagctattatatgagagctgagaagtt

SEQ ID NO: 6822993 - DNA, 83 bp, Homo sapiens
aagtattgtttgtgggttatgtatggagtctggtgttcaacttctggtttactgctaattctgtaggtttgcgcaaattactt

SEQ ID NO: 6822994 - DNA, 80 bp, Homo sapiens
cttggcatgggtggtgggcaggtcactctgcctcagtcctgccccagctgaagaggcgtcaccaccacccccatgcccag

SEQ ID NO: 6822995 - DNA, 94 bp, Homo sapiens
agtttaatgaaaatgggttgtatgtaaagtttgtaatagaaaacaggaaagtggtcttgtacataattattgtaaactactatttttataagct

SEQ ID NO: 6822996 - DNA, 64 bp, Homo sapiens
cagaggagatactgtttctcttctacatgaaactcatttcatgcagattcagcagatccctgtg

SEQ ID NO: 6822997 - DNA, 82 bp, Homo sapiens
gtgggttaggactccagcatatacttttagtgggacacaattcaacccataaaaggtggcagtgcttgagcactggattcat

SEQ ID NO: 6822998 - DNA, 73 bp, Homo sapiens
gatggagagcgcaaggggccaagcctgagttcagggaaaggctgagccaggctactccttgctgacagccatc

SEQ ID NO: 6822999 - DNA, 89 bp, Homo sapiens
tctctgtcctaattgagcacatgacttttagtcgagttccagaaatatgacacttgcactgagatctgtgccacaaaaaggctcagaga

SEQ ID NO: 6823000 - DNA, 79 bp, Homo sapiens
gaatgttccatgccttctgccagattaagggtgggattctaccacatatttgccatgaagagtgtttgaaaacacattc

SEQ ID NO: 6823001 - DNA, 77 bp, Homo sapiens
cagaagcaacttaccaaggggtatttaaagacatgaaaatttccagaaataccatttggtgcatccctttgtttctg

SEQ ID NO: 6823002 - DNA, 55 bp, Homo sapiens
tcatcaggtatccattgtgagaagactcgcctcttcttaacaatggctctgatga

SEQ ID NO: 6823003 - DNA, 78 bp, Homo sapiens
gggacagactgcgggtggggacgtactgagaggtccggacctcaatgcgtccgacccgtctccacaccgcccttttcc

SEQ ID NO: 6823004 - DNA, 69 bp, Homo sapiens
gcagcagggaaaaagggtagaaggaaatatcccacttctctcttcctttgcactccagtctcctgctgt

SEQ ID NO: 6823005 - DNA, 78 bp, Homo sapiens
taggttggtgcaaaagtaattgtggtttttgtcattgaaagtaattgaaaaaactgcaataacttttgcaccaagcta

SEQ ID NO: 6823006 - DNA, 58 bp, Homo sapiens
cttgttagtattgtcttatttcatggagggatacagggaatgaggtcccactgaggag

SEQ ID NO: 6823007 - DNA, 119 bp, Homo sapiens
ggactgtcttacaggcttttggagttggcctgggaagagggcatggtgggccttggttagactgccatttccacacttgctgtctgctgaggatggctcctctctatgctggatggacc

SEQ ID NO: 6823008 - DNA, 81 bp, Homo sapiens
cttcacttcaatacagcagatttccctgggctcctggctgggcacagagtggctggcagaggggagtctgtggacgtggag

SEQ ID NO: 6823009 - DNA, 77 bp, Homo sapiens
gacagtattctgggggatctttggtaacatttcttctgaaaattgcttgtcttcttccctactagaatgtagctgtt

SEQ ID NO: 6823010 - DNA, 59 bp, Homo sapiens
atacacaggcatgcttctgattcatcaataatctgaaattgtagcatgtgtttgtgtgt

SEQ ID NO: 6823011 - DNA, 66 bp, Homo sapiens
tgcttatcttttctctcactaggctggagcttaagtccacttatgaggagaaaatatataaaagca

SEQ ID NO: 6823012 - DNA, 67 bp, Homo sapiens
cctcactgctatgtgtttgctcatagcagctgctaatccagaaagaacaggcactaagcatgtgggg

SEQ ID NO: 6823013 - DNA, 63 bp, Homo sapiens
tcatcttgctgccattgctttagtttaaactggacccacaaatctgagcaatgtcagcaatga

SEQ ID NO: 6823014 - DNA, 79 bp, Homo sapiens
ttttatttggtctgtgcaaataaagagcaacattatctgaaaatgtttttaagtttatttgtgacagcatcaaagaaaa

SEQ ID NO: 6823015 - DNA, 56 bp, Homo sapiens
caggaggttgtaagagcaggccctacatttgttcgctgggctcttggaggctcttg

SEQ ID NO: 6823016 - DNA, 109 bp, Homo sapiens
ctcctttaggatggtagatttagttagagaagccacagtggacaggtcaaatcctgtgatctttggtaatctggcacattcattgattttattattttgtaaattggag

SEQ ID NO: 6823017 - DNA, 58 bp, Homo sapiens
tatctgaagggctaagggttttagaatttgtattccatagaattcttaccctttgatg

SEQ ID NO: 6823018 - DNA, 89 bp, Homo sapiens
ggataccatttggagatcactggaaaagctcaaagcaaaatttattttattgttctgttgttttattgtgagtcccattagatggttcc

SEQ ID NO: 6823019 - DNA, 62 bp, Homo sapiens
ggcaagttttagattgactccaatgtcatgtgctttgacagaaagagtattaaagatctgct

SEQ ID NO: 6823020 - DNA, 66 bp, Homo sapiens
cccacactgagaatacaatgttgcagggttttatgtagctcattaattcgtgttctccagtgaggg

SEQ ID NO: 6823021 - DNA, 79 bp, Homo sapiens
ggatcatgtcaggcacagctgggcaattgcggttccagagtaaaggtccgtcaaagttctcagttcatgtcaatgattt

SEQ ID NO: 6823022 - DNA, 65 bp, Homo sapiens
ggcaatagaattgtatttgaaccatggagccctcctccatgtttctgatgcagcttttatgagcc

SEQ ID NO: 6823023 - DNA, 109 bp, Homo sapiens
ccagcacaacatttagaacccagtgtttttgtcttgagttttgttttgtcaattaacaccaaagcaggctaaataataatacatgtttggttgtgagacagtgtgttgg

SEQ ID NO: 6823024 - DNA, 55 bp, Homo sapiens
agaagggaaatgctaacagatgggcaagctttttgttcatggtgtatttctttct

SEQ ID NO: 6823025 - DNA, 66 bp, Homo sapiens
aggcaccggcagatttggcatctggtgagggcctgtttctcatagatggcaccttctgtgtgtcct

SEQ ID NO: 6823026 - DNA, 55 bp, Homo sapiens
gtatgtgttgaattcaggggtcgtgacttacaccactctgaagtccagggcatac

SEQ ID NO: 6823027 - DNA, 89 bp, Homo sapiens
tgttcttggataaatattatgtagagtagtcagaaatgccaggagacatcttgtctttaaagcacttacatactctgcatacatgagca

SEQ ID NO: 6823028 - DNA, 59 bp, Homo sapiens
ctttcagtttggtgaaatacaagggcaaggtctctttgtgcttgaaatgagactgaagg

SEQ ID NO: 6823029 - DNA, 80 bp, Homo sapiens
ttgggtattttacaactttgtgctgatttgatatggacagatcatcccagtgttttatcagacaaagtataacactccag

SEQ ID NO: 6823030 - DNA, 63 bp, Homo sapiens
gtcatctcaaatgtttccacttctgcttcctgagacagccaggagagcaaagcaagagatcac

SEQ ID NO: 6823031 - DNA, 63 bp, Homo sapiens
tggaatctcagtggaagcaggaagtttagaaggcatcacagctaccatctactagagattgca

SEQ ID NO: 6823032 - DNA, 69 bp, Homo sapiens
tcttacttctcttatctcctgcccccggggctgagttttctctgccttggcaggctgataacatgtgga

SEQ ID NO: 6823033 - DNA, 56 bp, Homo sapiens
gacccaggaagctacttctggtaacagttgtcacataccaggcagtggactgggtc

SEQ ID NO: 6823034 - DNA, 99 bp, Homo sapiens
tgaaataaatgaagatctctacaagtattctacaaagaaattgaattggtagtttaatcttcagtttcctaggttttgtttggatgtttgtttttttca

SEQ ID NO: 6823035 - DNA, 125 bp, Homo sapiens
tgtctcctccactagatccgagccagtggctctgcccaggtggacagcagagtcgccgctgagattctaactgcttccatcggggctctcggagcagctgttggaacaggatggggagcagagca

SEQ ID NO: 6823036 - DNA, 91 bp, Homo sapiens
gtccccctccagccgcgtactgtccagcttggctcctggggcttggatgtccacctccatgctgggcagagacacgtccaggttgggggac

SEQ ID NO: 6823037 - DNA, 66 bp, Homo sapiens
tcaccaggggaatgagggtctaagtcctgtgaaagaatggtggcatggccctcattccagtggcga

SEQ ID NO: 6823038 - DNA, 56 bp, Homo sapiens
ctcaaggaacaaactgttcttcacaagtgtttcttggaatgacaagttgttcagag

SEQ ID NO: 6823039 - DNA, 74 bp, Homo sapiens
gcctgtggctcaaaatcccatgatactgaagataaatctgaaaattggcattatgcattttgccctacagcagc

SEQ ID NO: 6823040 - DNA, 81 bp, Homo sapiens
atagaataatataatcctacttcccatgatgctaatttatctctcactgtaacatgaaggttaaggatcatattgtgatat

SEQ ID NO: 6823041 - DNA, 125 bp, Homo sapiens
caggaacaactggaagcttgttaaaactgcaaatttctgggccctaaaccagctctattaaatcaatctctgtggaggtggggctcaggaatctgtattttaataagcttcatcagttgtttctg

SEQ ID NO: 6823042 - DNA, 65 bp, Homo sapiens
tgtgtgtatatgtgtatataggtgtctatacataattgtcttatttgtatgcatacatacacaca

SEQ ID NO: 6823043 - DNA, 75 bp, Homo sapiens
tgttaaggtgtaagtataaaatgctaagcttttatccctagaaattcagcaaaaagatacaggacacctttggca

SEQ ID NO: 6823044 - DNA, 72 bp, Homo sapiens
tgtaacactggtatttcatttagtgagaatatttactccataatagctaatgagtgctcggtgtttgataca

SEQ ID NO: 6823045 - DNA, 73 bp, Homo sapiens
ccagagactggaagatgggggcttaatacttctcaatgattacatgtcaaagagatggctcccaggtctctgg

SEQ ID NO: 6823046 - DNA, 72 bp, Homo sapiens
ggtcccctgttcagggcgggggctcaaccagtggatctttattctattagcaattgccctgtgcaatagacc

SEQ ID NO: 6823047 - DNA, 83 bp, Homo sapiens
ggcctggctgatggagctggaaagtgcttttctgagagggagtggtgccttctactttccattccatcttacaaagccaggcc

SEQ ID NO: 6823048 - DNA, 61 bp, Homo sapiens
tgggtctttttgctttcagctctacccaaattcctaacagaaggaagccctaaaggaccta

SEQ ID NO: 6823049 - DNA, 67 bp, Homo sapiens
gtcccagctacttgagaggctgaggcgggaggatcacttgagcccaggaggtcaagtagctatgggc

SEQ ID NO: 6823050 - DNA, 64 bp, Homo sapiens
ttaggagagacaaagctgggctgacaaaaaaatacatttgtggaactagtattgtcttaactga

SEQ ID NO: 6823051 - DNA, 73 bp, Homo sapiens
gcatgaacatgtgttggctttggtctggatgccagaggatgatatctgataaagaccaaggtaagcgttcagc

SEQ ID NO: 6823052 - DNA, 66 bp, Homo sapiens
gggcaggtagaccaccagaacctccatttcttaaagccccaatggacagctggaaattacttgccc

SEQ ID NO: 6823053 - DNA, 103 bp, Homo sapiens
ggaaataaatctctagtcttctccatgggatcttgggatctaacttctccttcaacttccaacaattttctttggagactctcagactactgcctttttttcc

SEQ ID NO: 6823054 - DNA, 59 bp, Homo sapiens
gtctactgtgaggctcctggatggtgagctattccagagaaatctagtcttacagagat

SEQ ID NO: 6823055 - DNA, 62 bp, Homo sapiens
gccatggcagggaccaagctgtcatttctcataatgattgtttataatcttgtcaatgaggc

SEQ ID NO: 6823056 - DNA, 69 bp, Homo sapiens
tccttacgtcttgtgacttgatagggtagagtagaaaatgtatttcttttaagacacacagattaagga

SEQ ID NO: 6823057 - DNA, 70 bp, Homo sapiens
gcaggcttttgaaaccgaaaatcacatctgtgaaaaatgtcatagctgtgtatggtttacaaatatttgt

SEQ ID NO: 6823058 - DNA, 96 bp, Homo sapiens
agttgaattattttccttttcaatgctttctgtatattaagtccagtataaatttatagatcatttgcattggtcgtaagggcagtgagtcacatt

SEQ ID NO: 6823059 - DNA, 76 bp, Homo sapiens
gcaagtttctaggttatggtgatgctgctggtccagggaccacagtttgagaaccactagcctagttattccttgt

SEQ ID NO: 6823060 - DNA, 71 bp, Homo sapiens
ggcgggagtgcagtggcgtgatctcggctcggtgcaagctccgcctcccgggttcatgccattctcctgcc

SEQ ID NO: 6823061 - DNA, 130 bp, Homo sapiens
gtgtgggaagcagactggagctctgttactgatcgttgaaattgggtgtggctgtcatggagatcactctggatccctggtccattatcccgctttccagaaaagacaggttccagttcaaatccttggc

SEQ ID NO: 6823062 - DNA, 55 bp, Homo sapiens
atgggaggcagacactaagttctggggtctccagttttagtgggtggccactgat

SEQ ID NO: 6823063 - DNA, 124 bp, Homo sapiens
acctcagaaacactcattggctccagaaagtttttgattctaagagagattcagggtatcctaagcatcattttttacttctctctcaaagggaatcaagactgttttaagaaatgatgatggt

SEQ ID NO: 6823064 - DNA, 85 bp, Homo sapiens
tagagtaactggagcagagaggtggctgcatatgaaaagcttttccttgtccttgcagacatctctcttcaaaccagtcactctg

SEQ ID NO: 6823065 - DNA, 70 bp, Homo sapiens
atacacagctcacaacgtgtgcatttgtgtgaccttgtctctgtgtgtgtgtgtgtgtgtgtgtgtgtgt

SEQ ID NO: 6823066 - DNA, 81 bp, Homo sapiens
acaggtgcctgtatcacatgactctgcactaggctatggtttcccttcttacaggagctgctctgtgatacttgtatttgt

SEQ ID NO: 6823067 - DNA, 64 bp, Homo sapiens
acaagcattcaactctcagtcagtctcttgggctgaggcagaacagagcctgaatctctcttgt

SEQ ID NO: 6823068 - DNA, 81 bp, Homo sapiens
tcctcacctctcctcatgggcgggttctgccccacttccattctttggcatggagaggactggccctgaggggaggcagga

SEQ ID NO: 6823069 - DNA, 63 bp, Homo sapiens
actgtgacgtgccttatggagagaatatgcgtgttagtaagctttgttcaggcaagttacagt

SEQ ID NO: 6823070 - DNA, 55 bp, Homo sapiens
tttggaatgtagtttaatcatctttaaaatgagaggattgaactagatctccaaa

SEQ ID NO: 6823071 - DNA, 61 bp, Homo sapiens
agtgaagtagctctgtttgcaagttagccaaaggcttttgacagatagatgttatgttcct

SEQ ID NO: 6823072 - DNA, 67 bp, Homo sapiens
ttgagactcctctgcccaaatttgtatatagcttagtgtgtataacaggggaggggagggatttcaa

SEQ ID NO: 6823073 - DNA, 66 bp, Homo sapiens
gagataaagttgcagtgaaataaggctcaggtcattcaaggccttagcggtcatagcaaagatttt

SEQ ID NO: 6823074 - DNA, 79 bp, Homo sapiens
ttggcctgcgggtctcgtgagctggaagaaatcaggaaagggaagctgagcatttaatcctacatagatcacaggctaa

SEQ ID NO: 6823075 - DNA, 60 bp, Homo sapiens
ctgatttgctaaatgtcacatctcctgcacagaggtaggtggggtgaatggcatagtcgg

SEQ ID NO: 6823076 - DNA, 82 bp, Homo sapiens
gaagtaatgagaacatgcatataggacacaaagaaatatccacctcatcactctttggtcacacatgtatctcaatggcttc

SEQ ID NO: 6823077 - DNA, 69 bp, Homo sapiens
gacaccaaagtacctctcagctgctggtgccaagacagaggtagcatctggcctggttacttttgtgtc

SEQ ID NO: 6823078 - DNA, 73 bp, Homo sapiens
acatgcagcagaataatgactataaaaccttataattatacagcacttggatagtcaggaactgttggtgtgt

SEQ ID NO: 6823079 - DNA, 65 bp, Homo sapiens
ccactgcaaggcattaccatggctagagtcacagaagtcattgcagtcctattgccttgttttgg

SEQ ID NO: 6823080 - DNA, 73 bp, Homo sapiens
gatggacttacttgggcacacatcttaagtgtctttgtgacacctctggtctgtgtcataggctgagttgatc

SEQ ID NO: 6823081 - DNA, 69 bp, Homo sapiens
gttaagcacagtggcttttgtgtctgcagatttgagctgaaattccagttctgcagcatagggcttaac

SEQ ID NO: 6823082 - DNA, 87 bp, Homo sapiens
gtagttctggagttggtgcaggaatctgcaattgaaaaagtattttgagtattgtaattcaagtagttcttgcattttgagaaatac

SEQ ID NO: 6823083 - DNA, 63 bp, Homo sapiens
gggcaagttgagaagaatgctaccaaccctaaaccccagttaagtcactcctctcgactgtcc

SEQ ID NO: 6823084 - DNA, 55 bp, Homo sapiens
gagccctgctgggccttgtctctgcccttgcacaggccgggtttggcagaggctc

SEQ ID NO: 6823085 - DNA, 58 bp, Homo sapiens
ggcccgggggttgggtgatatccccggctacagctgaatttcacagacttactgggcc

SEQ ID NO: 6823086 - DNA, 64 bp, Homo sapiens
ccttcctcagcaggtctgtgtaccagcttcgtacaaggctggtgcaaatccatcctgttgaagg

SEQ ID NO: 6823087 - DNA, 66 bp, Homo sapiens
gagttgactacatagatgcagaccaggccaaactagtcatgacctgccctgcactgtgggtagctc

SEQ ID NO: 6823088 - DNA, 77 bp, Homo sapiens
tttatttataaactctctgctgctgagcttggggcctggagccccaggaatgagcaggcaggggagactgagatgga

SEQ ID NO: 6823089 - DNA, 58 bp, Homo sapiens
attgtacaatgcctggaacattgtaggtgctccttaaatgtttcagtgcttgtccaat

SEQ ID NO: 6823090 - DNA, 55 bp, Homo sapiens
cagctcctctgttagccctggggacagagcctcctagggagcaaggtgggggctg

SEQ ID NO: 6823091 - DNA, 56 bp, Homo sapiens
taattgtatggagaaggctgcaagacaggcactgtggtcttcagtagatacagtta

SEQ ID NO: 6823092 - DNA, 67 bp, Homo sapiens
taagggagtatcttttacaccaggaaattaatagtacagtaaatttcactgataaagactccacttg

SEQ ID NO: 6823093 - DNA, 116 bp, Homo sapiens
gagtgcaagctttagagtaagtgggacctgtgtctgcattctgtgtaactcagtagctgtgtgacatagtagctgtgtaacatgagaatgttcctcaatctcgctgagcttcagtc

SEQ ID NO: 6823094 - DNA, 69 bp, Homo sapiens
gagtgacagggcagagaggcaggcttgggtctgtccagctccaaagcccatgctctgtccatgcatctc

SEQ ID NO: 6823095 - DNA, 62 bp, Homo sapiens
taggtctgtgttctttagaggtttttgttggtaggaacattgaaccagtagacacaaaccta

SEQ ID NO: 6823096 - DNA, 64 bp, Homo sapiens
gagtgtggatgggttcagtgattcactcctaataaaaacggacaatgcagcccctaccacattc

SEQ ID NO: 6823097 - DNA, 71 bp, Homo sapiens
cactttgcctttagataagccttctgcaaattagaatgtaatgaaagaccttgtaactagaggcccaagtg

SEQ ID NO: 6823098 - DNA, 100 bp, Homo sapiens
gtcctgggagctggggggcggctggaagccggcttccctcgagccctgagtttccttaggcttccggcaggcggcgccagcctcctccccaagtccgggc

SEQ ID NO: 6823099 - DNA, 130 bp, Homo sapiens
atggacattcattaaaatgggctctgacttgatagccacgttagcagaaaatggaaaagtccatctatcactgtctgttcccattttctgcataatcattcctggaagaaagaggcctgcaagtgtgtat

SEQ ID NO: 6823100 - DNA, 84 bp, Homo sapiens
gcctccacattcctgccctcgccactacagttacagagaaattaaaaaacctttcattgtacaactgagggtggaattgttggc

SEQ ID NO: 6823101 - DNA, 65 bp, Homo sapiens
aggactccggaagtactctctcctggatttcattaaatctaatgagttagataattttggagcct

SEQ ID NO: 6823102 - DNA, 57 bp, Homo sapiens
tgcagaattccttttgacatgtaatgtagcatattcacaagttctagggattaggca

SEQ ID NO: 6823103 - DNA, 129 bp, Homo sapiens
ccctcaccagtttaactttcttcctttcctaaaatgttgtttttctgcatgtctatttaagttagtgaacattcttggaggaaataacaggaccaggctgaatgatttctgaggtttagtctttttcag

SEQ ID NO: 6823104 - DNA, 73 bp, Homo sapiens
gttatcacaagcaattcaacctaagtgcatccagcaaaatggataccttaggttaggattcccgctagaaaat

SEQ ID NO: 6823105 - DNA, 82 bp, Homo sapiens
tttggattttattctggtggcaatgaggcgtcactgaaagaatttcagctgaggcatgatgctatcagatgagagatttaga

SEQ ID NO: 6823106 - DNA, 76 bp, Homo sapiens
tgctgggagaagagtctattggaactagacatgacatgttcatgtttgtgttataagaatcatcttcaatgcagca

SEQ ID NO: 6823107 - DNA, 71 bp, Homo sapiens
agcaaaggttgtgttctggggtgaggatcatgagagagatatttatcacatgcacatgcctttatatagct

SEQ ID NO: 6823108 - DNA, 69 bp, Homo sapiens
tttgttcctaggctgtgatctcatgatttgttccagggaacattcacgctctcaaagctgaggaagaaa

SEQ ID NO: 6823109 - DNA, 60 bp, Homo sapiens
tccttggagcaacacatgacatctagaactctacatggtccaaggtctgtctcacaagga

SEQ ID NO: 6823110 - DNA, 78 bp, Homo sapiens
ttgctgcccttgtcttggcatattttcaccaagcttgctgagcctggtgcatacttatgccaggggaagagttaacaa

SEQ ID NO: 6823111 - DNA, 80 bp, Homo sapiens
ttctgtttctgttttgggaggggtgtatgtgagagagttttccttccatgccttactcttcaccgctactgaaatacgaa

SEQ ID NO: 6823112 - DNA, 74 bp, Homo sapiens
tgctttgtcaccgaggctggagtgcagtggcacgatctcggctcactgcatcctccacctctcaggttcaagca

SEQ ID NO: 6823113 - DNA, 69 bp, Homo sapiens
cagagcccttggctggagcccagataattctcctcctaaatcttccagggcttctccctaaggactctg

SEQ ID NO: 6823114 - DNA, 60 bp, Homo sapiens
tggttacacagcatgtggacttgaacaggaatagtctgagccccgagtctgtgctaacca

SEQ ID NO: 6823115 - DNA, 77 bp, Homo sapiens
ttttttttgagaagaggtcttttgggatgcatggtgctccacatacagcttcacaaaatatttcattataagagaaa

SEQ ID NO: 6823116 - DNA, 67 bp, Homo sapiens
ggctgaagggaggcggccagtgcggggccctgggactctgcgccaccctcgcctgctcgcaccagcc

SEQ ID NO: 6823117 - DNA, 130 bp, Homo sapiens
tagcgaaaggtgacgaggctgttttcggagagccaggggtcccagcggcccgctttcctgctagaggagggggcggcgcgtagccggagacttcagcgcggcggctccaaagatctcccttcacttttca

SEQ ID NO: 6823118 - DNA, 90 bp, Homo sapiens
ggaataaaggcttcctaggtaacaaacttctgacttaagcaggttttgctgaaaacttaagcaggttttgctgaaaaggaagcagattcc

SEQ ID NO: 6823119 - DNA, 57 bp, Homo sapiens
gcagtggccacatggaggaggaggcccacccggaactctgcccacactggccactgc

SEQ ID NO: 6823120 - DNA, 77 bp, Homo sapiens
tctgaagtgataaggtcagtgtttgaacccagggttatctgattccatagctatgctcttaaacatgatccttcaga

SEQ ID NO: 6823121 - DNA, 93 bp, Homo sapiens
ccccagtggctgggacagaagctgctcacaggtctgtggctattgatggtcagagccagagacctgctgtgctcattctgggacgtggtgggg

SEQ ID NO: 6823122 - DNA, 71 bp, Homo sapiens
gttggcctgtcatgtagatgtagagtagaatgtaccaggcttcatttatgctatactgctgacatgctgac

SEQ ID NO: 6823123 - DNA, 74 bp, Homo sapiens
tcataaggcccaaaattcagagactaattgtaaattcacataatcagatttctagcgtttggccaatcttgtga

SEQ ID NO: 6823124 - DNA, 86 bp, Homo sapiens
gaagctcccagagtcctctgcccatgttttcttagccaggtttgtaaaagggatcattctggagcagagggcgtttgaggaaattc

SEQ ID NO: 6823125 - DNA, 56 bp, Homo sapiens
tttcatactgtgtttccaagtttctcctttggggatacaatgaagtatagatgaaa

SEQ ID NO: 6823126 - DNA, 92 bp, Homo sapiens
ccctcagtaactgttaaaaacgcatgccatttggtggattgagagcgaagctccagcttcatgaagtgcgtgccctgacagtcgctgatggg

SEQ ID NO: 6823127 - DNA, 63 bp, Homo sapiens
gctgggtacctcaccgctgctgctggggccactctggccagcagtccacgaggtgagaccagc

SEQ ID NO: 6823128 - DNA, 83 bp, Homo sapiens
accatattgaacactgtgtcctatttccttgacattctagtgaatgaaaaatgagagaacacagttaatgatttgattatggt

SEQ ID NO: 6823129 - DNA, 66 bp, Homo sapiens
tcatcactgcctgcccctgccccccagccaggtttgctgagggtccaggtcttcaggcagagatgg

SEQ ID NO: 6823130 - DNA, 62 bp, Homo sapiens
cgtagaggcaggatggggtcattagggcttttccagcccagtgcctcaggccagcctgcacg

SEQ ID NO: 6823131 - DNA, 57 bp, Homo sapiens
cagctggcctgatccctgtggcgccaggcgggtcctgcagggcgggcagggcagctg

SEQ ID NO: 6823132 - DNA, 72 bp, Homo sapiens
acctttttccaaagcttcttactgtggagtcagaatcctccctgacgtgataagaattttgtgagaagtggt

SEQ ID NO: 6823133 - DNA, 57 bp, Homo sapiens
gcgggcaggctgatgcctcttgggacatgtaagtgcagaaggcaaggcctgccacgc

SEQ ID NO: 6823134 - DNA, 78 bp, Homo sapiens
gacctgaggcaagttcactttcttaaatcttcaattgtcacctggaaaatggagatgataagagggttgcaatgggtc

SEQ ID NO: 6823135 - DNA, 56 bp, Homo sapiens
ggttccaagagattaagttacttgcccagggtcaagagttactaagtgctggaacc

SEQ ID NO: 6823136 - DNA, 71 bp, Homo sapiens
gtagatggaagttcaggaacatgttggaaagaaatcaagataactagattttcttgttttaacttccctac

SEQ ID NO: 6823137 - DNA, 59 bp, Homo sapiens
ttgccttgcagaatgtctgtttttaattgcactggaaagctaacccttctgttgggtaa

SEQ ID NO: 6823138 - DNA, 70 bp, Homo sapiens
cggctctggaccctggagtggctgcaggcggcatggggctgcaagccaggcgctgggcgtccgggagccg

SEQ ID NO: 6823139 - DNA, 72 bp, Homo sapiens
ctcatttgccaagtcgggttgcagacacatcctctttctggagaggctgtctcagcctgcttgcagaatgag

SEQ ID NO: 6823140 - DNA, 89 bp, Homo sapiens
gtcaatcatggataagaatccgattcgtgtacattaatttcttttacgaaagatgtgcaacttgatttgaatctgaaaacatgactgac

SEQ ID NO: 6823141 - DNA, 70 bp, Homo sapiens
aggaaaactgaggcattaaagggaatcttctttggagacagaaagtgttcctttgatccttatccttcct

SEQ ID NO: 6823142 - DNA, 109 bp, Homo sapiens
gagggaaatctgcaggtccgcttcaaagccctggtctgccacccacacccctccaaatgtggagaatgggggctacaggccacatgcagttgtggacctgcggaacctc

SEQ ID NO: 6823143 - DNA, 63 bp, Homo sapiens
ggaggcagtgtttactgccctgtggattcattagcactccaaggccggcctgctctcgcctcc

SEQ ID NO: 6823144 - DNA, 70 bp, Homo sapiens
gtagttagcactgtcagcaagcctctagcacagtctatgtgtatattagtggaatgatatgaagaattgc

SEQ ID NO: 6823145 - DNA, 62 bp, Homo sapiens
tgagaatataattttattcctagagttttaatgtgtgggctctaaaatggagttttatctca

SEQ ID NO: 6823146 - DNA, 73 bp, Homo sapiens
gtacagtatcttagggaattaactaaaaattaactaaaattaacattttctgttaggaccctggagaatgtat

SEQ ID NO: 6823147 - DNA, 61 bp, Homo sapiens
gctccctgcagctgagagttccttccctggaagcctattttattatgcatgtaaggggagt

SEQ ID NO: 6823148 - DNA, 71 bp, Homo sapiens
gtttcacagtctgcagaattttatttccacacagccttactggttccaacagaatttttggattgtgtaac

SEQ ID NO: 6823149 - DNA, 85 bp, Homo sapiens
tagtcaatttagagttcaattagttggataaataacatttgtaatggttatctgtctgacagggtatgaactaaataactgacta

SEQ ID NO: 6823150 - DNA, 57 bp, Homo sapiens
tgcttgtattcatatcacagctcgcttgagtaagtggtaacgacagaataataagca

SEQ ID NO: 6823151 - DNA, 66 bp, Homo sapiens
ttagcataagggcaagctctttagtgtccttcaaagcacatatgtaaatagctgcctgtgtactaa

SEQ ID NO: 6823152 - DNA, 93 bp, Homo sapiens
ggaactaaaagaggacagagtactgagtggaacataggatgatagatttacaaataatgtagcatacttctacttcattgtatcttaagtttc

SEQ ID NO: 6823153 - DNA, 68 bp, Homo sapiens
gaggactcagataatctttgagtcttcattggtgttaccattagaagtgttcaaaggatgtcttcctc

SEQ ID NO: 6823154 - DNA, 61 bp, Homo sapiens
gttgaccatgacatttctagtttctacaaccacaccatctgaaatgtagtgttatgtcaac

SEQ ID NO: 6823155 - DNA, 65 bp, Homo sapiens
tcaactgctattttataacagaagacatactgctaaaaatgtctctaagataggaatacagttga

SEQ ID NO: 6823156 - DNA, 68 bp, Homo sapiens
cactgaggactcccacgtaggtctctttactgcccttcggagacctttttgaaatcagtctgtcagtg

SEQ ID NO: 6823157 - DNA, 76 bp, Homo sapiens
ggatttgggggcagtgaaactactctctatgatacaataattatagacacatgttattatactttcaaccaaatcc

SEQ ID NO: 6823158 - DNA, 80 bp, Homo sapiens
gtggatgaggcagaggaaatgggaatagatggtatgggcagaatcacatgatacatcttgtttatttcaattctcaccac

SEQ ID NO: 6823159 - DNA, 75 bp, Homo sapiens
ttgtgtggagtttatcagagagcagaggtgggctttaagaggctcactagtggtttctggtggttgctataacga

SEQ ID NO: 6823160 - DNA, 58 bp, Homo sapiens
tccagggctgagactgtattgggtttggtggttaattcttcagccttatagccctggg

SEQ ID NO: 6823161 - DNA, 66 bp, Homo sapiens
ccagaatccccagccagcttgcttcccagtagcctctgccaatgggagacactggtgggagcttgg

SEQ ID NO: 6823162 - DNA, 62 bp, Homo sapiens
catgggctttggaggctggaggctgtctattcccaccccactccaccctcccctaccacatg

SEQ ID NO: 6823163 - DNA, 97 bp, Homo sapiens
tgtttagtttgctggcctgtgggtctccatgagttctgttgctttgggctgcacaaatgctgggaaccattggatcagccaccccagccactagata

SEQ ID NO: 6823164 - DNA, 117 bp, Homo sapiens
cgtctaattcactcagaattttttaaaaagaatgcttcctttgaaactgaagttctttctacttggtttcagcccaaaggtgagcatttttttgagaaggttaaatcttttcagatg

SEQ ID NO: 6823165 - DNA, 79 bp, Homo sapiens
tgtatgtagggaaatcacaaatcattttatctgtgtgcagcaaccaattatttaatgatttggggtctactggcgtaca

SEQ ID NO: 6823166 - DNA, 83 bp, Homo sapiens
caaaggtttcatgcaatgttatatctgtatgtatatgcatgtgtgtgttttcatcacagaatgtaacacatttgttatttttg

SEQ ID NO: 6823167 - DNA, 62 bp, Homo sapiens
agcccagagggtagcagaagaaagaagttgaatattttttctctctgttctcctctcttgct

SEQ ID NO: 6823168 - DNA, 66 bp, Homo sapiens
tgactgctggaccttcagctgggttttggttatttacaaaacaatgttgctgggtgcggtggctca

SEQ ID NO: 6823169 - DNA, 79 bp, Homo sapiens
gtctatgaggccctcttgccacaatgaaatgtgtaaatatttgtaaatttacttcagctgccaggatgggtaacatgat

SEQ ID NO: 6823170 - DNA, 57 bp, Homo sapiens
gcacgtgtgtgtgtatgtgtgtgggtgggtgagtgtgcacacatgtgtgttatgtgc

SEQ ID NO: 6823171 - DNA, 70 bp, Homo sapiens
ccttcacaccatctttaccagggggatactactattatctgtttttattggtggagaaatgctgagaagg

SEQ ID NO: 6823172 - DNA, 79 bp, Homo sapiens
ggctggttagttgaggaggacttagctgggatggtttgtctctgctccatgtgatctctcctcctccactaggctagcc

SEQ ID NO: 6823173 - DNA, 102 bp, Homo sapiens
gagacaggaggatcgcttgagcctacggaggtcaaggctacagtgagtcgtgactgcatcattgtactctagcctctgggcaacagaatgagatcctgtctc

SEQ ID NO: 6823174 - DNA, 65 bp, Homo sapiens
tttacagcacccattaaggactggggagttatgctccatccatttgagagtggagtatctgtaga

SEQ ID NO: 6823175 - DNA, 57 bp, Homo sapiens
gcatctctacaacgaagacagtctttgaaggctgttttcaaagagagagaatgatgc

SEQ ID NO: 6823176 - DNA, 77 bp, Homo sapiens
cagaaatcaaaagctgtatgagtattgagccagagcatcacttctgctcagtaagtaaacagtaactggatctgctg

SEQ ID NO: 6823177 - DNA, 64 bp, Homo sapiens
tatctgctgttgatgaacattggaagaaaagctacatcttttcatgtacattcggcaacagata

SEQ ID NO: 6823178 - DNA, 69 bp, Homo sapiens
aggattttgaaccagacagacttcttatgaaagccaacactcttttgtctgttcaggtttcagagaact

SEQ ID NO: 6823179 - DNA, 59 bp, Homo sapiens
cacatgtagacatcaccaagggtatcaatagacacaaccacagaggtgtctgcagtgtg

SEQ ID NO: 6823180 - DNA, 94 bp, Homo sapiens
agctcttctctacaccttcacaaaaggtttattgctatggttgtttactgagacccaaggcagagcagggccagtggagtcaaagagatgggct

SEQ ID NO: 6823181 - DNA, 64 bp, Homo sapiens
ggatggatggtgagtggattgtaatggtcgatggataatggcaaataaatgctcactgctgtct

SEQ ID NO: 6823182 - DNA, 60 bp, Homo sapiens
ctccgctgtgtgtttttgtgccctcaggaatgtgtggatgcagcaaatgacaacagtgag

SEQ ID NO: 6823183 - DNA, 90 bp, Homo sapiens
aggggtccgggggggcttgtcaggggctgagggggctctcccgaagctccccacactttcactcctggctggccctgggacctggccctt

SEQ ID NO: 6823184 - DNA, 59 bp, Homo sapiens
gaggctggcatgtggcagctggttcagtggcaaccctcagcccagcccagtgcccactc

SEQ ID NO: 6823185 - DNA, 66 bp, Homo sapiens
cactgcagggcagagggagaatctctggaaaactcactagaggtgaaagaatttggctctgaagtg

SEQ ID NO: 6823186 - DNA, 71 bp, Homo sapiens
cttataagctgtatgacctaaatcttgtgtggttaccacgaaaacacgcagatcatatatccagctgtaag

SEQ ID NO: 6823187 - DNA, 82 bp, Homo sapiens
attgatttgtagctaaaatatgtttacatgtattctatccatatgagcaaaatacagtaattgcataggcttcaaaggtaat

SEQ ID NO: 6823188 - DNA, 81 bp, Homo sapiens
cttcttttaagtgattataataagaaaaggaaacgatgtgtttgggtctttcctactttattgtgaactacttgagagaag

SEQ ID NO: 6823189 - DNA, 74 bp, Homo sapiens
gagccagccagccagggtgctggggctcagctcttgagaaaaatgttgatgtaaaagccttggtggcctggttc

SEQ ID NO: 6823190 - DNA, 85 bp, Homo sapiens
gctgacctggtgctgtagcctgattgaggggcacagccttttccccagtcttggtgtctgtagcacgtatgttcttagtctcagc

SEQ ID NO: 6823191 - DNA, 64 bp, Homo sapiens
agtgggtacagggtagggcaagggaacctgcgtgtttaacacgtgccccctctacccacccact

SEQ ID NO: 6823192 - DNA, 56 bp, Homo sapiens
gaagtacacgtgtaagcttttctcctctgaagagaaaggtaaaatcagtgtccttt

SEQ ID NO: 6823193 - DNA, 83 bp, Homo sapiens
ggtttctgctgcttccatttccagctttctaggcctgttgttgactctggacatacatgaggaggctggaaacagtggagact

SEQ ID NO: 6823194 - DNA, 62 bp, Homo sapiens
tgcaattttaatacattagaggctaacagagttatcttgagctcataatgtttgactttgca

SEQ ID NO: 6823195 - DNA, 59 bp, Homo sapiens
agctggcttgcaagagaccctacatattgttatgtgtcctgtgggttttgggagcagct

SEQ ID NO: 6823196 - DNA, 76 bp, Homo sapiens
gacctgctgggcaatatgctgggcctggacctctgaaaggacaacacccagaccgtggcccgtgcccacacaggtc

SEQ ID NO: 6823197 - DNA, 130 bp, Homo sapiens
tgggataagaaaaatttatatggagaagtagcttatgctcattctgatactgctttattaactatattagcagcatgttgggatgtgaaaataggataactgccattctattacaatatttgtttacaca

SEQ ID NO: 6823198 - DNA, 75 bp, Homo sapiens
aataagccagagccagcaactctagccctgtagagatttctttccaggaatagatctgttttgcctggtgatgtt

SEQ ID NO: 6823199 - DNA, 95 bp, Homo sapiens
tatcttttgtataaacctgtacaggtcaatgataagatagtttaaatattctctatctttcagggccatttgtatttggtttagacttagtgata

SEQ ID NO: 6823200 - DNA, 62 bp, Homo sapiens
gtgagtctttggagacagttcagtataagcaggattatctctggattgtatagaaggttcac

SEQ ID NO: 6823201 - DNA, 65 bp, Homo sapiens
tagcatttcccaaatgcatttgaccttctaggacctagtcaagtgtggggcctggggaaaagctg

SEQ ID NO: 6823202 - DNA, 55 bp, Homo sapiens
tctgacagttatataagcaccagagctaggcatggtctgacttgtagctgtgaga

SEQ ID NO: 6823203 - DNA, 91 bp, Homo sapiens
gcctggcagtgggaggagaccgtctgggcagagttgtgatgaactggggaccgagcagccccagctcgcctcggaggttcccgagccgggc

SEQ ID NO: 6823204 - DNA, 56 bp, Homo sapiens
tcctgagcacctatgccatggcacacaagtgctggggccacagttagggctcagga

SEQ ID NO: 6823205 - DNA, 129 bp, Homo sapiens
caacggcgttggggcaagcctctctgcacctgcgtgtccagcctctcctgcatgccagaagtccccaggcaggagtgtggtgggacatccggctggggtaaggacaggcaccctcccacagtgtcaggg

SEQ ID NO: 6823206 - DNA, 61 bp, Homo sapiens
acatatgagtactatacagtgcctgcataccgtgtgtatttattgtgaatactgcatatgt

SEQ ID NO: 6823207 - DNA, 72 bp, Homo sapiens
ccagagatccatgcaatacagtttatagtaattcttcatttgcaatttgacaagttgcatgtttccatctgg

SEQ ID NO: 6823208 - DNA, 80 bp, Homo sapiens
gtgattcttctgtcctggcacttttcccagttttggtgcttaaatttactatccacttgaaatgtgtcactgcctgtcac

SEQ ID NO: 6823209 - DNA, 56 bp, Homo sapiens
cattatgtctgagttccaataatggggggaaggaccagaaggaggaaggcatagtg

SEQ ID NO: 6823210 - DNA, 58 bp, Homo sapiens
ggaacatgtagagggcctgtaggttatcaccctgctttgccagttaatactgtgttcc

SEQ ID NO: 6823211 - DNA, 88 bp, Homo sapiens
ctctatacacaatcgcacagatccttcttctgcattgcttaaggaattcttaaggaattgcattctgggaatggcttggtgtatagag

SEQ ID NO: 6823212 - DNA, 100 bp, Homo sapiens
ccatctcagctgaaagatcatttccaaattagaggaagctgcgactgactgagaaggcaggaggtgccctctagtggcatggttacattagcttgggagg

SEQ ID NO: 6823213 - DNA, 70 bp, Homo sapiens
gatgctccaggtgtctcctatgagcacagcgatgccatttgccaatctcctggtgacatgcctgagcatc

SEQ ID NO: 6823214 - DNA, 64 bp, Homo sapiens
tggcagctgttcagcaactcgcagagcagtctctcttctccatctgcctcgctaacagcagcca

SEQ ID NO: 6823215 - DNA, 77 bp, Homo sapiens
tttcctgtgataagacagccttctctattggcctcatgtggtgatcctggtggtgtgggggctggctgcacaggaga

SEQ ID NO: 6823216 - DNA, 75 bp, Homo sapiens
aggactgtgtcaattaatgtttgatgtgtgtgtttccttacttgacagacattttaattattaaatctcagtttt

SEQ ID NO: 6823217 - DNA, 66 bp, Homo sapiens
agacacacacatacatatgacaactttcctgtaaaggtacagctgtgtgtgtatgatatcttgtct

SEQ ID NO: 6823218 - DNA, 65 bp, Homo sapiens
cctgagatctttagaagatagaatcagcaagacttgacaactgattggatgtgggaggtcttagg

SEQ ID NO: 6823219 - DNA, 55 bp, Homo sapiens
cagcagggttaagtgactcacctgagggcacacagtggagtctttgttactgctg

SEQ ID NO: 6823220 - DNA, 78 bp, Homo sapiens
agcaagaccagggttttgtgtttgtgaacctatctaatattgctggggtttgaaaactgaaccctgagttttattgct

SEQ ID NO: 6823221 - DNA, 66 bp, Homo sapiens
aaagcactatagccaaatagccccaggaacctctccttctttgattcaattggttgtggatgcttt

SEQ ID NO: 6823222 - DNA, 58 bp, Homo sapiens
agtcctgtgaggggtgcagctttgcaactgcaggccaaagagcaaaccaaacaggcct

SEQ ID NO: 6823223 - DNA, 60 bp, Homo sapiens
gctccactgtttattggcagaagggaggattgtgtccagggccgcagtatgcagtggggc

SEQ ID NO: 6823224 - DNA, 67 bp, Homo sapiens
gaggtggtaatattcagaacatcaagctttaggatattcctgtggacaagtgctgaataactacttt

SEQ ID NO: 6823225 - DNA, 55 bp, Homo sapiens
acagcttctatttctctgtactctatgtctttgagtttggagagaaagaagtagt

SEQ ID NO: 6823226 - DNA, 60 bp, Homo sapiens
tgtggcttccacgatggtcacctgagacaatctttattggtgacaatggtaggaatcata

SEQ ID NO: 6823227 - DNA, 82 bp, Homo sapiens
tgaaatgggttgtgcagaaggcagaaagtccaggtatcttggctagatccagaggcactgccctttgtgcacctagacctca

SEQ ID NO: 6823228 - DNA, 120 bp, Homo sapiens
taggctgactggcttttttagggtaggtgagaggagaagcactttactttggggtgcccacatccacattagaatgttttctcaatttctttctcttacttttttgagattttaggccta

SEQ ID NO: 6823229 - DNA, 83 bp, Homo sapiens
aagacaattttgtggatctgtcaaatggattttgtcagaatgagctgatggaattcattaagaaagagctaaagaactgtttt

SEQ ID NO: 6823230 - DNA, 100 bp, Homo sapiens
atggaacaagccatggatgcattcacagtctatcttggtttttggaaatgggagtttcagaaaaaaggacagggctgggatcatgaaagggcttggccat

SEQ ID NO: 6823231 - DNA, 90 bp, Homo sapiens
atgaccactttgtaacttatcatttcaatatagttccattgggtagtagtacctttattctgttttgaagataaggacactgaagggcat

SEQ ID NO: 6823232 - DNA, 76 bp, Homo sapiens
aagagtgctggactcatgaccagaaggcctggcatcaggtttggtgctgccaatttctggtcttgaacaagctttt

SEQ ID NO: 6823233 - DNA, 61 bp, Homo sapiens
aggtgccaaaatattagtgcttaagtacactgatggtgtgctaaaggcagaatattcacct

SEQ ID NO: 6823234 - DNA, 55 bp, Homo sapiens
cttggggtcttcctcctcctgagatctccttaggagggcttcatcagacccccag

SEQ ID NO: 6823235 - DNA, 58 bp, Homo sapiens
ctcagagcagactttgaaggagggggccatagttctctgggtcattttttcctctggg

SEQ ID NO: 6823236 - DNA, 69 bp, Homo sapiens
agcggtgagtagaatgtttctggatggtcaaaggagaaagggattttctcagctacgctttcaccagct

SEQ ID NO: 6823237 - DNA, 75 bp, Homo sapiens
gtgtttgacgtgaggaattgatacagagttgatgccttctatggggacagctggtactcagttcttgtcaagcac

SEQ ID NO: 6823238 - DNA, 64 bp, Homo sapiens
ggcttttgcctagggttgacccgtttccgccactgatcagctgaatgaccctgggacaagtccc

SEQ ID NO: 6823239 - DNA, 58 bp, Homo sapiens
ttctggtgagtcagctgtgaaacatggcccattgtttcaacaaatatggccaccagaa

SEQ ID NO: 6823240 - DNA, 122 bp, Homo sapiens
atgaacactgcctttcaaatgtgaaaaaacgtttaaggtataaaaagaagaagaagcaaatgtgcttctttagctagaaatactctaaagtacattttacattttttcagcagtagtttcat

SEQ ID NO: 6823241 - DNA, 80 bp, Homo sapiens
taagggtctgagaggttaagaatccttccaaatgcttatcttattgcaccactttggaacttaaccctgataggtcctta

SEQ ID NO: 6823242 - DNA, 71 bp, Homo sapiens
agaagtttgaaatatttctacaatgaaaacaccagaccatgtggtttttattggagtgataccaagctttt

SEQ ID NO: 6823243 - DNA, 110 bp, Homo sapiens
gttacctggcttgtaataggccttaagttgtctgctcctataaaggaatctccagaatattcctcacagagtggcaggcaatgttaaaacctcattagtaccagtgtaat

SEQ ID NO: 6823244 - DNA, 88 bp, Homo sapiens
ccacttggccacagcactgggttgctgatttagccatacacatgggcacatggtgtgggatagatcggtacccaatatgtggtggtgg

SEQ ID NO: 6823245 - DNA, 80 bp, Homo sapiens
gtctttctccacatcctctccaacacttattttttgaaatgttctcaggagaaacctgtaaggaaggaagtgagggaagc

SEQ ID NO: 6823246 - DNA, 56 bp, Homo sapiens
ctaggctagatagtatattggttcaattaatggtcatatattttaatttagcctgg

SEQ ID NO: 6823247 - DNA, 58 bp, Homo sapiens
ttggactgttactgtatttaatcatctaacacatctagaggaagacagtaacctccag

SEQ ID NO: 6823248 - DNA, 82 bp, Homo sapiens
gtatctttaagccatcggagtgaaaaataatcaatgtctacgttagttaaaccaccattctggtattggtagttgaaggtat

SEQ ID NO: 6823249 - DNA, 57 bp, Homo sapiens
tgactattacatgctttcaagactgtatgtcagtcaaacatgggggtatgagtggca

SEQ ID NO: 6823250 - DNA, 80 bp, Homo sapiens
ttccattcttgattttcttctggtggccgaagggctggacacagacttctcccaaccatcagagggcacagagtgtggag

SEQ ID NO: 6823251 - DNA, 78 bp, Homo sapiens
tttgtcttacattcgtgatttccttccacttctgacatgtcttacagctgaaggattcaagaaatggtgtagcacaag

SEQ ID NO: 6823252 - DNA, 88 bp, Homo sapiens
gctcactggtagctggaactgggtttgttggagggaccatcataatcactgcctctaaagcaaggcctttccaatgacagtagtgagt

SEQ ID NO: 6823253 - DNA, 77 bp, Homo sapiens
tgttgggctcctgagcaagcatgccaagtctgtttgcaatttccgcagcacatagcatgcttgtcagaggctttcca

SEQ ID NO: 6823254 - DNA, 60 bp, Homo sapiens
gaatgctgtagacagactctattaagtcccaaatctttgggcagtttttctccagcattc

SEQ ID NO: 6823255 - DNA, 76 bp, Homo sapiens
tcacgttagaagtggtaagtagaaagatgaagacttccagctccttctgttactcttcccaccacttctgttctga

SEQ ID NO: 6823256 - DNA, 122 bp, Homo sapiens
tcctaggcaaaagttttcacactgttttcagtcagttctatgtagttataatagaatgaatcttcctaatttaagtcatagaatgataaaagcagtgatgaaaagagaatgtacacctagga

SEQ ID NO: 6823257 - DNA, 85 bp, Homo sapiens
acagagtgtagctacacagttaaaggcccaatatctggataaggtcagccttagatttagaccctgcctgacagttactctctgt

SEQ ID NO: 6823258 - DNA, 63 bp, Homo sapiens
gctgccagtaattgaccgtaaagacgacaccctagccagttttcatcagttgatctggacagc

SEQ ID NO: 6823259 - DNA, 60 bp, Homo sapiens
ccatgatgcccagacgcctggcttggacagtggctccagtgagatatctgggcattatgg

SEQ ID NO: 6823260 - DNA, 56 bp, Homo sapiens
tctggaagagcatgtgtttacaaatgcagaatagcatgcaatactgcttatccagg

SEQ ID NO: 6823261 - DNA, 58 bp, Homo sapiens
cctgagctttgctttcctcatctgtgaaaatgacaagagtgaggcaagatggctctgg

SEQ ID NO: 6823262 - DNA, 71 bp, Homo sapiens
gcctagtaggaggtttgagtcagggtctgtgttcacaggctagtagctgaatgaacttctctgcctacggt

SEQ ID NO: 6823263 - DNA, 56 bp, Homo sapiens
ggtgacagttccggaggtacagatgaatacataacgtcagcttcctgcctgtcccc

SEQ ID NO: 6823264 - DNA, 57 bp, Homo sapiens
ttctctggagagtatcttcttatctgttgtgagagaattgagattttctccaaagaa

SEQ ID NO: 6823265 - DNA, 72 bp, Homo sapiens
gtatttgtgacagtatttgtcatcttgtcttttggccatagttatcatgacaggatgatagaaaacagatac

SEQ ID NO: 6823266 - DNA, 96 bp, Homo sapiens
tcaaacaggataactaaagcttattatcttatcaagcttgttcccttgcagacaagattgatcaattatcataggctttctgggtgttctttctga

SEQ ID NO: 6823267 - DNA, 80 bp, Homo sapiens
agttgttgtgccattgagaggtttcagatctcctagcataatttgattgctgtttctgccctacttaggtgatagcatct

SEQ ID NO: 6823268 - DNA, 73 bp, Homo sapiens
ggagctcagtctacaccccaggctccgggcctggctccttgcggcccctggtttccaggtgtgtacagggccc

SEQ ID NO: 6823269 - DNA, 70 bp, Homo sapiens
cacgtcgacacatatgcgtatagtttagtcgttttaactgctgttaaagtgtgcgcatgtgggagaggtg

SEQ ID NO: 6823270 - DNA, 92 bp, Homo sapiens
tgtgaaaaactgtgtgatctaggaggaagcagccctaggcatgaggaagtcttagccttgctttgcttctggacagctgcatgattgttgca

SEQ ID NO: 6823271 - DNA, 96 bp, Homo sapiens
tcttccttcctgtcatctgttccttcagcaagtcctgagcacctgacatgtgatagcatcttgctagtatttgttgagcggatgagtggatgaagg

SEQ ID NO: 6823272 - DNA, 108 bp, Homo sapiens
ctcctcgggtgatcttagacaagggttctgtgcctcctgctgctgcgccagctgccaggggcctggggctcggagctctcacacttacttctggggttgtccaatgag

SEQ ID NO: 6823273 - DNA, 81 bp, Homo sapiens
gccttcttatcctcaagttcacagtctggtcgctgctgtattccaaggcagtgaaaaaagacttgttgaacagatgaaggc

SEQ ID NO: 6823274 - DNA, 74 bp, Homo sapiens
agcctacatgtttactccaagtcagggtttctcaagcttgacaccactgacttgcgaatggataattgtttgct

SEQ ID NO: 6823275 - DNA, 67 bp, Homo sapiens
aggatcctgactattgatcatcactcaaacatgagccatgcaggagagtgagtcagtagggtgtcct

SEQ ID NO: 6823276 - DNA, 60 bp, Homo sapiens
ttgattgaattatgaggtctgtaaatcatgtagtttacagtcaggcatgaattcagtcaa

SEQ ID NO: 6823277 - DNA, 68 bp, Homo sapiens
ccttcctctgtggcttgcctttctgtccaccaagaacaaagggggagaaaagagagtcagagagtagg

SEQ ID NO: 6823278 - DNA, 62 bp, Homo sapiens
tgctggttttgaaaacgcaagctgcctgttgtaggttgcctgtgttgggaggcctataggca

SEQ ID NO: 6823279 - DNA, 70 bp, Homo sapiens
tcctcttgctatttgttttcaatgtgtcattcagtggtgggctgaaatgttaaacaagtggctctgaggg

SEQ ID NO: 6823280 - DNA, 109 bp, Homo sapiens
gaagaaatctagtgtttttttattttttaaccttatcatgcataagtagaaagcagtactcatgtccactctcttttgtgtgtgtagggtgaaacaaatctagttcttt

SEQ ID NO: 6823281 - DNA, 62 bp, Homo sapiens
tgagctcacacagctccaaatacaatggaaaccactgggttatttgtcagctgttgagttca

SEQ ID NO: 6823282 - DNA, 125 bp, Homo sapiens
cactactctctaagtccttggcttacccggctccagttcctgaatgtatatttcatttggttatttctcatgagacatgacttcaggcctttggagtctcactgggccttggtctgaagagtgtg

SEQ ID NO: 6823283 - DNA, 91 bp, Homo sapiens
ggggaatcacttggtgctgtccagggagccaggcaccttctgtgttgggctaggaggcctgcatttggctggctcccacagcagggacctc

SEQ ID NO: 6823284 - DNA, 91 bp, Homo sapiens
gaagttccagttgttttacatctcaccagattcatatgcccctcctttgcctttgtatcattctggtgggtgtgtagctgctggcaatttt

SEQ ID NO: 6823285 - DNA, 130 bp, Homo sapiens
ttgttgcttgtatcagaacttcattcctcttcatggttcagtaatctgctagaaatttgaaaaaactatttttgtcagttcagtgattacaaaatatttgaagttgaataactataattttaagcaagga

SEQ ID NO: 6823286 - DNA, 85 bp, Homo sapiens
gggacaagatgggaggatgctcgggtgctcagggatcctccagcctcccttgtccaccccttctcctaaccccaacttctttccc

SEQ ID NO: 6823287 - DNA, 59 bp, Homo sapiens
gggcagtggttacacagctgaggccctgagcctgcccagctccctgcacgaccctgccc

SEQ ID NO: 6823288 - DNA, 65 bp, Homo sapiens
ggttagttagcgaatgtgttttgcattcaaccaaggaagttcaaaatactgtctctgagagagcc

SEQ ID NO: 6823289 - DNA, 58 bp, Homo sapiens
ggagaggccacatcagagctgtccagggtcccccctcagcgtgatcttggtctcctcc

SEQ ID NO: 6823290 - DNA, 94 bp, Homo sapiens
ttctgaaaggtaattgtatgttccaagcagccgatattaacaacttccatcacgactctaggaataattcgcagttctgaaccatgttttagaa

SEQ ID NO: 6823291 - DNA, 57 bp, Homo sapiens
gggcttttccattccagggttctcatccctttgagcattcaaagaagaggaaggccc

SEQ ID NO: 6823292 - DNA, 102 bp, Homo sapiens
gaagcaaaaaagtaataggcaaagtttaaagtagatttcagctagatcataaacagcttgggatgctggtttaaatttgtagatgtttttgacttatgtttc

SEQ ID NO: 6823293 - DNA, 75 bp, Homo sapiens
gctaggtgcctgcgtccacggctgggagacgggccgtagccgagccgctccctgtttgggcggaggaaccatggc

SEQ ID NO: 6823294 - DNA, 108 bp, Homo sapiens
ggtttagatgggggagttaattagggtctgagggttgtgctggaggacatggggtacttgcccataaggtccttgtatagatgcagacacttggctccattgcctgcc

SEQ ID NO: 6823295 - DNA, 85 bp, Homo sapiens
aggcagtcatggccatggcacatagaaaaggatcaataaatattagtttagtggttatgagtgtgtctctggggacagactgctt

SEQ ID NO: 6823296 - DNA, 78 bp, Homo sapiens
tcttttattctctggcttccatgcagttattgagaaagtagtcacaattacccagggaccaagagaaaccctgagaga

SEQ ID NO: 6823297 - DNA, 56 bp, Homo sapiens
ttggaggaagctcatgggggatctgtgtatttcttaggtttctccctgttctccaa

SEQ ID NO: 6823298 - DNA, 78 bp, Homo sapiens
tcttgctgtgtctctgcaggcaacctcgtcctgcttatttttatgggacaggtactatgtgcagacacctatgctgga

SEQ ID NO: 6823299 - DNA, 84 bp, Homo sapiens
aattctctgcgtttcatcagtgctttaagaatgcctctctctctccatccttacagcaatactggtgggtcaagcagagtagtt

SEQ ID NO: 6823300 - DNA, 87 bp, Homo sapiens
tgctggaatattttggacctgcttgagccagtatgagatttgtgcacatatctgactttcaatccaggtttgaattgatattcagca

SEQ ID NO: 6823301 - DNA, 57 bp, Homo sapiens
ccttttctgtttcctgtcactgttgtggcaaaaacatggctgacctagcagagaggg

SEQ ID NO: 6823302 - DNA, 129 bp, Homo sapiens
ttctggaccagatattgttttttaattttcaatgtttattctaggaaaactccttagctcataaaagatttagtgttaagagaaaattctgctttgagagctttgaaaaatatttattattatccagaa

SEQ ID NO: 6823303 - DNA, 68 bp, Homo sapiens
gaacctctagagagtcaggacagcatagcagttaagagtagggcttctgatgtcagacttctgggttc

SEQ ID NO: 6823304 - DNA, 77 bp, Homo sapiens
tctcagattatccaggtggtcccaaatgtacttataaaggttcctctaagtaaaaggggatccaggagaatcagaga

SEQ ID NO: 6823305 - DNA, 66 bp, Homo sapiens
actgggtttaggccaggcaggcccaggcctggtttcgggcctggcgccgggctgcctgtctttggt

SEQ ID NO: 6823306 - DNA, 75 bp, Homo sapiens
ctggcagaccctcttctattggtgggaaccatgtctcatgggcactcacagttacaagggagtctgaaacaccag

SEQ ID NO: 6823307 - DNA, 107 bp, Homo sapiens
tgtgaggggtgtcagttatagccttggtccttgctccacttctgtggtgaggtgctgccaagagctgtggggaaaggagtggggctcagagctgatgcccatttgta

SEQ ID NO: 6823308 - DNA, 59 bp, Homo sapiens
cctatctagttagtaattaacatattaggtttgggtgcctaatatgttaattaggtagg

SEQ ID NO: 6823309 - DNA, 58 bp, Homo sapiens
ctgggaacaggcactgctgtcaggagctactgcctgggcctaccagcctgtatcccag

SEQ ID NO: 6823310 - DNA, 121 bp, Homo sapiens
aatatatattttagcaatttggatattcatgtcagctggagactgctcaatgagataacaactaatatttattgtgtacttcctctgtgctgggcatcatactaagtgctttatgtgtatt

SEQ ID NO: 6823311 - DNA, 67 bp, Homo sapiens
catttactgagcaacttttctgtgtgtcaggcactatatggccttgcatttcaattgctcaggaatg

SEQ ID NO: 6823312 - DNA, 64 bp, Homo sapiens
ttgaggcaacagagcatttgggtaatggcaagggtctcagattccagtggctttgctgctttaa

SEQ ID NO: 6823313 - DNA, 77 bp, Homo sapiens
ggcactggagcggccctccctccctctcttttggggacctcgagggtccaggggcgaggggagccgtgccagcagcc

SEQ ID NO: 6823314 - DNA, 129 bp, Homo sapiens
ggtgattgaatcatgggggtgggtttttttgtttgtttgttttgagatggagtcttgctctgtcgcccaggctggagtgcagtggcgcgatctccgctcactgcaagctccgcctcctgggttcacacc

SEQ ID NO: 6823315 - DNA, 65 bp, Homo sapiens
aggtcagagcaatgtattgcttctggtttgttaagcaatgtgtagcagtgcattgcttctgattt

SEQ ID NO: 6823316 - DNA, 57 bp, Homo sapiens
acaaagtgctgacattacaggcatgagccaccgtgcctggctatttttttgctttgt

SEQ ID NO: 6823317 - DNA, 101 bp, Homo sapiens
tgattttattagtgaaagatgaagttggtgctcatttctaggctaactgagtaagttctggtctaaatatggctctaaatcataaattatttcgataatca

SEQ ID NO: 6823318 - DNA, 56 bp, Homo sapiens
gcccaagtctatagccttggttgatctgaggattgaggatattaggtgatttgggt

SEQ ID NO: 6823319 - DNA, 84 bp, Homo sapiens
gtgccaataatatttttaaaattgctatacatgtggaagaaaaattctttcaagtcaatttttgaatgactgtttgttaggtac

SEQ ID NO: 6823320 - DNA, 77 bp, Homo sapiens
cagtgttgtataattccagggcgtgttgtctacaaggggtacaatgtgaagagtgctccctagagttgtgcaacctg

SEQ ID NO: 6823321 - DNA, 74 bp, Homo sapiens
tatggatctgaagatatgagctttatgattaattcctataaataagttatgaagttcctgttacagtggtcata

SEQ ID NO: 6823322 - DNA, 66 bp, Homo sapiens
atacacacaagttctaaagattgcgcataagctaatgtgcaagtccagaaagaactctgtttgtat

SEQ ID NO: 6823323 - DNA, 64 bp, Homo sapiens
atggaaaaagtcatgtgcacagagaacagtctatgaatggtgactgatttaaacgtggctctat

SEQ ID NO: 6823324 - DNA, 68 bp, Homo sapiens
gccgcgcgggctcctcactgcatccccaggctgagggggttggggatggggtcgggaccctgctcggc

SEQ ID NO: 6823325 - DNA, 129 bp, Homo sapiens
tcattgctgtggatttttgtcttggacttgacattcatgaatgttccatgtgagtaaagcactcaagtttacctgtgaccacctggagcagtatgatttggtgtccagttagctgatccagcttaaggg

SEQ ID NO: 6823326 - DNA, 68 bp, Homo sapiens
aggtcctgttatcctcagctcacctctagatgcgaaactagaggccgaatgctgagctgggagggcct

SEQ ID NO: 6823327 - DNA, 57 bp, Homo sapiens
atttgatgggcccgtgggacaaccacattgagatgttgtctttaggacctgttaaat

SEQ ID NO: 6823328 - DNA, 74 bp, Homo sapiens
agcctcccttgtctcaaggttactctatgatgccatttacatcccagagctccccatgggatcaggctgaggct

SEQ ID NO: 6823329 - DNA, 92 bp, Homo sapiens
gtttctcccctctggtgtagctgtccagtgagtccctttgaaataaaggtatgatactgtgacatgcttgcaaaaagtatacatggagaagc

SEQ ID NO: 6823330 - DNA, 65 bp, Homo sapiens
taaggagcgtcctcaaattacactcacagtttcaaagttcaagaattgtggctgagcactcctta

SEQ ID NO: 6823331 - DNA, 65 bp, Homo sapiens
agaaggagagtagttaggactggggcacgtataggtctcaatgactcctatttacatttttagct

SEQ ID NO: 6823332 - DNA, 75 bp, Homo sapiens
tgctattggtgggagtgtaaattagttcaaccattatggaaagcagtgtggcaactcctcagagagctaaaagca

SEQ ID NO: 6823333 - DNA, 112 bp, Homo sapiens
atgagtgcattttgcctccaacagaattattgcttctaacttgctgaattccatgaaggaatgggcacacttagagagtaaaattcattcagggaatttgtaaaacactcat

SEQ ID NO: 6823334 - DNA, 60 bp, Homo sapiens
gccatggggtcacatggagagagaaagcaaaccaactttcagagctctaggctctcaggc

SEQ ID NO: 6823335 - DNA, 57 bp, Homo sapiens
attaggttggtgcaaaagtaattacagtttttgcaattacttttgcaccaacctaat

SEQ ID NO: 6823336 - DNA, 77 bp, Homo sapiens
ctggccttgggtctctgtgccttctccccaccccacagatttggtggggaacatggcaggagggtaagcaaggtcag

SEQ ID NO: 6823337 - DNA, 82 bp, Homo sapiens
caagtgctcacataaactctctgtaccaatatactatatgtaatattgtgtgtacaagtagttagtatctaaggagcatatg

SEQ ID NO: 6823338 - DNA, 116 bp, Homo sapiens
gcaagtcatttaacctcttcaggcttagtcttctcatagtaaaactagagctatcatggaatgatttgcaggatgcttgtgaggactaagtgaaatgatgcagttgagtgcttagc

SEQ ID NO: 6823339 - DNA, 66 bp, Homo sapiens
tgtgcttatgcacacatatgagcatgtgtgtgcccatgcatgtgtaagtgtgtgtgtgtctgtgta

SEQ ID NO: 6823340 - DNA, 85 bp, Homo sapiens
ggcttcctccctgctgctcactaccattctcgccagcagaatggtgacaaaccagtagcaataaagaggtgggaggacttgagcc

SEQ ID NO: 6823341 - DNA, 116 bp, Homo sapiens
caagtttttcagtgatgcatgttaacagttaggtcctaaaattctgtggtgctaattctcccatacccaatggtgcttttgtggatgctaactgcacacatgctgaacaaagcttg

SEQ ID NO: 6823342 - DNA, 62 bp, Homo sapiens
gccgtcctggaaagcaccgtctgttgttcattcaattgcatccgggctacttccacaccggc

SEQ ID NO: 6823343 - DNA, 80 bp, Homo sapiens
gggaagtttagaggttggggactttgcaggttagggacgtcacataaaggcttcagaggaaacaatctttagtactttct

SEQ ID NO: 6823344 - DNA, 67 bp, Homo sapiens
tgtgtcctttccccctacttaaaaataatgataggttcttctggaacctgcttaagtaagtgacaca

SEQ ID NO: 6823345 - DNA, 87 bp, Homo sapiens
tgtgggagcctgtcctgtgcattgtcagatggctagcagcaaccctagcctctgctctataaatgccagtagcacctcctcccaaca

SEQ ID NO: 6823346 - DNA, 65 bp, Homo sapiens
gacagagccctgataccctgagaccaggcttgctctctctgggtgtcttaggagctcactatgtc

SEQ ID NO: 6823347 - DNA, 56 bp, Homo sapiens
tacttttgcagtataccaggaccacgttacacctggtccttaagtacctaagagtg

SEQ ID NO: 6823348 - DNA, 64 bp, Homo sapiens
tggcttgccatagttaccaggaaatgagtgtctatgcacattcatttcaggttgcatggtacca

SEQ ID NO: 6823349 - DNA, 68 bp, Homo sapiens
gactctgaagcatgtgctggggctttttgtatgtgctgtgtcaaaaaggtaagcacaatgagagggtt

SEQ ID NO: 6823350 - DNA, 62 bp, Homo sapiens
ggagtctgttttacatgcaggacagggatcttttcagcatgtagttcagatcatgttattcc

SEQ ID NO: 6823351 - DNA, 70 bp, Homo sapiens
gcaatattgtgttatttttctaagtatctatttttgttgtggataagaaaattgtaataactgttattgc

SEQ ID NO: 6823352 - DNA, 125 bp, Homo sapiens
ggctggctttgtacactcatttatagataggcttcagagacagtgaggaaggctaggttgaggaagccacaaaaccacggctctcactcctggagaattatttgtattgaggtccagaggcagct

SEQ ID NO: 6823353 - DNA, 55 bp, Homo sapiens
gtttgttgtggtagcttttgcactacaacagtgaagttgagtagttacaacagac

SEQ ID NO: 6823354 - DNA, 73 bp, Homo sapiens
aagcttagcctggggacagagtcaagttcctaagcatgatattggaatgggagctgcccccagggctgtgctt

SEQ ID NO: 6823355 - DNA, 95 bp, Homo sapiens
gggattcctcaggccggagatggccagccagaaagaagcctttgacccagaggctgctcagctgtctggcccactactggccctgtggtgctccc

SEQ ID NO: 6823356 - DNA, 62 bp, Homo sapiens
cagacaataggagcacattctgcagttgccgctactgctactacagatactcctgctgtttg

SEQ ID NO: 6823357 - DNA, 65 bp, Homo sapiens
acagtggaatctcaagctggaagaaaccttagaggtcacctaatctttgcatgagttccctctgt

SEQ ID NO: 6823358 - DNA, 60 bp, Homo sapiens
gcagccatagccacctcagaaggacctgagctgaggacaccacctgaggattatggttgt

SEQ ID NO: 6823359 - DNA, 90 bp, Homo sapiens
gggaggggtggctgcccgccagaaagctgcgaggtcaggggtgggagtcccctcttcccctcctgcctttgcggtggctccattcctccc

SEQ ID NO: 6823360 - DNA, 61 bp, Homo sapiens
gggagttggggcttactactgttttttataattgtctcagaaaacagctaaaccagctctc

SEQ ID NO: 6823361 - DNA, 74 bp, Homo sapiens
tgatttgatctgttttcctattgtttgttgatgcttttattgacagaattaatgaaaattacaaggttaagtca

SEQ ID NO: 6823362 - DNA, 65 bp, Homo sapiens
ctgtcagcctttagatgagctggctacccctgtggacattgccaggtctgcaggcatcctgacag

SEQ ID NO: 6823363 - DNA, 80 bp, Homo sapiens
agcctgaatgaaagagccagtggtgagacagtgagttgattacttctcactgtttcaccactggctctttggttcatgct

SEQ ID NO: 6823364 - DNA, 89 bp, Homo sapiens
tttttttctcaacggtctcatggctttcagccaactaaacactaattcaaggatttggtgccaagcatgaggactcttctagaaaaaga

SEQ ID NO: 6823365 - DNA, 64 bp, Homo sapiens
ggtttcagccctgctgttcctgggtggatccctcttacttttccaggtgcggtgggtgggagcc

SEQ ID NO: 6823366 - DNA, 65 bp, Homo sapiens
cgggtcgagtgggcacagctgggtggctcttgctctacttgctaccagctgggcttactcactcg

SEQ ID NO: 6823367 - DNA, 55 bp, Homo sapiens
tgtaatgaatgtggcaaggttttcagtcaaaaaggaaaccttgcatgtcattata

SEQ ID NO: 6823368 - DNA, 99 bp, Homo sapiens
gacctatttaagatgtgcttctgcagagactatttatttacttctatcaagtgcctgggatacaactgacatgaatcactttaaatttatttttgggtc

SEQ ID NO: 6823369 - DNA, 66 bp, Homo sapiens
gcagctgggctcatcatctgtgcatttcacaataaaattttatgatgcatccagacacccagctgc

SEQ ID NO: 6823370 - DNA, 65 bp, Homo sapiens
cagtcaaagaaacgcaccttacatgcagtcattattagtccatctgcatgtgcactcttcagctg

SEQ ID NO: 6823371 - DNA, 69 bp, Homo sapiens
acatagtagccatattcgcattcttcatttccaaaggaaccatgactgtgtgtgtgtgtgtgcgtgtgt

SEQ ID NO: 6823372 - DNA, 74 bp, Homo sapiens
ttcaccaacattttccaaagtaccatgtccctgataccaaaaatagtggagttggtgtttggagtctctgggaa

SEQ ID NO: 6823373 - DNA, 90 bp, Homo sapiens
tgtcacccttaactgagtatttcgctgtcctcaaaaggtttacagttaaacaatctttttagttgctcaggtattctcttagggttgata

SEQ ID NO: 6823374 - DNA, 59 bp, Homo sapiens
tgactcctgctccttcagatttcttcttccaatagacaatcaggcaaggaaaggagtta

SEQ ID NO: 6823375 - DNA, 60 bp, Homo sapiens
gggcggcaaacctaagtggcattttcaccagtgctgttatgctatttaatttttctgttc

SEQ ID NO: 6823376 - DNA, 87 bp, Homo sapiens
gcctccctggcctctgagtgtcctggtgggggccctgcaggagcagatgctagagcccttccttagacagcaggatccagggcaggc

SEQ ID NO: 6823377 - DNA, 66 bp, Homo sapiens
ggcagttttaaccatgggcagaatctttgcagatcaatgtttcagagaaatgcctatcaaactgcc

SEQ ID NO: 6823378 - DNA, 78 bp, Homo sapiens
gttttagagcttcaacgaatagcataacatttcaataggtactgctattgtatgctgatcaaaagcttcatctgagac

SEQ ID NO: 6823379 - DNA, 83 bp, Homo sapiens
cagagtcagcgtgcggggccagcgcaggctgataaccgcacggaacttcccaggcaccctgtgtggccgcactgctccctctg

SEQ ID NO: 6823380 - DNA, 79 bp, Homo sapiens
cagcatgttgaaacctgaagaaaatatttgctgagaacattcagttcgataattttcctcaattcagtggtttaggctg

SEQ ID NO: 6823381 - DNA, 58 bp, Homo sapiens
catctgatgctttgatttggtttctctagaagcacattctgagacagggattcaggtg

SEQ ID NO: 6823382 - DNA, 58 bp, Homo sapiens
aatgacttggcagccttttgacaaatgtttgtagtgtcttgaagaaagtcaagttatt

SEQ ID NO: 6823383 - DNA, 64 bp, Homo sapiens
gaggctgtaggttggaccctaatcccagagcctcattctgatggaggcttcaaccatacacctt

SEQ ID NO: 6823384 - DNA, 130 bp, Homo sapiens
ggtcacacccttggagcataacatgcctcctaaatacaggtttttagttactaatggtagcttaacaggcttagaactgttctccacagtacaggaaatcttgttcaaaaggtacttgaaaggtgtgact

SEQ ID NO: 6823385 - DNA, 82 bp, Homo sapiens
ctaaagtcagagtgttggcagggctgattccttctggaggctctaggacaggattccttgccttgccttttctgacttccag

SEQ ID NO: 6823386 - DNA, 76 bp, Homo sapiens
cctgtgtgtgcctcgtctactgagtgccagggttagtgccccacttgccaggtgagaggactgaggctcacacagg

SEQ ID NO: 6823387 - DNA, 75 bp, Homo sapiens
ggattaatgtaatagaacactcagcatggaaagccaccccggggctgctcctgtatatattttgttacatattcc

SEQ ID NO: 6823388 - DNA, 79 bp, Homo sapiens
caggaccaggctgtgcctctgctctcagggaactcacatcctagggtggagagaaagaaacgtgaacagatggtcactg

SEQ ID NO: 6823389 - DNA, 66 bp, Homo sapiens
cattttgagtcttttcattgtgtggatttcttaacaagttgtttttacaagaaaagcctctgtgtg

SEQ ID NO: 6823390 - DNA, 105 bp, Homo sapiens
gaagctggggaagggaattgcaggcagcagaagtagaagtacaggtaaactgcacacatgtgtttcgagactgttgagtagttcagtgacttgtccctaagattc

SEQ ID NO: 6823391 - DNA, 55 bp, Homo sapiens
gcactgggtgtgaggcagcgtcgtttccccttcgcgctcttcgaatgtcaagtgc

SEQ ID NO: 6823392 - DNA, 77 bp, Homo sapiens
aatgttccctgctctctgtatgtaactttgtacttagtcttcagtggcagggttgcagcagaggcccagtaaatatt

SEQ ID NO: 6823393 - DNA, 64 bp, Homo sapiens
agaggaaaaacagaaaaattcatggcagctcataatctgctgatatattctagttttctcctct

SEQ ID NO: 6823394 - DNA, 57 bp, Homo sapiens
ggccccctgcttgctttggggtctgagttagctcctggctccactgagcaggccgtc

SEQ ID NO: 6823395 - DNA, 69 bp, Homo sapiens
acagacacttacagaattccctccttttgctttctgcagcaggaaaatcaattctgtgtagtgtcctgt

SEQ ID NO: 6823396 - DNA, 58 bp, Homo sapiens
acctggcaggcggaggttgcagtgagccgagctcacaccagtacactccagcctgggt

SEQ ID NO: 6823397 - DNA, 103 bp, Homo sapiens
tgtgaaggcaatattttgttaactatgagtggcgtagaggtagggggttatagattaccctcatactttaacctattttcctacaatgtattttctttcctca

SEQ ID NO: 6823398 - DNA, 69 bp, Homo sapiens
ttagatgttaattctgaaatgagatataaggtagcatagctgttttatttacatttcagatatttctaa

SEQ ID NO: 6823399 - DNA, 66 bp, Homo sapiens
cactagagccttcctagcatttgcattagacacgtttgtgccttgcagccactcaggagctcagtg

SEQ ID NO: 6823400 - DNA, 56 bp, Homo sapiens
cctgtgccttccttaggcacctgttgtggactcaggtggcctcggtggtgcacagg

SEQ ID NO: 6823401 - DNA, 73 bp, Homo sapiens
ggtagtagtttagtgggacagtttaaagttgggatttgaagttcaaatctgtcccttaactagtcatattacc

SEQ ID NO: 6823402 - DNA, 69 bp, Homo sapiens
ttcttccatctacactatcattgattaggaaagcaatgtggttcaaaatgacagtgtgtgattgaagaa

SEQ ID NO: 6823403 - DNA, 82 bp, Homo sapiens
gaagccttgttttcatgtctgagtcttggccttataacatttctttgggacttgaaagaagacatggcaggaatacagcttc

SEQ ID NO: 6823404 - DNA, 58 bp, Homo sapiens
tcaggcatgttgggggagggtgcagtggcaagctctgaatggacactccagtgtttga

SEQ ID NO: 6823405 - DNA, 69 bp, Homo sapiens
gggaatttctgaaaaataattgctgaattttacaaaagtgattcagcacttggatttcagagattagtc

SEQ ID NO: 6823406 - DNA, 55 bp, Homo sapiens
ttaacagatgtcatttcggcggcggctggcccactgctgctgggccatttgttgg

SEQ ID NO: 6823407 - DNA, 72 bp, Homo sapiens
tgtgtttgatagatgcagatctcagtgtgctgttgtttcatataattaagcacctgttgcacttcataatca

SEQ ID NO: 6823408 - DNA, 59 bp, Homo sapiens
caagactttggaggaatttggactaagtttaaaattactccctttctcaaaagatcttg

SEQ ID NO: 6823409 - DNA, 89 bp, Homo sapiens
gttgaagtctcatagttaaaattctttcccaaattatctaacacctgttgggaagattatctcagaagtttacatagtgagacttgaac

SEQ ID NO: 6823410 - DNA, 56 bp, Homo sapiens
aggctccaggcccttcaccagctgcagccactcttgctgatggtagtctggggtct

SEQ ID NO: 6823411 - DNA, 63 bp, Homo sapiens
aaagctctctgaacaccagaccactcttaactatatttaagtggctgggttcatcagagtttt

SEQ ID NO: 6823412 - DNA, 75 bp, Homo sapiens
tagtgcttctgcttatggaattgtatactgagtattgctctgtaaactcttaccaaaagtgacaaattagcactg

SEQ ID NO: 6823413 - DNA, 124 bp, Homo sapiens
tgtgcagagacgctgggagcccgaagaggtcgtggctgtggcttccgctgcaggttagggctattgacttgcatggaggaacatggcccacggactgtgttgcaaaccctcagtctgttgcaca

SEQ ID NO: 6823414 - DNA, 64 bp, Homo sapiens
agaactctccaggggctgtcttggaatcttgggataaagacccccaccggcccctgagtggtct

SEQ ID NO: 6823415 - DNA, 55 bp, Homo sapiens
cccaggagatgcactccattggctgaatctagccaattagattcactttcctggg

SEQ ID NO: 6823416 - DNA, 69 bp, Homo sapiens
agagtctttattctctagagtgtgaaaatgtctacaatactgtgaggcactggaaaaatgaagattact

SEQ ID NO: 6823417 - DNA, 77 bp, Homo sapiens
gagcttttctttatacacctgctgagcctgtcctcagccaggggttaagaggataaaaggctcaaagcagcaggctc

SEQ ID NO: 6823418 - DNA, 69 bp, Homo sapiens
tcaaaggatcgtagaagctacaaggagacaggttgcaaaagataagtgtccttctctatgattgtctga

SEQ ID NO: 6823419 - DNA, 130 bp, Homo sapiens
aaaatctctgactccctgctatttttctgattcatgcatttggaagcttgaagattattaattcttgtgacagaaagaaatagttcaggcataaggcatgaacaaattatgatagggtgtggagtttcat

SEQ ID NO: 6823420 - DNA, 67 bp, Homo sapiens
tcacacattccaaaatcaagggtataagcaattacagccaactcttgattatccttggcaatgtgga

SEQ ID NO: 6823421 - DNA, 57 bp, Homo sapiens
gtttctgaatgctgattagtatgagaaattatgctacgaatgagagcatatagaaac

SEQ ID NO: 6823422 - DNA, 60 bp, Homo sapiens
atggtgggatattcatgcaatgatgtggtctgcatcagtgaaagtgaatgttctagccat

SEQ ID NO: 6823423 - DNA, 67 bp, Homo sapiens
ttgtaggaggtcaaaattgtatcaggctccatctatgggtctgagaacataaattgacttcttatag

SEQ ID NO: 6823424 - DNA, 57 bp, Homo sapiens
gagaaagagacgtaactttagggcttgccaagccctgagaggcaatgactcttactc

SEQ ID NO: 6823425 - DNA, 65 bp, Homo sapiens
ggtcagtgagcaaacaaccacgatttataatcatgtttgaatagtggctggtgcactcactgact

SEQ ID NO: 6823426 - DNA, 62 bp, Homo sapiens
gtgttggctttggtttttattgccaggaatggtcatggccacattggaccgaagcttaaggc

SEQ ID NO: 6823427 - DNA, 59 bp, Homo sapiens
aagtttaggccaaattagatttataattaggaaacaaatgctggtttggtactaaattt

SEQ ID NO: 6823428 - DNA, 67 bp, Homo sapiens
cagcttcagctgcctgtctgctgacccaggtctctgagggcctgggtgtcatgggcagctgggggtg

SEQ ID NO: 6823429 - DNA, 62 bp, Homo sapiens
tctttatcacagttttgtgccttgtggacggatagtgggtccatcccatgggagctgtagga

SEQ ID NO: 6823430 - DNA, 62 bp, Homo sapiens
tagatttgtccagacttgattacagcattattatgtttattgataaaagctggacacttctg

SEQ ID NO: 6823431 - DNA, 77 bp, Homo sapiens
tagttatgcctggctatctatttatttctatctctaagctatctttcagatgaaatgtgtatattatggcagaatta

SEQ ID NO: 6823432 - DNA, 90 bp, Homo sapiens
gagaatagacagatcagcaggcatgttaatcatcttaaaaagctcccttttaaggatgatgtgatatataaccgttagacatatcttctc

SEQ ID NO: 6823433 - DNA, 62 bp, Homo sapiens
ggaagaggccactatttttagggattggtagcacagaacttccttgaattgtgccacttacc

SEQ ID NO: 6823434 - DNA, 80 bp, Homo sapiens
caaatcctatcagtcatcttgggagtctgggaacatgtaaataaatcatgtttctcccccatgataatttctgtgagctg

SEQ ID NO: 6823435 - DNA, 64 bp, Homo sapiens
ttgtaagtgtctgtaagcttattgtgttgtaaaccaagcctgacagcacaatagacaccgataa

SEQ ID NO: 6823436 - DNA, 117 bp, Homo sapiens
cctcagatgttcgtgggaatgtcacataaggggtggcatgtatgcagctggcttatgcatagggaatcactagctacatacttggccattctccttcatttctgcctttgtctgggg

SEQ ID NO: 6823437 - DNA, 61 bp, Homo sapiens
tgaggtgtgtctgatgttgtccacagttccctcccacatctgacagcacagaaatatttca

SEQ ID NO: 6823438 - DNA, 60 bp, Homo sapiens
gtcaggcagtggaaattaaaaattactggagattgtgatgttattgaaaccattcctggc

SEQ ID NO: 6823439 - DNA, 55 bp, Homo sapiens
gactgtcggttctggtttcacatgcactgtgtgaacacgcttcatacagagggtc

SEQ ID NO: 6823440 - DNA, 66 bp, Homo sapiens
tggtatttgtatctggacctgactgactccaaggtagtgttagttagaataatacaagtaaaacca

SEQ ID NO: 6823441 - DNA, 59 bp, Homo sapiens
ctgctggccttacttttttagcatacagggattggaagtgaaagaaaagagaccagcag

SEQ ID NO: 6823442 - DNA, 72 bp, Homo sapiens
ggaagcaggagtccctctggccagcatgttctctcttcctgacacctggcccttgggacccctgggcattcc

SEQ ID NO: 6823443 - DNA, 65 bp, Homo sapiens
ccggccccggctccgctccggctcccgcactggcccggcaatggaggcgagagcgcgcgggctgg

SEQ ID NO: 6823444 - DNA, 106 bp, Homo sapiens
tttctctcaaactgacttcaaatgaattttgtctaaaattctactgatgtaaatgatgagtaagtggaggagctcagccattcatttgaaggtggtctgggagaag

SEQ ID NO: 6823445 - DNA, 127 bp, Homo sapiens
ctgggaccggattctgaggggcagaggtcagcgggctggagccgctggcccccaggggttccatgcctcatcctgtgtctggcccagcccctgatcccaccagcccacgggagtccaagtgccccag

SEQ ID NO: 6823446 - DNA, 58 bp, Homo sapiens
aggaagggagcagtttgttgtttgagtgctcttaaagcaaataatctgcttgcttttt

SEQ ID NO: 6823447 - DNA, 117 bp, Homo sapiens
tgacctaaattcttcctgctctgcactcggtgagtcttccccatgtgcagccctcccatggatctcacacatggaagagatacagtgaggtcctggggagcatgagaatctaggtca

SEQ ID NO: 6823448 - DNA, 94 bp, Homo sapiens
ggaggtatttaataaacaggtgcagctgaatgtgtgtggttaaagtgcaatccagtagttatttatttgtccagattgtttataacctgcttcc

SEQ ID NO: 6823449 - DNA, 57 bp, Homo sapiens
tggcagaggaggctcagattgaggaaacaatccctcatggaatgaattcttctgtta

SEQ ID NO: 6823450 - DNA, 65 bp, Homo sapiens
gggtagaagagatttatactgcaccagaataattttctgtgctttgtgttgattttatcatgtcc

SEQ ID NO: 6823451 - DNA, 88 bp, Homo sapiens
gtccccctattgaatattgccaggagaaagaccctgtcctggcctgggacagctgtacactcctggttaatcagttctgatgggaggc

SEQ ID NO: 6823452 - DNA, 66 bp, Homo sapiens
ccttccctgataagagcctcagaatgttttctgtccaagctgtttgggttcaagtacagggcaagg

SEQ ID NO: 6823453 - DNA, 68 bp, Homo sapiens
gcaggatccgctgctgtttggcctgtagctccctcagcaggagctgccgatgcccagctgcatcctgc

SEQ ID NO: 6823454 - DNA, 65 bp, Homo sapiens
gtatattcatgccatttttctagattgagatcatagaatgtaacgatttcatggcagtaatatgc

SEQ ID NO: 6823455 - DNA, 79 bp, Homo sapiens
taccatttatggtttctcattccattacatgtgctccatcactgtgcaggggaagagagaaaaacatggagaattggta

SEQ ID NO: 6823456 - DNA, 104 bp, Homo sapiens
tgttagccaggagggtctcgatctcctgacctcgtgatctgccagccttggcctcccaaagtgctgggattacaggcgtgagtgaccgtgcccggctggcaaca

SEQ ID NO: 6823457 - DNA, 63 bp, Homo sapiens
atggaggtgtttgataatttggttgctatgcaaccactttacaattatgtaagctcctaccat

SEQ ID NO: 6823458 - DNA, 82 bp, Homo sapiens
cctatttcagctacagcatctctgcttttatctattttatttgttagatcactgaaagaaagaatgttgtggcttaaagggg

SEQ ID NO: 6823459 - DNA, 59 bp, Homo sapiens
gggcagagcagtttctggccattagatgaacatctgtgtgccctaaagcctgctctcct

SEQ ID NO: 6823460 - DNA, 65 bp, Homo sapiens
gcacatttcttccacatgctgctgtccaccatacaggcggcttttatgaaatgggggaaaaaagc

SEQ ID NO: 6823461 - DNA, 92 bp, Homo sapiens
aaccagtaggaaggtgcccagctattcctttcttagttaagtctatcctcctgcttctcctgagggtggagtactgggtgccgctgctggtt

SEQ ID NO: 6823462 - DNA, 77 bp, Homo sapiens
ctcaactctctctggctcccagcaagtacaactatttataaaagatgaggtttgccagggaacagggagaggctgag

SEQ ID NO: 6823463 - DNA, 80 bp, Homo sapiens
ctgaggcctgtcattgtcttgttcacataccagggcgagttgaagatgaaggatgggaccaagacaaatggagtcctgag

SEQ ID NO: 6823464 - DNA, 80 bp, Homo sapiens
ggacaaggtcagcccaggtcggggagcactgggtgggatgcacggtggcctcagccagctcttggactctgacctggtcc

SEQ ID NO: 6823465 - DNA, 91 bp, Homo sapiens
gatgggagcacacttagattggaatcttgaccctagctgtgctggtggccacactgactggaatcaaggatgttcagaggtggctcctttc

SEQ ID NO: 6823466 - DNA, 127 bp, Homo sapiens
ctttaaaatggtaattgtaaaccctgccttgcggatgtttctgaagtttacagataatgtaaaacacattgcttagctcataggaaacactgaatgaaaggtaactattagtattgccaatttgaag

SEQ ID NO: 6823467 - DNA, 55 bp, Homo sapiens
aagagccctctgtgtttctgagatagggcttttcttgcataaaccagaggctctt

SEQ ID NO: 6823468 - DNA, 68 bp, Homo sapiens
actattctgttgtcttttctccaatagaattgcagtgagttctgccaggaagaaagcacaataatagt

SEQ ID NO: 6823469 - DNA, 79 bp, Homo sapiens
ttaggttgacgcaaaagcaattgtggtttttgtcattactttcaatgcaaaaactgcaattgcttttgcaccaacttaa

SEQ ID NO: 6823470 - DNA, 63 bp, Homo sapiens
tgagagactgaactagcacatttttataaaactggatcaaaatgtgcttgtgatcagctgtca

SEQ ID NO: 6823471 - DNA, 70 bp, Homo sapiens
attcctggaccccaagtatagttgtctaactctaaacgccaaatgagaagcttgcttggagtttaggagt

SEQ ID NO: 6823472 - DNA, 67 bp, Homo sapiens
actgggagagtttggatgaaactattgaatgaaattattttgggggtttctttctggctctcacagt

SEQ ID NO: 6823473 - DNA, 77 bp, Homo sapiens
ggtcaccgagagagttgaggaagcaacactcgaggtcccagcctttgcaggagctagacttagatcttccggtggcc

SEQ ID NO: 6823474 - DNA, 83 bp, Homo sapiens
ctgtgctggagagggagctgttggaagtgctgggtgcactgataaagaagcatgtgttcctctgcttcctccccattgcccag

SEQ ID NO: 6823475 - DNA, 57 bp, Homo sapiens
tccaaaggcaatgttcttgtcatcatactttgatgcacaaagtcagcatcctctggg

SEQ ID NO: 6823476 - DNA, 64 bp, Homo sapiens
gcaaggaggttgatgccagggagttggggccgatgatctccagtcccaggcagaaatccagtgt

SEQ ID NO: 6823477 - DNA, 92 bp, Homo sapiens
ttctgattcacagtagcagagctagatataaaggaggctgattacatgtcatctcctcatgtatctgggaattcttttactgtgcactagga

SEQ ID NO: 6823478 - DNA, 56 bp, Homo sapiens
tgggggctaaaacaagtttgcttagctatagctacagcttgccaattagccttccg

SEQ ID NO: 6823479 - DNA, 55 bp, Homo sapiens
gctgctggggtggagaaacgctgtgacccagtcagtgtttcttttaatgagcggc

SEQ ID NO: 6823480 - DNA, 76 bp, Homo sapiens
ctttccttccttcttccatggtaggtttcttaaagaacatttctattgattggcttcctggattagggttggacag

SEQ ID NO: 6823481 - DNA, 79 bp, Homo sapiens
gaaggcagaaaaggctaatccagagcaactcttgaaagcagccccaaggagtcttccagaaaagccttggtctgccttc

SEQ ID NO: 6823482 - DNA, 74 bp, Homo sapiens
cctggggctctgcacagagcagcagagctagagccatgaaacccacagacttggtgcctgagcgcagctccagg

SEQ ID NO: 6823483 - DNA, 68 bp, Homo sapiens
tcagatgtcaacaggcctttaaacatgctctttaccactgagcaataaataccctggttgagtcctga

SEQ ID NO: 6823484 - DNA, 74 bp, Homo sapiens
tggcagtttcttaagtcactggacttgcctagattggatttagcgtaacacatgagcttatttggaaaatgcca

SEQ ID NO: 6823485 - DNA, 60 bp, Homo sapiens
ggacatgtccccctggagttagtcagaagtgtaatttacctctagggatggcatatgtct

SEQ ID NO: 6823486 - DNA, 59 bp, Homo sapiens
gttacagcttgatgagagcgcgaggaatcctttttcctgtacctaaactcagctgtaac

SEQ ID NO: 6823487 - DNA, 62 bp, Homo sapiens
gacactttatctcatctcagacagggctctatggaggaatgggctggaaaagaatgaaggtc

SEQ ID NO: 6823488 - DNA, 66 bp, Homo sapiens
atgggtttggacatgttgagtctgatatgccattgtgacattcaggtagcagtgtccgatagacat

SEQ ID NO: 6823489 - DNA, 114 bp, Homo sapiens
ggctgctcggcacctggcctcagcaggtgaacatcatgccagattccttgtcagattcaaggccaagtgggtgaatgtcatgtgcagtgttgtgccaggtatgtgccgggagcc

SEQ ID NO: 6823490 - DNA, 84 bp, Homo sapiens
gtgtgaagagctctgacagtaaatcaacagaatatctgtagtgagaggcattgggtgttccatgacttactgtgctttgcacac

SEQ ID NO: 6823491 - DNA, 61 bp, Homo sapiens
tttcagcatttttgctgctgcccactattcatatgggtggtatgagctgaaattgctgaag

SEQ ID NO: 6823492 - DNA, 73 bp, Homo sapiens
ctcccaacagggcagttagagcctaccaaagtccccagctctgtgttcctctggattgctggattgttgggag

SEQ ID NO: 6823493 - DNA, 127 bp, Homo sapiens
tctatggaggaggcggggctgctgtgacctgtttctcgggcctcccagcagcctgggatggaccagcaagctgcttctttcctagaggctgatgagtcgagaaccagggcaccttctcgtctataga

SEQ ID NO: 6823494 - DNA, 78 bp, Homo sapiens
cctgggcctgtgtcctgtgcaaggggatgatttcctttgggcccctcgaccactctgcaaggcacacaaggctcatgg

SEQ ID NO: 6823495 - DNA, 65 bp, Homo sapiens
ccaaagctgtcctctcattgtttgtagctactcccattatcaacatgaaggtaggatggttttgg

SEQ ID NO: 6823496 - DNA, 68 bp, Homo sapiens
agagatctagcacctgctggtcctctatgtgggcgggaactgtgaggtccagcctggtgtatgtctct

SEQ ID NO: 6823497 - DNA, 56 bp, Homo sapiens
gtaaaataagaggggacttgatttagattggctttcacagtccttcttggttttac

SEQ ID NO: 6823498 - DNA, 112 bp, Homo sapiens
actttcgaaagcattttaaggctattgtctcttcatgtgtttaatttttacataaaataatgataataaaaaatgaatatgatggaggattctctgtaaagtgcaagacagt

SEQ ID NO: 6823499 - DNA, 55 bp, Homo sapiens
gtgaagggaaacgctcagctggtatatcatgtcccagccacgaagctcccttcat

SEQ ID NO: 6823500 - DNA, 88 bp, Homo sapiens
acaaggctcaacccagtttaggcaggggctatttcttttaaaaatagaggagacagacaaaattcctgcctgaatctgttagtcctgt

SEQ ID NO: 6823501 - DNA, 68 bp, Homo sapiens
ctgggaagaggcgctcctcacttcctagatgggatggcggctgggaagaggcgctcctcacttcctag

SEQ ID NO: 6823502 - DNA, 90 bp, Homo sapiens
cttgctataaacaaatggttaatgtcttcctattctacagagcatttgtgctatgtagggaggtttattattttgttgtaattatagagg

SEQ ID NO: 6823503 - DNA, 81 bp, Homo sapiens
atgcttgtgtctccattgaacatcctctcagaacctttagcatgctaatgtgtttgtgaatgtccaagggagtcataacat

SEQ ID NO: 6823504 - DNA, 105 bp, Homo sapiens
gaacattgtattaagaaatttactgggaattccaaggctaaatagtctctgcccagagatccttagggatttttccagtcagttccactcattaaatatatactc

SEQ ID NO: 6823505 - DNA, 93 bp, Homo sapiens
tgtcctcacatctggaaacttgagttttctgtgtgtgacccaggagactggctcatattaacaatgaaactcagaagagagaggtgtgggtca

SEQ ID NO: 6823506 - DNA, 62 bp, Homo sapiens
gtccttctgagtgcccaggcaggccgggccctgtgctgagcactgggcacatagctgagagc

SEQ ID NO: 6823507 - DNA, 93 bp, Homo sapiens
caggaattaggttttccttttcagattcaaattttatgtgagtatttgccttttgtaactttagctatttaatctgatggagaatttttcctg

SEQ ID NO: 6823508 - DNA, 78 bp, Homo sapiens
gtctgtctgggtggctgtccagccagccatcaggctgtcatttttctgctgtctggctgtccagcttatctatctggc

SEQ ID NO: 6823509 - DNA, 103 bp, Homo sapiens
atgttgtatcaaaatgtagatatagtatatagtggcgctgtatgctgtattcagcatatggtattagtggtgctatgtgctatttgcagtatgtatacaatat

SEQ ID NO: 6823510 - DNA, 74 bp, Homo sapiens
taagattttcagtccagcacatacagtcccagtgcccagcacaccggaagtttgtatactggcctcttatcttg

SEQ ID NO: 6823511 - DNA, 55 bp, Homo sapiens
ctatgggatgtggtctaaatgctttgcctgggcatcagaggttgccactccctgg

SEQ ID NO: 6823512 - DNA, 70 bp, Homo sapiens
tgaaggcttggtggcagcctctgaggttgatgggatctttaggcagaaggtggctgccacctagctatca

SEQ ID NO: 6823513 - DNA, 72 bp, Homo sapiens
ttgtcctccagttgcgaacttggtcccgtcagggtgaatatcaactgaaaaaatcggcttgcctggaaacaa

SEQ ID NO: 6823514 - DNA, 79 bp, Homo sapiens
ctgctggcctctgccagctctaaacggctctgtggtctggcaaggccaaggcaatgtgcagctggtgggaggtcggtgg

SEQ ID NO: 6823515 - DNA, 61 bp, Homo sapiens
agtgaaatgtgcagagaattaggaattggatatttcatctttgaactctgtataaaccact

SEQ ID NO: 6823516 - DNA, 62 bp, Homo sapiens
tggggctggctattgtctccctcctctctcctgtcagagggcaaagcaagctgtcagcctca

SEQ ID NO: 6823517 - DNA, 86 bp, Homo sapiens
gcttaaaaatttccacggtggcaaaggctggaatatcagttacggattcattcagcactaattgctacctagagccaattttcagc

SEQ ID NO: 6823518 - DNA, 68 bp, Homo sapiens
acctggggcagagtaggattttggcctctactgatcttgtttataatccaactctgctcccttttggt

SEQ ID NO: 6823519 - DNA, 66 bp, Homo sapiens
ggagctcgttctaccagaccccagacttgtaggatgatagaagtatgtgctggctagaagagcttt

SEQ ID NO: 6823520 - DNA, 77 bp, Homo sapiens
tgtaaacttgccaggcaccaaagtatgctttaggatatcaccatgactagtgccctttgctgcctgccatggttaca

SEQ ID NO: 6823521 - DNA, 72 bp, Homo sapiens
atattttaacatgtgtataatttttgtttgttggctaagacaaggccaagtatcaatacattgttaaagtat

SEQ ID NO: 6823522 - DNA, 65 bp, Homo sapiens
cccagctggagggcgccaggccagcagccatggggcagagcctggacaccgcccttgcagagggg

SEQ ID NO: 6823523 - DNA, 57 bp, Homo sapiens
agctctgactgaagagatgcaagattttctcagatgatttgtgtgtcagtcagagtt

SEQ ID NO: 6823524 - DNA, 63 bp, Homo sapiens
gtcatcacatgcctatcatgagctggctctgtgattcagtcagtgttgatttgtatctgagat

SEQ ID NO: 6823525 - DNA, 103 bp, Homo sapiens
gtacaggcttctgggttcacttctctgtattagctgccttggagctaagaagttttcctcttaataataaacagttgaagatggttgaacacagaagccttgc

SEQ ID NO: 6823526 - DNA, 71 bp, Homo sapiens
ttttctggggaaggatatgattagactaatgaaataatggaattaggcttatttgtctttcctacagtgaa

SEQ ID NO: 6823527 - DNA, 59 bp, Homo sapiens
gagatatgttggcagctggtatgcacttcatcagagggcaaattactgccacacatttc

SEQ ID NO: 6823528 - DNA, 61 bp, Homo sapiens
atgaggtgcaccattattcagttgctttaacaataaagagcaaagttgttgctaacctcat

SEQ ID NO: 6823529 - DNA, 90 bp, Homo sapiens
ggtatgaagagattcagtgctcttaaataacatcattgctttgtaaggactgaacattatacaagagtttcctgcaatctgattcttacc

SEQ ID NO: 6823530 - DNA, 113 bp, Homo sapiens
ggagggggcggctccgacctgtcccttctcatcacatcagttactttccattagcgggaggggaaatcagcagatgctggtgaggggggtcccggcgggaagcagaccccttc

SEQ ID NO: 6823531 - DNA, 65 bp, Homo sapiens
tgtctattgcttgttcttgataaggaatgaatctagaacatttctatgtgttgacaagcctgaca

SEQ ID NO: 6823532 - DNA, 91 bp, Homo sapiens
ctggatggcaacctgaaacccaaggccatgagcagcgagtgtgtgtgagcccagcatggattagtgcggtggccttgggaggcccttccag

SEQ ID NO: 6823533 - DNA, 70 bp, Homo sapiens
gaagatataaacggagtcatcccttccctcaacaaatttacaccaggtggggcagctctgttttattttc

SEQ ID NO: 6823534 - DNA, 68 bp, Homo sapiens
gggaaattcaggacaaagactcttgtgttttaaaacatgctcaagtctcttttcttcctgtattaccc

SEQ ID NO: 6823535 - DNA, 64 bp, Homo sapiens
gcgggtttcatttcattatgaaggctttccttgtgccagtttctaggatgctgatgagacccgt

SEQ ID NO: 6823536 - DNA, 57 bp, Homo sapiens
gctattagacacaattagtgattcagattccaaggagttgcttttcgtgtcaatggc

SEQ ID NO: 6823537 - DNA, 62 bp, Homo sapiens
gagaagggaaatgggaactcaaggcaagaatgcctccctggcagctggtccccaagcctctc

SEQ ID NO: 6823538 - DNA, 57 bp, Homo sapiens
gcaaagtccattcttccagccagctcttgctccagccctgctgtgatgagactctgc

SEQ ID NO: 6823539 - DNA, 68 bp, Homo sapiens
ctgtaaagtccaagatcaaagagccagcatttcgattcctagtgagggcctcttcctggagtttgcag

SEQ ID NO: 6823540 - DNA, 55 bp, Homo sapiens
tcttattcacctctattagactcagtcagctgagagtttttaattggtgaaggga

SEQ ID NO: 6823541 - DNA, 59 bp, Homo sapiens
ggtgagggtggaagcagaggtggttcaatgactttccacaaaggttccattctctcacc

SEQ ID NO: 6823542 - DNA, 67 bp, Homo sapiens
atcagagtttttagttctgcctctcacagtctacggaatcacaggcaggttacaaaaactttatgat

SEQ ID NO: 6823543 - DNA, 78 bp, Homo sapiens
tgaattgaagtacattcaaacgatttattgattgaattatctttaatcattcaaatgatttggaggtactgcagttta

SEQ ID NO: 6823544 - DNA, 76 bp, Homo sapiens
gacccattacaataaggtttatttgtagcatacatagttgcaaagtatgtatttaaatgttgctgtgtccagggtc

SEQ ID NO: 6823545 - DNA, 68 bp, Homo sapiens
ctttcattcattcatctgctgacttgacaagtaccagagtggtaattgtgggcttagtagagtgaaag

SEQ ID NO: 6823546 - DNA, 59 bp, Homo sapiens
tgtcctggaattcaaagtttggctggagtaaagctcttaagctgatgtgggtactgaca

SEQ ID NO: 6823547 - DNA, 108 bp, Homo sapiens
tgtggctcccatgttgggacttgggatgggggaagtttggtgtaatgttgaagagcactggcatttgaacattcaacagacccagattctgagccctcggctgccata

SEQ ID NO: 6823548 - DNA, 130 bp, Homo sapiens
actaccaaatattttactatagttaccctgaataaattacgttttgtcttaatttggattctactgaaagcagagcctgaggcaaggacttggtggcagggagtacatttgggtgggtatataaggaagt

SEQ ID NO: 6823549 - DNA, 73 bp, Homo sapiens
tggtagtcacaactgggggcattactggcatctagtggatgctgctaatattctgcagtgcacaggacaacca

SEQ ID NO: 6823550 - DNA, 85 bp, Homo sapiens
aatttttcactttaaacaagttactctggctgtaatgaggaaaacagttttgaaatggccaagagtcgatttggggagaaaaatt

SEQ ID NO: 6823551 - DNA, 71 bp, Homo sapiens
aggatagggctggcaaacacttttaaatgtcactaagtaatttcaggaaggagctggcctgccactgtcct

SEQ ID NO: 6823552 - DNA, 55 bp, Homo sapiens
tgcaccttgttgcttttacgaagtctggtaagaatgcggtgaagttagggtggca

SEQ ID NO: 6823553 - DNA, 73 bp, Homo sapiens
gaagctgccataacttcatgggttcaaagctgggttctcttgggacctgcttccatgcaatggcagtcagttc

SEQ ID NO: 6823554 - DNA, 77 bp, Homo sapiens
tggtacaactgaacataattaaatgtcctgggtggttcctgatctttcagggctcaaggttatctttagtgacatca

SEQ ID NO: 6823555 - DNA, 78 bp, Homo sapiens
gagtcatctgcaattgatttcataagggtttctagactttgcaacaaggctaaaagacatctttatgggtagagactt

SEQ ID NO: 6823556 - DNA, 64 bp, Homo sapiens
agatctaggggaagaaatttgaagcttaaaagtatgggctgaagacctccctctccatggatct

SEQ ID NO: 6823557 - DNA, 85 bp, Homo sapiens
atttaagcatttggtaattgagatgtcttttctgacagtttggggaaactataagaatgagataatctcagcctacatgttagat

SEQ ID NO: 6823558 - DNA, 55 bp, Homo sapiens
ttgtgtttcccagagatccgcctccagtgactccatttctctcagggaaacagaa

SEQ ID NO: 6823559 - DNA, 57 bp, Homo sapiens
atgacactgagaataacaggtatgctgagtggcagctttatctggggatagtgtcat

SEQ ID NO: 6823560 - DNA, 57 bp, Homo sapiens
ttacaactctagagaaaagaaaaggaattcagctacttatcttcctctggattgtga

SEQ ID NO: 6823561 - DNA, 129 bp, Homo sapiens
aagatttataagaagagtctaaggttagagcaattctaagttcactaagaccatagaatcagacaaaatgaactagattcaggtgtgtagtaagctgaaaattatttaacccactacagttgatttctt

SEQ ID NO: 6823562 - DNA, 100 bp, Homo sapiens
tttcatgtttctgatttcttgactgatttttctaaaatttggaacttagaaaaacatataaatttcttgagaaatgtcaggaaagaagtcccgcatggaa

SEQ ID NO: 6823563 - DNA, 56 bp, Homo sapiens
agtcaatttagtttccacagggggactctaacctgcctaggaggcttaattaggct

SEQ ID NO: 6823564 - DNA, 129 bp, Homo sapiens
tcatctggagatcttgttaaaggcagcttctgattagcagcgcctgcatttctaacaagctctcaggcggggctgatgctgctgatccaaggactgtacacactttgagaatctctgttctaagctgca

SEQ ID NO: 6823565 - DNA, 69 bp, Homo sapiens
tcttccttctccccatttgccacaagctttttcacgggttccatggcagcagtggaggtagaaagagga

SEQ ID NO: 6823566 - DNA, 71 bp, Homo sapiens
gggcttgtattaagcttagagaggcaggttgctcaccaaatttagcaggtttactgagtttgaatagggcc

SEQ ID NO: 6823567 - DNA, 55 bp, Homo sapiens
ttgagacggagtcttgctcttttgcccaggctggagtgcaatggctcagtctcag

SEQ ID NO: 6823568 - DNA, 55 bp, Homo sapiens
agagacggaaatgtgtagcctgaggtcaaaacctcacctagtacaatctgtttct

SEQ ID NO: 6823569 - DNA, 80 bp, Homo sapiens
caacattatgtttctgaggactttccatgttaatgtgaccccaatttattcattttaacagtcagagttttccattgttg

SEQ ID NO: 6823570 - DNA, 61 bp, Homo sapiens
gttacaaatgtaaattctggggcctcacttaggcctattgaattagagtctgcattttaac

SEQ ID NO: 6823571 - DNA, 78 bp, Homo sapiens
acggttccaataattgttctgaattggattctgttgaaaacctccttaacagaattgaaagtataatctgggcactgt

SEQ ID NO: 6823572 - DNA, 57 bp, Homo sapiens
attccttggaacagatgcgaaggattcatagtgcctttcagctctgcttcagggaat

SEQ ID NO: 6823573 - DNA, 82 bp, Homo sapiens
taagtagggtgagtaaaggtagagaataaggtggtggtatttgaggtactttgataaggttcttctattcttacctaactta

SEQ ID NO: 6823574 - DNA, 94 bp, Homo sapiens
tcagcactcttttcatttgttagcttttacttgaacacttttataattataaaagtttgattaggcaagaaaagactgagaagatagggactga

SEQ ID NO: 6823575 - DNA, 59 bp, Homo sapiens
ttacttacaaaggcaaaggaagtcgtgctgtgttttgcttctttagcttttgtggctaa

SEQ ID NO: 6823576 - DNA, 66 bp, Homo sapiens
agttggaatttcatgtaagtgactcattagaatgactcaactacttgagactcctttcccatgact

SEQ ID NO: 6823577 - DNA, 63 bp, Homo sapiens
agatggctctcaagtctgattagggaggacatttactctatggcagtactaagagggctattt

SEQ ID NO: 6823578 - DNA, 57 bp, Homo sapiens
cctggagattgccacttggaaggtcattgtgacctttgacagcgtggtttctgtggg

SEQ ID NO: 6823579 - DNA, 78 bp, Homo sapiens
ggcagcacattttaactaatgtttttctgaatgttctaattccagataaattcaaagcatttaggactcatgtctgcc

SEQ ID NO: 6823580 - DNA, 82 bp, Homo sapiens
gggagggccctgggagcccgcgtcctggtggcggcaccccctgtgctcccacccagcgggggctcaccaccggccccttctc

SEQ ID NO: 6823581 - DNA, 90 bp, Homo sapiens
gaggacttgaggacctgtctggacaaaggactcacaggatgttagatttagattcgtatattaggattttgtccaagtagctcatgcctc

SEQ ID NO: 6823582 - DNA, 57 bp, Homo sapiens
gtggtagagtctggaacccactctggaacccaggcagtctgactagactctgctcac

SEQ ID NO: 6823583 - DNA, 110 bp, Homo sapiens
actttaatttcatctgtttttggtttcagaaggggagaaaggtcaaagcttctttgttttaagtgagctggtcactccttctgaagtgtaaaatgataggggtcaggagt

SEQ ID NO: 6823584 - DNA, 57 bp, Homo sapiens
acagtggtatggactgaaattgtttctataataagcccaccagctttatgctactgt

SEQ ID NO: 6823585 - DNA, 71 bp, Homo sapiens
ggacactttgggactcagccctagtgttatctgtgtggaccctagaggaacaaatgagtcctaaagaatct

SEQ ID NO: 6823586 - DNA, 90 bp, Homo sapiens
aaacttgaggagaaagttatcacaaaattgagacttgccaagaatgtaccttatttgttgtaatttttgaaagatttttgcttcaggttt

SEQ ID NO: 6823587 - DNA, 62 bp, Homo sapiens
attggagttcttctctcttagtaaatggctttgtgccatacaagtatggaatgattctcagt

SEQ ID NO: 6823588 - DNA, 88 bp, Homo sapiens
gtcccatggggacactgagagaacgggctgctccctaaggaaactcgagttttgggtcagtctgatcctaccagacatcacatgagac

SEQ ID NO: 6823589 - DNA, 69 bp, Homo sapiens
agcagccctcatggagttctttaaattcacagagctctgtgccacctgagggactctagacttgctgct

SEQ ID NO: 6823590 - DNA, 73 bp, Homo sapiens
ccatagtttaacagatgaggaggtgagggaacagaaagcctcagcacatctctctgttgcacagttactgtgg

SEQ ID NO: 6823591 - DNA, 55 bp, Homo sapiens
tgacatgtatgtatttgtttatggattaaaaaatagatgaatgacttatatgtca

SEQ ID NO: 6823592 - DNA, 66 bp, Homo sapiens
gcctggccaacgtggtgaaaccttgtctctactaaaaatacaaaaattcgctgggagtggccaggc

SEQ ID NO: 6823593 - DNA, 66 bp, Homo sapiens
gcttcaccactttttcagtgtgcatgcatgcacgtgcatgtgtgtgtgtgagaaagagtgtggggt

SEQ ID NO: 6823594 - DNA, 66 bp, Homo sapiens
gactgtcatcgtaatatacctcagtgaaatgaaggttaattctgatgtacaacctgcatgacagtc

SEQ ID NO: 6823595 - DNA, 76 bp, Homo sapiens
gggggctgtcctgtgcattgtaggatttttaatagcatccatggcctttacccactatatgccagtagcagccccc

SEQ ID NO: 6823596 - DNA, 109 bp, Homo sapiens
ttcaatcccagaccaattaaaccagaattgctgaaggtaggctaaggaattgttatattttaaaagcttccctagcagttctaaacttttagttgcacttggttttgaa

SEQ ID NO: 6823597 - DNA, 91 bp, Homo sapiens
tgttctactttttctcaggaagaatttaaatgccttgcctatgtgcatgtactataacaatgcaaaatgaatttaggatgaaaaaagagca

SEQ ID NO: 6823598 - DNA, 96 bp, Homo sapiens
tctgctatgatgcaagacccaccacctcccctggggtcagggactctggctcagagagggagtgtggattgaactctgagctaaagtcatggcaga

SEQ ID NO: 6823599 - DNA, 72 bp, Homo sapiens
ggggtaggatgccttgtcccatctgtggcctcagcccactgggttccagacacaccaggcccattctgcttc

SEQ ID NO: 6823600 - DNA, 84 bp, Homo sapiens
gctcttctttcataaaagcacttgtattctatttaactcctgccattgagaaaaggtagctaaaacaggcttttgaaaggtagc

SEQ ID NO: 6823601 - DNA, 106 bp, Homo sapiens
cataacatatatagaaaatggaagtacctctgcatttgcttaggaaaaaaggttaagatccttgtttttaagagatgtttactccaggtcaatgatccctgttatg

SEQ ID NO: 6823602 - DNA, 70 bp, Homo sapiens
aaagtctcagtttgaagtgatgccagacctgggtttgaatccagcttggctacttccagctgggtgattt

SEQ ID NO: 6823603 - DNA, 59 bp, Homo sapiens
acatccctcagtcagactgtaaactgcatgaggcaggctgcatctgccttggggactgt

SEQ ID NO: 6823604 - DNA, 81 bp, Homo sapiens
gcctgttaagcccatcttgccttctctcctctggacaagaagtaaatgggagtgaaaggtaagttgagcttagcctttggc

SEQ ID NO: 6823605 - DNA, 60 bp, Homo sapiens
aaaggtttattgattctgctcttaatttctgtaaggcaaagagctgagttattggccttt

SEQ ID NO: 6823606 - DNA, 61 bp, Homo sapiens
ggtttcagaagaaaagacttttagagttgcaacagcctgggtgtctttcttttcaaaagcc

SEQ ID NO: 6823607 - DNA, 61 bp, Homo sapiens
cactgttcagcttgaatctggctttgacaaaagttatgccaatcccaggctggacacagtg

SEQ ID NO: 6823608 - DNA, 94 bp, Homo sapiens
agatgactggaaattgtgcaaaggagggtcttgttgattgtatctctgttatgctatctaactgggctattttattgggcaatgcttcatatct

SEQ ID NO: 6823609 - DNA, 88 bp, Homo sapiens
tattaatttctgaatactcagtttatatttttagattgttttgtgaattgggatctctgagtataaagtggttttcagcacattggtg

SEQ ID NO: 6823610 - DNA, 71 bp, Homo sapiens
cttgtgctgacaattcacagagaagtactgtaattagatgccaactgtcttctgtgaagtgacaacacgag

SEQ ID NO: 6823611 - DNA, 65 bp, Homo sapiens
tctcagaacagagccaggactcaagctaggtctgagcaacagacctgggtccctggcctgtggga

SEQ ID NO: 6823612 - DNA, 85 bp, Homo sapiens
agtagaccgaagttaggttggaatggagaggacgttgtttaaccattaacaatgtctttgtctccttcagtctatatagtgtatt

SEQ ID NO: 6823613 - DNA, 60 bp, Homo sapiens
tcaggcttccaggctctgctgaccacaagttctgctgccagcaaggctggcaggcctaga

SEQ ID NO: 6823614 - DNA, 66 bp, Homo sapiens
ctcctgctctcatggcacaacgtgctcaccatttgttcagtcgggcaccaggccatggagcgggag

SEQ ID NO: 6823615 - DNA, 57 bp, Homo sapiens
agtagtattctacagagggtgccagtgacatcctcttatgcaaaggatacacatact

SEQ ID NO: 6823616 - DNA, 78 bp, Homo sapiens
actctataccaggcatgaagaaacggtggcctatagaccagatcaggcccattgcctcggagcctgttatgtgtaagt

SEQ ID NO: 6823617 - DNA, 57 bp, Homo sapiens
ggcctctgtcaggtgaacgcgctcctgcgggagcagctggaacatatgaagaaggcc

SEQ ID NO: 6823618 - DNA, 59 bp, Homo sapiens
ggtggctttctaaaccaaatgtctgtcctgacccctgttttggtgctggaaatgccatt

SEQ ID NO: 6823619 - DNA, 58 bp, Homo sapiens
gggggtttctgggctgagcagaaatttgtttcttaattatctttttccagcaaccccc

SEQ ID NO: 6823620 - DNA, 73 bp, Homo sapiens
gttcaatgattaactagaggaggccatctctggaggacagaaagagtcttctgatctggttagccatgcagac

SEQ ID NO: 6823621 - DNA, 68 bp, Homo sapiens
cgtcagttagacagactgcctgtaccacgcactggccccaccagtgtagacagactgcctgacccacg

SEQ ID NO: 6823622 - DNA, 77 bp, Homo sapiens
tcggaccccgggagtttcctcttccgagggggaggcgaggccgcgccagctagcggggaggaaatgccggagtctgg

SEQ ID NO: 6823623 - DNA, 55 bp, Homo sapiens
tcccactgttgtttgtctctctggagaaggttattttcaggcaggcagagcggga

SEQ ID NO: 6823624 - DNA, 68 bp, Homo sapiens
tgacctcatttgatccttgctatgagaggcatattgtcattatgcttttacaagagccagagaggtca

SEQ ID NO: 6823625 - DNA, 69 bp, Homo sapiens
tttctcattctgtttgtgaactggctgagaggcaaaccttcttgatctaatttagaaatagaagagagg
